United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 75

SEQ ID NO: 2708677 - RNA, 14 nt, Haemophilus influenzae Rd
cuugugcuuugugc

SEQ ID NO: 2708678 - RNA, 12 nt, Haemophilus influenzae Rd
cuuguggaauaa

SEQ ID NO: 2708679 - RNA, 23 nt, Haemophilus influenzae Rd
cuuguggcggguuucuuuuaucg

SEQ ID NO: 2708680 - RNA, 16 nt, Haemophilus influenzae Rd
cuugugggaauuuuug

SEQ ID NO: 2708681 - RNA, 15 nt, Haemophilus influenzae Rd
cuuguuaaauaaaca

SEQ ID NO: 2708682 - RNA, 22 nt, Haemophilus influenzae Rd
cuuguucaaaaauuucgcuauu

SEQ ID NO: 2708683 - RNA, 17 nt, Haemophilus influenzae Rd
cuuguucaaauaaugug

SEQ ID NO: 2708684 - RNA, 13 nt, Haemophilus influenzae Rd
cuuguucaaguug

SEQ ID NO: 2708685 - RNA, 12 nt, Haemophilus influenzae Rd
cuuguuccaaca

SEQ ID NO: 2708686 - RNA, 18 nt, Haemophilus influenzae Rd
cuuguuccacauuauuug

SEQ ID NO: 2708687 - RNA, 18 nt, Haemophilus influenzae Rd
cuuguucuccauuaagca

SEQ ID NO: 2708688 - RNA, 13 nt, Haemophilus influenzae Rd
cuuguucuucaua

SEQ ID NO: 2708689 - RNA, 19 nt, Haemophilus influenzae Rd
cuuguugaaauuccucacu

SEQ ID NO: 2708690 - RNA, 20 nt, Haemophilus influenzae Rd
cuuguugauuaauacgcucu

SEQ ID NO: 2708691 - RNA, 15 nt, Haemophilus influenzae Rd
cuuguuggcauugaa

SEQ ID NO: 2708692 - RNA, 12 nt, Haemophilus influenzae Rd
cuuguuuaauau

SEQ ID NO: 2708693 - RNA, 13 nt, Haemophilus influenzae Rd
cuuguuuaaucac

SEQ ID NO: 2708694 - RNA, 21 nt, Haemophilus influenzae Rd
cuuguuuacugaauaaaaaaa

SEQ ID NO: 2708695 - RNA, 15 nt, Haemophilus influenzae Rd
cuuguuuauuauuuc

SEQ ID NO: 2708696 - RNA, 17 nt, Haemophilus influenzae Rd
cuuguuucauaaaaaau

SEQ ID NO: 2708697 - RNA, 12 nt, Haemophilus influenzae Rd
cuuguuuuaaaa

SEQ ID NO: 2708698 - RNA, 14 nt, Haemophilus influenzae Rd
cuuguuuuaaaauu

SEQ ID NO: 2708699 - RNA, 15 nt, Haemophilus influenzae Rd
cuuguuuuaaaauuu

SEQ ID NO: 2708700 - RNA, 14 nt, Haemophilus influenzae Rd
cuuguuuuaauuga

SEQ ID NO: 2708701 - RNA, 15 nt, Haemophilus influenzae Rd
cuuguuuucaauagu

SEQ ID NO: 2708702 - RNA, 14 nt, Haemophilus influenzae Rd
cuuguuuugcaaua

SEQ ID NO: 2708703 - RNA, 14 nt, Haemophilus influenzae Rd
cuuuaaaaaauaac

SEQ ID NO: 2708704 - RNA, 15 nt, Haemophilus influenzae Rd
cuuuaaaaaauaaca

SEQ ID NO: 2708705 - RNA, 16 nt, Haemophilus influenzae Rd
cuuuaaagaauauucu

SEQ ID NO: 2708706 - RNA, 19 nt, Haemophilus influenzae Rd
cuuuaaagagcaaauuuaa

SEQ ID NO: 2708707 - RNA, 18 nt, Haemophilus influenzae Rd
cuuuaaagguuuaaaccu

SEQ ID NO: 2708708 - RNA, 15 nt, Haemophilus influenzae Rd
cuuuaaauauuuaaa

SEQ ID NO: 2708709 - RNA, 16 nt, Haemophilus influenzae Rd
cuuuaaauucaauaaa

SEQ ID NO: 2708710 - RNA, 13 nt, Haemophilus influenzae Rd
cuuuaaauuguuu

SEQ ID NO: 2708711 - RNA, 15 nt, Haemophilus influenzae Rd
cuuuaaauuuuccug

SEQ ID NO: 2708712 - RNA, 17 nt, Haemophilus influenzae Rd
cuuuaaauuuuccuguu

SEQ ID NO: 2708713 - RNA, 15 nt, Haemophilus influenzae Rd
cuuuaaauuuugcuu

SEQ ID NO: 2708714 - RNA, 21 nt, Haemophilus influenzae Rd
cuuuaaauuuugcuuuaaauc

SEQ ID NO: 2708715 - RNA, 17 nt, Haemophilus influenzae Rd
cuuuaacaauuacugca

SEQ ID NO: 2708716 - RNA, 14 nt, Haemophilus influenzae Rd
cuuuaacaggaauu

SEQ ID NO: 2708717 - RNA, 16 nt, Haemophilus influenzae Rd
cuuuaacccauuuauu

SEQ ID NO: 2708718 - RNA, 20 nt, Haemophilus influenzae Rd
cuuuaacccauuuauuuaaa

SEQ ID NO: 2708719 - RNA, 17 nt, Haemophilus influenzae Rd
cuuuaacuucuaaagua

SEQ ID NO: 2708720 - RNA, 23 nt, Haemophilus influenzae Rd
cuuuaagaguaaauuuaacaauc

SEQ ID NO: 2708721 - RNA, 16 nt, Haemophilus influenzae Rd
cuuuaaggcacagauu

SEQ ID NO: 2708722 - RNA, 22 nt, Haemophilus influenzae Rd
cuuuaauaguaaacuuuuaaag

SEQ ID NO: 2708723 - RNA, 14 nt, Haemophilus influenzae Rd
cuuuaaucugucac

SEQ ID NO: 2708724 - RNA, 20 nt, Haemophilus influenzae Rd
cuuuaauuccaacuacaagu

SEQ ID NO: 2708725 - RNA, 18 nt, Haemophilus influenzae Rd
cuuuaauuucuucaacua

SEQ ID NO: 2708726 - RNA, 15 nt, Haemophilus influenzae Rd
cuuuuaaaaugaaca

SEQ ID NO: 2708727 - RNA, 23 nt, Haemophilus influenzae Rd
cuuuuaaacgugugauaccaaga

SEQ ID NO: 2708728 - RNA, 18 nt, Haemophilus influenzae Rd
cuuuuaaacguuuauuua

SEQ ID NO: 2708729 - RNA, 19 nt, Haemophilus influenzae Rd
cuuuuaaacguuuauuuau

SEQ ID NO: 2708730 - RNA, 22 nt, Haemophilus influenzae Rd
cuuuuaaauacagcucaaaaug

SEQ ID NO: 2708731 - RNA, 23 nt, Haemophilus influenzae Rd
cuuuuaaauacagcucaaaaugc

SEQ ID NO: 2708732 - RNA, 18 nt, Haemophilus influenzae Rd
cuuuuaacacuuuuucac

SEQ ID NO: 2708733 - RNA, 14 nt, Haemophilus influenzae Rd
cuuuuaacauuaca

SEQ ID NO: 2708734 - RNA, 17 nt, Haemophilus influenzae Rd
cuuuuaacugcuuuaau

SEQ ID NO: 2708735 - RNA, 22 nt, Haemophilus influenzae Rd
cuuuuaacuuaaucauuuuuua

SEQ ID NO: 2708736 - RNA, 15 nt, Haemophilus influenzae Rd
cuuuuaaguuaggau

SEQ ID NO: 2708737 - RNA, 15 nt, Haemophilus influenzae Rd
cuuuuaaguugugau

SEQ ID NO: 2708738 - RNA, 12 nt, Haemophilus influenzae Rd
cuuuuaauaaau

SEQ ID NO: 2708739 - RNA, 16 nt, Haemophilus influenzae Rd
cuuuuaauaugcugac

SEQ ID NO: 2708740 - RNA, 19 nt, Haemophilus influenzae Rd
cuuuuaaugaacgauagcc

SEQ ID NO: 2708741 - RNA, 22 nt, Haemophilus influenzae Rd
cuuuuaauuaaauacaaaacag

SEQ ID NO: 2708742 - RNA, 23 nt, Haemophilus influenzae Rd
cuuuuaauucagggauuaagaaa

SEQ ID NO: 2708743 - RNA, 17 nt, Haemophilus influenzae Rd
cuuuuaauucuugucuu

SEQ ID NO: 2708744 - RNA, 19 nt, Haemophilus influenzae Rd
cuuuuacaccguccaaggu

SEQ ID NO: 2708745 - RNA, 13 nt, Haemophilus influenzae Rd
cuuuuacaucaau

SEQ ID NO: 2708746 - RNA, 22 nt, Haemophilus influenzae Rd
cuuuuacgacuaauuuuuuaau

SEQ ID NO: 2708747 - RNA, 19 nt, Haemophilus influenzae Rd
cuuuuacgcguuuuucugg

SEQ ID NO: 2708748 - RNA, 20 nt, Haemophilus influenzae Rd
cuuuuagaauaaauuaaaaa

SEQ ID NO: 2708749 - RNA, 19 nt, Haemophilus influenzae Rd
cuuuuagugcuguauauuu

SEQ ID NO: 2708750 - RNA, 16 nt, Haemophilus influenzae Rd
cuuuuaguuuccccug

SEQ ID NO: 2708751 - RNA, 13 nt, Haemophilus influenzae Rd
cuuuuauaaagau

SEQ ID NO: 2708752 - RNA, 14 nt, Haemophilus influenzae Rd
cuuuuauaaagauc

SEQ ID NO: 2708753 - RNA, 16 nt, Haemophilus influenzae Rd
cuuuuauaaccaguua

SEQ ID NO: 2708754 - RNA, 20 nt, Haemophilus influenzae Rd
cuuuuauaagugaaaugcuc

SEQ ID NO: 2708755 - RNA, 16 nt, Haemophilus influenzae Rd
cuuuuauagacuucaa

SEQ ID NO: 2708756 - RNA, 18 nt, Haemophilus influenzae Rd
cuuuuauagacuucaagu

SEQ ID NO: 2708757 - RNA, 19 nt, Haemophilus influenzae Rd
cuuuuauagacuucaagug

SEQ ID NO: 2708758 - RNA, 17 nt, Haemophilus influenzae Rd
cuuuuauccaccagcac

SEQ ID NO: 2708759 - RNA, 15 nt, Haemophilus influenzae Rd
cuuuuaucuauaaaa

SEQ ID NO: 2708760 - RNA, 16 nt, Haemophilus influenzae Rd
cuuuuaucuauaaaaa

SEQ ID NO: 2708761 - RNA, 13 nt, Haemophilus influenzae Rd
cuuuuauuauuua

SEQ ID NO: 2708762 - RNA, 14 nt, Haemophilus influenzae Rd
cuuuucaaacaaca

SEQ ID NO: 2708763 - RNA, 16 nt, Haemophilus influenzae Rd
cuuuucaaacaacaag

SEQ ID NO: 2708764 - RNA, 19 nt, Haemophilus influenzae Rd
cuuuucaaacacaaaauaa

SEQ ID NO: 2708765 - RNA, 13 nt, Haemophilus influenzae Rd
cuuuucaacaaaa

SEQ ID NO: 2708766 - RNA, 14 nt, Haemophilus influenzae Rd
cuuuucaacaaaaa

SEQ ID NO: 2708767 - RNA, 15 nt, Haemophilus influenzae Rd
cuuuucaacaaaaaa

SEQ ID NO: 2708768 - RNA, 17 nt, Haemophilus influenzae Rd
cuuuucaauuugaaaau

SEQ ID NO: 2708769 - RNA, 19 nt, Haemophilus influenzae Rd
cuuuucaauuugaaaauuu

SEQ ID NO: 2708770 - RNA, 21 nt, Haemophilus influenzae Rd
cuuuucaauuugaaaauuuau

SEQ ID NO: 2708771 - RNA, 24 nt, Haemophilus influenzae Rd
cuuuucaauuugaaaauuuauuug

SEQ ID NO: 2708772 - RNA, 23 nt, Haemophilus influenzae Rd
cuuuuccaguauagugcgcauau

SEQ ID NO: 2708773 - RNA, 19 nt, Haemophilus influenzae Rd
cuuuucccaaugcaccaaa

SEQ ID NO: 2708774 - RNA, 16 nt, Haemophilus influenzae Rd
cuuuuccuaaaguuuu

SEQ ID NO: 2708775 - RNA, 14 nt, Haemophilus influenzae Rd
cuuuucgaauuaaa

SEQ ID NO: 2708776 - RNA, 22 nt, Haemophilus influenzae Rd
cuuuucgaauuaaacgugauuu

SEQ ID NO: 2708777 - RNA, 20 nt, Haemophilus influenzae Rd
cuuuucgauagaacaaaugu

SEQ ID NO: 2708778 - RNA, 20 nt, Haemophilus influenzae Rd
cuuuucgcaauucuuuuucu

SEQ ID NO: 2708779 - RNA, 21 nt, Haemophilus influenzae Rd
cuuuucuauaauuaaacauuu

SEQ ID NO: 2708780 - RNA, 17 nt, Haemophilus influenzae Rd
cuuuucucaaaacaucu

SEQ ID NO: 2708781 - RNA, 14 nt, Haemophilus influenzae Rd
cuuuucugauaauu

SEQ ID NO: 2708782 - RNA, 12 nt, Haemophilus influenzae Rd
cuuuucuucauc

SEQ ID NO: 2708783 - RNA, 19 nt, Haemophilus influenzae Rd
cuuuucuuguaaugcugua

SEQ ID NO: 2708784 - RNA, 16 nt, Haemophilus influenzae Rd
cuuuucuuuuauacuu

SEQ ID NO: 2708785 - RNA, 21 nt, Haemophilus influenzae Rd
cuuuugaggcuaauaaugcca

SEQ ID NO: 2708786 - RNA, 13 nt, Haemophilus influenzae Rd
cuuuugauaucca

SEQ ID NO: 2708787 - RNA, 18 nt, Haemophilus influenzae Rd
cuuuugauuuuauuuacu

SEQ ID NO: 2708788 - RNA, 22 nt, Haemophilus influenzae Rd
cuuuugcaaaaaugacaucauu

SEQ ID NO: 2708789 - RNA, 13 nt, Haemophilus influenzae Rd
cuuuugcaaucac

SEQ ID NO: 2708790 - RNA, 16 nt, Haemophilus influenzae Rd
cuuuugcacugcaaug

SEQ ID NO: 2708791 - RNA, 17 nt, Haemophilus influenzae Rd
cuuuugccauauuuaau

SEQ ID NO: 2708792 - RNA, 22 nt, Haemophilus influenzae Rd
cuuuugcccacgcacuuuucca

SEQ ID NO: 2708793 - RNA, 23 nt, Haemophilus influenzae Rd
cuuuugcccacgcacuuuuccaa

SEQ ID NO: 2708794 - RNA, 17 nt, Haemophilus influenzae Rd
cuuuugcuaccacguuu

SEQ ID NO: 2708795 - RNA, 23 nt, Haemophilus influenzae Rd
cuuuuggauacacaaauugaaga

SEQ ID NO: 2708796 - RNA, 11 nt, Haemophilus influenzae Rd
cuuuuggcauu

SEQ ID NO: 2708797 - RNA, 16 nt, Haemophilus influenzae Rd
cuuuugguaaauacug

SEQ ID NO: 2708798 - RNA, 14 nt, Haemophilus influenzae Rd
cuuuugguuuucug

SEQ ID NO: 2708799 - RNA, 15 nt, Haemophilus influenzae Rd
cuuuugguuuucugg

SEQ ID NO: 2708800 - RNA, 14 nt, Haemophilus influenzae Rd
cuuuuguagaaaag

SEQ ID NO: 2708801 - RNA, 15 nt, Haemophilus influenzae Rd
cuuuuguauuuuaug

SEQ ID NO: 2708802 - RNA, 16 nt, Haemophilus influenzae Rd
cuuuugugccagcugg

SEQ ID NO: 2708803 - RNA, 16 nt, Haemophilus influenzae Rd
cuuuuguuacuuucca

SEQ ID NO: 2708804 - RNA, 21 nt, Haemophilus influenzae Rd
cuuuuguugcacccauuuuga

SEQ ID NO: 2708805 - RNA, 18 nt, Haemophilus influenzae Rd
cuuuuguuuuaucagaau

SEQ ID NO: 2708806 - RNA, 23 nt, Haemophilus influenzae Rd
cuuuuuaauuuaaauaaagcauu

SEQ ID NO: 2708807 - RNA, 21 nt, Haemophilus influenzae Rd
cuuuuuacaacauuaccuucu

SEQ ID NO: 2708808 - RNA, 13 nt, Haemophilus influenzae Rd
cuuuuuauaaaaa

SEQ ID NO: 2708809 - RNA, 16 nt, Haemophilus influenzae Rd
cuuuuuauaaaaaaac

SEQ ID NO: 2708810 - RNA, 16 nt, Haemophilus influenzae Rd
cuuuuuauauuuuuuu

SEQ ID NO: 2708811 - RNA, 22 nt, Haemophilus influenzae Rd
cuuuuuauguuucgauaaaaaa

SEQ ID NO: 2708812 - RNA, 14 nt, Haemophilus influenzae Rd
cuuuuuauguuuug

SEQ ID NO: 2708813 - RNA, 19 nt, Haemophilus influenzae Rd
cuuuuuauuuagaacaaua

SEQ ID NO: 2708814 - RNA, 20 nt, Haemophilus influenzae Rd
cuuuuuauuuuacuaauuaa

SEQ ID NO: 2708815 - RNA, 13 nt, Haemophilus influenzae Rd
cuuuuuauuuuug

SEQ ID NO: 2708816 - RNA, 12 nt, Haemophilus influenzae Rd
cuuuuucaagaa

SEQ ID NO: 2708817 - RNA, 14 nt, Haemophilus influenzae Rd
cuuuuucagauacu

SEQ ID NO: 2708818 - RNA, 21 nt, Haemophilus influenzae Rd
cuuuuucaucuuuacccacac

SEQ ID NO: 2708819 - RNA, 19 nt, Haemophilus influenzae Rd
cuuuuucauguacaaguga

SEQ ID NO: 2708820 - RNA, 23 nt, Haemophilus influenzae Rd
cuuuuuccugaauaacuacauaa

SEQ ID NO: 2708821 - RNA, 16 nt, Haemophilus influenzae Rd
cuuuuucuauuuuuuc

SEQ ID NO: 2708822 - RNA, 19 nt, Haemophilus influenzae Rd
cuuuuucuucuuucauuug

SEQ ID NO: 2708823 - RNA, 20 nt, Haemophilus influenzae Rd
cuuuuucuuggaacaucauu

SEQ ID NO: 2708824 - RNA, 20 nt, Haemophilus influenzae Rd
cuuuuugauaauuaacaaua

SEQ ID NO: 2708825 - RNA, 19 nt, Haemophilus influenzae Rd
cuuuuugaucucuuucuau

SEQ ID NO: 2708826 - RNA, 21 nt, Haemophilus influenzae Rd
cuuuuugcgccaacgcaucua

SEQ ID NO: 2708827 - RNA, 21 nt, Haemophilus influenzae Rd
cuuuuugugccaauccauaaa

SEQ ID NO: 2708828 - RNA, 18 nt, Haemophilus influenzae Rd
cuuuuuguuacaucuuca

SEQ ID NO: 2708829 - RNA, 20 nt, Haemophilus influenzae Rd
cuuuuuguuacaucuucaaa

SEQ ID NO: 2708830 - RNA, 18 nt, Haemophilus influenzae Rd
cuuuuuuaaguaguguuu

SEQ ID NO: 2708831 - RNA, 15 nt, Haemophilus influenzae Rd
gaaauacaaagcacu

SEQ ID NO: 2708832 - RNA, 14 nt, Haemophilus influenzae Rd
gaaauacauuauua

SEQ ID NO: 2708833 - RNA, 17 nt, Haemophilus influenzae Rd
gaaauaccuucuugauu

SEQ ID NO: 2708834 - RNA, 18 nt, Haemophilus influenzae Rd
gaaauacgagaaagcuca

SEQ ID NO: 2708835 - RNA, 21 nt, Haemophilus influenzae Rd
gaaauacgagaaagcucacca

SEQ ID NO: 2708836 - RNA, 20 nt, Haemophilus influenzae Rd
gaaauagacuacuuaaaauu

SEQ ID NO: 2708837 - RNA, 15 nt, Haemophilus influenzae Rd
gaaauaggcaaguuc

SEQ ID NO: 2708838 - RNA, 18 nt, Haemophilus influenzae Rd
gaaauaguuaaagaaaau

SEQ ID NO: 2708839 - RNA, 14 nt, Haemophilus influenzae Rd
gaaauauaauaaau

SEQ ID NO: 2708840 - RNA, 16 nt, Haemophilus influenzae Rd
gaaauauaauaaauau

SEQ ID NO: 2708841 - RNA, 22 nt, Haemophilus influenzae Rd
gaaauauauuauugugauaauu

SEQ ID NO: 2708842 - RNA, 20 nt, Haemophilus influenzae Rd
gaaauaucagcuacuuguaa

SEQ ID NO: 2708843 - RNA, 22 nt, Haemophilus influenzae Rd
gaaauauuauuaaguaauacau

SEQ ID NO: 2708844 - RNA, 21 nt, Haemophilus influenzae Rd
gaaauauuccaacgauuuugc

SEQ ID NO: 2708845 - RNA, 22 nt, Haemophilus influenzae Rd
gaaauauugggcucugcauaau

SEQ ID NO: 2708846 - RNA, 23 nt, Haemophilus influenzae Rd
gaaauauugucuauuugcuuucc

SEQ ID NO: 2708847 - RNA, 17 nt, Haemophilus influenzae Rd
gaaauauuuacuucacg

SEQ ID NO: 2708848 - RNA, 12 nt, Haemophilus influenzae Rd
gaaauauuucac

SEQ ID NO: 2708849 - RNA, 15 nt, Haemophilus influenzae Rd
gaaaucaaaaaugcu

SEQ ID NO: 2708850 - RNA, 20 nt, Haemophilus influenzae Rd
gaaaucaaaaaugcuuuugc

SEQ ID NO: 2708851 - RNA, 13 nt, Haemophilus influenzae Rd
gaaaucaaacaac

SEQ ID NO: 2708852 - RNA, 13 nt, Haemophilus influenzae Rd
gaaaucaaauuga

SEQ ID NO: 2708853 - RNA, 17 nt, Haemophilus influenzae Rd
gaaaucacaauaaaagc

SEQ ID NO: 2708854 - RNA, 20 nt, Haemophilus influenzae Rd
gaaaucauaaacugauaauu

SEQ ID NO: 2708855 - RNA, 13 nt, Haemophilus influenzae Rd
gaaaucauuucaa

SEQ ID NO: 2708856 - RNA, 18 nt, Haemophilus influenzae Rd
gaaaucauuucaauguuu

SEQ ID NO: 2708857 - RNA, 19 nt, Haemophilus influenzae Rd
gaaauccccuacagauaca

SEQ ID NO: 2708858 - RNA, 15 nt, Haemophilus influenzae Rd
gaaaucuaauuugcu

SEQ ID NO: 2708859 - RNA, 23 nt, Haemophilus influenzae Rd
gaaaugaucaaaucaaauuuucc

SEQ ID NO: 2708860 - RNA, 19 nt, Haemophilus influenzae Rd
gaaaugcggacuuuuucau

SEQ ID NO: 2708861 - RNA, 18 nt, Haemophilus influenzae Rd
gaaauggcuagggauuaa

SEQ ID NO: 2708862 - RNA, 16 nt, Haemophilus influenzae Rd
gaaauggcuugcucaa

SEQ ID NO: 2708863 - RNA, 16 nt, Haemophilus influenzae Rd
gaaauggcuuuucaau

SEQ ID NO: 2708864 - RNA, 20 nt, Haemophilus influenzae Rd
gaaauguacuggcucuucuu

SEQ ID NO: 2708865 - RNA, 16 nt, Haemophilus influenzae Rd
gaaaugucguaagaac

SEQ ID NO: 2708866 - RNA, 21 nt, Haemophilus influenzae Rd
gaaauguuguccaucaaucau

SEQ ID NO: 2708867 - RNA, 16 nt, Haemophilus influenzae Rd
gaaauguuugaaggca

SEQ ID NO: 2708868 - RNA, 18 nt, Haemophilus influenzae Rd
gaaauguuugaaggcaaa

SEQ ID NO: 2708869 - RNA, 15 nt, Haemophilus influenzae Rd
gaaauuaaaauaaua

SEQ ID NO: 2708870 - RNA, 20 nt, Haemophilus influenzae Rd
gaaauuaaaauaauauccaa

SEQ ID NO: 2708871 - RNA, 21 nt, Haemophilus influenzae Rd
gaaauuaaccccagaaaugcu

SEQ ID NO: 2708872 - RNA, 12 nt, Haemophilus influenzae Rd
gaaauuaauaau

SEQ ID NO: 2708873 - RNA, 13 nt, Haemophilus influenzae Rd
gaaauuacuguca

SEQ ID NO: 2708874 - RNA, 14 nt, Haemophilus influenzae Rd
gaaauuacugucac

SEQ ID NO: 2708875 - RNA, 22 nt, Haemophilus influenzae Rd
gaaauuacuugaaucuaauccu

SEQ ID NO: 2708876 - RNA, 13 nt, Haemophilus influenzae Rd
gaaauuagacaaa

SEQ ID NO: 2708877 - RNA, 17 nt, Haemophilus influenzae Rd
gaaauuauugcuuauga

SEQ ID NO: 2708878 - RNA, 20 nt, Haemophilus influenzae Rd
gaaauucauucaacaaaaau

SEQ ID NO: 2708879 - RNA, 16 nt, Haemophilus influenzae Rd
gaaauucgcuuuuuua

SEQ ID NO: 2708880 - RNA, 16 nt, Haemophilus influenzae Rd
gaaauucuaaaaaaau

SEQ ID NO: 2708881 - RNA, 15 nt, Haemophilus influenzae Rd
gaaauugauauaaau

SEQ ID NO: 2708882 - RNA, 19 nt, Haemophilus influenzae Rd
gaaauuuaucuaaaaguaa

SEQ ID NO: 2708883 - RNA, 18 nt, Haemophilus influenzae Rd
gaaauuuauguuacaaau

SEQ ID NO: 2708884 - RNA, 13 nt, Haemophilus influenzae Rd
gaaauuuauuaua

SEQ ID NO: 2708885 - RNA, 15 nt, Haemophilus influenzae Rd
gaaauuuauuauaaa

SEQ ID NO: 2708886 - RNA, 18 nt, Haemophilus influenzae Rd
gaaauuuauuauaaaaau

SEQ ID NO: 2708887 - RNA, 13 nt, Haemophilus influenzae Rd
gaaauuucaccgu

SEQ ID NO: 2708888 - RNA, 13 nt, Haemophilus influenzae Rd
gaaauuucauagu

SEQ ID NO: 2708889 - RNA, 21 nt, Haemophilus influenzae Rd
gaaauuuccugagaauuuuca

SEQ ID NO: 2708890 - RNA, 21 nt, Haemophilus influenzae Rd
gaaauuuuuaucuaaauuaau

SEQ ID NO: 2708891 - RNA, 19 nt, Haemophilus influenzae Rd
gaaauuuuuccguuuucua

SEQ ID NO: 2708892 - RNA, 23 nt, Haemophilus influenzae Rd
gaaauuuuuuugcuggaaaaaug

SEQ ID NO: 2708893 - RNA, 19 nt, Haemophilus influenzae Rd
gaacaaaaaauuaaccgca

SEQ ID NO: 2708894 - RNA, 13 nt, Haemophilus influenzae Rd
gaacaaacgccau

SEQ ID NO: 2708895 - RNA, 17 nt, Haemophilus influenzae Rd
gaacaagcauuuuucau

SEQ ID NO: 2708896 - RNA, 19 nt, Haemophilus influenzae Rd
gaacaaugucagaaaagau

SEQ ID NO: 2708897 - RNA, 19 nt, Haemophilus influenzae Rd
gaacaauuaauacgucaau

SEQ ID NO: 2708898 - RNA, 22 nt, Haemophilus influenzae Rd
gaacaauuaauacgucaauugc

SEQ ID NO: 2708899 - RNA, 22 nt, Haemophilus influenzae Rd
gaacagguugcugauaaagaua

SEQ ID NO: 2708900 - RNA, 15 nt, Haemophilus influenzae Rd
gaacaguaaauuuaa

SEQ ID NO: 2708901 - RNA, 17 nt, Haemophilus influenzae Rd
gaacaguaaauuuaagg

SEQ ID NO: 2708902 - RNA, 14 nt, Haemophilus influenzae Rd
gaacauaacuuuuu

SEQ ID NO: 2708903 - RNA, 23 nt, Haemophilus influenzae Rd
gaacaucaccuguaaacaaauau

SEQ ID NO: 2708904 - RNA, 15 nt, Haemophilus influenzae Rd
gaacaucauuuucaa

SEQ ID NO: 2708905 - RNA, 18 nt, Haemophilus influenzae Rd
gaacaucauuuucaagua

SEQ ID NO: 2708906 - RNA, 21 nt, Haemophilus influenzae Rd
gaacauuaugugcaauuugac

SEQ ID NO: 2708907 - RNA, 19 nt, Haemophilus influenzae Rd
gaacauucacaccuaagua

SEQ ID NO: 2708908 - RNA, 22 nt, Haemophilus influenzae Rd
gaacauugugacauuggauuaa

SEQ ID NO: 2708909 - RNA, 16 nt, Haemophilus influenzae Rd
gaaccauuuuacaaua

SEQ ID NO: 2708910 - RNA, 20 nt, Haemophilus influenzae Rd
gaaccgauuuuaaauucucc

SEQ ID NO: 2708911 - RNA, 22 nt, Haemophilus influenzae Rd
gaaccgccacccgcuuuugcau

SEQ ID NO: 2708912 - RNA, 15 nt, Haemophilus influenzae Rd
gaaccgucuuuaaau

SEQ ID NO: 2708913 - RNA, 14 nt, Haemophilus influenzae Rd
gaaccuaaugcagu

SEQ ID NO: 2708914 - RNA, 16 nt, Haemophilus influenzae Rd
gaaccuauuagaauuu

SEQ ID NO: 2708915 - RNA, 20 nt, Haemophilus influenzae Rd
gaaccugauaaguagaaaaa

SEQ ID NO: 2708916 - RNA, 20 nt, Haemophilus influenzae Rd
gaaccuuucauauaaauaag

SEQ ID NO: 2708917 - RNA, 16 nt, Haemophilus influenzae Rd
gaacgaguaaucuaau

SEQ ID NO: 2708918 - RNA, 18 nt, Haemophilus influenzae Rd
gaacgauuaaaaaugcuu

SEQ ID NO: 2708919 - RNA, 22 nt, Haemophilus influenzae Rd
gaacgccgcaacuaauaaacca

SEQ ID NO: 2708920 - RNA, 18 nt, Haemophilus influenzae Rd
gaacgccuaaacacauaa

SEQ ID NO: 2708921 - RNA, 16 nt, Haemophilus influenzae Rd
gaacgcuggcggcagg

SEQ ID NO: 2708922 - RNA, 16 nt, Haemophilus influenzae Rd
gaacggucaaaaugca

SEQ ID NO: 2708923 - RNA, 18 nt, Haemophilus influenzae Rd
gaacggucaaaaugcagu

SEQ ID NO: 2708924 - RNA, 21 nt, Haemophilus influenzae Rd
gaacggucaaaaugcaguagg

SEQ ID NO: 2708925 - RNA, 15 nt, Haemophilus influenzae Rd
gaacgguucgccuga

SEQ ID NO: 2708926 - RNA, 23 nt, Haemophilus influenzae Rd
gaacguuuuugucguucuuuuuc

SEQ ID NO: 2708927 - RNA, 12 nt, Haemophilus influenzae Rd
gaacuaauauca

SEQ ID NO: 2708928 - RNA, 19 nt, Haemophilus influenzae Rd
gaacuauauccaaaucaaa

SEQ ID NO: 2708929 - RNA, 18 nt, Haemophilus influenzae Rd
gaacucacaauugaugua

SEQ ID NO: 2708930 - RNA, 21 nt, Haemophilus influenzae Rd
gaacucuaucuaaauggcaaa

SEQ ID NO: 2708931 - RNA, 19 nt, Haemophilus influenzae Rd
gaacuggaccuaaucccau

SEQ ID NO: 2708932 - RNA, 20 nt, Haemophilus influenzae Rd
gaacuggcugagagaagaaa

SEQ ID NO: 2708933 - RNA, 22 nt, Haemophilus influenzae Rd
gaacuuagucucuuuauuuuuu

SEQ ID NO: 2708934 - RNA, 19 nt, Haemophilus influenzae Rd
gaacuugcgcgcugguuuc

SEQ ID NO: 2708935 - RNA, 21 nt, Haemophilus influenzae Rd
gaacuuucgcguaauaacaag

SEQ ID NO: 2708936 - RNA, 19 nt, Haemophilus influenzae Rd
gaaugccauuaaacuucug

SEQ ID NO: 2708937 - RNA, 21 nt, Haemophilus influenzae Rd
gaaugcccacuaacucacauu

SEQ ID NO: 2708938 - RNA, 15 nt, Haemophilus influenzae Rd
gaaugcccagcaauu

SEQ ID NO: 2708939 - RNA, 20 nt, Haemophilus influenzae Rd
gaauggauuauaaauagaau

SEQ ID NO: 2708940 - RNA, 21 nt, Haemophilus influenzae Rd
gaauggcgucugcaauuagaa

SEQ ID NO: 2708941 - RNA, 18 nt, Haemophilus influenzae Rd
gaaugguugcaaaggcag

SEQ ID NO: 2708942 - RNA, 14 nt, Haemophilus influenzae Rd
gaauguaaaaaaua

SEQ ID NO: 2708943 - RNA, 14 nt, Haemophilus influenzae Rd
gaauuaaaaaccga

SEQ ID NO: 2708944 - RNA, 13 nt, Haemophilus influenzae Rd
gaauuaaaaaugg

SEQ ID NO: 2708945 - RNA, 12 nt, Haemophilus influenzae Rd
gaauuaaaacuu

SEQ ID NO: 2708946 - RNA, 13 nt, Haemophilus influenzae Rd
gaauuaaacggcu

SEQ ID NO: 2708947 - RNA, 16 nt, Haemophilus influenzae Rd
gaauuaaacgugauuu

SEQ ID NO: 2708948 - RNA, 12 nt, Haemophilus influenzae Rd
gaauuaaaucca

SEQ ID NO: 2708949 - RNA, 12 nt, Haemophilus influenzae Rd
gaauuaaaucug

SEQ ID NO: 2708950 - RNA, 12 nt, Haemophilus influenzae Rd
gaauuaauaacg

SEQ ID NO: 2708951 - RNA, 16 nt, Haemophilus influenzae Rd
gaauuaccaauuccaa

SEQ ID NO: 2708952 - RNA, 15 nt, Haemophilus influenzae Rd
gaauuaguaaagaaa

SEQ ID NO: 2708953 - RNA, 21 nt, Haemophilus influenzae Rd
gaauuaguuucaacuuggaaa

SEQ ID NO: 2708954 - RNA, 19 nt, Haemophilus influenzae Rd
gaauuaguuuuuuauuucu

SEQ ID NO: 2708955 - RNA, 20 nt, Haemophilus influenzae Rd
gaauuaguuuuuuauuucua

SEQ ID NO: 2708956 - RNA, 15 nt, Haemophilus influenzae Rd
gaauuauguauuuua

SEQ ID NO: 2708957 - RNA, 15 nt, Haemophilus influenzae Rd
gaauuauuuaaacuu

SEQ ID NO: 2708958 - RNA, 19 nt, Haemophilus influenzae Rd
gaauucgaagguauauaag

SEQ ID NO: 2708959 - RNA, 19 nt, Haemophilus influenzae Rd
gaauucugagcaaauuacc

SEQ ID NO: 2708960 - RNA, 20 nt, Haemophilus influenzae Rd
gaauugaucgaaugauucaa

SEQ ID NO: 2708961 - RNA, 21 nt, Haemophilus influenzae Rd
gaauugcaucguuuacaucac

SEQ ID NO: 2708962 - RNA, 15 nt, Haemophilus influenzae Rd
gaauugcauuuucuu

SEQ ID NO: 2708963 - RNA, 19 nt, Haemophilus influenzae Rd
gaauugcauuuucuuccaa

SEQ ID NO: 2708964 - RNA, 15 nt, Haemophilus influenzae Rd
gaauuggauuugaac

SEQ ID NO: 2708965 - RNA, 19 nt, Haemophilus influenzae Rd
gaauuggcgaaccuucacu

SEQ ID NO: 2708966 - RNA, 15 nt, Haemophilus influenzae Rd
gaauugguucuaaau

SEQ ID NO: 2708967 - RNA, 23 nt, Haemophilus influenzae Rd
gaauuguaccuucugcugcaguu

SEQ ID NO: 2708968 - RNA, 18 nt, Haemophilus influenzae Rd
gaauugugcuaaauuuuu

SEQ ID NO: 2708969 - RNA, 18 nt, Haemophilus influenzae Rd
gaauuguuuucgucacaa

SEQ ID NO: 2708970 - RNA, 16 nt, Haemophilus influenzae Rd
gaauuuaaacuuagga

SEQ ID NO: 2708971 - RNA, 19 nt, Haemophilus influenzae Rd
gaauuuagggaaaauuuua

SEQ ID NO: 2708972 - RNA, 15 nt, Haemophilus influenzae Rd
gaauuuaucaucaau

SEQ ID NO: 2708973 - RNA, 13 nt, Haemophilus influenzae Rd
gaauuucacuggc

SEQ ID NO: 2708974 - RNA, 22 nt, Haemophilus influenzae Rd
gaauuucauaaacgguauuuuc

SEQ ID NO: 2708975 - RNA, 15 nt, Haemophilus influenzae Rd
gaauuucuaauuuuu

SEQ ID NO: 2708976 - RNA, 19 nt, Haemophilus influenzae Rd
gaauuucuuaaaagaaauu

SEQ ID NO: 2708977 - RNA, 22 nt, Haemophilus influenzae Rd
gaauuugagcggugaauucuuu

SEQ ID NO: 2708978 - RNA, 21 nt, Haemophilus influenzae Rd
gaauuugaucacgaguaauau

SEQ ID NO: 2708979 - RNA, 16 nt, Haemophilus influenzae Rd
gaauuuguuguuugcu

SEQ ID NO: 2708980 - RNA, 18 nt, Haemophilus influenzae Rd
gaauuuuacuucuucagg

SEQ ID NO: 2708981 - RNA, 13 nt, Haemophilus influenzae Rd
gaauuuucaucaa

SEQ ID NO: 2708982 - RNA, 20 nt, Haemophilus influenzae Rd
gaauuuuuauuuucuuaauu

SEQ ID NO: 2708983 - RNA, 12 nt, Haemophilus influenzae Rd
gaauuuuugcug

SEQ ID NO: 2708984 - RNA, 18 nt, Haemophilus influenzae Rd
gaauuuuugugauuucaa

SEQ ID NO: 2708985 - RNA, 15 nt, Haemophilus influenzae Rd
gaauuuuuucuucaa

SEQ ID NO: 2708986 - RNA, 15 nt, Haemophilus influenzae Rd
gaauuuuuuucaaca

SEQ ID NO: 2708987 - RNA, 22 nt, Haemophilus influenzae Rd
gacaaagggucguuaagaaaga

SEQ ID NO: 2708988 - RNA, 20 nt, Haemophilus influenzae Rd
gacaaaucugccugauuuuu

SEQ ID NO: 2708989 - RNA, 11 nt, Haemophilus influenzae Rd
gacaaauuaau

SEQ ID NO: 2708990 - RNA, 18 nt, Haemophilus influenzae Rd
gacaaauuaauaagaaaa

SEQ ID NO: 2708991 - RNA, 23 nt, Haemophilus influenzae Rd
gacaaauuaauaagaaaaucaaa

SEQ ID NO: 2708992 - RNA, 17 nt, Haemophilus influenzae Rd
gacaaauuuguugcauu

SEQ ID NO: 2708993 - RNA, 18 nt, Haemophilus influenzae Rd
gacaaauuuguugcauuu

SEQ ID NO: 2708994 - RNA, 14 nt, Haemophilus influenzae Rd
gacaaauuuugcau

SEQ ID NO: 2708995 - RNA, 11 nt, Haemophilus influenzae Rd
gacaacacuug

SEQ ID NO: 2708996 - RNA, 15 nt, Haemophilus influenzae Rd
gacaaccguugcauu

SEQ ID NO: 2708997 - RNA, 17 nt, Haemophilus influenzae Rd
gacaacgcucacuuaau

SEQ ID NO: 2708998 - RNA, 23 nt, Haemophilus influenzae Rd
gacaagauaagagcuuacuucua

SEQ ID NO: 2708999 - RNA, 21 nt, Haemophilus influenzae Rd
gacaauaacugcgccaauaua

SEQ ID NO: 2709000 - RNA, 15 nt, Haemophilus influenzae Rd
gacaauaauaagcac

SEQ ID NO: 2709001 - RNA, 17 nt, Haemophilus influenzae Rd
gacaauaauaagcacaa

SEQ ID NO: 2709002 - RNA, 17 nt, Haemophilus influenzae Rd
gacaauggcuuugccac

SEQ ID NO: 2709003 - RNA, 19 nt, Haemophilus influenzae Rd
gacacaagggauuuaaaau

SEQ ID NO: 2709004 - RNA, 20 nt, Haemophilus influenzae Rd
gacacacuauuaauuacuuu

SEQ ID NO: 2709005 - RNA, 16 nt, Haemophilus influenzae Rd
gacaccuuuaaaaauu

SEQ ID NO: 2709006 - RNA, 19 nt, Haemophilus influenzae Rd
gacaccuuuaaaaauuaca

SEQ ID NO: 2709007 - RNA, 19 nt, Haemophilus influenzae Rd
gacacgguaguaaauaaca

SEQ ID NO: 2709008 - RNA, 22 nt, Haemophilus influenzae Rd
gacacuaaaaagcccaaaugca

SEQ ID NO: 2709009 - RNA, 21 nt, Haemophilus influenzae Rd
gacagacgcugcccaaauaac

SEQ ID NO: 2709010 - RNA, 14 nt, Haemophilus influenzae Rd
gacagcuauuaaaa

SEQ ID NO: 2709011 - RNA, 20 nt, Haemophilus influenzae Rd
gacagcuauuaaaaaaagca

SEQ ID NO: 2709012 - RNA, 12 nt, Haemophilus influenzae Rd
gacaggcauauu

SEQ ID NO: 2709013 - RNA, 13 nt, Haemophilus influenzae Rd
gacaguauauucg

SEQ ID NO: 2709014 - RNA, 23 nt, Haemophilus influenzae Rd
gacaguauuuagcggaauuuuug

SEQ ID NO: 2709015 - RNA, 18 nt, Haemophilus influenzae Rd
gacagucugcuaauguua

SEQ ID NO: 2709016 - RNA, 15 nt, Haemophilus influenzae Rd
gacaguuucgccugc

SEQ ID NO: 2709017 - RNA, 15 nt, Haemophilus influenzae Rd
gacauaaaaacauag

SEQ ID NO: 2709018 - RNA, 20 nt, Haemophilus influenzae Rd
gacauaaaaacauaguaaau

SEQ ID NO: 2709019 - RNA, 15 nt, Haemophilus influenzae Rd
gacauaaauacacca

SEQ ID NO: 2709020 - RNA, 13 nt, Haemophilus influenzae Rd
gacauaacauugu

SEQ ID NO: 2709021 - RNA, 14 nt, Haemophilus influenzae Rd
gacauaacauuguu

SEQ ID NO: 2709022 - RNA, 18 nt, Haemophilus influenzae Rd
gacauaauuaaggcugcu

SEQ ID NO: 2709023 - RNA, 17 nt, Haemophilus influenzae Rd
gacauacaaaguaaagu

SEQ ID NO: 2709024 - RNA, 23 nt, Haemophilus influenzae Rd
gacauagaaaguuuaacuuucaa

SEQ ID NO: 2709025 - RNA, 21 nt, Haemophilus influenzae Rd
gacauauuuucuaaaaaacgu

SEQ ID NO: 2709026 - RNA, 12 nt, Haemophilus influenzae Rd
gacaucaagcac

SEQ ID NO: 2709027 - RNA, 13 nt, Haemophilus influenzae Rd
gacaucaaucaaa

SEQ ID NO: 2709028 - RNA, 20 nt, Haemophilus influenzae Rd
gacauuauuuuuacaaauag

SEQ ID NO: 2709029 - RNA, 12 nt, Haemophilus influenzae Rd
gacauuccuauu

SEQ ID NO: 2709030 - RNA, 14 nt, Haemophilus influenzae Rd
gacauuccuauucu

SEQ ID NO: 2709031 - RNA, 15 nt, Haemophilus influenzae Rd
gacauuccuauucua

SEQ ID NO: 2709032 - RNA, 17 nt, Haemophilus influenzae Rd
gacauuccuauucuaaa

SEQ ID NO: 2709033 - RNA, 16 nt, Haemophilus influenzae Rd
gacauucgcauauuuu

SEQ ID NO: 2709034 - RNA, 15 nt, Haemophilus influenzae Rd
gacauucuuuagaau

SEQ ID NO: 2709035 - RNA, 19 nt, Haemophilus influenzae Rd
gacauuuuacuacguaaag

SEQ ID NO: 2709036 - RNA, 16 nt, Haemophilus influenzae Rd
gaccaaagcuguaaaa

SEQ ID NO: 2709037 - RNA, 22 nt, Haemophilus influenzae Rd
gaccaaauacaauuuuuuucaa

SEQ ID NO: 2709038 - RNA, 20 nt, Haemophilus influenzae Rd
gaccaacggauuaaaagucc

SEQ ID NO: 2709039 - RNA, 18 nt, Haemophilus influenzae Rd
gaccaauugguaaaauuu

SEQ ID NO: 2709040 - RNA, 17 nt, Haemophilus influenzae Rd
gaccacaugaauuucua

SEQ ID NO: 2709041 - RNA, 20 nt, Haemophilus influenzae Rd
gaccacaugaauuucuaauu

SEQ ID NO: 2709042 - RNA, 12 nt, Haemophilus influenzae Rd
gagccaauuuuc

SEQ ID NO: 2709043 - RNA, 12 nt, Haemophilus influenzae Rd
gagcccacaacu

SEQ ID NO: 2709044 - RNA, 16 nt, Haemophilus influenzae Rd
gagccuccacaagcaa

SEQ ID NO: 2709045 - RNA, 15 nt, Haemophilus influenzae Rd
gagccuucaaaauuu

SEQ ID NO: 2709046 - RNA, 16 nt, Haemophilus influenzae Rd
gagcgauagaaauaaa

SEQ ID NO: 2709047 - RNA, 20 nt, Haemophilus influenzae Rd
gagcgauagaaauaaagaua

SEQ ID NO: 2709048 - RNA, 13 nt, Haemophilus influenzae Rd
gagcgauguuuuc

SEQ ID NO: 2709049 - RNA, 22 nt, Haemophilus influenzae Rd
gagcgggaaacgaggcucgaac

SEQ ID NO: 2709050 - RNA, 21 nt, Haemophilus influenzae Rd
gagcgguuaaaacaaaagaaa

SEQ ID NO: 2709051 - RNA, 14 nt, Haemophilus influenzae Rd
gagcuaaaaaaucu

SEQ ID NO: 2709052 - RNA, 14 nt, Haemophilus influenzae Rd
gagcuaaauccaga

SEQ ID NO: 2709053 - RNA, 18 nt, Haemophilus influenzae Rd
gagcucgcacuuccucaa

SEQ ID NO: 2709054 - RNA, 15 nt, Haemophilus influenzae Rd
gagcucuaguaauuc

SEQ ID NO: 2709055 - RNA, 14 nt, Haemophilus influenzae Rd
gagcucuuucauua

SEQ ID NO: 2709056 - RNA, 21 nt, Haemophilus influenzae Rd
gagcucuuucauuaaauuagu

SEQ ID NO: 2709057 - RNA, 12 nt, Haemophilus influenzae Rd
gagcugcugcaa

SEQ ID NO: 2709058 - RNA, 23 nt, Haemophilus influenzae Rd
gagcugucuaauuuuuuauucaa

SEQ ID NO: 2709059 - RNA, 16 nt, Haemophilus influenzae Rd
gagcuugagcugcugc

SEQ ID NO: 2709060 - RNA, 23 nt, Haemophilus influenzae Rd
gagcuugauuuucagcacugguu

SEQ ID NO: 2709061 - RNA, 20 nt, Haemophilus influenzae Rd
gagcuuguuggaaaaaugcu

SEQ ID NO: 2709062 - RNA, 20 nt, Haemophilus influenzae Rd
gagcuuuauuauuggcuauu

SEQ ID NO: 2709063 - RNA, 19 nt, Haemophilus influenzae Rd
gagcuuucaugauuaacaa

SEQ ID NO: 2709064 - RNA, 17 nt, Haemophilus influenzae Rd
gagcuuuccaaacaagg

SEQ ID NO: 2709065 - RNA, 19 nt, Haemophilus influenzae Rd
gagcuuuccaaacaaggcu

SEQ ID NO: 2709066 - RNA, 13 nt, Haemophilus influenzae Rd
gaggaauaaugaa

SEQ ID NO: 2709067 - RNA, 19 nt, Haemophilus influenzae Rd
gaggaauggucgagugguu

SEQ ID NO: 2709068 - RNA, 22 nt, Haemophilus influenzae Rd
gaggagaaauaaucucuuuaua

SEQ ID NO: 2709069 - RNA, 16 nt, Haemophilus influenzae Rd
gaggagguagaaaauc

SEQ ID NO: 2709070 - RNA, 17 nt, Haemophilus influenzae Rd
gaggauuuuauggcugc

SEQ ID NO: 2709071 - RNA, 14 nt, Haemophilus influenzae Rd
gaggcgauaagcaa

SEQ ID NO: 2709072 - RNA, 21 nt, Haemophilus influenzae Rd
gaggcuaugauuuuaaagcca

SEQ ID NO: 2709073 - RNA, 16 nt, Haemophilus influenzae Rd
gaggggauaaaauaaa

SEQ ID NO: 2709074 - RNA, 18 nt, Haemophilus influenzae Rd
gagggucaaaagaaagac

SEQ ID NO: 2709075 - RNA, 19 nt, Haemophilus influenzae Rd
gaggguucgaaucccucuc

SEQ ID NO: 2709076 - RNA, 23 nt, Haemophilus influenzae Rd
gaggucugcaauaauaucugcuu

SEQ ID NO: 2709077 - RNA, 22 nt, Haemophilus influenzae Rd
gaggugagaaguuuaagaaaag

SEQ ID NO: 2709078 - RNA, 17 nt, Haemophilus influenzae Rd
gagguuuauaacaaaga

SEQ ID NO: 2709079 - RNA, 23 nt, Haemophilus influenzae Rd
gagguuugccaucugaaaguuug

SEQ ID NO: 2709080 - RNA, 23 nt, Haemophilus influenzae Rd
gaguaaaaaaucuagagauugua

SEQ ID NO: 2709081 - RNA, 14 nt, Haemophilus influenzae Rd
gaguaaaaauauua

SEQ ID NO: 2709082 - RNA, 16 nt, Haemophilus influenzae Rd
gaguaccaaaauuuaa

SEQ ID NO: 2709083 - RNA, 19 nt, Haemophilus influenzae Rd
gaguagcugaauaucagaa

SEQ ID NO: 2709084 - RNA, 12 nt, Haemophilus influenzae Rd
gaguauaaauuu

SEQ ID NO: 2709085 - RNA, 16 nt, Haemophilus influenzae Rd
gaguauagucauucaa

SEQ ID NO: 2709086 - RNA, 23 nt, Haemophilus influenzae Rd
gaguauagucauucaaugcagaa

SEQ ID NO: 2709087 - RNA, 12 nt, Haemophilus influenzae Rd
gaguauguugcu

SEQ ID NO: 2709088 - RNA, 13 nt, Haemophilus influenzae Rd
gagucaauccagu

SEQ ID NO: 2709089 - RNA, 15 nt, Haemophilus influenzae Rd
gagucgccugcucua

SEQ ID NO: 2709090 - RNA, 14 nt, Haemophilus influenzae Rd
gagugagauaaaua

SEQ ID NO: 2709091 - RNA, 20 nt, Haemophilus influenzae Rd
gagugagauaaauaaauuca

SEQ ID NO: 2709092 - RNA, 13 nt, Haemophilus influenzae Rd
gagugcaagccac

SEQ ID NO: 2709093 - RNA, 17 nt, Haemophilus influenzae Rd
gagugguggaaucggua

SEQ ID NO: 2709094 - RNA, 14 nt, Haemophilus influenzae Rd
gaguuauaaaccca

SEQ ID NO: 2709095 - RNA, 19 nt, Haemophilus influenzae Rd
gaguuauuucuuuaaaugg

SEQ ID NO: 2709096 - RNA, 12 nt, Haemophilus influenzae Rd
gaguuauuuuua

SEQ ID NO: 2709097 - RNA, 22 nt, Haemophilus influenzae Rd
gaguucaacgacaauuaaagua

SEQ ID NO: 2709098 - RNA, 22 nt, Haemophilus influenzae Rd
gaguucuguaauucacagggcu

SEQ ID NO: 2709099 - RNA, 18 nt, Haemophilus influenzae Rd
gaguucuugcaacuuuuu

SEQ ID NO: 2709100 - RNA, 19 nt, Haemophilus influenzae Rd
gaguucuugcaacuuuuuu

SEQ ID NO: 2709101 - RNA, 20 nt, Haemophilus influenzae Rd
gaguucuugcaacuuuuuua

SEQ ID NO: 2709102 - RNA, 17 nt, Haemophilus influenzae Rd
gaguugcauaagcaaaa

SEQ ID NO: 2709103 - RNA, 15 nt, Haemophilus influenzae Rd
gaguuggcucauugu

SEQ ID NO: 2709104 - RNA, 19 nt, Haemophilus influenzae Rd
gaguugucccgcauauaaa

SEQ ID NO: 2709105 - RNA, 23 nt, Haemophilus influenzae Rd
gaguuuagucuuuuuaauuuaaa

SEQ ID NO: 2709106 - RNA, 14 nt, Haemophilus influenzae Rd
gaguuuuucaaaaa

SEQ ID NO: 2709107 - RNA, 17 nt, Haemophilus influenzae Rd
gauaaaaaccagauaaa

SEQ ID NO: 2709108 - RNA, 22 nt, Haemophilus influenzae Rd
gauaaaaaccuaaaggcaaggu

SEQ ID NO: 2709109 - RNA, 23 nt, Haemophilus influenzae Rd
gauaaaaauuaaggaaagcccca

SEQ ID NO: 2709110 - RNA, 15 nt, Haemophilus influenzae Rd
gauaaaaccuaaaau

SEQ ID NO: 2709111 - RNA, 12 nt, Haemophilus influenzae Rd
gauaaaaucaaa

SEQ ID NO: 2709112 - RNA, 22 nt, Haemophilus influenzae Rd
gauaaaaucgcuugccagucau

SEQ ID NO: 2709113 - RNA, 18 nt, Haemophilus influenzae Rd
gauaaaauuaaucauaaa

SEQ ID NO: 2709114 - RNA, 21 nt, Haemophilus influenzae Rd
gauaaacaaaccuaaaccuua

SEQ ID NO: 2709115 - RNA, 19 nt, Haemophilus influenzae Rd
gauaaacauaaccugaauu

SEQ ID NO: 2709116 - RNA, 19 nt, Haemophilus influenzae Rd
gauaaaccguacaaaccca

SEQ ID NO: 2709117 - RNA, 13 nt, Haemophilus influenzae Rd
gauaaagauaacu

SEQ ID NO: 2709118 - RNA, 18 nt, Haemophilus influenzae Rd
gauaaagauaacuaagau

SEQ ID NO: 2709119 - RNA, 20 nt, Haemophilus influenzae Rd
gauaaagguuacucauucua

SEQ ID NO: 2709120 - RNA, 21 nt, Haemophilus influenzae Rd
gauaaaguaguuuuaguaauu

SEQ ID NO: 2709121 - RNA, 16 nt, Haemophilus influenzae Rd
gauaaaguccauaaua

SEQ ID NO: 2709122 - RNA, 11 nt, Haemophilus influenzae Rd
gauaaauaaac

SEQ ID NO: 2709123 - RNA, 18 nt, Haemophilus influenzae Rd
gauaaauaucaaaauuau

SEQ ID NO: 2709124 - RNA, 12 nt, Haemophilus influenzae Rd
gauaaauauuac

SEQ ID NO: 2709125 - RNA, 17 nt, Haemophilus influenzae Rd
gauaaauguguuaaaua

SEQ ID NO: 2709126 - RNA, 18 nt, Haemophilus influenzae Rd
gauaaauuacauaaaagc

SEQ ID NO: 2709127 - RNA, 17 nt, Haemophilus influenzae Rd
gauaaauuauauuuuua

SEQ ID NO: 2709128 - RNA, 16 nt, Haemophilus influenzae Rd
gauaacaaacccugaa

SEQ ID NO: 2709129 - RNA, 14 nt, Haemophilus influenzae Rd
gauaacaauuuuug

SEQ ID NO: 2709130 - RNA, 19 nt, Haemophilus influenzae Rd
gauaacacccucaaccacu

SEQ ID NO: 2709131 - RNA, 14 nt, Haemophilus influenzae Rd
gauaaccaaaauau

SEQ ID NO: 2709132 - RNA, 22 nt, Haemophilus influenzae Rd
gauaaccuaucaucugauacug

SEQ ID NO: 2709133 - RNA, 21 nt, Haemophilus influenzae Rd
gauaacgcuugaauaaauccc

SEQ ID NO: 2709134 - RNA, 14 nt, Haemophilus influenzae Rd
gauaacguaaguaa

SEQ ID NO: 2709135 - RNA, 20 nt, Haemophilus influenzae Rd
gauaacguaaguaaugaaaa

SEQ ID NO: 2709136 - RNA, 11 nt, Haemophilus influenzae Rd
gauaacuucuu

SEQ ID NO: 2709137 - RNA, 23 nt, Haemophilus influenzae Rd
gauaagaaguuaucauuugaauu

SEQ ID NO: 2709138 - RNA, 18 nt, Haemophilus influenzae Rd
gauaagaucguauuuuug

SEQ ID NO: 2709139 - RNA, 18 nt, Haemophilus influenzae Rd
gauaagaugauaaauucu

SEQ ID NO: 2709140 - RNA, 15 nt, Haemophilus influenzae Rd
gauaagauuugcuuu

SEQ ID NO: 2709141 - RNA, 18 nt, Haemophilus influenzae Rd
gauaagcauuuuaucaca

SEQ ID NO: 2709142 - RNA, 22 nt, Haemophilus influenzae Rd
gauaagcauuuuaucacaaguu

SEQ ID NO: 2709143 - RNA, 20 nt, Haemophilus influenzae Rd
gauaagccauuaacauuuaa

SEQ ID NO: 2709144 - RNA, 16 nt, Haemophilus influenzae Rd
gauaaggcagaaauga

SEQ ID NO: 2709145 - RNA, 22 nt, Haemophilus influenzae Rd
gauaaggcuuauuuuuaaacaa

SEQ ID NO: 2709146 - RNA, 19 nt, Haemophilus influenzae Rd
gauaaguaaugaaaauugc

SEQ ID NO: 2709147 - RNA, 13 nt, Haemophilus influenzae Rd
gaucgaguaaaaa

SEQ ID NO: 2709148 - RNA, 13 nt, Haemophilus influenzae Rd
gaucgcaauguuc

SEQ ID NO: 2709149 - RNA, 22 nt, Haemophilus influenzae Rd
gaucgcuuguuguaaauugguu

SEQ ID NO: 2709150 - RNA, 15 nt, Haemophilus influenzae Rd
gaucggcaaugguuc

SEQ ID NO: 2709151 - RNA, 15 nt, Haemophilus influenzae Rd
gaucgguuuuauuau

SEQ ID NO: 2709152 - RNA, 17 nt, Haemophilus influenzae Rd
gaucguauuuuuguccc

SEQ ID NO: 2709153 - RNA, 18 nt, Haemophilus influenzae Rd
gaucuacaccgaauaaua

SEQ ID NO: 2709154 - RNA, 15 nt, Haemophilus influenzae Rd
gaucuauaagaaaau

SEQ ID NO: 2709155 - RNA, 18 nt, Haemophilus influenzae Rd
gaucuauauucguuaaau

SEQ ID NO: 2709156 - RNA, 23 nt, Haemophilus influenzae Rd
gaucugcacgauagcaaugccaa

SEQ ID NO: 2709157 - RNA, 22 nt, Haemophilus influenzae Rd
gaucugcaucuaauucacuacc

SEQ ID NO: 2709158 - RNA, 20 nt, Haemophilus influenzae Rd
gaucuucaaucaucauuuau

SEQ ID NO: 2709159 - RNA, 18 nt, Haemophilus influenzae Rd
gaucuucagcauuuacca

SEQ ID NO: 2709160 - RNA, 18 nt, Haemophilus influenzae Rd
gaucuugauccccauaca

SEQ ID NO: 2709161 - RNA, 15 nt, Haemophilus influenzae Rd
gaucuuguaaagauu

SEQ ID NO: 2709162 - RNA, 16 nt, Haemophilus influenzae Rd
gaucuuuuaaacgugu

SEQ ID NO: 2709163 - RNA, 12 nt, Haemophilus influenzae Rd
gaucuuuugcca

SEQ ID NO: 2709164 - RNA, 17 nt, Haemophilus influenzae Rd
gaucuuuuuuuuguuuu

SEQ ID NO: 2709165 - RNA, 21 nt, Haemophilus influenzae Rd
gaugaaaaaaagugcgguuga

SEQ ID NO: 2709166 - RNA, 23 nt, Haemophilus influenzae Rd
gaugaaaaaagugcggaaaauuu

SEQ ID NO: 2709167 - RNA, 14 nt, Haemophilus influenzae Rd
gaugaaaucaaaau

SEQ ID NO: 2709168 - RNA, 18 nt, Haemophilus influenzae Rd
gaugaaaugccgauaaua

SEQ ID NO: 2709169 - RNA, 15 nt, Haemophilus influenzae Rd
gaugaaauuaucauc

SEQ ID NO: 2709170 - RNA, 22 nt, Haemophilus influenzae Rd
gaugaagcuaagaaaauccaag

SEQ ID NO: 2709171 - RNA, 17 nt, Haemophilus influenzae Rd
gaugacgaaaugaaauu

SEQ ID NO: 2709172 - RNA, 18 nt, Haemophilus influenzae Rd
gaugacgaaaugaaauua

SEQ ID NO: 2709173 - RNA, 13 nt, Haemophilus influenzae Rd
gaugacugcaauu

SEQ ID NO: 2709174 - RNA, 17 nt, Haemophilus influenzae Rd
gaugacuggcaaaaaug

SEQ ID NO: 2709175 - RNA, 22 nt, Haemophilus influenzae Rd
gaugacuuguuucauaaaaaau

SEQ ID NO: 2709176 - RNA, 21 nt, Haemophilus influenzae Rd
gaugaggcguuuuucuuaaau

SEQ ID NO: 2709177 - RNA, 12 nt, Haemophilus influenzae Rd
gaugauaagccc

SEQ ID NO: 2709178 - RNA, 15 nt, Haemophilus influenzae Rd
gaugauaauuucauc

SEQ ID NO: 2709179 - RNA, 15 nt, Haemophilus influenzae Rd
gaugaugcaggaaag

SEQ ID NO: 2709180 - RNA, 18 nt, Haemophilus influenzae Rd
gaugaugcaggaaaggca

SEQ ID NO: 2709181 - RNA, 20 nt, Haemophilus influenzae Rd
gaugaugggaugaaaucaaa

SEQ ID NO: 2709182 - RNA, 14 nt, Haemophilus influenzae Rd
gaugauuugcauaa

SEQ ID NO: 2709183 - RNA, 13 nt, Haemophilus influenzae Rd
gaugauuuuaaaa

SEQ ID NO: 2709184 - RNA, 16 nt, Haemophilus influenzae Rd
gaugcaccaauaccaa

SEQ ID NO: 2709185 - RNA, 21 nt, Haemophilus influenzae Rd
gaugcauacuuguaguggauu

SEQ ID NO: 2709186 - RNA, 20 nt, Haemophilus influenzae Rd
gaugccaagggcugaagcuc

SEQ ID NO: 2709187 - RNA, 17 nt, Haemophilus influenzae Rd
gaugcccaagugcgauc

SEQ ID NO: 2709188 - RNA, 18 nt, Haemophilus influenzae Rd
gaugccccugcaauugug

SEQ ID NO: 2709189 - RNA, 19 nt, Haemophilus influenzae Rd
gaugccgaaugaagaaaug

SEQ ID NO: 2709190 - RNA, 18 nt, Haemophilus influenzae Rd
gaugcggucggcgaguug

SEQ ID NO: 2709191 - RNA, 20 nt, Haemophilus influenzae Rd
gaugcucugcauaaaagccu

SEQ ID NO: 2709192 - RNA, 22 nt, Haemophilus influenzae Rd
gauggaauaaauuuugcccucu

SEQ ID NO: 2709193 - RNA, 20 nt, Haemophilus influenzae Rd
gauggcuauuuaagccuuga

SEQ ID NO: 2709194 - RNA, 19 nt, Haemophilus influenzae Rd
gauggcugggauuucaaac

SEQ ID NO: 2709195 - RNA, 16 nt, Haemophilus influenzae Rd
gaugguaaaaacuuug

SEQ ID NO: 2709196 - RNA, 13 nt, Haemophilus influenzae Rd
gaugguaaaaugu

SEQ ID NO: 2709197 - RNA, 18 nt, Haemophilus influenzae Rd
gauguaaaagauaaaaca

SEQ ID NO: 2709198 - RNA, 21 nt, Haemophilus influenzae Rd
gauguaaauuuucagcguuuu

SEQ ID NO: 2709199 - RNA, 15 nt, Haemophilus influenzae Rd
gauguaccaaaaugu

SEQ ID NO: 2709200 - RNA, 15 nt, Haemophilus influenzae Rd
gaugucuggcugagu

SEQ ID NO: 2709201 - RNA, 17 nt, Haemophilus influenzae Rd
gauguucaaguaaaugc

SEQ ID NO: 2709202 - RNA, 18 nt, Haemophilus influenzae Rd
gauguugcaaccuucagc

SEQ ID NO: 2709203 - RNA, 22 nt, Haemophilus influenzae Rd
gauguuugaggaucacacaaaa

SEQ ID NO: 2709204 - RNA, 13 nt, Haemophilus influenzae Rd
gauguuuuaacaa

SEQ ID NO: 2709205 - RNA, 18 nt, Haemophilus influenzae Rd
gauuaaaaugguuuaaau

SEQ ID NO: 2709206 - RNA, 14 nt, Haemophilus influenzae Rd
gauuaaacaaccaa

SEQ ID NO: 2709207 - RNA, 23 nt, Haemophilus influenzae Rd
gauuaaagcguuguucaucugcc

SEQ ID NO: 2709208 - RNA, 20 nt, Haemophilus influenzae Rd
gauuaaagugcgguaaauuu

SEQ ID NO: 2709209 - RNA, 15 nt, Haemophilus influenzae Rd
gauuaacaauaaugu

SEQ ID NO: 2709210 - RNA, 12 nt, Haemophilus influenzae Rd
gauuaagaaaau

SEQ ID NO: 2709211 - RNA, 17 nt, Haemophilus influenzae Rd
gauuaaguauaacuaau

SEQ ID NO: 2709212 - RNA, 16 nt, Haemophilus influenzae Rd
gauuaauaccaauaau

SEQ ID NO: 2709213 - RNA, 14 nt, Haemophilus influenzae Rd
gauuaauuaaauua

SEQ ID NO: 2709214 - RNA, 22 nt, Haemophilus influenzae Rd
gauuaauuacgccugcccaagu

SEQ ID NO: 2709215 - RNA, 14 nt, Haemophilus influenzae Rd
gauuaauucaacag

SEQ ID NO: 2709216 - RNA, 15 nt, Haemophilus influenzae Rd
gauuaauugcuacca

SEQ ID NO: 2709217 - RNA, 17 nt, Haemophilus influenzae Rd
gauuaauugcuaccauu

SEQ ID NO: 2709218 - RNA, 22 nt, Haemophilus influenzae Rd
gauuaauugcuaccauuuaucu

SEQ ID NO: 2709219 - RNA, 14 nt, Haemophilus influenzae Rd
gauuaauuuuccua

SEQ ID NO: 2709220 - RNA, 23 nt, Haemophilus influenzae Rd
gauuaauuuuccuaacaauaauu

SEQ ID NO: 2709221 - RNA, 14 nt, Haemophilus influenzae Rd
gauuacaaaaacac

SEQ ID NO: 2709222 - RNA, 15 nt, Haemophilus influenzae Rd
gauuacaucuaaugc

SEQ ID NO: 2709223 - RNA, 20 nt, Haemophilus influenzae Rd
gauuacccacuaaguauuaa

SEQ ID NO: 2709224 - RNA, 16 nt, Haemophilus influenzae Rd
gauuacugucaaucca

SEQ ID NO: 2709225 - RNA, 14 nt, Haemophilus influenzae Rd
gauuagcuaauaua

SEQ ID NO: 2709226 - RNA, 23 nt, Haemophilus influenzae Rd
gauuauacgaucacgauuuuucu

SEQ ID NO: 2709227 - RNA, 21 nt, Haemophilus influenzae Rd
gauuauccacuaaaaaacuaa

SEQ ID NO: 2709228 - RNA, 18 nt, Haemophilus influenzae Rd
gauuaucgccuaaaauug

SEQ ID NO: 2709229 - RNA, 18 nt, Haemophilus influenzae Rd
gauuaucuaaauuucgcu

SEQ ID NO: 2709230 - RNA, 17 nt, Haemophilus influenzae Rd
gauuaucuagaaaacuc

SEQ ID NO: 2709231 - RNA, 20 nt, Haemophilus influenzae Rd
gauuaucuagcacaaagaca

SEQ ID NO: 2709232 - RNA, 22 nt, Haemophilus influenzae Rd
gauuauuaccuaguuugcuaua

SEQ ID NO: 2709233 - RNA, 14 nt, Haemophilus influenzae Rd
gauuauugcacuaa

SEQ ID NO: 2709234 - RNA, 12 nt, Haemophilus influenzae Rd
gauucaaauaac

SEQ ID NO: 2709235 - RNA, 23 nt, Haemophilus influenzae Rd
gauucaaaucuaaugccuuuccu

SEQ ID NO: 2709236 - RNA, 18 nt, Haemophilus influenzae Rd
gauucaacaauaauuuuu

SEQ ID NO: 2709237 - RNA, 24 nt, Haemophilus influenzae Rd
gauucaauaauagccauauuaucu

SEQ ID NO: 2709238 - RNA, 17 nt, Haemophilus influenzae Rd
gauucaauucuucuaau

SEQ ID NO: 2709239 - RNA, 12 nt, Haemophilus influenzae Rd
gauucacuaauu

SEQ ID NO: 2709240 - RNA, 19 nt, Haemophilus influenzae Rd
gauucaguccgcauugaaa

SEQ ID NO: 2709241 - RNA, 19 nt, Haemophilus influenzae Rd
gauucaguguaguuuucug

SEQ ID NO: 2709242 - RNA, 14 nt, Haemophilus influenzae Rd
gauucauuaaguuu

SEQ ID NO: 2709243 - RNA, 14 nt, Haemophilus influenzae Rd
gauucauuguuucu

SEQ ID NO: 2709244 - RNA, 19 nt, Haemophilus influenzae Rd
gauucauuugcaaaucaag

SEQ ID NO: 2709245 - RNA, 19 nt, Haemophilus influenzae Rd
gauuccaccacucgggcaa

SEQ ID NO: 2709246 - RNA, 14 nt, Haemophilus influenzae Rd
gauuccuaaucuua

SEQ ID NO: 2709247 - RNA, 19 nt, Haemophilus influenzae Rd
gauuccuaaucuuaugaau

SEQ ID NO: 2709248 - RNA, 14 nt, Haemophilus influenzae Rd
gauuccuacaccac

SEQ ID NO: 2709249 - RNA, 21 nt, Haemophilus influenzae Rd
gauuccucugcaggcauuuuc

SEQ ID NO: 2709250 - RNA, 14 nt, Haemophilus influenzae Rd
gauucgauaaauua

SEQ ID NO: 2709251 - RNA, 15 nt, Haemophilus influenzae Rd
gauucgcacguuuuu

SEQ ID NO: 2709252 - RNA, 17 nt, Haemophilus influenzae Rd
gcaaaguuaccauuuau

SEQ ID NO: 2709253 - RNA, 15 nt, Haemophilus influenzae Rd
gcaaauaaaauagac

SEQ ID NO: 2709254 - RNA, 14 nt, Haemophilus influenzae Rd
gcaaauaaucucuu

SEQ ID NO: 2709255 - RNA, 16 nt, Haemophilus influenzae Rd
gcaaauacguauaauu

SEQ ID NO: 2709256 - RNA, 13 nt, Haemophilus influenzae Rd
gcaaaucaccuuc

SEQ ID NO: 2709257 - RNA, 16 nt, Haemophilus influenzae Rd
gcaaauccuacaacac

SEQ ID NO: 2709258 - RNA, 22 nt, Haemophilus influenzae Rd
gcaaauccuugaaucauuucau

SEQ ID NO: 2709259 - RNA, 19 nt, Haemophilus influenzae Rd
gcaaaugaggaaaauaaag

SEQ ID NO: 2709260 - RNA, 20 nt, Haemophilus influenzae Rd
gcaaaugaggaaaauaaagg

SEQ ID NO: 2709261 - RNA, 15 nt, Haemophilus influenzae Rd
gcaaaugguguuuua

SEQ ID NO: 2709262 - RNA, 13 nt, Haemophilus influenzae Rd
gcaaauuaucuga

SEQ ID NO: 2709263 - RNA, 13 nt, Haemophilus influenzae Rd
gcaaauuuaaaua

SEQ ID NO: 2709264 - RNA, 19 nt, Haemophilus influenzae Rd
gcaaauuuaaauaauaaau

SEQ ID NO: 2709265 - RNA, 22 nt, Haemophilus influenzae Rd
gcaaauuuucguuuacccacuu

SEQ ID NO: 2709266 - RNA, 20 nt, Haemophilus influenzae Rd
gcaaauuuuucauucugucg

SEQ ID NO: 2709267 - RNA, 12 nt, Haemophilus influenzae Rd
gcaaauuuuuuc

SEQ ID NO: 2709268 - RNA, 16 nt, Haemophilus influenzae Rd
gcaacaaauaaaucau

SEQ ID NO: 2709269 - RNA, 19 nt, Haemophilus influenzae Rd
gcaacaauaucauugacuu

SEQ ID NO: 2709270 - RNA, 16 nt, Haemophilus influenzae Rd
gcaacaccaccagcgu

SEQ ID NO: 2709271 - RNA, 12 nt, Haemophilus influenzae Rd
gcaacauauuuu

SEQ ID NO: 2709272 - RNA, 15 nt, Haemophilus influenzae Rd
gcaacauauuuucua

SEQ ID NO: 2709273 - RNA, 13 nt, Haemophilus influenzae Rd
gcaacaucaaacc

SEQ ID NO: 2709274 - RNA, 22 nt, Haemophilus influenzae Rd
gcaacaucaauaacaagcucag

SEQ ID NO: 2709275 - RNA, 15 nt, Haemophilus influenzae Rd
gcaaccaaugcaaca

SEQ ID NO: 2709276 - RNA, 13 nt, Haemophilus influenzae Rd
gcaaccacacaag

SEQ ID NO: 2709277 - RNA, 20 nt, Haemophilus influenzae Rd
gcaaccacacaagcaccagu

SEQ ID NO: 2709278 - RNA, 23 nt, Haemophilus influenzae Rd
gcaaccacacaagcaccagucaa

SEQ ID NO: 2709279 - RNA, 13 nt, Haemophilus influenzae Rd
gcaacccacuucu

SEQ ID NO: 2709280 - RNA, 16 nt, Haemophilus influenzae Rd
gcaacgacaaucacug

SEQ ID NO: 2709281 - RNA, 22 nt, Haemophilus influenzae Rd
gcaacuaaauuagcucuagucc

SEQ ID NO: 2709282 - RNA, 17 nt, Haemophilus influenzae Rd
gcaacuaaauucaauuu

SEQ ID NO: 2709283 - RNA, 16 nt, Haemophilus influenzae Rd
gcaacuucagcagcaa

SEQ ID NO: 2709284 - RNA, 13 nt, Haemophilus influenzae Rd
gcaacuucugcgc

SEQ ID NO: 2709285 - RNA, 15 nt, Haemophilus influenzae Rd
gcaagaaauucacuc

SEQ ID NO: 2709286 - RNA, 17 nt, Haemophilus influenzae Rd
gcaagauagcaaaauau

SEQ ID NO: 2709287 - RNA, 19 nt, Haemophilus influenzae Rd
gcaagauuguuaucuguag

SEQ ID NO: 2709288 - RNA, 21 nt, Haemophilus influenzae Rd
gcaagcaaaauuaacagcaaa

SEQ ID NO: 2709289 - RNA, 18 nt, Haemophilus influenzae Rd
gcaagcgcguuuaucauc

SEQ ID NO: 2709290 - RNA, 20 nt, Haemophilus influenzae Rd
gcaagcgcguuuaucaucug

SEQ ID NO: 2709291 - RNA, 22 nt, Haemophilus influenzae Rd
gcaagcggcacucucuugggug

SEQ ID NO: 2709292 - RNA, 19 nt, Haemophilus influenzae Rd
gcaagcugugcaagcauuu

SEQ ID NO: 2709293 - RNA, 15 nt, Haemophilus influenzae Rd
gcaaggcucacaaag

SEQ ID NO: 2709294 - RNA, 16 nt, Haemophilus influenzae Rd
gcaagguauuucaaca

SEQ ID NO: 2709295 - RNA, 17 nt, Haemophilus influenzae Rd
gcaaggucaagaucgga

SEQ ID NO: 2709296 - RNA, 15 nt, Haemophilus influenzae Rd
gcaagguuuccaaga

SEQ ID NO: 2709297 - RNA, 16 nt, Haemophilus influenzae Rd
gcaaguccaaguuuuu

SEQ ID NO: 2709298 - RNA, 16 nt, Haemophilus influenzae Rd
gcaagucuuaaucuua

SEQ ID NO: 2709299 - RNA, 20 nt, Haemophilus influenzae Rd
gcaagugagcuaagcauuuc

SEQ ID NO: 2709300 - RNA, 17 nt, Haemophilus influenzae Rd
gcaagugcgguaaaauu

SEQ ID NO: 2709301 - RNA, 20 nt, Haemophilus influenzae Rd
gcaaguugggauuuaucuuc

SEQ ID NO: 2709302 - RNA, 18 nt, Haemophilus influenzae Rd
gcaaguuugcgaucauca

SEQ ID NO: 2709303 - RNA, 18 nt, Haemophilus influenzae Rd
gcaauaaaaaaacaccuu

SEQ ID NO: 2709304 - RNA, 22 nt, Haemophilus influenzae Rd
gcaauaaacagaaauauugucu

SEQ ID NO: 2709305 - RNA, 17 nt, Haemophilus influenzae Rd
gcaauaaagcuugaaaa

SEQ ID NO: 2709306 - RNA, 13 nt, Haemophilus influenzae Rd
gcaauaaauuuau

SEQ ID NO: 2709307 - RNA, 17 nt, Haemophilus influenzae Rd
gcaauaaccaauaacga

SEQ ID NO: 2709308 - RNA, 13 nt, Haemophilus influenzae Rd
gcaauaaccacgc

SEQ ID NO: 2709309 - RNA, 11 nt, Haemophilus influenzae Rd
gcaauaauauc

SEQ ID NO: 2709310 - RNA, 10 nt, Haemophilus influenzae Rd
gcaauaaucc

SEQ ID NO: 2709311 - RNA, 18 nt, Haemophilus influenzae Rd
gcaauaauguugcugauu

SEQ ID NO: 2709312 - RNA, 13 nt, Haemophilus influenzae Rd
gcaauaauuaaga

SEQ ID NO: 2709313 - RNA, 14 nt, Haemophilus influenzae Rd
gcaauagauucuaa

SEQ ID NO: 2709314 - RNA, 20 nt, Haemophilus influenzae Rd
gcaauauaaucauugcuaag

SEQ ID NO: 2709315 - RNA, 20 nt, Haemophilus influenzae Rd
gcaauauaaucuuuuacacc

SEQ ID NO: 2709316 - RNA, 18 nt, Haemophilus influenzae Rd
gcaauauagucaaauaac

SEQ ID NO: 2709317 - RNA, 15 nt, Haemophilus influenzae Rd
gcaauaucaucauca

SEQ ID NO: 2709318 - RNA, 19 nt, Haemophilus influenzae Rd
gcaauaucgauuuggauuu

SEQ ID NO: 2709319 - RNA, 17 nt, Haemophilus influenzae Rd
gcaauaucuauuggaau

SEQ ID NO: 2709320 - RNA, 21 nt, Haemophilus influenzae Rd
gcaauauuuuagcaagugcgc

SEQ ID NO: 2709321 - RNA, 12 nt, Haemophilus influenzae Rd
gcaaucaacaca

SEQ ID NO: 2709322 - RNA, 13 nt, Haemophilus influenzae Rd
gcaaucaagcaaa

SEQ ID NO: 2709323 - RNA, 22 nt, Haemophilus influenzae Rd
gcaaucacaaaauggcaaacaa

SEQ ID NO: 2709324 - RNA, 11 nt, Haemophilus influenzae Rd
gcaaucauaau

SEQ ID NO: 2709325 - RNA, 16 nt, Haemophilus influenzae Rd
gcaauccaaucagcaa

SEQ ID NO: 2709326 - RNA, 20 nt, Haemophilus influenzae Rd
gcaauccacuacugcaucug

SEQ ID NO: 2709327 - RNA, 14 nt, Haemophilus influenzae Rd
gcaaucgucaaaua

SEQ ID NO: 2709328 - RNA, 13 nt, Haemophilus influenzae Rd
gcaaucguucuaa

SEQ ID NO: 2709329 - RNA, 15 nt, Haemophilus influenzae Rd
gcaaugaaauuuuug

SEQ ID NO: 2709330 - RNA, 22 nt, Haemophilus influenzae Rd
gcaaugcaaaaguaaauaaucc

SEQ ID NO: 2709331 - RNA, 20 nt, Haemophilus influenzae Rd
gcaauggcuuguuccacauu

SEQ ID NO: 2709332 - RNA, 21 nt, Haemophilus influenzae Rd
gcaauggcuuuuaauccaagu

SEQ ID NO: 2709333 - RNA, 23 nt, Haemophilus influenzae Rd
gcaaugguuaauacaaagcgauu

SEQ ID NO: 2709334 - RNA, 20 nt, Haemophilus influenzae Rd
gcaauuaaacuaauuccgac

SEQ ID NO: 2709335 - RNA, 18 nt, Haemophilus influenzae Rd
gcaauuaagccugcaaag

SEQ ID NO: 2709336 - RNA, 21 nt, Haemophilus influenzae Rd
gcaauuaagccugcaaagccu

SEQ ID NO: 2709337 - RNA, 22 nt, Haemophilus influenzae Rd
gcaauuaagccugcaaagccuu

SEQ ID NO: 2709338 - RNA, 22 nt, Haemophilus influenzae Rd
gcaauuaaggcauuuucccaca

SEQ ID NO: 2709339 - RNA, 21 nt, Haemophilus influenzae Rd
gcaauucgcccgaaacucacc

SEQ ID NO: 2709340 - RNA, 12 nt, Haemophilus influenzae Rd
gcaauugcuaaa

SEQ ID NO: 2709341 - RNA, 21 nt, Haemophilus influenzae Rd
gcaauuggcaauauuaagcca

SEQ ID NO: 2709342 - RNA, 12 nt, Haemophilus influenzae Rd
gcaauugggauu

SEQ ID NO: 2709343 - RNA, 23 nt, Haemophilus influenzae Rd
gcaauuguugcaccaauaauuga

SEQ ID NO: 2709344 - RNA, 20 nt, Haemophilus influenzae Rd
gcaauuucccagccuacaac

SEQ ID NO: 2709345 - RNA, 21 nt, Haemophilus influenzae Rd
gcaauuugaaaagaauuucau

SEQ ID NO: 2709346 - RNA, 17 nt, Haemophilus influenzae Rd
gcaauuugaauuaauac

SEQ ID NO: 2709347 - RNA, 13 nt, Haemophilus influenzae Rd
gcacaaaauaaug

SEQ ID NO: 2709348 - RNA, 17 nt, Haemophilus influenzae Rd
gcacaaagaaaaacuaa

SEQ ID NO: 2709349 - RNA, 22 nt, Haemophilus influenzae Rd
gcacaaagacagcuauuaaaaa

SEQ ID NO: 2709350 - RNA, 13 nt, Haemophilus influenzae Rd
gcacaacgguuga

SEQ ID NO: 2709351 - RNA, 17 nt, Haemophilus influenzae Rd
gcacaagauuugccaaa

SEQ ID NO: 2709352 - RNA, 23 nt, Haemophilus influenzae Rd
gcacaagauuugccaaaaucacg

SEQ ID NO: 2709353 - RNA, 14 nt, Haemophilus influenzae Rd
gcacaauccuucau

SEQ ID NO: 2709354 - RNA, 23 nt, Haemophilus influenzae Rd
gcacaauuacuucuuacaacaaa

SEQ ID NO: 2709355 - RNA, 21 nt, Haemophilus influenzae Rd
gcacaauucucaucagccuuu

SEQ ID NO: 2709356 - RNA, 18 nt, Haemophilus influenzae Rd
gcacacggguauuaaugc

SEQ ID NO: 2709357 - RNA, 17 nt, Haemophilus influenzae Rd
gcagguuuugcaaauac

SEQ ID NO: 2709358 - RNA, 14 nt, Haemophilus influenzae Rd
gcaguaaaggcacu

SEQ ID NO: 2709359 - RNA, 17 nt, Haemophilus influenzae Rd
gcaguaacuucugcugc

SEQ ID NO: 2709360 - RNA, 15 nt, Haemophilus influenzae Rd
gcaguaauaaauccu

SEQ ID NO: 2709361 - RNA, 16 nt, Haemophilus influenzae Rd
gcaguauaaaccgcau

SEQ ID NO: 2709362 - RNA, 23 nt, Haemophilus influenzae Rd
gcaguauuaguugguacuaaaga

SEQ ID NO: 2709363 - RNA, 23 nt, Haemophilus influenzae Rd
gcagugaucccagcauaaauaaa

SEQ ID NO: 2709364 - RNA, 18 nt, Haemophilus influenzae Rd
gcaguggugacuugcgca

SEQ ID NO: 2709365 - RNA, 15 nt, Haemophilus influenzae Rd
gcaguguugcaggga

SEQ ID NO: 2709366 - RNA, 18 nt, Haemophilus influenzae Rd
gcaguguugcagggaaag

SEQ ID NO: 2709367 - RNA, 23 nt, Haemophilus influenzae Rd
gcaguguugcagggaaagucgca

SEQ ID NO: 2709368 - RNA, 20 nt, Haemophilus influenzae Rd
gcaguuacugccucugccac

SEQ ID NO: 2709369 - RNA, 15 nt, Haemophilus influenzae Rd
gcaguugcuaaauca

SEQ ID NO: 2709370 - RNA, 23 nt, Haemophilus influenzae Rd
gcaguuucuggcucuaaaucuaa

SEQ ID NO: 2709371 - RNA, 23 nt, Haemophilus influenzae Rd
gcauaaaaauaaccgcacuuugg

SEQ ID NO: 2709372 - RNA, 14 nt, Haemophilus influenzae Rd
gcauaaaaauucca

SEQ ID NO: 2709373 - RNA, 23 nt, Haemophilus influenzae Rd
gcauaaaaauuccaguucuccuu

SEQ ID NO: 2709374 - RNA, 17 nt, Haemophilus influenzae Rd
gcauaaaacaguauuuu

SEQ ID NO: 2709375 - RNA, 12 nt, Haemophilus influenzae Rd
gcauaaaagccu

SEQ ID NO: 2709376 - RNA, 19 nt, Haemophilus influenzae Rd
gcauaaaagugcgguaaaa

SEQ ID NO: 2709377 - RNA, 22 nt, Haemophilus influenzae Rd
gcauaaaagugcgguaaaaaaa

SEQ ID NO: 2709378 - RNA, 22 nt, Haemophilus influenzae Rd
gcauaaacagccauggcuuuuu

SEQ ID NO: 2709379 - RNA, 17 nt, Haemophilus influenzae Rd
gcauaaacaucuugcau

SEQ ID NO: 2709380 - RNA, 15 nt, Haemophilus influenzae Rd
gcauaaacuaaaaua

SEQ ID NO: 2709381 - RNA, 12 nt, Haemophilus influenzae Rd
gcauaaccugcg

SEQ ID NO: 2709382 - RNA, 18 nt, Haemophilus influenzae Rd
gcauaauacuugacaacg

SEQ ID NO: 2709383 - RNA, 18 nt, Haemophilus influenzae Rd
gcauaauggcuuaauaau

SEQ ID NO: 2709384 - RNA, 20 nt, Haemophilus influenzae Rd
gcauaauggcuuaauaaugg

SEQ ID NO: 2709385 - RNA, 17 nt, Haemophilus influenzae Rd
gcauaauuccuuuuucu

SEQ ID NO: 2709386 - RNA, 17 nt, Haemophilus influenzae Rd
gcauacgacggcuaaau

SEQ ID NO: 2709387 - RNA, 18 nt, Haemophilus influenzae Rd
gcauacgugccgccacag

SEQ ID NO: 2709388 - RNA, 20 nt, Haemophilus influenzae Rd
gcauagccaagugcuuuacc

SEQ ID NO: 2709389 - RNA, 13 nt, Haemophilus influenzae Rd
gcauagccacuau

SEQ ID NO: 2709390 - RNA, 16 nt, Haemophilus influenzae Rd
gcauagccguucuuau

SEQ ID NO: 2709391 - RNA, 18 nt, Haemophilus influenzae Rd
gcauagccguucuuaucu

SEQ ID NO: 2709392 - RNA, 15 nt, Haemophilus influenzae Rd
gcauauaaaauaaag

SEQ ID NO: 2709393 - RNA, 16 nt, Haemophilus influenzae Rd
gcauauaaaauaaaga

SEQ ID NO: 2709394 - RNA, 18 nt, Haemophilus influenzae Rd
gcauauaaaauaaagaaa

SEQ ID NO: 2709395 - RNA, 20 nt, Haemophilus influenzae Rd
gcauauaaaauaaagaaacg

SEQ ID NO: 2709396 - RNA, 15 nt, Haemophilus influenzae Rd
gcauauaagauuuuu

SEQ ID NO: 2709397 - RNA, 13 nt, Haemophilus influenzae Rd
gcauauagacaac

SEQ ID NO: 2709398 - RNA, 22 nt, Haemophilus influenzae Rd
gcauaucaauuuggcucacaag

SEQ ID NO: 2709399 - RNA, 15 nt, Haemophilus influenzae Rd
gcauaucugcugcug

SEQ ID NO: 2709400 - RNA, 22 nt, Haemophilus influenzae Rd
gcauauucgcaccuucagccac

SEQ ID NO: 2709401 - RNA, 21 nt, Haemophilus influenzae Rd
gcauauugcuugcauucacaa

SEQ ID NO: 2709402 - RNA, 11 nt, Haemophilus influenzae Rd
gcauauuuucc

SEQ ID NO: 2709403 - RNA, 17 nt, Haemophilus influenzae Rd
gcauauuuuguucuaca

SEQ ID NO: 2709404 - RNA, 17 nt, Haemophilus influenzae Rd
gcauauuuuugcaagau

SEQ ID NO: 2709405 - RNA, 21 nt, Haemophilus influenzae Rd
gcaucaaaacguucuaagaau

SEQ ID NO: 2709406 - RNA, 20 nt, Haemophilus influenzae Rd
gcaucaaaauaaauaaaaua

SEQ ID NO: 2709407 - RNA, 16 nt, Haemophilus influenzae Rd
gcaucaaaauuauaaa

SEQ ID NO: 2709408 - RNA, 16 nt, Haemophilus influenzae Rd
gcaucaaaauucaaaa

SEQ ID NO: 2709409 - RNA, 22 nt, Haemophilus influenzae Rd
gcaucaaaggcuaauucuacac

SEQ ID NO: 2709410 - RNA, 18 nt, Haemophilus influenzae Rd
gcaucaaccgauaaaucu

SEQ ID NO: 2709411 - RNA, 12 nt, Haemophilus influenzae Rd
gcaucaauaauu

SEQ ID NO: 2709412 - RNA, 13 nt, Haemophilus influenzae Rd
gcaucagauuuuu

SEQ ID NO: 2709413 - RNA, 22 nt, Haemophilus influenzae Rd
gcaucagauuuuucgcauuuua

SEQ ID NO: 2709414 - RNA, 15 nt, Haemophilus influenzae Rd
gcaucauagccuuuu

SEQ ID NO: 2709415 - RNA, 18 nt, Haemophilus influenzae Rd
gcaucauagccuuuucua

SEQ ID NO: 2709416 - RNA, 13 nt, Haemophilus influenzae Rd
gcaucauuaauac

SEQ ID NO: 2709417 - RNA, 19 nt, Haemophilus influenzae Rd
gcaucauuaauacacaaaa

SEQ ID NO: 2709418 - RNA, 15 nt, Haemophilus influenzae Rd
gcaucauucaaugca

SEQ ID NO: 2709419 - RNA, 17 nt, Haemophilus influenzae Rd
gcauccaaacgccacgc

SEQ ID NO: 2709420 - RNA, 13 nt, Haemophilus influenzae Rd
gcauccacuucau

SEQ ID NO: 2709421 - RNA, 15 nt, Haemophilus influenzae Rd
gcauccacuuuuuuc

SEQ ID NO: 2709422 - RNA, 18 nt, Haemophilus influenzae Rd
gcaucgguauuaaugaca

SEQ ID NO: 2709423 - RNA, 17 nt, Haemophilus influenzae Rd
gcaucguagucuuucaa

SEQ ID NO: 2709424 - RNA, 16 nt, Haemophilus influenzae Rd
gcaucuaaaaauaauu

SEQ ID NO: 2709425 - RNA, 19 nt, Haemophilus influenzae Rd
gcaucuaaaaauaauuuua

SEQ ID NO: 2709426 - RNA, 21 nt, Haemophilus influenzae Rd
gcaucuucuauucucuguugc

SEQ ID NO: 2709427 - RNA, 15 nt, Haemophilus influenzae Rd
gcaucuuuauaacau

SEQ ID NO: 2709428 - RNA, 19 nt, Haemophilus influenzae Rd
gcaugaagaacuuguaguu

SEQ ID NO: 2709429 - RNA, 19 nt, Haemophilus influenzae Rd
gcaugauguuuuucagcaa

SEQ ID NO: 2709430 - RNA, 15 nt, Haemophilus influenzae Rd
gcaugcggaauaauu

SEQ ID NO: 2709431 - RNA, 20 nt, Haemophilus influenzae Rd
gcaugcggaauaauuuuccu

SEQ ID NO: 2709432 - RNA, 21 nt, Haemophilus influenzae Rd
gcauguuuacuuaaaucuuua

SEQ ID NO: 2709433 - RNA, 14 nt, Haemophilus influenzae Rd
gcauuaaaaauuua

SEQ ID NO: 2709434 - RNA, 20 nt, Haemophilus influenzae Rd
gcauuaaaaauuuaaaagca

SEQ ID NO: 2709435 - RNA, 22 nt, Haemophilus influenzae Rd
gcauuaaaagucuguuuaaaaa

SEQ ID NO: 2709436 - RNA, 13 nt, Haemophilus influenzae Rd
gcauuaaagcgag

SEQ ID NO: 2709437 - RNA, 12 nt, Haemophilus influenzae Rd
gcauuaaaucaa

SEQ ID NO: 2709438 - RNA, 13 nt, Haemophilus influenzae Rd
gcauuaaguuuuu

SEQ ID NO: 2709439 - RNA, 16 nt, Haemophilus influenzae Rd
gcauuaaguuuuuagc

SEQ ID NO: 2709440 - RNA, 19 nt, Haemophilus influenzae Rd
gcauuaaugccucagaugc

SEQ ID NO: 2709441 - RNA, 23 nt, Haemophilus influenzae Rd
gcauuaauuggcgcaacaucaaa

SEQ ID NO: 2709442 - RNA, 21 nt, Haemophilus influenzae Rd
gcauuaccgccagugauuuuu

SEQ ID NO: 2709443 - RNA, 15 nt, Haemophilus influenzae Rd
gcauuaucaaaugcc

SEQ ID NO: 2709444 - RNA, 15 nt, Haemophilus influenzae Rd
gcauuauguaauaua

SEQ ID NO: 2709445 - RNA, 15 nt, Haemophilus influenzae Rd
gcauucacaaaaguu

SEQ ID NO: 2709446 - RNA, 19 nt, Haemophilus influenzae Rd
gcauucacuucuaaaacca

SEQ ID NO: 2709447 - RNA, 17 nt, Haemophilus influenzae Rd
gcauucccacgguucca

SEQ ID NO: 2709448 - RNA, 23 nt, Haemophilus influenzae Rd
gcauucucaauugcaaaaucaca

SEQ ID NO: 2709449 - RNA, 22 nt, Haemophilus influenzae Rd
gcauugaaaccuuguaaauacu

SEQ ID NO: 2709450 - RNA, 14 nt, Haemophilus influenzae Rd
gcauugaguuuuuc

SEQ ID NO: 2709451 - RNA, 16 nt, Haemophilus influenzae Rd
gcauugaguuuuucug

SEQ ID NO: 2709452 - RNA, 16 nt, Haemophilus influenzae Rd
gcauugauugcuaaau

SEQ ID NO: 2709453 - RNA, 23 nt, Haemophilus influenzae Rd
gcauugauugcuuuaacugaagc

SEQ ID NO: 2709454 - RNA, 12 nt, Haemophilus influenzae Rd
gcauugccuaaa

SEQ ID NO: 2709455 - RNA, 18 nt, Haemophilus influenzae Rd
gcauuggaaugguauaaa

SEQ ID NO: 2709456 - RNA, 19 nt, Haemophilus influenzae Rd
gcauuggaaugguauaaaa

SEQ ID NO: 2709457 - RNA, 15 nt, Haemophilus influenzae Rd
gcauuguaaaccaaa

SEQ ID NO: 2709458 - RNA, 21 nt, Haemophilus influenzae Rd
gcauuguaaaccaaauuucuu

SEQ ID NO: 2709459 - RNA, 23 nt, Haemophilus influenzae Rd
gcauuguccacagcaaaagaaau

SEQ ID NO: 2709460 - RNA, 15 nt, Haemophilus influenzae Rd
gcauugucuuuuacg

SEQ ID NO: 2709461 - RNA, 21 nt, Haemophilus influenzae Rd
gcauugugggcuuuaagcuuu

SEQ ID NO: 2709462 - RNA, 23 nt, Haemophilus influenzae Rd
gcccaauccagauuaaaaauuca

SEQ ID NO: 2709463 - RNA, 14 nt, Haemophilus influenzae Rd
gcccaauuuggcaa

SEQ ID NO: 2709464 - RNA, 17 nt, Haemophilus influenzae Rd
gcccacuaacucacauu

SEQ ID NO: 2709465 - RNA, 22 nt, Haemophilus influenzae Rd
gcccauuccagcagcaccuaaa

SEQ ID NO: 2709466 - RNA, 12 nt, Haemophilus influenzae Rd
gccccaaaagcu

SEQ ID NO: 2709467 - RNA, 14 nt, Haemophilus influenzae Rd
gccccaaaagcugc

SEQ ID NO: 2709468 - RNA, 18 nt, Haemophilus influenzae Rd
gccccaauggggcuuuuu

SEQ ID NO: 2709469 - RNA, 14 nt, Haemophilus influenzae Rd
gccccugaagccaa

SEQ ID NO: 2709470 - RNA, 23 nt, Haemophilus influenzae Rd
gccccugcaauugugucauucgc

SEQ ID NO: 2709471 - RNA, 23 nt, Haemophilus influenzae Rd
gcccgaauucugagcaaauuacc

SEQ ID NO: 2709472 - RNA, 15 nt, Haemophilus influenzae Rd
gcccgauauuuuggc

SEQ ID NO: 2709473 - RNA, 16 nt, Haemophilus influenzae Rd
gcccgcuacaaauaag

SEQ ID NO: 2709474 - RNA, 16 nt, Haemophilus influenzae Rd
gcccguguuucaauuc

SEQ ID NO: 2709475 - RNA, 15 nt, Haemophilus influenzae Rd
gcccuagugcaacca

SEQ ID NO: 2709476 - RNA, 13 nt, Haemophilus influenzae Rd
gcccuauaccacc

SEQ ID NO: 2709477 - RNA, 14 nt, Haemophilus influenzae Rd
gcccuauaccacca

SEQ ID NO: 2709478 - RNA, 22 nt, Haemophilus influenzae Rd
gcccucaguauuguuuuaugaa

SEQ ID NO: 2709479 - RNA, 20 nt, Haemophilus influenzae Rd
gcccuguagauuacagagcc

SEQ ID NO: 2709480 - RNA, 17 nt, Haemophilus influenzae Rd
gcccuucaccuucgaau

SEQ ID NO: 2709481 - RNA, 20 nt, Haemophilus influenzae Rd
gcccuuuauuuuguuaaaag

SEQ ID NO: 2709482 - RNA, 15 nt, Haemophilus influenzae Rd
gcccuuuuuaucuau

SEQ ID NO: 2709483 - RNA, 17 nt, Haemophilus influenzae Rd
gcccuuuuuaucuauuu

SEQ ID NO: 2709484 - RNA, 11 nt, Haemophilus influenzae Rd
gccgaaaaugg

SEQ ID NO: 2709485 - RNA, 13 nt, Haemophilus influenzae Rd
gccgaaaauuuac

SEQ ID NO: 2709486 - RNA, 11 nt, Haemophilus influenzae Rd
gccgaagccau

SEQ ID NO: 2709487 - RNA, 18 nt, Haemophilus influenzae Rd
gccgaauagauuuaaaca

SEQ ID NO: 2709488 - RNA, 14 nt, Haemophilus influenzae Rd
gccgacacuaaaaa

SEQ ID NO: 2709489 - RNA, 19 nt, Haemophilus influenzae Rd
gccgaguaaauucaccaau

SEQ ID NO: 2709490 - RNA, 17 nt, Haemophilus influenzae Rd
gccgauaguuaauggca

SEQ ID NO: 2709491 - RNA, 12 nt, Haemophilus influenzae Rd
gccgauuacuug

SEQ ID NO: 2709492 - RNA, 11 nt, Haemophilus influenzae Rd
gccgcaaucaa

SEQ ID NO: 2709493 - RNA, 16 nt, Haemophilus influenzae Rd
gccgcaaucacaaaau

SEQ ID NO: 2709494 - RNA, 20 nt, Haemophilus influenzae Rd
gccgcacuuuugaucugcac

SEQ ID NO: 2709495 - RNA, 23 nt, Haemophilus influenzae Rd
gccgcaucaacuugauugauaaa

SEQ ID NO: 2709496 - RNA, 14 nt, Haemophilus influenzae Rd
gccgccuucuucca

SEQ ID NO: 2709497 - RNA, 12 nt, Haemophilus influenzae Rd
gccgcuucgcua

SEQ ID NO: 2709498 - RNA, 17 nt, Haemophilus influenzae Rd
gccguaaguuaaaccaa

SEQ ID NO: 2709499 - RNA, 20 nt, Haemophilus influenzae Rd
gccguacugcucaaucgcuu

SEQ ID NO: 2709500 - RNA, 13 nt, Haemophilus influenzae Rd
gccgugauaacgc

SEQ ID NO: 2709501 - RNA, 15 nt, Haemophilus influenzae Rd
gccguguucuagugc

SEQ ID NO: 2709502 - RNA, 14 nt, Haemophilus influenzae Rd
gccguuaguuugua

SEQ ID NO: 2709503 - RNA, 21 nt, Haemophilus influenzae Rd
gccguucaaaacaauggcuga

SEQ ID NO: 2709504 - RNA, 23 nt, Haemophilus influenzae Rd
gccuaaaacaagcgguuuuaauc

SEQ ID NO: 2709505 - RNA, 15 nt, Haemophilus influenzae Rd
gccuaaacacauaau

SEQ ID NO: 2709506 - RNA, 17 nt, Haemophilus influenzae Rd
gccuaauaaaaaauaaa

SEQ ID NO: 2709507 - RNA, 15 nt, Haemophilus influenzae Rd
gccuaauagaaaaau

SEQ ID NO: 2709508 - RNA, 16 nt, Haemophilus influenzae Rd
gccuaauagaaaaaug

SEQ ID NO: 2709509 - RNA, 19 nt, Haemophilus influenzae Rd
gccuaaugccuugaugcca

SEQ ID NO: 2709510 - RNA, 20 nt, Haemophilus influenzae Rd
gccuaaugccuugaugccau

SEQ ID NO: 2709511 - RNA, 16 nt, Haemophilus influenzae Rd
gccuaauucuugccag

SEQ ID NO: 2709512 - RNA, 14 nt, Haemophilus influenzae Rd
gccuaauuggaaaa

SEQ ID NO: 2709513 - RNA, 17 nt, Haemophilus influenzae Rd
gccuaauuggaaaagua

SEQ ID NO: 2709514 - RNA, 17 nt, Haemophilus influenzae Rd
gccuagauauuguucua

SEQ ID NO: 2709515 - RNA, 13 nt, Haemophilus influenzae Rd
gccuaguauuuuu

SEQ ID NO: 2709516 - RNA, 15 nt, Haemophilus influenzae Rd
gccuagugcuaaaau

SEQ ID NO: 2709517 - RNA, 17 nt, Haemophilus influenzae Rd
gccuagugcuaaaauaa

SEQ ID NO: 2709518 - RNA, 23 nt, Haemophilus influenzae Rd
gccuauuagacuuaauuucacau

SEQ ID NO: 2709519 - RNA, 15 nt, Haemophilus influenzae Rd
gccuauuuuuagaaa

SEQ ID NO: 2709520 - RNA, 15 nt, Haemophilus influenzae Rd
gccucugcagggaaa

SEQ ID NO: 2709521 - RNA, 22 nt, Haemophilus influenzae Rd
gccucugcagggaaaaauuuua

SEQ ID NO: 2709522 - RNA, 16 nt, Haemophilus influenzae Rd
gccucuguauuuuuca

SEQ ID NO: 2709523 - RNA, 21 nt, Haemophilus influenzae Rd
gccucuguauuuuucauaucu

SEQ ID NO: 2709524 - RNA, 22 nt, Haemophilus influenzae Rd
gccucuucuuuugcaaaaauga

SEQ ID NO: 2709525 - RNA, 21 nt, Haemophilus influenzae Rd
gccucuuggauuuucuuagcu

SEQ ID NO: 2709526 - RNA, 20 nt, Haemophilus influenzae Rd
gccugaaaaagcuaaaaaaa

SEQ ID NO: 2709527 - RNA, 11 nt, Haemophilus influenzae Rd
gccugaagccu

SEQ ID NO: 2709528 - RNA, 14 nt, Haemophilus influenzae Rd
gccugaagccucug

SEQ ID NO: 2709529 - RNA, 13 nt, Haemophilus influenzae Rd
gccugacauuuuu

SEQ ID NO: 2709530 - RNA, 19 nt, Haemophilus influenzae Rd
gccugauuucgcuuugcuu

SEQ ID NO: 2709531 - RNA, 12 nt, Haemophilus influenzae Rd
gccugcaaagcc

SEQ ID NO: 2709532 - RNA, 14 nt, Haemophilus influenzae Rd
gccugcauagaaug

SEQ ID NO: 2709533 - RNA, 19 nt, Haemophilus influenzae Rd
gccugcauuaauaaucuaa

SEQ ID NO: 2709534 - RNA, 16 nt, Haemophilus influenzae Rd
gccugcccaaguugug

SEQ ID NO: 2709535 - RNA, 23 nt, Haemophilus influenzae Rd
gccugcgaugccgaaugaagaaa

SEQ ID NO: 2709536 - RNA, 16 nt, Haemophilus influenzae Rd
gccugcuaauggcuga

SEQ ID NO: 2709537 - RNA, 15 nt, Haemophilus influenzae Rd
gccugcuacagaagc

SEQ ID NO: 2709538 - RNA, 16 nt, Haemophilus influenzae Rd
gccugcuacauuugcc

SEQ ID NO: 2709539 - RNA, 12 nt, Haemophilus influenzae Rd
gccugcugcagu

SEQ ID NO: 2709540 - RNA, 14 nt, Haemophilus influenzae Rd
gccugucauauaaa

SEQ ID NO: 2709541 - RNA, 18 nt, Haemophilus influenzae Rd
gccuguggaaacuaauuu

SEQ ID NO: 2709542 - RNA, 13 nt, Haemophilus influenzae Rd
gccuguggcaaaa

SEQ ID NO: 2709543 - RNA, 13 nt, Haemophilus influenzae Rd
gccuguucuucca

SEQ ID NO: 2709544 - RNA, 14 nt, Haemophilus influenzae Rd
gccuguucuuccac

SEQ ID NO: 2709545 - RNA, 19 nt, Haemophilus influenzae Rd
gccuguucuuccaccgcuu

SEQ ID NO: 2709546 - RNA, 19 nt, Haemophilus influenzae Rd
gccuuagccuguucuucca

SEQ ID NO: 2709547 - RNA, 12 nt, Haemophilus influenzae Rd
gccuuauuugua

SEQ ID NO: 2709548 - RNA, 21 nt, Haemophilus influenzae Rd
gccuucaaugggcauccaaag

SEQ ID NO: 2709549 - RNA, 16 nt, Haemophilus influenzae Rd
gccuucaccuaauccu

SEQ ID NO: 2709550 - RNA, 18 nt, Haemophilus influenzae Rd
gccuucauaaguccaagu

SEQ ID NO: 2709551 - RNA, 23 nt, Haemophilus influenzae Rd
gccuucgcgagauaaaauuuuua

SEQ ID NO: 2709552 - RNA, 20 nt, Haemophilus influenzae Rd
gccuucuaaaauaagaaugu

SEQ ID NO: 2709553 - RNA, 12 nt, Haemophilus influenzae Rd
gccuucuucacu

SEQ ID NO: 2709554 - RNA, 20 nt, Haemophilus influenzae Rd
gccuucuucacuacuugaac

SEQ ID NO: 2709555 - RNA, 14 nt, Haemophilus influenzae Rd
gccuugagauguuu

SEQ ID NO: 2709556 - RNA, 13 nt, Haemophilus influenzae Rd
gccuugcaaaaac

SEQ ID NO: 2709557 - RNA, 14 nt, Haemophilus influenzae Rd
gccuugcaaauuuu

SEQ ID NO: 2709558 - RNA, 15 nt, Haemophilus influenzae Rd
gccuugcaaauuuuc

SEQ ID NO: 2709559 - RNA, 16 nt, Haemophilus influenzae Rd
gccuugcauaaugcca

SEQ ID NO: 2709560 - RNA, 18 nt, Haemophilus influenzae Rd
gccuugggcuaacauugc

SEQ ID NO: 2709561 - RNA, 23 nt, Haemophilus influenzae Rd
gccuuguaauugauuuucagaaa

SEQ ID NO: 2709562 - RNA, 15 nt, Haemophilus influenzae Rd
gccuuguucugcagc

SEQ ID NO: 2709563 - RNA, 17 nt, Haemophilus influenzae Rd
gccuuucaucauugcuu

SEQ ID NO: 2709564 - RNA, 15 nt, Haemophilus influenzae Rd
gccuuuccugcauca

SEQ ID NO: 2709565 - RNA, 14 nt, Haemophilus influenzae Rd
gccuuuguuuuaua

SEQ ID NO: 2709566 - RNA, 14 nt, Haemophilus influenzae Rd
gccuuuuaaaauga

SEQ ID NO: 2709567 - RNA, 14 nt, Haemophilus influenzae Rd
gccuuuuauuucuu

SEQ ID NO: 2709568 - RNA, 15 nt, Haemophilus influenzae Rd
gccuuuuucuaaugg

SEQ ID NO: 2709569 - RNA, 12 nt, Haemophilus influenzae Rd
gcuaaauuuauu

SEQ ID NO: 2709570 - RNA, 18 nt, Haemophilus influenzae Rd
gcuaaauuuuuggcugcu

SEQ ID NO: 2709571 - RNA, 14 nt, Haemophilus influenzae Rd
gcuaacaaaauuaa

SEQ ID NO: 2709572 - RNA, 19 nt, Haemophilus influenzae Rd
gcuaacaaaauuaaugcca

SEQ ID NO: 2709573 - RNA, 14 nt, Haemophilus influenzae Rd
gcuaacaaauaaug

SEQ ID NO: 2709574 - RNA, 20 nt, Haemophilus influenzae Rd
gcuaacaaauaaugccucau

SEQ ID NO: 2709575 - RNA, 22 nt, Haemophilus influenzae Rd
gcuaacaaauuuaauauuucuu

SEQ ID NO: 2709576 - RNA, 13 nt, Haemophilus influenzae Rd
gcuaacacugcca

SEQ ID NO: 2709577 - RNA, 16 nt, Haemophilus influenzae Rd
gcuaacggcaaauaac

SEQ ID NO: 2709578 - RNA, 19 nt, Haemophilus influenzae Rd
gcuaacggcguaccuucaa

SEQ ID NO: 2709579 - RNA, 16 nt, Haemophilus influenzae Rd
gcuaacucaucaacaa

SEQ ID NO: 2709580 - RNA, 19 nt, Haemophilus influenzae Rd
gcuaacucugguucaaaau

SEQ ID NO: 2709581 - RNA, 14 nt, Haemophilus influenzae Rd
gcuaacuucuucca

SEQ ID NO: 2709582 - RNA, 16 nt, Haemophilus influenzae Rd
gcuaauaaaaauccuu

SEQ ID NO: 2709583 - RNA, 12 nt, Haemophilus influenzae Rd
gcuaauaaaguu

SEQ ID NO: 2709584 - RNA, 24 nt, Haemophilus influenzae Rd
gcuaauaaugccaagaaagucauu

SEQ ID NO: 2709585 - RNA, 14 nt, Haemophilus influenzae Rd
gcuaauccaaauca

SEQ ID NO: 2709586 - RNA, 15 nt, Haemophilus influenzae Rd
gcuaauccaauuuca

SEQ ID NO: 2709587 - RNA, 19 nt, Haemophilus influenzae Rd
gcuaauccaauuucacaac

SEQ ID NO: 2709588 - RNA, 19 nt, Haemophilus influenzae Rd
gcuaaugguugcauuugcu

SEQ ID NO: 2709589 - RNA, 21 nt, Haemophilus influenzae Rd
gcuaaugguugcauuugcuca

SEQ ID NO: 2709590 - RNA, 22 nt, Haemophilus influenzae Rd
gcuaaugguugcauuugcucaa

SEQ ID NO: 2709591 - RNA, 20 nt, Haemophilus influenzae Rd
gcuaaugguuggaagaaaag

SEQ ID NO: 2709592 - RNA, 18 nt, Haemophilus influenzae Rd
gcuaauuauuuaaaucua

SEQ ID NO: 2709593 - RNA, 21 nt, Haemophilus influenzae Rd
gcuaauucguuaauaaaucca

SEQ ID NO: 2709594 - RNA, 16 nt, Haemophilus influenzae Rd
gcuaauucuacaccag

SEQ ID NO: 2709595 - RNA, 15 nt, Haemophilus influenzae Rd
gcuaauucugcuaaa

SEQ ID NO: 2709596 - RNA, 20 nt, Haemophilus influenzae Rd
gcuaauuuuuaaaauagaau

SEQ ID NO: 2709597 - RNA, 18 nt, Haemophilus influenzae Rd
gcuaauuuuucagguaaa

SEQ ID NO: 2709598 - RNA, 16 nt, Haemophilus influenzae Rd
gcuaauuuuuuuccaa

SEQ ID NO: 2709599 - RNA, 17 nt, Haemophilus influenzae Rd
gcuacaaauaagccaau

SEQ ID NO: 2709600 - RNA, 19 nt, Haemophilus influenzae Rd
gcuacaauauuuauuucua

SEQ ID NO: 2709601 - RNA, 23 nt, Haemophilus influenzae Rd
gcuacacccacuucaccuuggca

SEQ ID NO: 2709602 - RNA, 17 nt, Haemophilus influenzae Rd
gcuacauauucaaaagg

SEQ ID NO: 2709603 - RNA, 14 nt, Haemophilus influenzae Rd
gcuacaucaacaaa

SEQ ID NO: 2709604 - RNA, 22 nt, Haemophilus influenzae Rd
gcuacauuugccccaacaacau

SEQ ID NO: 2709605 - RNA, 19 nt, Haemophilus influenzae Rd
gcuaccaauauucuuuaaa

SEQ ID NO: 2709606 - RNA, 19 nt, Haemophilus influenzae Rd
gcuaccacguuuucaacag

SEQ ID NO: 2709607 - RNA, 14 nt, Haemophilus influenzae Rd
gcuaccauuuaucu

SEQ ID NO: 2709608 - RNA, 14 nt, Haemophilus influenzae Rd
gcuaccgaaagaua

SEQ ID NO: 2709609 - RNA, 18 nt, Haemophilus influenzae Rd
gcuaccuacuaaugaacg

SEQ ID NO: 2709610 - RNA, 13 nt, Haemophilus influenzae Rd
gcuacgccuugga

SEQ ID NO: 2709611 - RNA, 16 nt, Haemophilus influenzae Rd
gcuacgguuauuuuuu

SEQ ID NO: 2709612 - RNA, 17 nt, Haemophilus influenzae Rd
gcuacuauacacaucag

SEQ ID NO: 2709613 - RNA, 22 nt, Haemophilus influenzae Rd
gcuacuaucauccgcuuguaau

SEQ ID NO: 2709614 - RNA, 23 nt, Haemophilus influenzae Rd
gcuacuucuuugaauugagugaa

SEQ ID NO: 2709615 - RNA, 14 nt, Haemophilus influenzae Rd
gcuagaggcugaag

SEQ ID NO: 2709616 - RNA, 16 nt, Haemophilus influenzae Rd
gcuagggauuaagaau

SEQ ID NO: 2709617 - RNA, 22 nt, Haemophilus influenzae Rd
gcuagucgucaucauuggggaa

SEQ ID NO: 2709618 - RNA, 13 nt, Haemophilus influenzae Rd
gcuaguucuuccu

SEQ ID NO: 2709619 - RNA, 16 nt, Haemophilus influenzae Rd
gcuauacaaaauuuug

SEQ ID NO: 2709620 - RNA, 20 nt, Haemophilus influenzae Rd
gcuauacaaaauuuuguccg

SEQ ID NO: 2709621 - RNA, 14 nt, Haemophilus influenzae Rd
gcuauagcuugcag

SEQ ID NO: 2709622 - RNA, 12 nt, Haemophilus influenzae Rd
gcuauauuuucc

SEQ ID NO: 2709623 - RNA, 17 nt, Haemophilus influenzae Rd
gcuaucgucaaauuuaa

SEQ ID NO: 2709624 - RNA, 15 nt, Haemophilus influenzae Rd
gcuaucugcuuuucu

SEQ ID NO: 2709625 - RNA, 16 nt, Haemophilus influenzae Rd
gcuaucugcuuuucuu

SEQ ID NO: 2709626 - RNA, 18 nt, Haemophilus influenzae Rd
gcuaucuuaccuuuuucu

SEQ ID NO: 2709627 - RNA, 13 nt, Haemophilus influenzae Rd
gcuaugauuuuaa

SEQ ID NO: 2709628 - RNA, 18 nt, Haemophilus influenzae Rd
gcuaugauuuuaaagcca

SEQ ID NO: 2709629 - RNA, 21 nt, Haemophilus influenzae Rd
gcuauuaauuaacgcucaaaa

SEQ ID NO: 2709630 - RNA, 19 nt, Haemophilus influenzae Rd
gcuauucccgcauuuauca

SEQ ID NO: 2709631 - RNA, 23 nt, Haemophilus influenzae Rd
gcuauuuaauaauuuaaauuuau

SEQ ID NO: 2709632 - RNA, 12 nt, Haemophilus influenzae Rd
gcuauuuucuaa

SEQ ID NO: 2709633 - RNA, 18 nt, Haemophilus influenzae Rd
gcuauuuucuaaugaaau

SEQ ID NO: 2709634 - RNA, 20 nt, Haemophilus influenzae Rd
gcuauuuucuaauuuucaca

SEQ ID NO: 2709635 - RNA, 12 nt, Haemophilus influenzae Rd
gcuauuuugcau

SEQ ID NO: 2709636 - RNA, 17 nt, Haemophilus influenzae Rd
gcuauuuuuaauuuacu

SEQ ID NO: 2709637 - RNA, 22 nt, Haemophilus influenzae Rd
gcuauuuuucgcuacgccuugg

SEQ ID NO: 2709638 - RNA, 13 nt, Haemophilus influenzae Rd
gcucaaaaucaag

SEQ ID NO: 2709639 - RNA, 15 nt, Haemophilus influenzae Rd
gcucaaaaugcucuu

SEQ ID NO: 2709640 - RNA, 12 nt, Haemophilus influenzae Rd
gcucaaauaaau

SEQ ID NO: 2709641 - RNA, 16 nt, Haemophilus influenzae Rd
gcucaaauuuucuguu

SEQ ID NO: 2709642 - RNA, 16 nt, Haemophilus influenzae Rd
gcucaauaauuuucac

SEQ ID NO: 2709643 - RNA, 24 nt, Haemophilus influenzae Rd
gcucaauaccuagcgggauaagau

SEQ ID NO: 2709644 - RNA, 18 nt, Haemophilus influenzae Rd
gcucaauguuaaguucau

SEQ ID NO: 2709645 - RNA, 13 nt, Haemophilus influenzae Rd
gcucacaagacgg

SEQ ID NO: 2709646 - RNA, 16 nt, Haemophilus influenzae Rd
gcucacauccauuccu

SEQ ID NO: 2709647 - RNA, 18 nt, Haemophilus influenzae Rd
gcucagucgguagagcag

SEQ ID NO: 2709648 - RNA, 19 nt, Haemophilus influenzae Rd
gcucagucgguuagagcag

SEQ ID NO: 2709649 - RNA, 15 nt, Haemophilus influenzae Rd
gcucaugauuauaaa

SEQ ID NO: 2709650 - RNA, 23 nt, Haemophilus influenzae Rd
gcucauuuuaaagaguucgucca

SEQ ID NO: 2709651 - RNA, 15 nt, Haemophilus influenzae Rd
gcucauuuuuucucu

SEQ ID NO: 2709652 - RNA, 22 nt, Haemophilus influenzae Rd
gcuccaguuguaaagauugacc

SEQ ID NO: 2709653 - RNA, 19 nt, Haemophilus influenzae Rd
gcuccauuaccguaugcaa

SEQ ID NO: 2709654 - RNA, 20 nt, Haemophilus influenzae Rd
gcucccagugcugaaauaua

SEQ ID NO: 2709655 - RNA, 16 nt, Haemophilus influenzae Rd
gcucccauaaaucggc

SEQ ID NO: 2709656 - RNA, 17 nt, Haemophilus influenzae Rd
gcucccgccccacuuuc

SEQ ID NO: 2709657 - RNA, 22 nt, Haemophilus influenzae Rd
gcuccgccaccuacgccugcga

SEQ ID NO: 2709658 - RNA, 17 nt, Haemophilus influenzae Rd
gcuccuacauuaaaaga

SEQ ID NO: 2709659 - RNA, 16 nt, Haemophilus influenzae Rd
gcuccuacuuuuacaa

SEQ ID NO: 2709660 - RNA, 16 nt, Haemophilus influenzae Rd
gcucgauagcccaagg

SEQ ID NO: 2709661 - RNA, 15 nt, Haemophilus influenzae Rd
gcucgauuuuuaaaa

SEQ ID NO: 2709662 - RNA, 13 nt, Haemophilus influenzae Rd
gcucgcucuucag

SEQ ID NO: 2709663 - RNA, 18 nt, Haemophilus influenzae Rd
gcucgcucuucagcuucu

SEQ ID NO: 2709664 - RNA, 15 nt, Haemophilus influenzae Rd
gcucgcuggaaucaa

SEQ ID NO: 2709665 - RNA, 22 nt, Haemophilus influenzae Rd
gcucguauaauauuuucuuuua

SEQ ID NO: 2709666 - RNA, 19 nt, Haemophilus influenzae Rd
gcucgugauuaucuaaauu

SEQ ID NO: 2709667 - RNA, 15 nt, Haemophilus influenzae Rd
gcucguuauuauuaa

SEQ ID NO: 2709668 - RNA, 14 nt, Haemophilus influenzae Rd
gcucuaaaagcugu

SEQ ID NO: 2709669 - RNA, 17 nt, Haemophilus influenzae Rd
gcucuaccgacugagcu

SEQ ID NO: 2709670 - RNA, 22 nt, Haemophilus influenzae Rd
gcucuaccuaaaauaaauuuug

SEQ ID NO: 2709671 - RNA, 21 nt, Haemophilus influenzae Rd
gcucuacgcaagcgguuaaau

SEQ ID NO: 2709672 - RNA, 19 nt, Haemophilus influenzae Rd
gcucuaguuuuaagguugu

SEQ ID NO: 2709673 - RNA, 14 nt, Haemophilus influenzae Rd
gcucuaucuuauua

SEQ ID NO: 2709674 - RNA, 21 nt, Haemophilus influenzae Rd
gcuucgugaauacgaucugca

SEQ ID NO: 2709675 - RNA, 17 nt, Haemophilus influenzae Rd
gcuucuaauuuuaaaac

SEQ ID NO: 2709676 - RNA, 19 nt, Haemophilus influenzae Rd
gcuucuaauuuuaaaacau

SEQ ID NO: 2709677 - RNA, 13 nt, Haemophilus influenzae Rd
gcuucuaauuuuu

SEQ ID NO: 2709678 - RNA, 16 nt, Haemophilus influenzae Rd
gcuucuaauuuuugca

SEQ ID NO: 2709679 - RNA, 10 nt, Haemophilus influenzae Rd
gcuucugccg

SEQ ID NO: 2709680 - RNA, 15 nt, Haemophilus influenzae Rd
gcuucuucuuccugc

SEQ ID NO: 2709681 - RNA, 18 nt, Haemophilus influenzae Rd
gcuugaauaaauccccca

SEQ ID NO: 2709682 - RNA, 17 nt, Haemophilus influenzae Rd
gcuugaauauuugggaa

SEQ ID NO: 2709683 - RNA, 19 nt, Haemophilus influenzae Rd
gcuugacgaaauaaaucua

SEQ ID NO: 2709684 - RNA, 21 nt, Haemophilus influenzae Rd
gcuugauauaauauuuuggca

SEQ ID NO: 2709685 - RNA, 15 nt, Haemophilus influenzae Rd
gcuugauuuuaaguu

SEQ ID NO: 2709686 - RNA, 22 nt, Haemophilus influenzae Rd
gcuugauuuucagcacugguua

SEQ ID NO: 2709687 - RNA, 21 nt, Haemophilus influenzae Rd
gcuugcauucacuucuaaaac

SEQ ID NO: 2709688 - RNA, 18 nt, Haemophilus influenzae Rd
gcuugccagucauuuuuu

SEQ ID NO: 2709689 - RNA, 22 nt, Haemophilus influenzae Rd
gcuugcgcugaaagaaauuuua

SEQ ID NO: 2709690 - RNA, 19 nt, Haemophilus influenzae Rd
gcuugcuuacauuuuggca

SEQ ID NO: 2709691 - RNA, 14 nt, Haemophilus influenzae Rd
gcuuggaaauguuu

SEQ ID NO: 2709692 - RNA, 17 nt, Haemophilus influenzae Rd
gcuuggcgaguaaauuu

SEQ ID NO: 2709693 - RNA, 13 nt, Haemophilus influenzae Rd
gcuugggcuuuuu

SEQ ID NO: 2709694 - RNA, 16 nt, Haemophilus influenzae Rd
gcuugguaauaaucaa

SEQ ID NO: 2709695 - RNA, 20 nt, Haemophilus influenzae Rd
gcuugguaguuuuucaccca

SEQ ID NO: 2709696 - RNA, 15 nt, Haemophilus influenzae Rd
gcuugugaaauaaaa

SEQ ID NO: 2709697 - RNA, 20 nt, Haemophilus influenzae Rd
gcuuguggacguuucaaaaa

SEQ ID NO: 2709698 - RNA, 19 nt, Haemophilus influenzae Rd
gcuuguuaauacacuuuua

SEQ ID NO: 2709699 - RNA, 18 nt, Haemophilus influenzae Rd
gcuuguuucaucauucug

SEQ ID NO: 2709700 - RNA, 16 nt, Haemophilus influenzae Rd
gcuuuaaaucaaauaa

SEQ ID NO: 2709701 - RNA, 15 nt, Haemophilus influenzae Rd
gcuuuaacaauuacu

SEQ ID NO: 2709702 - RNA, 17 nt, Haemophilus influenzae Rd
gcuuuaacccauuuauu

SEQ ID NO: 2709703 - RNA, 14 nt, Haemophilus influenzae Rd
gcuuuaacgagaau

SEQ ID NO: 2709704 - RNA, 22 nt, Haemophilus influenzae Rd
gcuuuaacgagaauauuccauu

SEQ ID NO: 2709705 - RNA, 13 nt, Haemophilus influenzae Rd
gcuuuaacugaag

SEQ ID NO: 2709706 - RNA, 15 nt, Haemophilus influenzae Rd
gcuuuaagcuuuucu

SEQ ID NO: 2709707 - RNA, 17 nt, Haemophilus influenzae Rd
gcuuuaagcuuuucuac

SEQ ID NO: 2709708 - RNA, 13 nt, Haemophilus influenzae Rd
gcuuuacaaugag

SEQ ID NO: 2709709 - RNA, 21 nt, Haemophilus influenzae Rd
gcuuuacccgggccaaauaau

SEQ ID NO: 2709710 - RNA, 13 nt, Haemophilus influenzae Rd
gcuuuagcuugau

SEQ ID NO: 2709711 - RNA, 16 nt, Haemophilus influenzae Rd
gcuuuaucaucuuuug

SEQ ID NO: 2709712 - RNA, 21 nt, Haemophilus influenzae Rd
gcuuuauuuaaauuaaaaaga

SEQ ID NO: 2709713 - RNA, 18 nt, Haemophilus influenzae Rd
gcuuuauuuagaauuuuu

SEQ ID NO: 2709714 - RNA, 14 nt, Haemophilus influenzae Rd
gcuuucaauuaaug

SEQ ID NO: 2709715 - RNA, 18 nt, Haemophilus influenzae Rd
gcuuucaauuaaugaacg

SEQ ID NO: 2709716 - RNA, 15 nt, Haemophilus influenzae Rd
gcuuucaauuucacg

SEQ ID NO: 2709717 - RNA, 15 nt, Haemophilus influenzae Rd
gcuuucaauuuucug

SEQ ID NO: 2709718 - RNA, 22 nt, Haemophilus influenzae Rd
gcuuucagauaacguaaguaau

SEQ ID NO: 2709719 - RNA, 18 nt, Haemophilus influenzae Rd
gcuuucauaaauucaucu

SEQ ID NO: 2709720 - RNA, 21 nt, Haemophilus influenzae Rd
gcuuucuaacgcaaacuacaa

SEQ ID NO: 2709721 - RNA, 23 nt, Haemophilus influenzae Rd
gcuuucuagaugaugaaauuuuu

SEQ ID NO: 2709722 - RNA, 14 nt, Haemophilus influenzae Rd
gcuuucuucagcca

SEQ ID NO: 2709723 - RNA, 22 nt, Haemophilus influenzae Rd
gcuuugagccguuauauuuccu

SEQ ID NO: 2709724 - RNA, 15 nt, Haemophilus influenzae Rd
gcuuugagguaaaag

SEQ ID NO: 2709725 - RNA, 23 nt, Haemophilus influenzae Rd
gcuuugagguaaaagugcgguga

SEQ ID NO: 2709726 - RNA, 20 nt, Haemophilus influenzae Rd
gcuuugcugccacuucagcu

SEQ ID NO: 2709727 - RNA, 15 nt, Haemophilus influenzae Rd
gcuuugcuugcccag

SEQ ID NO: 2709728 - RNA, 18 nt, Haemophilus influenzae Rd
gcuuuggcauaaccugcg

SEQ ID NO: 2709729 - RNA, 22 nt, Haemophilus influenzae Rd
gcuuuuaaaauacugcacaauc

SEQ ID NO: 2709730 - RNA, 15 nt, Haemophilus influenzae Rd
gcuuuuaaauuuuua

SEQ ID NO: 2709731 - RNA, 16 nt, Haemophilus influenzae Rd
gcuuuucccucuuuuu

SEQ ID NO: 2709732 - RNA, 11 nt, Haemophilus influenzae Rd
gcuuuucccuu

SEQ ID NO: 2709733 - RNA, 16 nt, Haemophilus influenzae Rd
gcuuuucccuuuucuu

SEQ ID NO: 2709734 - RNA, 13 nt, Haemophilus influenzae Rd
gcuuuucguuucu

SEQ ID NO: 2709735 - RNA, 19 nt, Haemophilus influenzae Rd
gcuuuucuagcaauaaaga

SEQ ID NO: 2709736 - RNA, 18 nt, Haemophilus influenzae Rd
gcuuuucugauaauuuuu

SEQ ID NO: 2709737 - RNA, 13 nt, Haemophilus influenzae Rd
gcuuuucuuguaa

SEQ ID NO: 2709738 - RNA, 19 nt, Haemophilus influenzae Rd
gcuuuugccauauuuaaua

SEQ ID NO: 2709739 - RNA, 15 nt, Haemophilus influenzae Rd
gcuuuugguuuucug

SEQ ID NO: 2709740 - RNA, 15 nt, Haemophilus influenzae Rd
gcuuuuuacaacauu

SEQ ID NO: 2709741 - RNA, 23 nt, Haemophilus influenzae Rd
gcuuuuuacaacauuaccuucug

SEQ ID NO: 2709742 - RNA, 23 nt, Haemophilus influenzae Rd
gcuuuuugcgccaacgcaucuau

SEQ ID NO: 2709743 - RNA, 21 nt, Haemophilus influenzae Rd
gcuuuuuuacugcuugguucu

SEQ ID NO: 2709744 - RNA, 21 nt, Haemophilus influenzae Rd
gcuuuuuuaucgaaacauaaa

SEQ ID NO: 2709745 - RNA, 22 nt, Haemophilus influenzae Rd
gcuuuuuucaaugcuuuuugcg

SEQ ID NO: 2709746 - RNA, 13 nt, Haemophilus influenzae Rd
gcuuuuuuuaauc

SEQ ID NO: 2709747 - RNA, 20 nt, Haemophilus influenzae Rd
ggaaaauagaaaguggcuua

SEQ ID NO: 2709748 - RNA, 20 nt, Haemophilus influenzae Rd
ggaaaauuuggaauaaacuc

SEQ ID NO: 2709749 - RNA, 22 nt, Haemophilus influenzae Rd
ggaaacuacggacuaaauaaau

SEQ ID NO: 2709750 - RNA, 16 nt, Haemophilus influenzae Rd
ggaaagcguugaagcu

SEQ ID NO: 2709751 - RNA, 14 nt, Haemophilus influenzae Rd
ggaaaggcauuaga

SEQ ID NO: 2709752 - RNA, 14 nt, Haemophilus influenzae Rd
ggaaagucgcagua

SEQ ID NO: 2709753 - RNA, 11 nt, Haemophilus influenzae Rd
ggaaaguguag

SEQ ID NO: 2709754 - RNA, 23 nt, Haemophilus influenzae Rd
ggaaaguucucgcaaaagugcgg

SEQ ID NO: 2709755 - RNA, 15 nt, Haemophilus influenzae Rd
ggaaauauuuuaaua

SEQ ID NO: 2709756 - RNA, 13 nt, Haemophilus influenzae Rd
ggaaaucuuggcu

SEQ ID NO: 2709757 - RNA, 22 nt, Haemophilus influenzae Rd
ggaaaucuuggcucauuuuaaa

SEQ ID NO: 2709758 - RNA, 19 nt, Haemophilus influenzae Rd
ggaaauguuugaaggcaaa

SEQ ID NO: 2709759 - RNA, 23 nt, Haemophilus influenzae Rd
ggaacaagaccugcuucuuuuaa

SEQ ID NO: 2709760 - RNA, 14 nt, Haemophilus influenzae Rd
ggaacaguugaaaa

SEQ ID NO: 2709761 - RNA, 12 nt, Haemophilus influenzae Rd
ggaacuucuaaa

SEQ ID NO: 2709762 - RNA, 10 nt, Haemophilus influenzae Rd
ggaagaaaaa

SEQ ID NO: 2709763 - RNA, 14 nt, Haemophilus influenzae Rd
ggaagaugaaagug

SEQ ID NO: 2709764 - RNA, 18 nt, Haemophilus influenzae Rd
ggaagcauuucuaaagga

SEQ ID NO: 2709765 - RNA, 12 nt, Haemophilus influenzae Rd
ggaaguaauauu

SEQ ID NO: 2709766 - RNA, 16 nt, Haemophilus influenzae Rd
ggaaguaauauuucuu

SEQ ID NO: 2709767 - RNA, 19 nt, Haemophilus influenzae Rd
ggaaguuaauggguuaaaa

SEQ ID NO: 2709768 - RNA, 15 nt, Haemophilus influenzae Rd
ggaauaaaauaaucu

SEQ ID NO: 2709769 - RNA, 13 nt, Haemophilus influenzae Rd
ggaauaaagcaac

SEQ ID NO: 2709770 - RNA, 18 nt, Haemophilus influenzae Rd
ggaauaaauugaauaucu

SEQ ID NO: 2709771 - RNA, 18 nt, Haemophilus influenzae Rd
ggaauaacacaccaacaa

SEQ ID NO: 2709772 - RNA, 18 nt, Haemophilus influenzae Rd
ggaauaagauaacaucac

SEQ ID NO: 2709773 - RNA, 15 nt, Haemophilus influenzae Rd
ggaauagccgauuga

SEQ ID NO: 2709774 - RNA, 15 nt, Haemophilus influenzae Rd
ggaauaucauuagca

SEQ ID NO: 2709775 - RNA, 15 nt, Haemophilus influenzae Rd
ggaaugaucugcacc

SEQ ID NO: 2709776 - RNA, 19 nt, Haemophilus influenzae Rd
ggaauggauguaaugagca

SEQ ID NO: 2709777 - RNA, 16 nt, Haemophilus influenzae Rd
ggaauucgaagguaua

SEQ ID NO: 2709778 - RNA, 19 nt, Haemophilus influenzae Rd
ggaauucuucuggcauauc

SEQ ID NO: 2709779 - RNA, 16 nt, Haemophilus influenzae Rd
ggaauugcauuaagaa

SEQ ID NO: 2709780 - RNA, 17 nt, Haemophilus influenzae Rd
ggaauuucagaaaucgu

SEQ ID NO: 2709781 - RNA, 18 nt, Haemophilus influenzae Rd
ggaauuugcucaauaauu

SEQ ID NO: 2709782 - RNA, 18 nt, Haemophilus influenzae Rd
ggacaccgcuaaaccuug

SEQ ID NO: 2709783 - RNA, 16 nt, Haemophilus influenzae Rd
ggacguuuuaauaguu

SEQ ID NO: 2709784 - RNA, 15 nt, Haemophilus influenzae Rd
ggacuaaacuuuuaa

SEQ ID NO: 2709785 - RNA, 18 nt, Haemophilus influenzae Rd
ggacugaguucugucauu

SEQ ID NO: 2709786 - RNA, 21 nt, Haemophilus influenzae Rd
ggacuggacuccaaggcaauu

SEQ ID NO: 2709787 - RNA, 14 nt, Haemophilus influenzae Rd
ggagaaaagcaugg

SEQ ID NO: 2709788 - RNA, 17 nt, Haemophilus influenzae Rd
ggagaaacauuuuuccc

SEQ ID NO: 2709789 - RNA, 23 nt, Haemophilus influenzae Rd
ggagaaagcuugcuuucuugcug

SEQ ID NO: 2709790 - RNA, 23 nt, Haemophilus influenzae Rd
ggagaacuucaaauuguacuuuu

SEQ ID NO: 2709791 - RNA, 14 nt, Haemophilus influenzae Rd
ggagaauaacaugc

SEQ ID NO: 2709792 - RNA, 13 nt, Haemophilus influenzae Rd
ggagauaaauaaa

SEQ ID NO: 2709793 - RNA, 17 nt, Haemophilus influenzae Rd
ggagauacgaaauagcg

SEQ ID NO: 2709794 - RNA, 23 nt, Haemophilus influenzae Rd
ggagauuuccaucuaaaaguugg

SEQ ID NO: 2709795 - RNA, 14 nt, Haemophilus influenzae Rd
ggagccaaauuuaa

SEQ ID NO: 2709796 - RNA, 16 nt, Haemophilus influenzae Rd
ggaguggacauaagag

SEQ ID NO: 2709797 - RNA, 19 nt, Haemophilus influenzae Rd
ggaguuagcucucuuuuua

SEQ ID NO: 2709798 - RNA, 16 nt, Haemophilus influenzae Rd
ggaguuguuuaaaauu

SEQ ID NO: 2709799 - RNA, 13 nt, Haemophilus influenzae Rd
ggauaaaauaaac

SEQ ID NO: 2709800 - RNA, 17 nt, Haemophilus influenzae Rd
ggauaacccuccgcauu

SEQ ID NO: 2709801 - RNA, 17 nt, Haemophilus influenzae Rd
ggauaauguucuuuuaa

SEQ ID NO: 2709802 - RNA, 23 nt, Haemophilus influenzae Rd
ggauaauuuagcccgaaaauuaa

SEQ ID NO: 2709803 - RNA, 15 nt, Haemophilus influenzae Rd
ggauaucuuguugau

SEQ ID NO: 2709804 - RNA, 14 nt, Haemophilus influenzae Rd
ggauauggauauuc

SEQ ID NO: 2709805 - RNA, 13 nt, Haemophilus influenzae Rd
ggauauuuuauug

SEQ ID NO: 2709806 - RNA, 15 nt, Haemophilus influenzae Rd
ggauauuuuuuauua

SEQ ID NO: 2709807 - RNA, 11 nt, Haemophilus influenzae Rd
ggaucuuccaa

SEQ ID NO: 2709808 - RNA, 12 nt, Haemophilus influenzae Rd
ggaugcuaauuc

SEQ ID NO: 2709809 - RNA, 16 nt, Haemophilus influenzae Rd
ggauguucaaguaaau

SEQ ID NO: 2709810 - RNA, 16 nt, Haemophilus influenzae Rd
ggauuaagaaaauugu

SEQ ID NO: 2709811 - RNA, 13 nt, Haemophilus influenzae Rd
ggauuaaucaauu

SEQ ID NO: 2709812 - RNA, 15 nt, Haemophilus influenzae Rd
ggauuaauuucucgc

SEQ ID NO: 2709813 - RNA, 23 nt, Haemophilus influenzae Rd
ggauuaccacccaaaauuucagc

SEQ ID NO: 2709814 - RNA, 22 nt, Haemophilus influenzae Rd
ggauuaccacuugccaaacauu

SEQ ID NO: 2709815 - RNA, 13 nt, Haemophilus influenzae Rd
ggauuacuuucau

SEQ ID NO: 2709816 - RNA, 15 nt, Haemophilus influenzae Rd
ggauuagaaaugauc

SEQ ID NO: 2709817 - RNA, 18 nt, Haemophilus influenzae Rd
ggauuagcauaaaauuaa

SEQ ID NO: 2709818 - RNA, 16 nt, Haemophilus influenzae Rd
ggauuaucuauaucuu

SEQ ID NO: 2709819 - RNA, 19 nt, Haemophilus influenzae Rd
ggauuaucuauaucuuuaa

SEQ ID NO: 2709820 - RNA, 18 nt, Haemophilus influenzae Rd
ggauuggaccguuuggua

SEQ ID NO: 2709821 - RNA, 12 nt, Haemophilus influenzae Rd
ggauuggauuuu

SEQ ID NO: 2709822 - RNA, 17 nt, Haemophilus influenzae Rd
ggauuuaaaaucccucg

SEQ ID NO: 2709823 - RNA, 17 nt, Haemophilus influenzae Rd
ggauuuauuauuuaaua

SEQ ID NO: 2709824 - RNA, 21 nt, Haemophilus influenzae Rd
ggauuuauuauuuaauacgaa

SEQ ID NO: 2709825 - RNA, 11 nt, Haemophilus influenzae Rd
ggauuuuaaau

SEQ ID NO: 2709826 - RNA, 17 nt, Haemophilus influenzae Rd
ggauuuuguaaccuuag

SEQ ID NO: 2709827 - RNA, 19 nt, Haemophilus influenzae Rd
ggauuuuuucuaauccaga

SEQ ID NO: 2709828 - RNA, 20 nt, Haemophilus influenzae Rd
ggcaaaaccgcuauuacuua

SEQ ID NO: 2709829 - RNA, 15 nt, Haemophilus influenzae Rd
ggcaaacaaaauaaa

SEQ ID NO: 2709830 - RNA, 17 nt, Haemophilus influenzae Rd
ggcaaacgcucuuuaau

SEQ ID NO: 2709831 - RNA, 19 nt, Haemophilus influenzae Rd
ggcaaacguggucgcagug

SEQ ID NO: 2709832 - RNA, 12 nt, Haemophilus influenzae Rd
ggcaaagguuuu

SEQ ID NO: 2709833 - RNA, 22 nt, Haemophilus influenzae Rd
ggcaacagugauacuucgggga

SEQ ID NO: 2709834 - RNA, 16 nt, Haemophilus influenzae Rd
ggcaacgccaauaaaa

SEQ ID NO: 2709835 - RNA, 17 nt, Haemophilus influenzae Rd
ggcaacucaguuuuuga

SEQ ID NO: 2709836 - RNA, 20 nt, Haemophilus influenzae Rd
ggcaagucccuguucaaauu

SEQ ID NO: 2709837 - RNA, 18 nt, Haemophilus influenzae Rd
ggcaagucugcugaaaua

SEQ ID NO: 2709838 - RNA, 13 nt, Haemophilus influenzae Rd
ggcaauaauuuaa

SEQ ID NO: 2709839 - RNA, 21 nt, Haemophilus influenzae Rd
ggcaauucgugaagugauucg

SEQ ID NO: 2709840 - RNA, 14 nt, Haemophilus influenzae Rd
ggcaauuggauaaa

SEQ ID NO: 2709841 - RNA, 21 nt, Haemophilus influenzae Rd
ggcaauuuuagcuaauggcug

SEQ ID NO: 2709842 - RNA, 14 nt, Haemophilus influenzae Rd
ggcaauuuuuuguc

SEQ ID NO: 2709843 - RNA, 17 nt, Haemophilus influenzae Rd
ggcacaacgguugaaau

SEQ ID NO: 2709844 - RNA, 13 nt, Haemophilus influenzae Rd
ggcacauaaauca

SEQ ID NO: 2709845 - RNA, 12 nt, Haemophilus influenzae Rd
ggcacauaagua

SEQ ID NO: 2709846 - RNA, 22 nt, Haemophilus influenzae Rd
ggcacauaaguaaaauagucac

SEQ ID NO: 2709847 - RNA, 13 nt, Haemophilus influenzae Rd
ggcacaucaaauu

SEQ ID NO: 2709848 - RNA, 20 nt, Haemophilus influenzae Rd
ggcaccgaauguggcagcaa

SEQ ID NO: 2709849 - RNA, 16 nt, Haemophilus influenzae Rd
ggcaccuuuuugcucu

SEQ ID NO: 2709850 - RNA, 11 nt, Haemophilus influenzae Rd
ggcacuuugca

SEQ ID NO: 2709851 - RNA, 20 nt, Haemophilus influenzae Rd
ggcagaauuucgucaaaaau

SEQ ID NO: 2709852 - RNA, 18 nt, Haemophilus influenzae Rd
ggcagagcaagauuuaaa

SEQ ID NO: 2709853 - RNA, 15 nt, Haemophilus influenzae Rd
ggcauaauuugguua

SEQ ID NO: 2709854 - RNA, 18 nt, Haemophilus influenzae Rd
ggcauacuuaacaaaucc

SEQ ID NO: 2709855 - RNA, 12 nt, Haemophilus influenzae Rd
ggcauagaaaag

SEQ ID NO: 2709856 - RNA, 19 nt, Haemophilus influenzae Rd
ggcauauaagauuuuugcc

SEQ ID NO: 2709857 - RNA, 17 nt, Haemophilus influenzae Rd
ggcauaucugcugcugg

SEQ ID NO: 2709858 - RNA, 15 nt, Haemophilus influenzae Rd
ggcaucaaaauucaa

SEQ ID NO: 2709859 - RNA, 21 nt, Haemophilus influenzae Rd
ggcaucaucauuuuuugcuuc

SEQ ID NO: 2709860 - RNA, 16 nt, Haemophilus influenzae Rd
ggcaugaauaucuucc

SEQ ID NO: 2709861 - RNA, 20 nt, Haemophilus influenzae Rd
ggcauggacguagucggcga

SEQ ID NO: 2709862 - RNA, 23 nt, Haemophilus influenzae Rd
ggcauuuagagggauaaaaauca

SEQ ID NO: 2709863 - RNA, 16 nt, Haemophilus influenzae Rd
ggcauuucaagcuggu

SEQ ID NO: 2709864 - RNA, 21 nt, Haemophilus influenzae Rd
ggcauuuuguaagcaacacag

SEQ ID NO: 2709865 - RNA, 16 nt, Haemophilus influenzae Rd
ggccacgagcgugaag

SEQ ID NO: 2709866 - RNA, 21 nt, Haemophilus influenzae Rd
ggccauacgcuugauugcacu

SEQ ID NO: 2709867 - RNA, 13 nt, Haemophilus influenzae Rd
ggcccaacagaaa

SEQ ID NO: 2709868 - RNA, 17 nt, Haemophilus influenzae Rd
ggcccaaggauaaucgg

SEQ ID NO: 2709869 - RNA, 17 nt, Haemophilus influenzae Rd
ggcccaucauuuguuaa

SEQ ID NO: 2709870 - RNA, 14 nt, Haemophilus influenzae Rd
ggccuuuacuaaag

SEQ ID NO: 2709871 - RNA, 17 nt, Haemophilus influenzae Rd
ggcgaaauaucgcccuu

SEQ ID NO: 2709872 - RNA, 15 nt, Haemophilus influenzae Rd
ggcgaaggcaaauca

SEQ ID NO: 2709873 - RNA, 23 nt, Haemophilus influenzae Rd
ggcgacaaaaugucgcuuucuua

SEQ ID NO: 2709874 - RNA, 21 nt, Haemophilus influenzae Rd
ggcgauaaaaucgcuugccag

SEQ ID NO: 2709875 - RNA, 17 nt, Haemophilus influenzae Rd
ggcgaugaucauaagau

SEQ ID NO: 2709876 - RNA, 14 nt, Haemophilus influenzae Rd
ggcggauuuauuau

SEQ ID NO: 2709877 - RNA, 19 nt, Haemophilus influenzae Rd
ggcggauuuauuauuuaau

SEQ ID NO: 2709878 - RNA, 19 nt, Haemophilus influenzae Rd
ggcgguuugaaauuuaugu

SEQ ID NO: 2709879 - RNA, 18 nt, Haemophilus influenzae Rd
ggcguaaaccuuuuugcg

SEQ ID NO: 2709880 - RNA, 17 nt, Haemophilus influenzae Rd
ggcguaucauacuaaaa

SEQ ID NO: 2709881 - RNA, 18 nt, Haemophilus influenzae Rd
ggcguaucauacuaaaaa

SEQ ID NO: 2709882 - RNA, 17 nt, Haemophilus influenzae Rd
ggcgugaaaaauaucac

SEQ ID NO: 2709883 - RNA, 20 nt, Haemophilus influenzae Rd
ggcguuuuuuauaaacuucu

SEQ ID NO: 2709884 - RNA, 16 nt, Haemophilus influenzae Rd
ggcuaacaaauaaugc

SEQ ID NO: 2709885 - RNA, 18 nt, Haemophilus influenzae Rd
ggcuaacuucuuccacuu

SEQ ID NO: 2709886 - RNA, 14 nt, Haemophilus influenzae Rd
gguggaauguaaaa

SEQ ID NO: 2709887 - RNA, 13 nt, Haemophilus influenzae Rd
gguggauuauaaa

SEQ ID NO: 2709888 - RNA, 18 nt, Haemophilus influenzae Rd
ggugggcugaagcccacc

SEQ ID NO: 2709889 - RNA, 13 nt, Haemophilus influenzae Rd
gguguauuuauaa

SEQ ID NO: 2709890 - RNA, 20 nt, Haemophilus influenzae Rd
gguguauuuuuguuuauuua

SEQ ID NO: 2709891 - RNA, 15 nt, Haemophilus influenzae Rd
ggugucguagaaaua

SEQ ID NO: 2709892 - RNA, 20 nt, Haemophilus influenzae Rd
ggugugccaucacagucuuu

SEQ ID NO: 2709893 - RNA, 12 nt, Haemophilus influenzae Rd
gguuaaaaauag

SEQ ID NO: 2709894 - RNA, 13 nt, Haemophilus influenzae Rd
gguuaaaaauagc

SEQ ID NO: 2709895 - RNA, 11 nt, Haemophilus influenzae Rd
gguuaaagaag

SEQ ID NO: 2709896 - RNA, 16 nt, Haemophilus influenzae Rd
gguuaaagaagcaugu

SEQ ID NO: 2709897 - RNA, 12 nt, Haemophilus influenzae Rd
gguuaaguaauc

SEQ ID NO: 2709898 - RNA, 13 nt, Haemophilus influenzae Rd
gguuaauguaaac

SEQ ID NO: 2709899 - RNA, 13 nt, Haemophilus influenzae Rd
gguuaauuuucac

SEQ ID NO: 2709900 - RNA, 23 nt, Haemophilus influenzae Rd
gguuaauuuuuuguucauuuuaa

SEQ ID NO: 2709901 - RNA, 20 nt, Haemophilus influenzae Rd
gguuacagaaauauuauuaa

SEQ ID NO: 2709902 - RNA, 17 nt, Haemophilus influenzae Rd
gguuacuaaaugugaca

SEQ ID NO: 2709903 - RNA, 24 nt, Haemophilus influenzae Rd
gguuacuaaaugugacauuguaaa

SEQ ID NO: 2709904 - RNA, 14 nt, Haemophilus influenzae Rd
gguuagaucagaaa

SEQ ID NO: 2709905 - RNA, 16 nt, Haemophilus influenzae Rd
gguuagaucagaaaac

SEQ ID NO: 2709906 - RNA, 22 nt, Haemophilus influenzae Rd
gguuaguuguuucaccauuucc

SEQ ID NO: 2709907 - RNA, 18 nt, Haemophilus influenzae Rd
gguuauaaguuuuuugcc

SEQ ID NO: 2709908 - RNA, 20 nt, Haemophilus influenzae Rd
gguuauuuaaaccauuuuaa

SEQ ID NO: 2709909 - RNA, 14 nt, Haemophilus influenzae Rd
gguucaaaaccaaa

SEQ ID NO: 2709910 - RNA, 12 nt, Haemophilus influenzae Rd
gguucaauaaug

SEQ ID NO: 2709911 - RNA, 17 nt, Haemophilus influenzae Rd
gguucgauaucuaaaau

SEQ ID NO: 2709912 - RNA, 17 nt, Haemophilus influenzae Rd
gguucuuuuaauucgcc

SEQ ID NO: 2709913 - RNA, 15 nt, Haemophilus influenzae Rd
gguugaacuucuaaa

SEQ ID NO: 2709914 - RNA, 17 nt, Haemophilus influenzae Rd
gguugaucuacaucagu

SEQ ID NO: 2709915 - RNA, 22 nt, Haemophilus influenzae Rd
gguugauuuuccugaugaauuu

SEQ ID NO: 2709916 - RNA, 18 nt, Haemophilus influenzae Rd
gguugcacccacuaaaau

SEQ ID NO: 2709917 - RNA, 15 nt, Haemophilus influenzae Rd
gguugcauaaaaucu

SEQ ID NO: 2709918 - RNA, 15 nt, Haemophilus influenzae Rd
gguugcuaugcccaa

SEQ ID NO: 2709919 - RNA, 23 nt, Haemophilus influenzae Rd
gguuggaagaaaagcauuaauag

SEQ ID NO: 2709920 - RNA, 21 nt, Haemophilus influenzae Rd
gguuuaaauuuuaaaaaauaa

SEQ ID NO: 2709921 - RNA, 17 nt, Haemophilus influenzae Rd
gguuuacuuuaauuguc

SEQ ID NO: 2709922 - RNA, 15 nt, Haemophilus influenzae Rd
gguuuauagaugaac

SEQ ID NO: 2709923 - RNA, 23 nt, Haemophilus influenzae Rd
gguuuaucuaccacaucaaauuu

SEQ ID NO: 2709924 - RNA, 17 nt, Haemophilus influenzae Rd
gguuuauguaaauaagg

SEQ ID NO: 2709925 - RNA, 19 nt, Haemophilus influenzae Rd
gguuuauguugaugaagac

SEQ ID NO: 2709926 - RNA, 14 nt, Haemophilus influenzae Rd
gguuuauuuucagc

SEQ ID NO: 2709927 - RNA, 17 nt, Haemophilus influenzae Rd
gguuucagaauaaagaa

SEQ ID NO: 2709928 - RNA, 22 nt, Haemophilus influenzae Rd
gguuuccaagaauuuuaauaag

SEQ ID NO: 2709929 - RNA, 16 nt, Haemophilus influenzae Rd
gguuucgauauuaaua

SEQ ID NO: 2709930 - RNA, 19 nt, Haemophilus influenzae Rd
gguuucuaaaugaauaaaa

SEQ ID NO: 2709931 - RNA, 13 nt, Haemophilus influenzae Rd
gguuugaaauuua

SEQ ID NO: 2709932 - RNA, 14 nt, Haemophilus influenzae Rd
gguuugaaauuuau

SEQ ID NO: 2709933 - RNA, 14 nt, Haemophilus influenzae Rd
gguuuuauccugua

SEQ ID NO: 2709934 - RNA, 13 nt, Haemophilus influenzae Rd
gguuuucguauuu

SEQ ID NO: 2709935 - RNA, 14 nt, Haemophilus influenzae Rd
gguuuucuugccaa

SEQ ID NO: 2709936 - RNA, 16 nt, Haemophilus influenzae Rd
gguuuugcaaaccaaa

SEQ ID NO: 2709937 - RNA, 23 nt, Haemophilus influenzae Rd
gguuuugccgcaaacaucaucac

SEQ ID NO: 2709938 - RNA, 11 nt, Haemophilus influenzae Rd
gguuuugugag

SEQ ID NO: 2709939 - RNA, 13 nt, Haemophilus influenzae Rd
gguuuuucuuuua

SEQ ID NO: 2709940 - RNA, 13 nt, Haemophilus influenzae Rd
gguuuuuuuauua

SEQ ID NO: 2709941 - RNA, 17 nt, Haemophilus influenzae Rd
guaaaaaaaugaaauau

SEQ ID NO: 2709942 - RNA, 13 nt, Haemophilus influenzae Rd
guaaaaaaccuug

SEQ ID NO: 2709943 - RNA, 19 nt, Haemophilus influenzae Rd
guaaaaaaucuuuaagugu

SEQ ID NO: 2709944 - RNA, 18 nt, Haemophilus influenzae Rd
guaaaaagaaaagugcgg

SEQ ID NO: 2709945 - RNA, 17 nt, Haemophilus influenzae Rd
guaaaaagugcggugaa

SEQ ID NO: 2709946 - RNA, 12 nt, Haemophilus influenzae Rd
guaaaaauaaaa

SEQ ID NO: 2709947 - RNA, 19 nt, Haemophilus influenzae Rd
guaaaaauauuauguguuu

SEQ ID NO: 2709948 - RNA, 21 nt, Haemophilus influenzae Rd
guaaaacuaauacuucauagu

SEQ ID NO: 2709949 - RNA, 18 nt, Haemophilus influenzae Rd
guaaaauauccacauaac

SEQ ID NO: 2709950 - RNA, 13 nt, Haemophilus influenzae Rd
guaaaauauuaag

SEQ ID NO: 2709951 - RNA, 14 nt, Haemophilus influenzae Rd
guaaaauuaagcaa

SEQ ID NO: 2709952 - RNA, 19 nt, Haemophilus influenzae Rd
guaaaauucuauuaaaaua

SEQ ID NO: 2709953 - RNA, 22 nt, Haemophilus influenzae Rd
guaaaauuucuucuacaccuuc

SEQ ID NO: 2709954 - RNA, 16 nt, Haemophilus influenzae Rd
guaaaauuuuucucac

SEQ ID NO: 2709955 - RNA, 18 nt, Haemophilus influenzae Rd
guaaaauuuuucucacca

SEQ ID NO: 2709956 - RNA, 13 nt, Haemophilus influenzae Rd
guaaacaauuuuc

SEQ ID NO: 2709957 - RNA, 21 nt, Haemophilus influenzae Rd
guaaacaauuuuccugcuuga

SEQ ID NO: 2709958 - RNA, 22 nt, Haemophilus influenzae Rd
guaaaccaaauuucuugcuauc

SEQ ID NO: 2709959 - RNA, 19 nt, Haemophilus influenzae Rd
guaaaccucgccuuguaau

SEQ ID NO: 2709960 - RNA, 16 nt, Haemophilus influenzae Rd
guaaagagagcauauu

SEQ ID NO: 2709961 - RNA, 22 nt, Haemophilus influenzae Rd
guaaagauuguccuuuugccau

SEQ ID NO: 2709962 - RNA, 23 nt, Haemophilus influenzae Rd
guaaagauuguccuuuugccauu

SEQ ID NO: 2709963 - RNA, 21 nt, Haemophilus influenzae Rd
guaaagauuuuucuugcuauu

SEQ ID NO: 2709964 - RNA, 16 nt, Haemophilus influenzae Rd
guaaagcaccauaaug

SEQ ID NO: 2709965 - RNA, 16 nt, Haemophilus influenzae Rd
guaaagcccacaugaa

SEQ ID NO: 2709966 - RNA, 22 nt, Haemophilus influenzae Rd
guaaagcgaguaagggcaaaaa

SEQ ID NO: 2709967 - RNA, 23 nt, Haemophilus influenzae Rd
guaaagcuacaucaacaaauguc

SEQ ID NO: 2709968 - RNA, 20 nt, Haemophilus influenzae Rd
guaaaguuuagcuuuacgua

SEQ ID NO: 2709969 - RNA, 21 nt, Haemophilus influenzae Rd
guaaauaaaaaaauaccgcac

SEQ ID NO: 2709970 - RNA, 13 nt, Haemophilus influenzae Rd
guaaauaaacguc

SEQ ID NO: 2709971 - RNA, 12 nt, Haemophilus influenzae Rd
guaaauaagcca

SEQ ID NO: 2709972 - RNA, 12 nt, Haemophilus influenzae Rd
guaaauacuguu

SEQ ID NO: 2709973 - RNA, 19 nt, Haemophilus influenzae Rd
guaaauaugccuuauauuu

SEQ ID NO: 2709974 - RNA, 19 nt, Haemophilus influenzae Rd
guaaaucuaaaauaaucgg

SEQ ID NO: 2709975 - RNA, 15 nt, Haemophilus influenzae Rd
guaaaugauaaaaau

SEQ ID NO: 2709976 - RNA, 18 nt, Haemophilus influenzae Rd
guaaauuagcaauaccua

SEQ ID NO: 2709977 - RNA, 15 nt, Haemophilus influenzae Rd
guaaauuaugcccaa

SEQ ID NO: 2709978 - RNA, 16 nt, Haemophilus influenzae Rd
guaaauucaauacuua

SEQ ID NO: 2709979 - RNA, 21 nt, Haemophilus influenzae Rd
guaaauucucgguuguuucau

SEQ ID NO: 2709980 - RNA, 17 nt, Haemophilus influenzae Rd
guaaauucuguuuaguc

SEQ ID NO: 2709981 - RNA, 19 nt, Haemophilus influenzae Rd
guaaauucuguuuagucuu

SEQ ID NO: 2709982 - RNA, 18 nt, Haemophilus influenzae Rd
guaaauucuucaaguguu

SEQ ID NO: 2709983 - RNA, 22 nt, Haemophilus influenzae Rd
guaaauugguuaauguaaacaa

SEQ ID NO: 2709984 - RNA, 14 nt, Haemophilus influenzae Rd
guaaauugguuuua

SEQ ID NO: 2709985 - RNA, 17 nt, Haemophilus influenzae Rd
guaaauugguuuuaucc

SEQ ID NO: 2709986 - RNA, 21 nt, Haemophilus influenzae Rd
guaaauuuuaaaaucuuugga

SEQ ID NO: 2709987 - RNA, 22 nt, Haemophilus influenzae Rd
guaaauuuuaaccgcacuuuau

SEQ ID NO: 2709988 - RNA, 15 nt, Haemophilus influenzae Rd
guaaauuuucagcgu

SEQ ID NO: 2709989 - RNA, 23 nt, Haemophilus influenzae Rd
guaaauuuuuauuguguuuugga

SEQ ID NO: 2709990 - RNA, 14 nt, Haemophilus influenzae Rd
guaacguauuuaaa

SEQ ID NO: 2709991 - RNA, 12 nt, Haemophilus influenzae Rd
guaacuaaaaaa

SEQ ID NO: 2709992 - RNA, 14 nt, Haemophilus influenzae Rd
guaguauuuuauuu

SEQ ID NO: 2709993 - RNA, 14 nt, Haemophilus influenzae Rd
guaguguuuuauuu

SEQ ID NO: 2709994 - RNA, 13 nt, Haemophilus influenzae Rd
guaguuaaaccaa

SEQ ID NO: 2709995 - RNA, 20 nt, Haemophilus influenzae Rd
guaguuuagcuaauccuuua

SEQ ID NO: 2709996 - RNA, 19 nt, Haemophilus influenzae Rd
guaguuuucuguauaccaa

SEQ ID NO: 2709997 - RNA, 13 nt, Haemophilus influenzae Rd
guauaaaaaagug

SEQ ID NO: 2709998 - RNA, 18 nt, Haemophilus influenzae Rd
guauaaacaucagugauu

SEQ ID NO: 2709999 - RNA, 22 nt, Haemophilus influenzae Rd
guauaaauaauggcgauaauua

SEQ ID NO: 2710000 - RNA, 12 nt, Haemophilus influenzae Rd
guauaacaaaua

SEQ ID NO: 2710001 - RNA, 22 nt, Haemophilus influenzae Rd
guauaacaaauaggauaaaaau

SEQ ID NO: 2710002 - RNA, 21 nt, Haemophilus influenzae Rd
guauaacguagcgauaaaaua

SEQ ID NO: 2710003 - RNA, 17 nt, Haemophilus influenzae Rd
guauaauuccuaaaaua

SEQ ID NO: 2710004 - RNA, 18 nt, Haemophilus influenzae Rd
guauaauuccuaaaauac

SEQ ID NO: 2710005 - RNA, 18 nt, Haemophilus influenzae Rd
guauagccuucgcuauuu

SEQ ID NO: 2710006 - RNA, 18 nt, Haemophilus influenzae Rd
guauagucauucaaugca

SEQ ID NO: 2710007 - RNA, 23 nt, Haemophilus influenzae Rd
guauauaagcguucguuaucauu

SEQ ID NO: 2710008 - RNA, 18 nt, Haemophilus influenzae Rd
guauauucuguaucaauu

SEQ ID NO: 2710009 - RNA, 16 nt, Haemophilus influenzae Rd
guauauuguuugcuuu

SEQ ID NO: 2710010 - RNA, 12 nt, Haemophilus influenzae Rd
guauauuuaucu

SEQ ID NO: 2710011 - RNA, 17 nt, Haemophilus influenzae Rd
guaucagaaauuaccac

SEQ ID NO: 2710012 - RNA, 19 nt, Haemophilus influenzae Rd
guaucauacuaaaaaauua

SEQ ID NO: 2710013 - RNA, 18 nt, Haemophilus influenzae Rd
guaucauuuaauaauuua

SEQ ID NO: 2710014 - RNA, 23 nt, Haemophilus influenzae Rd
guauccaauccuaaaucugccaa

SEQ ID NO: 2710015 - RNA, 22 nt, Haemophilus influenzae Rd
guaucccgaaagugcgguuaau

SEQ ID NO: 2710016 - RNA, 19 nt, Haemophilus influenzae Rd
guauccgccaaugcuuuua

SEQ ID NO: 2710017 - RNA, 21 nt, Haemophilus influenzae Rd
guaucgacaguugccauugcu

SEQ ID NO: 2710018 - RNA, 19 nt, Haemophilus influenzae Rd
guaucuaaauauauuuuua

SEQ ID NO: 2710019 - RNA, 14 nt, Haemophilus influenzae Rd
guaugaaaaaugcu

SEQ ID NO: 2710020 - RNA, 17 nt, Haemophilus influenzae Rd
guaugaugauuguuauu

SEQ ID NO: 2710021 - RNA, 11 nt, Haemophilus influenzae Rd
guauguauuuu

SEQ ID NO: 2710022 - RNA, 14 nt, Haemophilus influenzae Rd
guauguauuuucaa

SEQ ID NO: 2710023 - RNA, 22 nt, Haemophilus influenzae Rd
guauuaaaaaagugcgguaaau

SEQ ID NO: 2710024 - RNA, 21 nt, Haemophilus influenzae Rd
guauuaaucugauaaauuuug

SEQ ID NO: 2710025 - RNA, 16 nt, Haemophilus influenzae Rd
guauuaccauuuaucu

SEQ ID NO: 2710026 - RNA, 20 nt, Haemophilus influenzae Rd
guauuagguaaauuugguuc

SEQ ID NO: 2710027 - RNA, 12 nt, Haemophilus influenzae Rd
guauuauaccgc

SEQ ID NO: 2710028 - RNA, 16 nt, Haemophilus influenzae Rd
guauucaugauguaau

SEQ ID NO: 2710029 - RNA, 16 nt, Haemophilus influenzae Rd
guauucccaaauuuuu

SEQ ID NO: 2710030 - RNA, 22 nt, Haemophilus influenzae Rd
guauucgugaaucguuuguaaa

SEQ ID NO: 2710031 - RNA, 12 nt, Haemophilus influenzae Rd
guauucuuucca

SEQ ID NO: 2710032 - RNA, 16 nt, Haemophilus influenzae Rd
guauugaacuaaaaua

SEQ ID NO: 2710033 - RNA, 21 nt, Haemophilus influenzae Rd
guauugggcggaucgcuuguu

SEQ ID NO: 2710034 - RNA, 19 nt, Haemophilus influenzae Rd
guauuuaagcugaaauuua

SEQ ID NO: 2710035 - RNA, 23 nt, Haemophilus influenzae Rd
guauuuacaagucucuaugauuu

SEQ ID NO: 2710036 - RNA, 22 nt, Haemophilus influenzae Rd
guauuuauaacacagaugaaaa

SEQ ID NO: 2710037 - RNA, 23 nt, Haemophilus influenzae Rd
guauuuauaacacagaugaaaau

SEQ ID NO: 2710038 - RNA, 17 nt, Haemophilus influenzae Rd
guauuucaacauagugu

SEQ ID NO: 2710039 - RNA, 22 nt, Haemophilus influenzae Rd
guauuuuacggauuuauauauu

SEQ ID NO: 2710040 - RNA, 14 nt, Haemophilus influenzae Rd
guauuuuauuuaua

SEQ ID NO: 2710041 - RNA, 19 nt, Haemophilus influenzae Rd
guauuuuccaugccuaauu

SEQ ID NO: 2710042 - RNA, 18 nt, Haemophilus influenzae Rd
guauuuucuuauugaaga

SEQ ID NO: 2710043 - RNA, 12 nt, Haemophilus influenzae Rd
guauuuuguucu

SEQ ID NO: 2710044 - RNA, 21 nt, Haemophilus influenzae Rd
guauuuuuaaggaaacguaaa

SEQ ID NO: 2710045 - RNA, 20 nt, Haemophilus influenzae Rd
guauuuuugugagugauuuc

SEQ ID NO: 2710046 - RNA, 17 nt, Haemophilus influenzae Rd
guauuuuuuaguuaaau

SEQ ID NO: 2710047 - RNA, 14 nt, Haemophilus influenzae Rd
gucaaaagaaagac

SEQ ID NO: 2710048 - RNA, 15 nt, Haemophilus influenzae Rd
gucaaaagaaagacu

SEQ ID NO: 2710049 - RNA, 17 nt, Haemophilus influenzae Rd
gucaaagccauauucuu

SEQ ID NO: 2710050 - RNA, 22 nt, Haemophilus influenzae Rd
gucaaaugccgcuaaugguugc

SEQ ID NO: 2710051 - RNA, 20 nt, Haemophilus influenzae Rd
gucaaaugugaccgcuuguu

SEQ ID NO: 2710052 - RNA, 23 nt, Haemophilus influenzae Rd
gucaaaugugaccgcuuguuuau

SEQ ID NO: 2710053 - RNA, 15 nt, Haemophilus influenzae Rd
gucaauaaaucccaa

SEQ ID NO: 2710054 - RNA, 22 nt, Haemophilus influenzae Rd
gucaaucaucccuucuuuuaua

SEQ ID NO: 2710055 - RNA, 23 nt, Haemophilus influenzae Rd
gucaauguuauugccuaauaaaa

SEQ ID NO: 2710056 - RNA, 17 nt, Haemophilus influenzae Rd
gucaauuagcaaagaau

SEQ ID NO: 2710057 - RNA, 16 nt, Haemophilus influenzae Rd
gucaauuucaaccgca

SEQ ID NO: 2710058 - RNA, 20 nt, Haemophilus influenzae Rd
gucacaaugauuaauaucac

SEQ ID NO: 2710059 - RNA, 22 nt, Haemophilus influenzae Rd
gucacaccagagugaccaccaa

SEQ ID NO: 2710060 - RNA, 13 nt, Haemophilus influenzae Rd
gucacaggcccau

SEQ ID NO: 2710061 - RNA, 17 nt, Haemophilus influenzae Rd
gucaccaucacaagcaa

SEQ ID NO: 2710062 - RNA, 15 nt, Haemophilus influenzae Rd
gucaccguauugcuc

SEQ ID NO: 2710063 - RNA, 17 nt, Haemophilus influenzae Rd
gucacgagcuaaaaaau

SEQ ID NO: 2710064 - RNA, 15 nt, Haemophilus influenzae Rd
gucacgaggauuaau

SEQ ID NO: 2710065 - RNA, 21 nt, Haemophilus influenzae Rd
gucacgauuuuuuuauaaaaa

SEQ ID NO: 2710066 - RNA, 18 nt, Haemophilus influenzae Rd
gucacgcuguaaacaaga

SEQ ID NO: 2710067 - RNA, 14 nt, Haemophilus influenzae Rd
gucacuucuucaau

SEQ ID NO: 2710068 - RNA, 14 nt, Haemophilus influenzae Rd
gucagaaagcggau

SEQ ID NO: 2710069 - RNA, 20 nt, Haemophilus influenzae Rd
gucagauuuacccaaauuau

SEQ ID NO: 2710070 - RNA, 14 nt, Haemophilus influenzae Rd
gucagauuuauaaa

SEQ ID NO: 2710071 - RNA, 18 nt, Haemophilus influenzae Rd
gucagauuuauaaauagg

SEQ ID NO: 2710072 - RNA, 22 nt, Haemophilus influenzae Rd
gucagauuuauaaauaggcuca

SEQ ID NO: 2710073 - RNA, 23 nt, Haemophilus influenzae Rd
gucagcaaauuaucugauguuua

SEQ ID NO: 2710074 - RNA, 18 nt, Haemophilus influenzae Rd
gucaggaucgguaaguug

SEQ ID NO: 2710075 - RNA, 19 nt, Haemophilus influenzae Rd
gucaguaaaccaagugaaa

SEQ ID NO: 2710076 - RNA, 17 nt, Haemophilus influenzae Rd
gucauacuuauuuuggg

SEQ ID NO: 2710077 - RNA, 15 nt, Haemophilus influenzae Rd
gucauagcuaaacau

SEQ ID NO: 2710078 - RNA, 12 nt, Haemophilus influenzae Rd
gucauauucauu

SEQ ID NO: 2710079 - RNA, 19 nt, Haemophilus influenzae Rd
gucaucagaaauaucuuca

SEQ ID NO: 2710080 - RNA, 22 nt, Haemophilus influenzae Rd
gucaucauagucaggugcacga

SEQ ID NO: 2710081 - RNA, 17 nt, Haemophilus influenzae Rd
gucaucgaguuuuauaa

SEQ ID NO: 2710082 - RNA, 13 nt, Haemophilus influenzae Rd
gucaucuaauugu

SEQ ID NO: 2710083 - RNA, 22 nt, Haemophilus influenzae Rd
gucaucuaguaccugauuugua

SEQ ID NO: 2710084 - RNA, 17 nt, Haemophilus influenzae Rd
gucaugacuauuacaau

SEQ ID NO: 2710085 - RNA, 18 nt, Haemophilus influenzae Rd
gucaugccgcaaucaagc

SEQ ID NO: 2710086 - RNA, 22 nt, Haemophilus influenzae Rd
gucaugccgcaaucaagcaaau

SEQ ID NO: 2710087 - RNA, 16 nt, Haemophilus influenzae Rd
gucaugggauaaacau

SEQ ID NO: 2710088 - RNA, 20 nt, Haemophilus influenzae Rd
gucaugggauaaacauuucu

SEQ ID NO: 2710089 - RNA, 13 nt, Haemophilus influenzae Rd
gucauuaaaaaau

SEQ ID NO: 2710090 - RNA, 13 nt, Haemophilus influenzae Rd
gucauuaaugcau

SEQ ID NO: 2710091 - RNA, 18 nt, Haemophilus influenzae Rd
gucauucaaugcagaaau

SEQ ID NO: 2710092 - RNA, 23 nt, Haemophilus influenzae Rd
gucauugauggcucgaaaguuac

SEQ ID NO: 2710093 - RNA, 16 nt, Haemophilus influenzae Rd
gucauugccauuucug

SEQ ID NO: 2710094 - RNA, 17 nt, Haemophilus influenzae Rd
gucauugccauuucugc

SEQ ID NO: 2710095 - RNA, 19 nt, Haemophilus influenzae Rd
gucauuuuuguuucaguuu

SEQ ID NO: 2710096 - RNA, 13 nt, Haemophilus influenzae Rd
guccaaaaucucu

SEQ ID NO: 2710097 - RNA, 19 nt, Haemophilus influenzae Rd
gugcagauuuuuuuauaaa

SEQ ID NO: 2710098 - RNA, 17 nt, Haemophilus influenzae Rd
gugcagcccaaauaaag

SEQ ID NO: 2710099 - RNA, 21 nt, Haemophilus influenzae Rd
gugcaguuucaguaucacgca

SEQ ID NO: 2710100 - RNA, 13 nt, Haemophilus influenzae Rd
gugcauuuuucau

SEQ ID NO: 2710101 - RNA, 17 nt, Haemophilus influenzae Rd
gugccaguucaagucug

SEQ ID NO: 2710102 - RNA, 21 nt, Haemophilus influenzae Rd
gugcccgcuacaaauaagcca

SEQ ID NO: 2710103 - RNA, 18 nt, Haemophilus influenzae Rd
gugcgaauuaaacggcuc

SEQ ID NO: 2710104 - RNA, 22 nt, Haemophilus influenzae Rd
gugcgaccucgccauuuuucaa

SEQ ID NO: 2710105 - RNA, 15 nt, Haemophilus influenzae Rd
gugcgauuaacaaua

SEQ ID NO: 2710106 - RNA, 17 nt, Haemophilus influenzae Rd
gugcgcauauacuucuu

SEQ ID NO: 2710107 - RNA, 22 nt, Haemophilus influenzae Rd
gugcgcguaccaaauuccauuc

SEQ ID NO: 2710108 - RNA, 15 nt, Haemophilus influenzae Rd
gugcggcaaaaaaug

SEQ ID NO: 2710109 - RNA, 15 nt, Haemophilus influenzae Rd
gugcgguaaaaaaau

SEQ ID NO: 2710110 - RNA, 15 nt, Haemophilus influenzae Rd
gugcgguaaaauuuc

SEQ ID NO: 2710111 - RNA, 16 nt, Haemophilus influenzae Rd
gugcgguaagaaaauc

SEQ ID NO: 2710112 - RNA, 18 nt, Haemophilus influenzae Rd
gugcgguuaaaaauucuu

SEQ ID NO: 2710113 - RNA, 12 nt, Haemophilus influenzae Rd
gugcgguuaguu

SEQ ID NO: 2710114 - RNA, 12 nt, Haemophilus influenzae Rd
gugcgguugaaa

SEQ ID NO: 2710115 - RNA, 18 nt, Haemophilus influenzae Rd
gugcuaaauuuuuuugca

SEQ ID NO: 2710116 - RNA, 15 nt, Haemophilus influenzae Rd
gugcucgauuuuuaa

SEQ ID NO: 2710117 - RNA, 19 nt, Haemophilus influenzae Rd
gugcuuacuuuauuuuuaa

SEQ ID NO: 2710118 - RNA, 18 nt, Haemophilus influenzae Rd
gugcuuucauagaugauu

SEQ ID NO: 2710119 - RNA, 13 nt, Haemophilus influenzae Rd
gugcuuuuuacaa

SEQ ID NO: 2710120 - RNA, 12 nt, Haemophilus influenzae Rd
gugcuuuuucaa

SEQ ID NO: 2710121 - RNA, 14 nt, Haemophilus influenzae Rd
guggaaacgugcaa

SEQ ID NO: 2710122 - RNA, 16 nt, Haemophilus influenzae Rd
guggaaacgugcaauu

SEQ ID NO: 2710123 - RNA, 19 nt, Haemophilus influenzae Rd
guggaaacuaauuuuguug

SEQ ID NO: 2710124 - RNA, 16 nt, Haemophilus influenzae Rd
guggaaagguugcuau

SEQ ID NO: 2710125 - RNA, 18 nt, Haemophilus influenzae Rd
guggaacaaagguuaaac

SEQ ID NO: 2710126 - RNA, 14 nt, Haemophilus influenzae Rd
guggaacucuuuca

SEQ ID NO: 2710127 - RNA, 13 nt, Haemophilus influenzae Rd
guggaaggaacaa

SEQ ID NO: 2710128 - RNA, 13 nt, Haemophilus influenzae Rd
guggaauaaaagu

SEQ ID NO: 2710129 - RNA, 13 nt, Haemophilus influenzae Rd
guggaauaaaaua

SEQ ID NO: 2710130 - RNA, 15 nt, Haemophilus influenzae Rd
guggaauguaaaaau

SEQ ID NO: 2710131 - RNA, 19 nt, Haemophilus influenzae Rd
guggaauuucauaaacggu

SEQ ID NO: 2710132 - RNA, 19 nt, Haemophilus influenzae Rd
guggacgagauaaaacuug

SEQ ID NO: 2710133 - RNA, 17 nt, Haemophilus influenzae Rd
guggacguuucaaaaau

SEQ ID NO: 2710134 - RNA, 20 nt, Haemophilus influenzae Rd
guggaucguaaauuaauaag

SEQ ID NO: 2710135 - RNA, 22 nt, Haemophilus influenzae Rd
guggaugaccaacaccauucca

SEQ ID NO: 2710136 - RNA, 17 nt, Haemophilus influenzae Rd
guggcauaaagaaacag

SEQ ID NO: 2710137 - RNA, 16 nt, Haemophilus influenzae Rd
guggcguaaugguuuc

SEQ ID NO: 2710138 - RNA, 14 nt, Haemophilus influenzae Rd
guggcgucaagccu

SEQ ID NO: 2710139 - RNA, 14 nt, Haemophilus influenzae Rd
guggcguuuuaucg

SEQ ID NO: 2710140 - RNA, 19 nt, Haemophilus influenzae Rd
guggcuuuaaagguuuaaa

SEQ ID NO: 2710141 - RNA, 20 nt, Haemophilus influenzae Rd
guggcuuuucagcuaaaauu

SEQ ID NO: 2710142 - RNA, 21 nt, Haemophilus influenzae Rd
guggcuuuucugauaauuuuu

SEQ ID NO: 2710143 - RNA, 21 nt, Haemophilus influenzae Rd
guggcuuuuguuuauaucuuu

SEQ ID NO: 2710144 - RNA, 20 nt, Haemophilus influenzae Rd
gugggcugaagcccacccua

SEQ ID NO: 2710145 - RNA, 19 nt, Haemophilus influenzae Rd
guggggaaaaauauuaaag

SEQ ID NO: 2710146 - RNA, 22 nt, Haemophilus influenzae Rd
gugguaaaaaucucuugcucac

SEQ ID NO: 2710147 - RNA, 14 nt, Haemophilus influenzae Rd
guggugcaaccugu

SEQ ID NO: 2710148 - RNA, 16 nt, Haemophilus influenzae Rd
gugguggaauaaauaa

SEQ ID NO: 2710149 - RNA, 19 nt, Haemophilus influenzae Rd
gugguuauuugauuaucua

SEQ ID NO: 2710150 - RNA, 16 nt, Haemophilus influenzae Rd
gugguuucagaauaaa

SEQ ID NO: 2710151 - RNA, 13 nt, Haemophilus influenzae Rd
gugguuuuuguuu

SEQ ID NO: 2710152 - RNA, 21 nt, Haemophilus influenzae Rd
guguacacaaugcuaucaggc

SEQ ID NO: 2710153 - RNA, 16 nt, Haemophilus influenzae Rd
guguagcaauaaacag

SEQ ID NO: 2710154 - RNA, 17 nt, Haemophilus influenzae Rd
guguagcaauaaacaga

SEQ ID NO: 2710155 - RNA, 18 nt, Haemophilus influenzae Rd
guguauuaaguaaauauu

SEQ ID NO: 2710156 - RNA, 22 nt, Haemophilus influenzae Rd
guguauuuuuaucuaaauuccu

SEQ ID NO: 2710157 - RNA, 20 nt, Haemophilus influenzae Rd
gugucaaauuaauuaaucaa

SEQ ID NO: 2710158 - RNA, 13 nt, Haemophilus influenzae Rd
gugugaaauuccu

SEQ ID NO: 2710159 - RNA, 17 nt, Haemophilus influenzae Rd
gugugauuuuagaaaaa

SEQ ID NO: 2710160 - RNA, 21 nt, Haemophilus influenzae Rd
gugugcacccgccgcaccuaa

SEQ ID NO: 2710161 - RNA, 14 nt, Haemophilus influenzae Rd
guguggugauuuua

SEQ ID NO: 2710162 - RNA, 23 nt, Haemophilus influenzae Rd
guguuaaacgacgcauuccuucg

SEQ ID NO: 2710163 - RNA, 14 nt, Haemophilus influenzae Rd
guguuaagcaccau

SEQ ID NO: 2710164 - RNA, 14 nt, Haemophilus influenzae Rd
guguuaucacaauu

SEQ ID NO: 2710165 - RNA, 20 nt, Haemophilus influenzae Rd
guguucuagugcaacaacaa

SEQ ID NO: 2710166 - RNA, 22 nt, Haemophilus influenzae Rd
guguuuuuucaccuugaucuac

SEQ ID NO: 2710167 - RNA, 20 nt, Haemophilus influenzae Rd
guuaaaaguaagcaauuuuc

SEQ ID NO: 2710168 - RNA, 21 nt, Haemophilus influenzae Rd
guuaaaaguaagcaauuuucu

SEQ ID NO: 2710169 - RNA, 11 nt, Haemophilus influenzae Rd
guuaaaagugc

SEQ ID NO: 2710170 - RNA, 15 nt, Haemophilus influenzae Rd
guuaaaaguuuuuua

SEQ ID NO: 2710171 - RNA, 18 nt, Haemophilus influenzae Rd
guuaaaauacgcucaaaa

SEQ ID NO: 2710172 - RNA, 10 nt, Haemophilus influenzae Rd
guuaaaauau

SEQ ID NO: 2710173 - RNA, 12 nt, Haemophilus influenzae Rd
guuaaaauugcc

SEQ ID NO: 2710174 - RNA, 23 nt, Haemophilus influenzae Rd
guuaaacugccgccuucuuccac

SEQ ID NO: 2710175 - RNA, 23 nt, Haemophilus influenzae Rd
guuaaagcacccaucacauuuuc

SEQ ID NO: 2710176 - RNA, 14 nt, Haemophilus influenzae Rd
guuaaauaaacaca

SEQ ID NO: 2710177 - RNA, 22 nt, Haemophilus influenzae Rd
guuaaauugaacugaauuaaaa

SEQ ID NO: 2710178 - RNA, 11 nt, Haemophilus influenzae Rd
guuaaauuuag

SEQ ID NO: 2710179 - RNA, 22 nt, Haemophilus influenzae Rd
guuaaauuuaugcuguuuuaua

SEQ ID NO: 2710180 - RNA, 16 nt, Haemophilus influenzae Rd
guuaacgcuuuugcaa

SEQ ID NO: 2710181 - RNA, 18 nt, Haemophilus influenzae Rd
guuaagcaaauuucuguu

SEQ ID NO: 2710182 - RNA, 18 nt, Haemophilus influenzae Rd
guuaagccgauauuaucu

SEQ ID NO: 2710183 - RNA, 13 nt, Haemophilus influenzae Rd
guuaagccugaua

SEQ ID NO: 2710184 - RNA, 21 nt, Haemophilus influenzae Rd
guuaagcuaccugccauaaua

SEQ ID NO: 2710185 - RNA, 14 nt, Haemophilus influenzae Rd
guuaaggauuuuug

SEQ ID NO: 2710186 - RNA, 17 nt, Haemophilus influenzae Rd
guuaaguucagaaagag

SEQ ID NO: 2710187 - RNA, 18 nt, Haemophilus influenzae Rd
guuaaguucagaaagaga

SEQ ID NO: 2710188 - RNA, 17 nt, Haemophilus influenzae Rd
guuaaguucaucauaaa

SEQ ID NO: 2710189 - RNA, 17 nt, Haemophilus influenzae Rd
guuaauaaugcuaauuu

SEQ ID NO: 2710190 - RNA, 21 nt, Haemophilus influenzae Rd
guuaauaaugcuaauuucaaa

SEQ ID NO: 2710191 - RNA, 14 nt, Haemophilus influenzae Rd
guuaauaguuguuu

SEQ ID NO: 2710192 - RNA, 17 nt, Haemophilus influenzae Rd
guuaauauauucaauuc

SEQ ID NO: 2710193 - RNA, 21 nt, Haemophilus influenzae Rd
guuaauccuaaauuaugcucc

SEQ ID NO: 2710194 - RNA, 16 nt, Haemophilus influenzae Rd
guuaaugaaacuucac

SEQ ID NO: 2710195 - RNA, 15 nt, Haemophilus influenzae Rd
guuaauggguuaaaa

SEQ ID NO: 2710196 - RNA, 21 nt, Haemophilus influenzae Rd
guuaauguuuucuugaccuuc

SEQ ID NO: 2710197 - RNA, 16 nt, Haemophilus influenzae Rd
guuaauuaauugcucu

SEQ ID NO: 2710198 - RNA, 15 nt, Haemophilus influenzae Rd
guuaauuagaauaac

SEQ ID NO: 2710199 - RNA, 17 nt, Haemophilus influenzae Rd
guuaauuaucaaaaaga

SEQ ID NO: 2710200 - RNA, 20 nt, Haemophilus influenzae Rd
guuaauuaucaaaaagaaau

SEQ ID NO: 2710201 - RNA, 13 nt, Haemophilus influenzae Rd
guuaauugauuua

SEQ ID NO: 2710202 - RNA, 11 nt, Haemophilus influenzae Rd
guuaauuucug

SEQ ID NO: 2710203 - RNA, 21 nt, Haemophilus influenzae Rd
guucuucugcggucaucucuu

SEQ ID NO: 2710204 - RNA, 12 nt, Haemophilus influenzae Rd
guucuucuggga

SEQ ID NO: 2710205 - RNA, 18 nt, Haemophilus influenzae Rd
guucuucuguuaaacgca

SEQ ID NO: 2710206 - RNA, 23 nt, Haemophilus influenzae Rd
guucuugaugauaaucuucccau

SEQ ID NO: 2710207 - RNA, 17 nt, Haemophilus influenzae Rd
guucuuggauaauuucg

SEQ ID NO: 2710208 - RNA, 21 nt, Haemophilus influenzae Rd
guucuuguuuuaaaucuucua

SEQ ID NO: 2710209 - RNA, 22 nt, Haemophilus influenzae Rd
guucuuguuuuaaaucuucuau

SEQ ID NO: 2710210 - RNA, 13 nt, Haemophilus influenzae Rd
guucuuucuguca

SEQ ID NO: 2710211 - RNA, 17 nt, Haemophilus influenzae Rd
guucuuuguuaccuuuu

SEQ ID NO: 2710212 - RNA, 23 nt, Haemophilus influenzae Rd
guucuuuuaaaagaccacauucu

SEQ ID NO: 2710213 - RNA, 23 nt, Haemophilus influenzae Rd
guugaaacuguuuuggcauuuuc

SEQ ID NO: 2710214 - RNA, 15 nt, Haemophilus influenzae Rd
guugaaauuccucac

SEQ ID NO: 2710215 - RNA, 19 nt, Haemophilus influenzae Rd
guugaaauuuaauaagaau

SEQ ID NO: 2710216 - RNA, 13 nt, Haemophilus influenzae Rd
guugaagaaaguu

SEQ ID NO: 2710217 - RNA, 19 nt, Haemophilus influenzae Rd
guugaagagaauuuucauc

SEQ ID NO: 2710218 - RNA, 13 nt, Haemophilus influenzae Rd
guugaagcuaauu

SEQ ID NO: 2710219 - RNA, 12 nt, Haemophilus influenzae Rd
guugaauuuuuu

SEQ ID NO: 2710220 - RNA, 16 nt, Haemophilus influenzae Rd
guugagaauuuuuucu

SEQ ID NO: 2710221 - RNA, 20 nt, Haemophilus influenzae Rd
guugagcauaacguauuuuc

SEQ ID NO: 2710222 - RNA, 19 nt, Haemophilus influenzae Rd
guugagcgagguaagcuga

SEQ ID NO: 2710223 - RNA, 21 nt, Haemophilus influenzae Rd
guugagcgagguaagcugaag

SEQ ID NO: 2710224 - RNA, 13 nt, Haemophilus influenzae Rd
guugauaaucauc

SEQ ID NO: 2710225 - RNA, 19 nt, Haemophilus influenzae Rd
guugauacggcaaacuaaa

SEQ ID NO: 2710226 - RNA, 13 nt, Haemophilus influenzae Rd
guugauagaaacg

SEQ ID NO: 2710227 - RNA, 12 nt, Haemophilus influenzae Rd
guugaucagcaa

SEQ ID NO: 2710228 - RNA, 16 nt, Haemophilus influenzae Rd
guugaucgcaauguuc

SEQ ID NO: 2710229 - RNA, 17 nt, Haemophilus influenzae Rd
guugaucgcaauguuca

SEQ ID NO: 2710230 - RNA, 23 nt, Haemophilus influenzae Rd
guugauuuuaaaauaucaaaguu

SEQ ID NO: 2710231 - RNA, 12 nt, Haemophilus influenzae Rd
guugauuuuccc

SEQ ID NO: 2710232 - RNA, 18 nt, Haemophilus influenzae Rd
guugcaagauuuccagca

SEQ ID NO: 2710233 - RNA, 23 nt, Haemophilus influenzae Rd
guugcacccacuucgauauuuuc

SEQ ID NO: 2710234 - RNA, 21 nt, Haemophilus influenzae Rd
guugcacuuggguaaauauaa

SEQ ID NO: 2710235 - RNA, 13 nt, Haemophilus influenzae Rd
guugcauaaaauc

SEQ ID NO: 2710236 - RNA, 19 nt, Haemophilus influenzae Rd
guugcauaacuucaccaau

SEQ ID NO: 2710237 - RNA, 18 nt, Haemophilus influenzae Rd
guugccauaaauuuggau

SEQ ID NO: 2710238 - RNA, 15 nt, Haemophilus influenzae Rd
guugccccaucauuu

SEQ ID NO: 2710239 - RNA, 17 nt, Haemophilus influenzae Rd
guugccgccaauccagc

SEQ ID NO: 2710240 - RNA, 18 nt, Haemophilus influenzae Rd
guugccgcugaaaugaag

SEQ ID NO: 2710241 - RNA, 20 nt, Haemophilus influenzae Rd
guugcgguaaaucuacuuua

SEQ ID NO: 2710242 - RNA, 13 nt, Haemophilus influenzae Rd
guugcucuuucaa

SEQ ID NO: 2710243 - RNA, 14 nt, Haemophilus influenzae Rd
guuggaucauuauc

SEQ ID NO: 2710244 - RNA, 19 nt, Haemophilus influenzae Rd
guuggcacuucaauuucac

SEQ ID NO: 2710245 - RNA, 21 nt, Haemophilus influenzae Rd
guuggcggaauuauguauuuu

SEQ ID NO: 2710246 - RNA, 14 nt, Haemophilus influenzae Rd
guugggauuuaucu

SEQ ID NO: 2710247 - RNA, 23 nt, Haemophilus influenzae Rd
guugguaaagccaacuuuuucua

SEQ ID NO: 2710248 - RNA, 19 nt, Haemophilus influenzae Rd
guugguauuuacuaaauuc

SEQ ID NO: 2710249 - RNA, 20 nt, Haemophilus influenzae Rd
guugguucgauaucuaaaau

SEQ ID NO: 2710250 - RNA, 21 nt, Haemophilus influenzae Rd
guugguucgauaucuaaaauu

SEQ ID NO: 2710251 - RNA, 23 nt, Haemophilus influenzae Rd
guugguucgauaucuaaaauucg

SEQ ID NO: 2710252 - RNA, 18 nt, Haemophilus influenzae Rd
guugguuuugcaauuuuu

SEQ ID NO: 2710253 - RNA, 18 nt, Haemophilus influenzae Rd
guuguacuauuuuauaau

SEQ ID NO: 2710254 - RNA, 17 nt, Haemophilus influenzae Rd
guuguacuuuagaaauu

SEQ ID NO: 2710255 - RNA, 22 nt, Haemophilus influenzae Rd
guuguccucccauucuuaaauc

SEQ ID NO: 2710256 - RNA, 20 nt, Haemophilus influenzae Rd
guugucguuauuaugaaauu

SEQ ID NO: 2710257 - RNA, 17 nt, Haemophilus influenzae Rd
guugugaaguuuuuuaa

SEQ ID NO: 2710258 - RNA, 20 nt, Haemophilus influenzae Rd
guugugaguaaaccacaaua

SEQ ID NO: 2710259 - RNA, 12 nt, Haemophilus influenzae Rd
guugugauuuuc

SEQ ID NO: 2710260 - RNA, 22 nt, Haemophilus influenzae Rd
guuguggugcaagguauuucaa

SEQ ID NO: 2710261 - RNA, 15 nt, Haemophilus influenzae Rd
guuguguuucaacaa

SEQ ID NO: 2710262 - RNA, 17 nt, Haemophilus influenzae Rd
guuguucaauuuggaaa

SEQ ID NO: 2710263 - RNA, 14 nt, Haemophilus influenzae Rd
guuguucuaacauu

SEQ ID NO: 2710264 - RNA, 12 nt, Haemophilus influenzae Rd
guuguucuggug

SEQ ID NO: 2710265 - RNA, 12 nt, Haemophilus influenzae Rd
guuguucuucug

SEQ ID NO: 2710266 - RNA, 14 nt, Haemophilus influenzae Rd
guuguucuucuguu

SEQ ID NO: 2710267 - RNA, 22 nt, Haemophilus influenzae Rd
guuguuggcauauucgcaccuu

SEQ ID NO: 2710268 - RNA, 13 nt, Haemophilus influenzae Rd
guuguuuuuuaau

SEQ ID NO: 2710269 - RNA, 18 nt, Haemophilus influenzae Rd
guuuaaaagcccuucuau

SEQ ID NO: 2710270 - RNA, 15 nt, Haemophilus influenzae Rd
guuuaaauuaaaacc

SEQ ID NO: 2710271 - RNA, 20 nt, Haemophilus influenzae Rd
guuuaagggcuaaguucuau

SEQ ID NO: 2710272 - RNA, 22 nt, Haemophilus influenzae Rd
guuuaauaaaucuuggugccaa

SEQ ID NO: 2710273 - RNA, 14 nt, Haemophilus influenzae Rd
guuuaauacaaucu

SEQ ID NO: 2710274 - RNA, 18 nt, Haemophilus influenzae Rd
guuuaauuauagaaaaga

SEQ ID NO: 2710275 - RNA, 13 nt, Haemophilus influenzae Rd
guuuaauuucauc

SEQ ID NO: 2710276 - RNA, 20 nt, Haemophilus influenzae Rd
guuuaccaccgauaaacacu

SEQ ID NO: 2710277 - RNA, 14 nt, Haemophilus influenzae Rd
guuuacuauuaaag

SEQ ID NO: 2710278 - RNA, 15 nt, Haemophilus influenzae Rd
guuuacugaauaaaa

SEQ ID NO: 2710279 - RNA, 19 nt, Haemophilus influenzae Rd
guuuacugaauaaaaaaaa

SEQ ID NO: 2710280 - RNA, 24 nt, Haemophilus influenzae Rd
guuuacuuaaaucuuuaccuugua

SEQ ID NO: 2710281 - RNA, 17 nt, Haemophilus influenzae Rd
guuuacuuuugauuuua

SEQ ID NO: 2710282 - RNA, 21 nt, Haemophilus influenzae Rd
guuuagaaagcacuucaucac

SEQ ID NO: 2710283 - RNA, 16 nt, Haemophilus influenzae Rd
guuuaguaaaauaaaa

SEQ ID NO: 2710284 - RNA, 16 nt, Haemophilus influenzae Rd
guuuaguuuacuuuug

SEQ ID NO: 2710285 - RNA, 21 nt, Haemophilus influenzae Rd
guuuauagcgucuuuuugcac

SEQ ID NO: 2710286 - RNA, 19 nt, Haemophilus influenzae Rd
guuuauauuuccaucaaaa

SEQ ID NO: 2710287 - RNA, 20 nt, Haemophilus influenzae Rd
guuuaucacuaauauaaaga

SEQ ID NO: 2710288 - RNA, 19 nt, Haemophilus influenzae Rd
guuuaucgaaacgguuagu

SEQ ID NO: 2710289 - RNA, 18 nt, Haemophilus influenzae Rd
guuuaucuaccacaucaa

SEQ ID NO: 2710290 - RNA, 21 nt, Haemophilus influenzae Rd
guuuaucucuuucuuaaaaua

SEQ ID NO: 2710291 - RNA, 19 nt, Haemophilus influenzae Rd
guuuaugccauagcuccaa

SEQ ID NO: 2710292 - RNA, 20 nt, Haemophilus influenzae Rd
guuuauguaguugugauuuu

SEQ ID NO: 2710293 - RNA, 19 nt, Haemophilus influenzae Rd
guuuauugguaacaacugc

SEQ ID NO: 2710294 - RNA, 16 nt, Haemophilus influenzae Rd
guuuauuuaacaauaa

SEQ ID NO: 2710295 - RNA, 18 nt, Haemophilus influenzae Rd
guuuauuuaacaauaacu

SEQ ID NO: 2710296 - RNA, 16 nt, Haemophilus influenzae Rd
guuuauuuuuauuauu

SEQ ID NO: 2710297 - RNA, 15 nt, Haemophilus influenzae Rd
guuucaagaagauuu

SEQ ID NO: 2710298 - RNA, 22 nt, Haemophilus influenzae Rd
guuucaagaagauuugugauga

SEQ ID NO: 2710299 - RNA, 16 nt, Haemophilus influenzae Rd
guuucaaugucuuuuu

SEQ ID NO: 2710300 - RNA, 22 nt, Haemophilus influenzae Rd
guuucacauccacaaaauuccg

SEQ ID NO: 2710301 - RNA, 16 nt, Haemophilus influenzae Rd
guuucaccauuuccuu

SEQ ID NO: 2710302 - RNA, 20 nt, Haemophilus influenzae Rd
guuucacgaucauaaauuuu

SEQ ID NO: 2710303 - RNA, 15 nt, Haemophilus influenzae Rd
guuucagaauaaaga

SEQ ID NO: 2710304 - RNA, 20 nt, Haemophilus influenzae Rd
guuucauaugccauugauuu

SEQ ID NO: 2710305 - RNA, 17 nt, Haemophilus influenzae Rd
guuucauuuuugcacca

SEQ ID NO: 2710306 - RNA, 14 nt, Haemophilus influenzae Rd
guuuccaaauuccg

SEQ ID NO: 2710307 - RNA, 20 nt, Haemophilus influenzae Rd
guuuccaagaauuuuaauaa

SEQ ID NO: 2710308 - RNA, 14 nt, Haemophilus influenzae Rd
guuuuuccauucac

SEQ ID NO: 2710309 - RNA, 16 nt, Haemophilus influenzae Rd
guuuuucgcugcagcu

SEQ ID NO: 2710310 - RNA, 18 nt, Haemophilus influenzae Rd
guuuuugccaaaauucug

SEQ ID NO: 2710311 - RNA, 15 nt, Haemophilus influenzae Rd
guuuuugucguucuu

SEQ ID NO: 2710312 - RNA, 20 nt, Haemophilus influenzae Rd
guuuuuuacgaacuaauaag

SEQ ID NO: 2710313 - RNA, 11 nt, Haemophilus influenzae Rd
guuuuuuagaa

SEQ ID NO: 2710314 - RNA, 19 nt, Haemophilus influenzae Rd
guuuuuuaggcuuaucuac

SEQ ID NO: 2710315 - RNA, 13 nt, Haemophilus influenzae Rd
guuuuuuccagcg

SEQ ID NO: 2710316 - RNA, 18 nt, Haemophilus influenzae Rd
guuuuuucccuaaugcua

SEQ ID NO: 2710317 - RNA, 21 nt, Haemophilus influenzae Rd
uaaaaaaacccaguuuuaaac

SEQ ID NO: 2710318 - RNA, 18 nt, Haemophilus influenzae Rd
uaaaaaaacguuaaauuu

SEQ ID NO: 2710319 - RNA, 12 nt, Haemophilus influenzae Rd
uaaaaaaacuaa

SEQ ID NO: 2710320 - RNA, 17 nt, Haemophilus influenzae Rd
uaaaaaaacuaaaaaca

SEQ ID NO: 2710321 - RNA, 14 nt, Haemophilus influenzae Rd
uaaaaaaagcaaua

SEQ ID NO: 2710322 - RNA, 19 nt, Haemophilus influenzae Rd
uaaaaaacccguaauuaaa

SEQ ID NO: 2710323 - RNA, 21 nt, Haemophilus influenzae Rd
uaaaaaacccguaauuaaaaa

SEQ ID NO: 2710324 - RNA, 22 nt, Haemophilus influenzae Rd
uaaaaaacccguaauuaaaaau

SEQ ID NO: 2710325 - RNA, 11 nt, Haemophilus influenzae Rd
uaaaaaagaaa

SEQ ID NO: 2710326 - RNA, 13 nt, Haemophilus influenzae Rd
uaaaaaagaaaua

SEQ ID NO: 2710327 - RNA, 16 nt, Haemophilus influenzae Rd
uaaaaaagaguaaaua

SEQ ID NO: 2710328 - RNA, 14 nt, Haemophilus influenzae Rd
uaaaaaagcgaauu

SEQ ID NO: 2710329 - RNA, 21 nt, Haemophilus influenzae Rd
uaaaaaagcguugaguaaaua

SEQ ID NO: 2710330 - RNA, 20 nt, Haemophilus influenzae Rd
uaaaaaagugcgguaaaauu

SEQ ID NO: 2710331 - RNA, 20 nt, Haemophilus influenzae Rd
uaaaaaagugcgguaaauuu

SEQ ID NO: 2710332 - RNA, 13 nt, Haemophilus influenzae Rd
uaaaaaaguuuaa

SEQ ID NO: 2710333 - RNA, 13 nt, Haemophilus influenzae Rd
uaaaaaauaaauu

SEQ ID NO: 2710334 - RNA, 12 nt, Haemophilus influenzae Rd
uaaaaaaucaau

SEQ ID NO: 2710335 - RNA, 12 nt, Haemophilus influenzae Rd
uaaaaaaucuaa

SEQ ID NO: 2710336 - RNA, 22 nt, Haemophilus influenzae Rd
uaaaaaaugauuaaguuaaaag

SEQ ID NO: 2710337 - RNA, 23 nt, Haemophilus influenzae Rd
uaaaaaaugauuaaguuaaaagu

SEQ ID NO: 2710338 - RNA, 11 nt, Haemophilus influenzae Rd
uaaaaaaugcu

SEQ ID NO: 2710339 - RNA, 17 nt, Haemophilus influenzae Rd
uaaaaacauaguaaauu

SEQ ID NO: 2710340 - RNA, 21 nt, Haemophilus influenzae Rd
uaaaaaccagauaaaaacugu

SEQ ID NO: 2710341 - RNA, 12 nt, Haemophilus influenzae Rd
uaaaaaccuaaa

SEQ ID NO: 2710342 - RNA, 23 nt, Haemophilus influenzae Rd
uaaaaacucgaauagaagugagu

SEQ ID NO: 2710343 - RNA, 13 nt, Haemophilus influenzae Rd
uaaaaacugugcg

SEQ ID NO: 2710344 - RNA, 15 nt, Haemophilus influenzae Rd
uaaaaacugugcggu

SEQ ID NO: 2710345 - RNA, 18 nt, Haemophilus influenzae Rd
uaaaaagaaaagugcgga

SEQ ID NO: 2710346 - RNA, 17 nt, Haemophilus influenzae Rd
uaaaaagaaauaaaaga

SEQ ID NO: 2710347 - RNA, 19 nt, Haemophilus influenzae Rd
uaaaaagaaauaaaagaua

SEQ ID NO: 2710348 - RNA, 15 nt, Haemophilus influenzae Rd
uaaaaagaacuacau

SEQ ID NO: 2710349 - RNA, 15 nt, Haemophilus influenzae Rd
uaaaaagacaaaacg

SEQ ID NO: 2710350 - RNA, 11 nt, Haemophilus influenzae Rd
uaaaaagauaa

SEQ ID NO: 2710351 - RNA, 21 nt, Haemophilus influenzae Rd
uaaaaagauaacuuagaaaau

SEQ ID NO: 2710352 - RNA, 13 nt, Haemophilus influenzae Rd
uaaaaagcacuga

SEQ ID NO: 2710353 - RNA, 20 nt, Haemophilus influenzae Rd
uaaaaagcacugaaauucau

SEQ ID NO: 2710354 - RNA, 17 nt, Haemophilus influenzae Rd
uaaaaagcccaaaugca

SEQ ID NO: 2710355 - RNA, 22 nt, Haemophilus influenzae Rd
uaaaaagcccaaaugcaacaau

SEQ ID NO: 2710356 - RNA, 15 nt, Haemophilus influenzae Rd
uaaaaaggaaauaau

SEQ ID NO: 2710357 - RNA, 19 nt, Haemophilus influenzae Rd
uaaaaaggaaauaauuucc

SEQ ID NO: 2710358 - RNA, 20 nt, Haemophilus influenzae Rd
uaaaaagggaugguuaauuu

SEQ ID NO: 2710359 - RNA, 21 nt, Haemophilus influenzae Rd
uaaaaaguacagcaaaccaag

SEQ ID NO: 2710360 - RNA, 21 nt, Haemophilus influenzae Rd
uaaaaagugcggugaaauuuu

SEQ ID NO: 2710361 - RNA, 19 nt, Haemophilus influenzae Rd
uaaaaagugcgguuaauuu

SEQ ID NO: 2710362 - RNA, 12 nt, Haemophilus influenzae Rd
uaaaaagugggu

SEQ ID NO: 2710363 - RNA, 13 nt, Haemophilus influenzae Rd
uaaaaauaaaaaa

SEQ ID NO: 2710364 - RNA, 13 nt, Haemophilus influenzae Rd
uaaaaauaaaaac

SEQ ID NO: 2710365 - RNA, 14 nt, Haemophilus influenzae Rd
uaaaaauaaaaaca

SEQ ID NO: 2710366 - RNA, 15 nt, Haemophilus influenzae Rd
uaaaaauaaaaacau

SEQ ID NO: 2710367 - RNA, 22 nt, Haemophilus influenzae Rd
uaaaaauaaauagauacaagaa

SEQ ID NO: 2710368 - RNA, 21 nt, Haemophilus influenzae Rd
uaaaaauaacccuuacuuuau

SEQ ID NO: 2710369 - RNA, 15 nt, Haemophilus influenzae Rd
uaaaaauaaguucau

SEQ ID NO: 2710370 - RNA, 22 nt, Haemophilus influenzae Rd
uaaaaauaauguuuuuaugacc

SEQ ID NO: 2710371 - RNA, 17 nt, Haemophilus influenzae Rd
uaaaaauaauuuuacuu

SEQ ID NO: 2710372 - RNA, 14 nt, Haemophilus influenzae Rd
uaaaaauagccuca

SEQ ID NO: 2710373 - RNA, 16 nt, Haemophilus influenzae Rd
uaaaaauaucguaaaa

SEQ ID NO: 2710374 - RNA, 19 nt, Haemophilus influenzae Rd
uaaaaauaucguaaaaaau

SEQ ID NO: 2710375 - RNA, 12 nt, Haemophilus influenzae Rd
uaaaaauauuau

SEQ ID NO: 2710376 - RNA, 18 nt, Haemophilus influenzae Rd
uaaaaaucaaagagaagc

SEQ ID NO: 2710377 - RNA, 17 nt, Haemophilus influenzae Rd
uaaaaaucauuaaauaa

SEQ ID NO: 2710378 - RNA, 22 nt, Haemophilus influenzae Rd
uaaaaauccccauuauugugau

SEQ ID NO: 2710379 - RNA, 23 nt, Haemophilus influenzae Rd
uaaaaaucguacaucgaaaacau

SEQ ID NO: 2710380 - RNA, 19 nt, Haemophilus influenzae Rd
uaaaaaugcacguuaauua

SEQ ID NO: 2710381 - RNA, 11 nt, Haemophilus influenzae Rd
uaaaaaugcug

SEQ ID NO: 2710382 - RNA, 13 nt, Haemophilus influenzae Rd
uaaaaaugcuguu

SEQ ID NO: 2710383 - RNA, 15 nt, Haemophilus influenzae Rd
uaaaaaugggguuac

SEQ ID NO: 2710384 - RNA, 16 nt, Haemophilus influenzae Rd
uaaaaauuaaccgcac

SEQ ID NO: 2710385 - RNA, 21 nt, Haemophilus influenzae Rd
uaaaaauuaaggaaagcccca

SEQ ID NO: 2710386 - RNA, 11 nt, Haemophilus influenzae Rd
uaaaaauucac

SEQ ID NO: 2710387 - RNA, 22 nt, Haemophilus influenzae Rd
uaaaaauucuuuuuucuuccua

SEQ ID NO: 2710388 - RNA, 12 nt, Haemophilus influenzae Rd
uaaaaauuuaaa

SEQ ID NO: 2710389 - RNA, 15 nt, Haemophilus influenzae Rd
uaaaaauuuaaauau

SEQ ID NO: 2710390 - RNA, 18 nt, Haemophilus influenzae Rd
uaaaaauuuaaauauaau

SEQ ID NO: 2710391 - RNA, 11 nt, Haemophilus influenzae Rd
uaaaaauuuac

SEQ ID NO: 2710392 - RNA, 12 nt, Haemophilus influenzae Rd
uaaaaauuucag

SEQ ID NO: 2710393 - RNA, 14 nt, Haemophilus influenzae Rd
uaaaaauuucucuc

SEQ ID NO: 2710394 - RNA, 21 nt, Haemophilus influenzae Rd
uaaaaauuucucucauuuuuu

SEQ ID NO: 2710395 - RNA, 16 nt, Haemophilus influenzae Rd
uaaaacaaaagaaauu

SEQ ID NO: 2710396 - RNA, 12 nt, Haemophilus influenzae Rd
uaaaacaaaguc

SEQ ID NO: 2710397 - RNA, 13 nt, Haemophilus influenzae Rd
uaaaacaacagua

SEQ ID NO: 2710398 - RNA, 16 nt, Haemophilus influenzae Rd
uaaaacaacaguagaa

SEQ ID NO: 2710399 - RNA, 21 nt, Haemophilus influenzae Rd
uaaaacacaucgcuugcauuu

SEQ ID NO: 2710400 - RNA, 17 nt, Haemophilus influenzae Rd
uaaaacacguuugccag

SEQ ID NO: 2710401 - RNA, 20 nt, Haemophilus influenzae Rd
uaaaacagaaguugaaaaua

SEQ ID NO: 2710402 - RNA, 18 nt, Haemophilus influenzae Rd
uaaaacagagaaaaaaau

SEQ ID NO: 2710403 - RNA, 20 nt, Haemophilus influenzae Rd
uaaaacagagaaaaaaauag

SEQ ID NO: 2710404 - RNA, 22 nt, Haemophilus influenzae Rd
uaaaacagcaggaauauuagga

SEQ ID NO: 2710405 - RNA, 23 nt, Haemophilus influenzae Rd
uaaaacaguuaucgccaauaaua

SEQ ID NO: 2710406 - RNA, 15 nt, Haemophilus influenzae Rd
uaaaaccaagaaagc

SEQ ID NO: 2710407 - RNA, 17 nt, Haemophilus influenzae Rd
uaaaaccacaauaaaau

SEQ ID NO: 2710408 - RNA, 20 nt, Haemophilus influenzae Rd
uaaaaccauccgaaauuaau

SEQ ID NO: 2710409 - RNA, 21 nt, Haemophilus influenzae Rd
uaaaaccauccgaaauuaauu

SEQ ID NO: 2710410 - RNA, 18 nt, Haemophilus influenzae Rd
uaaaaccucagaagaaau

SEQ ID NO: 2710411 - RNA, 19 nt, Haemophilus influenzae Rd
uaaaaccuuguaaacgauu

SEQ ID NO: 2710412 - RNA, 17 nt, Haemophilus influenzae Rd
uaaaacgaacaauuucu

SEQ ID NO: 2710413 - RNA, 19 nt, Haemophilus influenzae Rd
uaaaacgaacaauuucuuu

SEQ ID NO: 2710414 - RNA, 19 nt, Haemophilus influenzae Rd
uaaaauugccccuucaccu

SEQ ID NO: 2710415 - RNA, 15 nt, Haemophilus influenzae Rd
uaaaauuggugcaaa

SEQ ID NO: 2710416 - RNA, 19 nt, Haemophilus influenzae Rd
uaaaauuguggcaauaguu

SEQ ID NO: 2710417 - RNA, 19 nt, Haemophilus influenzae Rd
uaaaauuuauuacaaacaa

SEQ ID NO: 2710418 - RNA, 18 nt, Haemophilus influenzae Rd
uaaaauuuauuuuaaaau

SEQ ID NO: 2710419 - RNA, 20 nt, Haemophilus influenzae Rd
uaaaauuuauuuuaaaauca

SEQ ID NO: 2710420 - RNA, 21 nt, Haemophilus influenzae Rd
uaaaauuuauuuuaaaaucau

SEQ ID NO: 2710421 - RNA, 22 nt, Haemophilus influenzae Rd
uaaaauuucuucuacaccuucu

SEQ ID NO: 2710422 - RNA, 16 nt, Haemophilus influenzae Rd
uaaaauuuuuaccaua

SEQ ID NO: 2710423 - RNA, 22 nt, Haemophilus influenzae Rd
uaaaauuuuuaccauauccauu

SEQ ID NO: 2710424 - RNA, 19 nt, Haemophilus influenzae Rd
uaaaauuuuuagugauuuu

SEQ ID NO: 2710425 - RNA, 14 nt, Haemophilus influenzae Rd
uaaacaaaaauaca

SEQ ID NO: 2710426 - RNA, 23 nt, Haemophilus influenzae Rd
uaaacaaaauaccccaauuaagu

SEQ ID NO: 2710427 - RNA, 18 nt, Haemophilus influenzae Rd
uaaacaaaccuaaaccuu

SEQ ID NO: 2710428 - RNA, 17 nt, Haemophilus influenzae Rd
uaaacaaacuuucauuc

SEQ ID NO: 2710429 - RNA, 15 nt, Haemophilus influenzae Rd
uaaacaaccaacuaa

SEQ ID NO: 2710430 - RNA, 16 nt, Haemophilus influenzae Rd
uaaacaauauaaccag

SEQ ID NO: 2710431 - RNA, 13 nt, Haemophilus influenzae Rd
uaaacaauucacu

SEQ ID NO: 2710432 - RNA, 15 nt, Haemophilus influenzae Rd
uaaacaauuccccuu

SEQ ID NO: 2710433 - RNA, 14 nt, Haemophilus influenzae Rd
uaaacaauuucauu

SEQ ID NO: 2710434 - RNA, 23 nt, Haemophilus influenzae Rd
uaaacacaaacugguuaaaaucc

SEQ ID NO: 2710435 - RNA, 14 nt, Haemophilus influenzae Rd
uaaacacacucuua

SEQ ID NO: 2710436 - RNA, 13 nt, Haemophilus influenzae Rd
uaaacacauaaua

SEQ ID NO: 2710437 - RNA, 22 nt, Haemophilus influenzae Rd
uaaacaccaauucaaagauuuu

SEQ ID NO: 2710438 - RNA, 15 nt, Haemophilus influenzae Rd
uaaacacuccaacac

SEQ ID NO: 2710439 - RNA, 19 nt, Haemophilus influenzae Rd
uaaacacugcgcagauuaa

SEQ ID NO: 2710440 - RNA, 20 nt, Haemophilus influenzae Rd
uaaacacugcgcagauuaau

SEQ ID NO: 2710441 - RNA, 15 nt, Haemophilus influenzae Rd
uaaacagaaauauug

SEQ ID NO: 2710442 - RNA, 16 nt, Haemophilus influenzae Rd
uaaacagaaauauugu

SEQ ID NO: 2710443 - RNA, 20 nt, Haemophilus influenzae Rd
uaaacagaaauauugucuau

SEQ ID NO: 2710444 - RNA, 17 nt, Haemophilus influenzae Rd
uaaacagcaaaagugcu

SEQ ID NO: 2710445 - RNA, 19 nt, Haemophilus influenzae Rd
uaaacagcaaaagugcuua

SEQ ID NO: 2710446 - RNA, 15 nt, Haemophilus influenzae Rd
uaaacagccaaacaa

SEQ ID NO: 2710447 - RNA, 22 nt, Haemophilus influenzae Rd
uaaacagccauggcuuuuuccu

SEQ ID NO: 2710448 - RNA, 23 nt, Haemophilus influenzae Rd
uaaacagccauggcuuuuuccug

SEQ ID NO: 2710449 - RNA, 14 nt, Haemophilus influenzae Rd
uaaacagcuuuccu

SEQ ID NO: 2710450 - RNA, 13 nt, Haemophilus influenzae Rd
uaaacauauugau

SEQ ID NO: 2710451 - RNA, 20 nt, Haemophilus influenzae Rd
uaaacauccgaauaaaugca

SEQ ID NO: 2710452 - RNA, 21 nt, Haemophilus influenzae Rd
uaaacauccgaauaaaugcau

SEQ ID NO: 2710453 - RNA, 20 nt, Haemophilus influenzae Rd
uaaacaucgcagaaauagau

SEQ ID NO: 2710454 - RNA, 14 nt, Haemophilus influenzae Rd
uaaacaucuugcau

SEQ ID NO: 2710455 - RNA, 20 nt, Haemophilus influenzae Rd
uaaacauuaggaauaucuuu

SEQ ID NO: 2710456 - RNA, 13 nt, Haemophilus influenzae Rd
uaaacauuucuau

SEQ ID NO: 2710457 - RNA, 13 nt, Haemophilus influenzae Rd
uaaacauuuugua

SEQ ID NO: 2710458 - RNA, 13 nt, Haemophilus influenzae Rd
uaaacauuuuuca

SEQ ID NO: 2710459 - RNA, 16 nt, Haemophilus influenzae Rd
uaaacauuuuucauuu

SEQ ID NO: 2710460 - RNA, 21 nt, Haemophilus influenzae Rd
uaaacauuuuucauuuucgca

SEQ ID NO: 2710461 - RNA, 18 nt, Haemophilus influenzae Rd
uaaaccaaacgagaaaau

SEQ ID NO: 2710462 - RNA, 22 nt, Haemophilus influenzae Rd
uaaaccaacaacugcacagccc

SEQ ID NO: 2710463 - RNA, 17 nt, Haemophilus influenzae Rd
uaaaccaacauacauua

SEQ ID NO: 2710464 - RNA, 18 nt, Haemophilus influenzae Rd
uaaaccaccgauuaauaa

SEQ ID NO: 2710465 - RNA, 18 nt, Haemophilus influenzae Rd
uaaaccauuuaauaaaac

SEQ ID NO: 2710466 - RNA, 18 nt, Haemophilus influenzae Rd
uaaacccaccauacgcaa

SEQ ID NO: 2710467 - RNA, 16 nt, Haemophilus influenzae Rd
uaaacccgaaauauaa

SEQ ID NO: 2710468 - RNA, 20 nt, Haemophilus influenzae Rd
uaaacccuguuuuaagguuu

SEQ ID NO: 2710469 - RNA, 19 nt, Haemophilus influenzae Rd
uaaaccgcaucaaaauuau

SEQ ID NO: 2710470 - RNA, 19 nt, Haemophilus influenzae Rd
uaaaccgccaaaaauuaau

SEQ ID NO: 2710471 - RNA, 20 nt, Haemophilus influenzae Rd
uaaaccguacaaacccacaa

SEQ ID NO: 2710472 - RNA, 19 nt, Haemophilus influenzae Rd
uaaaccgucauuuauaaaa

SEQ ID NO: 2710473 - RNA, 15 nt, Haemophilus influenzae Rd
uaaaccguuuagcaa

SEQ ID NO: 2710474 - RNA, 15 nt, Haemophilus influenzae Rd
uaaaccuaaagccaa

SEQ ID NO: 2710475 - RNA, 23 nt, Haemophilus influenzae Rd
uaaaccuacacccacugauuuuu

SEQ ID NO: 2710476 - RNA, 19 nt, Haemophilus influenzae Rd
uaaaccuaugauuauagau

SEQ ID NO: 2710477 - RNA, 19 nt, Haemophilus influenzae Rd
uaaaccucgccuuguaauu

SEQ ID NO: 2710478 - RNA, 15 nt, Haemophilus influenzae Rd
uaaaccuuauugcau

SEQ ID NO: 2710479 - RNA, 17 nt, Haemophilus influenzae Rd
uaaaccuuguaaagcac

SEQ ID NO: 2710480 - RNA, 14 nt, Haemophilus influenzae Rd
uaaacgaauaucag

SEQ ID NO: 2710481 - RNA, 20 nt, Haemophilus influenzae Rd
uaaacgaaugaaguuagaaa

SEQ ID NO: 2710482 - RNA, 14 nt, Haemophilus influenzae Rd
uaaacgaccuucau

SEQ ID NO: 2710483 - RNA, 23 nt, Haemophilus influenzae Rd
uaaacgaccuucaucaccugcuu

SEQ ID NO: 2710484 - RNA, 16 nt, Haemophilus influenzae Rd
uaaacgaucuauuccu

SEQ ID NO: 2710485 - RNA, 21 nt, Haemophilus influenzae Rd
uaaacgaugggcaauggcaau

SEQ ID NO: 2710486 - RNA, 19 nt, Haemophilus influenzae Rd
uaaacgauuucgugcaaua

SEQ ID NO: 2710487 - RNA, 19 nt, Haemophilus influenzae Rd
uaaacgcaacaucgcagug

SEQ ID NO: 2710488 - RNA, 15 nt, Haemophilus influenzae Rd
uaaacgcauauuuug

SEQ ID NO: 2710489 - RNA, 16 nt, Haemophilus influenzae Rd
uaaacgcauauuuugu

SEQ ID NO: 2710490 - RNA, 22 nt, Haemophilus influenzae Rd
uaaacgcaucaacuuuaucauu

SEQ ID NO: 2710491 - RNA, 17 nt, Haemophilus influenzae Rd
uaaacgccacgcuuugu

SEQ ID NO: 2710492 - RNA, 16 nt, Haemophilus influenzae Rd
uaaacgccaucaacca

SEQ ID NO: 2710493 - RNA, 18 nt, Haemophilus influenzae Rd
uaaacgcucaaauaaauu

SEQ ID NO: 2710494 - RNA, 15 nt, Haemophilus influenzae Rd
uaaacggaacucuug

SEQ ID NO: 2710495 - RNA, 21 nt, Haemophilus influenzae Rd
uaaacggagcgauguuuuccc

SEQ ID NO: 2710496 - RNA, 22 nt, Haemophilus influenzae Rd
uaaacggcguaucauacuaaaa

SEQ ID NO: 2710497 - RNA, 14 nt, Haemophilus influenzae Rd
uaaacggcgugcca

SEQ ID NO: 2710498 - RNA, 18 nt, Haemophilus influenzae Rd
uaaacggucauuuacaaa

SEQ ID NO: 2710499 - RNA, 22 nt, Haemophilus influenzae Rd
uaaacggucauuuacaaacaua

SEQ ID NO: 2710500 - RNA, 19 nt, Haemophilus influenzae Rd
uaaacgugauuuaccaaua

SEQ ID NO: 2710501 - RNA, 19 nt, Haemophilus influenzae Rd
uaaacgugugauaccaaga

SEQ ID NO: 2710502 - RNA, 19 nt, Haemophilus influenzae Rd
uaaacguugaaucgcacuu

SEQ ID NO: 2710503 - RNA, 23 nt, Haemophilus influenzae Rd
uaaacguugagccaauuuucucg

SEQ ID NO: 2710504 - RNA, 18 nt, Haemophilus influenzae Rd
uaaacguuuauuuauucc

SEQ ID NO: 2710505 - RNA, 17 nt, Haemophilus influenzae Rd
uaaacuaaaucuugcuu

SEQ ID NO: 2710506 - RNA, 19 nt, Haemophilus influenzae Rd
uaaacuacccaaauuuaua

SEQ ID NO: 2710507 - RNA, 23 nt, Haemophilus influenzae Rd
uaaacucaaugaauuaaaaguuu

SEQ ID NO: 2710508 - RNA, 16 nt, Haemophilus influenzae Rd
uaaacucgaaggaaau

SEQ ID NO: 2710509 - RNA, 16 nt, Haemophilus influenzae Rd
uaaacugacagaagac

SEQ ID NO: 2710510 - RNA, 14 nt, Haemophilus influenzae Rd
uaaacugauuuuga

SEQ ID NO: 2710511 - RNA, 15 nt, Haemophilus influenzae Rd
uaaacugauuuugau

SEQ ID NO: 2710512 - RNA, 16 nt, Haemophilus influenzae Rd
uaaacugauuuugauu

SEQ ID NO: 2710513 - RNA, 23 nt, Haemophilus influenzae Rd
uaaacugccgccuucuuccacgu

SEQ ID NO: 2710514 - RNA, 14 nt, Haemophilus influenzae Rd
uaaacuggaugaaa

SEQ ID NO: 2710515 - RNA, 19 nt, Haemophilus influenzae Rd
uaaacuggguuuuauuuua

SEQ ID NO: 2710516 - RNA, 15 nt, Haemophilus influenzae Rd
uaaacuguugccaua

SEQ ID NO: 2710517 - RNA, 14 nt, Haemophilus influenzae Rd
uaaacuuaccuaaa

SEQ ID NO: 2710518 - RNA, 22 nt, Haemophilus influenzae Rd
uaaacuuccaaaauuuaaagug

SEQ ID NO: 2710519 - RNA, 24 nt, Haemophilus influenzae Rd
uaaauagguauagccuucgcuauu

SEQ ID NO: 2710520 - RNA, 16 nt, Haemophilus influenzae Rd
uaaauaguuaauugau

SEQ ID NO: 2710521 - RNA, 21 nt, Haemophilus influenzae Rd
uaaauaguuaauugauuuaaa

SEQ ID NO: 2710522 - RNA, 12 nt, Haemophilus influenzae Rd
uaaauauaaacu

SEQ ID NO: 2710523 - RNA, 15 nt, Haemophilus influenzae Rd
uaaauauaaugaaaa

SEQ ID NO: 2710524 - RNA, 16 nt, Haemophilus influenzae Rd
uaaauauaauuuagca

SEQ ID NO: 2710525 - RNA, 15 nt, Haemophilus influenzae Rd
uaaauauaucaagca

SEQ ID NO: 2710526 - RNA, 19 nt, Haemophilus influenzae Rd
uaaauauauuuuuauugaa

SEQ ID NO: 2710527 - RNA, 22 nt, Haemophilus influenzae Rd
uaaauauccccauugaauuaaa

SEQ ID NO: 2710528 - RNA, 21 nt, Haemophilus influenzae Rd
uaaauaucuaaacuucaauuu

SEQ ID NO: 2710529 - RNA, 22 nt, Haemophilus influenzae Rd
uaaauaugccuuauauuucacu

SEQ ID NO: 2710530 - RNA, 14 nt, Haemophilus influenzae Rd
uaaauauuauuaaa

SEQ ID NO: 2710531 - RNA, 12 nt, Haemophilus influenzae Rd
uaaauauucaau

SEQ ID NO: 2710532 - RNA, 23 nt, Haemophilus influenzae Rd
uaaauauugagcaauaaauucua

SEQ ID NO: 2710533 - RNA, 20 nt, Haemophilus influenzae Rd
uaaauauuguauuuaaguaa

SEQ ID NO: 2710534 - RNA, 15 nt, Haemophilus influenzae Rd
uaaauauuuaaaaag

SEQ ID NO: 2710535 - RNA, 17 nt, Haemophilus influenzae Rd
uaaauauuuauacacuu

SEQ ID NO: 2710536 - RNA, 14 nt, Haemophilus influenzae Rd
uaaauauuucacua

SEQ ID NO: 2710537 - RNA, 16 nt, Haemophilus influenzae Rd
uaaauauuuucauuua

SEQ ID NO: 2710538 - RNA, 13 nt, Haemophilus influenzae Rd
uaaaucaaaaauu

SEQ ID NO: 2710539 - RNA, 15 nt, Haemophilus influenzae Rd
uaaaucaaaagaauu

SEQ ID NO: 2710540 - RNA, 21 nt, Haemophilus influenzae Rd
uaaaucaaaagaauuaaaaau

SEQ ID NO: 2710541 - RNA, 23 nt, Haemophilus influenzae Rd
uaaaucaaauaauucaagaugau

SEQ ID NO: 2710542 - RNA, 15 nt, Haemophilus influenzae Rd
uaaaucaauguuuuc

SEQ ID NO: 2710543 - RNA, 23 nt, Haemophilus influenzae Rd
uaaaucaauguuuucagcuucaa

SEQ ID NO: 2710544 - RNA, 14 nt, Haemophilus influenzae Rd
uaaaucaauuaacu

SEQ ID NO: 2710545 - RNA, 15 nt, Haemophilus influenzae Rd
uaaaucaauuaacua

SEQ ID NO: 2710546 - RNA, 23 nt, Haemophilus influenzae Rd
uaaaucacccggcacauaaauca

SEQ ID NO: 2710547 - RNA, 16 nt, Haemophilus influenzae Rd
uaaaucaccuaaaucu

SEQ ID NO: 2710548 - RNA, 17 nt, Haemophilus influenzae Rd
uaaaucaccuaaaucuu

SEQ ID NO: 2710549 - RNA, 15 nt, Haemophilus influenzae Rd
uaaaucacuuaauuu

SEQ ID NO: 2710550 - RNA, 17 nt, Haemophilus influenzae Rd
uaaaucacuuucauuaa

SEQ ID NO: 2710551 - RNA, 15 nt, Haemophilus influenzae Rd
uaaaucagaacuggc

SEQ ID NO: 2710552 - RNA, 22 nt, Haemophilus influenzae Rd
uaaaucagaacuggcuuccaac

SEQ ID NO: 2710553 - RNA, 17 nt, Haemophilus influenzae Rd
uaaaucagcgaauuaaa

SEQ ID NO: 2710554 - RNA, 18 nt, Haemophilus influenzae Rd
uaaaucagcgaauuaaag

SEQ ID NO: 2710555 - RNA, 15 nt, Haemophilus influenzae Rd
uaaaucauaagcaau

SEQ ID NO: 2710556 - RNA, 20 nt, Haemophilus influenzae Rd
uaaaucauaagcaauaauuu

SEQ ID NO: 2710557 - RNA, 20 nt, Haemophilus influenzae Rd
uaaaucaucccuguauaaag

SEQ ID NO: 2710558 - RNA, 23 nt, Haemophilus influenzae Rd
uaaaucaucuaccacgauaaauc

SEQ ID NO: 2710559 - RNA, 22 nt, Haemophilus influenzae Rd
uaaaucaugggcgauaaaaauu

SEQ ID NO: 2710560 - RNA, 12 nt, Haemophilus influenzae Rd
uaaauccaucaa

SEQ ID NO: 2710561 - RNA, 17 nt, Haemophilus influenzae Rd
uaaaucccaauagguuu

SEQ ID NO: 2710562 - RNA, 19 nt, Haemophilus influenzae Rd
uaaaucccccaaucccuca

SEQ ID NO: 2710563 - RNA, 21 nt, Haemophilus influenzae Rd
uaaaucccuugugucuaccga

SEQ ID NO: 2710564 - RNA, 22 nt, Haemophilus influenzae Rd
uaaauccucagcaauuucuuca

SEQ ID NO: 2710565 - RNA, 19 nt, Haemophilus influenzae Rd
uaaauccugcuucuuuauc

SEQ ID NO: 2710566 - RNA, 22 nt, Haemophilus influenzae Rd
uaaauccuucaggauaaaacaa

SEQ ID NO: 2710567 - RNA, 17 nt, Haemophilus influenzae Rd
uaaaucgccuucacaua

SEQ ID NO: 2710568 - RNA, 19 nt, Haemophilus influenzae Rd
uaaaucggcguauuuuaca

SEQ ID NO: 2710569 - RNA, 20 nt, Haemophilus influenzae Rd
uaaaucggcguauuuuacaa

SEQ ID NO: 2710570 - RNA, 16 nt, Haemophilus influenzae Rd
uaaaucgguucuacac

SEQ ID NO: 2710571 - RNA, 15 nt, Haemophilus influenzae Rd
uaaaucguauaagcc

SEQ ID NO: 2710572 - RNA, 13 nt, Haemophilus influenzae Rd
uaaaucuaaaaua

SEQ ID NO: 2710573 - RNA, 16 nt, Haemophilus influenzae Rd
uaaaucuacauuuuua

SEQ ID NO: 2710574 - RNA, 22 nt, Haemophilus influenzae Rd
uaaaucuacuuggacauuguug

SEQ ID NO: 2710575 - RNA, 13 nt, Haemophilus influenzae Rd
uaaaucuacuuua

SEQ ID NO: 2710576 - RNA, 14 nt, Haemophilus influenzae Rd
uaaaucuacuuuau

SEQ ID NO: 2710577 - RNA, 16 nt, Haemophilus influenzae Rd
uaaaucuguuucauuu

SEQ ID NO: 2710578 - RNA, 14 nt, Haemophilus influenzae Rd
uaaaucuucuuuac

SEQ ID NO: 2710579 - RNA, 17 nt, Haemophilus influenzae Rd
uaaaucuucuuuaccaa

SEQ ID NO: 2710580 - RNA, 20 nt, Haemophilus influenzae Rd
uaaaucuucuuuaccaacua

SEQ ID NO: 2710581 - RNA, 21 nt, Haemophilus influenzae Rd
uaaaucuugcuuuugguuuuc

SEQ ID NO: 2710582 - RNA, 15 nt, Haemophilus influenzae Rd
uaaaucuuuacccau

SEQ ID NO: 2710583 - RNA, 14 nt, Haemophilus influenzae Rd
uaaaucuuuccaga

SEQ ID NO: 2710584 - RNA, 11 nt, Haemophilus influenzae Rd
uaaaugaaaag

SEQ ID NO: 2710585 - RNA, 16 nt, Haemophilus influenzae Rd
uaaaugaaguuuuacu

SEQ ID NO: 2710586 - RNA, 14 nt, Haemophilus influenzae Rd
uaaaugaauaaaac

SEQ ID NO: 2710587 - RNA, 17 nt, Haemophilus influenzae Rd
uaaaugaucuaaugggg

SEQ ID NO: 2710588 - RNA, 21 nt, Haemophilus influenzae Rd
uaaaugauguaggcaaaaaca

SEQ ID NO: 2710589 - RNA, 20 nt, Haemophilus influenzae Rd
uaaaugcaguauaaaccgca

SEQ ID NO: 2710590 - RNA, 17 nt, Haemophilus influenzae Rd
uaaaugcaucauuaaua

SEQ ID NO: 2710591 - RNA, 22 nt, Haemophilus influenzae Rd
uaaaugcaucauuaauacacaa

SEQ ID NO: 2710592 - RNA, 17 nt, Haemophilus influenzae Rd
uaaaugcgcuuuuaauu

SEQ ID NO: 2710593 - RNA, 18 nt, Haemophilus influenzae Rd
uaaaugcgcuuuuaauuu

SEQ ID NO: 2710594 - RNA, 18 nt, Haemophilus influenzae Rd
uaaaugcgugaacugcuu

SEQ ID NO: 2710595 - RNA, 14 nt, Haemophilus influenzae Rd
uaaaugcuaaaauu

SEQ ID NO: 2710596 - RNA, 20 nt, Haemophilus influenzae Rd
uaaaugcuaaaauuaaaggc

SEQ ID NO: 2710597 - RNA, 15 nt, Haemophilus influenzae Rd
uaaaugcuguagaaa

SEQ ID NO: 2710598 - RNA, 17 nt, Haemophilus influenzae Rd
uaaaugcuguagaaauu

SEQ ID NO: 2710599 - RNA, 20 nt, Haemophilus influenzae Rd
uaaaugcuguagaaauuaau

SEQ ID NO: 2710600 - RNA, 19 nt, Haemophilus influenzae Rd
uaaauggauuuaauccacu

SEQ ID NO: 2710601 - RNA, 15 nt, Haemophilus influenzae Rd
uaaauggcaucugga

SEQ ID NO: 2710602 - RNA, 12 nt, Haemophilus influenzae Rd
uaaauggcuuua

SEQ ID NO: 2710603 - RNA, 18 nt, Haemophilus influenzae Rd
uaaaugggcaaacauuuu

SEQ ID NO: 2710604 - RNA, 16 nt, Haemophilus influenzae Rd
uaaauggucuucaucg

SEQ ID NO: 2710605 - RNA, 18 nt, Haemophilus influenzae Rd
uaaaugucuucuguuugg

SEQ ID NO: 2710606 - RNA, 18 nt, Haemophilus influenzae Rd
uaaaugugacauuguaaa

SEQ ID NO: 2710607 - RNA, 16 nt, Haemophilus influenzae Rd
uaaaugugauuuccau

SEQ ID NO: 2710608 - RNA, 11 nt, Haemophilus influenzae Rd
uaaaugugguc

SEQ ID NO: 2710609 - RNA, 16 nt, Haemophilus influenzae Rd
uaaauguguuaaauaa

SEQ ID NO: 2710610 - RNA, 13 nt, Haemophilus influenzae Rd
uaaauuaaaaaga

SEQ ID NO: 2710611 - RNA, 15 nt, Haemophilus influenzae Rd
uaaauuaaaaagacu

SEQ ID NO: 2710612 - RNA, 16 nt, Haemophilus influenzae Rd
uaaauuaauuacuguc

SEQ ID NO: 2710613 - RNA, 22 nt, Haemophilus influenzae Rd
uaaauuaccuuguuuugcaaua

SEQ ID NO: 2710614 - RNA, 18 nt, Haemophilus influenzae Rd
uaaauuagcguaaacauu

SEQ ID NO: 2710615 - RNA, 16 nt, Haemophilus influenzae Rd
uaaauuagcuuaauaa

SEQ ID NO: 2710616 - RNA, 21 nt, Haemophilus influenzae Rd
uaaauuagcuuaauaaaucac

SEQ ID NO: 2710617 - RNA, 16 nt, Haemophilus influenzae Rd
uaaauuaguuuaaaga

SEQ ID NO: 2710618 - RNA, 19 nt, Haemophilus influenzae Rd
uaaauuauagauaaauauc

SEQ ID NO: 2710619 - RNA, 21 nt, Haemophilus influenzae Rd
uaaauuauagauaaauaucaa

SEQ ID NO: 2710620 - RNA, 23 nt, Haemophilus influenzae Rd
uaaauuauagauaaauaucaaaa

SEQ ID NO: 2710621 - RNA, 13 nt, Haemophilus influenzae Rd
uaaauuauauuuu

SEQ ID NO: 2710622 - RNA, 16 nt, Haemophilus influenzae Rd
uaaauuauauuuuccu

SEQ ID NO: 2710623 - RNA, 24 nt, Haemophilus influenzae Rd
uaaauuauauuuuuaauuuauacu

SEQ ID NO: 2710624 - RNA, 17 nt, Haemophilus influenzae Rd
uaacaccauugagcauu

SEQ ID NO: 2710625 - RNA, 19 nt, Haemophilus influenzae Rd
uaacacccucaaccacuuc

SEQ ID NO: 2710626 - RNA, 14 nt, Haemophilus influenzae Rd
uaacacgaaaccaa

SEQ ID NO: 2710627 - RNA, 15 nt, Haemophilus influenzae Rd
uaacacgaaaccaac

SEQ ID NO: 2710628 - RNA, 17 nt, Haemophilus influenzae Rd
uaacacgaccauugaau

SEQ ID NO: 2710629 - RNA, 18 nt, Haemophilus influenzae Rd
uaacacugccaaugcagc

SEQ ID NO: 2710630 - RNA, 14 nt, Haemophilus influenzae Rd
uaacacuuuuucua

SEQ ID NO: 2710631 - RNA, 15 nt, Haemophilus influenzae Rd
uaacagauggaucua

SEQ ID NO: 2710632 - RNA, 15 nt, Haemophilus influenzae Rd
uaacagcaaacuuaa

SEQ ID NO: 2710633 - RNA, 20 nt, Haemophilus influenzae Rd
uaacagcaaacuuaaauaca

SEQ ID NO: 2710634 - RNA, 21 nt, Haemophilus influenzae Rd
uaacagcaaacuuaaauacau

SEQ ID NO: 2710635 - RNA, 14 nt, Haemophilus influenzae Rd
uaacaguuaacgcu

SEQ ID NO: 2710636 - RNA, 17 nt, Haemophilus influenzae Rd
uaacauaacuuuccaua

SEQ ID NO: 2710637 - RNA, 19 nt, Haemophilus influenzae Rd
uaacauaaugauuucuaaa

SEQ ID NO: 2710638 - RNA, 13 nt, Haemophilus influenzae Rd
uaacauaauuuau

SEQ ID NO: 2710639 - RNA, 17 nt, Haemophilus influenzae Rd
uaacauacccaugccuu

SEQ ID NO: 2710640 - RNA, 17 nt, Haemophilus influenzae Rd
uaacauagaaaucacua

SEQ ID NO: 2710641 - RNA, 18 nt, Haemophilus influenzae Rd
uaacauagaaaucacuaa

SEQ ID NO: 2710642 - RNA, 17 nt, Haemophilus influenzae Rd
uaacauaugacagauag

SEQ ID NO: 2710643 - RNA, 18 nt, Haemophilus influenzae Rd
uaacauaugauuauuuaa

SEQ ID NO: 2710644 - RNA, 11 nt, Haemophilus influenzae Rd
uaacaucaacg

SEQ ID NO: 2710645 - RNA, 16 nt, Haemophilus influenzae Rd
uaacaucaacgguuuu

SEQ ID NO: 2710646 - RNA, 22 nt, Haemophilus influenzae Rd
uaacaucaucaucgcaucugua

SEQ ID NO: 2710647 - RNA, 17 nt, Haemophilus influenzae Rd
uaacaucaugaaaugca

SEQ ID NO: 2710648 - RNA, 17 nt, Haemophilus influenzae Rd
uaacaucucuugaauac

SEQ ID NO: 2710649 - RNA, 21 nt, Haemophilus influenzae Rd
uaacaugcaaaauauucuauu

SEQ ID NO: 2710650 - RNA, 13 nt, Haemophilus influenzae Rd
uaacauuaauaaa

SEQ ID NO: 2710651 - RNA, 19 nt, Haemophilus influenzae Rd
uaacauuacacgagcaaug

SEQ ID NO: 2710652 - RNA, 22 nt, Haemophilus influenzae Rd
uaacauuacacgagcaauggca

SEQ ID NO: 2710653 - RNA, 19 nt, Haemophilus influenzae Rd
uaacauuccguuuuuaauc

SEQ ID NO: 2710654 - RNA, 17 nt, Haemophilus influenzae Rd
uaacauugcaucagcca

SEQ ID NO: 2710655 - RNA, 16 nt, Haemophilus influenzae Rd
uaacauuguuuuaaug

SEQ ID NO: 2710656 - RNA, 16 nt, Haemophilus influenzae Rd
uaacauuuauuuuucu

SEQ ID NO: 2710657 - RNA, 20 nt, Haemophilus influenzae Rd
uaacauuugcguauuaugga

SEQ ID NO: 2710658 - RNA, 13 nt, Haemophilus influenzae Rd
uaacauuuuuuuu

SEQ ID NO: 2710659 - RNA, 20 nt, Haemophilus influenzae Rd
uaaccaaagcguccaagcaa

SEQ ID NO: 2710660 - RNA, 22 nt, Haemophilus influenzae Rd
uaaccaaauagaugaaauuuau

SEQ ID NO: 2710661 - RNA, 23 nt, Haemophilus influenzae Rd
uaaccaaauagaugaaauuuauu

SEQ ID NO: 2710662 - RNA, 16 nt, Haemophilus influenzae Rd
uaaccaacauaaacau

SEQ ID NO: 2710663 - RNA, 17 nt, Haemophilus influenzae Rd
uaaccaacauaaacauu

SEQ ID NO: 2710664 - RNA, 22 nt, Haemophilus influenzae Rd
uaaccaacguggcuuuucugau

SEQ ID NO: 2710665 - RNA, 19 nt, Haemophilus influenzae Rd
uaaccaagccaaacuauua

SEQ ID NO: 2710666 - RNA, 17 nt, Haemophilus influenzae Rd
uaaccaagcuguaccag

SEQ ID NO: 2710667 - RNA, 14 nt, Haemophilus influenzae Rd
uaaccaauauuugu

SEQ ID NO: 2710668 - RNA, 24 nt, Haemophilus influenzae Rd
uaaccaauggcaaucacaaaucca

SEQ ID NO: 2710669 - RNA, 24 nt, Haemophilus influenzae Rd
uaaccacgcuggaauuuucacauu

SEQ ID NO: 2710670 - RNA, 16 nt, Haemophilus influenzae Rd
uaaccacuaaaaaagc

SEQ ID NO: 2710671 - RNA, 18 nt, Haemophilus influenzae Rd
uaaccacuccaaauaaua

SEQ ID NO: 2710672 - RNA, 19 nt, Haemophilus influenzae Rd
uaaccacuccaaauaauac

SEQ ID NO: 2710673 - RNA, 19 nt, Haemophilus influenzae Rd
uaaccacuugucauuaaaa

SEQ ID NO: 2710674 - RNA, 21 nt, Haemophilus influenzae Rd
uaaccacuugucauuaaaaaa

SEQ ID NO: 2710675 - RNA, 17 nt, Haemophilus influenzae Rd
uaaccaguuauucuuca

SEQ ID NO: 2710676 - RNA, 14 nt, Haemophilus influenzae Rd
uaaccauaaaaaau

SEQ ID NO: 2710677 - RNA, 16 nt, Haemophilus influenzae Rd
uaaccauaaaaaaugg

SEQ ID NO: 2710678 - RNA, 18 nt, Haemophilus influenzae Rd
uaaccaucccagucaaaa

SEQ ID NO: 2710679 - RNA, 21 nt, Haemophilus influenzae Rd
uaaccaucccagucaaaaaug

SEQ ID NO: 2710680 - RNA, 18 nt, Haemophilus influenzae Rd
uaaccaucuuuuuuugca

SEQ ID NO: 2710681 - RNA, 18 nt, Haemophilus influenzae Rd
uaaccauuguuuaauucg

SEQ ID NO: 2710682 - RNA, 14 nt, Haemophilus influenzae Rd
uaacccaccaaauu

SEQ ID NO: 2710683 - RNA, 19 nt, Haemophilus influenzae Rd
uaacccgccuuuguuuuau

SEQ ID NO: 2710684 - RNA, 14 nt, Haemophilus influenzae Rd
uaacccuaaaguga

SEQ ID NO: 2710685 - RNA, 21 nt, Haemophilus influenzae Rd
uaacccuuacuuuauacuaaa

SEQ ID NO: 2710686 - RNA, 19 nt, Haemophilus influenzae Rd
uaaccgcacuguaauaaag

SEQ ID NO: 2710687 - RNA, 11 nt, Haemophilus influenzae Rd
uaaccgcacuu

SEQ ID NO: 2710688 - RNA, 18 nt, Haemophilus influenzae Rd
uaaccgcacuuuagaaaa

SEQ ID NO: 2710689 - RNA, 21 nt, Haemophilus influenzae Rd
uaaccgcacuuuagaaaauau

SEQ ID NO: 2710690 - RNA, 17 nt, Haemophilus influenzae Rd
uaaccgcacuuuuaauu

SEQ ID NO: 2710691 - RNA, 17 nt, Haemophilus influenzae Rd
uaaccgcacuuuuucuu

SEQ ID NO: 2710692 - RNA, 19 nt, Haemophilus influenzae Rd
uaaccgcuuguguuucauu

SEQ ID NO: 2710693 - RNA, 16 nt, Haemophilus influenzae Rd
uaaccguuauaacguu

SEQ ID NO: 2710694 - RNA, 21 nt, Haemophilus influenzae Rd
uaaccguucuaguuuuuccuu

SEQ ID NO: 2710695 - RNA, 13 nt, Haemophilus influenzae Rd
uaaccguuuuuau

SEQ ID NO: 2710696 - RNA, 14 nt, Haemophilus influenzae Rd
uaaccguuuuuauu

SEQ ID NO: 2710697 - RNA, 18 nt, Haemophilus influenzae Rd
uaaccguuuuuauuuguu

SEQ ID NO: 2710698 - RNA, 19 nt, Haemophilus influenzae Rd
uaaccuaccggaaaccagc

SEQ ID NO: 2710699 - RNA, 15 nt, Haemophilus influenzae Rd
uaaccuauaauagcu

SEQ ID NO: 2710700 - RNA, 19 nt, Haemophilus influenzae Rd
uaaccugauuaaucaaaaa

SEQ ID NO: 2710701 - RNA, 22 nt, Haemophilus influenzae Rd
uaaccuuaaaucaaacaaaauu

SEQ ID NO: 2710702 - RNA, 23 nt, Haemophilus influenzae Rd
uaaccuuaaaucaaacaaaauuu

SEQ ID NO: 2710703 - RNA, 20 nt, Haemophilus influenzae Rd
uaaccuuacugccuuuuucu

SEQ ID NO: 2710704 - RNA, 21 nt, Haemophilus influenzae Rd
uaaccuuagcaccacuuaacg

SEQ ID NO: 2710705 - RNA, 20 nt, Haemophilus influenzae Rd
uaaccuugcgcugcuuuauu

SEQ ID NO: 2710706 - RNA, 19 nt, Haemophilus influenzae Rd
uaaccuugcugauaaauuc

SEQ ID NO: 2710707 - RNA, 20 nt, Haemophilus influenzae Rd
uaacgaauuaguauaaacau

SEQ ID NO: 2710708 - RNA, 16 nt, Haemophilus influenzae Rd
uaacgacgggaaacug

SEQ ID NO: 2710709 - RNA, 17 nt, Haemophilus influenzae Rd
uaacgauaagauuugcu

SEQ ID NO: 2710710 - RNA, 15 nt, Haemophilus influenzae Rd
uaacgauauucagug

SEQ ID NO: 2710711 - RNA, 17 nt, Haemophilus influenzae Rd
uaacgauguugcaaccu

SEQ ID NO: 2710712 - RNA, 14 nt, Haemophilus influenzae Rd
uaacgcaaacuaca

SEQ ID NO: 2710713 - RNA, 21 nt, Haemophilus influenzae Rd
uaacgcauaauuugcuguggu

SEQ ID NO: 2710714 - RNA, 16 nt, Haemophilus influenzae Rd
uaacgcaucaccacaa

SEQ ID NO: 2710715 - RNA, 15 nt, Haemophilus influenzae Rd
uaacgccaagguuau

SEQ ID NO: 2710716 - RNA, 19 nt, Haemophilus influenzae Rd
uaacgccauucguucccaa

SEQ ID NO: 2710717 - RNA, 19 nt, Haemophilus influenzae Rd
uaacgcccaaacggcacaa

SEQ ID NO: 2710718 - RNA, 17 nt, Haemophilus influenzae Rd
uaacgcguacuucccgc

SEQ ID NO: 2710719 - RNA, 12 nt, Haemophilus influenzae Rd
uaacgcucaaaa

SEQ ID NO: 2710720 - RNA, 13 nt, Haemophilus influenzae Rd
uaacgcuuuuaaa

SEQ ID NO: 2710721 - RNA, 22 nt, Haemophilus influenzae Rd
uaacguaaccauuguuuaauuc

SEQ ID NO: 2710722 - RNA, 19 nt, Haemophilus influenzae Rd
uaacguaagaaauaacgau

SEQ ID NO: 2710723 - RNA, 17 nt, Haemophilus influenzae Rd
uaacguagcgauaaaau

SEQ ID NO: 2710724 - RNA, 12 nt, Haemophilus influenzae Rd
uaacguuauaaa

SEQ ID NO: 2710725 - RNA, 18 nt, Haemophilus influenzae Rd
uaacguuuaaaaauuaau

SEQ ID NO: 2710726 - RNA, 15 nt, Haemophilus influenzae Rd
uaacuaaaaaaguuu

SEQ ID NO: 2710727 - RNA, 15 nt, Haemophilus influenzae Rd
uaacuaaaaauaccg

SEQ ID NO: 2710728 - RNA, 17 nt, Haemophilus influenzae Rd
uaacuaaaccauuuaau

SEQ ID NO: 2710729 - RNA, 23 nt, Haemophilus influenzae Rd
uaagccuugacgaauaccccaag

SEQ ID NO: 2710730 - RNA, 19 nt, Haemophilus influenzae Rd
uaagcguaaugcacuuuca

SEQ ID NO: 2710731 - RNA, 18 nt, Haemophilus influenzae Rd
uaagcguucguuaucauu

SEQ ID NO: 2710732 - RNA, 17 nt, Haemophilus influenzae Rd
uaagcuaaguacaaaag

SEQ ID NO: 2710733 - RNA, 21 nt, Haemophilus influenzae Rd
uaagcuaccugccauaauaac

SEQ ID NO: 2710734 - RNA, 22 nt, Haemophilus influenzae Rd
uaagcuagaggcugaagccauu

SEQ ID NO: 2710735 - RNA, 19 nt, Haemophilus influenzae Rd
uaagcuaucgucaaauuua

SEQ ID NO: 2710736 - RNA, 21 nt, Haemophilus influenzae Rd
uaagcuaucgucaaauuuaaa

SEQ ID NO: 2710737 - RNA, 19 nt, Haemophilus influenzae Rd
uaagcuauuguuauagaaa

SEQ ID NO: 2710738 - RNA, 17 nt, Haemophilus influenzae Rd
uaagcucgcuauuuuga

SEQ ID NO: 2710739 - RNA, 23 nt, Haemophilus influenzae Rd
uaagcugaaccauuccaaaucau

SEQ ID NO: 2710740 - RNA, 16 nt, Haemophilus influenzae Rd
uaagcuguauuacuua

SEQ ID NO: 2710741 - RNA, 17 nt, Haemophilus influenzae Rd
uaagcugugguaaaaau

SEQ ID NO: 2710742 - RNA, 21 nt, Haemophilus influenzae Rd
uaagcugugguaaaaauaauc

SEQ ID NO: 2710743 - RNA, 12 nt, Haemophilus influenzae Rd
uaagcuuuucua

SEQ ID NO: 2710744 - RNA, 22 nt, Haemophilus influenzae Rd
uaagcuuuucuagcaauaaaga

SEQ ID NO: 2710745 - RNA, 16 nt, Haemophilus influenzae Rd
uaagcuuuugaguuuu

SEQ ID NO: 2710746 - RNA, 16 nt, Haemophilus influenzae Rd
uaagcuuuuuuuaauc

SEQ ID NO: 2710747 - RNA, 18 nt, Haemophilus influenzae Rd
uaagcuuuuuuuaaucac

SEQ ID NO: 2710748 - RNA, 19 nt, Haemophilus influenzae Rd
uaagcuuuuuuuaaucaca

SEQ ID NO: 2710749 - RNA, 17 nt, Haemophilus influenzae Rd
uaaggaaacguaaaaua

SEQ ID NO: 2710750 - RNA, 15 nt, Haemophilus influenzae Rd
uaaggaccaagcaau

SEQ ID NO: 2710751 - RNA, 16 nt, Haemophilus influenzae Rd
uaaggaccaagcaaug

SEQ ID NO: 2710752 - RNA, 21 nt, Haemophilus influenzae Rd
uaaggaucuuguaaagauugu

SEQ ID NO: 2710753 - RNA, 18 nt, Haemophilus influenzae Rd
uaaggauuucuuaugaaa

SEQ ID NO: 2710754 - RNA, 19 nt, Haemophilus influenzae Rd
uaaggauuucuuaugaaaa

SEQ ID NO: 2710755 - RNA, 22 nt, Haemophilus influenzae Rd
uaaggcgagaucuugauaauag

SEQ ID NO: 2710756 - RNA, 15 nt, Haemophilus influenzae Rd
uaaggcuagauaaca

SEQ ID NO: 2710757 - RNA, 16 nt, Haemophilus influenzae Rd
uaaggcuuuucuuuua

SEQ ID NO: 2710758 - RNA, 14 nt, Haemophilus influenzae Rd
uaagggcaaaaaau

SEQ ID NO: 2710759 - RNA, 16 nt, Haemophilus influenzae Rd
uaagggcaaaaaaucu

SEQ ID NO: 2710760 - RNA, 19 nt, Haemophilus influenzae Rd
uaagguaauauguaauauu

SEQ ID NO: 2710761 - RNA, 13 nt, Haemophilus influenzae Rd
uaagguacaacag

SEQ ID NO: 2710762 - RNA, 22 nt, Haemophilus influenzae Rd
uaaggugcagaaaacucgacuu

SEQ ID NO: 2710763 - RNA, 21 nt, Haemophilus influenzae Rd
uaaggugcagauuaauuauau

SEQ ID NO: 2710764 - RNA, 22 nt, Haemophilus influenzae Rd
uaagguggauuggucacgauaa

SEQ ID NO: 2710765 - RNA, 15 nt, Haemophilus influenzae Rd
uaagguuaaauucac

SEQ ID NO: 2710766 - RNA, 16 nt, Haemophilus influenzae Rd
uaagguuaaauucacu

SEQ ID NO: 2710767 - RNA, 19 nt, Haemophilus influenzae Rd
uaagguuaugccaaugcua

SEQ ID NO: 2710768 - RNA, 17 nt, Haemophilus influenzae Rd
uaagguuuauagaugaa

SEQ ID NO: 2710769 - RNA, 16 nt, Haemophilus influenzae Rd
uaagguuuccauaaug

SEQ ID NO: 2710770 - RNA, 13 nt, Haemophilus influenzae Rd
uaaguaaauauuu

SEQ ID NO: 2710771 - RNA, 14 nt, Haemophilus influenzae Rd
uaaguaaauauuuu

SEQ ID NO: 2710772 - RNA, 19 nt, Haemophilus influenzae Rd
uaaguaaggguaucacaaa

SEQ ID NO: 2710773 - RNA, 13 nt, Haemophilus influenzae Rd
uaaguaaugcuaa

SEQ ID NO: 2710774 - RNA, 15 nt, Haemophilus influenzae Rd
uaaguacaaaagagc

SEQ ID NO: 2710775 - RNA, 21 nt, Haemophilus influenzae Rd
uaaguacgacaucuuaaauua

SEQ ID NO: 2710776 - RNA, 20 nt, Haemophilus influenzae Rd
uaaguaguauuuuauuuaua

SEQ ID NO: 2710777 - RNA, 13 nt, Haemophilus influenzae Rd
uaaguaguuacca

SEQ ID NO: 2710778 - RNA, 14 nt, Haemophilus influenzae Rd
uaaguauaaaucua

SEQ ID NO: 2710779 - RNA, 19 nt, Haemophilus influenzae Rd
uaaguauaacuaauuaaga

SEQ ID NO: 2710780 - RNA, 15 nt, Haemophilus influenzae Rd
uaaguauagcuuuuu

SEQ ID NO: 2710781 - RNA, 18 nt, Haemophilus influenzae Rd
uaaguauagcuuuuugca

SEQ ID NO: 2710782 - RNA, 18 nt, Haemophilus influenzae Rd
uaaguaugccauaaaaua

SEQ ID NO: 2710783 - RNA, 19 nt, Haemophilus influenzae Rd
uaaguaugccauaaaauag

SEQ ID NO: 2710784 - RNA, 17 nt, Haemophilus influenzae Rd
uaagucaagcuaaucuc

SEQ ID NO: 2710785 - RNA, 22 nt, Haemophilus influenzae Rd
uaagucagcauaaacaaaauaa

SEQ ID NO: 2710786 - RNA, 16 nt, Haemophilus influenzae Rd
uaagucaggaauaaaa

SEQ ID NO: 2710787 - RNA, 16 nt, Haemophilus influenzae Rd
uaagucauauagggcu

SEQ ID NO: 2710788 - RNA, 17 nt, Haemophilus influenzae Rd
uaagucuaguaacuguu

SEQ ID NO: 2710789 - RNA, 21 nt, Haemophilus influenzae Rd
uaagucuauuacuaaaauucu

SEQ ID NO: 2710790 - RNA, 12 nt, Haemophilus influenzae Rd
uaagucuucuuu

SEQ ID NO: 2710791 - RNA, 19 nt, Haemophilus influenzae Rd
uaagugauaaguauaacuu

SEQ ID NO: 2710792 - RNA, 23 nt, Haemophilus influenzae Rd
uaagugcgguauuuuuauuuaua

SEQ ID NO: 2710793 - RNA, 20 nt, Haemophilus influenzae Rd
uaagugcgguccguuuucaa

SEQ ID NO: 2710794 - RNA, 21 nt, Haemophilus influenzae Rd
uaagugcgguccguuuucaau

SEQ ID NO: 2710795 - RNA, 13 nt, Haemophilus influenzae Rd
uaaguguuuacua

SEQ ID NO: 2710796 - RNA, 12 nt, Haemophilus influenzae Rd
uaaguuaaaagu

SEQ ID NO: 2710797 - RNA, 15 nt, Haemophilus influenzae Rd
uaaguuaaaccaaca

SEQ ID NO: 2710798 - RNA, 22 nt, Haemophilus influenzae Rd
uaaguuaccgcuucuuccuguu

SEQ ID NO: 2710799 - RNA, 16 nt, Haemophilus influenzae Rd
uaaguuauuuauauaa

SEQ ID NO: 2710800 - RNA, 21 nt, Haemophilus influenzae Rd
uaaguuauuuauauaauuuaa

SEQ ID NO: 2710801 - RNA, 22 nt, Haemophilus influenzae Rd
uaaguuauuuauauaauuuaac

SEQ ID NO: 2710802 - RNA, 18 nt, Haemophilus influenzae Rd
uaaguucaaauuucuuca

SEQ ID NO: 2710803 - RNA, 16 nt, Haemophilus influenzae Rd
uaaguucagaaagaga

SEQ ID NO: 2710804 - RNA, 23 nt, Haemophilus influenzae Rd
uaaguucagaaagagacucuguu

SEQ ID NO: 2710805 - RNA, 17 nt, Haemophilus influenzae Rd
uaaguucauaaaagggg

SEQ ID NO: 2710806 - RNA, 21 nt, Haemophilus influenzae Rd
uaaguucauaaaaggggcaaa

SEQ ID NO: 2710807 - RNA, 13 nt, Haemophilus influenzae Rd
uaaguucuaaaau

SEQ ID NO: 2710808 - RNA, 14 nt, Haemophilus influenzae Rd
uaaguucuaaaauu

SEQ ID NO: 2710809 - RNA, 18 nt, Haemophilus influenzae Rd
uaaguucuaaauaaacua

SEQ ID NO: 2710810 - RNA, 22 nt, Haemophilus influenzae Rd
uaaguugggcuuauuuguuuua

SEQ ID NO: 2710811 - RNA, 18 nt, Haemophilus influenzae Rd
uaaguuuucaccaacaaa

SEQ ID NO: 2710812 - RNA, 15 nt, Haemophilus influenzae Rd
uaaguuuuuugccaa

SEQ ID NO: 2710813 - RNA, 13 nt, Haemophilus influenzae Rd
uaauaaaaaaacc

SEQ ID NO: 2710814 - RNA, 13 nt, Haemophilus influenzae Rd
uaauaaaaaauaa

SEQ ID NO: 2710815 - RNA, 13 nt, Haemophilus influenzae Rd
uaauaaaaauccu

SEQ ID NO: 2710816 - RNA, 17 nt, Haemophilus influenzae Rd
uaauaaaacaaauguaa

SEQ ID NO: 2710817 - RNA, 21 nt, Haemophilus influenzae Rd
uaauaaaacaaauguaaaaca

SEQ ID NO: 2710818 - RNA, 20 nt, Haemophilus influenzae Rd
uaauaaaaucacgaauugau

SEQ ID NO: 2710819 - RNA, 19 nt, Haemophilus influenzae Rd
uaauaaaccaacauacauu

SEQ ID NO: 2710820 - RNA, 20 nt, Haemophilus influenzae Rd
uaauaaaccaacauacauua

SEQ ID NO: 2710821 - RNA, 14 nt, Haemophilus influenzae Rd
uaauaaaccaauaa

SEQ ID NO: 2710822 - RNA, 21 nt, Haemophilus influenzae Rd
uaauaaaccaauaagauagaa

SEQ ID NO: 2710823 - RNA, 23 nt, Haemophilus influenzae Rd
uaauaaaccaauaagauagaaau

SEQ ID NO: 2710824 - RNA, 15 nt, Haemophilus influenzae Rd
uaauaaagauaaauu

SEQ ID NO: 2710825 - RNA, 20 nt, Haemophilus influenzae Rd
uaauaaagcuccuugaauau

SEQ ID NO: 2710826 - RNA, 15 nt, Haemophilus influenzae Rd
uaauaaaguaaaaua

SEQ ID NO: 2710827 - RNA, 22 nt, Haemophilus influenzae Rd
uaauaaagucgguucauuuggg

SEQ ID NO: 2710828 - RNA, 14 nt, Haemophilus influenzae Rd
uaauaaauagaaau

SEQ ID NO: 2710829 - RNA, 12 nt, Haemophilus influenzae Rd
uaauaaaucaag

SEQ ID NO: 2710830 - RNA, 24 nt, Haemophilus influenzae Rd
uaauaaauccuucaggauaaaaca

SEQ ID NO: 2710831 - RNA, 23 nt, Haemophilus influenzae Rd
uaauaaauuagccccaaauuacu

SEQ ID NO: 2710832 - RNA, 19 nt, Haemophilus influenzae Rd
uaauaacaagcgaaaaacg

SEQ ID NO: 2710833 - RNA, 19 nt, Haemophilus influenzae Rd
uaauaacguguaaauugcu

SEQ ID NO: 2710834 - RNA, 16 nt, Haemophilus influenzae Rd
uaaucacugaauuuca

SEQ ID NO: 2710835 - RNA, 16 nt, Haemophilus influenzae Rd
uaaucacuugauaaaa

SEQ ID NO: 2710836 - RNA, 22 nt, Haemophilus influenzae Rd
uaaucagaacaagcauuuuuca

SEQ ID NO: 2710837 - RNA, 17 nt, Haemophilus influenzae Rd
uaaucagugauuauauu

SEQ ID NO: 2710838 - RNA, 23 nt, Haemophilus influenzae Rd
uaaucaguugaucgcaauguuca

SEQ ID NO: 2710839 - RNA, 24 nt, Haemophilus influenzae Rd
uaaucaguugaucgcaauguucac

SEQ ID NO: 2710840 - RNA, 19 nt, Haemophilus influenzae Rd
uaaucauaucuaacauagg

SEQ ID NO: 2710841 - RNA, 22 nt, Haemophilus influenzae Rd
uaaucauuacuuagauauauua

SEQ ID NO: 2710842 - RNA, 18 nt, Haemophilus influenzae Rd
uaaucauugcaagugcag

SEQ ID NO: 2710843 - RNA, 21 nt, Haemophilus influenzae Rd
uaauccaacuaugaagacuaa

SEQ ID NO: 2710844 - RNA, 18 nt, Haemophilus influenzae Rd
uaauccaauccauaacaa

SEQ ID NO: 2710845 - RNA, 17 nt, Haemophilus influenzae Rd
uaauccagcuacauuca

SEQ ID NO: 2710846 - RNA, 18 nt, Haemophilus influenzae Rd
uaauccagcuacauucau

SEQ ID NO: 2710847 - RNA, 14 nt, Haemophilus influenzae Rd
uaauccauuuugaa

SEQ ID NO: 2710848 - RNA, 16 nt, Haemophilus influenzae Rd
uaauccccuaaacuaa

SEQ ID NO: 2710849 - RNA, 15 nt, Haemophilus influenzae Rd
uaauccgcaucuaaa

SEQ ID NO: 2710850 - RNA, 17 nt, Haemophilus influenzae Rd
uaauccguuaauuucau

SEQ ID NO: 2710851 - RNA, 19 nt, Haemophilus influenzae Rd
uaauccguuaauuucaucc

SEQ ID NO: 2710852 - RNA, 20 nt, Haemophilus influenzae Rd
uaauccugccaguagaaaau

SEQ ID NO: 2710853 - RNA, 22 nt, Haemophilus influenzae Rd
uaauccugcgugaaugacuuuc

SEQ ID NO: 2710854 - RNA, 17 nt, Haemophilus influenzae Rd
uaauccugucaucugua

SEQ ID NO: 2710855 - RNA, 17 nt, Haemophilus influenzae Rd
uaauccuucuucggcga

SEQ ID NO: 2710856 - RNA, 17 nt, Haemophilus influenzae Rd
uaauccuuucacuaaag

SEQ ID NO: 2710857 - RNA, 14 nt, Haemophilus influenzae Rd
uaaucgaaaucaca

SEQ ID NO: 2710858 - RNA, 13 nt, Haemophilus influenzae Rd
uaaucgaucaauu

SEQ ID NO: 2710859 - RNA, 17 nt, Haemophilus influenzae Rd
uaaucgaucaauuugcg

SEQ ID NO: 2710860 - RNA, 23 nt, Haemophilus influenzae Rd
uaaucgcaaugccagcgcuugca

SEQ ID NO: 2710861 - RNA, 14 nt, Haemophilus influenzae Rd
uaaucgcacuuaaa

SEQ ID NO: 2710862 - RNA, 17 nt, Haemophilus influenzae Rd
uaaucgcauuguuuuau

SEQ ID NO: 2710863 - RNA, 15 nt, Haemophilus influenzae Rd
uaaucgccaaaauca

SEQ ID NO: 2710864 - RNA, 17 nt, Haemophilus influenzae Rd
uaaucgccaaucuaagc

SEQ ID NO: 2710865 - RNA, 14 nt, Haemophilus influenzae Rd
uaaucgccccaaaa

SEQ ID NO: 2710866 - RNA, 15 nt, Haemophilus influenzae Rd
uaaucgccccaaaag

SEQ ID NO: 2710867 - RNA, 16 nt, Haemophilus influenzae Rd
uaaucgcccuuuuguu

SEQ ID NO: 2710868 - RNA, 16 nt, Haemophilus influenzae Rd
uaaucggauguuugaa

SEQ ID NO: 2710869 - RNA, 15 nt, Haemophilus influenzae Rd
uaaucggcaauguuu

SEQ ID NO: 2710870 - RNA, 18 nt, Haemophilus influenzae Rd
uaaucggcaauguuuuaa

SEQ ID NO: 2710871 - RNA, 15 nt, Haemophilus influenzae Rd
uaaucggcacaagac

SEQ ID NO: 2710872 - RNA, 15 nt, Haemophilus influenzae Rd
uaaucgggauaacuu

SEQ ID NO: 2710873 - RNA, 22 nt, Haemophilus influenzae Rd
uaaucgguuguuuuuuaauauc

SEQ ID NO: 2710874 - RNA, 21 nt, Haemophilus influenzae Rd
uaaucguagaaaucaaaaaug

SEQ ID NO: 2710875 - RNA, 16 nt, Haemophilus influenzae Rd
uaaucguccaauuuca

SEQ ID NO: 2710876 - RNA, 18 nt, Haemophilus influenzae Rd
uaaucgugccugccacca

SEQ ID NO: 2710877 - RNA, 23 nt, Haemophilus influenzae Rd
uaaucguuuaggaauuuaugguu

SEQ ID NO: 2710878 - RNA, 14 nt, Haemophilus influenzae Rd
uaaucguuuuucca

SEQ ID NO: 2710879 - RNA, 17 nt, Haemophilus influenzae Rd
uaaucuaaaaaaccuug

SEQ ID NO: 2710880 - RNA, 16 nt, Haemophilus influenzae Rd
uaaucuaaaaauuaac

SEQ ID NO: 2710881 - RNA, 21 nt, Haemophilus influenzae Rd
uaaucuaaacuuguuaaauaa

SEQ ID NO: 2710882 - RNA, 12 nt, Haemophilus influenzae Rd
uaaucuacaaaa

SEQ ID NO: 2710883 - RNA, 13 nt, Haemophilus influenzae Rd
uaaucuacaaaac

SEQ ID NO: 2710884 - RNA, 23 nt, Haemophilus influenzae Rd
uaaucuacaaaacauaauaaaau

SEQ ID NO: 2710885 - RNA, 12 nt, Haemophilus influenzae Rd
uaaucucccaaa

SEQ ID NO: 2710886 - RNA, 15 nt, Haemophilus influenzae Rd
uaaucucccaaagaa

SEQ ID NO: 2710887 - RNA, 14 nt, Haemophilus influenzae Rd
uaaucucuucuaaa

SEQ ID NO: 2710888 - RNA, 15 nt, Haemophilus influenzae Rd
uaaucugauaaauuu

SEQ ID NO: 2710889 - RNA, 18 nt, Haemophilus influenzae Rd
uaaucugauaaauuuugu

SEQ ID NO: 2710890 - RNA, 11 nt, Haemophilus influenzae Rd
uaaucuucuuc

SEQ ID NO: 2710891 - RNA, 12 nt, Haemophilus influenzae Rd
uaaucuucuucc

SEQ ID NO: 2710892 - RNA, 13 nt, Haemophilus influenzae Rd
uaaucuucuuccc

SEQ ID NO: 2710893 - RNA, 13 nt, Haemophilus influenzae Rd
uaaucuugaccaa

SEQ ID NO: 2710894 - RNA, 23 nt, Haemophilus influenzae Rd
uaaucuuuaaaauguaaaaaauc

SEQ ID NO: 2710895 - RNA, 21 nt, Haemophilus influenzae Rd
uaaucuuucacugcauuuucu

SEQ ID NO: 2710896 - RNA, 13 nt, Haemophilus influenzae Rd
uaaucuuuuaauu

SEQ ID NO: 2710897 - RNA, 12 nt, Haemophilus influenzae Rd
uaaucuuuuuuc

SEQ ID NO: 2710898 - RNA, 18 nt, Haemophilus influenzae Rd
uaaugaaacuucaccagu

SEQ ID NO: 2710899 - RNA, 20 nt, Haemophilus influenzae Rd
uaaugaaagggaaauuuauu

SEQ ID NO: 2710900 - RNA, 13 nt, Haemophilus influenzae Rd
uaaugaaauauuc

SEQ ID NO: 2710901 - RNA, 17 nt, Haemophilus influenzae Rd
uaaugaaccaaaucuaa

SEQ ID NO: 2710902 - RNA, 18 nt, Haemophilus influenzae Rd
uaaugaacgaacuaaaau

SEQ ID NO: 2710903 - RNA, 19 nt, Haemophilus influenzae Rd
uaaugaaucugcaccuaaa

SEQ ID NO: 2710904 - RNA, 22 nt, Haemophilus influenzae Rd
uaaugacauuaaagcaauugcu

SEQ ID NO: 2710905 - RNA, 16 nt, Haemophilus influenzae Rd
uaaugagguauaaaau

SEQ ID NO: 2710906 - RNA, 17 nt, Haemophilus influenzae Rd
uaaugauaaauuuuauu

SEQ ID NO: 2710907 - RNA, 12 nt, Haemophilus influenzae Rd
uaaugauaaucu

SEQ ID NO: 2710908 - RNA, 15 nt, Haemophilus influenzae Rd
uaaugauauuauucc

SEQ ID NO: 2710909 - RNA, 18 nt, Haemophilus influenzae Rd
uaaugauguaccaaaaug

SEQ ID NO: 2710910 - RNA, 11 nt, Haemophilus influenzae Rd
uaaugauuaau

SEQ ID NO: 2710911 - RNA, 14 nt, Haemophilus influenzae Rd
uaaugauuaauuaa

SEQ ID NO: 2710912 - RNA, 14 nt, Haemophilus influenzae Rd
uaaugcaaaaucuu

SEQ ID NO: 2710913 - RNA, 16 nt, Haemophilus influenzae Rd
uaaugcaaccaaacaa

SEQ ID NO: 2710914 - RNA, 18 nt, Haemophilus influenzae Rd
uaaugcaguaauaaaucc

SEQ ID NO: 2710915 - RNA, 19 nt, Haemophilus influenzae Rd
uaaugcaguaauaaauccu

SEQ ID NO: 2710916 - RNA, 20 nt, Haemophilus influenzae Rd
uaaugccauugcgugaauau

SEQ ID NO: 2710917 - RNA, 21 nt, Haemophilus influenzae Rd
uaaugccgccuuaucuaaacu

SEQ ID NO: 2710918 - RNA, 14 nt, Haemophilus influenzae Rd
uaaugccuguuacg

SEQ ID NO: 2710919 - RNA, 16 nt, Haemophilus influenzae Rd
uaaugcggcgaauagc

SEQ ID NO: 2710920 - RNA, 23 nt, Haemophilus influenzae Rd
uaaugcggugcuuuaaguaaaag

SEQ ID NO: 2710921 - RNA, 15 nt, Haemophilus influenzae Rd
uaaugcuaaaccaau

SEQ ID NO: 2710922 - RNA, 13 nt, Haemophilus influenzae Rd
uaaugcuguuuaa

SEQ ID NO: 2710923 - RNA, 23 nt, Haemophilus influenzae Rd
uaaugcuguuuaaaucuaagccu

SEQ ID NO: 2710924 - RNA, 15 nt, Haemophilus influenzae Rd
uaaugcuucuaaucc

SEQ ID NO: 2710925 - RNA, 19 nt, Haemophilus influenzae Rd
uaaugcuucuaaucccauu

SEQ ID NO: 2710926 - RNA, 23 nt, Haemophilus influenzae Rd
uaaugcuucuguugcuucaauug

SEQ ID NO: 2710927 - RNA, 16 nt, Haemophilus influenzae Rd
uaaugcuuuaaauugu

SEQ ID NO: 2710928 - RNA, 17 nt, Haemophilus influenzae Rd
uaaugcuuuaauuuguu

SEQ ID NO: 2710929 - RNA, 15 nt, Haemophilus influenzae Rd
uaaugcuuuauuuaa

SEQ ID NO: 2710930 - RNA, 17 nt, Haemophilus influenzae Rd
uaaugcuuuauuuaaau

SEQ ID NO: 2710931 - RNA, 14 nt, Haemophilus influenzae Rd
uaauggcaauucgu

SEQ ID NO: 2710932 - RNA, 14 nt, Haemophilus influenzae Rd
uaauggcaauuucc

SEQ ID NO: 2710933 - RNA, 21 nt, Haemophilus influenzae Rd
uaauggcccguguuucaauuc

SEQ ID NO: 2710934 - RNA, 23 nt, Haemophilus influenzae Rd
uaauggcgguaaaaaaguaacaa

SEQ ID NO: 2710935 - RNA, 15 nt, Haemophilus influenzae Rd
uaauggguuaaaagc

SEQ ID NO: 2710936 - RNA, 18 nt, Haemophilus influenzae Rd
uaauggguuaaaagccaa

SEQ ID NO: 2710937 - RNA, 15 nt, Haemophilus influenzae Rd
uaaugguauugugau

SEQ ID NO: 2710938 - RNA, 21 nt, Haemophilus influenzae Rd
uaaugguuguaaauuuucaau

SEQ ID NO: 2710939 - RNA, 13 nt, Haemophilus influenzae Rd
uaaugguuugcug

SEQ ID NO: 2710940 - RNA, 14 nt, Haemophilus influenzae Rd
uaauugacguaaaa

SEQ ID NO: 2710941 - RNA, 14 nt, Haemophilus influenzae Rd
uaauugauuaaaaa

SEQ ID NO: 2710942 - RNA, 18 nt, Haemophilus influenzae Rd
uaauugauucgauaaauu

SEQ ID NO: 2710943 - RNA, 18 nt, Haemophilus influenzae Rd
uaauugauuuaaaaaucu

SEQ ID NO: 2710944 - RNA, 20 nt, Haemophilus influenzae Rd
uaauugauuuuaaagaaugu

SEQ ID NO: 2710945 - RNA, 18 nt, Haemophilus influenzae Rd
uaauugauuuucagaaag

SEQ ID NO: 2710946 - RNA, 19 nt, Haemophilus influenzae Rd
uaauugcccaauaaaagua

SEQ ID NO: 2710947 - RNA, 20 nt, Haemophilus influenzae Rd
uaauugcuaccauuuaucuu

SEQ ID NO: 2710948 - RNA, 19 nt, Haemophilus influenzae Rd
uaauugcugggcaauauaa

SEQ ID NO: 2710949 - RNA, 14 nt, Haemophilus influenzae Rd
uaauuggaaauaau

SEQ ID NO: 2710950 - RNA, 16 nt, Haemophilus influenzae Rd
uaauuggacaagaaau

SEQ ID NO: 2710951 - RNA, 17 nt, Haemophilus influenzae Rd
uaauuggacaagaaaua

SEQ ID NO: 2710952 - RNA, 21 nt, Haemophilus influenzae Rd
uaauugggucguuagcucagu

SEQ ID NO: 2710953 - RNA, 22 nt, Haemophilus influenzae Rd
uaauugguaaucaaauucugug

SEQ ID NO: 2710954 - RNA, 16 nt, Haemophilus influenzae Rd
uaauuggugugcaaua

SEQ ID NO: 2710955 - RNA, 14 nt, Haemophilus influenzae Rd
uaauugugcaauuu

SEQ ID NO: 2710956 - RNA, 20 nt, Haemophilus influenzae Rd
uaauugugcggauuuaucuu

SEQ ID NO: 2710957 - RNA, 13 nt, Haemophilus influenzae Rd
uaauugugcuaaa

SEQ ID NO: 2710958 - RNA, 15 nt, Haemophilus influenzae Rd
uaauugugcuaaaua

SEQ ID NO: 2710959 - RNA, 20 nt, Haemophilus influenzae Rd
uaauugugcuaaauaauuac

SEQ ID NO: 2710960 - RNA, 22 nt, Haemophilus influenzae Rd
uaauugugggaaaguuggccaa

SEQ ID NO: 2710961 - RNA, 23 nt, Haemophilus influenzae Rd
uaauuguugguuacuaaauguga

SEQ ID NO: 2710962 - RNA, 16 nt, Haemophilus influenzae Rd
uaauuguuguaaaaua

SEQ ID NO: 2710963 - RNA, 22 nt, Haemophilus influenzae Rd
uaauuguuugguagaguaaauu

SEQ ID NO: 2710964 - RNA, 14 nt, Haemophilus influenzae Rd
uaauuguuuuaaaa

SEQ ID NO: 2710965 - RNA, 15 nt, Haemophilus influenzae Rd
uaauuuaagaaaaac

SEQ ID NO: 2710966 - RNA, 16 nt, Haemophilus influenzae Rd
uaauuuaagaaaaacg

SEQ ID NO: 2710967 - RNA, 19 nt, Haemophilus influenzae Rd
uaauuuaaggcuuuuucug

SEQ ID NO: 2710968 - RNA, 19 nt, Haemophilus influenzae Rd
uaauuuaauucuaaauucu

SEQ ID NO: 2710969 - RNA, 19 nt, Haemophilus influenzae Rd
uaauuuacagccugcgagc

SEQ ID NO: 2710970 - RNA, 22 nt, Haemophilus influenzae Rd
uaauuuacguaaugcuuuugcu

SEQ ID NO: 2710971 - RNA, 23 nt, Haemophilus influenzae Rd
uaauuuacguaucgcuaagaaua

SEQ ID NO: 2710972 - RNA, 22 nt, Haemophilus influenzae Rd
uaauuuacuggaaauucuucaa

SEQ ID NO: 2710973 - RNA, 17 nt, Haemophilus influenzae Rd
uaauuuagcccgaaaau

SEQ ID NO: 2710974 - RNA, 15 nt, Haemophilus influenzae Rd
uaauuuagcgacagc

SEQ ID NO: 2710975 - RNA, 13 nt, Haemophilus influenzae Rd
uaauuuagucaua

SEQ ID NO: 2710976 - RNA, 19 nt, Haemophilus influenzae Rd
uaauuuaguuauaugccua

SEQ ID NO: 2710977 - RNA, 11 nt, Haemophilus influenzae Rd
uaauuuauaca

SEQ ID NO: 2710978 - RNA, 23 nt, Haemophilus influenzae Rd
uaauuuaucaucuaguuuuaaua

SEQ ID NO: 2710979 - RNA, 20 nt, Haemophilus influenzae Rd
uaauuuaucgccauagaaaa

SEQ ID NO: 2710980 - RNA, 14 nt, Haemophilus influenzae Rd
uaauuuauuuucua

SEQ ID NO: 2710981 - RNA, 17 nt, Haemophilus influenzae Rd
uaauuucaaaaucacau

SEQ ID NO: 2710982 - RNA, 17 nt, Haemophilus influenzae Rd
uaauuucaauauaaguu

SEQ ID NO: 2710983 - RNA, 15 nt, Haemophilus influenzae Rd
uaauuucacaauuuu

SEQ ID NO: 2710984 - RNA, 22 nt, Haemophilus influenzae Rd
uaauuucacaccauuuuuaauu

SEQ ID NO: 2710985 - RNA, 16 nt, Haemophilus influenzae Rd
uaauuucauaaaaauu

SEQ ID NO: 2710986 - RNA, 22 nt, Haemophilus influenzae Rd
uaauuucaucgcguuuuuucuu

SEQ ID NO: 2710987 - RNA, 21 nt, Haemophilus influenzae Rd
uaauuucaucguauuuccuau

SEQ ID NO: 2710988 - RNA, 18 nt, Haemophilus influenzae Rd
uaauuucaucuuuuaaau

SEQ ID NO: 2710989 - RNA, 15 nt, Haemophilus influenzae Rd
uaauuucauuaauaa

SEQ ID NO: 2710990 - RNA, 15 nt, Haemophilus influenzae Rd
uaauuucauuuugca

SEQ ID NO: 2710991 - RNA, 18 nt, Haemophilus influenzae Rd
uaauuucucugcgcacuu

SEQ ID NO: 2710992 - RNA, 21 nt, Haemophilus influenzae Rd
uaauuugaccuucauaaacuu

SEQ ID NO: 2710993 - RNA, 19 nt, Haemophilus influenzae Rd
uaauuugaucuaauuugcc

SEQ ID NO: 2710994 - RNA, 17 nt, Haemophilus influenzae Rd
uaauuugccaucacuca

SEQ ID NO: 2710995 - RNA, 16 nt, Haemophilus influenzae Rd
uaauuugcucaaaguu

SEQ ID NO: 2710996 - RNA, 20 nt, Haemophilus influenzae Rd
uaauuugcucaaaguucggg

SEQ ID NO: 2710997 - RNA, 23 nt, Haemophilus influenzae Rd
uaauuugcuguggugaagugcgg

SEQ ID NO: 2710998 - RNA, 17 nt, Haemophilus influenzae Rd
uaauuugcuuuuugauu

SEQ ID NO: 2710999 - RNA, 21 nt, Haemophilus influenzae Rd
uaauuuggucuguuucuucua

SEQ ID NO: 2711000 - RNA, 13 nt, Haemophilus influenzae Rd
uaauuuguuagau

SEQ ID NO: 2711001 - RNA, 20 nt, Haemophilus influenzae Rd
uaauuuguuagaucaaauuu

SEQ ID NO: 2711002 - RNA, 14 nt, Haemophilus influenzae Rd
uaauuuuaaaacau

SEQ ID NO: 2711003 - RNA, 19 nt, Haemophilus influenzae Rd
uaauuuuaccaagaaauaa

SEQ ID NO: 2711004 - RNA, 15 nt, Haemophilus influenzae Rd
uaauuuuacguuuca

SEQ ID NO: 2711005 - RNA, 13 nt, Haemophilus influenzae Rd
uaauuuuauagaa

SEQ ID NO: 2711006 - RNA, 12 nt, Haemophilus influenzae Rd
uaauuuuauagc

SEQ ID NO: 2711007 - RNA, 16 nt, Haemophilus influenzae Rd
uaauuuuaucuaauca

SEQ ID NO: 2711008 - RNA, 17 nt, Haemophilus influenzae Rd
uaauuuuaucuaaucau

SEQ ID NO: 2711009 - RNA, 22 nt, Haemophilus influenzae Rd
uaauuuucaaacacaacauaau

SEQ ID NO: 2711010 - RNA, 20 nt, Haemophilus influenzae Rd
uaauuuuccuaacaauaauu

SEQ ID NO: 2711011 - RNA, 13 nt, Haemophilus influenzae Rd
uaauuuugcgguu

SEQ ID NO: 2711012 - RNA, 21 nt, Haemophilus influenzae Rd
uaauuuuguaagcauuaaaaa

SEQ ID NO: 2711013 - RNA, 23 nt, Haemophilus influenzae Rd
uaauuuuguuagcggauaaaaua

SEQ ID NO: 2711014 - RNA, 14 nt, Haemophilus influenzae Rd
uaauuuuuaaaaua

SEQ ID NO: 2711015 - RNA, 15 nt, Haemophilus influenzae Rd
uaauuuuuaaaauag

SEQ ID NO: 2711016 - RNA, 16 nt, Haemophilus influenzae Rd
uaauuuuuaaaauaga

SEQ ID NO: 2711017 - RNA, 14 nt, Haemophilus influenzae Rd
uaauuuuuaaagaa

SEQ ID NO: 2711018 - RNA, 17 nt, Haemophilus influenzae Rd
uaauuuuuaaagaaauc

SEQ ID NO: 2711019 - RNA, 16 nt, Haemophilus influenzae Rd
uaauuuuuaauucuuu

SEQ ID NO: 2711020 - RNA, 12 nt, Haemophilus influenzae Rd
uaauuuuuagaa

SEQ ID NO: 2711021 - RNA, 14 nt, Haemophilus influenzae Rd
uaauuuuuauaauu

SEQ ID NO: 2711022 - RNA, 15 nt, Haemophilus influenzae Rd
uaauuuuuauaauuu

SEQ ID NO: 2711023 - RNA, 19 nt, Haemophilus influenzae Rd
uaauuuuuauaauuuugau

SEQ ID NO: 2711024 - RNA, 14 nt, Haemophilus influenzae Rd
uaauuuuucacuga

SEQ ID NO: 2711025 - RNA, 22 nt, Haemophilus influenzae Rd
uaauuuuucagguacaacauuu

SEQ ID NO: 2711026 - RNA, 13 nt, Haemophilus influenzae Rd
uaauuuuucuuca

SEQ ID NO: 2711027 - RNA, 18 nt, Haemophilus influenzae Rd
uaauuuuuuacgauauuu

SEQ ID NO: 2711028 - RNA, 19 nt, Haemophilus influenzae Rd
uaauuuuuuacgauauuuu

SEQ ID NO: 2711029 - RNA, 18 nt, Haemophilus influenzae Rd
uaauuuuuuauucaaaau

SEQ ID NO: 2711030 - RNA, 19 nt, Haemophilus influenzae Rd
uaauuuuuuguucauuuua

SEQ ID NO: 2711031 - RNA, 13 nt, Haemophilus influenzae Rd
uaauuuuuuucca

SEQ ID NO: 2711032 - RNA, 19 nt, Haemophilus influenzae Rd
uaauuuuuuuucuaauaau

SEQ ID NO: 2711033 - RNA, 14 nt, Haemophilus influenzae Rd
uacaaaacauaaua

SEQ ID NO: 2711034 - RNA, 23 nt, Haemophilus influenzae Rd
uacaaaacauaauaaaauuuauu

SEQ ID NO: 2711035 - RNA, 12 nt, Haemophilus influenzae Rd
uacaaaaccaau

SEQ ID NO: 2711036 - RNA, 20 nt, Haemophilus influenzae Rd
uacaaaagagcgguugaaaa

SEQ ID NO: 2711037 - RNA, 23 nt, Haemophilus influenzae Rd
uacaaaauccacacuuuaaaagu

SEQ ID NO: 2711038 - RNA, 19 nt, Haemophilus influenzae Rd
uacaaaauuagacuuucuu

SEQ ID NO: 2711039 - RNA, 22 nt, Haemophilus influenzae Rd
uacaaacauauuggcgauuaau

SEQ ID NO: 2711040 - RNA, 13 nt, Haemophilus influenzae Rd
uacaaacccacaa

SEQ ID NO: 2711041 - RNA, 18 nt, Haemophilus influenzae Rd
uacaaauaacacagaaac

SEQ ID NO: 2711042 - RNA, 22 nt, Haemophilus influenzae Rd
uacaaauaacacagaaaccaau

SEQ ID NO: 2711043 - RNA, 23 nt, Haemophilus influenzae Rd
uacaaauaaccuaucccaaaaug

SEQ ID NO: 2711044 - RNA, 15 nt, Haemophilus influenzae Rd
uacaaauacugaccu

SEQ ID NO: 2711045 - RNA, 18 nt, Haemophilus influenzae Rd
uacauuuacaucuaaaau

SEQ ID NO: 2711046 - RNA, 15 nt, Haemophilus influenzae Rd
uacauuucuaaaaua

SEQ ID NO: 2711047 - RNA, 16 nt, Haemophilus influenzae Rd
uacauuucuaaaauaa

SEQ ID NO: 2711048 - RNA, 18 nt, Haemophilus influenzae Rd
uacauuucuaaaauaaua

SEQ ID NO: 2711049 - RNA, 19 nt, Haemophilus influenzae Rd
uacauuucuaaaauaauau

SEQ ID NO: 2711050 - RNA, 21 nt, Haemophilus influenzae Rd
uacauuugccccaacaacaua

SEQ ID NO: 2711051 - RNA, 16 nt, Haemophilus influenzae Rd
uacauuuggcaaaaua

SEQ ID NO: 2711052 - RNA, 17 nt, Haemophilus influenzae Rd
uacauuuggcaaaauaa

SEQ ID NO: 2711053 - RNA, 17 nt, Haemophilus influenzae Rd
uacauuuucauaaccaa

SEQ ID NO: 2711054 - RNA, 17 nt, Haemophilus influenzae Rd
uacauuuuguuucuaaa

SEQ ID NO: 2711055 - RNA, 18 nt, Haemophilus influenzae Rd
uacauuuuguuucuaaau

SEQ ID NO: 2711056 - RNA, 20 nt, Haemophilus influenzae Rd
uacauuuuugauugcaccua

SEQ ID NO: 2711057 - RNA, 18 nt, Haemophilus influenzae Rd
uaccaaaaaauucguaaa

SEQ ID NO: 2711058 - RNA, 20 nt, Haemophilus influenzae Rd
uaccaaaaggucuuaauagc

SEQ ID NO: 2711059 - RNA, 18 nt, Haemophilus influenzae Rd
uaccaaauuccauucacu

SEQ ID NO: 2711060 - RNA, 23 nt, Haemophilus influenzae Rd
uaccaaauuccauucacuuucac

SEQ ID NO: 2711061 - RNA, 14 nt, Haemophilus influenzae Rd
uaccaacugagcua

SEQ ID NO: 2711062 - RNA, 17 nt, Haemophilus influenzae Rd
uaccaagauaauaaagu

SEQ ID NO: 2711063 - RNA, 17 nt, Haemophilus influenzae Rd
uaccaauaacuaaaaau

SEQ ID NO: 2711064 - RNA, 19 nt, Haemophilus influenzae Rd
uaccaauacgauaauuaaa

SEQ ID NO: 2711065 - RNA, 23 nt, Haemophilus influenzae Rd
uaccaauagauugugaaauuuca

SEQ ID NO: 2711066 - RNA, 18 nt, Haemophilus influenzae Rd
uaccaauauucuuuaaaa

SEQ ID NO: 2711067 - RNA, 15 nt, Haemophilus influenzae Rd
uaccaaucacaacac

SEQ ID NO: 2711068 - RNA, 19 nt, Haemophilus influenzae Rd
uaccaauucaaaaaccaaa

SEQ ID NO: 2711069 - RNA, 17 nt, Haemophilus influenzae Rd
uaccaauugauuuuuca

SEQ ID NO: 2711070 - RNA, 16 nt, Haemophilus influenzae Rd
uaccaauugcaacuuc

SEQ ID NO: 2711071 - RNA, 11 nt, Haemophilus influenzae Rd
uaccacagcau

SEQ ID NO: 2711072 - RNA, 20 nt, Haemophilus influenzae Rd
uaccacaugcauuuuucuua

SEQ ID NO: 2711073 - RNA, 21 nt, Haemophilus influenzae Rd
uaccacaugcauuuuucuuau

SEQ ID NO: 2711074 - RNA, 17 nt, Haemophilus influenzae Rd
uaccaccacagaaccag

SEQ ID NO: 2711075 - RNA, 22 nt, Haemophilus influenzae Rd
uaccaccagucggcauuaucug

SEQ ID NO: 2711076 - RNA, 16 nt, Haemophilus influenzae Rd
uaccacgauaaauccu

SEQ ID NO: 2711077 - RNA, 22 nt, Haemophilus influenzae Rd
uaccacgauacggcaaauuaaa

SEQ ID NO: 2711078 - RNA, 17 nt, Haemophilus influenzae Rd
uaccacgguugauacca

SEQ ID NO: 2711079 - RNA, 13 nt, Haemophilus influenzae Rd
uaccauacuugcc

SEQ ID NO: 2711080 - RNA, 16 nt, Haemophilus influenzae Rd
uaccauauccauugca

SEQ ID NO: 2711081 - RNA, 19 nt, Haemophilus influenzae Rd
uaccauucuuucaauaauu

SEQ ID NO: 2711082 - RNA, 15 nt, Haemophilus influenzae Rd
uaccauugugccaaa

SEQ ID NO: 2711083 - RNA, 21 nt, Haemophilus influenzae Rd
uaccauugugccaaauucagu

SEQ ID NO: 2711084 - RNA, 18 nt, Haemophilus influenzae Rd
uaccauuuaaaaguaaaa

SEQ ID NO: 2711085 - RNA, 15 nt, Haemophilus influenzae Rd
uaccauuugauucac

SEQ ID NO: 2711086 - RNA, 18 nt, Haemophilus influenzae Rd
uacccaaaugaugaaaca

SEQ ID NO: 2711087 - RNA, 23 nt, Haemophilus influenzae Rd
uacccaaaugaugaaacaagcug

SEQ ID NO: 2711088 - RNA, 12 nt, Haemophilus influenzae Rd
uacccaaauuau

SEQ ID NO: 2711089 - RNA, 17 nt, Haemophilus influenzae Rd
uacccacacaaacuaau

SEQ ID NO: 2711090 - RNA, 12 nt, Haemophilus influenzae Rd
uacccacuucau

SEQ ID NO: 2711091 - RNA, 22 nt, Haemophilus influenzae Rd
uacccacuucauauaaaucaau

SEQ ID NO: 2711092 - RNA, 18 nt, Haemophilus influenzae Rd
uacccauugcucgauaag

SEQ ID NO: 2711093 - RNA, 18 nt, Haemophilus influenzae Rd
uaccccucuuuucucaaa

SEQ ID NO: 2711094 - RNA, 19 nt, Haemophilus influenzae Rd
uacccgugccuaauucacu

SEQ ID NO: 2711095 - RNA, 22 nt, Haemophilus influenzae Rd
uaccgaaguaagauguuguaaa

SEQ ID NO: 2711096 - RNA, 14 nt, Haemophilus influenzae Rd
uaccgacugagcua

SEQ ID NO: 2711097 - RNA, 21 nt, Haemophilus influenzae Rd
uaccgauaauauguuuugcca

SEQ ID NO: 2711098 - RNA, 16 nt, Haemophilus influenzae Rd
uaccgcacuuucuucg

SEQ ID NO: 2711099 - RNA, 19 nt, Haemophilus influenzae Rd
uaccgcacuuuugagugcu

SEQ ID NO: 2711100 - RNA, 20 nt, Haemophilus influenzae Rd
uaccgcacuuuuuauuuuuc

SEQ ID NO: 2711101 - RNA, 14 nt, Haemophilus influenzae Rd
uaccgcacuuuuuu

SEQ ID NO: 2711102 - RNA, 22 nt, Haemophilus influenzae Rd
uaccgcacuuuuuuuauaucuu

SEQ ID NO: 2711103 - RNA, 15 nt, Haemophilus influenzae Rd
uaccgcauuuuuaau

SEQ ID NO: 2711104 - RNA, 17 nt, Haemophilus influenzae Rd
uaccgccagugauuuuu

SEQ ID NO: 2711105 - RNA, 20 nt, Haemophilus influenzae Rd
uaccgcucgccaauaaaaug

SEQ ID NO: 2711106 - RNA, 21 nt, Haemophilus influenzae Rd
uaccggaaaccagcuuuccaa

SEQ ID NO: 2711107 - RNA, 19 nt, Haemophilus influenzae Rd
uaccgguuacuuggaugaa

SEQ ID NO: 2711108 - RNA, 20 nt, Haemophilus influenzae Rd
uaccguauuuuuuuaauuuu

SEQ ID NO: 2711109 - RNA, 21 nt, Haemophilus influenzae Rd
uaccgucagccaaauuuuucu

SEQ ID NO: 2711110 - RNA, 14 nt, Haemophilus influenzae Rd
uaccuaaaaaugcc

SEQ ID NO: 2711111 - RNA, 15 nt, Haemophilus influenzae Rd
uaccuaaaaauuuaa

SEQ ID NO: 2711112 - RNA, 17 nt, Haemophilus influenzae Rd
uaccuaaaaauuuaaau

SEQ ID NO: 2711113 - RNA, 22 nt, Haemophilus influenzae Rd
uaccuaacauacugcuuucuag

SEQ ID NO: 2711114 - RNA, 16 nt, Haemophilus influenzae Rd
uaccuaaguuuugguc

SEQ ID NO: 2711115 - RNA, 13 nt, Haemophilus influenzae Rd
uaccuaauggaua

SEQ ID NO: 2711116 - RNA, 20 nt, Haemophilus influenzae Rd
uaccuaauggauauagaaau

SEQ ID NO: 2711117 - RNA, 19 nt, Haemophilus influenzae Rd
uaccuagcgggauaagauu

SEQ ID NO: 2711118 - RNA, 20 nt, Haemophilus influenzae Rd
uaccuaguuugcuauauuac

SEQ ID NO: 2711119 - RNA, 16 nt, Haemophilus influenzae Rd
uaccuauauacuuuuu

SEQ ID NO: 2711120 - RNA, 15 nt, Haemophilus influenzae Rd
uaccugaugaaauca

SEQ ID NO: 2711121 - RNA, 18 nt, Haemophilus influenzae Rd
uaccugguugcauaaaau

SEQ ID NO: 2711122 - RNA, 19 nt, Haemophilus influenzae Rd
uaccugguugcauaaaauc

SEQ ID NO: 2711123 - RNA, 16 nt, Haemophilus influenzae Rd
uaccuguaauccuuuu

SEQ ID NO: 2711124 - RNA, 15 nt, Haemophilus influenzae Rd
uaccugugaaaacac

SEQ ID NO: 2711125 - RNA, 15 nt, Haemophilus influenzae Rd
uaccugugcauugcu

SEQ ID NO: 2711126 - RNA, 18 nt, Haemophilus influenzae Rd
uaccugugcauugcuauu

SEQ ID NO: 2711127 - RNA, 15 nt, Haemophilus influenzae Rd
uaccuguugcauuag

SEQ ID NO: 2711128 - RNA, 16 nt, Haemophilus influenzae Rd
uaccuuaacauuuucu

SEQ ID NO: 2711129 - RNA, 21 nt, Haemophilus influenzae Rd
uaccuuagccaaaucaucuag

SEQ ID NO: 2711130 - RNA, 17 nt, Haemophilus influenzae Rd
uaccuucuguuuucaau

SEQ ID NO: 2711131 - RNA, 22 nt, Haemophilus influenzae Rd
uaccuuguggcaguaaaggcac

SEQ ID NO: 2711132 - RNA, 18 nt, Haemophilus influenzae Rd
uaccuuguucgacaauuu

SEQ ID NO: 2711133 - RNA, 22 nt, Haemophilus influenzae Rd
uaccuuguuuugcaauaaaguu

SEQ ID NO: 2711134 - RNA, 18 nt, Haemophilus influenzae Rd
uaccuuuaaauucuucga

SEQ ID NO: 2711135 - RNA, 20 nt, Haemophilus influenzae Rd
uaccuuuaauuaaagccaca

SEQ ID NO: 2711136 - RNA, 14 nt, Haemophilus influenzae Rd
uaccuuuuucuacc

SEQ ID NO: 2711137 - RNA, 14 nt, Haemophilus influenzae Rd
uacgaacagccgca

SEQ ID NO: 2711138 - RNA, 17 nt, Haemophilus influenzae Rd
uacgaagaauccacauu

SEQ ID NO: 2711139 - RNA, 20 nt, Haemophilus influenzae Rd
uacgaauuguaccuucugcu

SEQ ID NO: 2711140 - RNA, 17 nt, Haemophilus influenzae Rd
uacgacauucuuuagaa

SEQ ID NO: 2711141 - RNA, 17 nt, Haemophilus influenzae Rd
uacgacauuuuuaacua

SEQ ID NO: 2711142 - RNA, 14 nt, Haemophilus influenzae Rd
uacgagaaaaaucu

SEQ ID NO: 2711143 - RNA, 21 nt, Haemophilus influenzae Rd
uacgagaaaaaucuuuaccaa

SEQ ID NO: 2711144 - RNA, 19 nt, Haemophilus influenzae Rd
uacgagcacaguauuuaua

SEQ ID NO: 2711145 - RNA, 17 nt, Haemophilus influenzae Rd
uacgagcaccaaauauc

SEQ ID NO: 2711146 - RNA, 12 nt, Haemophilus influenzae Rd
uacgauaaacac

SEQ ID NO: 2711147 - RNA, 18 nt, Haemophilus influenzae Rd
uacgauacuuuuaauuaa

SEQ ID NO: 2711148 - RNA, 19 nt, Haemophilus influenzae Rd
uacgauacuuuuaauuaaa

SEQ ID NO: 2711149 - RNA, 15 nt, Haemophilus influenzae Rd
uacgauaguaaaaaa

SEQ ID NO: 2711150 - RNA, 20 nt, Haemophilus influenzae Rd
uacuucuuacaacaaauugu

SEQ ID NO: 2711151 - RNA, 13 nt, Haemophilus influenzae Rd
uacuucuuugaau

SEQ ID NO: 2711152 - RNA, 17 nt, Haemophilus influenzae Rd
uacuugaacuaauauca

SEQ ID NO: 2711153 - RNA, 18 nt, Haemophilus influenzae Rd
uacuugaacuaauaucac

SEQ ID NO: 2711154 - RNA, 22 nt, Haemophilus influenzae Rd
uacuugaaucuaauccuaaaau

SEQ ID NO: 2711155 - RNA, 24 nt, Haemophilus influenzae Rd
uacuugaccagagccaaauacaau

SEQ ID NO: 2711156 - RNA, 21 nt, Haemophilus influenzae Rd
uacuugaucggcuacuauaca

SEQ ID NO: 2711157 - RNA, 14 nt, Haemophilus influenzae Rd
uacuuggaauauca

SEQ ID NO: 2711158 - RNA, 20 nt, Haemophilus influenzae Rd
uacuuggauugcaugaaaug

SEQ ID NO: 2711159 - RNA, 18 nt, Haemophilus influenzae Rd
uacuuggcauuucaagcu

SEQ ID NO: 2711160 - RNA, 23 nt, Haemophilus influenzae Rd
uacuuggggcuaauuuuuaaaau

SEQ ID NO: 2711161 - RNA, 15 nt, Haemophilus influenzae Rd
uacuuguucaaaaau

SEQ ID NO: 2711162 - RNA, 17 nt, Haemophilus influenzae Rd
uacuuguucaaaaauuu

SEQ ID NO: 2711163 - RNA, 22 nt, Haemophilus influenzae Rd
uacuuguuggcauugaaaccua

SEQ ID NO: 2711164 - RNA, 18 nt, Haemophilus influenzae Rd
uacuuguuuaugucuaaa

SEQ ID NO: 2711165 - RNA, 15 nt, Haemophilus influenzae Rd
uacuuuaaagaauau

SEQ ID NO: 2711166 - RNA, 23 nt, Haemophilus influenzae Rd
uacuuuagaaauucgauugcauu

SEQ ID NO: 2711167 - RNA, 21 nt, Haemophilus influenzae Rd
uacuuuauaaaugauuggauu

SEQ ID NO: 2711168 - RNA, 19 nt, Haemophilus influenzae Rd
uacuuuauacuaaaaguac

SEQ ID NO: 2711169 - RNA, 13 nt, Haemophilus influenzae Rd
uacuuuaucacaa

SEQ ID NO: 2711170 - RNA, 13 nt, Haemophilus influenzae Rd
uacuuuauuuuua

SEQ ID NO: 2711171 - RNA, 23 nt, Haemophilus influenzae Rd
uacuuucaggauuuguuucuguc

SEQ ID NO: 2711172 - RNA, 20 nt, Haemophilus influenzae Rd
uacuuucuauuaaaaaauca

SEQ ID NO: 2711173 - RNA, 15 nt, Haemophilus influenzae Rd
uacuuucuuucaaua

SEQ ID NO: 2711174 - RNA, 17 nt, Haemophilus influenzae Rd
uacuuugcgccuguacu

SEQ ID NO: 2711175 - RNA, 20 nt, Haemophilus influenzae Rd
uacuuuguugaaugccauuc

SEQ ID NO: 2711176 - RNA, 16 nt, Haemophilus influenzae Rd
uacuuuuacaauccua

SEQ ID NO: 2711177 - RNA, 17 nt, Haemophilus influenzae Rd
uacuuuuagauaaauuu

SEQ ID NO: 2711178 - RNA, 16 nt, Haemophilus influenzae Rd
uacuuuuauaaagauc

SEQ ID NO: 2711179 - RNA, 14 nt, Haemophilus influenzae Rd
uacuuuuauaucua

SEQ ID NO: 2711180 - RNA, 15 nt, Haemophilus influenzae Rd
uacuuuuauugguaa

SEQ ID NO: 2711181 - RNA, 17 nt, Haemophilus influenzae Rd
uacuuuugauuuauuaa

SEQ ID NO: 2711182 - RNA, 14 nt, Haemophilus influenzae Rd
uacuuuugauuuua

SEQ ID NO: 2711183 - RNA, 17 nt, Haemophilus influenzae Rd
uacuuuugcacugcaau

SEQ ID NO: 2711184 - RNA, 19 nt, Haemophilus influenzae Rd
uacuuuugcacugcaauga

SEQ ID NO: 2711185 - RNA, 13 nt, Haemophilus influenzae Rd
uacuuuugcuuca

SEQ ID NO: 2711186 - RNA, 17 nt, Haemophilus influenzae Rd
uacuuuuuaauaaauca

SEQ ID NO: 2711187 - RNA, 21 nt, Haemophilus influenzae Rd
uacuuuuuauuuuugauuuag

SEQ ID NO: 2711188 - RNA, 23 nt, Haemophilus influenzae Rd
uacuuuuuauuuuugauuuaguc

SEQ ID NO: 2711189 - RNA, 14 nt, Haemophilus influenzae Rd
uacuuuuuuaagua

SEQ ID NO: 2711190 - RNA, 23 nt, Haemophilus influenzae Rd
uacuuuuuuugcgcuuucaauuu

SEQ ID NO: 2711191 - RNA, 14 nt, Haemophilus influenzae Rd
uagaaaaauuggua

SEQ ID NO: 2711192 - RNA, 17 nt, Haemophilus influenzae Rd
uagaaaacaauaaaaaa

SEQ ID NO: 2711193 - RNA, 15 nt, Haemophilus influenzae Rd
uagaaaacucaucca

SEQ ID NO: 2711194 - RNA, 20 nt, Haemophilus influenzae Rd
uagaaaagacaauaauucag

SEQ ID NO: 2711195 - RNA, 12 nt, Haemophilus influenzae Rd
uagaaaauagaa

SEQ ID NO: 2711196 - RNA, 23 nt, Haemophilus influenzae Rd
uagaaaauauaauuaaucugcac

SEQ ID NO: 2711197 - RNA, 22 nt, Haemophilus influenzae Rd
uagaaaaucacuucucgucuuu

SEQ ID NO: 2711198 - RNA, 18 nt, Haemophilus influenzae Rd
uagaaacagaaguauuua

SEQ ID NO: 2711199 - RNA, 19 nt, Haemophilus influenzae Rd
uagaaaccaauaauuucau

SEQ ID NO: 2711200 - RNA, 14 nt, Haemophilus influenzae Rd
uagaaacuaaacuu

SEQ ID NO: 2711201 - RNA, 22 nt, Haemophilus influenzae Rd
uagaaagcugagaaauuaagua

SEQ ID NO: 2711202 - RNA, 18 nt, Haemophilus influenzae Rd
uagaaaggcaauauuuua

SEQ ID NO: 2711203 - RNA, 15 nt, Haemophilus influenzae Rd
uagaaaguaaacaau

SEQ ID NO: 2711204 - RNA, 16 nt, Haemophilus influenzae Rd
uagaaaguaaacaauu

SEQ ID NO: 2711205 - RNA, 14 nt, Haemophilus influenzae Rd
uagaaaguggcuua

SEQ ID NO: 2711206 - RNA, 17 nt, Haemophilus influenzae Rd
uagaaaucaaaaaugcu

SEQ ID NO: 2711207 - RNA, 13 nt, Haemophilus influenzae Rd
uagaaaucacaau

SEQ ID NO: 2711208 - RNA, 14 nt, Haemophilus influenzae Rd
uagaaauuaauaau

SEQ ID NO: 2711209 - RNA, 22 nt, Haemophilus influenzae Rd
uagaaauucgauugcauuuuuu

SEQ ID NO: 2711210 - RNA, 20 nt, Haemophilus influenzae Rd
uagaaauugccauauaagca

SEQ ID NO: 2711211 - RNA, 13 nt, Haemophilus influenzae Rd
uagaaauuuuggc

SEQ ID NO: 2711212 - RNA, 20 nt, Haemophilus influenzae Rd
uagaacgguggacuguuaau

SEQ ID NO: 2711213 - RNA, 16 nt, Haemophilus influenzae Rd
uagaacgguuaugaaa

SEQ ID NO: 2711214 - RNA, 19 nt, Haemophilus influenzae Rd
uagaacguuuuuuacuugc

SEQ ID NO: 2711215 - RNA, 20 nt, Haemophilus influenzae Rd
uagaacuuagccuuuuuguu

SEQ ID NO: 2711216 - RNA, 19 nt, Haemophilus influenzae Rd
uagaagauuuaaaacaaga

SEQ ID NO: 2711217 - RNA, 13 nt, Haemophilus influenzae Rd
uagaagcguucau

SEQ ID NO: 2711218 - RNA, 20 nt, Haemophilus influenzae Rd
uagaaggcuaguucuuccuu

SEQ ID NO: 2711219 - RNA, 23 nt, Haemophilus influenzae Rd
uagaaggcuaguucuuccuuggu

SEQ ID NO: 2711220 - RNA, 22 nt, Haemophilus influenzae Rd
uagaaguaaacgcguaaaccua

SEQ ID NO: 2711221 - RNA, 15 nt, Haemophilus influenzae Rd
uagaauaaauuaaaa

SEQ ID NO: 2711222 - RNA, 23 nt, Haemophilus influenzae Rd
uagaauaacaacaaaagugcggu

SEQ ID NO: 2711223 - RNA, 14 nt, Haemophilus influenzae Rd
uagaauauuuugca

SEQ ID NO: 2711224 - RNA, 18 nt, Haemophilus influenzae Rd
uagaauauuuugcauguu

SEQ ID NO: 2711225 - RNA, 15 nt, Haemophilus influenzae Rd
uagaaucaauggcuu

SEQ ID NO: 2711226 - RNA, 21 nt, Haemophilus influenzae Rd
uagaaugcaacaaguacgauu

SEQ ID NO: 2711227 - RNA, 16 nt, Haemophilus influenzae Rd
uagaauggugacgaga

SEQ ID NO: 2711228 - RNA, 16 nt, Haemophilus influenzae Rd
uagaauuaaauuugcu

SEQ ID NO: 2711229 - RNA, 22 nt, Haemophilus influenzae Rd
uagaauuuuaccgcacuuuauu

SEQ ID NO: 2711230 - RNA, 15 nt, Haemophilus influenzae Rd
uagacaauaaaacac

SEQ ID NO: 2711231 - RNA, 16 nt, Haemophilus influenzae Rd
uagacaauauugaaau

SEQ ID NO: 2711232 - RNA, 18 nt, Haemophilus influenzae Rd
uagacaauauugaaauaa

SEQ ID NO: 2711233 - RNA, 19 nt, Haemophilus influenzae Rd
uagacaauauugaaauaag

SEQ ID NO: 2711234 - RNA, 20 nt, Haemophilus influenzae Rd
uagacacaagggauuuaaaa

SEQ ID NO: 2711235 - RNA, 19 nt, Haemophilus influenzae Rd
uagacagacuauuucugua

SEQ ID NO: 2711236 - RNA, 21 nt, Haemophilus influenzae Rd
uagacagacuauuucuguauu

SEQ ID NO: 2711237 - RNA, 16 nt, Haemophilus influenzae Rd
uagacauuaguaucuu

SEQ ID NO: 2711238 - RNA, 21 nt, Haemophilus influenzae Rd
uagacauuaguaucuuccauu

SEQ ID NO: 2711239 - RNA, 21 nt, Haemophilus influenzae Rd
uagacucguuuuuuauuuugu

SEQ ID NO: 2711240 - RNA, 15 nt, Haemophilus influenzae Rd
uagacuuaauaauau

SEQ ID NO: 2711241 - RNA, 23 nt, Haemophilus influenzae Rd
uagacuucaagugauuauuucuc

SEQ ID NO: 2711242 - RNA, 13 nt, Haemophilus influenzae Rd
uagagauaauaaa

SEQ ID NO: 2711243 - RNA, 12 nt, Haemophilus influenzae Rd
uagagcaagcaa

SEQ ID NO: 2711244 - RNA, 21 nt, Haemophilus influenzae Rd
uagagcagcggacuuuuaauc

SEQ ID NO: 2711245 - RNA, 18 nt, Haemophilus influenzae Rd
uagagcagggauuuucau

SEQ ID NO: 2711246 - RNA, 22 nt, Haemophilus influenzae Rd
uagagccaucacguucaaaaau

SEQ ID NO: 2711247 - RNA, 16 nt, Haemophilus influenzae Rd
uagagccuacauuaga

SEQ ID NO: 2711248 - RNA, 19 nt, Haemophilus influenzae Rd
uagagcucaauuauuuaua

SEQ ID NO: 2711249 - RNA, 15 nt, Haemophilus influenzae Rd
uagagggauaaaaau

SEQ ID NO: 2711250 - RNA, 20 nt, Haemophilus influenzae Rd
uagaguacgcccauugaaaa

SEQ ID NO: 2711251 - RNA, 15 nt, Haemophilus influenzae Rd
uagagucaauccagu

SEQ ID NO: 2711252 - RNA, 16 nt, Haemophilus influenzae Rd
uagagucauuuacagg

SEQ ID NO: 2711253 - RNA, 13 nt, Haemophilus influenzae Rd
uagagugcagauu

SEQ ID NO: 2711254 - RNA, 16 nt, Haemophilus influenzae Rd
uagauaaaaauuucag

SEQ ID NO: 2711255 - RNA, 21 nt, Haemophilus influenzae Rd
uagcuaacaaauuuaauauuu

SEQ ID NO: 2711256 - RNA, 21 nt, Haemophilus influenzae Rd
uagcucaacgcuuuucguuuc

SEQ ID NO: 2711257 - RNA, 18 nt, Haemophilus influenzae Rd
uagcucaauagauuuaau

SEQ ID NO: 2711258 - RNA, 19 nt, Haemophilus influenzae Rd
uagcucagucgguuagagc

SEQ ID NO: 2711259 - RNA, 15 nt, Haemophilus influenzae Rd
uagcucucguuguuc

SEQ ID NO: 2711260 - RNA, 23 nt, Haemophilus influenzae Rd
uagcugaaaaauaaaaaauauug

SEQ ID NO: 2711261 - RNA, 17 nt, Haemophilus influenzae Rd
uagcugaauaucagaag

SEQ ID NO: 2711262 - RNA, 22 nt, Haemophilus influenzae Rd
uagcugacacgguaguaaauaa

SEQ ID NO: 2711263 - RNA, 18 nt, Haemophilus influenzae Rd
uagcugauuuuuuaaagu

SEQ ID NO: 2711264 - RNA, 12 nt, Haemophilus influenzae Rd
uagcugcaggga

SEQ ID NO: 2711265 - RNA, 21 nt, Haemophilus influenzae Rd
uagcuucaucagccgcuuuuu

SEQ ID NO: 2711266 - RNA, 18 nt, Haemophilus influenzae Rd
uagcuuccgcuuuuuucg

SEQ ID NO: 2711267 - RNA, 18 nt, Haemophilus influenzae Rd
uagcuugaauugcuccuc

SEQ ID NO: 2711268 - RNA, 23 nt, Haemophilus influenzae Rd
uagcuuuacguaccgcaccuuua

SEQ ID NO: 2711269 - RNA, 13 nt, Haemophilus influenzae Rd
uagcuuuuuaauu

SEQ ID NO: 2711270 - RNA, 18 nt, Haemophilus influenzae Rd
uaggaaugaucugcaccc

SEQ ID NO: 2711271 - RNA, 21 nt, Haemophilus influenzae Rd
uaggacauagccuuuuucuuu

SEQ ID NO: 2711272 - RNA, 13 nt, Haemophilus influenzae Rd
uaggacuaaauca

SEQ ID NO: 2711273 - RNA, 19 nt, Haemophilus influenzae Rd
uaggaugaaauuugaauau

SEQ ID NO: 2711274 - RNA, 22 nt, Haemophilus influenzae Rd
uaggauuaacguaagaaauaac

SEQ ID NO: 2711275 - RNA, 16 nt, Haemophilus influenzae Rd
uaggauugccuucaua

SEQ ID NO: 2711276 - RNA, 22 nt, Haemophilus influenzae Rd
uaggauugccuucauauaauaa

SEQ ID NO: 2711277 - RNA, 17 nt, Haemophilus influenzae Rd
uaggauuuggcacuaaa

SEQ ID NO: 2711278 - RNA, 20 nt, Haemophilus influenzae Rd
uaggauuuggcacuaaagca

SEQ ID NO: 2711279 - RNA, 21 nt, Haemophilus influenzae Rd
uaggcaauaaaaaaacaccuu

SEQ ID NO: 2711280 - RNA, 20 nt, Haemophilus influenzae Rd
uaggcaauguuccaccacuc

SEQ ID NO: 2711281 - RNA, 21 nt, Haemophilus influenzae Rd
uaggcaucaaaauucaaaaug

SEQ ID NO: 2711282 - RNA, 23 nt, Haemophilus influenzae Rd
uaggcauuuagagggauaaaaau

SEQ ID NO: 2711283 - RNA, 15 nt, Haemophilus influenzae Rd
uaggcgaaucaaaau

SEQ ID NO: 2711284 - RNA, 21 nt, Haemophilus influenzae Rd
uaggcuauaaagagauuauuu

SEQ ID NO: 2711285 - RNA, 17 nt, Haemophilus influenzae Rd
uaggcuauuuuauaauu

SEQ ID NO: 2711286 - RNA, 17 nt, Haemophilus influenzae Rd
uaggcugaaaaaauauc

SEQ ID NO: 2711287 - RNA, 18 nt, Haemophilus influenzae Rd
uaggcuucggccuauuaa

SEQ ID NO: 2711288 - RNA, 19 nt, Haemophilus influenzae Rd
uagggcucaaaucuacuaa

SEQ ID NO: 2711289 - RNA, 15 nt, Haemophilus influenzae Rd
uagggcugcaugugc

SEQ ID NO: 2711290 - RNA, 17 nt, Haemophilus influenzae Rd
uagguaaacuuuggaau

SEQ ID NO: 2711291 - RNA, 18 nt, Haemophilus influenzae Rd
uagguaaacuuuggaaua

SEQ ID NO: 2711292 - RNA, 18 nt, Haemophilus influenzae Rd
uagguaacauaaugauuu

SEQ ID NO: 2711293 - RNA, 20 nt, Haemophilus influenzae Rd
uagguaguuuucaauaucaa

SEQ ID NO: 2711294 - RNA, 13 nt, Haemophilus influenzae Rd
uagguuaauaguu

SEQ ID NO: 2711295 - RNA, 16 nt, Haemophilus influenzae Rd
uagguuaauaguuguu

SEQ ID NO: 2711296 - RNA, 16 nt, Haemophilus influenzae Rd
uagguuuaaaagauac

SEQ ID NO: 2711297 - RNA, 13 nt, Haemophilus influenzae Rd
uagguuucaauuu

SEQ ID NO: 2711298 - RNA, 16 nt, Haemophilus influenzae Rd
uagguuuuauuugcgg

SEQ ID NO: 2711299 - RNA, 17 nt, Haemophilus influenzae Rd
uaguaaaaaaucaagcc

SEQ ID NO: 2711300 - RNA, 18 nt, Haemophilus influenzae Rd
uaguaaaaaaucaagccc

SEQ ID NO: 2711301 - RNA, 17 nt, Haemophilus influenzae Rd
uaguaaaaauuguugau

SEQ ID NO: 2711302 - RNA, 23 nt, Haemophilus influenzae Rd
uaguaaaacuaauacuucauagu

SEQ ID NO: 2711303 - RNA, 12 nt, Haemophilus influenzae Rd
uaguaaaauaau

SEQ ID NO: 2711304 - RNA, 20 nt, Haemophilus influenzae Rd
uaguaaacacuuaaauaguu

SEQ ID NO: 2711305 - RNA, 13 nt, Haemophilus influenzae Rd
uaguaaacuuuua

SEQ ID NO: 2711306 - RNA, 16 nt, Haemophilus influenzae Rd
uaguaaacuuuuaaag

SEQ ID NO: 2711307 - RNA, 15 nt, Haemophilus influenzae Rd
uaguaaagaaauaag

SEQ ID NO: 2711308 - RNA, 14 nt, Haemophilus influenzae Rd
uaguaaagaauauu

SEQ ID NO: 2711309 - RNA, 23 nt, Haemophilus influenzae Rd
uaguaaauaacacaucagaaaau

SEQ ID NO: 2711310 - RNA, 14 nt, Haemophilus influenzae Rd
uaguaaauuuucca

SEQ ID NO: 2711311 - RNA, 15 nt, Haemophilus influenzae Rd
uaguaaauuuuccaa

SEQ ID NO: 2711312 - RNA, 23 nt, Haemophilus influenzae Rd
uaguaacuguucgguuuuuugau

SEQ ID NO: 2711313 - RNA, 19 nt, Haemophilus influenzae Rd
uaguaagugguaucaaucg

SEQ ID NO: 2711314 - RNA, 13 nt, Haemophilus influenzae Rd
uaguaauaaauuc

SEQ ID NO: 2711315 - RNA, 13 nt, Haemophilus influenzae Rd
uaguaaugaaucu

SEQ ID NO: 2711316 - RNA, 12 nt, Haemophilus influenzae Rd
uaguaauuggca

SEQ ID NO: 2711317 - RNA, 13 nt, Haemophilus influenzae Rd
uaguaauuuuaau

SEQ ID NO: 2711318 - RNA, 16 nt, Haemophilus influenzae Rd
uaguacuuguaacuug

SEQ ID NO: 2711319 - RNA, 21 nt, Haemophilus influenzae Rd
uaguagagucauuuacagguu

SEQ ID NO: 2711320 - RNA, 18 nt, Haemophilus influenzae Rd
uaguaguuagaauuuuaa

SEQ ID NO: 2711321 - RNA, 14 nt, Haemophilus influenzae Rd
uagucaauuuaccc

SEQ ID NO: 2711322 - RNA, 15 nt, Haemophilus influenzae Rd
uagucagauaauaca

SEQ ID NO: 2711323 - RNA, 19 nt, Haemophilus influenzae Rd
uagucauauugauuucucu

SEQ ID NO: 2711324 - RNA, 23 nt, Haemophilus influenzae Rd
uagucccgcuuuugccauauuua

SEQ ID NO: 2711325 - RNA, 22 nt, Haemophilus influenzae Rd
uaguccuuuacugacuuucuaa

SEQ ID NO: 2711326 - RNA, 21 nt, Haemophilus influenzae Rd
uagucgaaaucauaaucugaa

SEQ ID NO: 2711327 - RNA, 19 nt, Haemophilus influenzae Rd
uagucgcuggaacuucuaa

SEQ ID NO: 2711328 - RNA, 20 nt, Haemophilus influenzae Rd
uagucgcuggaacuucuaaa

SEQ ID NO: 2711329 - RNA, 14 nt, Haemophilus influenzae Rd
uagucgucaucauu

SEQ ID NO: 2711330 - RNA, 14 nt, Haemophilus influenzae Rd
uagucuaacuuuuu

SEQ ID NO: 2711331 - RNA, 19 nt, Haemophilus influenzae Rd
uagucuacaagaaaccaaa

SEQ ID NO: 2711332 - RNA, 22 nt, Haemophilus influenzae Rd
uagucucuuuauuuuuucauca

SEQ ID NO: 2711333 - RNA, 19 nt, Haemophilus influenzae Rd
uagucucuuuugaggcuaa

SEQ ID NO: 2711334 - RNA, 21 nt, Haemophilus influenzae Rd
uagucucuuuugaggcuaaua

SEQ ID NO: 2711335 - RNA, 14 nt, Haemophilus influenzae Rd
uagucuuuuuaauu

SEQ ID NO: 2711336 - RNA, 18 nt, Haemophilus influenzae Rd
uagucuuuuuaauuuaaa

SEQ ID NO: 2711337 - RNA, 14 nt, Haemophilus influenzae Rd
uagugaaauauuua

SEQ ID NO: 2711338 - RNA, 22 nt, Haemophilus influenzae Rd
uagugauuucuauguuauuaaa

SEQ ID NO: 2711339 - RNA, 12 nt, Haemophilus influenzae Rd
uagugcuaaaau

SEQ ID NO: 2711340 - RNA, 23 nt, Haemophilus influenzae Rd
uagugcuaaauggaauguagaua

SEQ ID NO: 2711341 - RNA, 18 nt, Haemophilus influenzae Rd
uagugcuguauauuuuua

SEQ ID NO: 2711342 - RNA, 17 nt, Haemophilus influenzae Rd
uaguggcaauaacuaca

SEQ ID NO: 2711343 - RNA, 14 nt, Haemophilus influenzae Rd
uaguggcaauccaa

SEQ ID NO: 2711344 - RNA, 17 nt, Haemophilus influenzae Rd
uaguggugccuucuuca

SEQ ID NO: 2711345 - RNA, 14 nt, Haemophilus influenzae Rd
uaguguuuuuaauc

SEQ ID NO: 2711346 - RNA, 21 nt, Haemophilus influenzae Rd
uaguuaaagaaaauauuuaac

SEQ ID NO: 2711347 - RNA, 12 nt, Haemophilus influenzae Rd
uaguuaaagccu

SEQ ID NO: 2711348 - RNA, 12 nt, Haemophilus influenzae Rd
uaguuaaauaau

SEQ ID NO: 2711349 - RNA, 18 nt, Haemophilus influenzae Rd
uaguuaauugauuuaaaa

SEQ ID NO: 2711350 - RNA, 23 nt, Haemophilus influenzae Rd
uaguuacaaacaaucuuaacugc

SEQ ID NO: 2711351 - RNA, 16 nt, Haemophilus influenzae Rd
uaguuagcuaaaaaaa

SEQ ID NO: 2711352 - RNA, 18 nt, Haemophilus influenzae Rd
uaguuagcuaaaaaaacu

SEQ ID NO: 2711353 - RNA, 14 nt, Haemophilus influenzae Rd
uaguuauaugccua

SEQ ID NO: 2711354 - RNA, 22 nt, Haemophilus influenzae Rd
uaguuauuuauuccuucaaucg

SEQ ID NO: 2711355 - RNA, 18 nt, Haemophilus influenzae Rd
uaguuauuuauuuaagau

SEQ ID NO: 2711356 - RNA, 15 nt, Haemophilus influenzae Rd
uaguucaaggacuga

SEQ ID NO: 2711357 - RNA, 17 nt, Haemophilus influenzae Rd
uaguucguuuuuuagcu

SEQ ID NO: 2711358 - RNA, 14 nt, Haemophilus influenzae Rd
uaguucuuccccuc

SEQ ID NO: 2711359 - RNA, 14 nt, Haemophilus influenzae Rd
uaguucuuccuugg

SEQ ID NO: 2711360 - RNA, 16 nt, Haemophilus influenzae Rd
uauacuuaauuucuca

SEQ ID NO: 2711361 - RNA, 13 nt, Haemophilus influenzae Rd
uauacuuacucaa

SEQ ID NO: 2711362 - RNA, 21 nt, Haemophilus influenzae Rd
uauacuuuucaacacuuuauu

SEQ ID NO: 2711363 - RNA, 18 nt, Haemophilus influenzae Rd
uauagaaaagacaauaau

SEQ ID NO: 2711364 - RNA, 12 nt, Haemophilus influenzae Rd
uauagaaaucau

SEQ ID NO: 2711365 - RNA, 19 nt, Haemophilus influenzae Rd
uauagaacgguuaugaaaa

SEQ ID NO: 2711366 - RNA, 24 nt, Haemophilus influenzae Rd
uauagaacuuagcccuuaaacuaa

SEQ ID NO: 2711367 - RNA, 15 nt, Haemophilus influenzae Rd
uauagauaaauauca

SEQ ID NO: 2711368 - RNA, 18 nt, Haemophilus influenzae Rd
uauagauaaauaucaaaa

SEQ ID NO: 2711369 - RNA, 20 nt, Haemophilus influenzae Rd
uauagaugaacucaauuccu

SEQ ID NO: 2711370 - RNA, 22 nt, Haemophilus influenzae Rd
uauagcgucuuuuugcacguuc

SEQ ID NO: 2711371 - RNA, 17 nt, Haemophilus influenzae Rd
uauagcgugcuuuaaua

SEQ ID NO: 2711372 - RNA, 16 nt, Haemophilus influenzae Rd
uauagcuuuaguuuua

SEQ ID NO: 2711373 - RNA, 13 nt, Haemophilus influenzae Rd
uauaggauuuuaa

SEQ ID NO: 2711374 - RNA, 18 nt, Haemophilus influenzae Rd
uauaggcuauauuuucca

SEQ ID NO: 2711375 - RNA, 16 nt, Haemophilus influenzae Rd
uauaggguaaauaaaa

SEQ ID NO: 2711376 - RNA, 20 nt, Haemophilus influenzae Rd
uauaggguaaauaaaaauga

SEQ ID NO: 2711377 - RNA, 20 nt, Haemophilus influenzae Rd
uauaguaagcaccaaaauuu

SEQ ID NO: 2711378 - RNA, 14 nt, Haemophilus influenzae Rd
uauaguauauuuau

SEQ ID NO: 2711379 - RNA, 14 nt, Haemophilus influenzae Rd
uauagugauuauuu

SEQ ID NO: 2711380 - RNA, 20 nt, Haemophilus influenzae Rd
uauagugauuauuuacaauu

SEQ ID NO: 2711381 - RNA, 13 nt, Haemophilus influenzae Rd
uauaguuuaaacu

SEQ ID NO: 2711382 - RNA, 15 nt, Haemophilus influenzae Rd
uauaguuuaaacuca

SEQ ID NO: 2711383 - RNA, 17 nt, Haemophilus influenzae Rd
uauaguuuuauuuuaau

SEQ ID NO: 2711384 - RNA, 13 nt, Haemophilus influenzae Rd
uauauaaaaaacc

SEQ ID NO: 2711385 - RNA, 11 nt, Haemophilus influenzae Rd
uauauaaaaua

SEQ ID NO: 2711386 - RNA, 13 nt, Haemophilus influenzae Rd
uauauaaacaauu

SEQ ID NO: 2711387 - RNA, 21 nt, Haemophilus influenzae Rd
uauauaaagcucuaauugaaa

SEQ ID NO: 2711388 - RNA, 13 nt, Haemophilus influenzae Rd
uauauaaauaacu

SEQ ID NO: 2711389 - RNA, 21 nt, Haemophilus influenzae Rd
uauauaaauccguaaaauacg

SEQ ID NO: 2711390 - RNA, 23 nt, Haemophilus influenzae Rd
uauauagccuguuguucucacua

SEQ ID NO: 2711391 - RNA, 15 nt, Haemophilus influenzae Rd
uauauauaaaauaua

SEQ ID NO: 2711392 - RNA, 22 nt, Haemophilus influenzae Rd
uauauaucacagauuuuuaaau

SEQ ID NO: 2711393 - RNA, 23 nt, Haemophilus influenzae Rd
uauauaucauggcacaaaauaau

SEQ ID NO: 2711394 - RNA, 16 nt, Haemophilus influenzae Rd
uauauauuaaaaaaau

SEQ ID NO: 2711395 - RNA, 14 nt, Haemophilus influenzae Rd
uauauauuuuccua

SEQ ID NO: 2711396 - RNA, 18 nt, Haemophilus influenzae Rd
uauaucaagcugugcaaa

SEQ ID NO: 2711397 - RNA, 15 nt, Haemophilus influenzae Rd
uauaucacagauuuu

SEQ ID NO: 2711398 - RNA, 20 nt, Haemophilus influenzae Rd
uauaucacagauuuuuaaau

SEQ ID NO: 2711399 - RNA, 18 nt, Haemophilus influenzae Rd
uauaucacagauuuuuua

SEQ ID NO: 2711400 - RNA, 20 nt, Haemophilus influenzae Rd
uauaucauggcacaaaauaa

SEQ ID NO: 2711401 - RNA, 11 nt, Haemophilus influenzae Rd
uauauccaaau

SEQ ID NO: 2711402 - RNA, 18 nt, Haemophilus influenzae Rd
uauaucgccauccacuac

SEQ ID NO: 2711403 - RNA, 22 nt, Haemophilus influenzae Rd
uauaucugaacuuuguucauuu

SEQ ID NO: 2711404 - RNA, 15 nt, Haemophilus influenzae Rd
uauaucuuauauuuu

SEQ ID NO: 2711405 - RNA, 18 nt, Haemophilus influenzae Rd
uauaugauuauaaauuag

SEQ ID NO: 2711406 - RNA, 15 nt, Haemophilus influenzae Rd
uauaugccaagauuu

SEQ ID NO: 2711407 - RNA, 21 nt, Haemophilus influenzae Rd
uauaugccaagauuucgccca

SEQ ID NO: 2711408 - RNA, 16 nt, Haemophilus influenzae Rd
uauaugccuaaaaaga

SEQ ID NO: 2711409 - RNA, 16 nt, Haemophilus influenzae Rd
uauaugguucauuauu

SEQ ID NO: 2711410 - RNA, 19 nt, Haemophilus influenzae Rd
uauaugguucauuauuaau

SEQ ID NO: 2711411 - RNA, 21 nt, Haemophilus influenzae Rd
uauauuaaaaaaaucuuuauc

SEQ ID NO: 2711412 - RNA, 23 nt, Haemophilus influenzae Rd
uauauuaacuugcuauuuucuaa

SEQ ID NO: 2711413 - RNA, 19 nt, Haemophilus influenzae Rd
uauauuaauuauuuuagau

SEQ ID NO: 2711414 - RNA, 15 nt, Haemophilus influenzae Rd
uauauuaauuuugau

SEQ ID NO: 2711415 - RNA, 15 nt, Haemophilus influenzae Rd
uauauucaaauuuca

SEQ ID NO: 2711416 - RNA, 14 nt, Haemophilus influenzae Rd
uauauucaacuaaa

SEQ ID NO: 2711417 - RNA, 22 nt, Haemophilus influenzae Rd
uauauucaacuaaaggcacaaa

SEQ ID NO: 2711418 - RNA, 18 nt, Haemophilus influenzae Rd
uauauucauuuaaaacaa

SEQ ID NO: 2711419 - RNA, 16 nt, Haemophilus influenzae Rd
uauauucguuaaauaa

SEQ ID NO: 2711420 - RNA, 22 nt, Haemophilus influenzae Rd
uauauugcauaaucauaucuaa

SEQ ID NO: 2711421 - RNA, 16 nt, Haemophilus influenzae Rd
uauauuguugcacauu

SEQ ID NO: 2711422 - RNA, 19 nt, Haemophilus influenzae Rd
uauauuguugcacauuaau

SEQ ID NO: 2711423 - RNA, 15 nt, Haemophilus influenzae Rd
uauauuucacuggcu

SEQ ID NO: 2711424 - RNA, 22 nt, Haemophilus influenzae Rd
uauauuucacuggcucauuauu

SEQ ID NO: 2711425 - RNA, 13 nt, Haemophilus influenzae Rd
uauauuucuaaua

SEQ ID NO: 2711426 - RNA, 15 nt, Haemophilus influenzae Rd
uauauuucuuuucaa

SEQ ID NO: 2711427 - RNA, 19 nt, Haemophilus influenzae Rd
uauauuucuuuucaaacac

SEQ ID NO: 2711428 - RNA, 22 nt, Haemophilus influenzae Rd
uauauuuuaucaacuaaaaaau

SEQ ID NO: 2711429 - RNA, 12 nt, Haemophilus influenzae Rd
uauauuuuuaau

SEQ ID NO: 2711430 - RNA, 13 nt, Haemophilus influenzae Rd
uauauuuuuaauu

SEQ ID NO: 2711431 - RNA, 19 nt, Haemophilus influenzae Rd
uauauuuuuaauuuauacu

SEQ ID NO: 2711432 - RNA, 15 nt, Haemophilus influenzae Rd
uauauuuuuauugaa

SEQ ID NO: 2711433 - RNA, 13 nt, Haemophilus influenzae Rd
uauauuuuuucuu

SEQ ID NO: 2711434 - RNA, 17 nt, Haemophilus influenzae Rd
uaucaaaaaguugaauu

SEQ ID NO: 2711435 - RNA, 22 nt, Haemophilus influenzae Rd
uaucaaaaaguugaauuuucaa

SEQ ID NO: 2711436 - RNA, 17 nt, Haemophilus influenzae Rd
uaucaaaacuugcuaca

SEQ ID NO: 2711437 - RNA, 20 nt, Haemophilus influenzae Rd
uaucaaacaagcccacauuu

SEQ ID NO: 2711438 - RNA, 18 nt, Haemophilus influenzae Rd
uaucaaagaauuuuuuca

SEQ ID NO: 2711439 - RNA, 19 nt, Haemophilus influenzae Rd
uaucaaagaauuuuuucac

SEQ ID NO: 2711440 - RNA, 15 nt, Haemophilus influenzae Rd
uaucaacuaaaaaau

SEQ ID NO: 2711441 - RNA, 18 nt, Haemophilus influenzae Rd
uaucaagaacaguauaac

SEQ ID NO: 2711442 - RNA, 21 nt, Haemophilus influenzae Rd
uaucaaucauaucaucaacca

SEQ ID NO: 2711443 - RNA, 13 nt, Haemophilus influenzae Rd
uaucaaugccauc

SEQ ID NO: 2711444 - RNA, 14 nt, Haemophilus influenzae Rd
uaucaaugccaucg

SEQ ID NO: 2711445 - RNA, 17 nt, Haemophilus influenzae Rd
uaucaauguuugugcgu

SEQ ID NO: 2711446 - RNA, 16 nt, Haemophilus influenzae Rd
uaucaauuccuucaaa

SEQ ID NO: 2711447 - RNA, 13 nt, Haemophilus influenzae Rd
uaucaauuuggcu

SEQ ID NO: 2711448 - RNA, 14 nt, Haemophilus influenzae Rd
uaucaauuuggcuc

SEQ ID NO: 2711449 - RNA, 21 nt, Haemophilus influenzae Rd
uaucaauuuggcucacaagac

SEQ ID NO: 2711450 - RNA, 21 nt, Haemophilus influenzae Rd
uaucaauuuuauugaauacua

SEQ ID NO: 2711451 - RNA, 18 nt, Haemophilus influenzae Rd
uaucacaaauuuccauau

SEQ ID NO: 2711452 - RNA, 16 nt, Haemophilus influenzae Rd
uaucacaaguuaaaac

SEQ ID NO: 2711453 - RNA, 22 nt, Haemophilus influenzae Rd
uaucacagauuuuuaaaucaau

SEQ ID NO: 2711454 - RNA, 21 nt, Haemophilus influenzae Rd
uaucacagauuuuuuauuaau

SEQ ID NO: 2711455 - RNA, 17 nt, Haemophilus influenzae Rd
uaucacauuuuauugaa

SEQ ID NO: 2711456 - RNA, 20 nt, Haemophilus influenzae Rd
uaucaccugggcggaagcua

SEQ ID NO: 2711457 - RNA, 16 nt, Haemophilus influenzae Rd
uaucacgaaaaucacg

SEQ ID NO: 2711458 - RNA, 18 nt, Haemophilus influenzae Rd
uaucacuaauauaaagau

SEQ ID NO: 2711459 - RNA, 14 nt, Haemophilus influenzae Rd
uaucacuaauauuu

SEQ ID NO: 2711460 - RNA, 14 nt, Haemophilus influenzae Rd
uaucacuuaaacca

SEQ ID NO: 2711461 - RNA, 17 nt, Haemophilus influenzae Rd
uaucacuucuguaagca

SEQ ID NO: 2711462 - RNA, 16 nt, Haemophilus influenzae Rd
uaucacuuuuuuauuc

SEQ ID NO: 2711463 - RNA, 21 nt, Haemophilus influenzae Rd
uaucacuuuuuuauucuccaa

SEQ ID NO: 2711464 - RNA, 23 nt, Haemophilus influenzae Rd
uaucagauuuaggcaauaaaaaa

SEQ ID NO: 2711465 - RNA, 19 nt, Haemophilus influenzae Rd
uaugagaauuaauuuauaa

SEQ ID NO: 2711466 - RNA, 18 nt, Haemophilus influenzae Rd
uaugauaaaaauaaaaaa

SEQ ID NO: 2711467 - RNA, 15 nt, Haemophilus influenzae Rd
uaugauaaaugcaau

SEQ ID NO: 2711468 - RNA, 16 nt, Haemophilus influenzae Rd
uaugauaaaugcaaua

SEQ ID NO: 2711469 - RNA, 12 nt, Haemophilus influenzae Rd
uaugaucuacac

SEQ ID NO: 2711470 - RNA, 16 nt, Haemophilus influenzae Rd
uaugaugugcuugaug

SEQ ID NO: 2711471 - RNA, 22 nt, Haemophilus influenzae Rd
uaugauuaaaaugguuuaaaua

SEQ ID NO: 2711472 - RNA, 13 nt, Haemophilus influenzae Rd
uaugauuauaaau

SEQ ID NO: 2711473 - RNA, 16 nt, Haemophilus influenzae Rd
uaugauuuagaacaau

SEQ ID NO: 2711474 - RNA, 16 nt, Haemophilus influenzae Rd
uaugauuuuaaagcca

SEQ ID NO: 2711475 - RNA, 22 nt, Haemophilus influenzae Rd
uaugauuuuuaaccgcccuuua

SEQ ID NO: 2711476 - RNA, 16 nt, Haemophilus influenzae Rd
uaugccaaauaaaauu

SEQ ID NO: 2711477 - RNA, 13 nt, Haemophilus influenzae Rd
uaugccaaucaca

SEQ ID NO: 2711478 - RNA, 20 nt, Haemophilus influenzae Rd
uaugccaaugcuauuaucau

SEQ ID NO: 2711479 - RNA, 13 nt, Haemophilus influenzae Rd
uaugccauaaaau

SEQ ID NO: 2711480 - RNA, 18 nt, Haemophilus influenzae Rd
uaugccuacuuuuuauuu

SEQ ID NO: 2711481 - RNA, 18 nt, Haemophilus influenzae Rd
uaugccuuauauuucacu

SEQ ID NO: 2711482 - RNA, 14 nt, Haemophilus influenzae Rd
uaugcgcuucauca

SEQ ID NO: 2711483 - RNA, 16 nt, Haemophilus influenzae Rd
uaugcgggcaaaaacu

SEQ ID NO: 2711484 - RNA, 21 nt, Haemophilus influenzae Rd
uaugcguugaugcaacauuua

SEQ ID NO: 2711485 - RNA, 21 nt, Haemophilus influenzae Rd
uaugcuccauugcaauuucag

SEQ ID NO: 2711486 - RNA, 13 nt, Haemophilus influenzae Rd
uauggaaauaaau

SEQ ID NO: 2711487 - RNA, 17 nt, Haemophilus influenzae Rd
uauggauauuguaggaa

SEQ ID NO: 2711488 - RNA, 22 nt, Haemophilus influenzae Rd
uauggauauuguaggaagacag

SEQ ID NO: 2711489 - RNA, 15 nt, Haemophilus influenzae Rd
uauggaucacccauu

SEQ ID NO: 2711490 - RNA, 23 nt, Haemophilus influenzae Rd
uauggaucacccauuaaauaaaa

SEQ ID NO: 2711491 - RNA, 22 nt, Haemophilus influenzae Rd
uauggcaagugcaagccccuga

SEQ ID NO: 2711492 - RNA, 19 nt, Haemophilus influenzae Rd
uauggcaaugaauaaacag

SEQ ID NO: 2711493 - RNA, 19 nt, Haemophilus influenzae Rd
uauggcauacuuaacaaau

SEQ ID NO: 2711494 - RNA, 12 nt, Haemophilus influenzae Rd
uauggcguucac

SEQ ID NO: 2711495 - RNA, 21 nt, Haemophilus influenzae Rd
uauggcucuaaauuaauuuac

SEQ ID NO: 2711496 - RNA, 22 nt, Haemophilus influenzae Rd
uauggcuugugcuauacaaaau

SEQ ID NO: 2711497 - RNA, 17 nt, Haemophilus influenzae Rd
uaugggcugacauaaau

SEQ ID NO: 2711498 - RNA, 16 nt, Haemophilus influenzae Rd
uaugguaauuagccuu

SEQ ID NO: 2711499 - RNA, 20 nt, Haemophilus influenzae Rd
uauggugggcuggguagaaa

SEQ ID NO: 2711500 - RNA, 17 nt, Haemophilus influenzae Rd
uaugguucauuauuaau

SEQ ID NO: 2711501 - RNA, 19 nt, Haemophilus influenzae Rd
uaugguucauuauuaauug

SEQ ID NO: 2711502 - RNA, 12 nt, Haemophilus influenzae Rd
uauguaaauaag

SEQ ID NO: 2711503 - RNA, 20 nt, Haemophilus influenzae Rd
uauguaaauaaggaauuuua

SEQ ID NO: 2711504 - RNA, 13 nt, Haemophilus influenzae Rd
uauguaauauuuu

SEQ ID NO: 2711505 - RNA, 16 nt, Haemophilus influenzae Rd
uauguaauauuuuccc

SEQ ID NO: 2711506 - RNA, 21 nt, Haemophilus influenzae Rd
uauguagcaguugcuaaauca

SEQ ID NO: 2711507 - RNA, 23 nt, Haemophilus influenzae Rd
uauguagcaguugcuaaaucacc

SEQ ID NO: 2711508 - RNA, 16 nt, Haemophilus influenzae Rd
uauguauaauuccuaa

SEQ ID NO: 2711509 - RNA, 13 nt, Haemophilus influenzae Rd
uauguauuuucaa

SEQ ID NO: 2711510 - RNA, 20 nt, Haemophilus influenzae Rd
uaugucaauuacuguuugaa

SEQ ID NO: 2711511 - RNA, 16 nt, Haemophilus influenzae Rd
uaugucguuucugugg

SEQ ID NO: 2711512 - RNA, 14 nt, Haemophilus influenzae Rd
uaugugaauaaaau

SEQ ID NO: 2711513 - RNA, 15 nt, Haemophilus influenzae Rd
uaugugaauaaaauc

SEQ ID NO: 2711514 - RNA, 23 nt, Haemophilus influenzae Rd
uaugugaauaaaaucaauaauau

SEQ ID NO: 2711515 - RNA, 21 nt, Haemophilus influenzae Rd
uauguucaacaaguaaaucaa

SEQ ID NO: 2711516 - RNA, 21 nt, Haemophilus influenzae Rd
uauguucuaagguauaaauaa

SEQ ID NO: 2711517 - RNA, 19 nt, Haemophilus influenzae Rd
uauguucucucacgugaau

SEQ ID NO: 2711518 - RNA, 22 nt, Haemophilus influenzae Rd
uauguucucucacgugaaucac

SEQ ID NO: 2711519 - RNA, 14 nt, Haemophilus influenzae Rd
uauguugcuuuuau

SEQ ID NO: 2711520 - RNA, 17 nt, Haemophilus influenzae Rd
uauguugcuuuuaucaa

SEQ ID NO: 2711521 - RNA, 20 nt, Haemophilus influenzae Rd
uauguuucucucuauucauc

SEQ ID NO: 2711522 - RNA, 13 nt, Haemophilus influenzae Rd
uauguuuugccaa

SEQ ID NO: 2711523 - RNA, 23 nt, Haemophilus influenzae Rd
uauuaaaaauaaguucaucaacu

SEQ ID NO: 2711524 - RNA, 16 nt, Haemophilus influenzae Rd
uauuaaaauuaauaaa

SEQ ID NO: 2711525 - RNA, 22 nt, Haemophilus influenzae Rd
uauuaaauauaggguaaauaaa

SEQ ID NO: 2711526 - RNA, 21 nt, Haemophilus influenzae Rd
uauuaacuugcuauuuucuaa

SEQ ID NO: 2711527 - RNA, 15 nt, Haemophilus influenzae Rd
uauuaagauauaaaa

SEQ ID NO: 2711528 - RNA, 17 nt, Haemophilus influenzae Rd
uauuaagauauaaaagu

SEQ ID NO: 2711529 - RNA, 19 nt, Haemophilus influenzae Rd
uauuaagguaauauguaau

SEQ ID NO: 2711530 - RNA, 17 nt, Haemophilus influenzae Rd
uauuaaguaaauauuuu

SEQ ID NO: 2711531 - RNA, 16 nt, Haemophilus influenzae Rd
uauuaaucgcaauaac

SEQ ID NO: 2711532 - RNA, 17 nt, Haemophilus influenzae Rd
uauuaaugcuguuuaaa

SEQ ID NO: 2711533 - RNA, 20 nt, Haemophilus influenzae Rd
uauuaauguuauuaaauaua

SEQ ID NO: 2711534 - RNA, 13 nt, Haemophilus influenzae Rd
uauuaauuacuuu

SEQ ID NO: 2711535 - RNA, 14 nt, Haemophilus influenzae Rd
uauuaauuauaaaa

SEQ ID NO: 2711536 - RNA, 18 nt, Haemophilus influenzae Rd
uauuaauuauuuuagauu

SEQ ID NO: 2711537 - RNA, 12 nt, Haemophilus influenzae Rd
uauuaauuuaau

SEQ ID NO: 2711538 - RNA, 20 nt, Haemophilus influenzae Rd
uauuaauuugucgauaaaag

SEQ ID NO: 2711539 - RNA, 11 nt, Haemophilus influenzae Rd
uauuacaaaau

SEQ ID NO: 2711540 - RNA, 16 nt, Haemophilus influenzae Rd
uauuacaaacaaaaag

SEQ ID NO: 2711541 - RNA, 14 nt, Haemophilus influenzae Rd
uauuacaagauaau

SEQ ID NO: 2711542 - RNA, 15 nt, Haemophilus influenzae Rd
uauuacccguuugaa

SEQ ID NO: 2711543 - RNA, 22 nt, Haemophilus influenzae Rd
uauuacccuauucuaaauuuau

SEQ ID NO: 2711544 - RNA, 14 nt, Haemophilus influenzae Rd
uauuaccuaaccaa

SEQ ID NO: 2711545 - RNA, 20 nt, Haemophilus influenzae Rd
uauuaccuaguuugcuauau

SEQ ID NO: 2711546 - RNA, 17 nt, Haemophilus influenzae Rd
uauuaccugguugcaua

SEQ ID NO: 2711547 - RNA, 18 nt, Haemophilus influenzae Rd
uauuacuucacuuuucca

SEQ ID NO: 2711548 - RNA, 12 nt, Haemophilus influenzae Rd
uauuacuuucca

SEQ ID NO: 2711549 - RNA, 14 nt, Haemophilus influenzae Rd
uauuacuuuccaua

SEQ ID NO: 2711550 - RNA, 16 nt, Haemophilus influenzae Rd
uauuacuuuccauaau

SEQ ID NO: 2711551 - RNA, 21 nt, Haemophilus influenzae Rd
uauuacuuuccauaauagaaa

SEQ ID NO: 2711552 - RNA, 15 nt, Haemophilus influenzae Rd
uauuagaaauauauu

SEQ ID NO: 2711553 - RNA, 19 nt, Haemophilus influenzae Rd
uauuagaaguaaauucagu

SEQ ID NO: 2711554 - RNA, 13 nt, Haemophilus influenzae Rd
uauuagaauauaa

SEQ ID NO: 2711555 - RNA, 18 nt, Haemophilus influenzae Rd
uauuagacuuaauuucac

SEQ ID NO: 2711556 - RNA, 21 nt, Haemophilus influenzae Rd
uauuaguuaguuuuuuaccuu

SEQ ID NO: 2711557 - RNA, 12 nt, Haemophilus influenzae Rd
uauuauaaaaau

SEQ ID NO: 2711558 - RNA, 13 nt, Haemophilus influenzae Rd
uauuauaaaaaua

SEQ ID NO: 2711559 - RNA, 19 nt, Haemophilus influenzae Rd
uauuauaaaaauauuuuaa

SEQ ID NO: 2711560 - RNA, 20 nt, Haemophilus influenzae Rd
uauuauaaaaauauuuuaau

SEQ ID NO: 2711561 - RNA, 14 nt, Haemophilus influenzae Rd
uauuauauaaaaaa

SEQ ID NO: 2711562 - RNA, 15 nt, Haemophilus influenzae Rd
uauuauauaaaaaac

SEQ ID NO: 2711563 - RNA, 20 nt, Haemophilus influenzae Rd
uauuaucaacaguaaauuuu

SEQ ID NO: 2711564 - RNA, 16 nt, Haemophilus influenzae Rd
uauuaucuaaaucucu

SEQ ID NO: 2711565 - RNA, 21 nt, Haemophilus influenzae Rd
uauuaucuacuagccaaucau

SEQ ID NO: 2711566 - RNA, 18 nt, Haemophilus influenzae Rd
uauuaucuucaugauuuu

SEQ ID NO: 2711567 - RNA, 21 nt, Haemophilus influenzae Rd
uauuaucuucaugauuuucca

SEQ ID NO: 2711568 - RNA, 13 nt, Haemophilus influenzae Rd
uauuaugaaauuu

SEQ ID NO: 2711569 - RNA, 16 nt, Haemophilus influenzae Rd
uauuaugaaauuuguu

SEQ ID NO: 2711570 - RNA, 21 nt, Haemophilus influenzae Rd
uauuaugcuaauaaucuauuu

SEQ ID NO: 2711571 - RNA, 17 nt, Haemophilus influenzae Rd
uauuuaauacuuucuuu

SEQ ID NO: 2711572 - RNA, 14 nt, Haemophilus influenzae Rd
uauuuaauauauuu

SEQ ID NO: 2711573 - RNA, 23 nt, Haemophilus influenzae Rd
uauuuaauaugccaaauaaaauu

SEQ ID NO: 2711574 - RNA, 13 nt, Haemophilus influenzae Rd
uauuuaauuucgc

SEQ ID NO: 2711575 - RNA, 22 nt, Haemophilus influenzae Rd
uauuuaccgcuuucaauuaaug

SEQ ID NO: 2711576 - RNA, 17 nt, Haemophilus influenzae Rd
uauuuacgacuaaaauu

SEQ ID NO: 2711577 - RNA, 12 nt, Haemophilus influenzae Rd
uauuuacuaaau

SEQ ID NO: 2711578 - RNA, 17 nt, Haemophilus influenzae Rd
uauuuacuaaauucuuu

SEQ ID NO: 2711579 - RNA, 21 nt, Haemophilus influenzae Rd
uauuuacuaaauucuuuugcc

SEQ ID NO: 2711580 - RNA, 16 nt, Haemophilus influenzae Rd
uauuuacugauuuaaa

SEQ ID NO: 2711581 - RNA, 23 nt, Haemophilus influenzae Rd
uauuuacuuccuaaacuacaaca

SEQ ID NO: 2711582 - RNA, 17 nt, Haemophilus influenzae Rd
uauuuacuuuauaaaug

SEQ ID NO: 2711583 - RNA, 20 nt, Haemophilus influenzae Rd
uauuuagaauuuuuauuuuu

SEQ ID NO: 2711584 - RNA, 14 nt, Haemophilus influenzae Rd
uauuuagauauaaa

SEQ ID NO: 2711585 - RNA, 15 nt, Haemophilus influenzae Rd
uauuuagauauaaaa

SEQ ID NO: 2711586 - RNA, 12 nt, Haemophilus influenzae Rd
uauuuagauuac

SEQ ID NO: 2711587 - RNA, 15 nt, Haemophilus influenzae Rd
uauuuagauuacuuu

SEQ ID NO: 2711588 - RNA, 17 nt, Haemophilus influenzae Rd
uauuuagcggaauuuuu

SEQ ID NO: 2711589 - RNA, 21 nt, Haemophilus influenzae Rd
uauuuauaacacagaugaaaa

SEQ ID NO: 2711590 - RNA, 14 nt, Haemophilus influenzae Rd
uauuuauaauccau

SEQ ID NO: 2711591 - RNA, 19 nt, Haemophilus influenzae Rd
uauuuauaauccauucagc

SEQ ID NO: 2711592 - RNA, 13 nt, Haemophilus influenzae Rd
uauuuauaaugug

SEQ ID NO: 2711593 - RNA, 14 nt, Haemophilus influenzae Rd
uauuuauaaugugg

SEQ ID NO: 2711594 - RNA, 15 nt, Haemophilus influenzae Rd
uauuuauagcauuua

SEQ ID NO: 2711595 - RNA, 19 nt, Haemophilus influenzae Rd
uauuuauagcauuuaaaua

SEQ ID NO: 2711596 - RNA, 23 nt, Haemophilus influenzae Rd
uauuuauagcauuuaaauauuau

SEQ ID NO: 2711597 - RNA, 21 nt, Haemophilus influenzae Rd
uauuuauagcuaagcaguuua

SEQ ID NO: 2711598 - RNA, 14 nt, Haemophilus influenzae Rd
uauuuauuauucuu

SEQ ID NO: 2711599 - RNA, 20 nt, Haemophilus influenzae Rd
uauuuauuauucuugaguau

SEQ ID NO: 2711600 - RNA, 14 nt, Haemophilus influenzae Rd
uauuuauuuaauuu

SEQ ID NO: 2711601 - RNA, 15 nt, Haemophilus influenzae Rd
uauuuauuuauugaa

SEQ ID NO: 2711602 - RNA, 12 nt, Haemophilus influenzae Rd
uauuuauuucua

SEQ ID NO: 2711603 - RNA, 15 nt, Haemophilus influenzae Rd
uauuuauuuugaauu

SEQ ID NO: 2711604 - RNA, 13 nt, Haemophilus influenzae Rd
uauuucaacauag

SEQ ID NO: 2711605 - RNA, 21 nt, Haemophilus influenzae Rd
uauuucaacauagugucagca

SEQ ID NO: 2711606 - RNA, 13 nt, Haemophilus influenzae Rd
uauuucaauauug

SEQ ID NO: 2711607 - RNA, 11 nt, Haemophilus influenzae Rd
uauuucaauuu

SEQ ID NO: 2711608 - RNA, 17 nt, Haemophilus influenzae Rd
uauuucagcugcaauau

SEQ ID NO: 2711609 - RNA, 20 nt, Haemophilus influenzae Rd
uauuucagcugcaauaucaa

SEQ ID NO: 2711610 - RNA, 14 nt, Haemophilus influenzae Rd
uauuucaucuuuag

SEQ ID NO: 2711611 - RNA, 11 nt, Haemophilus influenzae Rd
uauuucauuug

SEQ ID NO: 2711612 - RNA, 14 nt, Haemophilus influenzae Rd
uauuuccaucaaaa

SEQ ID NO: 2711613 - RNA, 18 nt, Haemophilus influenzae Rd
uauuuccaucaaaagauc

SEQ ID NO: 2711614 - RNA, 15 nt, Haemophilus influenzae Rd
uauuuccucuaaaua

SEQ ID NO: 2711615 - RNA, 20 nt, Haemophilus influenzae Rd
uauuucgcccuuauacaaaa

SEQ ID NO: 2711616 - RNA, 22 nt, Haemophilus influenzae Rd
uauuucgcccuuauacaaaacu

SEQ ID NO: 2711617 - RNA, 20 nt, Haemophilus influenzae Rd
uauuucgucuuaauuuuuua

SEQ ID NO: 2711618 - RNA, 17 nt, Haemophilus influenzae Rd
uauuucuaacaaaugau

SEQ ID NO: 2711619 - RNA, 18 nt, Haemophilus influenzae Rd
uauuucuaggcuauauuu

SEQ ID NO: 2711620 - RNA, 16 nt, Haemophilus influenzae Rd
uauuucucacuucuuu

SEQ ID NO: 2711621 - RNA, 19 nt, Haemophilus influenzae Rd
uauuucugaagguuuucuu

SEQ ID NO: 2711622 - RNA, 18 nt, Haemophilus influenzae Rd
uauuucuguauuaucuaa

SEQ ID NO: 2711623 - RNA, 19 nt, Haemophilus influenzae Rd
uauuucuguauuaucuaau

SEQ ID NO: 2711624 - RNA, 24 nt, Haemophilus influenzae Rd
uauuucuguauuaucuaauuauuu

SEQ ID NO: 2711625 - RNA, 23 nt, Haemophilus influenzae Rd
uauuucuguauuuuuuauuuaau

SEQ ID NO: 2711626 - RNA, 13 nt, Haemophilus influenzae Rd
uauuucuguuacu

SEQ ID NO: 2711627 - RNA, 21 nt, Haemophilus influenzae Rd
uauuucuucaauauguucuaa

SEQ ID NO: 2711628 - RNA, 16 nt, Haemophilus influenzae Rd
uauuucuucauuuuaa

SEQ ID NO: 2711629 - RNA, 20 nt, Haemophilus influenzae Rd
uauuucuucauuuuaaauua

SEQ ID NO: 2711630 - RNA, 15 nt, Haemophilus influenzae Rd
uauuucuuucguuca

SEQ ID NO: 2711631 - RNA, 14 nt, Haemophilus influenzae Rd
uauuucuuuuugau

SEQ ID NO: 2711632 - RNA, 17 nt, Haemophilus influenzae Rd
uauuugaagcaagaaac

SEQ ID NO: 2711633 - RNA, 16 nt, Haemophilus influenzae Rd
uauuugacuuaaauga

SEQ ID NO: 2711634 - RNA, 18 nt, Haemophilus influenzae Rd
uauuugagaaaaauguua

SEQ ID NO: 2711635 - RNA, 16 nt, Haemophilus influenzae Rd
uauuugaguuauuuuu

SEQ ID NO: 2711636 - RNA, 21 nt, Haemophilus influenzae Rd
uauuugauuuuuauagugaua

SEQ ID NO: 2711637 - RNA, 13 nt, Haemophilus influenzae Rd
uauuugcuaaaau

SEQ ID NO: 2711638 - RNA, 14 nt, Haemophilus influenzae Rd
uauuugcuaaaauu

SEQ ID NO: 2711639 - RNA, 17 nt, Haemophilus influenzae Rd
uauuuggaacaguaaau

SEQ ID NO: 2711640 - RNA, 17 nt, Haemophilus influenzae Rd
uauuuggcauagaaaag

SEQ ID NO: 2711641 - RNA, 21 nt, Haemophilus influenzae Rd
uauuuggcauuugaauuacca

SEQ ID NO: 2711642 - RNA, 18 nt, Haemophilus influenzae Rd
uauuuggcugauauauua

SEQ ID NO: 2711643 - RNA, 14 nt, Haemophilus influenzae Rd
uauuugguuaugau

SEQ ID NO: 2711644 - RNA, 18 nt, Haemophilus influenzae Rd
uauuugguugaacuucua

SEQ ID NO: 2711645 - RNA, 22 nt, Haemophilus influenzae Rd
uauuugguugaacuucuaaaaa

SEQ ID NO: 2711646 - RNA, 23 nt, Haemophilus influenzae Rd
uauuuguguaacagcucuguaaa

SEQ ID NO: 2711647 - RNA, 20 nt, Haemophilus influenzae Rd
uauuuguguggaaaaaugua

SEQ ID NO: 2711648 - RNA, 13 nt, Haemophilus influenzae Rd
uauuuuaaaauca

SEQ ID NO: 2711649 - RNA, 14 nt, Haemophilus influenzae Rd
uauuuuaaauaaaa

SEQ ID NO: 2711650 - RNA, 16 nt, Haemophilus influenzae Rd
uauuuuaaauaaaaaa

SEQ ID NO: 2711651 - RNA, 16 nt, Haemophilus influenzae Rd
uauuuuaaccgcacuu

SEQ ID NO: 2711652 - RNA, 16 nt, Haemophilus influenzae Rd
uauuuuaauagaauuu

SEQ ID NO: 2711653 - RNA, 13 nt, Haemophilus influenzae Rd
uauuuuacggauu

SEQ ID NO: 2711654 - RNA, 13 nt, Haemophilus influenzae Rd
uauuuuacuaauu

SEQ ID NO: 2711655 - RNA, 22 nt, Haemophilus influenzae Rd
uauuuuaguuagauaagccauu

SEQ ID NO: 2711656 - RNA, 16 nt, Haemophilus influenzae Rd
uauuuuauaauuaaua

SEQ ID NO: 2711657 - RNA, 17 nt, Haemophilus influenzae Rd
uauuuuauaauuaauaa

SEQ ID NO: 2711658 - RNA, 18 nt, Haemophilus influenzae Rd
uauuuuauaauuaauaaa

SEQ ID NO: 2711659 - RNA, 12 nt, Haemophilus influenzae Rd
uauuuuauauau

SEQ ID NO: 2711660 - RNA, 14 nt, Haemophilus influenzae Rd
uauuuuauauauua

SEQ ID NO: 2711661 - RNA, 23 nt, Haemophilus influenzae Rd
uauuuuauauauuaaaaaaaucu

SEQ ID NO: 2711662 - RNA, 14 nt, Haemophilus influenzae Rd
uauuuuauuaucaa

SEQ ID NO: 2711663 - RNA, 17 nt, Haemophilus influenzae Rd
uauuuuauuuuguauau

SEQ ID NO: 2711664 - RNA, 14 nt, Haemophilus influenzae Rd
uauuuucaaauuca

SEQ ID NO: 2711665 - RNA, 14 nt, Haemophilus influenzae Rd
uauuuucccaguaa

SEQ ID NO: 2711666 - RNA, 16 nt, Haemophilus influenzae Rd
uauuuuccccuuucca

SEQ ID NO: 2711667 - RNA, 13 nt, Haemophilus influenzae Rd
uauuuucuaaaaa

SEQ ID NO: 2711668 - RNA, 13 nt, Haemophilus influenzae Rd
uauuuucuaaagu

SEQ ID NO: 2711669 - RNA, 14 nt, Haemophilus influenzae Rd
uauuuucuaauaag

SEQ ID NO: 2711670 - RNA, 19 nt, Haemophilus influenzae Rd
uauuuucucaucauuauuu

SEQ ID NO: 2711671 - RNA, 12 nt, Haemophilus influenzae Rd
uauuuucuuauu

SEQ ID NO: 2711672 - RNA, 15 nt, Haemophilus influenzae Rd
uauuuugaauaauaa

SEQ ID NO: 2711673 - RNA, 17 nt, Haemophilus influenzae Rd
uauuuugauugcgaaua

SEQ ID NO: 2711674 - RNA, 19 nt, Haemophilus influenzae Rd
uauuuuggcuaauaccauu

SEQ ID NO: 2711675 - RNA, 12 nt, Haemophilus influenzae Rd
uauuuugugauc

SEQ ID NO: 2711676 - RNA, 18 nt, Haemophilus influenzae Rd
uauuuuguuaaaaguuag

SEQ ID NO: 2711677 - RNA, 16 nt, Haemophilus influenzae Rd
ucaaauucuguguaau

SEQ ID NO: 2711678 - RNA, 14 nt, Haemophilus influenzae Rd
ucaaauugcaaaaa

SEQ ID NO: 2711679 - RNA, 13 nt, Haemophilus influenzae Rd
ucaaauuuaaaua

SEQ ID NO: 2711680 - RNA, 21 nt, Haemophilus influenzae Rd
ucaaauuucaacuauuuuagu

SEQ ID NO: 2711681 - RNA, 14 nt, Haemophilus influenzae Rd
ucaaauuucuucac

SEQ ID NO: 2711682 - RNA, 13 nt, Haemophilus influenzae Rd
ucaaauuuuucac

SEQ ID NO: 2711683 - RNA, 14 nt, Haemophilus influenzae Rd
ucaaauuuuucaca

SEQ ID NO: 2711684 - RNA, 18 nt, Haemophilus influenzae Rd
ucaacaaaaaacaccuaa

SEQ ID NO: 2711685 - RNA, 22 nt, Haemophilus influenzae Rd
ucaacaaaaaacaccuaaaaug

SEQ ID NO: 2711686 - RNA, 13 nt, Haemophilus influenzae Rd
ucaacaaaaauac

SEQ ID NO: 2711687 - RNA, 16 nt, Haemophilus influenzae Rd
ucaacaaaugucauug

SEQ ID NO: 2711688 - RNA, 14 nt, Haemophilus influenzae Rd
ucaacaacaucuug

SEQ ID NO: 2711689 - RNA, 14 nt, Haemophilus influenzae Rd
ucaacaagacucuc

SEQ ID NO: 2711690 - RNA, 18 nt, Haemophilus influenzae Rd
ucaacaagacucucgccu

SEQ ID NO: 2711691 - RNA, 18 nt, Haemophilus influenzae Rd
ucaacaauaauuuuuaau

SEQ ID NO: 2711692 - RNA, 20 nt, Haemophilus influenzae Rd
ucaacaauaauuuuuaauuc

SEQ ID NO: 2711693 - RNA, 16 nt, Haemophilus influenzae Rd
ucaacaaucacuucgu

SEQ ID NO: 2711694 - RNA, 18 nt, Haemophilus influenzae Rd
ucaacaauuucugcauaa

SEQ ID NO: 2711695 - RNA, 22 nt, Haemophilus influenzae Rd
ucaacaauuucugcauaauggc

SEQ ID NO: 2711696 - RNA, 14 nt, Haemophilus influenzae Rd
ucaacacaccuauu

SEQ ID NO: 2711697 - RNA, 21 nt, Haemophilus influenzae Rd
ucaacacaccuauuuuuuccu

SEQ ID NO: 2711698 - RNA, 17 nt, Haemophilus influenzae Rd
ucaacaccgcaaaaaua

SEQ ID NO: 2711699 - RNA, 21 nt, Haemophilus influenzae Rd
ucaacacuuuauuacuuuuau

SEQ ID NO: 2711700 - RNA, 16 nt, Haemophilus influenzae Rd
ucaacagggugguugc

SEQ ID NO: 2711701 - RNA, 17 nt, Haemophilus influenzae Rd
ucaacagugaaaccaaa

SEQ ID NO: 2711702 - RNA, 22 nt, Haemophilus influenzae Rd
ucaaccacugucucgccacuua

SEQ ID NO: 2711703 - RNA, 18 nt, Haemophilus influenzae Rd
ucaaccacuucaaauacc

SEQ ID NO: 2711704 - RNA, 18 nt, Haemophilus influenzae Rd
ucaaccacuucagcagau

SEQ ID NO: 2711705 - RNA, 18 nt, Haemophilus influenzae Rd
ucaaccauuaaauaggca

SEQ ID NO: 2711706 - RNA, 14 nt, Haemophilus influenzae Rd
ucaaccauuuguug

SEQ ID NO: 2711707 - RNA, 15 nt, Haemophilus influenzae Rd
ucaacccauuuucca

SEQ ID NO: 2711708 - RNA, 18 nt, Haemophilus influenzae Rd
ucaaccgcacuuaauaaa

SEQ ID NO: 2711709 - RNA, 16 nt, Haemophilus influenzae Rd
ucaaccgcacuuuauu

SEQ ID NO: 2711710 - RNA, 17 nt, Haemophilus influenzae Rd
ucaaccguacacgcgca

SEQ ID NO: 2711711 - RNA, 19 nt, Haemophilus influenzae Rd
ucaacgacaauuaaaguaa

SEQ ID NO: 2711712 - RNA, 15 nt, Haemophilus influenzae Rd
ucaacgacuaaaauu

SEQ ID NO: 2711713 - RNA, 13 nt, Haemophilus influenzae Rd
ucaacgccacuca

SEQ ID NO: 2711714 - RNA, 18 nt, Haemophilus influenzae Rd
ucaacgccguauuuggca

SEQ ID NO: 2711715 - RNA, 19 nt, Haemophilus influenzae Rd
ucaacgccguauuuggcaa

SEQ ID NO: 2711716 - RNA, 15 nt, Haemophilus influenzae Rd
ucaacgcuuuucguu

SEQ ID NO: 2711717 - RNA, 19 nt, Haemophilus influenzae Rd
ucaacgguuucuugggcgg

SEQ ID NO: 2711718 - RNA, 15 nt, Haemophilus influenzae Rd
ucaacgguuuucauu

SEQ ID NO: 2711719 - RNA, 14 nt, Haemophilus influenzae Rd
ucaacuaaaaaaua

SEQ ID NO: 2711720 - RNA, 16 nt, Haemophilus influenzae Rd
ucaacuaaaaaauagu

SEQ ID NO: 2711721 - RNA, 19 nt, Haemophilus influenzae Rd
ucaacuaaaaaauaguuaa

SEQ ID NO: 2711722 - RNA, 22 nt, Haemophilus influenzae Rd
ucaacuaaaaaauaguuaauaa

SEQ ID NO: 2711723 - RNA, 20 nt, Haemophilus influenzae Rd
ucaacuaaaggcacaaaaaa

SEQ ID NO: 2711724 - RNA, 22 nt, Haemophilus influenzae Rd
ucaacuaaaggcacaaaaaauu

SEQ ID NO: 2711725 - RNA, 19 nt, Haemophilus influenzae Rd
ucaacuaacacgcgcugcu

SEQ ID NO: 2711726 - RNA, 22 nt, Haemophilus influenzae Rd
ucaacucacuauccaaacauuu

SEQ ID NO: 2711727 - RNA, 15 nt, Haemophilus influenzae Rd
ucaacuuaaacaagc

SEQ ID NO: 2711728 - RNA, 20 nt, Haemophilus influenzae Rd
ucaacuuccgcuaauacuag

SEQ ID NO: 2711729 - RNA, 18 nt, Haemophilus influenzae Rd
ucaacuugauugauaaau

SEQ ID NO: 2711730 - RNA, 17 nt, Haemophilus influenzae Rd
ucaacuugccagcagaa

SEQ ID NO: 2711731 - RNA, 17 nt, Haemophilus influenzae Rd
ucaacuuggaaaggcac

SEQ ID NO: 2711732 - RNA, 12 nt, Haemophilus influenzae Rd
ucaagaaacuga

SEQ ID NO: 2711733 - RNA, 19 nt, Haemophilus influenzae Rd
ucaagaacaguauaaccag

SEQ ID NO: 2711734 - RNA, 14 nt, Haemophilus influenzae Rd
ucaagaauauauuu

SEQ ID NO: 2711735 - RNA, 13 nt, Haemophilus influenzae Rd
ucaagaauuccau

SEQ ID NO: 2711736 - RNA, 15 nt, Haemophilus influenzae Rd
ucaagacaaauuugu

SEQ ID NO: 2711737 - RNA, 17 nt, Haemophilus influenzae Rd
ucaagauaccaauaauc

SEQ ID NO: 2711738 - RNA, 17 nt, Haemophilus influenzae Rd
ucaagaucggaauauuu

SEQ ID NO: 2711739 - RNA, 17 nt, Haemophilus influenzae Rd
ucaagaucuuucacgau

SEQ ID NO: 2711740 - RNA, 21 nt, Haemophilus influenzae Rd
ucaagaugacgaaaugaaauu

SEQ ID NO: 2711741 - RNA, 21 nt, Haemophilus influenzae Rd
ucaagaugauauuuaauaaaa

SEQ ID NO: 2711742 - RNA, 15 nt, Haemophilus influenzae Rd
ucaagauuaaucuuu

SEQ ID NO: 2711743 - RNA, 20 nt, Haemophilus influenzae Rd
ucaagauuaaucuuuuuucu

SEQ ID NO: 2711744 - RNA, 17 nt, Haemophilus influenzae Rd
ucaagcaacauagucgc

SEQ ID NO: 2711745 - RNA, 18 nt, Haemophilus influenzae Rd
ucaagcaaccuaaacccg

SEQ ID NO: 2711746 - RNA, 14 nt, Haemophilus influenzae Rd
ucaagcacaaucag

SEQ ID NO: 2711747 - RNA, 13 nt, Haemophilus influenzae Rd
ucaagcacuuuau

SEQ ID NO: 2711748 - RNA, 18 nt, Haemophilus influenzae Rd
ucaagcacuuuuccuuuu

SEQ ID NO: 2711749 - RNA, 15 nt, Haemophilus influenzae Rd
ucaagcauaaaucuu

SEQ ID NO: 2711750 - RNA, 19 nt, Haemophilus influenzae Rd
ucaagccuucuaaaauaag

SEQ ID NO: 2711751 - RNA, 22 nt, Haemophilus influenzae Rd
ucaagccuucuaaaauaagaau

SEQ ID NO: 2711752 - RNA, 18 nt, Haemophilus influenzae Rd
ucaagcugugcaaaacua

SEQ ID NO: 2711753 - RNA, 24 nt, Haemophilus influenzae Rd
ucaagcuuugcaacaaagugcggc

SEQ ID NO: 2711754 - RNA, 16 nt, Haemophilus influenzae Rd
ucaaggaaaaaggcau

SEQ ID NO: 2711755 - RNA, 19 nt, Haemophilus influenzae Rd
ucaaggaaaaaggcaucuu

SEQ ID NO: 2711756 - RNA, 18 nt, Haemophilus influenzae Rd
ucaaggcuuuaauuuuau

SEQ ID NO: 2711757 - RNA, 15 nt, Haemophilus influenzae Rd
ucaagguugcaacau

SEQ ID NO: 2711758 - RNA, 17 nt, Haemophilus influenzae Rd
ucaagguugcaacauca

SEQ ID NO: 2711759 - RNA, 12 nt, Haemophilus influenzae Rd
ucaaguaaaugc

SEQ ID NO: 2711760 - RNA, 15 nt, Haemophilus influenzae Rd
ucaaguaacuuucac

SEQ ID NO: 2711761 - RNA, 16 nt, Haemophilus influenzae Rd
ucaaguaacuuucaca

SEQ ID NO: 2711762 - RNA, 18 nt, Haemophilus influenzae Rd
ucaaguaauacuuuuuau

SEQ ID NO: 2711763 - RNA, 19 nt, Haemophilus influenzae Rd
ucaaguaaugcuuuaaauu

SEQ ID NO: 2711764 - RNA, 18 nt, Haemophilus influenzae Rd
ucaaguauucagugccua

SEQ ID NO: 2711765 - RNA, 15 nt, Haemophilus influenzae Rd
ucaagucaaaaaccg

SEQ ID NO: 2711766 - RNA, 16 nt, Haemophilus influenzae Rd
ucaagucguuauuuuc

SEQ ID NO: 2711767 - RNA, 16 nt, Haemophilus influenzae Rd
ucaagugauuauuucu

SEQ ID NO: 2711768 - RNA, 15 nt, Haemophilus influenzae Rd
ucaagugguuuauuu

SEQ ID NO: 2711769 - RNA, 23 nt, Haemophilus influenzae Rd
ucaagugugugaaaggcaagcuc

SEQ ID NO: 2711770 - RNA, 20 nt, Haemophilus influenzae Rd
ucaaguuacuuaauuuugcu

SEQ ID NO: 2711771 - RNA, 20 nt, Haemophilus influenzae Rd
ucaaguuuaucguauuccca

SEQ ID NO: 2711772 - RNA, 16 nt, Haemophilus influenzae Rd
ucaaguuuguggagua

SEQ ID NO: 2711773 - RNA, 22 nt, Haemophilus influenzae Rd
ucaaguuuuauuugagaaaaau

SEQ ID NO: 2711774 - RNA, 21 nt, Haemophilus influenzae Rd
ucaauaaaaaauaccgcacuu

SEQ ID NO: 2711775 - RNA, 11 nt, Haemophilus influenzae Rd
ucaauaaaaau

SEQ ID NO: 2711776 - RNA, 13 nt, Haemophilus influenzae Rd
ucaauaaaaauaa

SEQ ID NO: 2711777 - RNA, 13 nt, Haemophilus influenzae Rd
ucaauaaaaauau

SEQ ID NO: 2711778 - RNA, 16 nt, Haemophilus influenzae Rd
ucaauaaaaauauauu

SEQ ID NO: 2711779 - RNA, 15 nt, Haemophilus influenzae Rd
ucaauaaauaucuaa

SEQ ID NO: 2711780 - RNA, 22 nt, Haemophilus influenzae Rd
ucaauaaauaucuaaacuucaa

SEQ ID NO: 2711781 - RNA, 20 nt, Haemophilus influenzae Rd
ucaauaacucuauaaaauga

SEQ ID NO: 2711782 - RNA, 18 nt, Haemophilus influenzae Rd
ucaauaacugaucgccau

SEQ ID NO: 2711783 - RNA, 11 nt, Haemophilus influenzae Rd
ucacaaugagc

SEQ ID NO: 2711784 - RNA, 13 nt, Haemophilus influenzae Rd
ucacaaugauuaa

SEQ ID NO: 2711785 - RNA, 24 nt, Haemophilus influenzae Rd
ucacacaguuauacacaaguuaca

SEQ ID NO: 2711786 - RNA, 17 nt, Haemophilus influenzae Rd
ucacaccauuuuuaauu

SEQ ID NO: 2711787 - RNA, 18 nt, Haemophilus influenzae Rd
ucacaccauuuuuaauua

SEQ ID NO: 2711788 - RNA, 17 nt, Haemophilus influenzae Rd
ucacaccgucuaaaaau

SEQ ID NO: 2711789 - RNA, 18 nt, Haemophilus influenzae Rd
ucacaccgucuaaaaauc

SEQ ID NO: 2711790 - RNA, 15 nt, Haemophilus influenzae Rd
ucacacguccaucac

SEQ ID NO: 2711791 - RNA, 15 nt, Haemophilus influenzae Rd
ucacagagaauaaau

SEQ ID NO: 2711792 - RNA, 14 nt, Haemophilus influenzae Rd
ucacagauuucaau

SEQ ID NO: 2711793 - RNA, 18 nt, Haemophilus influenzae Rd
ucacagauuucaauuaaa

SEQ ID NO: 2711794 - RNA, 15 nt, Haemophilus influenzae Rd
ucacagauuuuuaaa

SEQ ID NO: 2711795 - RNA, 22 nt, Haemophilus influenzae Rd
ucacagauuuuuuauuaauuau

SEQ ID NO: 2711796 - RNA, 14 nt, Haemophilus influenzae Rd
ucacaguaaagauu

SEQ ID NO: 2711797 - RNA, 14 nt, Haemophilus influenzae Rd
ucacagucuuuuaa

SEQ ID NO: 2711798 - RNA, 21 nt, Haemophilus influenzae Rd
ucacagucuuuuaacacauaa

SEQ ID NO: 2711799 - RNA, 19 nt, Haemophilus influenzae Rd
ucacaguuuuauuuuccau

SEQ ID NO: 2711800 - RNA, 15 nt, Haemophilus influenzae Rd
ucacauaaaaaauga

SEQ ID NO: 2711801 - RNA, 22 nt, Haemophilus influenzae Rd
ucacauaauaaacauacaucua

SEQ ID NO: 2711802 - RNA, 23 nt, Haemophilus influenzae Rd
ucacaucgccaacuugaauaccu

SEQ ID NO: 2711803 - RNA, 17 nt, Haemophilus influenzae Rd
ucacauuaugauauuuc

SEQ ID NO: 2711804 - RNA, 22 nt, Haemophilus influenzae Rd
ucacauuaugauauuucaauuu

SEQ ID NO: 2711805 - RNA, 13 nt, Haemophilus influenzae Rd
ucacauugccauu

SEQ ID NO: 2711806 - RNA, 18 nt, Haemophilus influenzae Rd
ucacauuuucaaauuguc

SEQ ID NO: 2711807 - RNA, 20 nt, Haemophilus influenzae Rd
ucaccaaauacauuuuugau

SEQ ID NO: 2711808 - RNA, 18 nt, Haemophilus influenzae Rd
ucaccaacaaauucuaau

SEQ ID NO: 2711809 - RNA, 22 nt, Haemophilus influenzae Rd
ucaccaagacuauuaaguucaa

SEQ ID NO: 2711810 - RNA, 20 nt, Haemophilus influenzae Rd
ucaccacaaaauaaaugauu

SEQ ID NO: 2711811 - RNA, 23 nt, Haemophilus influenzae Rd
ucaccacaaaauaaaugauuauc

SEQ ID NO: 2711812 - RNA, 15 nt, Haemophilus influenzae Rd
ucaccaccagauaag

SEQ ID NO: 2711813 - RNA, 19 nt, Haemophilus influenzae Rd
ucaccacuuggugcaacca

SEQ ID NO: 2711814 - RNA, 15 nt, Haemophilus influenzae Rd
ucaccagugaauuuc

SEQ ID NO: 2711815 - RNA, 12 nt, Haemophilus influenzae Rd
ucaccauaauca

SEQ ID NO: 2711816 - RNA, 15 nt, Haemophilus influenzae Rd
ucaccauaucaauuu

SEQ ID NO: 2711817 - RNA, 13 nt, Haemophilus influenzae Rd
ucaccaucacaag

SEQ ID NO: 2711818 - RNA, 18 nt, Haemophilus influenzae Rd
ucaccauuuccuuugagc

SEQ ID NO: 2711819 - RNA, 19 nt, Haemophilus influenzae Rd
ucacccaucaaaucuuuug

SEQ ID NO: 2711820 - RNA, 15 nt, Haemophilus influenzae Rd
ucacccaucuaaacu

SEQ ID NO: 2711821 - RNA, 23 nt, Haemophilus influenzae Rd
ucacccauuaaauaaaaaugaug

SEQ ID NO: 2711822 - RNA, 15 nt, Haemophilus influenzae Rd
ucaccgaaauaaccu

SEQ ID NO: 2711823 - RNA, 16 nt, Haemophilus influenzae Rd
ucaccgauaauaugca

SEQ ID NO: 2711824 - RNA, 19 nt, Haemophilus influenzae Rd
ucaccgauaauaugcauca

SEQ ID NO: 2711825 - RNA, 14 nt, Haemophilus influenzae Rd
ucaccgcaauaaua

SEQ ID NO: 2711826 - RNA, 17 nt, Haemophilus influenzae Rd
ucaccgcaauaauaccu

SEQ ID NO: 2711827 - RNA, 17 nt, Haemophilus influenzae Rd
ucaccgcacuuucuucu

SEQ ID NO: 2711828 - RNA, 18 nt, Haemophilus influenzae Rd
ucaccgcacuuuuuacuu

SEQ ID NO: 2711829 - RNA, 22 nt, Haemophilus influenzae Rd
ucaccgcagaaguaaaauagcu

SEQ ID NO: 2711830 - RNA, 18 nt, Haemophilus influenzae Rd
ucaccgccaagcgcugca

SEQ ID NO: 2711831 - RNA, 14 nt, Haemophilus influenzae Rd
ucaccgcuuuucuc

SEQ ID NO: 2711832 - RNA, 18 nt, Haemophilus influenzae Rd
ucaccgggcgauaaaauc

SEQ ID NO: 2711833 - RNA, 17 nt, Haemophilus influenzae Rd
ucaccgugcaaaccaac

SEQ ID NO: 2711834 - RNA, 14 nt, Haemophilus influenzae Rd
ucaccguuuuuccu

SEQ ID NO: 2711835 - RNA, 16 nt, Haemophilus influenzae Rd
ucaccucguaaaauau

SEQ ID NO: 2711836 - RNA, 20 nt, Haemophilus influenzae Rd
ucaccucgugcuguuuucaa

SEQ ID NO: 2711837 - RNA, 23 nt, Haemophilus influenzae Rd
ucaccugaagaauacaagcgauu

SEQ ID NO: 2711838 - RNA, 15 nt, Haemophilus influenzae Rd
ucaccuucaacauaa

SEQ ID NO: 2711839 - RNA, 13 nt, Haemophilus influenzae Rd
ucaccuucaagua

SEQ ID NO: 2711840 - RNA, 16 nt, Haemophilus influenzae Rd
ucacgacccaccacuu

SEQ ID NO: 2711841 - RNA, 16 nt, Haemophilus influenzae Rd
ucacgaccuuuuucag

SEQ ID NO: 2711842 - RNA, 18 nt, Haemophilus influenzae Rd
ucacgacgccaauuaaua

SEQ ID NO: 2711843 - RNA, 19 nt, Haemophilus influenzae Rd
ucacgauaaggcuuauuuu

SEQ ID NO: 2711844 - RNA, 19 nt, Haemophilus influenzae Rd
ucacgauuuuuuuauaaaa

SEQ ID NO: 2711845 - RNA, 22 nt, Haemophilus influenzae Rd
ucacgcaaaggaacaauuucua

SEQ ID NO: 2711846 - RNA, 23 nt, Haemophilus influenzae Rd
ucacgcacaccaccugaugcuuu

SEQ ID NO: 2711847 - RNA, 15 nt, Haemophilus influenzae Rd
ucacgcagaauaaac

SEQ ID NO: 2711848 - RNA, 15 nt, Haemophilus influenzae Rd
ucacgccuuugucuu

SEQ ID NO: 2711849 - RNA, 16 nt, Haemophilus influenzae Rd
ucacgccuuugucuua

SEQ ID NO: 2711850 - RNA, 21 nt, Haemophilus influenzae Rd
ucacgcgugguauucuuucca

SEQ ID NO: 2711851 - RNA, 15 nt, Haemophilus influenzae Rd
ucacgcucguuaaau

SEQ ID NO: 2711852 - RNA, 19 nt, Haemophilus influenzae Rd
ucacgcucuuuuaucucgg

SEQ ID NO: 2711853 - RNA, 13 nt, Haemophilus influenzae Rd
ucacguaaaauca

SEQ ID NO: 2711854 - RNA, 20 nt, Haemophilus influenzae Rd
ucacguaaguaagucaagcu

SEQ ID NO: 2711855 - RNA, 17 nt, Haemophilus influenzae Rd
ucacguaauacaaaaua

SEQ ID NO: 2711856 - RNA, 15 nt, Haemophilus influenzae Rd
ucacguaauacacgg

SEQ ID NO: 2711857 - RNA, 18 nt, Haemophilus influenzae Rd
ucacguaguuaaaccaaa

SEQ ID NO: 2711858 - RNA, 16 nt, Haemophilus influenzae Rd
ucacguguuuuuucac

SEQ ID NO: 2711859 - RNA, 15 nt, Haemophilus influenzae Rd
ucacguuuauccugu

SEQ ID NO: 2711860 - RNA, 19 nt, Haemophilus influenzae Rd
ucacuaaauaaauggucaa

SEQ ID NO: 2711861 - RNA, 12 nt, Haemophilus influenzae Rd
ucacuaaauuuc

SEQ ID NO: 2711862 - RNA, 16 nt, Haemophilus influenzae Rd
ucacuaaauuucagcu

SEQ ID NO: 2711863 - RNA, 21 nt, Haemophilus influenzae Rd
ucacuaauacgcggucagaaa

SEQ ID NO: 2711864 - RNA, 17 nt, Haemophilus influenzae Rd
ucacuacacccucaguu

SEQ ID NO: 2711865 - RNA, 20 nt, Haemophilus influenzae Rd
ucacuacacccucaguuacc

SEQ ID NO: 2711866 - RNA, 20 nt, Haemophilus influenzae Rd
ucacuacagguugcucgccu

SEQ ID NO: 2711867 - RNA, 17 nt, Haemophilus influenzae Rd
ucacuacguguuaauaa

SEQ ID NO: 2711868 - RNA, 18 nt, Haemophilus influenzae Rd
ucacuacguguuaauaac

SEQ ID NO: 2711869 - RNA, 15 nt, Haemophilus influenzae Rd
ucacuagauuuucuu

SEQ ID NO: 2711870 - RNA, 17 nt, Haemophilus influenzae Rd
ucacuagccauaaauaa

SEQ ID NO: 2711871 - RNA, 19 nt, Haemophilus influenzae Rd
ucacuagccauaaauaaau

SEQ ID NO: 2711872 - RNA, 23 nt, Haemophilus influenzae Rd
ucacuagccauaaauaaaucaau

SEQ ID NO: 2711873 - RNA, 15 nt, Haemophilus influenzae Rd
ucacuauaacuuuuc

SEQ ID NO: 2711874 - RNA, 17 nt, Haemophilus influenzae Rd
ucacuauaacuuuucaa

SEQ ID NO: 2711875 - RNA, 20 nt, Haemophilus influenzae Rd
ucacuauuaccgcguaaaaa

SEQ ID NO: 2711876 - RNA, 17 nt, Haemophilus influenzae Rd
ucacuauuucaucuuua

SEQ ID NO: 2711877 - RNA, 20 nt, Haemophilus influenzae Rd
ucacucaauuuacacauugc

SEQ ID NO: 2711878 - RNA, 14 nt, Haemophilus influenzae Rd
ucacucguggaauu

SEQ ID NO: 2711879 - RNA, 14 nt, Haemophilus influenzae Rd
ucacucuuauucau

SEQ ID NO: 2711880 - RNA, 18 nt, Haemophilus influenzae Rd
ucacugaauaaugugcaa

SEQ ID NO: 2711881 - RNA, 23 nt, Haemophilus influenzae Rd
ucacugaauuucauucaaaaaua

SEQ ID NO: 2711882 - RNA, 13 nt, Haemophilus influenzae Rd
ucacugauuucac

SEQ ID NO: 2711883 - RNA, 15 nt, Haemophilus influenzae Rd
ucacugcauuuucuu

SEQ ID NO: 2711884 - RNA, 21 nt, Haemophilus influenzae Rd
ucacugcauuuucuuuuucaa

SEQ ID NO: 2711885 - RNA, 16 nt, Haemophilus influenzae Rd
ucacuguaaauaauag

SEQ ID NO: 2711886 - RNA, 21 nt, Haemophilus influenzae Rd
ucacuguaucuuuuuguaauu

SEQ ID NO: 2711887 - RNA, 16 nt, Haemophilus influenzae Rd
ucacuguauuggaaaa

SEQ ID NO: 2711888 - RNA, 12 nt, Haemophilus influenzae Rd
ucaguuugcuuu

SEQ ID NO: 2711889 - RNA, 15 nt, Haemophilus influenzae Rd
ucaguuuuuacgccu

SEQ ID NO: 2711890 - RNA, 13 nt, Haemophilus influenzae Rd
ucauaaaaaacau

SEQ ID NO: 2711891 - RNA, 14 nt, Haemophilus influenzae Rd
ucauaaaaaaugcu

SEQ ID NO: 2711892 - RNA, 11 nt, Haemophilus influenzae Rd
ucauaaaaauu

SEQ ID NO: 2711893 - RNA, 22 nt, Haemophilus influenzae Rd
ucauaaaaggcaaagcaaaauc

SEQ ID NO: 2711894 - RNA, 18 nt, Haemophilus influenzae Rd
ucauaaacgguauuuucu

SEQ ID NO: 2711895 - RNA, 14 nt, Haemophilus influenzae Rd
ucauaaacuucuau

SEQ ID NO: 2711896 - RNA, 23 nt, Haemophilus influenzae Rd
ucauaaauaggaaaggcauuuuu

SEQ ID NO: 2711897 - RNA, 11 nt, Haemophilus influenzae Rd
ucauaaauauc

SEQ ID NO: 2711898 - RNA, 15 nt, Haemophilus influenzae Rd
ucauaaauccaaucc

SEQ ID NO: 2711899 - RNA, 18 nt, Haemophilus influenzae Rd
ucauaaaucgguucuaca

SEQ ID NO: 2711900 - RNA, 12 nt, Haemophilus influenzae Rd
ucauaaauuccu

SEQ ID NO: 2711901 - RNA, 19 nt, Haemophilus influenzae Rd
ucauaaauuccuuuuuaau

SEQ ID NO: 2711902 - RNA, 17 nt, Haemophilus influenzae Rd
ucauaacgggcauuuuu

SEQ ID NO: 2711903 - RNA, 13 nt, Haemophilus influenzae Rd
ucauaacuauaau

SEQ ID NO: 2711904 - RNA, 17 nt, Haemophilus influenzae Rd
ucauaagguacaacaga

SEQ ID NO: 2711905 - RNA, 16 nt, Haemophilus influenzae Rd
ucauaaggugcauuag

SEQ ID NO: 2711906 - RNA, 16 nt, Haemophilus influenzae Rd
ucauaaguaaaaccau

SEQ ID NO: 2711907 - RNA, 10 nt, Haemophilus influenzae Rd
ucauaagucc

SEQ ID NO: 2711908 - RNA, 13 nt, Haemophilus influenzae Rd
ucauaauccacua

SEQ ID NO: 2711909 - RNA, 18 nt, Haemophilus influenzae Rd
ucauaauccacuaaaaac

SEQ ID NO: 2711910 - RNA, 13 nt, Haemophilus influenzae Rd
ucauaaucgccaa

SEQ ID NO: 2711911 - RNA, 13 nt, Haemophilus influenzae Rd
ucauaaucugaaa

SEQ ID NO: 2711912 - RNA, 16 nt, Haemophilus influenzae Rd
ucauaaucugaaagug

SEQ ID NO: 2711913 - RNA, 17 nt, Haemophilus influenzae Rd
ucauaauuuauucaaaa

SEQ ID NO: 2711914 - RNA, 18 nt, Haemophilus influenzae Rd
ucauaauuuauucaaaau

SEQ ID NO: 2711915 - RNA, 19 nt, Haemophilus influenzae Rd
ucauaauuuauucaaaaua

SEQ ID NO: 2711916 - RNA, 17 nt, Haemophilus influenzae Rd
ucauacguucaacaauc

SEQ ID NO: 2711917 - RNA, 15 nt, Haemophilus influenzae Rd
ucauacuaaaaaauu

SEQ ID NO: 2711918 - RNA, 22 nt, Haemophilus influenzae Rd
ucauagaaaccaauaauuucau

SEQ ID NO: 2711919 - RNA, 12 nt, Haemophilus influenzae Rd
ucauagaaaucc

SEQ ID NO: 2711920 - RNA, 14 nt, Haemophilus influenzae Rd
ucauagaaaucccu

SEQ ID NO: 2711921 - RNA, 23 nt, Haemophilus influenzae Rd
ucauagaaggcuaguucuuccuu

SEQ ID NO: 2711922 - RNA, 15 nt, Haemophilus influenzae Rd
ucauagauaaaauua

SEQ ID NO: 2711923 - RNA, 10 nt, Haemophilus influenzae Rd
ucauagcuga

SEQ ID NO: 2711924 - RNA, 21 nt, Haemophilus influenzae Rd
ucauagcugacguguaaaucu

SEQ ID NO: 2711925 - RNA, 22 nt, Haemophilus influenzae Rd
ucauagcugacguguaaaucua

SEQ ID NO: 2711926 - RNA, 23 nt, Haemophilus influenzae Rd
ucauagcugacguguaaaucuaa

SEQ ID NO: 2711927 - RNA, 22 nt, Haemophilus influenzae Rd
ucauaguccacuguauauuguu

SEQ ID NO: 2711928 - RNA, 19 nt, Haemophilus influenzae Rd
ucauaguuuucugauuuaa

SEQ ID NO: 2711929 - RNA, 14 nt, Haemophilus influenzae Rd
ucauauaaagugga

SEQ ID NO: 2711930 - RNA, 13 nt, Haemophilus influenzae Rd
ucauauaaauaag

SEQ ID NO: 2711931 - RNA, 22 nt, Haemophilus influenzae Rd
ucauauagggcucaaauuuucu

SEQ ID NO: 2711932 - RNA, 17 nt, Haemophilus influenzae Rd
ucauauauaaauuuaga

SEQ ID NO: 2711933 - RNA, 22 nt, Haemophilus influenzae Rd
ucauauauucaacuaaaggcac

SEQ ID NO: 2711934 - RNA, 21 nt, Haemophilus influenzae Rd
ucauauccaccacaauuaaug

SEQ ID NO: 2711935 - RNA, 22 nt, Haemophilus influenzae Rd
ucauaucgagcagacaaaauug

SEQ ID NO: 2711936 - RNA, 22 nt, Haemophilus influenzae Rd
ucauaucuauugagauuuaauu

SEQ ID NO: 2711937 - RNA, 19 nt, Haemophilus influenzae Rd
ucauaucugucauauaacc

SEQ ID NO: 2711938 - RNA, 18 nt, Haemophilus influenzae Rd
ucauaucuuuaccuguuu

SEQ ID NO: 2711939 - RNA, 16 nt, Haemophilus influenzae Rd
ucauauucccaaggcu

SEQ ID NO: 2711940 - RNA, 21 nt, Haemophilus influenzae Rd
ucauauugauuuacauuaauu

SEQ ID NO: 2711941 - RNA, 22 nt, Haemophilus influenzae Rd
ucauauugauuuacauuaauuu

SEQ ID NO: 2711942 - RNA, 13 nt, Haemophilus influenzae Rd
ucauauuguuuca

SEQ ID NO: 2711943 - RNA, 14 nt, Haemophilus influenzae Rd
ucauauuucugcaa

SEQ ID NO: 2711944 - RNA, 15 nt, Haemophilus influenzae Rd
ucauauuucugcaaa

SEQ ID NO: 2711945 - RNA, 14 nt, Haemophilus influenzae Rd
ucauauuugaaguu

SEQ ID NO: 2711946 - RNA, 12 nt, Haemophilus influenzae Rd
ucauauuuuaaa

SEQ ID NO: 2711947 - RNA, 18 nt, Haemophilus influenzae Rd
ucauauuuuaaauaauua

SEQ ID NO: 2711948 - RNA, 13 nt, Haemophilus influenzae Rd
ucaucaaaaccau

SEQ ID NO: 2711949 - RNA, 11 nt, Haemophilus influenzae Rd
ucaucaaaaug

SEQ ID NO: 2711950 - RNA, 20 nt, Haemophilus influenzae Rd
ucaucaaacacccaaucugg

SEQ ID NO: 2711951 - RNA, 16 nt, Haemophilus influenzae Rd
ucaucaaagcucaccu

SEQ ID NO: 2711952 - RNA, 21 nt, Haemophilus influenzae Rd
ucaucaaaguaacguugcucu

SEQ ID NO: 2711953 - RNA, 17 nt, Haemophilus influenzae Rd
ucaucaagauuuauucc

SEQ ID NO: 2711954 - RNA, 22 nt, Haemophilus influenzae Rd
ucaucaagcaaacuuagauaac

SEQ ID NO: 2711955 - RNA, 23 nt, Haemophilus influenzae Rd
ucaucaaugcaacaucuucuacg

SEQ ID NO: 2711956 - RNA, 12 nt, Haemophilus influenzae Rd
ucaucaauggca

SEQ ID NO: 2711957 - RNA, 18 nt, Haemophilus influenzae Rd
ucaucacaucaauacuug

SEQ ID NO: 2711958 - RNA, 17 nt, Haemophilus influenzae Rd
ucaucacccaucaaauc

SEQ ID NO: 2711959 - RNA, 12 nt, Haemophilus influenzae Rd
ucaucacuucaa

SEQ ID NO: 2711960 - RNA, 19 nt, Haemophilus influenzae Rd
ucaucagaaauauaaucaa

SEQ ID NO: 2711961 - RNA, 16 nt, Haemophilus influenzae Rd
ucaucagaaauaucuu

SEQ ID NO: 2711962 - RNA, 19 nt, Haemophilus influenzae Rd
ucaucauaauuuauucaaa

SEQ ID NO: 2711963 - RNA, 15 nt, Haemophilus influenzae Rd
ucaucauacaaucca

SEQ ID NO: 2711964 - RNA, 18 nt, Haemophilus influenzae Rd
ucaucauacaauccacca

SEQ ID NO: 2711965 - RNA, 14 nt, Haemophilus influenzae Rd
ucaucaucaaauug

SEQ ID NO: 2711966 - RNA, 17 nt, Haemophilus influenzae Rd
ucaucauuaugaaaaaa

SEQ ID NO: 2711967 - RNA, 18 nt, Haemophilus influenzae Rd
ucaucauuaugaaaaaaa

SEQ ID NO: 2711968 - RNA, 15 nt, Haemophilus influenzae Rd
ucaucauuugcucua

SEQ ID NO: 2711969 - RNA, 16 nt, Haemophilus influenzae Rd
ucaucauuuuggcuuu

SEQ ID NO: 2711970 - RNA, 21 nt, Haemophilus influenzae Rd
ucaucauuuuggcuuuacgca

SEQ ID NO: 2711971 - RNA, 18 nt, Haemophilus influenzae Rd
ucauccaaucaucagaau

SEQ ID NO: 2711972 - RNA, 17 nt, Haemophilus influenzae Rd
ucauccaaugcugaagu

SEQ ID NO: 2711973 - RNA, 18 nt, Haemophilus influenzae Rd
ucauccaauguugcaaua

SEQ ID NO: 2711974 - RNA, 18 nt, Haemophilus influenzae Rd
ucauccacauaaggugga

SEQ ID NO: 2711975 - RNA, 16 nt, Haemophilus influenzae Rd
ucauccacuaaaccau

SEQ ID NO: 2711976 - RNA, 13 nt, Haemophilus influenzae Rd
ucauccacuaauu

SEQ ID NO: 2711977 - RNA, 17 nt, Haemophilus influenzae Rd
ucaucccagauuuuacu

SEQ ID NO: 2711978 - RNA, 19 nt, Haemophilus influenzae Rd
ucaucccagauuuuacuug

SEQ ID NO: 2711979 - RNA, 23 nt, Haemophilus influenzae Rd
ucaucccagauuuuacuugccgu

SEQ ID NO: 2711980 - RNA, 14 nt, Haemophilus influenzae Rd
ucaucccauuuuug

SEQ ID NO: 2711981 - RNA, 22 nt, Haemophilus influenzae Rd
ucaucgauuacgcuuacucauu

SEQ ID NO: 2711982 - RNA, 19 nt, Haemophilus influenzae Rd
ucaucgcccgcuucuuucg

SEQ ID NO: 2711983 - RNA, 18 nt, Haemophilus influenzae Rd
ucaucgccgugauaauau

SEQ ID NO: 2711984 - RNA, 20 nt, Haemophilus influenzae Rd
ucaucgccgugauaauaucg

SEQ ID NO: 2711985 - RNA, 23 nt, Haemophilus influenzae Rd
ucaucgcguuuauuuuuauaaau

SEQ ID NO: 2711986 - RNA, 18 nt, Haemophilus influenzae Rd
ucaucgcguuuuuucuua

SEQ ID NO: 2711987 - RNA, 18 nt, Haemophilus influenzae Rd
ucaucgcuucuaaaucua

SEQ ID NO: 2711988 - RNA, 23 nt, Haemophilus influenzae Rd
ucaucggcuacagguucuacgua

SEQ ID NO: 2711989 - RNA, 13 nt, Haemophilus influenzae Rd
ucaucuaacaaua

SEQ ID NO: 2711990 - RNA, 18 nt, Haemophilus influenzae Rd
ucaucuaacacaauaacc

SEQ ID NO: 2711991 - RNA, 21 nt, Haemophilus influenzae Rd
ucaucuaagguuuuauuuuca

SEQ ID NO: 2711992 - RNA, 13 nt, Haemophilus influenzae Rd
ucaucuaauaaua

SEQ ID NO: 2711993 - RNA, 14 nt, Haemophilus influenzae Rd
ucaucuaauaauaa

SEQ ID NO: 2711994 - RNA, 15 nt, Haemophilus influenzae Rd
ucauuuuuuuaaaua

SEQ ID NO: 2711995 - RNA, 13 nt, Haemophilus influenzae Rd
uccaaaaaccaac

SEQ ID NO: 2711996 - RNA, 12 nt, Haemophilus influenzae Rd
uccaaaaucucu

SEQ ID NO: 2711997 - RNA, 18 nt, Haemophilus influenzae Rd
uccaaaauuaaauugaaa

SEQ ID NO: 2711998 - RNA, 21 nt, Haemophilus influenzae Rd
uccaaaauuaaauugaaaaaa

SEQ ID NO: 2711999 - RNA, 15 nt, Haemophilus influenzae Rd
uccaaaauuuaaagu

SEQ ID NO: 2712000 - RNA, 14 nt, Haemophilus influenzae Rd
uccaaaauuucuga

SEQ ID NO: 2712001 - RNA, 19 nt, Haemophilus influenzae Rd
uccaaaccgucagugcuuu

SEQ ID NO: 2712002 - RNA, 23 nt, Haemophilus influenzae Rd
uccaaacgccacgcucgaggguu

SEQ ID NO: 2712003 - RNA, 14 nt, Haemophilus influenzae Rd
uccaaagaaaucac

SEQ ID NO: 2712004 - RNA, 13 nt, Haemophilus influenzae Rd
uccaaagaauaau

SEQ ID NO: 2712005 - RNA, 15 nt, Haemophilus influenzae Rd
uccaaagaauaauaa

SEQ ID NO: 2712006 - RNA, 16 nt, Haemophilus influenzae Rd
uccaaagaaucaucuu

SEQ ID NO: 2712007 - RNA, 18 nt, Haemophilus influenzae Rd
uccaaagaaucaucuuca

SEQ ID NO: 2712008 - RNA, 19 nt, Haemophilus influenzae Rd
uccaaagacuaaaaccaca

SEQ ID NO: 2712009 - RNA, 21 nt, Haemophilus influenzae Rd
uccaaauaauccuagaguaag

SEQ ID NO: 2712010 - RNA, 19 nt, Haemophilus influenzae Rd
uccaaauauaaaauaaaau

SEQ ID NO: 2712011 - RNA, 20 nt, Haemophilus influenzae Rd
uccaaaucauaccaauugca

SEQ ID NO: 2712012 - RNA, 17 nt, Haemophilus influenzae Rd
uccaaaugccuaacaca

SEQ ID NO: 2712013 - RNA, 15 nt, Haemophilus influenzae Rd
uccaaauucauuuuu

SEQ ID NO: 2712014 - RNA, 21 nt, Haemophilus influenzae Rd
uccaaauucauuuuuuauuuu

SEQ ID NO: 2712015 - RNA, 19 nt, Haemophilus influenzae Rd
uccaaauuccgcaauauuu

SEQ ID NO: 2712016 - RNA, 16 nt, Haemophilus influenzae Rd
uccaaauugagaucuu

SEQ ID NO: 2712017 - RNA, 13 nt, Haemophilus influenzae Rd
uccaacagcuugc

SEQ ID NO: 2712018 - RNA, 11 nt, Haemophilus influenzae Rd
uccaacauuaa

SEQ ID NO: 2712019 - RNA, 16 nt, Haemophilus influenzae Rd
uccaacauuaauaacg

SEQ ID NO: 2712020 - RNA, 19 nt, Haemophilus influenzae Rd
uccaaccccauuugccaaa

SEQ ID NO: 2712021 - RNA, 17 nt, Haemophilus influenzae Rd
uccaaccgauaaggaaa

SEQ ID NO: 2712022 - RNA, 14 nt, Haemophilus influenzae Rd
uccaaccuaauaac

SEQ ID NO: 2712023 - RNA, 17 nt, Haemophilus influenzae Rd
uccaaccuaauaacggc

SEQ ID NO: 2712024 - RNA, 15 nt, Haemophilus influenzae Rd
uccaacgauuuugca

SEQ ID NO: 2712025 - RNA, 16 nt, Haemophilus influenzae Rd
uccaacgcacguaaca

SEQ ID NO: 2712026 - RNA, 22 nt, Haemophilus influenzae Rd
uccaacgcacguaacaaaugca

SEQ ID NO: 2712027 - RNA, 19 nt, Haemophilus influenzae Rd
uccaacguuuuaauccuuc

SEQ ID NO: 2712028 - RNA, 17 nt, Haemophilus influenzae Rd
uccaacuaugaagacua

SEQ ID NO: 2712029 - RNA, 13 nt, Haemophilus influenzae Rd
uccaagaaguuuu

SEQ ID NO: 2712030 - RNA, 21 nt, Haemophilus influenzae Rd
uccaagaggcucugaucacaa

SEQ ID NO: 2712031 - RNA, 15 nt, Haemophilus influenzae Rd
uccaagcaaagaaau

SEQ ID NO: 2712032 - RNA, 20 nt, Haemophilus influenzae Rd
uccaagccauguugauguaa

SEQ ID NO: 2712033 - RNA, 17 nt, Haemophilus influenzae Rd
uccaagcguaaaaguau

SEQ ID NO: 2712034 - RNA, 14 nt, Haemophilus influenzae Rd
uccaagguuuuaau

SEQ ID NO: 2712035 - RNA, 21 nt, Haemophilus influenzae Rd
uccaaguauuuuguggaauau

SEQ ID NO: 2712036 - RNA, 14 nt, Haemophilus influenzae Rd
uccaauaaccaauc

SEQ ID NO: 2712037 - RNA, 13 nt, Haemophilus influenzae Rd
uccaauaauuaaa

SEQ ID NO: 2712038 - RNA, 17 nt, Haemophilus influenzae Rd
uccaauacuguuuggca

SEQ ID NO: 2712039 - RNA, 18 nt, Haemophilus influenzae Rd
uccaauacuguuuggcaa

SEQ ID NO: 2712040 - RNA, 15 nt, Haemophilus influenzae Rd
uccaauaggaaacua

SEQ ID NO: 2712041 - RNA, 20 nt, Haemophilus influenzae Rd
uccaaucaucagaauaauua

SEQ ID NO: 2712042 - RNA, 18 nt, Haemophilus influenzae Rd
uccaaucaucaucccaau

SEQ ID NO: 2712043 - RNA, 22 nt, Haemophilus influenzae Rd
uccaaucaucaucccaaucuuc

SEQ ID NO: 2712044 - RNA, 14 nt, Haemophilus influenzae Rd
uccaaucuaauucu

SEQ ID NO: 2712045 - RNA, 16 nt, Haemophilus influenzae Rd
uccaaugauccccauu

SEQ ID NO: 2712046 - RNA, 14 nt, Haemophilus influenzae Rd
uccaaugcacuugu

SEQ ID NO: 2712047 - RNA, 17 nt, Haemophilus influenzae Rd
uccaaugccuugugcau

SEQ ID NO: 2712048 - RNA, 22 nt, Haemophilus influenzae Rd
uccaaugcugaagucguuucau

SEQ ID NO: 2712049 - RNA, 21 nt, Haemophilus influenzae Rd
uccaaugugaccaaauaaucg

SEQ ID NO: 2712050 - RNA, 13 nt, Haemophilus influenzae Rd
uccaauuacuaau

SEQ ID NO: 2712051 - RNA, 16 nt, Haemophilus influenzae Rd
uccaauuacuaaugcc

SEQ ID NO: 2712052 - RNA, 18 nt, Haemophilus influenzae Rd
uccaauucuuuuaaaugu

SEQ ID NO: 2712053 - RNA, 17 nt, Haemophilus influenzae Rd
uccaauuucaucccaau

SEQ ID NO: 2712054 - RNA, 21 nt, Haemophilus influenzae Rd
uccacaaaaucugauacgaau

SEQ ID NO: 2712055 - RNA, 13 nt, Haemophilus influenzae Rd
uccacaaucaauc

SEQ ID NO: 2712056 - RNA, 13 nt, Haemophilus influenzae Rd
uccacauuuugau

SEQ ID NO: 2712057 - RNA, 23 nt, Haemophilus influenzae Rd
uccaccacagcccaaaauucagc

SEQ ID NO: 2712058 - RNA, 19 nt, Haemophilus influenzae Rd
uccaccacccuucuuucaa

SEQ ID NO: 2712059 - RNA, 15 nt, Haemophilus influenzae Rd
uccaccaugaauauu

SEQ ID NO: 2712060 - RNA, 21 nt, Haemophilus influenzae Rd
uccacccacauacuuauucaa

SEQ ID NO: 2712061 - RNA, 22 nt, Haemophilus influenzae Rd
uccacccgguacgcaaccuuga

SEQ ID NO: 2712062 - RNA, 15 nt, Haemophilus influenzae Rd
uccaccuugaauaau

SEQ ID NO: 2712063 - RNA, 21 nt, Haemophilus influenzae Rd
uccaccuugaauugcauuuuc

SEQ ID NO: 2712064 - RNA, 20 nt, Haemophilus influenzae Rd
uccacgccuguggcaaaauc

SEQ ID NO: 2712065 - RNA, 19 nt, Haemophilus influenzae Rd
uccacgcuaaaaucuugca

SEQ ID NO: 2712066 - RNA, 19 nt, Haemophilus influenzae Rd
uccacgguauuuucuuauu

SEQ ID NO: 2712067 - RNA, 15 nt, Haemophilus influenzae Rd
uccacuaaaaaacua

SEQ ID NO: 2712068 - RNA, 15 nt, Haemophilus influenzae Rd
uccacuaaaaacgca

SEQ ID NO: 2712069 - RNA, 15 nt, Haemophilus influenzae Rd
uccacuaaaccauuu

SEQ ID NO: 2712070 - RNA, 19 nt, Haemophilus influenzae Rd
uccacuacugcaucugcau

SEQ ID NO: 2712071 - RNA, 13 nt, Haemophilus influenzae Rd
uccacuaguucau

SEQ ID NO: 2712072 - RNA, 16 nt, Haemophilus influenzae Rd
uccacuauaaaauacu

SEQ ID NO: 2712073 - RNA, 13 nt, Haemophilus influenzae Rd
uccacuucuuaug

SEQ ID NO: 2712074 - RNA, 23 nt, Haemophilus influenzae Rd
uccacuuuugguggauuauaaac

SEQ ID NO: 2712075 - RNA, 13 nt, Haemophilus influenzae Rd
uccacuuuuucau

SEQ ID NO: 2712076 - RNA, 19 nt, Haemophilus influenzae Rd
uccacuuuuucauguacaa

SEQ ID NO: 2712077 - RNA, 14 nt, Haemophilus influenzae Rd
uccacuuuuuucac

SEQ ID NO: 2712078 - RNA, 17 nt, Haemophilus influenzae Rd
uccacuuuuuucacgau

SEQ ID NO: 2712079 - RNA, 20 nt, Haemophilus influenzae Rd
uccagaaaauugcaccuucu

SEQ ID NO: 2712080 - RNA, 15 nt, Haemophilus influenzae Rd
uccagauuaaaaauu

SEQ ID NO: 2712081 - RNA, 19 nt, Haemophilus influenzae Rd
uccagauugguauuccgcu

SEQ ID NO: 2712082 - RNA, 22 nt, Haemophilus influenzae Rd
uccagcaaaaaaauuucuuuuu

SEQ ID NO: 2712083 - RNA, 19 nt, Haemophilus influenzae Rd
uccagcguuaaguaauuuu

SEQ ID NO: 2712084 - RNA, 13 nt, Haemophilus influenzae Rd
uccagguuguuuu

SEQ ID NO: 2712085 - RNA, 17 nt, Haemophilus influenzae Rd
uccaguauuaaucugau

SEQ ID NO: 2712086 - RNA, 17 nt, Haemophilus influenzae Rd
uccagugguaaaccuaa

SEQ ID NO: 2712087 - RNA, 18 nt, Haemophilus influenzae Rd
uccaguucuccuucucca

SEQ ID NO: 2712088 - RNA, 20 nt, Haemophilus influenzae Rd
uccauaaaagaccucucuag

SEQ ID NO: 2712089 - RNA, 16 nt, Haemophilus influenzae Rd
uccauaaggaaauugc

SEQ ID NO: 2712090 - RNA, 22 nt, Haemophilus influenzae Rd
uccauaauguucccuauaaaua

SEQ ID NO: 2712091 - RNA, 15 nt, Haemophilus influenzae Rd
uccauacaguaaaaa

SEQ ID NO: 2712092 - RNA, 17 nt, Haemophilus influenzae Rd
uccauaccaaaaugucg

SEQ ID NO: 2712093 - RNA, 20 nt, Haemophilus influenzae Rd
uccauaccguuacgaacuuc

SEQ ID NO: 2712094 - RNA, 16 nt, Haemophilus influenzae Rd
uccauaguucacuaaa

SEQ ID NO: 2712095 - RNA, 18 nt, Haemophilus influenzae Rd
uccauaguucacuaaaaa

SEQ ID NO: 2712096 - RNA, 19 nt, Haemophilus influenzae Rd
uccauaguucacuaaaaau

SEQ ID NO: 2712097 - RNA, 23 nt, Haemophilus influenzae Rd
uccauaguuuggcugaaauucua

SEQ ID NO: 2712098 - RNA, 18 nt, Haemophilus influenzae Rd
uccauaucacauuuuauu

SEQ ID NO: 2712099 - RNA, 15 nt, Haemophilus influenzae Rd
uccauaugaccauua

SEQ ID NO: 2712100 - RNA, 16 nt, Haemophilus influenzae Rd
ucgagggucaaaagaa

SEQ ID NO: 2712101 - RNA, 16 nt, Haemophilus influenzae Rd
ucgaggguucgaaucc

SEQ ID NO: 2712102 - RNA, 14 nt, Haemophilus influenzae Rd
ucgagguuuuccac

SEQ ID NO: 2712103 - RNA, 19 nt, Haemophilus influenzae Rd
ucgaguaaaaauaaaaugc

SEQ ID NO: 2712104 - RNA, 15 nt, Haemophilus influenzae Rd
ucgaguaauuucaua

SEQ ID NO: 2712105 - RNA, 13 nt, Haemophilus influenzae Rd
ucgauaaagaauu

SEQ ID NO: 2712106 - RNA, 18 nt, Haemophilus influenzae Rd
ucgauaaauucaaucgcu

SEQ ID NO: 2712107 - RNA, 14 nt, Haemophilus influenzae Rd
ucgauaacaauuuu

SEQ ID NO: 2712108 - RNA, 22 nt, Haemophilus influenzae Rd
ucgauaggcgguaucaaugcca

SEQ ID NO: 2712109 - RNA, 22 nt, Haemophilus influenzae Rd
ucgaucagcacgauaaccauca

SEQ ID NO: 2712110 - RNA, 16 nt, Haemophilus influenzae Rd
ucgaucuaaucuuaaa

SEQ ID NO: 2712111 - RNA, 14 nt, Haemophilus influenzae Rd
ucgaucucugccau

SEQ ID NO: 2712112 - RNA, 21 nt, Haemophilus influenzae Rd
ucgauggauuuauugcguucc

SEQ ID NO: 2712113 - RNA, 18 nt, Haemophilus influenzae Rd
ucgaugugcauuuuucau

SEQ ID NO: 2712114 - RNA, 15 nt, Haemophilus influenzae Rd
ucgauucaaauaacg

SEQ ID NO: 2712115 - RNA, 19 nt, Haemophilus influenzae Rd
ucgauuucaacgaauaauu

SEQ ID NO: 2712116 - RNA, 18 nt, Haemophilus influenzae Rd
ucgauuuuucuaaaauca

SEQ ID NO: 2712117 - RNA, 19 nt, Haemophilus influenzae Rd
ucgcaaacaugcucccaaa

SEQ ID NO: 2712118 - RNA, 16 nt, Haemophilus influenzae Rd
ucgcaaauccuacaac

SEQ ID NO: 2712119 - RNA, 20 nt, Haemophilus influenzae Rd
ucgcaauauuaaacaaaguc

SEQ ID NO: 2712120 - RNA, 16 nt, Haemophilus influenzae Rd
ucgcaaucaauucuuu

SEQ ID NO: 2712121 - RNA, 16 nt, Haemophilus influenzae Rd
ucgcaaucagcauauu

SEQ ID NO: 2712122 - RNA, 12 nt, Haemophilus influenzae Rd
ucgcaauucuuu

SEQ ID NO: 2712123 - RNA, 23 nt, Haemophilus influenzae Rd
ucgcaauuuuaacgccugcugca

SEQ ID NO: 2712124 - RNA, 16 nt, Haemophilus influenzae Rd
ucgcacuuaaaaagag

SEQ ID NO: 2712125 - RNA, 16 nt, Haemophilus influenzae Rd
ucgcacuuaaaagauu

SEQ ID NO: 2712126 - RNA, 18 nt, Haemophilus influenzae Rd
ucgcacuuaaaagauuaa

SEQ ID NO: 2712127 - RNA, 19 nt, Haemophilus influenzae Rd
ucgcacuuaaaagauuaaa

SEQ ID NO: 2712128 - RNA, 20 nt, Haemophilus influenzae Rd
ucgcagccacuugugcauca

SEQ ID NO: 2712129 - RNA, 18 nt, Haemophilus influenzae Rd
ucgcaggauaagaugaua

SEQ ID NO: 2712130 - RNA, 18 nt, Haemophilus influenzae Rd
ucgcaggaucacaaucau

SEQ ID NO: 2712131 - RNA, 15 nt, Haemophilus influenzae Rd
ucgcaggcuuucacu

SEQ ID NO: 2712132 - RNA, 22 nt, Haemophilus influenzae Rd
ucgcaggcuuucacuauuucau

SEQ ID NO: 2712133 - RNA, 18 nt, Haemophilus influenzae Rd
ucgcaggugucacagcaa

SEQ ID NO: 2712134 - RNA, 21 nt, Haemophilus influenzae Rd
ucgcaguuucuuuguucacau

SEQ ID NO: 2712135 - RNA, 15 nt, Haemophilus influenzae Rd
ucgcauaauauaaau

SEQ ID NO: 2712136 - RNA, 20 nt, Haemophilus influenzae Rd
ucgcauaucgauaauuuaac

SEQ ID NO: 2712137 - RNA, 18 nt, Haemophilus influenzae Rd
ucgcaucaaaggcuaauu

SEQ ID NO: 2712138 - RNA, 22 nt, Haemophilus influenzae Rd
ucgcaucaaaggcuaauucuac

SEQ ID NO: 2712139 - RNA, 16 nt, Haemophilus influenzae Rd
ucgcaucauucaaugc

SEQ ID NO: 2712140 - RNA, 20 nt, Haemophilus influenzae Rd
ucgcauuaucaaaugccacu

SEQ ID NO: 2712141 - RNA, 22 nt, Haemophilus influenzae Rd
ucgcauuguuaucuaaauaauu

SEQ ID NO: 2712142 - RNA, 14 nt, Haemophilus influenzae Rd
ucgcauuuuuauua

SEQ ID NO: 2712143 - RNA, 11 nt, Haemophilus influenzae Rd
ucgccaaagcu

SEQ ID NO: 2712144 - RNA, 13 nt, Haemophilus influenzae Rd
ucgccaagaauaa

SEQ ID NO: 2712145 - RNA, 17 nt, Haemophilus influenzae Rd
ucgccaauucuucagau

SEQ ID NO: 2712146 - RNA, 20 nt, Haemophilus influenzae Rd
ucgccacuggugcugaaaau

SEQ ID NO: 2712147 - RNA, 13 nt, Haemophilus influenzae Rd
ucgccagcaccac

SEQ ID NO: 2712148 - RNA, 14 nt, Haemophilus influenzae Rd
ucgccagcaccacg

SEQ ID NO: 2712149 - RNA, 20 nt, Haemophilus influenzae Rd
ucgccagcagugccaaccac

SEQ ID NO: 2712150 - RNA, 13 nt, Haemophilus influenzae Rd
ucgccaucaucag

SEQ ID NO: 2712151 - RNA, 16 nt, Haemophilus influenzae Rd
ucgccaucuucuucug

SEQ ID NO: 2712152 - RNA, 13 nt, Haemophilus influenzae Rd
ucgccauuuucuu

SEQ ID NO: 2712153 - RNA, 21 nt, Haemophilus influenzae Rd
ucgccauuuucuuguucucca

SEQ ID NO: 2712154 - RNA, 17 nt, Haemophilus influenzae Rd
ucgccauuuuuaaaaau

SEQ ID NO: 2712155 - RNA, 18 nt, Haemophilus influenzae Rd
ucgccauuuuuaaaaaua

SEQ ID NO: 2712156 - RNA, 14 nt, Haemophilus influenzae Rd
ucgcccaauuuggc

SEQ ID NO: 2712157 - RNA, 15 nt, Haemophilus influenzae Rd
ucgcccaauuuggca

SEQ ID NO: 2712158 - RNA, 21 nt, Haemophilus influenzae Rd
ucgccccaaaagcugccaucu

SEQ ID NO: 2712159 - RNA, 14 nt, Haemophilus influenzae Rd
ucgcccuauuaaaa

SEQ ID NO: 2712160 - RNA, 21 nt, Haemophilus influenzae Rd
ucgccgaguaaauucaccaau

SEQ ID NO: 2712161 - RNA, 21 nt, Haemophilus influenzae Rd
ucgccgugauaauaucgcccg

SEQ ID NO: 2712162 - RNA, 15 nt, Haemophilus influenzae Rd
ucgccuaaauacauu

SEQ ID NO: 2712163 - RNA, 18 nt, Haemophilus influenzae Rd
ucgccugaggauuuugua

SEQ ID NO: 2712164 - RNA, 14 nt, Haemophilus influenzae Rd
ucgccugccgcaua

SEQ ID NO: 2712165 - RNA, 13 nt, Haemophilus influenzae Rd
ucgccugcucuaa

SEQ ID NO: 2712166 - RNA, 16 nt, Haemophilus influenzae Rd
ucgccuguuucacgau

SEQ ID NO: 2712167 - RNA, 13 nt, Haemophilus influenzae Rd
ucgccuucacaaa

SEQ ID NO: 2712168 - RNA, 16 nt, Haemophilus influenzae Rd
ucgccuucacaaaccc

SEQ ID NO: 2712169 - RNA, 17 nt, Haemophilus influenzae Rd
ucgccuugcuuuuaaua

SEQ ID NO: 2712170 - RNA, 13 nt, Haemophilus influenzae Rd
ucgccuuuuucaa

SEQ ID NO: 2712171 - RNA, 17 nt, Haemophilus influenzae Rd
ucgcgagaauuaccaca

SEQ ID NO: 2712172 - RNA, 20 nt, Haemophilus influenzae Rd
ucgcgauacuuggcguucau

SEQ ID NO: 2712173 - RNA, 14 nt, Haemophilus influenzae Rd
ucgcggaauuucag

SEQ ID NO: 2712174 - RNA, 16 nt, Haemophilus influenzae Rd
ucgcguagugugcgag

SEQ ID NO: 2712175 - RNA, 20 nt, Haemophilus influenzae Rd
ucgcguuuauuuaacaauaa

SEQ ID NO: 2712176 - RNA, 18 nt, Haemophilus influenzae Rd
ucgcuaacugaucuaaau

SEQ ID NO: 2712177 - RNA, 15 nt, Haemophilus influenzae Rd
ucgcuaagaauaaag

SEQ ID NO: 2712178 - RNA, 20 nt, Haemophilus influenzae Rd
ucgcuaauuuuuuuucuaau

SEQ ID NO: 2712179 - RNA, 12 nt, Haemophilus influenzae Rd
ucgcuacauuuc

SEQ ID NO: 2712180 - RNA, 12 nt, Haemophilus influenzae Rd
ucgcuauuuaau

SEQ ID NO: 2712181 - RNA, 16 nt, Haemophilus influenzae Rd
ucgcucaauaauuuuc

SEQ ID NO: 2712182 - RNA, 16 nt, Haemophilus influenzae Rd
ucgcuccaaucaucau

SEQ ID NO: 2712183 - RNA, 19 nt, Haemophilus influenzae Rd
ucgcucuucagcuucuuca

SEQ ID NO: 2712184 - RNA, 19 nt, Haemophilus influenzae Rd
ucgcugcgaugugaccacg

SEQ ID NO: 2712185 - RNA, 18 nt, Haemophilus influenzae Rd
ucgcuggaacuucuaaac

SEQ ID NO: 2712186 - RNA, 14 nt, Haemophilus influenzae Rd
ucgcuggaaucaau

SEQ ID NO: 2712187 - RNA, 18 nt, Haemophilus influenzae Rd
ucgcuggcuaacaccauu

SEQ ID NO: 2712188 - RNA, 18 nt, Haemophilus influenzae Rd
ucgcugugaaagaagauu

SEQ ID NO: 2712189 - RNA, 14 nt, Haemophilus influenzae Rd
ucgcuuaagucagc

SEQ ID NO: 2712190 - RNA, 18 nt, Haemophilus influenzae Rd
ucgcuuaagucagcauaa

SEQ ID NO: 2712191 - RNA, 16 nt, Haemophilus influenzae Rd
ucgcuuacaaaauaua

SEQ ID NO: 2712192 - RNA, 20 nt, Haemophilus influenzae Rd
ucgcuuauacgaguaaaaaa

SEQ ID NO: 2712193 - RNA, 14 nt, Haemophilus influenzae Rd
ucgcuucaucaucg

SEQ ID NO: 2712194 - RNA, 17 nt, Haemophilus influenzae Rd
ucgcuucauuauauucc

SEQ ID NO: 2712195 - RNA, 16 nt, Haemophilus influenzae Rd
ucgcuucauucucuuc

SEQ ID NO: 2712196 - RNA, 18 nt, Haemophilus influenzae Rd
ucgcuucauucucuucug

SEQ ID NO: 2712197 - RNA, 12 nt, Haemophilus influenzae Rd
ucgcuucugcuu

SEQ ID NO: 2712198 - RNA, 16 nt, Haemophilus influenzae Rd
ucgcuucugcuuggua

SEQ ID NO: 2712199 - RNA, 17 nt, Haemophilus influenzae Rd
ucgcuugcauuucuuca

SEQ ID NO: 2712200 - RNA, 19 nt, Haemophilus influenzae Rd
ucgcuuuauacugcucuug

SEQ ID NO: 2712201 - RNA, 18 nt, Haemophilus influenzae Rd
ucgcuuucauuucuucug

SEQ ID NO: 2712202 - RNA, 16 nt, Haemophilus influenzae Rd
ucggaaaauaauauug

SEQ ID NO: 2712203 - RNA, 21 nt, Haemophilus influenzae Rd
ucggaauauuuuuuugcuuuu

SEQ ID NO: 2712204 - RNA, 20 nt, Haemophilus influenzae Rd
ucggaaugccgccucagcaa

SEQ ID NO: 2712205 - RNA, 20 nt, Haemophilus influenzae Rd
ucggaauguaaaaucgguuu

SEQ ID NO: 2712206 - RNA, 20 nt, Haemophilus influenzae Rd
ucuaaaguuggcacuucaau

SEQ ID NO: 2712207 - RNA, 13 nt, Haemophilus influenzae Rd
ucuaaauaaaaac

SEQ ID NO: 2712208 - RNA, 24 nt, Haemophilus influenzae Rd
ucuaaauagaccgcacuuugcacu

SEQ ID NO: 2712209 - RNA, 18 nt, Haemophilus influenzae Rd
ucuaaauagcuaacaaua

SEQ ID NO: 2712210 - RNA, 20 nt, Haemophilus influenzae Rd
ucuaaauaggaaacucuuac

SEQ ID NO: 2712211 - RNA, 12 nt, Haemophilus influenzae Rd
ucuaaauauuuu

SEQ ID NO: 2712212 - RNA, 16 nt, Haemophilus influenzae Rd
ucuaaauauuuuucaa

SEQ ID NO: 2712213 - RNA, 16 nt, Haemophilus influenzae Rd
ucuaaauggcaaaauu

SEQ ID NO: 2712214 - RNA, 12 nt, Haemophilus influenzae Rd
ucuaaauuaauu

SEQ ID NO: 2712215 - RNA, 22 nt, Haemophilus influenzae Rd
ucuaaauuaauuaggacaauau

SEQ ID NO: 2712216 - RNA, 17 nt, Haemophilus influenzae Rd
ucuaaauuaucguuuac

SEQ ID NO: 2712217 - RNA, 19 nt, Haemophilus influenzae Rd
ucuaaauuaucguuuacuu

SEQ ID NO: 2712218 - RNA, 23 nt, Haemophilus influenzae Rd
ucuaaauuauggguguuuaaauu

SEQ ID NO: 2712219 - RNA, 14 nt, Haemophilus influenzae Rd
ucuaaauucucaag

SEQ ID NO: 2712220 - RNA, 15 nt, Haemophilus influenzae Rd
ucuaaauuugcugcg

SEQ ID NO: 2712221 - RNA, 23 nt, Haemophilus influenzae Rd
ucuaaauuuuagcguuuagcuuu

SEQ ID NO: 2712222 - RNA, 18 nt, Haemophilus influenzae Rd
ucuaacaaucgacuuugu

SEQ ID NO: 2712223 - RNA, 14 nt, Haemophilus influenzae Rd
ucuaacgcauucaa

SEQ ID NO: 2712224 - RNA, 18 nt, Haemophilus influenzae Rd
ucuaacgcauucaaaucu

SEQ ID NO: 2712225 - RNA, 17 nt, Haemophilus influenzae Rd
ucuaacggaucaacaua

SEQ ID NO: 2712226 - RNA, 21 nt, Haemophilus influenzae Rd
ucuaacggaucaacauaacgu

SEQ ID NO: 2712227 - RNA, 15 nt, Haemophilus influenzae Rd
ucuaacguauuuaaa

SEQ ID NO: 2712228 - RNA, 15 nt, Haemophilus influenzae Rd
ucuaagccuaagcca

SEQ ID NO: 2712229 - RNA, 17 nt, Haemophilus influenzae Rd
ucuaagccuaagccaaa

SEQ ID NO: 2712230 - RNA, 19 nt, Haemophilus influenzae Rd
ucuaaggcgacaaaauguc

SEQ ID NO: 2712231 - RNA, 15 nt, Haemophilus influenzae Rd
ucuaagguauaaaua

SEQ ID NO: 2712232 - RNA, 16 nt, Haemophilus influenzae Rd
ucuaagguauaaauaa

SEQ ID NO: 2712233 - RNA, 20 nt, Haemophilus influenzae Rd
ucuaagguuucgauauuaau

SEQ ID NO: 2712234 - RNA, 15 nt, Haemophilus influenzae Rd
ucuaagguuuuauuu

SEQ ID NO: 2712235 - RNA, 19 nt, Haemophilus influenzae Rd
ucuaaguuuaagugguuuc

SEQ ID NO: 2712236 - RNA, 12 nt, Haemophilus influenzae Rd
ucuaauaagaag

SEQ ID NO: 2712237 - RNA, 20 nt, Haemophilus influenzae Rd
ucuaauaauccucuuuaaaa

SEQ ID NO: 2712238 - RNA, 15 nt, Haemophilus influenzae Rd
ucuaauaugauuaau

SEQ ID NO: 2712239 - RNA, 12 nt, Haemophilus influenzae Rd
ucuaaucccauu

SEQ ID NO: 2712240 - RNA, 19 nt, Haemophilus influenzae Rd
ucuaaucgggcuuuaucau

SEQ ID NO: 2712241 - RNA, 16 nt, Haemophilus influenzae Rd
ucuaaugcaauuucaa

SEQ ID NO: 2712242 - RNA, 22 nt, Haemophilus influenzae Rd
ucuaaugcaggcaacucaguuu

SEQ ID NO: 2712243 - RNA, 23 nt, Haemophilus influenzae Rd
ucuaaugcaggcaacucaguuuu

SEQ ID NO: 2712244 - RNA, 22 nt, Haemophilus influenzae Rd
ucuaaugccgcaaauacuucac

SEQ ID NO: 2712245 - RNA, 15 nt, Haemophilus influenzae Rd
ucuaaugccuuuccu

SEQ ID NO: 2712246 - RNA, 19 nt, Haemophilus influenzae Rd
ucuaaugguuguaaauuuu

SEQ ID NO: 2712247 - RNA, 18 nt, Haemophilus influenzae Rd
ucuaauuaacugaaaauu

SEQ ID NO: 2712248 - RNA, 16 nt, Haemophilus influenzae Rd
ucuaauuauuucagua

SEQ ID NO: 2712249 - RNA, 16 nt, Haemophilus influenzae Rd
ucuaauucagcaaaaa

SEQ ID NO: 2712250 - RNA, 19 nt, Haemophilus influenzae Rd
ucuaauucagcaaaaagug

SEQ ID NO: 2712251 - RNA, 14 nt, Haemophilus influenzae Rd
ucuaauucggcuuc

SEQ ID NO: 2712252 - RNA, 13 nt, Haemophilus influenzae Rd
ucuaauucugcac

SEQ ID NO: 2712253 - RNA, 11 nt, Haemophilus influenzae Rd
ucuaauucuuc

SEQ ID NO: 2712254 - RNA, 21 nt, Haemophilus influenzae Rd
ucuaauucuuccaaaaguugu

SEQ ID NO: 2712255 - RNA, 22 nt, Haemophilus influenzae Rd
ucuaauucuuccaaaaguugug

SEQ ID NO: 2712256 - RNA, 13 nt, Haemophilus influenzae Rd
ucuaauucuuccc

SEQ ID NO: 2712257 - RNA, 14 nt, Haemophilus influenzae Rd
ucuaauucuugccc

SEQ ID NO: 2712258 - RNA, 19 nt, Haemophilus influenzae Rd
ucuaauugauucaaaucua

SEQ ID NO: 2712259 - RNA, 20 nt, Haemophilus influenzae Rd
ucuaauuggacaagaaauaa

SEQ ID NO: 2712260 - RNA, 20 nt, Haemophilus influenzae Rd
ucuaauugugcuaaauaauu

SEQ ID NO: 2712261 - RNA, 19 nt, Haemophilus influenzae Rd
ucuaauuugccaaguacaa

SEQ ID NO: 2712262 - RNA, 15 nt, Haemophilus influenzae Rd
ucuaauuugccauca

SEQ ID NO: 2712263 - RNA, 17 nt, Haemophilus influenzae Rd
ucuaauuugcuuacauu

SEQ ID NO: 2712264 - RNA, 13 nt, Haemophilus influenzae Rd
ucuaauuuuaaaa

SEQ ID NO: 2712265 - RNA, 15 nt, Haemophilus influenzae Rd
ucuaauuuuaaaaca

SEQ ID NO: 2712266 - RNA, 22 nt, Haemophilus influenzae Rd
ucuaauuuuaccaagaaauaag

SEQ ID NO: 2712267 - RNA, 15 nt, Haemophilus influenzae Rd
ucuaauuuucacaua

SEQ ID NO: 2712268 - RNA, 17 nt, Haemophilus influenzae Rd
ucuaauuuucacauaau

SEQ ID NO: 2712269 - RNA, 12 nt, Haemophilus influenzae Rd
ucuaauuuuuca

SEQ ID NO: 2712270 - RNA, 15 nt, Haemophilus influenzae Rd
ucuaauuuuuuauuc

SEQ ID NO: 2712271 - RNA, 15 nt, Haemophilus influenzae Rd
ucuacaaaacauaau

SEQ ID NO: 2712272 - RNA, 13 nt, Haemophilus influenzae Rd
ucuacaacgcuua

SEQ ID NO: 2712273 - RNA, 16 nt, Haemophilus influenzae Rd
ucuacaaucaaaaaau

SEQ ID NO: 2712274 - RNA, 21 nt, Haemophilus influenzae Rd
ucuacaccucgauaaagaauu

SEQ ID NO: 2712275 - RNA, 23 nt, Haemophilus influenzae Rd
ucuacacuuguacaguaauuguu

SEQ ID NO: 2712276 - RNA, 22 nt, Haemophilus influenzae Rd
ucuacauaaugggcuuuccaau

SEQ ID NO: 2712277 - RNA, 19 nt, Haemophilus influenzae Rd
ucuaccacagucaaauugu

SEQ ID NO: 2712278 - RNA, 21 nt, Haemophilus influenzae Rd
ucuaccacaucaaauuuaucg

SEQ ID NO: 2712279 - RNA, 16 nt, Haemophilus influenzae Rd
ucuaccaucuaaaguu

SEQ ID NO: 2712280 - RNA, 15 nt, Haemophilus influenzae Rd
ucuacccaauaaaca

SEQ ID NO: 2712281 - RNA, 23 nt, Haemophilus influenzae Rd
ucuacccacacaccuuuuaagug

SEQ ID NO: 2712282 - RNA, 19 nt, Haemophilus influenzae Rd
ucuacccauucaaauggua

SEQ ID NO: 2712283 - RNA, 14 nt, Haemophilus influenzae Rd
ucuaccgcacuuuu

SEQ ID NO: 2712284 - RNA, 17 nt, Haemophilus influenzae Rd
ucuaccgcauuuuuaau

SEQ ID NO: 2712285 - RNA, 14 nt, Haemophilus influenzae Rd
ucuacuguuaauuu

SEQ ID NO: 2712286 - RNA, 13 nt, Haemophilus influenzae Rd
ucuacuuguucaa

SEQ ID NO: 2712287 - RNA, 21 nt, Haemophilus influenzae Rd
ucuacuuguucaaaaauuucg

SEQ ID NO: 2712288 - RNA, 13 nt, Haemophilus influenzae Rd
ucuacuuuauuca

SEQ ID NO: 2712289 - RNA, 14 nt, Haemophilus influenzae Rd
ucuacuuuauucaa

SEQ ID NO: 2712290 - RNA, 21 nt, Haemophilus influenzae Rd
ucuagcuuaacaacaaaguca

SEQ ID NO: 2712291 - RNA, 23 nt, Haemophilus influenzae Rd
ucuagcuuaccuuaauuaaucuu

SEQ ID NO: 2712292 - RNA, 16 nt, Haemophilus influenzae Rd
ucuaggcuuucaccaa

SEQ ID NO: 2712293 - RNA, 19 nt, Haemophilus influenzae Rd
ucuaguaaaacuaauacuu

SEQ ID NO: 2712294 - RNA, 19 nt, Haemophilus influenzae Rd
ucuaguaccugauuuguaa

SEQ ID NO: 2712295 - RNA, 13 nt, Haemophilus influenzae Rd
ucuaguucuuccc

SEQ ID NO: 2712296 - RNA, 17 nt, Haemophilus influenzae Rd
ucuauaagaaaauuauc

SEQ ID NO: 2712297 - RNA, 21 nt, Haemophilus influenzae Rd
ucuauaauccgcagaauuuag

SEQ ID NO: 2712298 - RNA, 17 nt, Haemophilus influenzae Rd
ucuauaauuuuagaacu

SEQ ID NO: 2712299 - RNA, 13 nt, Haemophilus influenzae Rd
ucuauacaaaauu

SEQ ID NO: 2712300 - RNA, 15 nt, Haemophilus influenzae Rd
ucuauacaaaauugu

SEQ ID NO: 2712301 - RNA, 18 nt, Haemophilus influenzae Rd
ucuauagaauuauuuaaa

SEQ ID NO: 2712302 - RNA, 13 nt, Haemophilus influenzae Rd
ucuauagauaaca

SEQ ID NO: 2712303 - RNA, 16 nt, Haemophilus influenzae Rd
ucuauaucuguaaugc

SEQ ID NO: 2712304 - RNA, 16 nt, Haemophilus influenzae Rd
ucuauaucuuuaaauu

SEQ ID NO: 2712305 - RNA, 19 nt, Haemophilus influenzae Rd
ucuauaucuuuaaauucua

SEQ ID NO: 2712306 - RNA, 15 nt, Haemophilus influenzae Rd
ucuauauuauuuaag

SEQ ID NO: 2712307 - RNA, 17 nt, Haemophilus influenzae Rd
ucuauauucguuaaaua

SEQ ID NO: 2712308 - RNA, 16 nt, Haemophilus influenzae Rd
ucuaucacgaaaauca

SEQ ID NO: 2712309 - RNA, 14 nt, Haemophilus influenzae Rd
ucuaucccaacaga

SEQ ID NO: 2712310 - RNA, 18 nt, Haemophilus influenzae Rd
ucuaucgcauuuuacaga

SEQ ID NO: 2712311 - RNA, 15 nt, Haemophilus influenzae Rd
ucuaucuaaaauaua

SEQ ID NO: 2712312 - RNA, 18 nt, Haemophilus influenzae Rd
ucugcauaacuuaaauuu

SEQ ID NO: 2712313 - RNA, 22 nt, Haemophilus influenzae Rd
ucugcauaauguagagcucaau

SEQ ID NO: 2712314 - RNA, 14 nt, Haemophilus influenzae Rd
ucugcaucaguauu

SEQ ID NO: 2712315 - RNA, 16 nt, Haemophilus influenzae Rd
ucugcauuuaaugguu

SEQ ID NO: 2712316 - RNA, 18 nt, Haemophilus influenzae Rd
ucugcauuugauuucaga

SEQ ID NO: 2712317 - RNA, 13 nt, Haemophilus influenzae Rd
ucugccaaugcuu

SEQ ID NO: 2712318 - RNA, 12 nt, Haemophilus influenzae Rd
ucugccucugua

SEQ ID NO: 2712319 - RNA, 16 nt, Haemophilus influenzae Rd
ucugccugauuuuuuu

SEQ ID NO: 2712320 - RNA, 13 nt, Haemophilus influenzae Rd
ucugcuaaaucug

SEQ ID NO: 2712321 - RNA, 14 nt, Haemophilus influenzae Rd
ucugcuaauguuaa

SEQ ID NO: 2712322 - RNA, 14 nt, Haemophilus influenzae Rd
ucugcuacaaguga

SEQ ID NO: 2712323 - RNA, 17 nt, Haemophilus influenzae Rd
ucugcuccacaaaaacg

SEQ ID NO: 2712324 - RNA, 12 nt, Haemophilus influenzae Rd
ucugcugaaaua

SEQ ID NO: 2712325 - RNA, 16 nt, Haemophilus influenzae Rd
ucugcugaaauacaaa

SEQ ID NO: 2712326 - RNA, 13 nt, Haemophilus influenzae Rd
ucugcugccauaa

SEQ ID NO: 2712327 - RNA, 23 nt, Haemophilus influenzae Rd
ucugcuugguaauaaucaauuaa

SEQ ID NO: 2712328 - RNA, 18 nt, Haemophilus influenzae Rd
ucugcuuuacguuuugcu

SEQ ID NO: 2712329 - RNA, 15 nt, Haemophilus influenzae Rd
ucuggaaauucguau

SEQ ID NO: 2712330 - RNA, 16 nt, Haemophilus influenzae Rd
ucuggacaagccauuu

SEQ ID NO: 2712331 - RNA, 17 nt, Haemophilus influenzae Rd
ucuggacugaaggugcg

SEQ ID NO: 2712332 - RNA, 12 nt, Haemophilus influenzae Rd
ucuggauuggau

SEQ ID NO: 2712333 - RNA, 13 nt, Haemophilus influenzae Rd
ucuggcaaucgcc

SEQ ID NO: 2712334 - RNA, 19 nt, Haemophilus influenzae Rd
ucuggcccgaauccaaugc

SEQ ID NO: 2712335 - RNA, 17 nt, Haemophilus influenzae Rd
ucuggcucgcucuucag

SEQ ID NO: 2712336 - RNA, 22 nt, Haemophilus influenzae Rd
ucuggcuguuuugccacaaagc

SEQ ID NO: 2712337 - RNA, 18 nt, Haemophilus influenzae Rd
ucugguacaaauuuagau

SEQ ID NO: 2712338 - RNA, 18 nt, Haemophilus influenzae Rd
ucugguggaauguaaaaa

SEQ ID NO: 2712339 - RNA, 18 nt, Haemophilus influenzae Rd
ucugguuuugugaguaaa

SEQ ID NO: 2712340 - RNA, 14 nt, Haemophilus influenzae Rd
ucuguaaaacauuu

SEQ ID NO: 2712341 - RNA, 17 nt, Haemophilus influenzae Rd
ucuguaaacuaaaucuu

SEQ ID NO: 2712342 - RNA, 21 nt, Haemophilus influenzae Rd
ucuguaacaaguaauuuaucg

SEQ ID NO: 2712343 - RNA, 18 nt, Haemophilus influenzae Rd
ucuguaauauaugaaaaa

SEQ ID NO: 2712344 - RNA, 23 nt, Haemophilus influenzae Rd
ucuguaauauaugaaaaauaauc

SEQ ID NO: 2712345 - RNA, 14 nt, Haemophilus influenzae Rd
ucuguaccugcauu

SEQ ID NO: 2712346 - RNA, 15 nt, Haemophilus influenzae Rd
ucuguauaccaacca

SEQ ID NO: 2712347 - RNA, 18 nt, Haemophilus influenzae Rd
ucuguauaccaaccauua

SEQ ID NO: 2712348 - RNA, 15 nt, Haemophilus influenzae Rd
ucuguaucaauuccu

SEQ ID NO: 2712349 - RNA, 16 nt, Haemophilus influenzae Rd
ucuguaucuuuagcuu

SEQ ID NO: 2712350 - RNA, 19 nt, Haemophilus influenzae Rd
ucuguaugacuauuuagaa

SEQ ID NO: 2712351 - RNA, 13 nt, Haemophilus influenzae Rd
ucuguauuuuuca

SEQ ID NO: 2712352 - RNA, 19 nt, Haemophilus influenzae Rd
ucuguauuuuucauaucuu

SEQ ID NO: 2712353 - RNA, 22 nt, Haemophilus influenzae Rd
ucugucacgagcuaaaaaaucu

SEQ ID NO: 2712354 - RNA, 14 nt, Haemophilus influenzae Rd
ucugucauauaacc

SEQ ID NO: 2712355 - RNA, 16 nt, Haemophilus influenzae Rd
ucugucgcuuuuuccu

SEQ ID NO: 2712356 - RNA, 23 nt, Haemophilus influenzae Rd
ucugugacgccauccaaaacuaa

SEQ ID NO: 2712357 - RNA, 15 nt, Haemophilus influenzae Rd
ucugugagucuugcu

SEQ ID NO: 2712358 - RNA, 16 nt, Haemophilus influenzae Rd
ucugugagucuugcuu

SEQ ID NO: 2712359 - RNA, 23 nt, Haemophilus influenzae Rd
ucugugccuuaaagcugaauaaa

SEQ ID NO: 2712360 - RNA, 18 nt, Haemophilus influenzae Rd
ucuguggcguauuuagaa

SEQ ID NO: 2712361 - RNA, 14 nt, Haemophilus influenzae Rd
ucuguguuagaaag

SEQ ID NO: 2712362 - RNA, 13 nt, Haemophilus influenzae Rd
ucuguuaaacgca

SEQ ID NO: 2712363 - RNA, 20 nt, Haemophilus influenzae Rd
ucuguugcaaauuuuucauu

SEQ ID NO: 2712364 - RNA, 22 nt, Haemophilus influenzae Rd
ucuguugcaaauuuuucauucu

SEQ ID NO: 2712365 - RNA, 13 nt, Haemophilus influenzae Rd
ucuguugccauca

SEQ ID NO: 2712366 - RNA, 13 nt, Haemophilus influenzae Rd
ucuguugcucagc

SEQ ID NO: 2712367 - RNA, 22 nt, Haemophilus influenzae Rd
ucuguuugauaaauaucuugca

SEQ ID NO: 2712368 - RNA, 14 nt, Haemophilus influenzae Rd
ucuguuuguuggcc

SEQ ID NO: 2712369 - RNA, 20 nt, Haemophilus influenzae Rd
ucuguuuuaccugaaaaacc

SEQ ID NO: 2712370 - RNA, 19 nt, Haemophilus influenzae Rd
ucuguuuuuccauucacua

SEQ ID NO: 2712371 - RNA, 15 nt, Haemophilus influenzae Rd
ucuuaaaagaaauuc

SEQ ID NO: 2712372 - RNA, 18 nt, Haemophilus influenzae Rd
ucuuaaaagaaauucgcu

SEQ ID NO: 2712373 - RNA, 22 nt, Haemophilus influenzae Rd
ucuuaaaagugcggugcaauuu

SEQ ID NO: 2712374 - RNA, 23 nt, Haemophilus influenzae Rd
ucuuaaaauacccauaaaauugu

SEQ ID NO: 2712375 - RNA, 22 nt, Haemophilus influenzae Rd
ucuuaaagaauuucuuucgcuu

SEQ ID NO: 2712376 - RNA, 13 nt, Haemophilus influenzae Rd
ucuuaaagauaaa

SEQ ID NO: 2712377 - RNA, 15 nt, Haemophilus influenzae Rd
ucuuaaagauaaaag

SEQ ID NO: 2712378 - RNA, 19 nt, Haemophilus influenzae Rd
ucuuaaauauaucaagcag

SEQ ID NO: 2712379 - RNA, 18 nt, Haemophilus influenzae Rd
ucuuaacugcaaguccgc

SEQ ID NO: 2712380 - RNA, 17 nt, Haemophilus influenzae Rd
ucuuaauccacaauucu

SEQ ID NO: 2712381 - RNA, 16 nt, Haemophilus influenzae Rd
ucuuaauguaggcucu

SEQ ID NO: 2712382 - RNA, 20 nt, Haemophilus influenzae Rd
ucuuaauuaagauaauuuuu

SEQ ID NO: 2712383 - RNA, 22 nt, Haemophilus influenzae Rd
ucuuaauuaagauaauuuuucu

SEQ ID NO: 2712384 - RNA, 15 nt, Haemophilus influenzae Rd
ucuuaauuuuuuaac

SEQ ID NO: 2712385 - RNA, 21 nt, Haemophilus influenzae Rd
ucuuacagggcuuuauuuuug

SEQ ID NO: 2712386 - RNA, 13 nt, Haemophilus influenzae Rd
ucuuaccaaaagg

SEQ ID NO: 2712387 - RNA, 18 nt, Haemophilus influenzae Rd
ucuuaccccaacaaacac

SEQ ID NO: 2712388 - RNA, 15 nt, Haemophilus influenzae Rd
ucuuacgaagaaucc

SEQ ID NO: 2712389 - RNA, 20 nt, Haemophilus influenzae Rd
ucuuacguuuaaauuuauga

SEQ ID NO: 2712390 - RNA, 21 nt, Haemophilus influenzae Rd
ucuuagacucguuuuuuauuu

SEQ ID NO: 2712391 - RNA, 16 nt, Haemophilus influenzae Rd
ucuuagauuucuaaua

SEQ ID NO: 2712392 - RNA, 16 nt, Haemophilus influenzae Rd
ucuuaguauuuuauuu

SEQ ID NO: 2712393 - RNA, 13 nt, Haemophilus influenzae Rd
ucuuauaauuaca

SEQ ID NO: 2712394 - RNA, 18 nt, Haemophilus influenzae Rd
ucuuauacaacaaaaagg

SEQ ID NO: 2712395 - RNA, 14 nt, Haemophilus influenzae Rd
ucuuauauauaaaa

SEQ ID NO: 2712396 - RNA, 17 nt, Haemophilus influenzae Rd
ucuuauauauaaaauau

SEQ ID NO: 2712397 - RNA, 19 nt, Haemophilus influenzae Rd
ucuuauauucaaauuucau

SEQ ID NO: 2712398 - RNA, 16 nt, Haemophilus influenzae Rd
ucuuauccguuacauu

SEQ ID NO: 2712399 - RNA, 13 nt, Haemophilus influenzae Rd
ucuuaugaaaaaa

SEQ ID NO: 2712400 - RNA, 20 nt, Haemophilus influenzae Rd
ucuuaugaacuuuuuuauaa

SEQ ID NO: 2712401 - RNA, 14 nt, Haemophilus influenzae Rd
ucuuauuauacauu

SEQ ID NO: 2712402 - RNA, 15 nt, Haemophilus influenzae Rd
ucuuauuauacauuu

SEQ ID NO: 2712403 - RNA, 17 nt, Haemophilus influenzae Rd
ucuuauuucaauauugu

SEQ ID NO: 2712404 - RNA, 22 nt, Haemophilus influenzae Rd
ucuucaauagaacguaauaauu

SEQ ID NO: 2712405 - RNA, 16 nt, Haemophilus influenzae Rd
ucuucaaucaucauuu

SEQ ID NO: 2712406 - RNA, 16 nt, Haemophilus influenzae Rd
ucuucacaaauaauau

SEQ ID NO: 2712407 - RNA, 22 nt, Haemophilus influenzae Rd
ucuucacugugccaacuucuac

SEQ ID NO: 2712408 - RNA, 23 nt, Haemophilus influenzae Rd
ucuucagaacugcuuucuuccaa

SEQ ID NO: 2712409 - RNA, 20 nt, Haemophilus influenzae Rd
ucuucagacuagcaucaaaa

SEQ ID NO: 2712410 - RNA, 22 nt, Haemophilus influenzae Rd
ucuucagacuagcaucaaaaua

SEQ ID NO: 2712411 - RNA, 16 nt, Haemophilus influenzae Rd
ucuucagcacuugcau

SEQ ID NO: 2712412 - RNA, 15 nt, Haemophilus influenzae Rd
ucuucagcuucuuca

SEQ ID NO: 2712413 - RNA, 17 nt, Haemophilus influenzae Rd
ucuucaggugcaacuug

SEQ ID NO: 2712414 - RNA, 15 nt, Haemophilus influenzae Rd
ucuucauagaagugc

SEQ ID NO: 2712415 - RNA, 14 nt, Haemophilus influenzae Rd
ucuucauauccacc

SEQ ID NO: 2712416 - RNA, 14 nt, Haemophilus influenzae Rd
ucuucaucaaaaug

SEQ ID NO: 2712417 - RNA, 15 nt, Haemophilus influenzae Rd
ucuucaucaauaaca

SEQ ID NO: 2712418 - RNA, 17 nt, Haemophilus influenzae Rd
ucuuuacuguucaaaua

SEQ ID NO: 2712419 - RNA, 20 nt, Haemophilus influenzae Rd
ucuuuacuguucaaauaagc

SEQ ID NO: 2712420 - RNA, 20 nt, Haemophilus influenzae Rd
ucuuuagcuaaugcaaaauu

SEQ ID NO: 2712421 - RNA, 18 nt, Haemophilus influenzae Rd
ucuuuagcuauuaaauua

SEQ ID NO: 2712422 - RNA, 14 nt, Haemophilus influenzae Rd
ucuuuagcugcaau

SEQ ID NO: 2712423 - RNA, 13 nt, Haemophilus influenzae Rd
ucuuuaggaucac

SEQ ID NO: 2712424 - RNA, 15 nt, Haemophilus influenzae Rd
ucuuuaggaucacua

SEQ ID NO: 2712425 - RNA, 16 nt, Haemophilus influenzae Rd
ucuuuaggaucacuaa

SEQ ID NO: 2712426 - RNA, 15 nt, Haemophilus influenzae Rd
ucuuuauaacauaau

SEQ ID NO: 2712427 - RNA, 24 nt, Haemophilus influenzae Rd
ucuuuaucggcaaauacguauaau

SEQ ID NO: 2712428 - RNA, 16 nt, Haemophilus influenzae Rd
ucuuuaucuauugauu

SEQ ID NO: 2712429 - RNA, 21 nt, Haemophilus influenzae Rd
ucuuuaucugauuuaaucauu

SEQ ID NO: 2712430 - RNA, 18 nt, Haemophilus influenzae Rd
ucuuuaucuucuacaaau

SEQ ID NO: 2712431 - RNA, 14 nt, Haemophilus influenzae Rd
ucuuuauuaaacaa

SEQ ID NO: 2712432 - RNA, 20 nt, Haemophilus influenzae Rd
ucuuuauuaaacaaaaacca

SEQ ID NO: 2712433 - RNA, 15 nt, Haemophilus influenzae Rd
ucuuuauuauuucug

SEQ ID NO: 2712434 - RNA, 15 nt, Haemophilus influenzae Rd
ucuuucaaaaaucaa

SEQ ID NO: 2712435 - RNA, 14 nt, Haemophilus influenzae Rd
ucuuucaauaauuu

SEQ ID NO: 2712436 - RNA, 14 nt, Haemophilus influenzae Rd
ucuuucaauuucaa

SEQ ID NO: 2712437 - RNA, 14 nt, Haemophilus influenzae Rd
ucuuucacugcauu

SEQ ID NO: 2712438 - RNA, 13 nt, Haemophilus influenzae Rd
ucuuuccaaccag

SEQ ID NO: 2712439 - RNA, 14 nt, Haemophilus influenzae Rd
ucuuuccaaccagg

SEQ ID NO: 2712440 - RNA, 22 nt, Haemophilus influenzae Rd
ucuuuccacgcguuuuuacaua

SEQ ID NO: 2712441 - RNA, 13 nt, Haemophilus influenzae Rd
ucuuuccauuuga

SEQ ID NO: 2712442 - RNA, 16 nt, Haemophilus influenzae Rd
ucuuucgccaguuuag

SEQ ID NO: 2712443 - RNA, 20 nt, Haemophilus influenzae Rd
ucuuucgccaguuuagaaag

SEQ ID NO: 2712444 - RNA, 17 nt, Haemophilus influenzae Rd
ucuuucugcaauuuuac

SEQ ID NO: 2712445 - RNA, 16 nt, Haemophilus influenzae Rd
ucuuucuuaaaauacc

SEQ ID NO: 2712446 - RNA, 21 nt, Haemophilus influenzae Rd
ucuuugaaaagcugauauaaa

SEQ ID NO: 2712447 - RNA, 17 nt, Haemophilus influenzae Rd
ucuuugaauugaagcau

SEQ ID NO: 2712448 - RNA, 17 nt, Haemophilus influenzae Rd
ucuuugaauugagugaa

SEQ ID NO: 2712449 - RNA, 15 nt, Haemophilus influenzae Rd
ucuuugaguaaaaaa

SEQ ID NO: 2712450 - RNA, 20 nt, Haemophilus influenzae Rd
ucuuugaguaaaaaaucuag

SEQ ID NO: 2712451 - RNA, 21 nt, Haemophilus influenzae Rd
ucuuugauuuucuuauuaauu

SEQ ID NO: 2712452 - RNA, 13 nt, Haemophilus influenzae Rd
ucuuuggcuaugu

SEQ ID NO: 2712453 - RNA, 15 nt, Haemophilus influenzae Rd
ucuuuggcuauguca

SEQ ID NO: 2712454 - RNA, 22 nt, Haemophilus influenzae Rd
ucuuuggcuaugucaauuacug

SEQ ID NO: 2712455 - RNA, 14 nt, Haemophilus influenzae Rd
ucuuuguugaugau

SEQ ID NO: 2712456 - RNA, 21 nt, Haemophilus influenzae Rd
ucuuuguugaugauuugcaua

SEQ ID NO: 2712457 - RNA, 21 nt, Haemophilus influenzae Rd
ucuuuuaaaagaccacauucu

SEQ ID NO: 2712458 - RNA, 15 nt, Haemophilus influenzae Rd
ucuuuuaaauaacca

SEQ ID NO: 2712459 - RNA, 18 nt, Haemophilus influenzae Rd
ucuuuuaauaaaaccaua

SEQ ID NO: 2712460 - RNA, 13 nt, Haemophilus influenzae Rd
ucuuuuaauucag

SEQ ID NO: 2712461 - RNA, 14 nt, Haemophilus influenzae Rd
ucuuuuaauucucc

SEQ ID NO: 2712462 - RNA, 11 nt, Haemophilus influenzae Rd
ucuuuuaauuu

SEQ ID NO: 2712463 - RNA, 19 nt, Haemophilus influenzae Rd
ucuuuuacaccguccaagg

SEQ ID NO: 2712464 - RNA, 18 nt, Haemophilus influenzae Rd
ucuuuuagugguucagau

SEQ ID NO: 2712465 - RNA, 17 nt, Haemophilus influenzae Rd
ucuuuuaucgacaaauu

SEQ ID NO: 2712466 - RNA, 21 nt, Haemophilus influenzae Rd
ucuuuuaucgagaaaauuaaa

SEQ ID NO: 2712467 - RNA, 20 nt, Haemophilus influenzae Rd
ucuuuuaucucggcuaaaau

SEQ ID NO: 2712468 - RNA, 23 nt, Haemophilus influenzae Rd
ucuuuuaucucggcuaaaaucug

SEQ ID NO: 2712469 - RNA, 15 nt, Haemophilus influenzae Rd
ucuuuucaaacaaca

SEQ ID NO: 2712470 - RNA, 22 nt, Haemophilus influenzae Rd
ucuuuucaaacaacaagucauc

SEQ ID NO: 2712471 - RNA, 17 nt, Haemophilus influenzae Rd
ucuuuucaauuugaaaa

SEQ ID NO: 2712472 - RNA, 20 nt, Haemophilus influenzae Rd
ucuuuuccuccgaugaccuc

SEQ ID NO: 2712473 - RNA, 20 nt, Haemophilus influenzae Rd
ucuuuucuaacgcuuuuaaa

SEQ ID NO: 2712474 - RNA, 17 nt, Haemophilus influenzae Rd
ucuuuucuauaauuaaa

SEQ ID NO: 2712475 - RNA, 17 nt, Haemophilus influenzae Rd
ucuuuugcccauucuaa

SEQ ID NO: 2712476 - RNA, 20 nt, Haemophilus influenzae Rd
ucuuuuggcauuugcauauu

SEQ ID NO: 2712477 - RNA, 17 nt, Haemophilus influenzae Rd
ucuuuuuaauuuaaaua

SEQ ID NO: 2712478 - RNA, 22 nt, Haemophilus influenzae Rd
ucuuuuuauuuuacuaauuaaa

SEQ ID NO: 2712479 - RNA, 14 nt, Haemophilus influenzae Rd
ucuuuuucaagaac

SEQ ID NO: 2712480 - RNA, 14 nt, Haemophilus influenzae Rd
ucuuuuucuuggaa

SEQ ID NO: 2712481 - RNA, 15 nt, Haemophilus influenzae Rd
ucuuuuuuaagauaa

SEQ ID NO: 2712482 - RNA, 17 nt, Haemophilus influenzae Rd
ucuuuuuuaucaaaaau

SEQ ID NO: 2712483 - RNA, 15 nt, Haemophilus influenzae Rd
ucuuuuuucauugca

SEQ ID NO: 2712484 - RNA, 21 nt, Haemophilus influenzae Rd
ucuuuuuucuuccuaugaaua

SEQ ID NO: 2712485 - RNA, 21 nt, Haemophilus influenzae Rd
ucuuuuuucuugcuaaaaaga

SEQ ID NO: 2712486 - RNA, 14 nt, Haemophilus influenzae Rd
ucuuuuuuuuguuu

SEQ ID NO: 2712487 - RNA, 23 nt, Haemophilus influenzae Rd
ugaaaaaaagaaaaccaaaacau

SEQ ID NO: 2712488 - RNA, 22 nt, Haemophilus influenzae Rd
ugaaaaaagugcggaaaauuuu

SEQ ID NO: 2712489 - RNA, 12 nt, Haemophilus influenzae Rd
ugaaaaaauaac

SEQ ID NO: 2712490 - RNA, 18 nt, Haemophilus influenzae Rd
ugaaaaaauaaccacuag

SEQ ID NO: 2712491 - RNA, 20 nt, Haemophilus influenzae Rd
ugaaaaaaucuuccaauaca

SEQ ID NO: 2712492 - RNA, 14 nt, Haemophilus influenzae Rd
ugaaaaacauucaa

SEQ ID NO: 2712493 - RNA, 19 nt, Haemophilus influenzae Rd
ugaaaaagcuaaaaaaaca

SEQ ID NO: 2712494 - RNA, 18 nt, Haemophilus influenzae Rd
ugaaaaaggcggcuacuu

SEQ ID NO: 2712495 - RNA, 12 nt, Haemophilus influenzae Rd
ugaaaaauaaaa

SEQ ID NO: 2712496 - RNA, 17 nt, Haemophilus influenzae Rd
ugaaaaaugcuuguucu

SEQ ID NO: 2712497 - RNA, 16 nt, Haemophilus influenzae Rd
ugaaaacuacuuucca

SEQ ID NO: 2712498 - RNA, 13 nt, Haemophilus influenzae Rd
ugaaaacuaugcu

SEQ ID NO: 2712499 - RNA, 12 nt, Haemophilus influenzae Rd
ugaaaagaaaac

SEQ ID NO: 2712500 - RNA, 15 nt, Haemophilus influenzae Rd
ugaaaagaaaacuua

SEQ ID NO: 2712501 - RNA, 23 nt, Haemophilus influenzae Rd
ugaaaagaaaacuuauaaagaua

SEQ ID NO: 2712502 - RNA, 20 nt, Haemophilus influenzae Rd
ugaaaagaaaguauuaaaua

SEQ ID NO: 2712503 - RNA, 23 nt, Haemophilus influenzae Rd
ugaaaagaauaauauuaaagaaa

SEQ ID NO: 2712504 - RNA, 22 nt, Haemophilus influenzae Rd
ugaaaaguaaaugauaaaaauc

SEQ ID NO: 2712505 - RNA, 21 nt, Haemophilus influenzae Rd
ugaaaauacagugucaaaugc

SEQ ID NO: 2712506 - RNA, 13 nt, Haemophilus influenzae Rd
ugaaaaucaaaag

SEQ ID NO: 2712507 - RNA, 14 nt, Haemophilus influenzae Rd
ugaaaaucucuaua

SEQ ID NO: 2712508 - RNA, 16 nt, Haemophilus influenzae Rd
ugaaaaucucuauaau

SEQ ID NO: 2712509 - RNA, 13 nt, Haemophilus influenzae Rd
ugaaaauguaaau

SEQ ID NO: 2712510 - RNA, 23 nt, Haemophilus influenzae Rd
ugaaaauuaguuuuucgcugcag

SEQ ID NO: 2712511 - RNA, 22 nt, Haemophilus influenzae Rd
ugaaaauucuucuaacauuucu

SEQ ID NO: 2712512 - RNA, 17 nt, Haemophilus influenzae Rd
ugaaacaagcuguagca

SEQ ID NO: 2712513 - RNA, 16 nt, Haemophilus influenzae Rd
ugaaacaauaaaacuu

SEQ ID NO: 2712514 - RNA, 19 nt, Haemophilus influenzae Rd
ugaaacagcuaaaaaugaa

SEQ ID NO: 2712515 - RNA, 19 nt, Haemophilus influenzae Rd
ugaaacagggcauucauug

SEQ ID NO: 2712516 - RNA, 17 nt, Haemophilus influenzae Rd
ugaaaccucccaaaaac

SEQ ID NO: 2712517 - RNA, 20 nt, Haemophilus influenzae Rd
ugaaaccucccaaaaacuaa

SEQ ID NO: 2712518 - RNA, 20 nt, Haemophilus influenzae Rd
ugaaacgagauuuauuuugg

SEQ ID NO: 2712519 - RNA, 24 nt, Haemophilus influenzae Rd
ugaaacggcgaagagauucuaauu

SEQ ID NO: 2712520 - RNA, 17 nt, Haemophilus influenzae Rd
ugaaacgggcucaucac

SEQ ID NO: 2712521 - RNA, 14 nt, Haemophilus influenzae Rd
ugaaacuaaagaau

SEQ ID NO: 2712522 - RNA, 17 nt, Haemophilus influenzae Rd
ugaaacuguuuuggcau

SEQ ID NO: 2712523 - RNA, 20 nt, Haemophilus influenzae Rd
ugaauaauucaaaacgguca

SEQ ID NO: 2712524 - RNA, 19 nt, Haemophilus influenzae Rd
ugaauaauuuccaacacau

SEQ ID NO: 2712525 - RNA, 12 nt, Haemophilus influenzae Rd
ugaauaauuuuu

SEQ ID NO: 2712526 - RNA, 19 nt, Haemophilus influenzae Rd
ugaauaauuuuuauaauuu

SEQ ID NO: 2712527 - RNA, 21 nt, Haemophilus influenzae Rd
ugaauacacuuuaaauuuucc

SEQ ID NO: 2712528 - RNA, 18 nt, Haemophilus influenzae Rd
ugaauacgaucugcaucu

SEQ ID NO: 2712529 - RNA, 22 nt, Haemophilus influenzae Rd
ugaauacgcccauugaaauaac

SEQ ID NO: 2712530 - RNA, 16 nt, Haemophilus influenzae Rd
ugaauaguaaagaaua

SEQ ID NO: 2712531 - RNA, 13 nt, Haemophilus influenzae Rd
ugaauauaaaauu

SEQ ID NO: 2712532 - RNA, 18 nt, Haemophilus influenzae Rd
ugaauauaagaaaucucu

SEQ ID NO: 2712533 - RNA, 22 nt, Haemophilus influenzae Rd
ugaauauauucaugaaucguuu

SEQ ID NO: 2712534 - RNA, 14 nt, Haemophilus influenzae Rd
ugaauaucuaacau

SEQ ID NO: 2712535 - RNA, 16 nt, Haemophilus influenzae Rd
ugaauaucuaacauaa

SEQ ID NO: 2712536 - RNA, 14 nt, Haemophilus influenzae Rd
ugaauaucugucau

SEQ ID NO: 2712537 - RNA, 13 nt, Haemophilus influenzae Rd
ugaauauugguuu

SEQ ID NO: 2712538 - RNA, 19 nt, Haemophilus influenzae Rd
ugaauauugguuuuauuca

SEQ ID NO: 2712539 - RNA, 22 nt, Haemophilus influenzae Rd
ugaauauuugggaaauggcuuu

SEQ ID NO: 2712540 - RNA, 20 nt, Haemophilus influenzae Rd
ugaaucaauuagaugacugg

SEQ ID NO: 2712541 - RNA, 21 nt, Haemophilus influenzae Rd
ugaaucaauuagaugacuggc

SEQ ID NO: 2712542 - RNA, 21 nt, Haemophilus influenzae Rd
ugaaucaauuuuuucuccaca

SEQ ID NO: 2712543 - RNA, 21 nt, Haemophilus influenzae Rd
ugaaucacaacauauaaaucu

SEQ ID NO: 2712544 - RNA, 15 nt, Haemophilus influenzae Rd
ugaauccaaugcacu

SEQ ID NO: 2712545 - RNA, 22 nt, Haemophilus influenzae Rd
ugaaucgaggcgauaagcaauu

SEQ ID NO: 2712546 - RNA, 22 nt, Haemophilus influenzae Rd
ugaaucuaauccuaaaaugcuc

SEQ ID NO: 2712547 - RNA, 22 nt, Haemophilus influenzae Rd
ugaaucuaaucgggcuuuauca

SEQ ID NO: 2712548 - RNA, 17 nt, Haemophilus influenzae Rd
ugaaucucacguacuuu

SEQ ID NO: 2712549 - RNA, 14 nt, Haemophilus influenzae Rd
ugaaucucagcaag

SEQ ID NO: 2712550 - RNA, 17 nt, Haemophilus influenzae Rd
ugaaugaucgaguaaaa

SEQ ID NO: 2712551 - RNA, 19 nt, Haemophilus influenzae Rd
ugaaugccauucucccuga

SEQ ID NO: 2712552 - RNA, 16 nt, Haemophilus influenzae Rd
ugaauggauuauaaau

SEQ ID NO: 2712553 - RNA, 19 nt, Haemophilus influenzae Rd
ugaauggauuauaaauaga

SEQ ID NO: 2712554 - RNA, 17 nt, Haemophilus influenzae Rd
ugaauggcgaauuucac

SEQ ID NO: 2712555 - RNA, 16 nt, Haemophilus influenzae Rd
ugaauggcuaucugcu

SEQ ID NO: 2712556 - RNA, 15 nt, Haemophilus influenzae Rd
ugaauguaaaaaaua

SEQ ID NO: 2712557 - RNA, 16 nt, Haemophilus influenzae Rd
ugaauguaaaaauaac

SEQ ID NO: 2712558 - RNA, 23 nt, Haemophilus influenzae Rd
ugaauguaaaaauaaccuauaau

SEQ ID NO: 2712559 - RNA, 22 nt, Haemophilus influenzae Rd
ugaaugugcgguagauuuucau

SEQ ID NO: 2712560 - RNA, 14 nt, Haemophilus influenzae Rd
ugaauguuuuucau

SEQ ID NO: 2712561 - RNA, 16 nt, Haemophilus influenzae Rd
ugaauuaaaaguagaa

SEQ ID NO: 2712562 - RNA, 17 nt, Haemophilus influenzae Rd
ugaauuaaaaguagaag

SEQ ID NO: 2712563 - RNA, 13 nt, Haemophilus influenzae Rd
ugaauuaaaaguu

SEQ ID NO: 2712564 - RNA, 15 nt, Haemophilus influenzae Rd
ugaauuaaaaguuua

SEQ ID NO: 2712565 - RNA, 17 nt, Haemophilus influenzae Rd
ugaauuaccacaucauu

SEQ ID NO: 2712566 - RNA, 16 nt, Haemophilus influenzae Rd
ugaauuaccauaaaac

SEQ ID NO: 2712567 - RNA, 18 nt, Haemophilus influenzae Rd
ugaauuaccauaaaacgu

SEQ ID NO: 2712568 - RNA, 22 nt, Haemophilus influenzae Rd
ugaauuagauucggcuaaaaca

SEQ ID NO: 2712569 - RNA, 23 nt, Haemophilus influenzae Rd
ugaauuaguuucaacuuggaaag

SEQ ID NO: 2712570 - RNA, 15 nt, Haemophilus influenzae Rd
ugaauuauugucuuu

SEQ ID NO: 2712571 - RNA, 14 nt, Haemophilus influenzae Rd
ugaauugagugaau

SEQ ID NO: 2712572 - RNA, 15 nt, Haemophilus influenzae Rd
ugaauugguguuuaa

SEQ ID NO: 2712573 - RNA, 19 nt, Haemophilus influenzae Rd
ugaauugguguuuaaaugg

SEQ ID NO: 2712574 - RNA, 13 nt, Haemophilus influenzae Rd
ugaauuuaaacuu

SEQ ID NO: 2712575 - RNA, 14 nt, Haemophilus influenzae Rd
ugaauuuaauucac

SEQ ID NO: 2712576 - RNA, 15 nt, Haemophilus influenzae Rd
ugaauuuaauucacc

SEQ ID NO: 2712577 - RNA, 15 nt, Haemophilus influenzae Rd
ugaauuuaucaucaa

SEQ ID NO: 2712578 - RNA, 11 nt, Haemophilus influenzae Rd
ugaauuucuaa

SEQ ID NO: 2712579 - RNA, 21 nt, Haemophilus influenzae Rd
ugaauuucuugccgaaaauuu

SEQ ID NO: 2712580 - RNA, 18 nt, Haemophilus influenzae Rd
ugaauuuuacuucuucag

SEQ ID NO: 2712581 - RNA, 20 nt, Haemophilus influenzae Rd
ugaauuuucaccguuuuucc

SEQ ID NO: 2712582 - RNA, 14 nt, Haemophilus influenzae Rd
ugaauuuuucuaag

SEQ ID NO: 2712583 - RNA, 18 nt, Haemophilus influenzae Rd
ugaauuuuuuuaguuuug

SEQ ID NO: 2712584 - RNA, 14 nt, Haemophilus influenzae Rd
ugacaaaaaauauc

SEQ ID NO: 2712585 - RNA, 18 nt, Haemophilus influenzae Rd
ugacaaaucugccugauu

SEQ ID NO: 2712586 - RNA, 19 nt, Haemophilus influenzae Rd
ugacaaauuuguugaucug

SEQ ID NO: 2712587 - RNA, 17 nt, Haemophilus influenzae Rd
ugacaaauuuugcauua

SEQ ID NO: 2712588 - RNA, 20 nt, Haemophilus influenzae Rd
ugacaacgcgacuaaaucuu

SEQ ID NO: 2712589 - RNA, 13 nt, Haemophilus influenzae Rd
ugacaagcaaccu

SEQ ID NO: 2712590 - RNA, 21 nt, Haemophilus influenzae Rd
ugacaauaacugcgccaauau

SEQ ID NO: 2712591 - RNA, 22 nt, Haemophilus influenzae Rd
ugacaauguuuuagagaaaugc

SEQ ID NO: 2712592 - RNA, 17 nt, Haemophilus influenzae Rd
ugacacccaaauuaaaa

SEQ ID NO: 2712593 - RNA, 22 nt, Haemophilus influenzae Rd
ugacacccaaauuaaaaaagca

SEQ ID NO: 2712594 - RNA, 17 nt, Haemophilus influenzae Rd
ugacacgguaguaaaua

SEQ ID NO: 2712595 - RNA, 17 nt, Haemophilus influenzae Rd
ugacagaaacaaauccu

SEQ ID NO: 2712596 - RNA, 20 nt, Haemophilus influenzae Rd
ugacagaauuacguaauauu

SEQ ID NO: 2712597 - RNA, 21 nt, Haemophilus influenzae Rd
ugacagauauuggauuuacuu

SEQ ID NO: 2712598 - RNA, 20 nt, Haemophilus influenzae Rd
ugacagcaauauauaaaucc

SEQ ID NO: 2712599 - RNA, 18 nt, Haemophilus influenzae Rd
ugacaguaauguaauaac

SEQ ID NO: 2712600 - RNA, 20 nt, Haemophilus influenzae Rd
ugacagucgauuacaaaaac

SEQ ID NO: 2712601 - RNA, 16 nt, Haemophilus influenzae Rd
ugacaguuuaucucuu

SEQ ID NO: 2712602 - RNA, 22 nt, Haemophilus influenzae Rd
ugacaguuuguaauccugcauu

SEQ ID NO: 2712603 - RNA, 19 nt, Haemophilus influenzae Rd
ugacauuaaagcaauugcu

SEQ ID NO: 2712604 - RNA, 15 nt, Haemophilus influenzae Rd
ugacauuacauaaau

SEQ ID NO: 2712605 - RNA, 20 nt, Haemophilus influenzae Rd
ugacauuggauuaaucaauu

SEQ ID NO: 2712606 - RNA, 22 nt, Haemophilus influenzae Rd
ugacauuuuacuuuagcaaugc

SEQ ID NO: 2712607 - RNA, 12 nt, Haemophilus influenzae Rd
ugaccaaaauug

SEQ ID NO: 2712608 - RNA, 17 nt, Haemophilus influenzae Rd
ugaccaaauuccaagcc

SEQ ID NO: 2712609 - RNA, 16 nt, Haemophilus influenzae Rd
ugaccaacaccauucc

SEQ ID NO: 2712610 - RNA, 13 nt, Haemophilus influenzae Rd
ugaccacuuucaa

SEQ ID NO: 2712611 - RNA, 15 nt, Haemophilus influenzae Rd
ugaccagucauugau

SEQ ID NO: 2712612 - RNA, 21 nt, Haemophilus influenzae Rd
ugaccauuggcuuucauuaca

SEQ ID NO: 2712613 - RNA, 13 nt, Haemophilus influenzae Rd
ugacccacaucau

SEQ ID NO: 2712614 - RNA, 17 nt, Haemophilus influenzae Rd
ugaccccaaaaaguuag

SEQ ID NO: 2712615 - RNA, 16 nt, Haemophilus influenzae Rd
ugacccgcuuuuaaug

SEQ ID NO: 2712616 - RNA, 15 nt, Haemophilus influenzae Rd
ugaccgauuaauuca

SEQ ID NO: 2712617 - RNA, 16 nt, Haemophilus influenzae Rd
ugaccgcccaacauuu

SEQ ID NO: 2712618 - RNA, 17 nt, Haemophilus influenzae Rd
ugaccuacgcugagaau

SEQ ID NO: 2712619 - RNA, 16 nt, Haemophilus influenzae Rd
ugaccucguggcaaaa

SEQ ID NO: 2712620 - RNA, 19 nt, Haemophilus influenzae Rd
ugaccucguggcaaaagau

SEQ ID NO: 2712621 - RNA, 15 nt, Haemophilus influenzae Rd
ugaccugcagagaag

SEQ ID NO: 2712622 - RNA, 15 nt, Haemophilus influenzae Rd
ugaccugcguagccu

SEQ ID NO: 2712623 - RNA, 18 nt, Haemophilus influenzae Rd
ugaccuguacuugcuuca

SEQ ID NO: 2712624 - RNA, 17 nt, Haemophilus influenzae Rd
ugaccuuuuuuuagaau

SEQ ID NO: 2712625 - RNA, 19 nt, Haemophilus influenzae Rd
ugacgaaaaauuaaccauc

SEQ ID NO: 2712626 - RNA, 19 nt, Haemophilus influenzae Rd
ugacgagaagaugccagca

SEQ ID NO: 2712627 - RNA, 21 nt, Haemophilus influenzae Rd
ugacgauuaauaccaauaaua

SEQ ID NO: 2712628 - RNA, 15 nt, Haemophilus influenzae Rd
ugauaauuaacaaua

SEQ ID NO: 2712629 - RNA, 15 nt, Haemophilus influenzae Rd
ugauaauuucaucgc

SEQ ID NO: 2712630 - RNA, 14 nt, Haemophilus influenzae Rd
ugauaauuuuuacc

SEQ ID NO: 2712631 - RNA, 13 nt, Haemophilus influenzae Rd
ugauaauuuuuca

SEQ ID NO: 2712632 - RNA, 14 nt, Haemophilus influenzae Rd
ugauaauuuuucac

SEQ ID NO: 2712633 - RNA, 21 nt, Haemophilus influenzae Rd
ugauacaaucgguuaaaagua

SEQ ID NO: 2712634 - RNA, 12 nt, Haemophilus influenzae Rd
ugauacauuucu

SEQ ID NO: 2712635 - RNA, 14 nt, Haemophilus influenzae Rd
ugauacauuucuaa

SEQ ID NO: 2712636 - RNA, 18 nt, Haemophilus influenzae Rd
ugauacauuucuaaaaua

SEQ ID NO: 2712637 - RNA, 12 nt, Haemophilus influenzae Rd
ugauaccaauaa

SEQ ID NO: 2712638 - RNA, 14 nt, Haemophilus influenzae Rd
ugauacgaauguuu

SEQ ID NO: 2712639 - RNA, 14 nt, Haemophilus influenzae Rd
ugauacggaaagua

SEQ ID NO: 2712640 - RNA, 23 nt, Haemophilus influenzae Rd
ugauacuucggggaucauuucau

SEQ ID NO: 2712641 - RNA, 13 nt, Haemophilus influenzae Rd
ugauagaaccaau

SEQ ID NO: 2712642 - RNA, 15 nt, Haemophilus influenzae Rd
ugauagacaauauaa

SEQ ID NO: 2712643 - RNA, 16 nt, Haemophilus influenzae Rd
ugauagguaauaauag

SEQ ID NO: 2712644 - RNA, 19 nt, Haemophilus influenzae Rd
ugauauaaauuguuuuucc

SEQ ID NO: 2712645 - RNA, 21 nt, Haemophilus influenzae Rd
ugauauaaguucuaaauaaac

SEQ ID NO: 2712646 - RNA, 20 nt, Haemophilus influenzae Rd
ugauauaauauuuuggcaau

SEQ ID NO: 2712647 - RNA, 18 nt, Haemophilus influenzae Rd
ugauauaguggcuuuaaa

SEQ ID NO: 2712648 - RNA, 22 nt, Haemophilus influenzae Rd
ugauauaguggcuuuaaagguu

SEQ ID NO: 2712649 - RNA, 16 nt, Haemophilus influenzae Rd
ugauauaugauuauaa

SEQ ID NO: 2712650 - RNA, 15 nt, Haemophilus influenzae Rd
ugauaugccaaggcu

SEQ ID NO: 2712651 - RNA, 13 nt, Haemophilus influenzae Rd
ugauauucaauua

SEQ ID NO: 2712652 - RNA, 15 nt, Haemophilus influenzae Rd
ugauauucaauuacu

SEQ ID NO: 2712653 - RNA, 12 nt, Haemophilus influenzae Rd
ugauauuuaaaa

SEQ ID NO: 2712654 - RNA, 16 nt, Haemophilus influenzae Rd
ugauauuuaacaucau

SEQ ID NO: 2712655 - RNA, 14 nt, Haemophilus influenzae Rd
ugauauuuaauaaa

SEQ ID NO: 2712656 - RNA, 13 nt, Haemophilus influenzae Rd
ugauauuucacua

SEQ ID NO: 2712657 - RNA, 19 nt, Haemophilus influenzae Rd
ugauauuucacuaaauccu

SEQ ID NO: 2712658 - RNA, 19 nt, Haemophilus influenzae Rd
ugaucaaaucaaauuuucc

SEQ ID NO: 2712659 - RNA, 20 nt, Haemophilus influenzae Rd
ugaucaaaucaaauuuuccu

SEQ ID NO: 2712660 - RNA, 21 nt, Haemophilus influenzae Rd
ugaucaaaucaaauuuuccuu

SEQ ID NO: 2712661 - RNA, 22 nt, Haemophilus influenzae Rd
ugaucaaaucaaauuuuccuuc

SEQ ID NO: 2712662 - RNA, 13 nt, Haemophilus influenzae Rd
ugaucaaggguac

SEQ ID NO: 2712663 - RNA, 19 nt, Haemophilus influenzae Rd
ugaucaaggguacaacaaa

SEQ ID NO: 2712664 - RNA, 17 nt, Haemophilus influenzae Rd
ugaucaccgaaauaacc

SEQ ID NO: 2712665 - RNA, 19 nt, Haemophilus influenzae Rd
ugaucacuucauaaauugu

SEQ ID NO: 2712666 - RNA, 19 nt, Haemophilus influenzae Rd
ugaucagaaguuaaaacuu

SEQ ID NO: 2712667 - RNA, 22 nt, Haemophilus influenzae Rd
ugaucagaaguuaaaacuugaa

SEQ ID NO: 2712668 - RNA, 19 nt, Haemophilus influenzae Rd
ugaucaugguuguaauaau

SEQ ID NO: 2712669 - RNA, 13 nt, Haemophilus influenzae Rd
ugauccaaaaaua

SEQ ID NO: 2712670 - RNA, 13 nt, Haemophilus influenzae Rd
ugauccuagaugu

SEQ ID NO: 2712671 - RNA, 21 nt, Haemophilus influenzae Rd
ugaucgaguaaaaauaaaaug

SEQ ID NO: 2712672 - RNA, 18 nt, Haemophilus influenzae Rd
ugaucggauuucuuuauu

SEQ ID NO: 2712673 - RNA, 14 nt, Haemophilus influenzae Rd
ugaucgguuuuauu

SEQ ID NO: 2712674 - RNA, 16 nt, Haemophilus influenzae Rd
ugaucuaaauuaucgu

SEQ ID NO: 2712675 - RNA, 19 nt, Haemophilus influenzae Rd
ugaucucuuucuauuugaa

SEQ ID NO: 2712676 - RNA, 15 nt, Haemophilus influenzae Rd
ugaucugcaaauggu

SEQ ID NO: 2712677 - RNA, 20 nt, Haemophilus influenzae Rd
ugaucugcaccccaaaaguu

SEQ ID NO: 2712678 - RNA, 20 nt, Haemophilus influenzae Rd
ugaucugcacuccaaaaguu

SEQ ID NO: 2712679 - RNA, 16 nt, Haemophilus influenzae Rd
ugaucuucaaucauca

SEQ ID NO: 2712680 - RNA, 22 nt, Haemophilus influenzae Rd
ugaucuucccagaaugguaaug

SEQ ID NO: 2712681 - RNA, 21 nt, Haemophilus influenzae Rd
ugaucuugguagaaaauuuga

SEQ ID NO: 2712682 - RNA, 14 nt, Haemophilus influenzae Rd
ugaugaaaauuauc

SEQ ID NO: 2712683 - RNA, 14 nt, Haemophilus influenzae Rd
ugaugaaacaagcu

SEQ ID NO: 2712684 - RNA, 13 nt, Haemophilus influenzae Rd
ugaugaaacaauc

SEQ ID NO: 2712685 - RNA, 21 nt, Haemophilus influenzae Rd
ugaugaaacugaaccagccau

SEQ ID NO: 2712686 - RNA, 19 nt, Haemophilus influenzae Rd
ugaugaaccauaaacaaua

SEQ ID NO: 2712687 - RNA, 12 nt, Haemophilus influenzae Rd
ugaugaagauga

SEQ ID NO: 2712688 - RNA, 19 nt, Haemophilus influenzae Rd
ugaugaguagauuuuuauu

SEQ ID NO: 2712689 - RNA, 20 nt, Haemophilus influenzae Rd
ugaugaguagauuuuuauuc

SEQ ID NO: 2712690 - RNA, 13 nt, Haemophilus influenzae Rd
ugaugauaaucuu

SEQ ID NO: 2712691 - RNA, 14 nt, Haemophilus influenzae Rd
ugaugauaaucuuc

SEQ ID NO: 2712692 - RNA, 15 nt, Haemophilus influenzae Rd
ugaugauggccauga

SEQ ID NO: 2712693 - RNA, 16 nt, Haemophilus influenzae Rd
ugaugaugguguucug

SEQ ID NO: 2712694 - RNA, 20 nt, Haemophilus influenzae Rd
ugaugauuguuauugugaug

SEQ ID NO: 2712695 - RNA, 23 nt, Haemophilus influenzae Rd
ugaugauuugcauaaaaccagca

SEQ ID NO: 2712696 - RNA, 12 nt, Haemophilus influenzae Rd
ugaugauuuuca

SEQ ID NO: 2712697 - RNA, 17 nt, Haemophilus influenzae Rd
ugaugcaacauuuaaug

SEQ ID NO: 2712698 - RNA, 19 nt, Haemophilus influenzae Rd
ugaugcagaaagcacuugu

SEQ ID NO: 2712699 - RNA, 15 nt, Haemophilus influenzae Rd
ugaugccauuuuuug

SEQ ID NO: 2712700 - RNA, 14 nt, Haemophilus influenzae Rd
ugaugcgaaaaugg

SEQ ID NO: 2712701 - RNA, 16 nt, Haemophilus influenzae Rd
ugaugcgugucaaauu

SEQ ID NO: 2712702 - RNA, 15 nt, Haemophilus influenzae Rd
ugauggaauuuauac

SEQ ID NO: 2712703 - RNA, 17 nt, Haemophilus influenzae Rd
ugaugggaauucauaaa

SEQ ID NO: 2712704 - RNA, 17 nt, Haemophilus influenzae Rd
ugaugggaugaaaucaa

SEQ ID NO: 2712705 - RNA, 14 nt, Haemophilus influenzae Rd
ugauguaccaaaau

SEQ ID NO: 2712706 - RNA, 17 nt, Haemophilus influenzae Rd
ugauguaccaauuugua

SEQ ID NO: 2712707 - RNA, 19 nt, Haemophilus influenzae Rd
ugauguaggcaaaaacacu

SEQ ID NO: 2712708 - RNA, 12 nt, Haemophilus influenzae Rd
ugauguggcuuu

SEQ ID NO: 2712709 - RNA, 15 nt, Haemophilus influenzae Rd
ugauguucagccacu

SEQ ID NO: 2712710 - RNA, 22 nt, Haemophilus influenzae Rd
ugauuaaaaugguuuaaauaac

SEQ ID NO: 2712711 - RNA, 14 nt, Haemophilus influenzae Rd
ugauuaaucaaaaa

SEQ ID NO: 2712712 - RNA, 15 nt, Haemophilus influenzae Rd
ugauuaaucaaaaau

SEQ ID NO: 2712713 - RNA, 18 nt, Haemophilus influenzae Rd
ugauuaccaggaaauauu

SEQ ID NO: 2712714 - RNA, 16 nt, Haemophilus influenzae Rd
ugauuagcuaauauaa

SEQ ID NO: 2712715 - RNA, 17 nt, Haemophilus influenzae Rd
ugauuagucuacaagaa

SEQ ID NO: 2712716 - RNA, 16 nt, Haemophilus influenzae Rd
ugauuagugauaaaug

SEQ ID NO: 2712717 - RNA, 17 nt, Haemophilus influenzae Rd
ugauuauagauuuaguc

SEQ ID NO: 2712718 - RNA, 14 nt, Haemophilus influenzae Rd
ugauuaucuaaauu

SEQ ID NO: 2712719 - RNA, 19 nt, Haemophilus influenzae Rd
ugauuaucuaaauuucgcu

SEQ ID NO: 2712720 - RNA, 23 nt, Haemophilus influenzae Rd
ugauuauucucuauuaauuuuaa

SEQ ID NO: 2712721 - RNA, 21 nt, Haemophilus influenzae Rd
ugauuauugaucgccuaaaua

SEQ ID NO: 2712722 - RNA, 13 nt, Haemophilus influenzae Rd
ugauuauuuuuua

SEQ ID NO: 2712723 - RNA, 22 nt, Haemophilus influenzae Rd
ugauucaaacgcguuaaaucac

SEQ ID NO: 2712724 - RNA, 16 nt, Haemophilus influenzae Rd
ugauucaauucuucua

SEQ ID NO: 2712725 - RNA, 23 nt, Haemophilus influenzae Rd
ugauucaauuugaccuugaaguu

SEQ ID NO: 2712726 - RNA, 11 nt, Haemophilus influenzae Rd
ugauucacuaa

SEQ ID NO: 2712727 - RNA, 21 nt, Haemophilus influenzae Rd
ugauucaguccgcauugaaac

SEQ ID NO: 2712728 - RNA, 22 nt, Haemophilus influenzae Rd
ugauucauugcauuuuuauaaa

SEQ ID NO: 2712729 - RNA, 11 nt, Haemophilus influenzae Rd
ugauucauuug

SEQ ID NO: 2712730 - RNA, 20 nt, Haemophilus influenzae Rd
ugauuccaacaaguucuucu

SEQ ID NO: 2712731 - RNA, 21 nt, Haemophilus influenzae Rd
ugauuccaacaaguucuucua

SEQ ID NO: 2712732 - RNA, 22 nt, Haemophilus influenzae Rd
ugauuccaacaaguucuucuau

SEQ ID NO: 2712733 - RNA, 14 nt, Haemophilus influenzae Rd
ugauucgauaaauu

SEQ ID NO: 2712734 - RNA, 22 nt, Haemophilus influenzae Rd
ugcaccccaaaagcuggauuaa

SEQ ID NO: 2712735 - RNA, 15 nt, Haemophilus influenzae Rd
ugcacccgcuuuaau

SEQ ID NO: 2712736 - RNA, 18 nt, Haemophilus influenzae Rd
ugcacccuaauucauuaa

SEQ ID NO: 2712737 - RNA, 15 nt, Haemophilus influenzae Rd
ugcaccguuugacgu

SEQ ID NO: 2712738 - RNA, 15 nt, Haemophilus influenzae Rd
ugcaccuaaaaguua

SEQ ID NO: 2712739 - RNA, 17 nt, Haemophilus influenzae Rd
ugcaccugcaucaauuu

SEQ ID NO: 2712740 - RNA, 21 nt, Haemophilus influenzae Rd
ugcaccuuaaaggcugaauaa

SEQ ID NO: 2712741 - RNA, 15 nt, Haemophilus influenzae Rd
ugcaccuucaacauu

SEQ ID NO: 2712742 - RNA, 20 nt, Haemophilus influenzae Rd
ugcaccuucaccacuuggug

SEQ ID NO: 2712743 - RNA, 18 nt, Haemophilus influenzae Rd
ugcaccuucuuuuggaua

SEQ ID NO: 2712744 - RNA, 22 nt, Haemophilus influenzae Rd
ugcacgagcuugagcugcugca

SEQ ID NO: 2712745 - RNA, 16 nt, Haemophilus influenzae Rd
ugcacguuaauuacca

SEQ ID NO: 2712746 - RNA, 14 nt, Haemophilus influenzae Rd
ugcacguucuaaug

SEQ ID NO: 2712747 - RNA, 22 nt, Haemophilus influenzae Rd
ugcacguucuaauguuaauuuu

SEQ ID NO: 2712748 - RNA, 13 nt, Haemophilus influenzae Rd
ugcacuaauaaau

SEQ ID NO: 2712749 - RNA, 22 nt, Haemophilus influenzae Rd
ugcacuaauugugguaaagcua

SEQ ID NO: 2712750 - RNA, 19 nt, Haemophilus influenzae Rd
ugcacuaguucagcgauuu

SEQ ID NO: 2712751 - RNA, 20 nt, Haemophilus influenzae Rd
ugcacuauauacauuaacaa

SEQ ID NO: 2712752 - RNA, 21 nt, Haemophilus influenzae Rd
ugcacuaucuaugauuucauu

SEQ ID NO: 2712753 - RNA, 22 nt, Haemophilus influenzae Rd
ugcacuccaaaaguuggauuaa

SEQ ID NO: 2712754 - RNA, 22 nt, Haemophilus influenzae Rd
ugcacucgcucuaacaauauuu

SEQ ID NO: 2712755 - RNA, 13 nt, Haemophilus influenzae Rd
ugcacuucuucag

SEQ ID NO: 2712756 - RNA, 22 nt, Haemophilus influenzae Rd
ugcacuuggguaaauauaaaug

SEQ ID NO: 2712757 - RNA, 12 nt, Haemophilus influenzae Rd
ugcacuuucucg

SEQ ID NO: 2712758 - RNA, 16 nt, Haemophilus influenzae Rd
ugcagaaccgccaccc

SEQ ID NO: 2712759 - RNA, 17 nt, Haemophilus influenzae Rd
ugcagaauuuggaucuu

SEQ ID NO: 2712760 - RNA, 15 nt, Haemophilus influenzae Rd
ugcagauuaaauauu

SEQ ID NO: 2712761 - RNA, 14 nt, Haemophilus influenzae Rd
ugcagauuaauuau

SEQ ID NO: 2712762 - RNA, 18 nt, Haemophilus influenzae Rd
ugcagauuaauuauauuu

SEQ ID NO: 2712763 - RNA, 11 nt, Haemophilus influenzae Rd
ugcagauuuuu

SEQ ID NO: 2712764 - RNA, 24 nt, Haemophilus influenzae Rd
ugcagauuuuuauaucuaaauaau

SEQ ID NO: 2712765 - RNA, 16 nt, Haemophilus influenzae Rd
ugcagauuuuuuauua

SEQ ID NO: 2712766 - RNA, 20 nt, Haemophilus influenzae Rd
ugcagauuuuuuauuaauaa

SEQ ID NO: 2712767 - RNA, 22 nt, Haemophilus influenzae Rd
ugcagauuuuuuauuuauuaag

SEQ ID NO: 2712768 - RNA, 21 nt, Haemophilus influenzae Rd
ugcagauuuuuuuaugauuaa

SEQ ID NO: 2712769 - RNA, 17 nt, Haemophilus influenzae Rd
ugcagcaggaagaacau

SEQ ID NO: 2712770 - RNA, 20 nt, Haemophilus influenzae Rd
ugcagccauaauauuuaaaa

SEQ ID NO: 2712771 - RNA, 16 nt, Haemophilus influenzae Rd
ugcagcccaaauuguu

SEQ ID NO: 2712772 - RNA, 17 nt, Haemophilus influenzae Rd
ugcagcugcugcuuuaa

SEQ ID NO: 2712773 - RNA, 16 nt, Haemophilus influenzae Rd
ugcagggaaaaauuuu

SEQ ID NO: 2712774 - RNA, 15 nt, Haemophilus influenzae Rd
ugcaguaaaaucuuc

SEQ ID NO: 2712775 - RNA, 19 nt, Haemophilus influenzae Rd
ugcaguaacuucugcugca

SEQ ID NO: 2712776 - RNA, 22 nt, Haemophilus influenzae Rd
ugcaguagguauguuuaguucu

SEQ ID NO: 2712777 - RNA, 19 nt, Haemophilus influenzae Rd
ugcaguauuaguugguacu

SEQ ID NO: 2712778 - RNA, 19 nt, Haemophilus influenzae Rd
ugcaguuucugguuccauu

SEQ ID NO: 2712779 - RNA, 23 nt, Haemophilus influenzae Rd
ugcaguuuuuuguuuuuccgcuu

SEQ ID NO: 2712780 - RNA, 15 nt, Haemophilus influenzae Rd
ugcauaaaauaauuu

SEQ ID NO: 2712781 - RNA, 14 nt, Haemophilus influenzae Rd
ugcauaaaaucuuc

SEQ ID NO: 2712782 - RNA, 17 nt, Haemophilus influenzae Rd
ugcauaaagcucagcca

SEQ ID NO: 2712783 - RNA, 17 nt, Haemophilus influenzae Rd
ugcauaaucauaucuaa

SEQ ID NO: 2712784 - RNA, 21 nt, Haemophilus influenzae Rd
ugcauaauggcuuaauaaugg

SEQ ID NO: 2712785 - RNA, 20 nt, Haemophilus influenzae Rd
ugcauagaaugcaacaagua

SEQ ID NO: 2712786 - RNA, 21 nt, Haemophilus influenzae Rd
ugcauagaaugcaacaaguac

SEQ ID NO: 2712787 - RNA, 13 nt, Haemophilus influenzae Rd
ugcauauccgcug

SEQ ID NO: 2712788 - RNA, 20 nt, Haemophilus influenzae Rd
ugcauauguugguaauucag

SEQ ID NO: 2712789 - RNA, 16 nt, Haemophilus influenzae Rd
ugcauauuaaugcggu

SEQ ID NO: 2712790 - RNA, 23 nt, Haemophilus influenzae Rd
ugcauauuaaugcggugcuuuaa

SEQ ID NO: 2712791 - RNA, 19 nt, Haemophilus influenzae Rd
ugcaucaaccgauaaaucu

SEQ ID NO: 2712792 - RNA, 20 nt, Haemophilus influenzae Rd
ugcaucaaccgauaaaucua

SEQ ID NO: 2712793 - RNA, 15 nt, Haemophilus influenzae Rd
ugcaucaaucauuaa

SEQ ID NO: 2712794 - RNA, 14 nt, Haemophilus influenzae Rd
ugcaucagccaccu

SEQ ID NO: 2712795 - RNA, 17 nt, Haemophilus influenzae Rd
ugcaucagccaccuuaa

SEQ ID NO: 2712796 - RNA, 17 nt, Haemophilus influenzae Rd
ugcaucaggauuuuucg

SEQ ID NO: 2712797 - RNA, 21 nt, Haemophilus influenzae Rd
ugcaucaggauuuuucgcagg

SEQ ID NO: 2712798 - RNA, 13 nt, Haemophilus influenzae Rd
ugcaucaggcaca

SEQ ID NO: 2712799 - RNA, 17 nt, Haemophilus influenzae Rd
ugcauccacuuuuuuca

SEQ ID NO: 2712800 - RNA, 21 nt, Haemophilus influenzae Rd
ugcauccacuuuuuucacgau

SEQ ID NO: 2712801 - RNA, 17 nt, Haemophilus influenzae Rd
ugcaucuaaaaauaauu

SEQ ID NO: 2712802 - RNA, 22 nt, Haemophilus influenzae Rd
ugcaucuguugugaaugcaaua

SEQ ID NO: 2712803 - RNA, 20 nt, Haemophilus influenzae Rd
ugcaucuuggcauuuuugcu

SEQ ID NO: 2712804 - RNA, 15 nt, Haemophilus influenzae Rd
ugcaugagcuuugcu

SEQ ID NO: 2712805 - RNA, 23 nt, Haemophilus influenzae Rd
ugcaugugguaauuaacgugcau

SEQ ID NO: 2712806 - RNA, 23 nt, Haemophilus influenzae Rd
ugcauuaaaagucuguuuaaaaa

SEQ ID NO: 2712807 - RNA, 23 nt, Haemophilus influenzae Rd
ugcauuaaagcgagaauaguuaa

SEQ ID NO: 2712808 - RNA, 17 nt, Haemophilus influenzae Rd
ugcauuaaaucaaauuu

SEQ ID NO: 2712809 - RNA, 16 nt, Haemophilus influenzae Rd
ugcauuaagaaguuau

SEQ ID NO: 2712810 - RNA, 13 nt, Haemophilus influenzae Rd
ugcauuaauaauc

SEQ ID NO: 2712811 - RNA, 14 nt, Haemophilus influenzae Rd
ugcauuaauaaucu

SEQ ID NO: 2712812 - RNA, 15 nt, Haemophilus influenzae Rd
ugcauuagaaaucaa

SEQ ID NO: 2712813 - RNA, 21 nt, Haemophilus influenzae Rd
ugcauuauaaccaaaguuucc

SEQ ID NO: 2712814 - RNA, 14 nt, Haemophilus influenzae Rd
ugcauucaaauuuc

SEQ ID NO: 2712815 - RNA, 16 nt, Haemophilus influenzae Rd
ugcauucacaaaaguu

SEQ ID NO: 2712816 - RNA, 15 nt, Haemophilus influenzae Rd
ugcauucuaaaaguu

SEQ ID NO: 2712817 - RNA, 20 nt, Haemophilus influenzae Rd
ugcauugaugacugcaucaa

SEQ ID NO: 2712818 - RNA, 21 nt, Haemophilus influenzae Rd
ugcauuggaaugguauaaaaa

SEQ ID NO: 2712819 - RNA, 22 nt, Haemophilus influenzae Rd
ugcauuggcuagagcuaauucu

SEQ ID NO: 2712820 - RNA, 15 nt, Haemophilus influenzae Rd
ugcauuuaaugguuu

SEQ ID NO: 2712821 - RNA, 20 nt, Haemophilus influenzae Rd
ugcauuuacauaaacggcug

SEQ ID NO: 2712822 - RNA, 21 nt, Haemophilus influenzae Rd
ugcauuuaugccguguaauac

SEQ ID NO: 2712823 - RNA, 18 nt, Haemophilus influenzae Rd
ugcauuucaauuucacug

SEQ ID NO: 2712824 - RNA, 23 nt, Haemophilus influenzae Rd
ugcauuucuaaauaaaauugcuu

SEQ ID NO: 2712825 - RNA, 13 nt, Haemophilus influenzae Rd
ugcauuucuucag

SEQ ID NO: 2712826 - RNA, 16 nt, Haemophilus influenzae Rd
ugcauuugauuucaga

SEQ ID NO: 2712827 - RNA, 18 nt, Haemophilus influenzae Rd
ugcauuugauuucagaac

SEQ ID NO: 2712828 - RNA, 18 nt, Haemophilus influenzae Rd
ugcauuugcauaaagcau

SEQ ID NO: 2712829 - RNA, 18 nt, Haemophilus influenzae Rd
ugcauuugcucaauaccu

SEQ ID NO: 2712830 - RNA, 13 nt, Haemophilus influenzae Rd
ugcauuuucuucc

SEQ ID NO: 2712831 - RNA, 17 nt, Haemophilus influenzae Rd
ugcauuuucuuccaaug

SEQ ID NO: 2712832 - RNA, 20 nt, Haemophilus influenzae Rd
ugcauuuucuuuuucaagaa

SEQ ID NO: 2712833 - RNA, 15 nt, Haemophilus influenzae Rd
ugcauuuuuauaaag

SEQ ID NO: 2712834 - RNA, 13 nt, Haemophilus influenzae Rd
ugcauuuuucaua

SEQ ID NO: 2712835 - RNA, 16 nt, Haemophilus influenzae Rd
ugcauuuuuuaaucua

SEQ ID NO: 2712836 - RNA, 22 nt, Haemophilus influenzae Rd
ugcauuuuuuauaaauggcuca

SEQ ID NO: 2712837 - RNA, 20 nt, Haemophilus influenzae Rd
ugccaaagcauuaaguuuuu

SEQ ID NO: 2712838 - RNA, 11 nt, Haemophilus influenzae Rd
ugccaaauaaa

SEQ ID NO: 2712839 - RNA, 19 nt, Haemophilus influenzae Rd
ugcggaaacauaucaaaaa

SEQ ID NO: 2712840 - RNA, 17 nt, Haemophilus influenzae Rd
ugcggaauaauuuuccu

SEQ ID NO: 2712841 - RNA, 9 nt, Haemophilus influenzae Rd
ugcggacgc

SEQ ID NO: 2712842 - RNA, 15 nt, Haemophilus influenzae Rd
ugcggacuuuuucau

SEQ ID NO: 2712843 - RNA, 18 nt, Haemophilus influenzae Rd
ugcggacuuuuucauuau

SEQ ID NO: 2712844 - RNA, 15 nt, Haemophilus influenzae Rd
ugcggauuaagaugg

SEQ ID NO: 2712845 - RNA, 19 nt, Haemophilus influenzae Rd
ugcggauucgccaaagcua

SEQ ID NO: 2712846 - RNA, 18 nt, Haemophilus influenzae Rd
ugcggauuucacuagaua

SEQ ID NO: 2712847 - RNA, 14 nt, Haemophilus influenzae Rd
ugcggcaaaaaaug

SEQ ID NO: 2712848 - RNA, 15 nt, Haemophilus influenzae Rd
ugcggcaaagguuuu

SEQ ID NO: 2712849 - RNA, 16 nt, Haemophilus influenzae Rd
ugcgggaauagcucag

SEQ ID NO: 2712850 - RNA, 23 nt, Haemophilus influenzae Rd
ugcgguaaaaaaaugaaauauuu

SEQ ID NO: 2712851 - RNA, 16 nt, Haemophilus influenzae Rd
ugcgguaaaaauuaac

SEQ ID NO: 2712852 - RNA, 14 nt, Haemophilus influenzae Rd
ugcgguaaaaauuc

SEQ ID NO: 2712853 - RNA, 16 nt, Haemophilus influenzae Rd
ugcgguaaaaauuuac

SEQ ID NO: 2712854 - RNA, 18 nt, Haemophilus influenzae Rd
ugcgguaaaaauuuaccg

SEQ ID NO: 2712855 - RNA, 19 nt, Haemophilus influenzae Rd
ugcgguaaaaauuucucuc

SEQ ID NO: 2712856 - RNA, 15 nt, Haemophilus influenzae Rd
ugcgguaaauuuuaa

SEQ ID NO: 2712857 - RNA, 14 nt, Haemophilus influenzae Rd
ugcgguaaauuuuc

SEQ ID NO: 2712858 - RNA, 15 nt, Haemophilus influenzae Rd
ugcgguaaauuuuua

SEQ ID NO: 2712859 - RNA, 16 nt, Haemophilus influenzae Rd
ugcgguaaauuuuuaa

SEQ ID NO: 2712860 - RNA, 19 nt, Haemophilus influenzae Rd
ugcgguaauuuuuagaaga

SEQ ID NO: 2712861 - RNA, 15 nt, Haemophilus influenzae Rd
ugcgguagauuuuca

SEQ ID NO: 2712862 - RNA, 19 nt, Haemophilus influenzae Rd
ugcgguagauuuucaucgu

SEQ ID NO: 2712863 - RNA, 19 nt, Haemophilus influenzae Rd
ugcgguauuuuuauuuaua

SEQ ID NO: 2712864 - RNA, 20 nt, Haemophilus influenzae Rd
ugcggucaauaaaaauaaug

SEQ ID NO: 2712865 - RNA, 15 nt, Haemophilus influenzae Rd
ugcggucaauuuuca

SEQ ID NO: 2712866 - RNA, 16 nt, Haemophilus influenzae Rd
ugcggucaauuuuuca

SEQ ID NO: 2712867 - RNA, 23 nt, Haemophilus influenzae Rd
ugcggucaucucuuguuuuucca

SEQ ID NO: 2712868 - RNA, 23 nt, Haemophilus influenzae Rd
ugcggucuguugcaaauuuuuca

SEQ ID NO: 2712869 - RNA, 15 nt, Haemophilus influenzae Rd
ugcggugaaauuuua

SEQ ID NO: 2712870 - RNA, 19 nt, Haemophilus influenzae Rd
ugcggugagauuucuugcu

SEQ ID NO: 2712871 - RNA, 21 nt, Haemophilus influenzae Rd
ugcggugcaauuugaaaagaa

SEQ ID NO: 2712872 - RNA, 11 nt, Haemophilus influenzae Rd
ugcgguuaaaa

SEQ ID NO: 2712873 - RNA, 19 nt, Haemophilus influenzae Rd
ugcgguuaaaaaagaaaua

SEQ ID NO: 2712874 - RNA, 13 nt, Haemophilus influenzae Rd
ugcgguuaaauuu

SEQ ID NO: 2712875 - RNA, 13 nt, Haemophilus influenzae Rd
ugcgguuaauuuu

SEQ ID NO: 2712876 - RNA, 15 nt, Haemophilus influenzae Rd
ugcgguuaauuuuua

SEQ ID NO: 2712877 - RNA, 16 nt, Haemophilus influenzae Rd
ugcgguuauuuuauua

SEQ ID NO: 2712878 - RNA, 23 nt, Haemophilus influenzae Rd
ugcgguucuucuuuuaauaauag

SEQ ID NO: 2712879 - RNA, 19 nt, Haemophilus influenzae Rd
ugcgguuguuuuugccaaa

SEQ ID NO: 2712880 - RNA, 14 nt, Haemophilus influenzae Rd
ugcguaauucucca

SEQ ID NO: 2712881 - RNA, 22 nt, Haemophilus influenzae Rd
ugcguagccuggcacuaagaaa

SEQ ID NO: 2712882 - RNA, 20 nt, Haemophilus influenzae Rd
ugcguaucacuuaaaccaaa

SEQ ID NO: 2712883 - RNA, 13 nt, Haemophilus influenzae Rd
ugcguauccgcug

SEQ ID NO: 2712884 - RNA, 12 nt, Haemophilus influenzae Rd
ugcgucuuaaau

SEQ ID NO: 2712885 - RNA, 17 nt, Haemophilus influenzae Rd
ugcgugaauuugauaau

SEQ ID NO: 2712886 - RNA, 19 nt, Haemophilus influenzae Rd
ugcgugagcuugauuuuca

SEQ ID NO: 2712887 - RNA, 19 nt, Haemophilus influenzae Rd
ugcguguauauauuuuccu

SEQ ID NO: 2712888 - RNA, 14 nt, Haemophilus influenzae Rd
ugcgugucaaauua

SEQ ID NO: 2712889 - RNA, 15 nt, Haemophilus influenzae Rd
ugcguucaauaugca

SEQ ID NO: 2712890 - RNA, 15 nt, Haemophilus influenzae Rd
ugcguucauauuuga

SEQ ID NO: 2712891 - RNA, 19 nt, Haemophilus influenzae Rd
ugcguucaugguuguaaua

SEQ ID NO: 2712892 - RNA, 16 nt, Haemophilus influenzae Rd
ugcguuucaaaugcuu

SEQ ID NO: 2712893 - RNA, 18 nt, Haemophilus influenzae Rd
ugcguuucaaaugcuuug

SEQ ID NO: 2712894 - RNA, 17 nt, Haemophilus influenzae Rd
ugcguuuuacaccaaca

SEQ ID NO: 2712895 - RNA, 22 nt, Haemophilus influenzae Rd
ugcguuuucgcaauaucaucau

SEQ ID NO: 2712896 - RNA, 14 nt, Haemophilus influenzae Rd
ugcguuuuuuaauu

SEQ ID NO: 2712897 - RNA, 16 nt, Haemophilus influenzae Rd
ugcuaaaaagaaauaa

SEQ ID NO: 2712898 - RNA, 23 nt, Haemophilus influenzae Rd
ugcuaaaauuaaaggcauagcua

SEQ ID NO: 2712899 - RNA, 14 nt, Haemophilus influenzae Rd
ugcuaaacccacuu

SEQ ID NO: 2712900 - RNA, 22 nt, Haemophilus influenzae Rd
ugcuaaaggguuuacuuuaauu

SEQ ID NO: 2712901 - RNA, 15 nt, Haemophilus influenzae Rd
ugcuaaauaaauucc

SEQ ID NO: 2712902 - RNA, 19 nt, Haemophilus influenzae Rd
ugcuaaaucaccuaaaucu

SEQ ID NO: 2712903 - RNA, 14 nt, Haemophilus influenzae Rd
ugcuaaauuaaauu

SEQ ID NO: 2712904 - RNA, 20 nt, Haemophilus influenzae Rd
ugcuaacucaucaacaaaau

SEQ ID NO: 2712905 - RNA, 16 nt, Haemophilus influenzae Rd
ugcuaauagaacuguu

SEQ ID NO: 2712906 - RNA, 16 nt, Haemophilus influenzae Rd
ugcuaauucugcuaaa

SEQ ID NO: 2712907 - RNA, 21 nt, Haemophilus influenzae Rd
ugcuaauuuauccaauacugu

SEQ ID NO: 2712908 - RNA, 19 nt, Haemophilus influenzae Rd
ugcuacaagugaaccaaua

SEQ ID NO: 2712909 - RNA, 14 nt, Haemophilus influenzae Rd
ugcuacacgaacac

SEQ ID NO: 2712910 - RNA, 18 nt, Haemophilus influenzae Rd
ugcuacagcuuguuucau

SEQ ID NO: 2712911 - RNA, 14 nt, Haemophilus influenzae Rd
ugcuacauuugccc

SEQ ID NO: 2712912 - RNA, 20 nt, Haemophilus influenzae Rd
ugcuaccgaaagauauauaa

SEQ ID NO: 2712913 - RNA, 23 nt, Haemophilus influenzae Rd
ugcuauaaauccaacuaaaccac

SEQ ID NO: 2712914 - RNA, 17 nt, Haemophilus influenzae Rd
ugcuaucaggcuuaacu

SEQ ID NO: 2712915 - RNA, 18 nt, Haemophilus influenzae Rd
ugcuauccaguaaagaau

SEQ ID NO: 2712916 - RNA, 20 nt, Haemophilus influenzae Rd
ugcuauccaguaaagaauca

SEQ ID NO: 2712917 - RNA, 22 nt, Haemophilus influenzae Rd
ugcuauccuuuguugucguuau

SEQ ID NO: 2712918 - RNA, 16 nt, Haemophilus influenzae Rd
ugcuauuuuauuuaga

SEQ ID NO: 2712919 - RNA, 19 nt, Haemophilus influenzae Rd
ugcuauuuuauuuagaaag

SEQ ID NO: 2712920 - RNA, 19 nt, Haemophilus influenzae Rd
ugcuauuuucuaauuuuca

SEQ ID NO: 2712921 - RNA, 14 nt, Haemophilus influenzae Rd
ugcucaaaaucaag

SEQ ID NO: 2712922 - RNA, 22 nt, Haemophilus influenzae Rd
ugcucaaaaucaaguuaaaaaa

SEQ ID NO: 2712923 - RNA, 18 nt, Haemophilus influenzae Rd
ugcucacgccgugauaac

SEQ ID NO: 2712924 - RNA, 22 nt, Haemophilus influenzae Rd
ugcucacguaaccguucuaguu

SEQ ID NO: 2712925 - RNA, 16 nt, Haemophilus influenzae Rd
ugcucacguucagcuu

SEQ ID NO: 2712926 - RNA, 15 nt, Haemophilus influenzae Rd
ugcucccccccaaua

SEQ ID NO: 2712927 - RNA, 21 nt, Haemophilus influenzae Rd
ugcucccccccaauaaaaaga

SEQ ID NO: 2712928 - RNA, 22 nt, Haemophilus influenzae Rd
ugcuccgcagucgcuuuuuuau

SEQ ID NO: 2712929 - RNA, 18 nt, Haemophilus influenzae Rd
ugcuccgcuaaaaaugca

SEQ ID NO: 2712930 - RNA, 17 nt, Haemophilus influenzae Rd
ugcuccuacuuuuacaa

SEQ ID NO: 2712931 - RNA, 16 nt, Haemophilus influenzae Rd
ugcucgacaaagauuu

SEQ ID NO: 2712932 - RNA, 20 nt, Haemophilus influenzae Rd
ugcucgacaaagauuuucuc

SEQ ID NO: 2712933 - RNA, 22 nt, Haemophilus influenzae Rd
ugcucgauaaguaaugaaaauu

SEQ ID NO: 2712934 - RNA, 20 nt, Haemophilus influenzae Rd
ugcucgauagcccaaggccu

SEQ ID NO: 2712935 - RNA, 20 nt, Haemophilus influenzae Rd
ugcucgugcaggauaaaggu

SEQ ID NO: 2712936 - RNA, 20 nt, Haemophilus influenzae Rd
ugcucuaaaugugauuucca

SEQ ID NO: 2712937 - RNA, 20 nt, Haemophilus influenzae Rd
ugcucuaaccgacugagcua

SEQ ID NO: 2712938 - RNA, 17 nt, Haemophilus influenzae Rd
ugcucuaccgacugagc

SEQ ID NO: 2712939 - RNA, 19 nt, Haemophilus influenzae Rd
ugcucuaccgacugagcua

SEQ ID NO: 2712940 - RNA, 20 nt, Haemophilus influenzae Rd
ugcucugcuagucguucuug

SEQ ID NO: 2712941 - RNA, 22 nt, Haemophilus influenzae Rd
ugcucuugaaauaguuaaagaa

SEQ ID NO: 2712942 - RNA, 21 nt, Haemophilus influenzae Rd
ugcucuugauauucuucgcuu

SEQ ID NO: 2712943 - RNA, 21 nt, Haemophilus influenzae Rd
ugcucuugcgccccuuuuuua

SEQ ID NO: 2712944 - RNA, 14 nt, Haemophilus influenzae Rd
uggacagaauaacu

SEQ ID NO: 2712945 - RNA, 20 nt, Haemophilus influenzae Rd
uggacauuguuguuuaauaa

SEQ ID NO: 2712946 - RNA, 16 nt, Haemophilus influenzae Rd
uggaccaauugguaaa

SEQ ID NO: 2712947 - RNA, 20 nt, Haemophilus influenzae Rd
uggacgcucuacauuuacau

SEQ ID NO: 2712948 - RNA, 17 nt, Haemophilus influenzae Rd
uggacuuuauuugauug

SEQ ID NO: 2712949 - RNA, 13 nt, Haemophilus influenzae Rd
uggagaaagaaau

SEQ ID NO: 2712950 - RNA, 13 nt, Haemophilus influenzae Rd
uggagaacuucaa

SEQ ID NO: 2712951 - RNA, 18 nt, Haemophilus influenzae Rd
uggagauaauauuccaaa

SEQ ID NO: 2712952 - RNA, 20 nt, Haemophilus influenzae Rd
uggagcaguaugaugauugu

SEQ ID NO: 2712953 - RNA, 15 nt, Haemophilus influenzae Rd
uggaguuggcucgcc

SEQ ID NO: 2712954 - RNA, 17 nt, Haemophilus influenzae Rd
uggaguuguuuaaaauu

SEQ ID NO: 2712955 - RNA, 21 nt, Haemophilus influenzae Rd
uggaguuguuuaaaauuagua

SEQ ID NO: 2712956 - RNA, 18 nt, Haemophilus influenzae Rd
uggauaaauuauucugca

SEQ ID NO: 2712957 - RNA, 12 nt, Haemophilus influenzae Rd
uggauaauguuc

SEQ ID NO: 2712958 - RNA, 23 nt, Haemophilus influenzae Rd
uggauacacaaauugaagagauu

SEQ ID NO: 2712959 - RNA, 22 nt, Haemophilus influenzae Rd
uggauacauuccaucaaaacuu

SEQ ID NO: 2712960 - RNA, 22 nt, Haemophilus influenzae Rd
uggauauagaaaucauaaacug

SEQ ID NO: 2712961 - RNA, 14 nt, Haemophilus influenzae Rd
uggauauucugcau

SEQ ID NO: 2712962 - RNA, 23 nt, Haemophilus influenzae Rd
uggaucacccauuaaauaaaaau

SEQ ID NO: 2712963 - RNA, 18 nt, Haemophilus influenzae Rd
uggaucggcuauuucagc

SEQ ID NO: 2712964 - RNA, 14 nt, Haemophilus influenzae Rd
uggaucuaaaucug

SEQ ID NO: 2712965 - RNA, 21 nt, Haemophilus influenzae Rd
uggaucugugacgccauccaa

SEQ ID NO: 2712966 - RNA, 13 nt, Haemophilus influenzae Rd
uggaucuucagca

SEQ ID NO: 2712967 - RNA, 20 nt, Haemophilus influenzae Rd
uggaucuuccaauaauucuu

SEQ ID NO: 2712968 - RNA, 11 nt, Haemophilus influenzae Rd
uggaugaaauc

SEQ ID NO: 2712969 - RNA, 22 nt, Haemophilus influenzae Rd
uggaugaaaucauuuguaaguu

SEQ ID NO: 2712970 - RNA, 14 nt, Haemophilus influenzae Rd
uggauguaaauuga

SEQ ID NO: 2712971 - RNA, 15 nt, Haemophilus influenzae Rd
uggauuaaauaacca

SEQ ID NO: 2712972 - RNA, 14 nt, Haemophilus influenzae Rd
uggauuauuuagau

SEQ ID NO: 2712973 - RNA, 21 nt, Haemophilus influenzae Rd
uggauucauuugcaaaucaag

SEQ ID NO: 2712974 - RNA, 18 nt, Haemophilus influenzae Rd
uggauugauauuuggaua

SEQ ID NO: 2712975 - RNA, 21 nt, Haemophilus influenzae Rd
uggauugcaugaaauguagca

SEQ ID NO: 2712976 - RNA, 17 nt, Haemophilus influenzae Rd
uggauuggcaaugagca

SEQ ID NO: 2712977 - RNA, 17 nt, Haemophilus influenzae Rd
uggauuuacuuuaaugc

SEQ ID NO: 2712978 - RNA, 21 nt, Haemophilus influenzae Rd
uggauuugcaauccagugcau

SEQ ID NO: 2712979 - RNA, 14 nt, Haemophilus influenzae Rd
uggauuuuguaaua

SEQ ID NO: 2712980 - RNA, 15 nt, Haemophilus influenzae Rd
uggcaaaaaauacau

SEQ ID NO: 2712981 - RNA, 16 nt, Haemophilus influenzae Rd
uggcaaaaaugucagg

SEQ ID NO: 2712982 - RNA, 21 nt, Haemophilus influenzae Rd
uggcaaaaucucuggagaaaa

SEQ ID NO: 2712983 - RNA, 21 nt, Haemophilus influenzae Rd
uggcaaacucuugugccaaau

SEQ ID NO: 2712984 - RNA, 16 nt, Haemophilus influenzae Rd
uggcaauaauguugcu

SEQ ID NO: 2712985 - RNA, 15 nt, Haemophilus influenzae Rd
uggcaauauuuaaua

SEQ ID NO: 2712986 - RNA, 16 nt, Haemophilus influenzae Rd
uggcaauauuucaaua

SEQ ID NO: 2712987 - RNA, 22 nt, Haemophilus influenzae Rd
uggcaauuucccagccuacaac

SEQ ID NO: 2712988 - RNA, 15 nt, Haemophilus influenzae Rd
uggcacaacaucaga

SEQ ID NO: 2712989 - RNA, 19 nt, Haemophilus influenzae Rd
uggcacuaaagcaauauuu

SEQ ID NO: 2712990 - RNA, 13 nt, Haemophilus influenzae Rd
uggcauaucaauu

SEQ ID NO: 2712991 - RNA, 20 nt, Haemophilus influenzae Rd
uggcauauucgcaccuucag

SEQ ID NO: 2712992 - RNA, 23 nt, Haemophilus influenzae Rd
uggcauauucgcaccuucagcca

SEQ ID NO: 2712993 - RNA, 13 nt, Haemophilus influenzae Rd
uggcaucaauaau

SEQ ID NO: 2712994 - RNA, 14 nt, Haemophilus influenzae Rd
uggcaucaauauua

SEQ ID NO: 2712995 - RNA, 19 nt, Haemophilus influenzae Rd
uggcaucgugaugauuuuc

SEQ ID NO: 2712996 - RNA, 17 nt, Haemophilus influenzae Rd
uggcauugaaaccuaaa

SEQ ID NO: 2712997 - RNA, 16 nt, Haemophilus influenzae Rd
uggcauuuucaagccc

SEQ ID NO: 2712998 - RNA, 20 nt, Haemophilus influenzae Rd
uggcccgauauuuuggcuaa

SEQ ID NO: 2712999 - RNA, 17 nt, Haemophilus influenzae Rd
uggcgaauuugguuuug

SEQ ID NO: 2713000 - RNA, 22 nt, Haemophilus influenzae Rd
uggcgacagaggggauaaaaua

SEQ ID NO: 2713001 - RNA, 15 nt, Haemophilus influenzae Rd
uggcgaccauucucu

SEQ ID NO: 2713002 - RNA, 16 nt, Haemophilus influenzae Rd
uggcgauauucuccuu

SEQ ID NO: 2713003 - RNA, 15 nt, Haemophilus influenzae Rd
uggcggcaggcuuaa

SEQ ID NO: 2713004 - RNA, 17 nt, Haemophilus influenzae Rd
uggcggcguauugggcg

SEQ ID NO: 2713005 - RNA, 14 nt, Haemophilus influenzae Rd
uggcggguuucuuu

SEQ ID NO: 2713006 - RNA, 15 nt, Haemophilus influenzae Rd
uggcgguuuugccaa

SEQ ID NO: 2713007 - RNA, 16 nt, Haemophilus influenzae Rd
uggcgguuuuuuaauu

SEQ ID NO: 2713008 - RNA, 16 nt, Haemophilus influenzae Rd
uggcguaaugccauca

SEQ ID NO: 2713009 - RNA, 14 nt, Haemophilus influenzae Rd
uggcguaaugguuu

SEQ ID NO: 2713010 - RNA, 19 nt, Haemophilus influenzae Rd
uggcgucugcaauuagaaa

SEQ ID NO: 2713011 - RNA, 15 nt, Haemophilus influenzae Rd
uggcgugagauccuu

SEQ ID NO: 2713012 - RNA, 20 nt, Haemophilus influenzae Rd
uggcguggaggauuaauuac

SEQ ID NO: 2713013 - RNA, 23 nt, Haemophilus influenzae Rd
uggcguucugucuauuuauuuuc

SEQ ID NO: 2713014 - RNA, 16 nt, Haemophilus influenzae Rd
uggcuaacuucuucca

SEQ ID NO: 2713015 - RNA, 16 nt, Haemophilus influenzae Rd
uggcuaugucaauuac

SEQ ID NO: 2713016 - RNA, 16 nt, Haemophilus influenzae Rd
uggcucaaguauucag

SEQ ID NO: 2713017 - RNA, 17 nt, Haemophilus influenzae Rd
uggcucauuuuaaagag

SEQ ID NO: 2713018 - RNA, 12 nt, Haemophilus influenzae Rd
uggcuccgccac

SEQ ID NO: 2713019 - RNA, 19 nt, Haemophilus influenzae Rd
uggcucgcucuucagcuuc

SEQ ID NO: 2713020 - RNA, 21 nt, Haemophilus influenzae Rd
uggcucuacuuugcgccugua

SEQ ID NO: 2713021 - RNA, 15 nt, Haemophilus influenzae Rd
uggcugaaaaauuca

SEQ ID NO: 2713022 - RNA, 23 nt, Haemophilus influenzae Rd
uggcugagguuccccuaaaaaau

SEQ ID NO: 2713023 - RNA, 12 nt, Haemophilus influenzae Rd
uggcuuaauuac

SEQ ID NO: 2713024 - RNA, 14 nt, Haemophilus influenzae Rd
uggcuuaauuacua

SEQ ID NO: 2713025 - RNA, 13 nt, Haemophilus influenzae Rd
uggcuuacagcaa

SEQ ID NO: 2713026 - RNA, 17 nt, Haemophilus influenzae Rd
uggcuuacagcaaaagc

SEQ ID NO: 2713027 - RNA, 23 nt, Haemophilus influenzae Rd
uggcuuauuuacuuuauaaauga

SEQ ID NO: 2713028 - RNA, 18 nt, Haemophilus influenzae Rd
uggcuucaucuuuuaaca

SEQ ID NO: 2713029 - RNA, 23 nt, Haemophilus influenzae Rd
uggcuucgggcaccauuuaaaca

SEQ ID NO: 2713030 - RNA, 16 nt, Haemophilus influenzae Rd
uggcuugaaaauauuc

SEQ ID NO: 2713031 - RNA, 13 nt, Haemophilus influenzae Rd
uggcuugauuuua

SEQ ID NO: 2713032 - RNA, 20 nt, Haemophilus influenzae Rd
uggcuugcucuguauuuugu

SEQ ID NO: 2713033 - RNA, 17 nt, Haemophilus influenzae Rd
uggcuugugaaauaaaa

SEQ ID NO: 2713034 - RNA, 20 nt, Haemophilus influenzae Rd
uggcuugugaaauaaaauau

SEQ ID NO: 2713035 - RNA, 18 nt, Haemophilus influenzae Rd
uggcuuuaaagguuuaaa

SEQ ID NO: 2713036 - RNA, 19 nt, Haemophilus influenzae Rd
uggcuuuacgcauuuuuuc

SEQ ID NO: 2713037 - RNA, 16 nt, Haemophilus influenzae Rd
uggcuuucuuuuucaa

SEQ ID NO: 2713038 - RNA, 14 nt, Haemophilus influenzae Rd
uggcuuuuuucaua

SEQ ID NO: 2713039 - RNA, 21 nt, Haemophilus influenzae Rd
uggcuuuuuugccuuuuaaua

SEQ ID NO: 2713040 - RNA, 16 nt, Haemophilus influenzae Rd
ugggaaaguuggccaa

SEQ ID NO: 2713041 - RNA, 18 nt, Haemophilus influenzae Rd
ugggaauaauuuuggauc

SEQ ID NO: 2713042 - RNA, 14 nt, Haemophilus influenzae Rd
ugggaauucauaaa

SEQ ID NO: 2713043 - RNA, 14 nt, Haemophilus influenzae Rd
ugggaauuuuccca

SEQ ID NO: 2713044 - RNA, 20 nt, Haemophilus influenzae Rd
ugggacuggacuccaaggca

SEQ ID NO: 2713045 - RNA, 18 nt, Haemophilus influenzae Rd
ugggauaaacauuucuau

SEQ ID NO: 2713046 - RNA, 14 nt, Haemophilus influenzae Rd
ugggauaaauucau

SEQ ID NO: 2713047 - RNA, 19 nt, Haemophilus influenzae Rd
ugggauaauccauaucuca

SEQ ID NO: 2713048 - RNA, 14 nt, Haemophilus influenzae Rd
ugggaugaaaucaa

SEQ ID NO: 2713049 - RNA, 15 nt, Haemophilus influenzae Rd
ugggaugaaaucaaa

SEQ ID NO: 2713050 - RNA, 16 nt, Haemophilus influenzae Rd
uguaacguauuuaaaa

SEQ ID NO: 2713051 - RNA, 18 nt, Haemophilus influenzae Rd
uguaacguauuuaaaauc

SEQ ID NO: 2713052 - RNA, 17 nt, Haemophilus influenzae Rd
uguaacguuaaaugaac

SEQ ID NO: 2713053 - RNA, 16 nt, Haemophilus influenzae Rd
uguaagacacagggcu

SEQ ID NO: 2713054 - RNA, 15 nt, Haemophilus influenzae Rd
uguaagacgcauuac

SEQ ID NO: 2713055 - RNA, 21 nt, Haemophilus influenzae Rd
uguaagauaaacgcauagaaa

SEQ ID NO: 2713056 - RNA, 15 nt, Haemophilus influenzae Rd
uguaagcaacacaga

SEQ ID NO: 2713057 - RNA, 19 nt, Haemophilus influenzae Rd
uguaagcauuaaaaauuua

SEQ ID NO: 2713058 - RNA, 21 nt, Haemophilus influenzae Rd
uguaagcauuaaaaauuuaaa

SEQ ID NO: 2713059 - RNA, 23 nt, Haemophilus influenzae Rd
uguaaguguagcaauaaacagaa

SEQ ID NO: 2713060 - RNA, 17 nt, Haemophilus influenzae Rd
uguaauaaauuuuauua

SEQ ID NO: 2713061 - RNA, 18 nt, Haemophilus influenzae Rd
uguaauaaauuuuauuau

SEQ ID NO: 2713062 - RNA, 15 nt, Haemophilus influenzae Rd
uguaauaguaaaauu

SEQ ID NO: 2713063 - RNA, 14 nt, Haemophilus influenzae Rd
uguaauccaacgaa

SEQ ID NO: 2713064 - RNA, 15 nt, Haemophilus influenzae Rd
uguaaucuaaauauu

SEQ ID NO: 2713065 - RNA, 15 nt, Haemophilus influenzae Rd
uguaaugcaaaccau

SEQ ID NO: 2713066 - RNA, 15 nt, Haemophilus influenzae Rd
uguaaugcuuuuagu

SEQ ID NO: 2713067 - RNA, 15 nt, Haemophilus influenzae Rd
uguaauguuuuaaua

SEQ ID NO: 2713068 - RNA, 11 nt, Haemophilus influenzae Rd
uguaauuccau

SEQ ID NO: 2713069 - RNA, 17 nt, Haemophilus influenzae Rd
uguaauugauuuucaga

SEQ ID NO: 2713070 - RNA, 16 nt, Haemophilus influenzae Rd
uguaauuucauuuuaa

SEQ ID NO: 2713071 - RNA, 15 nt, Haemophilus influenzae Rd
uguaauuucucacca

SEQ ID NO: 2713072 - RNA, 17 nt, Haemophilus influenzae Rd
uguaauuucucaccaaa

SEQ ID NO: 2713073 - RNA, 14 nt, Haemophilus influenzae Rd
uguaauuugugcgu

SEQ ID NO: 2713074 - RNA, 23 nt, Haemophilus influenzae Rd
uguaauuuuuucucuuuuuauua

SEQ ID NO: 2713075 - RNA, 16 nt, Haemophilus influenzae Rd
uguacaacagcaauaa

SEQ ID NO: 2713076 - RNA, 17 nt, Haemophilus influenzae Rd
uguacaacagcaauaag

SEQ ID NO: 2713077 - RNA, 13 nt, Haemophilus influenzae Rd
uguacaagugcua

SEQ ID NO: 2713078 - RNA, 14 nt, Haemophilus influenzae Rd
uguacaccaaaaua

SEQ ID NO: 2713079 - RNA, 16 nt, Haemophilus influenzae Rd
uguacaccaaaauaac

SEQ ID NO: 2713080 - RNA, 18 nt, Haemophilus influenzae Rd
uguacaucccauauacuu

SEQ ID NO: 2713081 - RNA, 16 nt, Haemophilus influenzae Rd
uguaccacgguugaua

SEQ ID NO: 2713082 - RNA, 15 nt, Haemophilus influenzae Rd
uguaccugcauuuug

SEQ ID NO: 2713083 - RNA, 16 nt, Haemophilus influenzae Rd
uguaccuucugcugca

SEQ ID NO: 2713084 - RNA, 15 nt, Haemophilus influenzae Rd
uguacguccaugaac

SEQ ID NO: 2713085 - RNA, 20 nt, Haemophilus influenzae Rd
uguacguucaaaaagcuuaa

SEQ ID NO: 2713086 - RNA, 14 nt, Haemophilus influenzae Rd
uguacuauuuuaua

SEQ ID NO: 2713087 - RNA, 22 nt, Haemophilus influenzae Rd
uguacucaauaaggcuuuuuua

SEQ ID NO: 2713088 - RNA, 18 nt, Haemophilus influenzae Rd
uguacuggcucuucuuuc

SEQ ID NO: 2713089 - RNA, 20 nt, Haemophilus influenzae Rd
uguacuguugcgauuuccac

SEQ ID NO: 2713090 - RNA, 12 nt, Haemophilus influenzae Rd
uguacuuuagaa

SEQ ID NO: 2713091 - RNA, 13 nt, Haemophilus influenzae Rd
uguagaaaggcaa

SEQ ID NO: 2713092 - RNA, 19 nt, Haemophilus influenzae Rd
uguagagauaauaaauaua

SEQ ID NO: 2713093 - RNA, 15 nt, Haemophilus influenzae Rd
uguagauaaaauauu

SEQ ID NO: 2713094 - RNA, 13 nt, Haemophilus influenzae Rd
uguagauaaugau

SEQ ID NO: 2713095 - RNA, 15 nt, Haemophilus influenzae Rd
uguagcuugaauauu

SEQ ID NO: 2713096 - RNA, 13 nt, Haemophilus influenzae Rd
uguaggcaaaaac

SEQ ID NO: 2713097 - RNA, 14 nt, Haemophilus influenzae Rd
uguaggcucuuucg

SEQ ID NO: 2713098 - RNA, 21 nt, Haemophilus influenzae Rd
uguaguagauaacaacuaaaa

SEQ ID NO: 2713099 - RNA, 23 nt, Haemophilus influenzae Rd
uguaguagauaacaacuaaaaau

SEQ ID NO: 2713100 - RNA, 23 nt, Haemophilus influenzae Rd
uguagucacuauuaauguuauua

SEQ ID NO: 2713101 - RNA, 17 nt, Haemophilus influenzae Rd
uguaguuggaacugauu

SEQ ID NO: 2713102 - RNA, 17 nt, Haemophilus influenzae Rd
uguaguuggaucauuau

SEQ ID NO: 2713103 - RNA, 21 nt, Haemophilus influenzae Rd
uguaguuggaucauuauccaa

SEQ ID NO: 2713104 - RNA, 12 nt, Haemophilus influenzae Rd
uguauaaaaauu

SEQ ID NO: 2713105 - RNA, 14 nt, Haemophilus influenzae Rd
uguauaaauauuua

SEQ ID NO: 2713106 - RNA, 23 nt, Haemophilus influenzae Rd
uguauaacaaauaggauaaaaau

SEQ ID NO: 2713107 - RNA, 13 nt, Haemophilus influenzae Rd
uguauaagauuaa

SEQ ID NO: 2713108 - RNA, 14 nt, Haemophilus influenzae Rd
uguauaagauuaau

SEQ ID NO: 2713109 - RNA, 16 nt, Haemophilus influenzae Rd
uguauaauuccuaaaa

SEQ ID NO: 2713110 - RNA, 14 nt, Haemophilus influenzae Rd
uguauaauuuuuca

SEQ ID NO: 2713111 - RNA, 21 nt, Haemophilus influenzae Rd
uguauagaacgguuaugaaaa

SEQ ID NO: 2713112 - RNA, 16 nt, Haemophilus influenzae Rd
uguauauuuuuaauuu

SEQ ID NO: 2713113 - RNA, 18 nt, Haemophilus influenzae Rd
uguaucaauuccuucaaa

SEQ ID NO: 2713114 - RNA, 22 nt, Haemophilus influenzae Rd
uguaucaauuccuucaaauucu

SEQ ID NO: 2713115 - RNA, 16 nt, Haemophilus influenzae Rd
uguaucugauuuuuua

SEQ ID NO: 2713116 - RNA, 16 nt, Haemophilus influenzae Rd
uguaugaaaaaugcuu

SEQ ID NO: 2713117 - RNA, 20 nt, Haemophilus influenzae Rd
uguauguggcguacaacgug

SEQ ID NO: 2713118 - RNA, 15 nt, Haemophilus influenzae Rd
uguauuaaagguuau

SEQ ID NO: 2713119 - RNA, 21 nt, Haemophilus influenzae Rd
uguauuaaguaaauauuuuuu

SEQ ID NO: 2713120 - RNA, 16 nt, Haemophilus influenzae Rd
uguauuagaaguaaau

SEQ ID NO: 2713121 - RNA, 18 nt, Haemophilus influenzae Rd
uguauuggaaaaguucag

SEQ ID NO: 2713122 - RNA, 18 nt, Haemophilus influenzae Rd
uguauuuuaugcuggauu

SEQ ID NO: 2713123 - RNA, 16 nt, Haemophilus influenzae Rd
uguauuuugugagggc

SEQ ID NO: 2713124 - RNA, 13 nt, Haemophilus influenzae Rd
uguauuuuucaua

SEQ ID NO: 2713125 - RNA, 14 nt, Haemophilus influenzae Rd
uguauuuuuuauuu

SEQ ID NO: 2713126 - RNA, 13 nt, Haemophilus influenzae Rd
ugucaaaauuacg

SEQ ID NO: 2713127 - RNA, 19 nt, Haemophilus influenzae Rd
ugucaaaauugaugaaaau

SEQ ID NO: 2713128 - RNA, 12 nt, Haemophilus influenzae Rd
ugucaauaauag

SEQ ID NO: 2713129 - RNA, 13 nt, Haemophilus influenzae Rd
ugucaauuuuucu

SEQ ID NO: 2713130 - RNA, 20 nt, Haemophilus influenzae Rd
ugucacagcaagaacagcca

SEQ ID NO: 2713131 - RNA, 14 nt, Haemophilus influenzae Rd
ugucacauaaucag

SEQ ID NO: 2713132 - RNA, 18 nt, Haemophilus influenzae Rd
ugucaccaaauacauuuu

SEQ ID NO: 2713133 - RNA, 19 nt, Haemophilus influenzae Rd
ugucacuagauuuucuuca

SEQ ID NO: 2713134 - RNA, 14 nt, Haemophilus influenzae Rd
ugucagauuuaccc

SEQ ID NO: 2713135 - RNA, 23 nt, Haemophilus influenzae Rd
ugucagauuuauaaauaggcuca

SEQ ID NO: 2713136 - RNA, 15 nt, Haemophilus influenzae Rd
ugucaguaacuacaa

SEQ ID NO: 2713137 - RNA, 13 nt, Haemophilus influenzae Rd
ugucaguuugcuu

SEQ ID NO: 2713138 - RNA, 21 nt, Haemophilus influenzae Rd
ugucaucagaaauaucuucaa

SEQ ID NO: 2713139 - RNA, 16 nt, Haemophilus influenzae Rd
ugucaucuaguaccug

SEQ ID NO: 2713140 - RNA, 20 nt, Haemophilus influenzae Rd
ugucaucuaguaccugauuu

SEQ ID NO: 2713141 - RNA, 20 nt, Haemophilus influenzae Rd
ugucaugacuauuacaauug

SEQ ID NO: 2713142 - RNA, 13 nt, Haemophilus influenzae Rd
ugucauuaaaaaa

SEQ ID NO: 2713143 - RNA, 16 nt, Haemophilus influenzae Rd
ugucauuaaaaaauaa

SEQ ID NO: 2713144 - RNA, 20 nt, Haemophilus influenzae Rd
ugucauuuauggaaauaaau

SEQ ID NO: 2713145 - RNA, 16 nt, Haemophilus influenzae Rd
uguccauaacugucaa

SEQ ID NO: 2713146 - RNA, 14 nt, Haemophilus influenzae Rd
ugucccaaaauauu

SEQ ID NO: 2713147 - RNA, 16 nt, Haemophilus influenzae Rd
uguccgccaccaaaau

SEQ ID NO: 2713148 - RNA, 15 nt, Haemophilus influenzae Rd
uguccucccauucuu

SEQ ID NO: 2713149 - RNA, 14 nt, Haemophilus influenzae Rd
ugucgaaauuuuuc

SEQ ID NO: 2713150 - RNA, 16 nt, Haemophilus influenzae Rd
ugucgcagaauggugc

SEQ ID NO: 2713151 - RNA, 19 nt, Haemophilus influenzae Rd
ugucgcaggugucacagca

SEQ ID NO: 2713152 - RNA, 21 nt, Haemophilus influenzae Rd
ugucgcagucuguuuggcuaa

SEQ ID NO: 2713153 - RNA, 20 nt, Haemophilus influenzae Rd
ugucgcuacaucaacacaac

SEQ ID NO: 2713154 - RNA, 19 nt, Haemophilus influenzae Rd
ugucgcuucuaauucugca

SEQ ID NO: 2713155 - RNA, 22 nt, Haemophilus influenzae Rd
ugucgcuucuaauucugcacga

SEQ ID NO: 2713156 - RNA, 22 nt, Haemophilus influenzae Rd
uguucugauuacuuaaaguuau

SEQ ID NO: 2713157 - RNA, 14 nt, Haemophilus influenzae Rd
uguucugcaucaau

SEQ ID NO: 2713158 - RNA, 15 nt, Haemophilus influenzae Rd
uguucugcaucaaua

SEQ ID NO: 2713159 - RNA, 20 nt, Haemophilus influenzae Rd
uguugaaacagguaauuucu

SEQ ID NO: 2713160 - RNA, 21 nt, Haemophilus influenzae Rd
uguugaauaguaaagaauauu

SEQ ID NO: 2713161 - RNA, 21 nt, Haemophilus influenzae Rd
uguugaaugccauucucccug

SEQ ID NO: 2713162 - RNA, 17 nt, Haemophilus influenzae Rd
uguugaauuggaaguuu

SEQ ID NO: 2713163 - RNA, 22 nt, Haemophilus influenzae Rd
uguugauugacuuguuuuaaaa

SEQ ID NO: 2713164 - RNA, 13 nt, Haemophilus influenzae Rd
uguugauuuauca

SEQ ID NO: 2713165 - RNA, 12 nt, Haemophilus influenzae Rd
uguugauuucua

SEQ ID NO: 2713166 - RNA, 13 nt, Haemophilus influenzae Rd
uguugcaauaauc

SEQ ID NO: 2713167 - RNA, 23 nt, Haemophilus influenzae Rd
uguugcaauaccuagacgauugc

SEQ ID NO: 2713168 - RNA, 23 nt, Haemophilus influenzae Rd
uguugcaaugacaguuucgccug

SEQ ID NO: 2713169 - RNA, 24 nt, Haemophilus influenzae Rd
uguugcagggaaagucgcaguauu

SEQ ID NO: 2713170 - RNA, 16 nt, Haemophilus influenzae Rd
uguugcauuucuaaau

SEQ ID NO: 2713171 - RNA, 21 nt, Haemophilus influenzae Rd
uguugccaguaacuuucuuca

SEQ ID NO: 2713172 - RNA, 20 nt, Haemophilus influenzae Rd
uguugccauuguuaaauguu

SEQ ID NO: 2713173 - RNA, 15 nt, Haemophilus influenzae Rd
uguugcccuagugca

SEQ ID NO: 2713174 - RNA, 21 nt, Haemophilus influenzae Rd
uguugccuaucgguucgccau

SEQ ID NO: 2713175 - RNA, 18 nt, Haemophilus influenzae Rd
uguugcuugaauggcuau

SEQ ID NO: 2713176 - RNA, 19 nt, Haemophilus influenzae Rd
uguugcuuggucaaguuau

SEQ ID NO: 2713177 - RNA, 15 nt, Haemophilus influenzae Rd
uguuggaaaaaugcu

SEQ ID NO: 2713178 - RNA, 14 nt, Haemophilus influenzae Rd
uguuggaaauuuaa

SEQ ID NO: 2713179 - RNA, 17 nt, Haemophilus influenzae Rd
uguuggaacguuuaaau

SEQ ID NO: 2713180 - RNA, 14 nt, Haemophilus influenzae Rd
uguuggaauuucaa

SEQ ID NO: 2713181 - RNA, 14 nt, Haemophilus influenzae Rd
uguuggauaucuug

SEQ ID NO: 2713182 - RNA, 19 nt, Haemophilus influenzae Rd
uguuguaauccauuuugaa

SEQ ID NO: 2713183 - RNA, 12 nt, Haemophilus influenzae Rd
uguuguacuuua

SEQ ID NO: 2713184 - RNA, 20 nt, Haemophilus influenzae Rd
uguugugaaguuuuuuaagu

SEQ ID NO: 2713185 - RNA, 22 nt, Haemophilus influenzae Rd
uguugugaguaagucuucuuua

SEQ ID NO: 2713186 - RNA, 21 nt, Haemophilus influenzae Rd
uguuguggcaucucaaggcga

SEQ ID NO: 2713187 - RNA, 19 nt, Haemophilus influenzae Rd
uguuguucuaacauuuuuu

SEQ ID NO: 2713188 - RNA, 12 nt, Haemophilus influenzae Rd
uguuguucuuuc

SEQ ID NO: 2713189 - RNA, 17 nt, Haemophilus influenzae Rd
uguuguuuaauaagccu

SEQ ID NO: 2713190 - RNA, 15 nt, Haemophilus influenzae Rd
uguuguuuuggcugg

SEQ ID NO: 2713191 - RNA, 11 nt, Haemophilus influenzae Rd
uguuuaaaagc

SEQ ID NO: 2713192 - RNA, 12 nt, Haemophilus influenzae Rd
uguuuaaauggu

SEQ ID NO: 2713193 - RNA, 17 nt, Haemophilus influenzae Rd
uguuuaauuauagaaaa

SEQ ID NO: 2713194 - RNA, 22 nt, Haemophilus influenzae Rd
uguuuaauucgugccacaugau

SEQ ID NO: 2713195 - RNA, 23 nt, Haemophilus influenzae Rd
uguuuaauuggaaauaauauuca

SEQ ID NO: 2713196 - RNA, 19 nt, Haemophilus influenzae Rd
uguuuaccaccgauaaaca

SEQ ID NO: 2713197 - RNA, 17 nt, Haemophilus influenzae Rd
uguuuacgcuaauuuaa

SEQ ID NO: 2713198 - RNA, 17 nt, Haemophilus influenzae Rd
uguuuacuauuaauucu

SEQ ID NO: 2713199 - RNA, 13 nt, Haemophilus influenzae Rd
uguuuagauuuua

SEQ ID NO: 2713200 - RNA, 13 nt, Haemophilus influenzae Rd
uguuuaguuuuau

SEQ ID NO: 2713201 - RNA, 14 nt, Haemophilus influenzae Rd
uguuuaguuuuaua

SEQ ID NO: 2713202 - RNA, 19 nt, Haemophilus influenzae Rd
uguuuauaacguuaauuca

SEQ ID NO: 2713203 - RNA, 22 nt, Haemophilus influenzae Rd
uguuuauaacguuaauucaaac

SEQ ID NO: 2713204 - RNA, 22 nt, Haemophilus influenzae Rd
uguuuauauucuggcaauauuu

SEQ ID NO: 2713205 - RNA, 22 nt, Haemophilus influenzae Rd
uguuuaucaggcggguauuuau

SEQ ID NO: 2713206 - RNA, 14 nt, Haemophilus influenzae Rd
uguuuauuuaacaa

SEQ ID NO: 2713207 - RNA, 17 nt, Haemophilus influenzae Rd
uguuucaacaaaaauac

SEQ ID NO: 2713208 - RNA, 18 nt, Haemophilus influenzae Rd
uguuucaacaaaaauacg

SEQ ID NO: 2713209 - RNA, 14 nt, Haemophilus influenzae Rd
uguuucaauucucc

SEQ ID NO: 2713210 - RNA, 20 nt, Haemophilus influenzae Rd
uguuucacaaguucuugcgc

SEQ ID NO: 2713211 - RNA, 21 nt, Haemophilus influenzae Rd
uguuucacgaucauaaauuuu

SEQ ID NO: 2713212 - RNA, 13 nt, Haemophilus influenzae Rd
uguuucacuuugc

SEQ ID NO: 2713213 - RNA, 13 nt, Haemophilus influenzae Rd
uguuucaucauuc

SEQ ID NO: 2713214 - RNA, 16 nt, Haemophilus influenzae Rd
uguuucgauacuuucu

SEQ ID NO: 2713215 - RNA, 17 nt, Haemophilus influenzae Rd
uguuucgauacuuucuu

SEQ ID NO: 2713216 - RNA, 21 nt, Haemophilus influenzae Rd
uguuucgcaguguuaaaugca

SEQ ID NO: 2713217 - RNA, 12 nt, Haemophilus influenzae Rd
uguuucucucua

SEQ ID NO: 2713218 - RNA, 15 nt, Haemophilus influenzae Rd
uguuucuucucuuua

SEQ ID NO: 2713219 - RNA, 17 nt, Haemophilus influenzae Rd
uguuucuuuaaauaguu

SEQ ID NO: 2713220 - RNA, 18 nt, Haemophilus influenzae Rd
uguuugaaaauucuucua

SEQ ID NO: 2713221 - RNA, 22 nt, Haemophilus influenzae Rd
uguuugaaaucaaauugaucaa

SEQ ID NO: 2713222 - RNA, 18 nt, Haemophilus influenzae Rd
uguuugaacgcuauuaag

SEQ ID NO: 2713223 - RNA, 23 nt, Haemophilus influenzae Rd
uguuugaacuauauccaaaucaa

SEQ ID NO: 2713224 - RNA, 17 nt, Haemophilus influenzae Rd
uguuugauaaauaucuu

SEQ ID NO: 2713225 - RNA, 19 nt, Haemophilus influenzae Rd
uguuugcgaguaacgucua

SEQ ID NO: 2713226 - RNA, 21 nt, Haemophilus influenzae Rd
uguuugcggaaacauaucaaa

SEQ ID NO: 2713227 - RNA, 21 nt, Haemophilus influenzae Rd
uguuuguaauaaauuuuauua

SEQ ID NO: 2713228 - RNA, 19 nt, Haemophilus influenzae Rd
uguuugugcguuuuuuaau

SEQ ID NO: 2713229 - RNA, 14 nt, Haemophilus influenzae Rd
uguuuguuuuauuu

SEQ ID NO: 2713230 - RNA, 16 nt, Haemophilus influenzae Rd
uguuuguuuuauuuau

SEQ ID NO: 2713231 - RNA, 20 nt, Haemophilus influenzae Rd
uguuuuaaaacuauuuuuaa

SEQ ID NO: 2713232 - RNA, 21 nt, Haemophilus influenzae Rd
uguuuuaaaacuauuuuuaau

SEQ ID NO: 2713233 - RNA, 22 nt, Haemophilus influenzae Rd
uguuuuaaaacuauuuuuaauu

SEQ ID NO: 2713234 - RNA, 12 nt, Haemophilus influenzae Rd
uguuuuaaaauu

SEQ ID NO: 2713235 - RNA, 16 nt, Haemophilus influenzae Rd
uguuuuaaaucuucua

SEQ ID NO: 2713236 - RNA, 11 nt, Haemophilus influenzae Rd
uguuuuaaccg

SEQ ID NO: 2713237 - RNA, 19 nt, Haemophilus influenzae Rd
uguuuuaauuuuaguuauc

SEQ ID NO: 2713238 - RNA, 22 nt, Haemophilus influenzae Rd
uguuuuaccaccgcuaaaucau

SEQ ID NO: 2713239 - RNA, 14 nt, Haemophilus influenzae Rd
uguuuuaucagaau

SEQ ID NO: 2713240 - RNA, 17 nt, Haemophilus influenzae Rd
uguuuuaucuuuuacau

SEQ ID NO: 2713241 - RNA, 14 nt, Haemophilus influenzae Rd
uguuuuauuuauag

SEQ ID NO: 2713242 - RNA, 14 nt, Haemophilus influenzae Rd
uguuuuauuuauca

SEQ ID NO: 2713243 - RNA, 17 nt, Haemophilus influenzae Rd
uguuuucaauuuuaaaa

SEQ ID NO: 2713244 - RNA, 22 nt, Haemophilus influenzae Rd
uguuuuccaaacauuuuuauuu

SEQ ID NO: 2713245 - RNA, 18 nt, Haemophilus influenzae Rd
uguuuucccccaguacau

SEQ ID NO: 2713246 - RNA, 17 nt, Haemophilus influenzae Rd
uguuuucgaucauuuga

SEQ ID NO: 2713247 - RNA, 21 nt, Haemophilus influenzae Rd
uguuuucgucacaaugauuaa

SEQ ID NO: 2713248 - RNA, 17 nt, Haemophilus influenzae Rd
uguuuugcaauaaaguu

SEQ ID NO: 2713249 - RNA, 11 nt, Haemophilus influenzae Rd
uguuuuggaua

SEQ ID NO: 2713250 - RNA, 18 nt, Haemophilus influenzae Rd
uguuuuggcauuuucaau

SEQ ID NO: 2713251 - RNA, 13 nt, Haemophilus influenzae Rd
uguuuuucaucaa

SEQ ID NO: 2713252 - RNA, 19 nt, Haemophilus influenzae Rd
uguuuuuccaauucuuuua

SEQ ID NO: 2713253 - RNA, 21 nt, Haemophilus influenzae Rd
uguuuuucccacaaagguaaa

SEQ ID NO: 2713254 - RNA, 22 nt, Haemophilus influenzae Rd
uguuuuucgcguucuuucgcaa

SEQ ID NO: 2713255 - RNA, 16 nt, Haemophilus influenzae Rd
uguuuuuucauauuuu

SEQ ID NO: 2713256 - RNA, 19 nt, Haemophilus influenzae Rd
uguuuuuucauauuuuaaa

SEQ ID NO: 2713257 - RNA, 15 nt, Haemophilus influenzae Rd
uguuuuuuucuaaau

SEQ ID NO: 2713258 - RNA, 19 nt, Haemophilus influenzae Rd
uuaaaaaaacguuaaauuu

SEQ ID NO: 2713259 - RNA, 20 nt, Haemophilus influenzae Rd
uuaaaaaauaaauuuaaauu

SEQ ID NO: 2713260 - RNA, 16 nt, Haemophilus influenzae Rd
uuaaaaaauaauuuag

SEQ ID NO: 2713261 - RNA, 19 nt, Haemophilus influenzae Rd
uuaaaucuucuaucuacua

SEQ ID NO: 2713262 - RNA, 21 nt, Haemophilus influenzae Rd
uuaaaucuuuaccuuguaaac

SEQ ID NO: 2713263 - RNA, 12 nt, Haemophilus influenzae Rd
uuaaaugaaguu

SEQ ID NO: 2713264 - RNA, 21 nt, Haemophilus influenzae Rd
uuaaaugaaguuuuacugauu

SEQ ID NO: 2713265 - RNA, 18 nt, Haemophilus influenzae Rd
uuaaaugauuaucuugua

SEQ ID NO: 2713266 - RNA, 19 nt, Haemophilus influenzae Rd
uuaaaugggacaaagcagu

SEQ ID NO: 2713267 - RNA, 17 nt, Haemophilus influenzae Rd
uuaaauguuaauggcuu

SEQ ID NO: 2713268 - RNA, 12 nt, Haemophilus influenzae Rd
uuaaauuaaaaa

SEQ ID NO: 2713269 - RNA, 14 nt, Haemophilus influenzae Rd
uuaaauuaaaaaga

SEQ ID NO: 2713270 - RNA, 21 nt, Haemophilus influenzae Rd
uuaaauuagacuaauuuuuua

SEQ ID NO: 2713271 - RNA, 20 nt, Haemophilus influenzae Rd
uuaaauuagcguaaacauuu

SEQ ID NO: 2713272 - RNA, 13 nt, Haemophilus influenzae Rd
uuaaauuauacau

SEQ ID NO: 2713273 - RNA, 19 nt, Haemophilus influenzae Rd
uuaaauuauagauaaauau

SEQ ID NO: 2713274 - RNA, 21 nt, Haemophilus influenzae Rd
uuaaauuauauuuuccuguua

SEQ ID NO: 2713275 - RNA, 14 nt, Haemophilus influenzae Rd
uuaaauuauuuuuu

SEQ ID NO: 2713276 - RNA, 20 nt, Haemophilus influenzae Rd
uuaaauucaucgcaucacgc

SEQ ID NO: 2713277 - RNA, 13 nt, Haemophilus influenzae Rd
uuaaauugaaaaa

SEQ ID NO: 2713278 - RNA, 17 nt, Haemophilus influenzae Rd
uuaaauugaaaaaauaa

SEQ ID NO: 2713279 - RNA, 22 nt, Haemophilus influenzae Rd
uuaaauugaacugaauuaaaaa

SEQ ID NO: 2713280 - RNA, 22 nt, Haemophilus influenzae Rd
uuaaauuuaguuaauauauuca

SEQ ID NO: 2713281 - RNA, 12 nt, Haemophilus influenzae Rd
uuaaauuuauca

SEQ ID NO: 2713282 - RNA, 23 nt, Haemophilus influenzae Rd
uuaaauuuauuuuuuaaaacuua

SEQ ID NO: 2713283 - RNA, 14 nt, Haemophilus influenzae Rd
uuaaauuuuaaaaa

SEQ ID NO: 2713284 - RNA, 15 nt, Haemophilus influenzae Rd
uuaaauuuuaaaaaa

SEQ ID NO: 2713285 - RNA, 18 nt, Haemophilus influenzae Rd
uuaaauuuuaaaaaauaa

SEQ ID NO: 2713286 - RNA, 16 nt, Haemophilus influenzae Rd
uuaaauuuuuaauaaa

SEQ ID NO: 2713287 - RNA, 22 nt, Haemophilus influenzae Rd
uuaaauuuuuaaugcuuacaaa

SEQ ID NO: 2713288 - RNA, 15 nt, Haemophilus influenzae Rd
uuaaauuuuuaauuu

SEQ ID NO: 2713289 - RNA, 22 nt, Haemophilus influenzae Rd
uuaacaaaacagacugaaauuc

SEQ ID NO: 2713290 - RNA, 13 nt, Haemophilus influenzae Rd
uuaacaaauaauu

SEQ ID NO: 2713291 - RNA, 20 nt, Haemophilus influenzae Rd
uuaacaaauacaucuucaca

SEQ ID NO: 2713292 - RNA, 21 nt, Haemophilus influenzae Rd
uuaacaauaaugugagaauaa

SEQ ID NO: 2713293 - RNA, 12 nt, Haemophilus influenzae Rd
uuaacaauuacu

SEQ ID NO: 2713294 - RNA, 18 nt, Haemophilus influenzae Rd
uuaacacaugcaagucga

SEQ ID NO: 2713295 - RNA, 16 nt, Haemophilus influenzae Rd
uuaacacgaaaccaac

SEQ ID NO: 2713296 - RNA, 23 nt, Haemophilus influenzae Rd
uuaacacgaaaccaacgaaaaua

SEQ ID NO: 2713297 - RNA, 19 nt, Haemophilus influenzae Rd
uuaacaggaauuugcucaa

SEQ ID NO: 2713298 - RNA, 18 nt, Haemophilus influenzae Rd
uuaacauaacuuuccaua

SEQ ID NO: 2713299 - RNA, 20 nt, Haemophilus influenzae Rd
uuaacauaacuuuccauaua

SEQ ID NO: 2713300 - RNA, 20 nt, Haemophilus influenzae Rd
uuaacaucuuaguauuuuau

SEQ ID NO: 2713301 - RNA, 18 nt, Haemophilus influenzae Rd
uuaacauuaauaaaccaa

SEQ ID NO: 2713302 - RNA, 12 nt, Haemophilus influenzae Rd
uuaacauuuucu

SEQ ID NO: 2713303 - RNA, 13 nt, Haemophilus influenzae Rd
uuaaccauaaaaa

SEQ ID NO: 2713304 - RNA, 16 nt, Haemophilus influenzae Rd
uuaacccauuuauuua

SEQ ID NO: 2713305 - RNA, 20 nt, Haemophilus influenzae Rd
uuaaccgcacuuuaaauauu

SEQ ID NO: 2713306 - RNA, 21 nt, Haemophilus influenzae Rd
uuaaccgcacuuuuaauuaau

SEQ ID NO: 2713307 - RNA, 22 nt, Haemophilus influenzae Rd
uuaaccgcacuuuuuguuuuau

SEQ ID NO: 2713308 - RNA, 17 nt, Haemophilus influenzae Rd
uuaaccguaauuucaaa

SEQ ID NO: 2713309 - RNA, 14 nt, Haemophilus influenzae Rd
uuaaccuacaacaa

SEQ ID NO: 2713310 - RNA, 18 nt, Haemophilus influenzae Rd
uuaaccugauuaaucaaa

SEQ ID NO: 2713311 - RNA, 16 nt, Haemophilus influenzae Rd
uuaacgcucaaaaauu

SEQ ID NO: 2713312 - RNA, 17 nt, Haemophilus influenzae Rd
uuaacgcucaaaaauuu

SEQ ID NO: 2713313 - RNA, 20 nt, Haemophilus influenzae Rd
uuaacguaagaaauaacgau

SEQ ID NO: 2713314 - RNA, 14 nt, Haemophilus influenzae Rd
uuaacguuauaaac

SEQ ID NO: 2713315 - RNA, 23 nt, Haemophilus influenzae Rd
uuaacuauucaaaugaaauguuu

SEQ ID NO: 2713316 - RNA, 18 nt, Haemophilus influenzae Rd
uuaacuauuuuuuauuua

SEQ ID NO: 2713317 - RNA, 23 nt, Haemophilus influenzae Rd
uuaacuauuuuuuauuuauauaa

SEQ ID NO: 2713318 - RNA, 20 nt, Haemophilus influenzae Rd
uuaacucaggugugccauca

SEQ ID NO: 2713319 - RNA, 16 nt, Haemophilus influenzae Rd
uuaacugaaaauuagu

SEQ ID NO: 2713320 - RNA, 18 nt, Haemophilus influenzae Rd
uuaacugaaaauucauca

SEQ ID NO: 2713321 - RNA, 21 nt, Haemophilus influenzae Rd
uuaacugaaaauucauuauua

SEQ ID NO: 2713322 - RNA, 15 nt, Haemophilus influenzae Rd
uuaacugcuuuaaua

SEQ ID NO: 2713323 - RNA, 20 nt, Haemophilus influenzae Rd
uuaacugcuuuuuuccagcc

SEQ ID NO: 2713324 - RNA, 17 nt, Haemophilus influenzae Rd
uuaacuuaaucuccaau

SEQ ID NO: 2713325 - RNA, 13 nt, Haemophilus influenzae Rd
uuaacuucaacca

SEQ ID NO: 2713326 - RNA, 15 nt, Haemophilus influenzae Rd
uuaacuucuaaagua

SEQ ID NO: 2713327 - RNA, 22 nt, Haemophilus influenzae Rd
uuaacuugcuauuuucuaauuu

SEQ ID NO: 2713328 - RNA, 17 nt, Haemophilus influenzae Rd
uuaacuugcucugguug

SEQ ID NO: 2713329 - RNA, 15 nt, Haemophilus influenzae Rd
uuaacuuuuuuauuu

SEQ ID NO: 2713330 - RNA, 14 nt, Haemophilus influenzae Rd
uuaagaaaaaauau

SEQ ID NO: 2713331 - RNA, 19 nt, Haemophilus influenzae Rd
uuaagaaaaucguaucuuu

SEQ ID NO: 2713332 - RNA, 12 nt, Haemophilus influenzae Rd
uuaagaaaauug

SEQ ID NO: 2713333 - RNA, 13 nt, Haemophilus influenzae Rd
uuaagaaagaaac

SEQ ID NO: 2713334 - RNA, 18 nt, Haemophilus influenzae Rd
uuaagagaggagaaauaa

SEQ ID NO: 2713335 - RNA, 23 nt, Haemophilus influenzae Rd
uuaagauaaguggggaaaaauau

SEQ ID NO: 2713336 - RNA, 11 nt, Haemophilus influenzae Rd
uuaagaucuaa

SEQ ID NO: 2713337 - RNA, 15 nt, Haemophilus influenzae Rd
uuaagauuuacagaa

SEQ ID NO: 2713338 - RNA, 19 nt, Haemophilus influenzae Rd
uuaagauuuacagaacaaa

SEQ ID NO: 2713339 - RNA, 20 nt, Haemophilus influenzae Rd
uuaagauuuacagaacaaaa

SEQ ID NO: 2713340 - RNA, 16 nt, Haemophilus influenzae Rd
uuaagcaauugaauaa

SEQ ID NO: 2713341 - RNA, 17 nt, Haemophilus influenzae Rd
uuaagcaauugaauaaa

SEQ ID NO: 2713342 - RNA, 15 nt, Haemophilus influenzae Rd
uuaagcaccaucaua

SEQ ID NO: 2713343 - RNA, 22 nt, Haemophilus influenzae Rd
uuaagcauccaucgacauacaa

SEQ ID NO: 2713344 - RNA, 14 nt, Haemophilus influenzae Rd
uuaagccugauagc

SEQ ID NO: 2713345 - RNA, 20 nt, Haemophilus influenzae Rd
uuaaggauuuuugaauuuca

SEQ ID NO: 2713346 - RNA, 20 nt, Haemophilus influenzae Rd
uuaaggcacagauuaaagug

SEQ ID NO: 2713347 - RNA, 23 nt, Haemophilus influenzae Rd
uuaagggcgcagacugcauaucc

SEQ ID NO: 2713348 - RNA, 19 nt, Haemophilus influenzae Rd
uuaagguuucuucuaaagc

SEQ ID NO: 2713349 - RNA, 21 nt, Haemophilus influenzae Rd
uuaagguuucuucuaaagcga

SEQ ID NO: 2713350 - RNA, 15 nt, Haemophilus influenzae Rd
uuaaguaaauauuuu

SEQ ID NO: 2713351 - RNA, 21 nt, Haemophilus influenzae Rd
uuaaguaguauuuuauuuaua

SEQ ID NO: 2713352 - RNA, 19 nt, Haemophilus influenzae Rd
uuaaguaguguuuuauuua

SEQ ID NO: 2713353 - RNA, 14 nt, Haemophilus influenzae Rd
uuaagucaaaaauu

SEQ ID NO: 2713354 - RNA, 18 nt, Haemophilus influenzae Rd
uuaagucagcauaaacaa

SEQ ID NO: 2713355 - RNA, 20 nt, Haemophilus influenzae Rd
uuaagucgauaaagaaugca

SEQ ID NO: 2713356 - RNA, 15 nt, Haemophilus influenzae Rd
uuaagugaauuuaua

SEQ ID NO: 2713357 - RNA, 21 nt, Haemophilus influenzae Rd
uuaagugaucuugauccccau

SEQ ID NO: 2713358 - RNA, 13 nt, Haemophilus influenzae Rd
uuaagugcaacug

SEQ ID NO: 2713359 - RNA, 22 nt, Haemophilus influenzae Rd
uuaagugcgguauuuuuauuua

SEQ ID NO: 2713360 - RNA, 19 nt, Haemophilus influenzae Rd
uuaagugcguguauauauu

SEQ ID NO: 2713361 - RNA, 15 nt, Haemophilus influenzae Rd
uuaaguguuuacuau

SEQ ID NO: 2713362 - RNA, 16 nt, Haemophilus influenzae Rd
uuaaguguuuacuauu

SEQ ID NO: 2713363 - RNA, 17 nt, Haemophilus influenzae Rd
uuaaguguuuacuauua

SEQ ID NO: 2713364 - RNA, 13 nt, Haemophilus influenzae Rd
uuaaguuaaaagu

SEQ ID NO: 2713365 - RNA, 14 nt, Haemophilus influenzae Rd
uuaaguucaucaua

SEQ ID NO: 2713366 - RNA, 15 nt, Haemophilus influenzae Rd
uuaauuuaaauaaag

SEQ ID NO: 2713367 - RNA, 23 nt, Haemophilus influenzae Rd
uuaauuuacuggaaauucuucaa

SEQ ID NO: 2713368 - RNA, 16 nt, Haemophilus influenzae Rd
uuaauuuagauaaaaa

SEQ ID NO: 2713369 - RNA, 21 nt, Haemophilus influenzae Rd
uuaauuuaguuaaacaucgca

SEQ ID NO: 2713370 - RNA, 13 nt, Haemophilus influenzae Rd
uuaauuuauacaa

SEQ ID NO: 2713371 - RNA, 18 nt, Haemophilus influenzae Rd
uuaauuuauuuucuaaua

SEQ ID NO: 2713372 - RNA, 14 nt, Haemophilus influenzae Rd
uuaauuucaaaauc

SEQ ID NO: 2713373 - RNA, 22 nt, Haemophilus influenzae Rd
uuaauuucuuuuccuugcugau

SEQ ID NO: 2713374 - RNA, 14 nt, Haemophilus influenzae Rd
uuaauuugccauca

SEQ ID NO: 2713375 - RNA, 20 nt, Haemophilus influenzae Rd
uuaauuugucgauaaaagaa

SEQ ID NO: 2713376 - RNA, 15 nt, Haemophilus influenzae Rd
uuaauuuguugaauu

SEQ ID NO: 2713377 - RNA, 17 nt, Haemophilus influenzae Rd
uuaauuuuaucuugcug

SEQ ID NO: 2713378 - RNA, 19 nt, Haemophilus influenzae Rd
uuaauuuuaucuugcugcu

SEQ ID NO: 2713379 - RNA, 18 nt, Haemophilus influenzae Rd
uuaauuuuauuuuuugcg

SEQ ID NO: 2713380 - RNA, 12 nt, Haemophilus influenzae Rd
uuaauuuuccua

SEQ ID NO: 2713381 - RNA, 12 nt, Haemophilus influenzae Rd
uuaauuuuuaaa

SEQ ID NO: 2713382 - RNA, 15 nt, Haemophilus influenzae Rd
uuaauuuuuagauua

SEQ ID NO: 2713383 - RNA, 16 nt, Haemophilus influenzae Rd
uuaauuuuuagauuau

SEQ ID NO: 2713384 - RNA, 13 nt, Haemophilus influenzae Rd
uuaauuuuuuaua

SEQ ID NO: 2713385 - RNA, 13 nt, Haemophilus influenzae Rd
uuaauuuuuucac

SEQ ID NO: 2713386 - RNA, 23 nt, Haemophilus influenzae Rd
uuaauuuuuucuaaauuuuagcg

SEQ ID NO: 2713387 - RNA, 18 nt, Haemophilus influenzae Rd
uuaauuuuuucuguuuuu

SEQ ID NO: 2713388 - RNA, 23 nt, Haemophilus influenzae Rd
uuacaaaaaaguacuugcaaggg

SEQ ID NO: 2713389 - RNA, 22 nt, Haemophilus influenzae Rd
uuacaaaaaguacuugcaaggg

SEQ ID NO: 2713390 - RNA, 23 nt, Haemophilus influenzae Rd
uuacaaaaaguacuugcaaggga

SEQ ID NO: 2713391 - RNA, 18 nt, Haemophilus influenzae Rd
uuacaaagguugaaugcg

SEQ ID NO: 2713392 - RNA, 20 nt, Haemophilus influenzae Rd
uuacaaauuccucugaaccu

SEQ ID NO: 2713393 - RNA, 14 nt, Haemophilus influenzae Rd
uuacaacucuaaau

SEQ ID NO: 2713394 - RNA, 15 nt, Haemophilus influenzae Rd
uuacaaggacaauaa

SEQ ID NO: 2713395 - RNA, 17 nt, Haemophilus influenzae Rd
uuacaaggacaauaaua

SEQ ID NO: 2713396 - RNA, 19 nt, Haemophilus influenzae Rd
uuacaaguacuagcaaaac

SEQ ID NO: 2713397 - RNA, 15 nt, Haemophilus influenzae Rd
uuacaaguauaaaga

SEQ ID NO: 2713398 - RNA, 17 nt, Haemophilus influenzae Rd
uuacaaguauaaagagu

SEQ ID NO: 2713399 - RNA, 16 nt, Haemophilus influenzae Rd
uuacaaguuaaagcac

SEQ ID NO: 2713400 - RNA, 18 nt, Haemophilus influenzae Rd
uuacaauccuaacuuuuc

SEQ ID NO: 2713401 - RNA, 15 nt, Haemophilus influenzae Rd
uuacaaugaguguua

SEQ ID NO: 2713402 - RNA, 17 nt, Haemophilus influenzae Rd
uuacacauugccauauu

SEQ ID NO: 2713403 - RNA, 15 nt, Haemophilus influenzae Rd
uuacacgaauuaacg

SEQ ID NO: 2713404 - RNA, 22 nt, Haemophilus influenzae Rd
uuacagauaaaucagcgaguuu

SEQ ID NO: 2713405 - RNA, 17 nt, Haemophilus influenzae Rd
uuacagauuuugguugu

SEQ ID NO: 2713406 - RNA, 13 nt, Haemophilus influenzae Rd
uuacagguguagu

SEQ ID NO: 2713407 - RNA, 20 nt, Haemophilus influenzae Rd
uuacaguacaauuaauuaaa

SEQ ID NO: 2713408 - RNA, 18 nt, Haemophilus influenzae Rd
uuacauaccaaucacaac

SEQ ID NO: 2713409 - RNA, 23 nt, Haemophilus influenzae Rd
uuacauauaaagauugcauaacg

SEQ ID NO: 2713410 - RNA, 13 nt, Haemophilus influenzae Rd
uuacauauuucac

SEQ ID NO: 2713411 - RNA, 22 nt, Haemophilus influenzae Rd
uuacaucauccuuaccuuccac

SEQ ID NO: 2713412 - RNA, 23 nt, Haemophilus influenzae Rd
uuacaucauccuuaccuuccacu

SEQ ID NO: 2713413 - RNA, 14 nt, Haemophilus influenzae Rd
uuacaucuaaugcc

SEQ ID NO: 2713414 - RNA, 17 nt, Haemophilus influenzae Rd
uuacaucugugauaacu

SEQ ID NO: 2713415 - RNA, 16 nt, Haemophilus influenzae Rd
uuacaucuugcguuaa

SEQ ID NO: 2713416 - RNA, 19 nt, Haemophilus influenzae Rd
uuacauuuccuuuacauuu

SEQ ID NO: 2713417 - RNA, 16 nt, Haemophilus influenzae Rd
uuacauuuggcaaaau

SEQ ID NO: 2713418 - RNA, 19 nt, Haemophilus influenzae Rd
uuaccaagaaaccaacaga

SEQ ID NO: 2713419 - RNA, 13 nt, Haemophilus influenzae Rd
uuaccaagaaaua

SEQ ID NO: 2713420 - RNA, 23 nt, Haemophilus influenzae Rd
uuaccaauaggaagcauuucuaa

SEQ ID NO: 2713421 - RNA, 15 nt, Haemophilus influenzae Rd
uuaccaauuugugcg

SEQ ID NO: 2713422 - RNA, 19 nt, Haemophilus influenzae Rd
uuaccacccaaaauuucag

SEQ ID NO: 2713423 - RNA, 21 nt, Haemophilus influenzae Rd
uuaccacccaaaauuucagcu

SEQ ID NO: 2713424 - RNA, 16 nt, Haemophilus influenzae Rd
uuaccaccgauaaaca

SEQ ID NO: 2713425 - RNA, 17 nt, Haemophilus influenzae Rd
uuaccaccgcuaaauca

SEQ ID NO: 2713426 - RNA, 23 nt, Haemophilus influenzae Rd
uuaccacguucuuguaagccaaa

SEQ ID NO: 2713427 - RNA, 19 nt, Haemophilus influenzae Rd
uuaccagugguauauacca

SEQ ID NO: 2713428 - RNA, 23 nt, Haemophilus influenzae Rd
uuaccauugcguucacucacuuu

SEQ ID NO: 2713429 - RNA, 13 nt, Haemophilus influenzae Rd
uuacccaacaaau

SEQ ID NO: 2713430 - RNA, 14 nt, Haemophilus influenzae Rd
uuacccacaacuca

SEQ ID NO: 2713431 - RNA, 13 nt, Haemophilus influenzae Rd
uuacccacuaagu

SEQ ID NO: 2713432 - RNA, 21 nt, Haemophilus influenzae Rd
uuacccacuugguaaacauuu

SEQ ID NO: 2713433 - RNA, 16 nt, Haemophilus influenzae Rd
uuaccgaucauuucug

SEQ ID NO: 2713434 - RNA, 15 nt, Haemophilus influenzae Rd
uuaccgcacuuuaaa

SEQ ID NO: 2713435 - RNA, 15 nt, Haemophilus influenzae Rd
uuaccgcacuuuuua

SEQ ID NO: 2713436 - RNA, 20 nt, Haemophilus influenzae Rd
uuaccgccgaaauucccauu

SEQ ID NO: 2713437 - RNA, 18 nt, Haemophilus influenzae Rd
uuaccgcucgccaauaaa

SEQ ID NO: 2713438 - RNA, 15 nt, Haemophilus influenzae Rd
uuaccgcuucuuccu

SEQ ID NO: 2713439 - RNA, 15 nt, Haemophilus influenzae Rd
uuaccuaaaaauuua

SEQ ID NO: 2713440 - RNA, 11 nt, Haemophilus influenzae Rd
uuaccuaacca

SEQ ID NO: 2713441 - RNA, 16 nt, Haemophilus influenzae Rd
uuaccuguaauccuuu

SEQ ID NO: 2713442 - RNA, 12 nt, Haemophilus influenzae Rd
uuaccugugaaa

SEQ ID NO: 2713443 - RNA, 14 nt, Haemophilus influenzae Rd
uuaccugugaaaac

SEQ ID NO: 2713444 - RNA, 13 nt, Haemophilus influenzae Rd
uuaccuuagccaa

SEQ ID NO: 2713445 - RNA, 16 nt, Haemophilus influenzae Rd
uuaccuuuggcuaaac

SEQ ID NO: 2713446 - RNA, 22 nt, Haemophilus influenzae Rd
uuacgaaaaguugaaacuguuu

SEQ ID NO: 2713447 - RNA, 15 nt, Haemophilus influenzae Rd
uuacgacgugcaagu

SEQ ID NO: 2713448 - RNA, 14 nt, Haemophilus influenzae Rd
uuacgacuaaaauu

SEQ ID NO: 2713449 - RNA, 22 nt, Haemophilus influenzae Rd
uuacgauuuuccgaaaaaacaa

SEQ ID NO: 2713450 - RNA, 13 nt, Haemophilus influenzae Rd
uuacgccuaacca

SEQ ID NO: 2713451 - RNA, 21 nt, Haemophilus influenzae Rd
uuacgccuccauuaguuguuu

SEQ ID NO: 2713452 - RNA, 15 nt, Haemophilus influenzae Rd
uuacgcgcaauuuca

SEQ ID NO: 2713453 - RNA, 19 nt, Haemophilus influenzae Rd
uuacgcgcugauucuaaug

SEQ ID NO: 2713454 - RNA, 18 nt, Haemophilus influenzae Rd
uuacgcuaauuuaagaaa

SEQ ID NO: 2713455 - RNA, 14 nt, Haemophilus influenzae Rd
uuacggaugcaauc

SEQ ID NO: 2713456 - RNA, 17 nt, Haemophilus influenzae Rd
uuacggauuuauauauu

SEQ ID NO: 2713457 - RNA, 18 nt, Haemophilus influenzae Rd
uuacguaauguaccacgg

SEQ ID NO: 2713458 - RNA, 20 nt, Haemophilus influenzae Rd
uuacgugcaauagauguuaa

SEQ ID NO: 2713459 - RNA, 19 nt, Haemophilus influenzae Rd
uuacgugcgaauuuuuauu

SEQ ID NO: 2713460 - RNA, 14 nt, Haemophilus influenzae Rd
uuacguuuaguaaa

SEQ ID NO: 2713461 - RNA, 15 nt, Haemophilus influenzae Rd
uuacguuuuaaauua

SEQ ID NO: 2713462 - RNA, 11 nt, Haemophilus influenzae Rd
uuacuaaaaua

SEQ ID NO: 2713463 - RNA, 13 nt, Haemophilus influenzae Rd
uuacuaaaucccu

SEQ ID NO: 2713464 - RNA, 15 nt, Haemophilus influenzae Rd
uuacuaauuaaaagg

SEQ ID NO: 2713465 - RNA, 19 nt, Haemophilus influenzae Rd
uuacuaauucauuacauaa

SEQ ID NO: 2713466 - RNA, 15 nt, Haemophilus influenzae Rd
uuacuacuuuggauu

SEQ ID NO: 2713467 - RNA, 14 nt, Haemophilus influenzae Rd
uuacuauauaguuu

SEQ ID NO: 2713468 - RNA, 15 nt, Haemophilus influenzae Rd
uuacuauauaguuuu

SEQ ID NO: 2713469 - RNA, 20 nt, Haemophilus influenzae Rd
uuacuauucuuauauucuua

SEQ ID NO: 2713470 - RNA, 14 nt, Haemophilus influenzae Rd
uuacuauucuucaa

SEQ ID NO: 2713471 - RNA, 19 nt, Haemophilus influenzae Rd
uuacucaaagaaauagauu

SEQ ID NO: 2713472 - RNA, 14 nt, Haemophilus influenzae Rd
uuaguucagucggu

SEQ ID NO: 2713473 - RNA, 13 nt, Haemophilus influenzae Rd
uuaguuuccccug

SEQ ID NO: 2713474 - RNA, 18 nt, Haemophilus influenzae Rd
uuaguuuccccugaaugc

SEQ ID NO: 2713475 - RNA, 17 nt, Haemophilus influenzae Rd
uuaguuugauuacagua

SEQ ID NO: 2713476 - RNA, 21 nt, Haemophilus influenzae Rd
uuaguuuuguauaagggcgaa

SEQ ID NO: 2713477 - RNA, 14 nt, Haemophilus influenzae Rd
uuaguuuuuuauuu

SEQ ID NO: 2713478 - RNA, 15 nt, Haemophilus influenzae Rd
uuauaaaaaaacuaa

SEQ ID NO: 2713479 - RNA, 12 nt, Haemophilus influenzae Rd
uuauaaaaaaau

SEQ ID NO: 2713480 - RNA, 15 nt, Haemophilus influenzae Rd
uuauaaaaauauuuu

SEQ ID NO: 2713481 - RNA, 19 nt, Haemophilus influenzae Rd
uuauaaaaauauuuuaaua

SEQ ID NO: 2713482 - RNA, 20 nt, Haemophilus influenzae Rd
uuauaaaaauauuuuaauaa

SEQ ID NO: 2713483 - RNA, 23 nt, Haemophilus influenzae Rd
uuauaaaauagccuaaauauuua

SEQ ID NO: 2713484 - RNA, 21 nt, Haemophilus influenzae Rd
uuauaaaauggcgguuuuuua

SEQ ID NO: 2713485 - RNA, 15 nt, Haemophilus influenzae Rd
uuauaaaauuucagu

SEQ ID NO: 2713486 - RNA, 19 nt, Haemophilus influenzae Rd
uuauaaauuaccuuguuuu

SEQ ID NO: 2713487 - RNA, 19 nt, Haemophilus influenzae Rd
uuauaaauuagcuuaauaa

SEQ ID NO: 2713488 - RNA, 12 nt, Haemophilus influenzae Rd
uuauaacauaau

SEQ ID NO: 2713489 - RNA, 14 nt, Haemophilus influenzae Rd
uuauaacguuuaaa

SEQ ID NO: 2713490 - RNA, 22 nt, Haemophilus influenzae Rd
uuauaagaugacuuguuucaua

SEQ ID NO: 2713491 - RNA, 19 nt, Haemophilus influenzae Rd
uuauaagccuaaaccaaau

SEQ ID NO: 2713492 - RNA, 22 nt, Haemophilus influenzae Rd
uuauaagccuaaaccaaauaug

SEQ ID NO: 2713493 - RNA, 23 nt, Haemophilus influenzae Rd
uuauaagcugugguaaaaauaau

SEQ ID NO: 2713494 - RNA, 19 nt, Haemophilus influenzae Rd
uuauaagugccaacaauau

SEQ ID NO: 2713495 - RNA, 15 nt, Haemophilus influenzae Rd
uuauaaucuuuaaaa

SEQ ID NO: 2713496 - RNA, 17 nt, Haemophilus influenzae Rd
uuauaaucuuuaaaaug

SEQ ID NO: 2713497 - RNA, 16 nt, Haemophilus influenzae Rd
uuauaaucuuuaaauu

SEQ ID NO: 2713498 - RNA, 19 nt, Haemophilus influenzae Rd
uuauaaucuuuaaauuuug

SEQ ID NO: 2713499 - RNA, 18 nt, Haemophilus influenzae Rd
uuauaaugcaaccaaaca

SEQ ID NO: 2713500 - RNA, 13 nt, Haemophilus influenzae Rd
uuauaauuaauaa

SEQ ID NO: 2713501 - RNA, 18 nt, Haemophilus influenzae Rd
uuauacaaaacuaaaaaa

SEQ ID NO: 2713502 - RNA, 20 nt, Haemophilus influenzae Rd
uuauacaacaaaaaggcuaa

SEQ ID NO: 2713503 - RNA, 20 nt, Haemophilus influenzae Rd
uuauacaguuagaacaacaa

SEQ ID NO: 2713504 - RNA, 16 nt, Haemophilus influenzae Rd
uuauacgaguaaaaaa

SEQ ID NO: 2713505 - RNA, 17 nt, Haemophilus influenzae Rd
uuauacgaguaaaaaau

SEQ ID NO: 2713506 - RNA, 22 nt, Haemophilus influenzae Rd
uuauacuaaggguauacuuuau

SEQ ID NO: 2713507 - RNA, 16 nt, Haemophilus influenzae Rd
uuauagacuucaagug

SEQ ID NO: 2713508 - RNA, 17 nt, Haemophilus influenzae Rd
uuauagagaaauaauca

SEQ ID NO: 2713509 - RNA, 17 nt, Haemophilus influenzae Rd
uuauagauaaauaucaa

SEQ ID NO: 2713510 - RNA, 19 nt, Haemophilus influenzae Rd
uuauagcauuuaaauauua

SEQ ID NO: 2713511 - RNA, 23 nt, Haemophilus influenzae Rd
uuauagccuuguuccacgagaaa

SEQ ID NO: 2713512 - RNA, 15 nt, Haemophilus influenzae Rd
uuauaggcgcucuuc

SEQ ID NO: 2713513 - RNA, 13 nt, Haemophilus influenzae Rd
uuauaguauauuu

SEQ ID NO: 2713514 - RNA, 17 nt, Haemophilus influenzae Rd
uuauaguauauuuaucu

SEQ ID NO: 2713515 - RNA, 16 nt, Haemophilus influenzae Rd
uuauagugauuauuua

SEQ ID NO: 2713516 - RNA, 19 nt, Haemophilus influenzae Rd
uuauagugauuauuuacaa

SEQ ID NO: 2713517 - RNA, 12 nt, Haemophilus influenzae Rd
uuauauaaacaa

SEQ ID NO: 2713518 - RNA, 13 nt, Haemophilus influenzae Rd
uuauauaacauac

SEQ ID NO: 2713519 - RNA, 12 nt, Haemophilus influenzae Rd
uuauauaccauu

SEQ ID NO: 2713520 - RNA, 17 nt, Haemophilus influenzae Rd
uuauauaccauuugauu

SEQ ID NO: 2713521 - RNA, 21 nt, Haemophilus influenzae Rd
uuauaucaagcugugcaaaac

SEQ ID NO: 2713522 - RNA, 14 nt, Haemophilus influenzae Rd
uuauaucuaaauaa

SEQ ID NO: 2713523 - RNA, 20 nt, Haemophilus influenzae Rd
uuauaugaaccuauuagaau

SEQ ID NO: 2713524 - RNA, 15 nt, Haemophilus influenzae Rd
uuauaugccuaaaaa

SEQ ID NO: 2713525 - RNA, 18 nt, Haemophilus influenzae Rd
uuauaugccuaaaaagaa

SEQ ID NO: 2713526 - RNA, 20 nt, Haemophilus influenzae Rd
uuauauucagcaaaaucacu

SEQ ID NO: 2713527 - RNA, 16 nt, Haemophilus influenzae Rd
uuauauucauuuaaaa

SEQ ID NO: 2713528 - RNA, 17 nt, Haemophilus influenzae Rd
uuauauucauuuaaaac

SEQ ID NO: 2713529 - RNA, 16 nt, Haemophilus influenzae Rd
uuauauuccuuauuca

SEQ ID NO: 2713530 - RNA, 22 nt, Haemophilus influenzae Rd
uuauauucuggcaauauuucaa

SEQ ID NO: 2713531 - RNA, 15 nt, Haemophilus influenzae Rd
uuauauuuucuaaag

SEQ ID NO: 2713532 - RNA, 14 nt, Haemophilus influenzae Rd
uuauauuuuuaauu

SEQ ID NO: 2713533 - RNA, 17 nt, Haemophilus influenzae Rd
uuauauuuuuucuuaaa

SEQ ID NO: 2713534 - RNA, 13 nt, Haemophilus influenzae Rd
uuaucaaaaaacg

SEQ ID NO: 2713535 - RNA, 14 nt, Haemophilus influenzae Rd
uuaucaaaaaucuu

SEQ ID NO: 2713536 - RNA, 15 nt, Haemophilus influenzae Rd
uuaucaaaagaaaag

SEQ ID NO: 2713537 - RNA, 15 nt, Haemophilus influenzae Rd
uuaucaaacaagccc

SEQ ID NO: 2713538 - RNA, 20 nt, Haemophilus influenzae Rd
uuaucaaagaauuuuuucac

SEQ ID NO: 2713539 - RNA, 13 nt, Haemophilus influenzae Rd
uuaucaaaugcca

SEQ ID NO: 2713540 - RNA, 15 nt, Haemophilus influenzae Rd
uuaucaacuaaaaaa

SEQ ID NO: 2713541 - RNA, 18 nt, Haemophilus influenzae Rd
uuaucaagaacaguauaa

SEQ ID NO: 2713542 - RNA, 20 nt, Haemophilus influenzae Rd
uuaucaaguaauacuuuuua

SEQ ID NO: 2713543 - RNA, 12 nt, Haemophilus influenzae Rd
uuaucaauaaag

SEQ ID NO: 2713544 - RNA, 18 nt, Haemophilus influenzae Rd
uuaucaauaacugauuuu

SEQ ID NO: 2713545 - RNA, 21 nt, Haemophilus influenzae Rd
uuaucaauaacugauuuugag

SEQ ID NO: 2713546 - RNA, 16 nt, Haemophilus influenzae Rd
uuaucaaucaagaauu

SEQ ID NO: 2713547 - RNA, 18 nt, Haemophilus influenzae Rd
uuaucaaucaagaauucc

SEQ ID NO: 2713548 - RNA, 19 nt, Haemophilus influenzae Rd
uuaucaggcggguauuuau

SEQ ID NO: 2713549 - RNA, 13 nt, Haemophilus influenzae Rd
uuaucauaacuau

SEQ ID NO: 2713550 - RNA, 15 nt, Haemophilus influenzae Rd
uuaucauuaaauaua

SEQ ID NO: 2713551 - RNA, 15 nt, Haemophilus influenzae Rd
uuauccaacauuaau

SEQ ID NO: 2713552 - RNA, 14 nt, Haemophilus influenzae Rd
uuauccaauacugu

SEQ ID NO: 2713553 - RNA, 18 nt, Haemophilus influenzae Rd
uuauccaccagcacaguu

SEQ ID NO: 2713554 - RNA, 16 nt, Haemophilus influenzae Rd
uuauccacuaaaaaac

SEQ ID NO: 2713555 - RNA, 21 nt, Haemophilus influenzae Rd
uuauccauccagaaaauugca

SEQ ID NO: 2713556 - RNA, 22 nt, Haemophilus influenzae Rd
uuauccauccagaaaauugcac

SEQ ID NO: 2713557 - RNA, 15 nt, Haemophilus influenzae Rd
uuauccaugacuaau

SEQ ID NO: 2713558 - RNA, 19 nt, Haemophilus influenzae Rd
uuauccgguuggaaaagcc

SEQ ID NO: 2713559 - RNA, 15 nt, Haemophilus influenzae Rd
uuauccguuacauua

SEQ ID NO: 2713560 - RNA, 22 nt, Haemophilus influenzae Rd
uuaucgaauagauuuuuaccaa

SEQ ID NO: 2713561 - RNA, 22 nt, Haemophilus influenzae Rd
uuaucgacaaauuaauaagaaa

SEQ ID NO: 2713562 - RNA, 22 nt, Haemophilus influenzae Rd
uuaucgccaucacgccauaaac

SEQ ID NO: 2713563 - RNA, 16 nt, Haemophilus influenzae Rd
uuaucgggaauaauau

SEQ ID NO: 2713564 - RNA, 22 nt, Haemophilus influenzae Rd
uuaucgguauaggggauuuuau

SEQ ID NO: 2713565 - RNA, 18 nt, Haemophilus influenzae Rd
uuaucgguuauuacuuca

SEQ ID NO: 2713566 - RNA, 20 nt, Haemophilus influenzae Rd
uuaucgucugcacgaauaau

SEQ ID NO: 2713567 - RNA, 22 nt, Haemophilus influenzae Rd
uuaucgucugcacgaauaauua

SEQ ID NO: 2713568 - RNA, 23 nt, Haemophilus influenzae Rd
uuaucguguaaaaguuguuuugc

SEQ ID NO: 2713569 - RNA, 19 nt, Haemophilus influenzae Rd
uuaucguuuacuuaaaauc

SEQ ID NO: 2713570 - RNA, 22 nt, Haemophilus influenzae Rd
uuaucuaaaccguuuagcaaac

SEQ ID NO: 2713571 - RNA, 18 nt, Haemophilus influenzae Rd
uuaucuaaauaauuuccu

SEQ ID NO: 2713572 - RNA, 16 nt, Haemophilus influenzae Rd
uuaucuaaauuucgcu

SEQ ID NO: 2713573 - RNA, 21 nt, Haemophilus influenzae Rd
uuaucuaacuaaaauaguuga

SEQ ID NO: 2713574 - RNA, 23 nt, Haemophilus influenzae Rd
uuaucuaacucuuggcuaacuuc

SEQ ID NO: 2713575 - RNA, 16 nt, Haemophilus influenzae Rd
uuaucuacaaucaaaa

SEQ ID NO: 2713576 - RNA, 18 nt, Haemophilus influenzae Rd
uuaucuacaaucaaaaaa

SEQ ID NO: 2713577 - RNA, 13 nt, Haemophilus influenzae Rd
uuauuucuuagau

SEQ ID NO: 2713578 - RNA, 15 nt, Haemophilus influenzae Rd
uuauuugauuaagua

SEQ ID NO: 2713579 - RNA, 21 nt, Haemophilus influenzae Rd
uuauuugcauaguuuuccauu

SEQ ID NO: 2713580 - RNA, 21 nt, Haemophilus influenzae Rd
uuauuuggaacaguaaauuua

SEQ ID NO: 2713581 - RNA, 22 nt, Haemophilus influenzae Rd
uuauuuggaacaguaaauuuaa

SEQ ID NO: 2713582 - RNA, 19 nt, Haemophilus influenzae Rd
uuauuuggcauuugaauua

SEQ ID NO: 2713583 - RNA, 23 nt, Haemophilus influenzae Rd
uuauuuguguggaaaaauguaau

SEQ ID NO: 2713584 - RNA, 16 nt, Haemophilus influenzae Rd
uuauuuuaaaaucauc

SEQ ID NO: 2713585 - RNA, 12 nt, Haemophilus influenzae Rd
uuauuuuaaaua

SEQ ID NO: 2713586 - RNA, 13 nt, Haemophilus influenzae Rd
uuauuuuaaauaa

SEQ ID NO: 2713587 - RNA, 12 nt, Haemophilus influenzae Rd
uuauuuuaauuu

SEQ ID NO: 2713588 - RNA, 15 nt, Haemophilus influenzae Rd
uuauuuuccaucauc

SEQ ID NO: 2713589 - RNA, 16 nt, Haemophilus influenzae Rd
uuauuuuuaacguaaa

SEQ ID NO: 2713590 - RNA, 14 nt, Haemophilus influenzae Rd
uuauuuuuaucaua

SEQ ID NO: 2713591 - RNA, 13 nt, Haemophilus influenzae Rd
uuauuuuuuacua

SEQ ID NO: 2713592 - RNA, 12 nt, Haemophilus influenzae Rd
uuauuuuuugcu

SEQ ID NO: 2713593 - RNA, 15 nt, Haemophilus influenzae Rd
uucaaaaacauaauu

SEQ ID NO: 2713594 - RNA, 13 nt, Haemophilus influenzae Rd
uucaaaaaccaaa

SEQ ID NO: 2713595 - RNA, 21 nt, Haemophilus influenzae Rd
uucaaaaagaacggucaaaau

SEQ ID NO: 2713596 - RNA, 11 nt, Haemophilus influenzae Rd
uucaaaaauag

SEQ ID NO: 2713597 - RNA, 15 nt, Haemophilus influenzae Rd
uucaaaaauuugaau

SEQ ID NO: 2713598 - RNA, 18 nt, Haemophilus influenzae Rd
uucaaaaauuuuugcaaa

SEQ ID NO: 2713599 - RNA, 20 nt, Haemophilus influenzae Rd
uucaaaaauuuuugcaaaaa

SEQ ID NO: 2713600 - RNA, 19 nt, Haemophilus influenzae Rd
uucaaaacaguuuucaaau

SEQ ID NO: 2713601 - RNA, 19 nt, Haemophilus influenzae Rd
uucaaaacgcucaacauaa

SEQ ID NO: 2713602 - RNA, 16 nt, Haemophilus influenzae Rd
uucaaaacuaucaaaa

SEQ ID NO: 2713603 - RNA, 15 nt, Haemophilus influenzae Rd
uucaaaauaaaacca

SEQ ID NO: 2713604 - RNA, 14 nt, Haemophilus influenzae Rd
uucaaaauuuggcc

SEQ ID NO: 2713605 - RNA, 12 nt, Haemophilus influenzae Rd
uucaaaauuuug

SEQ ID NO: 2713606 - RNA, 12 nt, Haemophilus influenzae Rd
uucaaacaacaa

SEQ ID NO: 2713607 - RNA, 13 nt, Haemophilus influenzae Rd
uucaaacaacaag

SEQ ID NO: 2713608 - RNA, 18 nt, Haemophilus influenzae Rd
uucaaacacaacauaauu

SEQ ID NO: 2713609 - RNA, 22 nt, Haemophilus influenzae Rd
uucaaacaggcuuauuaaaaac

SEQ ID NO: 2713610 - RNA, 21 nt, Haemophilus influenzae Rd
uucaaacgcguuaaaucacaa

SEQ ID NO: 2713611 - RNA, 19 nt, Haemophilus influenzae Rd
uucaaacucuaauuccacc

SEQ ID NO: 2713612 - RNA, 17 nt, Haemophilus influenzae Rd
uucaaacugaucauaau

SEQ ID NO: 2713613 - RNA, 17 nt, Haemophilus influenzae Rd
uucaaagauuauuuaau

SEQ ID NO: 2713614 - RNA, 18 nt, Haemophilus influenzae Rd
uucaaagauuuuaaaauu

SEQ ID NO: 2713615 - RNA, 23 nt, Haemophilus influenzae Rd
uucaaaggcucuaccuaaaauaa

SEQ ID NO: 2713616 - RNA, 19 nt, Haemophilus influenzae Rd
uucaaauaacguaaccauu

SEQ ID NO: 2713617 - RNA, 13 nt, Haemophilus influenzae Rd
uucaaauauaacg

SEQ ID NO: 2713618 - RNA, 23 nt, Haemophilus influenzae Rd
uucaaaucgaucacuuaauaaaa

SEQ ID NO: 2713619 - RNA, 20 nt, Haemophilus influenzae Rd
uucaaaucguuugccguaau

SEQ ID NO: 2713620 - RNA, 14 nt, Haemophilus influenzae Rd
uucaaaucuugaca

SEQ ID NO: 2713621 - RNA, 22 nt, Haemophilus influenzae Rd
uucaaauucauccaaagaaauc

SEQ ID NO: 2713622 - RNA, 19 nt, Haemophilus influenzae Rd
uucaaauucccuagccuuu

SEQ ID NO: 2713623 - RNA, 12 nt, Haemophilus influenzae Rd
uucaaauugaaa

SEQ ID NO: 2713624 - RNA, 15 nt, Haemophilus influenzae Rd
uucaaauugcaaaaa

SEQ ID NO: 2713625 - RNA, 17 nt, Haemophilus influenzae Rd
uucaaauugcaaaaaac

SEQ ID NO: 2713626 - RNA, 15 nt, Haemophilus influenzae Rd
uucaaauuucuucac

SEQ ID NO: 2713627 - RNA, 13 nt, Haemophilus influenzae Rd
uucaacaaaaaac

SEQ ID NO: 2713628 - RNA, 23 nt, Haemophilus influenzae Rd
uucaacaaaaaacaccuaaaaug

SEQ ID NO: 2713629 - RNA, 23 nt, Haemophilus influenzae Rd
uucaacaaaaauacguuguuuuu

SEQ ID NO: 2713630 - RNA, 16 nt, Haemophilus influenzae Rd
uucaacaaguaaauca

SEQ ID NO: 2713631 - RNA, 16 nt, Haemophilus influenzae Rd
uucaacaauucauaaa

SEQ ID NO: 2713632 - RNA, 19 nt, Haemophilus influenzae Rd
uucaacacgccuaacauaa

SEQ ID NO: 2713633 - RNA, 22 nt, Haemophilus influenzae Rd
uucaacacgguggcauuuacgu

SEQ ID NO: 2713634 - RNA, 16 nt, Haemophilus influenzae Rd
uucaaccacuucaaau

SEQ ID NO: 2713635 - RNA, 16 nt, Haemophilus influenzae Rd
uucaaccauuuucucu

SEQ ID NO: 2713636 - RNA, 14 nt, Haemophilus influenzae Rd
uucaacccauuuuc

SEQ ID NO: 2713637 - RNA, 18 nt, Haemophilus influenzae Rd
uucaacccauuuuccauu

SEQ ID NO: 2713638 - RNA, 17 nt, Haemophilus influenzae Rd
uucaacgaauaauuuca

SEQ ID NO: 2713639 - RNA, 20 nt, Haemophilus influenzae Rd
uucaacuaaaggcacaaaaa

SEQ ID NO: 2713640 - RNA, 21 nt, Haemophilus influenzae Rd
uucaacuacgccguuuuucac

SEQ ID NO: 2713641 - RNA, 18 nt, Haemophilus influenzae Rd
uucaacuggcuuaaauga

SEQ ID NO: 2713642 - RNA, 19 nt, Haemophilus influenzae Rd
uucaacuuccgcuaauacu

SEQ ID NO: 2713643 - RNA, 20 nt, Haemophilus influenzae Rd
uucaacuuccgcuaauacua

SEQ ID NO: 2713644 - RNA, 22 nt, Haemophilus influenzae Rd
uucaacuugccacaguagaugu

SEQ ID NO: 2713645 - RNA, 19 nt, Haemophilus influenzae Rd
uucaagaucuuucacgaua

SEQ ID NO: 2713646 - RNA, 22 nt, Haemophilus influenzae Rd
uucaagaugauauuuaauaaaa

SEQ ID NO: 2713647 - RNA, 15 nt, Haemophilus influenzae Rd
uucaagcaaauauuu

SEQ ID NO: 2713648 - RNA, 16 nt, Haemophilus influenzae Rd
uucaagcaaauauuua

SEQ ID NO: 2713649 - RNA, 19 nt, Haemophilus influenzae Rd
uucaagccuucuaaaauaa

SEQ ID NO: 2713650 - RNA, 16 nt, Haemophilus influenzae Rd
uucaagcuuugcaaca

SEQ ID NO: 2713651 - RNA, 21 nt, Haemophilus influenzae Rd
uucaaggaaaaaggcaucuuu

SEQ ID NO: 2713652 - RNA, 22 nt, Haemophilus influenzae Rd
uucaaggagcuuuauuauuggc

SEQ ID NO: 2713653 - RNA, 13 nt, Haemophilus influenzae Rd
uucaaguaaaugc

SEQ ID NO: 2713654 - RNA, 14 nt, Haemophilus influenzae Rd
uucaagucuuuuuu

SEQ ID NO: 2713655 - RNA, 18 nt, Haemophilus influenzae Rd
uucaagugauuauuucuc

SEQ ID NO: 2713656 - RNA, 19 nt, Haemophilus influenzae Rd
uucaagugugugaaaggca

SEQ ID NO: 2713657 - RNA, 19 nt, Haemophilus influenzae Rd
uucaaguuguuugauaaug

SEQ ID NO: 2713658 - RNA, 19 nt, Haemophilus influenzae Rd
uucaauaacucuauaaaau

SEQ ID NO: 2713659 - RNA, 22 nt, Haemophilus influenzae Rd
uucaauaagcaaguaauuuaaa

SEQ ID NO: 2713660 - RNA, 18 nt, Haemophilus influenzae Rd
uucaauaagcucgccuuu

SEQ ID NO: 2713661 - RNA, 19 nt, Haemophilus influenzae Rd
uucaauaauagccauauua

SEQ ID NO: 2713662 - RNA, 11 nt, Haemophilus influenzae Rd
uucaauaauau

SEQ ID NO: 2713663 - RNA, 19 nt, Haemophilus influenzae Rd
uucaauaauugaagcaauu

SEQ ID NO: 2713664 - RNA, 14 nt, Haemophilus influenzae Rd
uucaauauaaaaaa

SEQ ID NO: 2713665 - RNA, 16 nt, Haemophilus influenzae Rd
uucaauauaaucaauu

SEQ ID NO: 2713666 - RNA, 18 nt, Haemophilus influenzae Rd
uucaauaucaaagaaaaa

SEQ ID NO: 2713667 - RNA, 16 nt, Haemophilus influenzae Rd
uucaauaucuaagaaa

SEQ ID NO: 2713668 - RNA, 13 nt, Haemophilus influenzae Rd
uucaauauguucu

SEQ ID NO: 2713669 - RNA, 15 nt, Haemophilus influenzae Rd
uucaauccuauuuuu

SEQ ID NO: 2713670 - RNA, 22 nt, Haemophilus influenzae Rd
uucaaucgcaucauucaaugca

SEQ ID NO: 2713671 - RNA, 14 nt, Haemophilus influenzae Rd
uucaaugcaacaau

SEQ ID NO: 2713672 - RNA, 19 nt, Haemophilus influenzae Rd
uucaaugcaccuaagucag

SEQ ID NO: 2713673 - RNA, 14 nt, Haemophilus influenzae Rd
uucaaugcagaaau

SEQ ID NO: 2713674 - RNA, 16 nt, Haemophilus influenzae Rd
uucaaugcagaaauaa

SEQ ID NO: 2713675 - RNA, 19 nt, Haemophilus influenzae Rd
uucaaugcagaaauacuuu

SEQ ID NO: 2713676 - RNA, 15 nt, Haemophilus influenzae Rd
uucaaugcuuccuuc

SEQ ID NO: 2713677 - RNA, 16 nt, Haemophilus influenzae Rd
uucaaugcuuuuugcg

SEQ ID NO: 2713678 - RNA, 20 nt, Haemophilus influenzae Rd
uucaauggcuuauugcuauc

SEQ ID NO: 2713679 - RNA, 17 nt, Haemophilus influenzae Rd
uucaaugguuuauaaca

SEQ ID NO: 2713680 - RNA, 15 nt, Haemophilus influenzae Rd
uucaaugucuuuuuc

SEQ ID NO: 2713681 - RNA, 15 nt, Haemophilus influenzae Rd
uucaauuaaaucaaa

SEQ ID NO: 2713682 - RNA, 13 nt, Haemophilus influenzae Rd
uucaauuaaugaa

SEQ ID NO: 2713683 - RNA, 20 nt, Haemophilus influenzae Rd
uucauagaaggcuaguucuu

SEQ ID NO: 2713684 - RNA, 22 nt, Haemophilus influenzae Rd
uucauagaaggcuaguucuucc

SEQ ID NO: 2713685 - RNA, 22 nt, Haemophilus influenzae Rd
uucauaguuuucugauuuaaaa

SEQ ID NO: 2713686 - RNA, 13 nt, Haemophilus influenzae Rd
uucauauaaauaa

SEQ ID NO: 2713687 - RNA, 21 nt, Haemophilus influenzae Rd
uucauauaauucauuagccaa

SEQ ID NO: 2713688 - RNA, 21 nt, Haemophilus influenzae Rd
uucauauccaccacaauuaau

SEQ ID NO: 2713689 - RNA, 13 nt, Haemophilus influenzae Rd
uucauaucuauug

SEQ ID NO: 2713690 - RNA, 17 nt, Haemophilus influenzae Rd
uucauaucucacaauaa

SEQ ID NO: 2713691 - RNA, 19 nt, Haemophilus influenzae Rd
uucauauuguuucaacaua

SEQ ID NO: 2713692 - RNA, 22 nt, Haemophilus influenzae Rd
uucaucaaaucauuuuuugcaa

SEQ ID NO: 2713693 - RNA, 14 nt, Haemophilus influenzae Rd
uucaucaauuuuga

SEQ ID NO: 2713694 - RNA, 13 nt, Haemophilus influenzae Rd
uucaucacaucag

SEQ ID NO: 2713695 - RNA, 16 nt, Haemophilus influenzae Rd
uucaucacccaucaaa

SEQ ID NO: 2713696 - RNA, 21 nt, Haemophilus influenzae Rd
uucaucacuaaauucuuguuu

SEQ ID NO: 2713697 - RNA, 14 nt, Haemophilus influenzae Rd
uucaucacuucaaa

SEQ ID NO: 2713698 - RNA, 14 nt, Haemophilus influenzae Rd
uucaucauaaauuu

SEQ ID NO: 2713699 - RNA, 15 nt, Haemophilus influenzae Rd
uucaucauaaauuuc

SEQ ID NO: 2713700 - RNA, 22 nt, Haemophilus influenzae Rd
uucaucauaaauuuccucaggu

SEQ ID NO: 2713701 - RNA, 15 nt, Haemophilus influenzae Rd
uucaucaucggcagu

SEQ ID NO: 2713702 - RNA, 16 nt, Haemophilus influenzae Rd
uucaucauuacuuuuu

SEQ ID NO: 2713703 - RNA, 15 nt, Haemophilus influenzae Rd
uucauccaaagaaau

SEQ ID NO: 2713704 - RNA, 16 nt, Haemophilus influenzae Rd
uucauccaauccuuua

SEQ ID NO: 2713705 - RNA, 18 nt, Haemophilus influenzae Rd
uucaucccaauuauugga

SEQ ID NO: 2713706 - RNA, 19 nt, Haemophilus influenzae Rd
uucauccuaaaaaaauaac

SEQ ID NO: 2713707 - RNA, 16 nt, Haemophilus influenzae Rd
uucaucgagaaauacg

SEQ ID NO: 2713708 - RNA, 15 nt, Haemophilus influenzae Rd
uucaucgccauuaaa

SEQ ID NO: 2713709 - RNA, 19 nt, Haemophilus influenzae Rd
uucaucgccugacugcccg

SEQ ID NO: 2713710 - RNA, 18 nt, Haemophilus influenzae Rd
uucaucgccuguuaagcc

SEQ ID NO: 2713711 - RNA, 18 nt, Haemophilus influenzae Rd
uucaucguaauuaaacaa

SEQ ID NO: 2713712 - RNA, 19 nt, Haemophilus influenzae Rd
uucaucguuugaacaaauu

SEQ ID NO: 2713713 - RNA, 21 nt, Haemophilus influenzae Rd
uucaucguuugaacaaauuca

SEQ ID NO: 2713714 - RNA, 19 nt, Haemophilus influenzae Rd
uucaucuaagugaaugaag

SEQ ID NO: 2713715 - RNA, 16 nt, Haemophilus influenzae Rd
uucaucugcaucacaa

SEQ ID NO: 2713716 - RNA, 16 nt, Haemophilus influenzae Rd
uucaucuguuggaaug

SEQ ID NO: 2713717 - RNA, 21 nt, Haemophilus influenzae Rd
uucaucuuagcuuuuuucuua

SEQ ID NO: 2713718 - RNA, 20 nt, Haemophilus influenzae Rd
uucaucuucagcauuuaaaa

SEQ ID NO: 2713719 - RNA, 13 nt, Haemophilus influenzae Rd
uucaucuucagua

SEQ ID NO: 2713720 - RNA, 14 nt, Haemophilus influenzae Rd
uucaucuuccguga

SEQ ID NO: 2713721 - RNA, 22 nt, Haemophilus influenzae Rd
uucaucuucugcugauaaucca

SEQ ID NO: 2713722 - RNA, 23 nt, Haemophilus influenzae Rd
uucaucuucugcugauaauccag

SEQ ID NO: 2713723 - RNA, 14 nt, Haemophilus influenzae Rd
uucaucuuuaccca

SEQ ID NO: 2713724 - RNA, 17 nt, Haemophilus influenzae Rd
uucaucuuuuuauaaaa

SEQ ID NO: 2713725 - RNA, 18 nt, Haemophilus influenzae Rd
uucaucuuuuuauaaaaa

SEQ ID NO: 2713726 - RNA, 22 nt, Haemophilus influenzae Rd
uucaugagcugggcaaacaauc

SEQ ID NO: 2713727 - RNA, 19 nt, Haemophilus influenzae Rd
uucaugauuaacaaugauu

SEQ ID NO: 2713728 - RNA, 17 nt, Haemophilus influenzae Rd
uucaugauuuuccaaaa

SEQ ID NO: 2713729 - RNA, 18 nt, Haemophilus influenzae Rd
uucaugauuuuccaaaau

SEQ ID NO: 2713730 - RNA, 15 nt, Haemophilus influenzae Rd
uucaugcauuaaaaa

SEQ ID NO: 2713731 - RNA, 16 nt, Haemophilus influenzae Rd
uucaugguuuguucca

SEQ ID NO: 2713732 - RNA, 18 nt, Haemophilus influenzae Rd
uucaugugggcuuuacaa

SEQ ID NO: 2713733 - RNA, 21 nt, Haemophilus influenzae Rd
uucaugugggcuuuacaauga

SEQ ID NO: 2713734 - RNA, 22 nt, Haemophilus influenzae Rd
uucaugugggcuuuacaaugag

SEQ ID NO: 2713735 - RNA, 18 nt, Haemophilus influenzae Rd
uucauuaaaaccaauuuu

SEQ ID NO: 2713736 - RNA, 15 nt, Haemophilus influenzae Rd
uucauuaaagaagaa

SEQ ID NO: 2713737 - RNA, 19 nt, Haemophilus influenzae Rd
uucauuaacgcuuaaauga

SEQ ID NO: 2713738 - RNA, 22 nt, Haemophilus influenzae Rd
uucauuaauaaccuugcugaua

SEQ ID NO: 2713739 - RNA, 19 nt, Haemophilus influenzae Rd
uucauuacgugcaaauaaa

SEQ ID NO: 2713740 - RNA, 20 nt, Haemophilus influenzae Rd
uucauuacgugcaaauaaau

SEQ ID NO: 2713741 - RNA, 16 nt, Haemophilus influenzae Rd
uucauuauuacuuuuu

SEQ ID NO: 2713742 - RNA, 22 nt, Haemophilus influenzae Rd
uucauucaaaaauaaagcccug

SEQ ID NO: 2713743 - RNA, 17 nt, Haemophilus influenzae Rd
uucauucaacaaaaaug

SEQ ID NO: 2713744 - RNA, 17 nt, Haemophilus influenzae Rd
uucauucaacaauucau

SEQ ID NO: 2713745 - RNA, 15 nt, Haemophilus influenzae Rd
uucauuccauucuaa

SEQ ID NO: 2713746 - RNA, 16 nt, Haemophilus influenzae Rd
uucauuccauuuugca

SEQ ID NO: 2713747 - RNA, 19 nt, Haemophilus influenzae Rd
uucauucguauaaauauuu

SEQ ID NO: 2713748 - RNA, 15 nt, Haemophilus influenzae Rd
uucauugcaucaggu

SEQ ID NO: 2713749 - RNA, 16 nt, Haemophilus influenzae Rd
uucauugcauuuuuau

SEQ ID NO: 2713750 - RNA, 15 nt, Haemophilus influenzae Rd
uucauuguuucucaa

SEQ ID NO: 2713751 - RNA, 13 nt, Haemophilus influenzae Rd
uucauuuaaaaca

SEQ ID NO: 2713752 - RNA, 13 nt, Haemophilus influenzae Rd
uucauuuaaaaua

SEQ ID NO: 2713753 - RNA, 17 nt, Haemophilus influenzae Rd
uucauuuaaaauauaua

SEQ ID NO: 2713754 - RNA, 19 nt, Haemophilus influenzae Rd
uucauuuaaaauauauauu

SEQ ID NO: 2713755 - RNA, 18 nt, Haemophilus influenzae Rd
uucauuuaguuuaagggc

SEQ ID NO: 2713756 - RNA, 15 nt, Haemophilus influenzae Rd
uucauuugaacaauu

SEQ ID NO: 2713757 - RNA, 18 nt, Haemophilus influenzae Rd
uucauuugcuuuaaccca

SEQ ID NO: 2713758 - RNA, 16 nt, Haemophilus influenzae Rd
uucauuuuaaauuauu

SEQ ID NO: 2713759 - RNA, 21 nt, Haemophilus influenzae Rd
uucauuuuccaaccaaucagu

SEQ ID NO: 2713760 - RNA, 22 nt, Haemophilus influenzae Rd
uucauuuucgacauucgcauau

SEQ ID NO: 2713761 - RNA, 19 nt, Haemophilus influenzae Rd
uucauuuugagauaaauuu

SEQ ID NO: 2713762 - RNA, 14 nt, Haemophilus influenzae Rd
uucauuuuuuauuu

SEQ ID NO: 2713763 - RNA, 22 nt, Haemophilus influenzae Rd
uucauuuuuuauuuuuucuaaa

SEQ ID NO: 2713764 - RNA, 12 nt, Haemophilus influenzae Rd
uucauuuuuugg

SEQ ID NO: 2713765 - RNA, 14 nt, Haemophilus influenzae Rd
uuccaaaaaccaac

SEQ ID NO: 2713766 - RNA, 14 nt, Haemophilus influenzae Rd
uuccaaaauuucug

SEQ ID NO: 2713767 - RNA, 16 nt, Haemophilus influenzae Rd
uuccaaacaaggcuaa

SEQ ID NO: 2713768 - RNA, 18 nt, Haemophilus influenzae Rd
uuccaaaucauaccaauu

SEQ ID NO: 2713769 - RNA, 23 nt, Haemophilus influenzae Rd
uuccaaaucauaccaauugcaac

SEQ ID NO: 2713770 - RNA, 13 nt, Haemophilus influenzae Rd
uuccaacaaaaua

SEQ ID NO: 2713771 - RNA, 15 nt, Haemophilus influenzae Rd
uuccaauaggaaacu

SEQ ID NO: 2713772 - RNA, 21 nt, Haemophilus influenzae Rd
uuccaaugugaccaaauaauc

SEQ ID NO: 2713773 - RNA, 22 nt, Haemophilus influenzae Rd
uuccaaugugaccaaauaaucg

SEQ ID NO: 2713774 - RNA, 16 nt, Haemophilus influenzae Rd
uuccaauucuaguucu

SEQ ID NO: 2713775 - RNA, 21 nt, Haemophilus influenzae Rd
uuccacaacaaccacauucaa

SEQ ID NO: 2713776 - RNA, 18 nt, Haemophilus influenzae Rd
uuccacaauucaaacaau

SEQ ID NO: 2713777 - RNA, 14 nt, Haemophilus influenzae Rd
uuccacagguuucu

SEQ ID NO: 2713778 - RNA, 20 nt, Haemophilus influenzae Rd
uuccacaucgcugccuaauu

SEQ ID NO: 2713779 - RNA, 21 nt, Haemophilus influenzae Rd
uuccaccacccuucuuucaaa

SEQ ID NO: 2713780 - RNA, 20 nt, Haemophilus influenzae Rd
uuccacuucauaaauccaau

SEQ ID NO: 2713781 - RNA, 16 nt, Haemophilus influenzae Rd
uuccagaaaauuggcg

SEQ ID NO: 2713782 - RNA, 16 nt, Haemophilus influenzae Rd
uuccagcaaaaaaauu

SEQ ID NO: 2713783 - RNA, 22 nt, Haemophilus influenzae Rd
uuccaguaaugguuacuuuauc

SEQ ID NO: 2713784 - RNA, 20 nt, Haemophilus influenzae Rd
uuccaguauagugcgcauau

SEQ ID NO: 2713785 - RNA, 13 nt, Haemophilus influenzae Rd
uuccagugguaaa

SEQ ID NO: 2713786 - RNA, 17 nt, Haemophilus influenzae Rd
uuccagugguaaaccua

SEQ ID NO: 2713787 - RNA, 14 nt, Haemophilus influenzae Rd
uuccaguucuccuu

SEQ ID NO: 2713788 - RNA, 18 nt, Haemophilus influenzae Rd
uucuaaaaaacguauuau

SEQ ID NO: 2713789 - RNA, 13 nt, Haemophilus influenzae Rd
uucuaaaaauuac

SEQ ID NO: 2713790 - RNA, 18 nt, Haemophilus influenzae Rd
uucuaaaaccaauaaucc

SEQ ID NO: 2713791 - RNA, 13 nt, Haemophilus influenzae Rd
uucuaaaauaaua

SEQ ID NO: 2713792 - RNA, 16 nt, Haemophilus influenzae Rd
uucuaaaauaauauca

SEQ ID NO: 2713793 - RNA, 17 nt, Haemophilus influenzae Rd
uucuaaaauaauaucac

SEQ ID NO: 2713794 - RNA, 13 nt, Haemophilus influenzae Rd
uucuaaauaaacu

SEQ ID NO: 2713795 - RNA, 15 nt, Haemophilus influenzae Rd
uucuaaauaaacuac

SEQ ID NO: 2713796 - RNA, 21 nt, Haemophilus influenzae Rd
uucuaaauagcuaacaauauc

SEQ ID NO: 2713797 - RNA, 22 nt, Haemophilus influenzae Rd
uucuaaauauugauuauguaaa

SEQ ID NO: 2713798 - RNA, 16 nt, Haemophilus influenzae Rd
uucuaaauauuuuuca

SEQ ID NO: 2713799 - RNA, 15 nt, Haemophilus influenzae Rd
uucuaaaugaauaaa

SEQ ID NO: 2713800 - RNA, 18 nt, Haemophilus influenzae Rd
uucuaaaugaauaaaacu

SEQ ID NO: 2713801 - RNA, 20 nt, Haemophilus influenzae Rd
uucuaacaucggcaaccaag

SEQ ID NO: 2713802 - RNA, 18 nt, Haemophilus influenzae Rd
uucuaacaucucuugaau

SEQ ID NO: 2713803 - RNA, 14 nt, Haemophilus influenzae Rd
uucuaacauuugac

SEQ ID NO: 2713804 - RNA, 23 nt, Haemophilus influenzae Rd
uucuaaccgcacuuuuuaauaaa

SEQ ID NO: 2713805 - RNA, 16 nt, Haemophilus influenzae Rd
uucuaacgcuuuuaaa

SEQ ID NO: 2713806 - RNA, 20 nt, Haemophilus influenzae Rd
uucuaagguauccacuuuuc

SEQ ID NO: 2713807 - RNA, 23 nt, Haemophilus influenzae Rd
uucuaagguugcucgaacaauau

SEQ ID NO: 2713808 - RNA, 12 nt, Haemophilus influenzae Rd
uucuaaguguuu

SEQ ID NO: 2713809 - RNA, 21 nt, Haemophilus influenzae Rd
uucuaauaauccucuuuaaaa

SEQ ID NO: 2713810 - RNA, 23 nt, Haemophilus influenzae Rd
uucuaauaauccucuuuaaaauu

SEQ ID NO: 2713811 - RNA, 21 nt, Haemophilus influenzae Rd
uucuaauccagauugguauuc

SEQ ID NO: 2713812 - RNA, 12 nt, Haemophilus influenzae Rd
uucuaaucccau

SEQ ID NO: 2713813 - RNA, 12 nt, Haemophilus influenzae Rd
uucuaauguuaa

SEQ ID NO: 2713814 - RNA, 16 nt, Haemophilus influenzae Rd
uucuaauuaacugaaa

SEQ ID NO: 2713815 - RNA, 17 nt, Haemophilus influenzae Rd
uucuaauuaacugaaaa

SEQ ID NO: 2713816 - RNA, 22 nt, Haemophilus influenzae Rd
uucuaauucacgcauuuaaaua

SEQ ID NO: 2713817 - RNA, 19 nt, Haemophilus influenzae Rd
uucuaauuccccuucaaau

SEQ ID NO: 2713818 - RNA, 20 nt, Haemophilus influenzae Rd
uucuaauuccccuucaaaua

SEQ ID NO: 2713819 - RNA, 13 nt, Haemophilus influenzae Rd
uucuaauucugca

SEQ ID NO: 2713820 - RNA, 13 nt, Haemophilus influenzae Rd
uucuaauucuucc

SEQ ID NO: 2713821 - RNA, 15 nt, Haemophilus influenzae Rd
uucuaauuugccauc

SEQ ID NO: 2713822 - RNA, 13 nt, Haemophilus influenzae Rd
uucuaauuuucac

SEQ ID NO: 2713823 - RNA, 15 nt, Haemophilus influenzae Rd
uucuaauuuuugcaa

SEQ ID NO: 2713824 - RNA, 21 nt, Haemophilus influenzae Rd
uucuaauuuuugcaauggcuu

SEQ ID NO: 2713825 - RNA, 22 nt, Haemophilus influenzae Rd
uucuacaaucauagaaaucccu

SEQ ID NO: 2713826 - RNA, 16 nt, Haemophilus influenzae Rd
uucuacacuuaaauua

SEQ ID NO: 2713827 - RNA, 21 nt, Haemophilus influenzae Rd
uucuaccgcacuuuaacccau

SEQ ID NO: 2713828 - RNA, 13 nt, Haemophilus influenzae Rd
uucuaccugcugu

SEQ ID NO: 2713829 - RNA, 15 nt, Haemophilus influenzae Rd
uucuacgacauuuuu

SEQ ID NO: 2713830 - RNA, 21 nt, Haemophilus influenzae Rd
uucuacggucgcaccaccuuu

SEQ ID NO: 2713831 - RNA, 15 nt, Haemophilus influenzae Rd
uucuacgguuuuaau

SEQ ID NO: 2713832 - RNA, 17 nt, Haemophilus influenzae Rd
uucuacguaauuuaauu

SEQ ID NO: 2713833 - RNA, 22 nt, Haemophilus influenzae Rd
uucuacguaauuuaauuuauca

SEQ ID NO: 2713834 - RNA, 21 nt, Haemophilus influenzae Rd
uucuacguauugaacuaaaau

SEQ ID NO: 2713835 - RNA, 16 nt, Haemophilus influenzae Rd
uucuacuuguucaaaa

SEQ ID NO: 2713836 - RNA, 12 nt, Haemophilus influenzae Rd
uucuacuuuuuu

SEQ ID NO: 2713837 - RNA, 21 nt, Haemophilus influenzae Rd
uucuagcgguaaaccaacucu

SEQ ID NO: 2713838 - RNA, 22 nt, Haemophilus influenzae Rd
uucuagcuuaccuuaauuaauc

SEQ ID NO: 2713839 - RNA, 15 nt, Haemophilus influenzae Rd
uucuaguucuucccc

SEQ ID NO: 2713840 - RNA, 13 nt, Haemophilus influenzae Rd
uucuaguuuuucc

SEQ ID NO: 2713841 - RNA, 20 nt, Haemophilus influenzae Rd
uucuauaauccgcagaauuu

SEQ ID NO: 2713842 - RNA, 13 nt, Haemophilus influenzae Rd
uucuauaauuaaa

SEQ ID NO: 2713843 - RNA, 15 nt, Haemophilus influenzae Rd
uucuauagauuuauu

SEQ ID NO: 2713844 - RNA, 15 nt, Haemophilus influenzae Rd
uucuauauuauuuaa

SEQ ID NO: 2713845 - RNA, 18 nt, Haemophilus influenzae Rd
uucuauauuuugaauaau

SEQ ID NO: 2713846 - RNA, 16 nt, Haemophilus influenzae Rd
uucuaucagaucgaua

SEQ ID NO: 2713847 - RNA, 21 nt, Haemophilus influenzae Rd
uucuaucuacuacgcuaacac

SEQ ID NO: 2713848 - RNA, 18 nt, Haemophilus influenzae Rd
uucuaugccaaucacaau

SEQ ID NO: 2713849 - RNA, 20 nt, Haemophilus influenzae Rd
uucuauuaaaaaaucaucaa

SEQ ID NO: 2713850 - RNA, 14 nt, Haemophilus influenzae Rd
uucuauuaaaauau

SEQ ID NO: 2713851 - RNA, 14 nt, Haemophilus influenzae Rd
uucuauuuuaaaaa

SEQ ID NO: 2713852 - RNA, 21 nt, Haemophilus influenzae Rd
uucucaagaauauauuuuauc

SEQ ID NO: 2713853 - RNA, 22 nt, Haemophilus influenzae Rd
uucucaagaauauauuuuauca

SEQ ID NO: 2713854 - RNA, 16 nt, Haemophilus influenzae Rd
uucucaauugcaaaau

SEQ ID NO: 2713855 - RNA, 18 nt, Haemophilus influenzae Rd
uucucaauugcaaaauca

SEQ ID NO: 2713856 - RNA, 15 nt, Haemophilus influenzae Rd
uucucaccaaauugu

SEQ ID NO: 2713857 - RNA, 16 nt, Haemophilus influenzae Rd
uucucaccaaauuguu

SEQ ID NO: 2713858 - RNA, 19 nt, Haemophilus influenzae Rd
uucucaccaaauuguucua

SEQ ID NO: 2713859 - RNA, 20 nt, Haemophilus influenzae Rd
uucucaccaccagauaaggu

SEQ ID NO: 2713860 - RNA, 16 nt, Haemophilus influenzae Rd
uucucauaauagaaaa

SEQ ID NO: 2713861 - RNA, 13 nt, Haemophilus influenzae Rd
uucucauacaaaa

SEQ ID NO: 2713862 - RNA, 11 nt, Haemophilus influenzae Rd
uucuccacgca

SEQ ID NO: 2713863 - RNA, 22 nt, Haemophilus influenzae Rd
uucuccauuaagcacaggcgua

SEQ ID NO: 2713864 - RNA, 14 nt, Haemophilus influenzae Rd
uucuccauuugccc

SEQ ID NO: 2713865 - RNA, 23 nt, Haemophilus influenzae Rd
uucucccgccgcauaggccucag

SEQ ID NO: 2713866 - RNA, 23 nt, Haemophilus influenzae Rd
uucuccgauacauaauacuggca

SEQ ID NO: 2713867 - RNA, 21 nt, Haemophilus influenzae Rd
uucuccgccugauucgccaaa

SEQ ID NO: 2713868 - RNA, 17 nt, Haemophilus influenzae Rd
uucuccguuagcaauaa

SEQ ID NO: 2713869 - RNA, 18 nt, Haemophilus influenzae Rd
uucuccuacaucgccuug

SEQ ID NO: 2713870 - RNA, 20 nt, Haemophilus influenzae Rd
uucucgggcugaaauaccuu

SEQ ID NO: 2713871 - RNA, 20 nt, Haemophilus influenzae Rd
uucucgucuuugaagccuga

SEQ ID NO: 2713872 - RNA, 18 nt, Haemophilus influenzae Rd
uucucuaacgcauucaaa

SEQ ID NO: 2713873 - RNA, 21 nt, Haemophilus influenzae Rd
uucucuagccgaacaagcccc

SEQ ID NO: 2713874 - RNA, 15 nt, Haemophilus influenzae Rd
uucucuaguguugcu

SEQ ID NO: 2713875 - RNA, 14 nt, Haemophilus influenzae Rd
uucucuauaauuac

SEQ ID NO: 2713876 - RNA, 18 nt, Haemophilus influenzae Rd
uucucucgcugaauuauu

SEQ ID NO: 2713877 - RNA, 18 nt, Haemophilus influenzae Rd
uucucuggcucgcucuuc

SEQ ID NO: 2713878 - RNA, 15 nt, Haemophilus influenzae Rd
uucucuuauuugugu

SEQ ID NO: 2713879 - RNA, 15 nt, Haemophilus influenzae Rd
uucucuuuucucaag

SEQ ID NO: 2713880 - RNA, 19 nt, Haemophilus influenzae Rd
uucugaacacucuaucuaa

SEQ ID NO: 2713881 - RNA, 17 nt, Haemophilus influenzae Rd
uucugaacuaaaauaac

SEQ ID NO: 2713882 - RNA, 19 nt, Haemophilus influenzae Rd
uucugaacuaaaauaaccu

SEQ ID NO: 2713883 - RNA, 13 nt, Haemophilus influenzae Rd
uucugaauaaauu

SEQ ID NO: 2713884 - RNA, 15 nt, Haemophilus influenzae Rd
uucugauaauuuuuc

SEQ ID NO: 2713885 - RNA, 17 nt, Haemophilus influenzae Rd
uucugauaauuuuucac

SEQ ID NO: 2713886 - RNA, 23 nt, Haemophilus influenzae Rd
uucugauaauuuuucacuguauu

SEQ ID NO: 2713887 - RNA, 22 nt, Haemophilus influenzae Rd
uucugauuuagguuucaauuua

SEQ ID NO: 2713888 - RNA, 17 nt, Haemophilus influenzae Rd
uucugcagaaaaauguu

SEQ ID NO: 2713889 - RNA, 20 nt, Haemophilus influenzae Rd
uucugcagcaaacgaaccau

SEQ ID NO: 2713890 - RNA, 17 nt, Haemophilus influenzae Rd
uucugcagcaagaucaa

SEQ ID NO: 2713891 - RNA, 19 nt, Haemophilus influenzae Rd
uucugcagcguuugcugcc

SEQ ID NO: 2713892 - RNA, 19 nt, Haemophilus influenzae Rd
uucugcaggaaaaauaaau

SEQ ID NO: 2713893 - RNA, 13 nt, Haemophilus influenzae Rd
uucugcauaaaau

SEQ ID NO: 2713894 - RNA, 16 nt, Haemophilus influenzae Rd
uucugcaucaauaauu

SEQ ID NO: 2713895 - RNA, 17 nt, Haemophilus influenzae Rd
uucugcaucaauaauuc

SEQ ID NO: 2713896 - RNA, 14 nt, Haemophilus influenzae Rd
uucugcauuuaaug

SEQ ID NO: 2713897 - RNA, 14 nt, Haemophilus influenzae Rd
uucugccauuucag

SEQ ID NO: 2713898 - RNA, 22 nt, Haemophilus influenzae Rd
uucugccauuucaggaucgucu

SEQ ID NO: 2713899 - RNA, 20 nt, Haemophilus influenzae Rd
uucugccgcugcaacaaaua

SEQ ID NO: 2713900 - RNA, 22 nt, Haemophilus influenzae Rd
uucugccgcugcaacaaauaaa

SEQ ID NO: 2713901 - RNA, 15 nt, Haemophilus influenzae Rd
uucugccuaauaagc

SEQ ID NO: 2713902 - RNA, 14 nt, Haemophilus influenzae Rd
uucugccucuguau

SEQ ID NO: 2713903 - RNA, 16 nt, Haemophilus influenzae Rd
uucugcgccuaaucca

SEQ ID NO: 2713904 - RNA, 18 nt, Haemophilus influenzae Rd
uucugcucugcaccaucc

SEQ ID NO: 2713905 - RNA, 17 nt, Haemophilus influenzae Rd
uucugcucuucaucaaa

SEQ ID NO: 2713906 - RNA, 13 nt, Haemophilus influenzae Rd
uucugcugcacga

SEQ ID NO: 2713907 - RNA, 21 nt, Haemophilus influenzae Rd
uucugcuugggcaaucaaauu

SEQ ID NO: 2713908 - RNA, 21 nt, Haemophilus influenzae Rd
uucuggguaaaauaaugcaaa

SEQ ID NO: 2713909 - RNA, 15 nt, Haemophilus influenzae Rd
uucugguuccauuac

SEQ ID NO: 2713910 - RNA, 14 nt, Haemophilus influenzae Rd
uucuguaaauaugc

SEQ ID NO: 2713911 - RNA, 16 nt, Haemophilus influenzae Rd
uucuguaaauaugccu

SEQ ID NO: 2713912 - RNA, 15 nt, Haemophilus influenzae Rd
uucuguaccugcauu

SEQ ID NO: 2713913 - RNA, 17 nt, Haemophilus influenzae Rd
uucuguaugacuauuua

SEQ ID NO: 2713914 - RNA, 20 nt, Haemophilus influenzae Rd
uucugucauuuauggaaaua

SEQ ID NO: 2713915 - RNA, 15 nt, Haemophilus influenzae Rd
uucugucuauuuauu

SEQ ID NO: 2713916 - RNA, 16 nt, Haemophilus influenzae Rd
uucuguugauuuauca

SEQ ID NO: 2713917 - RNA, 13 nt, Haemophilus influenzae Rd
uucuguugcuuca

SEQ ID NO: 2713918 - RNA, 18 nt, Haemophilus influenzae Rd
uucuguugggaauaauuc

SEQ ID NO: 2713919 - RNA, 19 nt, Haemophilus influenzae Rd
uucuguugggaauaauucu

SEQ ID NO: 2713920 - RNA, 18 nt, Haemophilus influenzae Rd
uucuguuugauaaauauc

SEQ ID NO: 2713921 - RNA, 15 nt, Haemophilus influenzae Rd
uucuguuuugccugc

SEQ ID NO: 2713922 - RNA, 13 nt, Haemophilus influenzae Rd
uucuguuuuuacc

SEQ ID NO: 2713923 - RNA, 22 nt, Haemophilus influenzae Rd
uucuuaaaauacccauaaaauu

SEQ ID NO: 2713924 - RNA, 16 nt, Haemophilus influenzae Rd
uucuuaaauauaucaa

SEQ ID NO: 2713925 - RNA, 16 nt, Haemophilus influenzae Rd
uucuuaauuaagauaa

SEQ ID NO: 2713926 - RNA, 13 nt, Haemophilus influenzae Rd
uucuuaauuuuau

SEQ ID NO: 2713927 - RNA, 17 nt, Haemophilus influenzae Rd
uucuuacaacaaauugu

SEQ ID NO: 2713928 - RNA, 15 nt, Haemophilus influenzae Rd
uucuuagauaaaaac

SEQ ID NO: 2713929 - RNA, 19 nt, Haemophilus influenzae Rd
uucuuauagauaaaauguu

SEQ ID NO: 2713930 - RNA, 14 nt, Haemophilus influenzae Rd
uucuuauauucaaa

SEQ ID NO: 2713931 - RNA, 18 nt, Haemophilus influenzae Rd
uucuuauauucaaauuuc

SEQ ID NO: 2713932 - RNA, 20 nt, Haemophilus influenzae Rd
uucuuauccguuacauuauu

SEQ ID NO: 2713933 - RNA, 22 nt, Haemophilus influenzae Rd
uucuuaucuacaaucaaaaaau

SEQ ID NO: 2713934 - RNA, 17 nt, Haemophilus influenzae Rd
uucuuaugaaaaaaaau

SEQ ID NO: 2713935 - RNA, 13 nt, Haemophilus influenzae Rd
uucuuauucagua

SEQ ID NO: 2713936 - RNA, 19 nt, Haemophilus influenzae Rd
uucuuauuggacugcauau

SEQ ID NO: 2713937 - RNA, 13 nt, Haemophilus influenzae Rd
uucuucaaagauu

SEQ ID NO: 2713938 - RNA, 19 nt, Haemophilus influenzae Rd
uucuucaaauugcaaaaaa

SEQ ID NO: 2713939 - RNA, 13 nt, Haemophilus influenzae Rd
uucuucaauaaca

SEQ ID NO: 2713940 - RNA, 17 nt, Haemophilus influenzae Rd
uucuucaauaauugaag

SEQ ID NO: 2713941 - RNA, 19 nt, Haemophilus influenzae Rd
uucuucaauagaacguaau

SEQ ID NO: 2713942 - RNA, 13 nt, Haemophilus influenzae Rd
uucuucaauaugu

SEQ ID NO: 2713943 - RNA, 20 nt, Haemophilus influenzae Rd
uucuucaccugcguuaguga

SEQ ID NO: 2713944 - RNA, 13 nt, Haemophilus influenzae Rd
uucuucagaacug

SEQ ID NO: 2713945 - RNA, 18 nt, Haemophilus influenzae Rd
uucuucagcuuguuuaau

SEQ ID NO: 2713946 - RNA, 22 nt, Haemophilus influenzae Rd
uucuucagggcgguuuauuuga

SEQ ID NO: 2713947 - RNA, 19 nt, Haemophilus influenzae Rd
uucuucaguaccagucacu

SEQ ID NO: 2713948 - RNA, 14 nt, Haemophilus influenzae Rd
uucuucauaaaaaa

SEQ ID NO: 2713949 - RNA, 19 nt, Haemophilus influenzae Rd
uucuucauuuuaaauuauu

SEQ ID NO: 2713950 - RNA, 20 nt, Haemophilus influenzae Rd
uucuuccaaagaaucaucuu

SEQ ID NO: 2713951 - RNA, 14 nt, Haemophilus influenzae Rd
uucuuccauuucaa

SEQ ID NO: 2713952 - RNA, 21 nt, Haemophilus influenzae Rd
uucuucccaaucuuguuuuaa

SEQ ID NO: 2713953 - RNA, 22 nt, Haemophilus influenzae Rd
uucuucccagcguaaaaaugcu

SEQ ID NO: 2713954 - RNA, 18 nt, Haemophilus influenzae Rd
uucuuccuugguuaaucc

SEQ ID NO: 2713955 - RNA, 13 nt, Haemophilus influenzae Rd
uucuucgauuuuu

SEQ ID NO: 2713956 - RNA, 22 nt, Haemophilus influenzae Rd
uucuucgccauuuucuuguucu

SEQ ID NO: 2713957 - RNA, 15 nt, Haemophilus influenzae Rd
uucuucgcgagaauu

SEQ ID NO: 2713958 - RNA, 19 nt, Haemophilus influenzae Rd
uucuucgcuccaaucauca

SEQ ID NO: 2713959 - RNA, 22 nt, Haemophilus influenzae Rd
uucuucuaacauuucuuuuggc

SEQ ID NO: 2713960 - RNA, 21 nt, Haemophilus influenzae Rd
uucuucuaauucaguguaaug

SEQ ID NO: 2713961 - RNA, 14 nt, Haemophilus influenzae Rd
uucuucuaauucuu

SEQ ID NO: 2713962 - RNA, 16 nt, Haemophilus influenzae Rd
uucuucuacaccuucu

SEQ ID NO: 2713963 - RNA, 21 nt, Haemophilus influenzae Rd
uucuucuuucauuugaacaau

SEQ ID NO: 2713964 - RNA, 11 nt, Haemophilus influenzae Rd
uucuucuuuua

SEQ ID NO: 2713965 - RNA, 11 nt, Haemophilus influenzae Rd
uucuucuuuuu

SEQ ID NO: 2713966 - RNA, 19 nt, Haemophilus influenzae Rd
uucuugaccuucaauugug

SEQ ID NO: 2713967 - RNA, 19 nt, Haemophilus influenzae Rd
uucuugaccuuucaauaau

SEQ ID NO: 2713968 - RNA, 13 nt, Haemophilus influenzae Rd
uucuugacguaau

SEQ ID NO: 2713969 - RNA, 21 nt, Haemophilus influenzae Rd
uucuugaugauaaucuuccca

SEQ ID NO: 2713970 - RNA, 15 nt, Haemophilus influenzae Rd
uucuugccaaaaauu

SEQ ID NO: 2713971 - RNA, 19 nt, Haemophilus influenzae Rd
uucuugccgaaaauuuacc

SEQ ID NO: 2713972 - RNA, 17 nt, Haemophilus influenzae Rd
uucuugcuaaaauaucu

SEQ ID NO: 2713973 - RNA, 18 nt, Haemophilus influenzae Rd
uucuugcucauuugucgu

SEQ ID NO: 2713974 - RNA, 17 nt, Haemophilus influenzae Rd
uucuugcuuaaauugac

SEQ ID NO: 2713975 - RNA, 21 nt, Haemophilus influenzae Rd
uucuuggagauaauauuccaa

SEQ ID NO: 2713976 - RNA, 22 nt, Haemophilus influenzae Rd
uucuuggagauaauauuccaaa

SEQ ID NO: 2713977 - RNA, 17 nt, Haemophilus influenzae Rd
uucuuggauaauuucgu

SEQ ID NO: 2713978 - RNA, 23 nt, Haemophilus influenzae Rd
uucuuggcaauauuuaauauauu

SEQ ID NO: 2713979 - RNA, 22 nt, Haemophilus influenzae Rd
uucuuguaagccaaauaaugca

SEQ ID NO: 2713980 - RNA, 18 nt, Haemophilus influenzae Rd
uucuuguuuaaauucagg

SEQ ID NO: 2713981 - RNA, 16 nt, Haemophilus influenzae Rd
uucuuguuuaauauuu

SEQ ID NO: 2713982 - RNA, 15 nt, Haemophilus influenzae Rd
uucuuguuuagcaag

SEQ ID NO: 2713983 - RNA, 23 nt, Haemophilus influenzae Rd
uucuuguuuuaaaucuucuaucu

SEQ ID NO: 2713984 - RNA, 12 nt, Haemophilus influenzae Rd
uucuuuaaaaca

SEQ ID NO: 2713985 - RNA, 12 nt, Haemophilus influenzae Rd
uucuuuaaaauu

SEQ ID NO: 2713986 - RNA, 20 nt, Haemophilus influenzae Rd
uucuuuaaaauuauaauauu

SEQ ID NO: 2713987 - RNA, 13 nt, Haemophilus influenzae Rd
uucuuuaaaggca

SEQ ID NO: 2713988 - RNA, 12 nt, Haemophilus influenzae Rd
uucuuuaaauau

SEQ ID NO: 2713989 - RNA, 16 nt, Haemophilus influenzae Rd
uucuuuaaauauucaa

SEQ ID NO: 2713990 - RNA, 20 nt, Haemophilus influenzae Rd
uucuuuaaauucaauaaacc

SEQ ID NO: 2713991 - RNA, 14 nt, Haemophilus influenzae Rd
uucuuuaauugauu

SEQ ID NO: 2713992 - RNA, 17 nt, Haemophilus influenzae Rd
uucuuuaauuucuucaa

SEQ ID NO: 2713993 - RNA, 15 nt, Haemophilus influenzae Rd
uucuuuacaaauugc

SEQ ID NO: 2713994 - RNA, 14 nt, Haemophilus influenzae Rd
uucuuuacaaauuu

SEQ ID NO: 2713995 - RNA, 21 nt, Haemophilus influenzae Rd
uucuuuaccuugcauuucuuu

SEQ ID NO: 2713996 - RNA, 19 nt, Haemophilus influenzae Rd
uucuuuagcuauuaaauua

SEQ ID NO: 2713997 - RNA, 15 nt, Haemophilus influenzae Rd
uucuuuagcugcaau

SEQ ID NO: 2713998 - RNA, 19 nt, Haemophilus influenzae Rd
uucuuuauuaaacaaaaac

SEQ ID NO: 2713999 - RNA, 21 nt, Haemophilus influenzae Rd
uugagugaugaguucugucac

SEQ ID NO: 2714000 - RNA, 18 nt, Haemophilus influenzae Rd
uugagugcuguacacaca

SEQ ID NO: 2714001 - RNA, 19 nt, Haemophilus influenzae Rd
uugagugcuguacacacac

SEQ ID NO: 2714002 - RNA, 16 nt, Haemophilus influenzae Rd
uugaguugucacaaca

SEQ ID NO: 2714003 - RNA, 15 nt, Haemophilus influenzae Rd
uugaguuuagucuuu

SEQ ID NO: 2714004 - RNA, 15 nt, Haemophilus influenzae Rd
uugauaaaaaagaaa

SEQ ID NO: 2714005 - RNA, 13 nt, Haemophilus influenzae Rd
uugauaaaaacac

SEQ ID NO: 2714006 - RNA, 14 nt, Haemophilus influenzae Rd
uugauaaaaaugag

SEQ ID NO: 2714007 - RNA, 23 nt, Haemophilus influenzae Rd
uugauaaaggcauuuauuucaau

SEQ ID NO: 2714008 - RNA, 13 nt, Haemophilus influenzae Rd
uugauaaaguuuu

SEQ ID NO: 2714009 - RNA, 18 nt, Haemophilus influenzae Rd
uugauaacgucgaauaac

SEQ ID NO: 2714010 - RNA, 22 nt, Haemophilus influenzae Rd
uugauaagcuugcguaauguuu

SEQ ID NO: 2714011 - RNA, 19 nt, Haemophilus influenzae Rd
uugauaauuuaagcaaaau

SEQ ID NO: 2714012 - RNA, 20 nt, Haemophilus influenzae Rd
uugauaauuuaagcaaaauc

SEQ ID NO: 2714013 - RNA, 20 nt, Haemophilus influenzae Rd
uugauaccaagauaauaaag

SEQ ID NO: 2714014 - RNA, 16 nt, Haemophilus influenzae Rd
uugauagacaauauaa

SEQ ID NO: 2714015 - RNA, 20 nt, Haemophilus influenzae Rd
uugauagcugccgaauagau

SEQ ID NO: 2714016 - RNA, 15 nt, Haemophilus influenzae Rd
uugauauaaauuguu

SEQ ID NO: 2714017 - RNA, 18 nt, Haemophilus influenzae Rd
uugauauaaguucuaaau

SEQ ID NO: 2714018 - RNA, 20 nt, Haemophilus influenzae Rd
uugauauaaguucuaaauaa

SEQ ID NO: 2714019 - RNA, 23 nt, Haemophilus influenzae Rd
uugauauaccauucuuucaauaa

SEQ ID NO: 2714020 - RNA, 19 nt, Haemophilus influenzae Rd
uugauauauucuucuucaa

SEQ ID NO: 2714021 - RNA, 18 nt, Haemophilus influenzae Rd
uugauauucaauuacuau

SEQ ID NO: 2714022 - RNA, 20 nt, Haemophilus influenzae Rd
uugauauuuggauaacaaau

SEQ ID NO: 2714023 - RNA, 21 nt, Haemophilus influenzae Rd
uugauauuuggauaacaaauu

SEQ ID NO: 2714024 - RNA, 18 nt, Haemophilus influenzae Rd
uugaucaccuaucacaaa

SEQ ID NO: 2714025 - RNA, 15 nt, Haemophilus influenzae Rd
uugauccauauauug

SEQ ID NO: 2714026 - RNA, 22 nt, Haemophilus influenzae Rd
uugauccccauacaaguauuuu

SEQ ID NO: 2714027 - RNA, 16 nt, Haemophilus influenzae Rd
uugaucguuaauauca

SEQ ID NO: 2714028 - RNA, 17 nt, Haemophilus influenzae Rd
uugaucuaauuugccaa

SEQ ID NO: 2714029 - RNA, 11 nt, Haemophilus influenzae Rd
uugaucuacag

SEQ ID NO: 2714030 - RNA, 16 nt, Haemophilus influenzae Rd
uugaucuacagaagug

SEQ ID NO: 2714031 - RNA, 18 nt, Haemophilus influenzae Rd
uugaucugcaaauggugu

SEQ ID NO: 2714032 - RNA, 12 nt, Haemophilus influenzae Rd
uugaucugcacu

SEQ ID NO: 2714033 - RNA, 19 nt, Haemophilus influenzae Rd
uugaugaaaauuaucugcu

SEQ ID NO: 2714034 - RNA, 21 nt, Haemophilus influenzae Rd
uugaugaagcuaaacuuuaga

SEQ ID NO: 2714035 - RNA, 15 nt, Haemophilus influenzae Rd
uugaugauuaacuau

SEQ ID NO: 2714036 - RNA, 15 nt, Haemophilus influenzae Rd
uugaugcacaacgau

SEQ ID NO: 2714037 - RNA, 13 nt, Haemophilus influenzae Rd
uugaugccaagau

SEQ ID NO: 2714038 - RNA, 21 nt, Haemophilus influenzae Rd
uugaugccaagauaaccaauu

SEQ ID NO: 2714039 - RNA, 19 nt, Haemophilus influenzae Rd
uugaugcccacuuuuccua

SEQ ID NO: 2714040 - RNA, 19 nt, Haemophilus influenzae Rd
uugaugcucugcauaaaag

SEQ ID NO: 2714041 - RNA, 18 nt, Haemophilus influenzae Rd
uugauggaucauaaguaa

SEQ ID NO: 2714042 - RNA, 23 nt, Haemophilus influenzae Rd
uugauguaaaaacucgaauagaa

SEQ ID NO: 2714043 - RNA, 13 nt, Haemophilus influenzae Rd
uugauuaccacga

SEQ ID NO: 2714044 - RNA, 14 nt, Haemophilus influenzae Rd
uugauuaucaaggc

SEQ ID NO: 2714045 - RNA, 14 nt, Haemophilus influenzae Rd
uugauuaucuaauu

SEQ ID NO: 2714046 - RNA, 16 nt, Haemophilus influenzae Rd
uugauuauuuuuuaac

SEQ ID NO: 2714047 - RNA, 21 nt, Haemophilus influenzae Rd
uugauuauuuuuuaacguacc

SEQ ID NO: 2714048 - RNA, 13 nt, Haemophilus influenzae Rd
uugauucacuaau

SEQ ID NO: 2714049 - RNA, 15 nt, Haemophilus influenzae Rd
uugauugacuuguuu

SEQ ID NO: 2714050 - RNA, 13 nt, Haemophilus influenzae Rd
uugauugagaugc

SEQ ID NO: 2714051 - RNA, 17 nt, Haemophilus influenzae Rd
uugauugagaugccauu

SEQ ID NO: 2714052 - RNA, 19 nt, Haemophilus influenzae Rd
uugauugcgagucaaauuu

SEQ ID NO: 2714053 - RNA, 12 nt, Haemophilus influenzae Rd
uugauuuaaaaa

SEQ ID NO: 2714054 - RNA, 13 nt, Haemophilus influenzae Rd
uugauuuaaaaau

SEQ ID NO: 2714055 - RNA, 14 nt, Haemophilus influenzae Rd
uugauuuaaaaauc

SEQ ID NO: 2714056 - RNA, 15 nt, Haemophilus influenzae Rd
uugauuuaauugaaa

SEQ ID NO: 2714057 - RNA, 17 nt, Haemophilus influenzae Rd
uugauuuagccaguaau

SEQ ID NO: 2714058 - RNA, 17 nt, Haemophilus influenzae Rd
uugauuuaguucaagga

SEQ ID NO: 2714059 - RNA, 15 nt, Haemophilus influenzae Rd
uugauuuaucauaau

SEQ ID NO: 2714060 - RNA, 14 nt, Haemophilus influenzae Rd
uugauuucagaaca

SEQ ID NO: 2714061 - RNA, 17 nt, Haemophilus influenzae Rd
uugauuuuaaaauauca

SEQ ID NO: 2714062 - RNA, 14 nt, Haemophilus influenzae Rd
uugauuuuaaugua

SEQ ID NO: 2714063 - RNA, 12 nt, Haemophilus influenzae Rd
uugauuuuauuu

SEQ ID NO: 2714064 - RNA, 20 nt, Haemophilus influenzae Rd
uugauuuucagcacugguua

SEQ ID NO: 2714065 - RNA, 12 nt, Haemophilus influenzae Rd
uugauuuuccug

SEQ ID NO: 2714066 - RNA, 12 nt, Haemophilus influenzae Rd
uugauuuuucaa

SEQ ID NO: 2714067 - RNA, 14 nt, Haemophilus influenzae Rd
uugauuuuucaacu

SEQ ID NO: 2714068 - RNA, 19 nt, Haemophilus influenzae Rd
uugcaaaaaguacuugcaa

SEQ ID NO: 2714069 - RNA, 23 nt, Haemophilus influenzae Rd
uugcaaaaaguacuugcaaggga

SEQ ID NO: 2714070 - RNA, 21 nt, Haemophilus influenzae Rd
uugcaaaaaugacaucauuaa

SEQ ID NO: 2714071 - RNA, 19 nt, Haemophilus influenzae Rd
uugcaaaaucacacgugcu

SEQ ID NO: 2714072 - RNA, 15 nt, Haemophilus influenzae Rd
uugcaaaccaaauca

SEQ ID NO: 2714073 - RNA, 19 nt, Haemophilus influenzae Rd
uugcaaaccaaaucacaau

SEQ ID NO: 2714074 - RNA, 18 nt, Haemophilus influenzae Rd
uugcaaauuuucagcuug

SEQ ID NO: 2714075 - RNA, 22 nt, Haemophilus influenzae Rd
uugcaaauuuucagcuugugcu

SEQ ID NO: 2714076 - RNA, 17 nt, Haemophilus influenzae Rd
uugcaaauuuucgacuu

SEQ ID NO: 2714077 - RNA, 14 nt, Haemophilus influenzae Rd
uugcaaauuuuuca

SEQ ID NO: 2714078 - RNA, 20 nt, Haemophilus influenzae Rd
uugcaacaucaauaacaagc

SEQ ID NO: 2714079 - RNA, 22 nt, Haemophilus influenzae Rd
uugcaacuaauagcgugaaaag

SEQ ID NO: 2714080 - RNA, 13 nt, Haemophilus influenzae Rd
uugcaacuuuuuu

SEQ ID NO: 2714081 - RNA, 14 nt, Haemophilus influenzae Rd
uugcaagccaauag

SEQ ID NO: 2714082 - RNA, 18 nt, Haemophilus influenzae Rd
uugcaagggauuugaaaa

SEQ ID NO: 2714083 - RNA, 23 nt, Haemophilus influenzae Rd
uugcaauaaauucguacaaauga

SEQ ID NO: 2714084 - RNA, 13 nt, Haemophilus influenzae Rd
uugcaauaaucac

SEQ ID NO: 2714085 - RNA, 12 nt, Haemophilus influenzae Rd
uugcaauggcuu

SEQ ID NO: 2714086 - RNA, 14 nt, Haemophilus influenzae Rd
uugcaauuucagcu

SEQ ID NO: 2714087 - RNA, 19 nt, Haemophilus influenzae Rd
uugcacaauagcuuccgcu

SEQ ID NO: 2714088 - RNA, 21 nt, Haemophilus influenzae Rd
uugcacaauuacuucuuacaa

SEQ ID NO: 2714089 - RNA, 18 nt, Haemophilus influenzae Rd
uugcaccacguucuuuua

SEQ ID NO: 2714090 - RNA, 16 nt, Haemophilus influenzae Rd
uugcacccacuaaaau

SEQ ID NO: 2714091 - RNA, 12 nt, Haemophilus influenzae Rd
uugcaccuaauu

SEQ ID NO: 2714092 - RNA, 21 nt, Haemophilus influenzae Rd
uugcacguucuucagcacuug

SEQ ID NO: 2714093 - RNA, 13 nt, Haemophilus influenzae Rd
uugcacugguucu

SEQ ID NO: 2714094 - RNA, 17 nt, Haemophilus influenzae Rd
uugcacuuuaaaaauaa

SEQ ID NO: 2714095 - RNA, 21 nt, Haemophilus influenzae Rd
uugcacuuuaaagaaauaaau

SEQ ID NO: 2714096 - RNA, 22 nt, Haemophilus influenzae Rd
uugcacuuuaaagaaauaaauu

SEQ ID NO: 2714097 - RNA, 20 nt, Haemophilus influenzae Rd
uugcagaacagguguugcau

SEQ ID NO: 2714098 - RNA, 15 nt, Haemophilus influenzae Rd
uugcagaaccgccac

SEQ ID NO: 2714099 - RNA, 14 nt, Haemophilus influenzae Rd
uugcauaaaccaac

SEQ ID NO: 2714100 - RNA, 17 nt, Haemophilus influenzae Rd
uugcauaacuucaccaa

SEQ ID NO: 2714101 - RNA, 12 nt, Haemophilus influenzae Rd
uugcauaauucc

SEQ ID NO: 2714102 - RNA, 20 nt, Haemophilus influenzae Rd
uugcauauccgcugcaaauu

SEQ ID NO: 2714103 - RNA, 21 nt, Haemophilus influenzae Rd
uugcauauugaacuugagaaa

SEQ ID NO: 2714104 - RNA, 15 nt, Haemophilus influenzae Rd
uugcaugaaauguag

SEQ ID NO: 2714105 - RNA, 19 nt, Haemophilus influenzae Rd
uuggccaauuugcauaugu

SEQ ID NO: 2714106 - RNA, 23 nt, Haemophilus influenzae Rd
uuggccgcacuuuugaucugcac

SEQ ID NO: 2714107 - RNA, 16 nt, Haemophilus influenzae Rd
uuggcgaaaaucauca

SEQ ID NO: 2714108 - RNA, 16 nt, Haemophilus influenzae Rd
uuggcgaauuugguuu

SEQ ID NO: 2714109 - RNA, 19 nt, Haemophilus influenzae Rd
uuggcgcaggcaaaccaag

SEQ ID NO: 2714110 - RNA, 13 nt, Haemophilus influenzae Rd
uuggcguuaaagu

SEQ ID NO: 2714111 - RNA, 18 nt, Haemophilus influenzae Rd
uuggcuaacuucuuccac

SEQ ID NO: 2714112 - RNA, 21 nt, Haemophilus influenzae Rd
uuggcuaugucaauuacuguu

SEQ ID NO: 2714113 - RNA, 17 nt, Haemophilus influenzae Rd
uuggcucaagccuuugg

SEQ ID NO: 2714114 - RNA, 21 nt, Haemophilus influenzae Rd
uuggcucuucuuuaauuucuu

SEQ ID NO: 2714115 - RNA, 12 nt, Haemophilus influenzae Rd
uuggcugaauuu

SEQ ID NO: 2714116 - RNA, 21 nt, Haemophilus influenzae Rd
uuggcuuccagaaaauuggcg

SEQ ID NO: 2714117 - RNA, 17 nt, Haemophilus influenzae Rd
uuggcuuucauuacaag

SEQ ID NO: 2714118 - RNA, 16 nt, Haemophilus influenzae Rd
uugggauaagcuuuug

SEQ ID NO: 2714119 - RNA, 17 nt, Haemophilus influenzae Rd
uugggauauuccaaggu

SEQ ID NO: 2714120 - RNA, 19 nt, Haemophilus influenzae Rd
uugggcggaucgcuuguug

SEQ ID NO: 2714121 - RNA, 15 nt, Haemophilus influenzae Rd
uugggcuuauuuguu

SEQ ID NO: 2714122 - RNA, 13 nt, Haemophilus influenzae Rd
uuggggaaguaau

SEQ ID NO: 2714123 - RNA, 13 nt, Haemophilus influenzae Rd
uuggguaaucaaa

SEQ ID NO: 2714124 - RNA, 18 nt, Haemophilus influenzae Rd
uuggguguguauccacaa

SEQ ID NO: 2714125 - RNA, 17 nt, Haemophilus influenzae Rd
uugguaaauuagcaaua

SEQ ID NO: 2714126 - RNA, 16 nt, Haemophilus influenzae Rd
uugguaagaaagauag

SEQ ID NO: 2714127 - RNA, 19 nt, Haemophilus influenzae Rd
uugguagaguaaauucucg

SEQ ID NO: 2714128 - RNA, 17 nt, Haemophilus influenzae Rd
uugguauuuacuaaauu

SEQ ID NO: 2714129 - RNA, 12 nt, Haemophilus influenzae Rd
uuggugcaaaag

SEQ ID NO: 2714130 - RNA, 18 nt, Haemophilus influenzae Rd
uuggugggcaaauaaaga

SEQ ID NO: 2714131 - RNA, 15 nt, Haemophilus influenzae Rd
uuggugguuugugac

SEQ ID NO: 2714132 - RNA, 20 nt, Haemophilus influenzae Rd
uuggugugcaauaccuuugu

SEQ ID NO: 2714133 - RNA, 17 nt, Haemophilus influenzae Rd
uugguuagaucagaaaa

SEQ ID NO: 2714134 - RNA, 16 nt, Haemophilus influenzae Rd
uugguucgauaaacau

SEQ ID NO: 2714135 - RNA, 16 nt, Haemophilus influenzae Rd
uugguucgauaucuaa

SEQ ID NO: 2714136 - RNA, 13 nt, Haemophilus influenzae Rd
uugguucuaaaua

SEQ ID NO: 2714137 - RNA, 20 nt, Haemophilus influenzae Rd
uugguucuaaauauuuuuca

SEQ ID NO: 2714138 - RNA, 16 nt, Haemophilus influenzae Rd
uugguuuucuugccaa

SEQ ID NO: 2714139 - RNA, 20 nt, Haemophilus influenzae Rd
uugguuuugcucuuuuucca

SEQ ID NO: 2714140 - RNA, 14 nt, Haemophilus influenzae Rd
uuguaaaauaucca

SEQ ID NO: 2714141 - RNA, 16 nt, Haemophilus influenzae Rd
uuguaaaauauccaca

SEQ ID NO: 2714142 - RNA, 16 nt, Haemophilus influenzae Rd
uuguaaaauugguggg

SEQ ID NO: 2714143 - RNA, 18 nt, Haemophilus influenzae Rd
uuguaaacugcuuucaaa

SEQ ID NO: 2714144 - RNA, 13 nt, Haemophilus influenzae Rd
uuguaaagauugu

SEQ ID NO: 2714145 - RNA, 14 nt, Haemophilus influenzae Rd
uuguaaagauuguc

SEQ ID NO: 2714146 - RNA, 17 nt, Haemophilus influenzae Rd
uuguaacguauuuaaaa

SEQ ID NO: 2714147 - RNA, 20 nt, Haemophilus influenzae Rd
uuguaagcaacacagauuuu

SEQ ID NO: 2714148 - RNA, 17 nt, Haemophilus influenzae Rd
uuguaagcgauaaauau

SEQ ID NO: 2714149 - RNA, 21 nt, Haemophilus influenzae Rd
uuguaagcguaaugcacuuuc

SEQ ID NO: 2714150 - RNA, 16 nt, Haemophilus influenzae Rd
uuguaaguuguaaauu

SEQ ID NO: 2714151 - RNA, 21 nt, Haemophilus influenzae Rd
uuguaauaaauuuuauuaugu

SEQ ID NO: 2714152 - RNA, 20 nt, Haemophilus influenzae Rd
uuguaauccauuuugaacaa

SEQ ID NO: 2714153 - RNA, 18 nt, Haemophilus influenzae Rd
uuguaauccugcauuuuc

SEQ ID NO: 2714154 - RNA, 19 nt, Haemophilus influenzae Rd
uuguaaugucgugaaagaa

SEQ ID NO: 2714155 - RNA, 13 nt, Haemophilus influenzae Rd
uuguaauugcucu

SEQ ID NO: 2714156 - RNA, 17 nt, Haemophilus influenzae Rd
uuguaauugcucuaauu

SEQ ID NO: 2714157 - RNA, 20 nt, Haemophilus influenzae Rd
uuguaauuguugaauggugu

SEQ ID NO: 2714158 - RNA, 19 nt, Haemophilus influenzae Rd
uuguacaacagcaauaagc

SEQ ID NO: 2714159 - RNA, 21 nt, Haemophilus influenzae Rd
uuguacaacagcaauaagcaa

SEQ ID NO: 2714160 - RNA, 23 nt, Haemophilus influenzae Rd
uuguacaguaauuguugguuacu

SEQ ID NO: 2714161 - RNA, 15 nt, Haemophilus influenzae Rd
uuguaccaaucaaag

SEQ ID NO: 2714162 - RNA, 22 nt, Haemophilus influenzae Rd
uuguaccuucugcugcaguuuc

SEQ ID NO: 2714163 - RNA, 19 nt, Haemophilus influenzae Rd
uuguacuguggauaauuca

SEQ ID NO: 2714164 - RNA, 16 nt, Haemophilus influenzae Rd
uuguacuucuaaaagc

SEQ ID NO: 2714165 - RNA, 18 nt, Haemophilus influenzae Rd
uuguacuucuaaaagcug

SEQ ID NO: 2714166 - RNA, 16 nt, Haemophilus influenzae Rd
uuguacuuuagaaauu

SEQ ID NO: 2714167 - RNA, 15 nt, Haemophilus influenzae Rd
uuguagauuaucuga

SEQ ID NO: 2714168 - RNA, 14 nt, Haemophilus influenzae Rd
uuguagccauuuuc

SEQ ID NO: 2714169 - RNA, 14 nt, Haemophilus influenzae Rd
uuguagcccaaucu

SEQ ID NO: 2714170 - RNA, 20 nt, Haemophilus influenzae Rd
uuguaggauguucaaguaaa

SEQ ID NO: 2714171 - RNA, 20 nt, Haemophilus influenzae Rd
uuguaggugggcuuuagccc

SEQ ID NO: 2714172 - RNA, 12 nt, Haemophilus influenzae Rd
uuguauaaaaau

SEQ ID NO: 2714173 - RNA, 20 nt, Haemophilus influenzae Rd
uuguauaagauuaaugauaa

SEQ ID NO: 2714174 - RNA, 14 nt, Haemophilus influenzae Rd
uuguauauugugac

SEQ ID NO: 2714175 - RNA, 16 nt, Haemophilus influenzae Rd
uugucacguaauacac

SEQ ID NO: 2714176 - RNA, 18 nt, Haemophilus influenzae Rd
uugucagauuuauaaaua

SEQ ID NO: 2714177 - RNA, 17 nt, Haemophilus influenzae Rd
uugucauuaaaaaauaa

SEQ ID NO: 2714178 - RNA, 17 nt, Haemophilus influenzae Rd
uugucauugccauuucu

SEQ ID NO: 2714179 - RNA, 16 nt, Haemophilus influenzae Rd
uuguccaaagaauaau

SEQ ID NO: 2714180 - RNA, 21 nt, Haemophilus influenzae Rd
uuguccaaagaauaauaagug

SEQ ID NO: 2714181 - RNA, 14 nt, Haemophilus influenzae Rd
uugucccaaaauau

SEQ ID NO: 2714182 - RNA, 18 nt, Haemophilus influenzae Rd
uugucccgcauauaaaau

SEQ ID NO: 2714183 - RNA, 22 nt, Haemophilus influenzae Rd
uugucccgcauauaaaauaaag

SEQ ID NO: 2714184 - RNA, 19 nt, Haemophilus influenzae Rd
uuguccgauaguggcaccg

SEQ ID NO: 2714185 - RNA, 12 nt, Haemophilus influenzae Rd
uuguccucccau

SEQ ID NO: 2714186 - RNA, 17 nt, Haemophilus influenzae Rd
uugucgcgccaccaucu

SEQ ID NO: 2714187 - RNA, 18 nt, Haemophilus influenzae Rd
uugucgcgccaccaucua

SEQ ID NO: 2714188 - RNA, 16 nt, Haemophilus influenzae Rd
uugucggaaaauaaua

SEQ ID NO: 2714189 - RNA, 22 nt, Haemophilus influenzae Rd
uugucuaagguuuccauaaugu

SEQ ID NO: 2714190 - RNA, 15 nt, Haemophilus influenzae Rd
uugugaaauaaaaua

SEQ ID NO: 2714191 - RNA, 17 nt, Haemophilus influenzae Rd
uugugaaauaaaauaua

SEQ ID NO: 2714192 - RNA, 16 nt, Haemophilus influenzae Rd
uugugacggugaauuu

SEQ ID NO: 2714193 - RNA, 20 nt, Haemophilus influenzae Rd
uugugacggugaauuuauca

SEQ ID NO: 2714194 - RNA, 16 nt, Haemophilus influenzae Rd
uugugacucaaacuug

SEQ ID NO: 2714195 - RNA, 17 nt, Haemophilus influenzae Rd
uugugagcgaucugcac

SEQ ID NO: 2714196 - RNA, 15 nt, Haemophilus influenzae Rd
uugugauguaccaau

SEQ ID NO: 2714197 - RNA, 20 nt, Haemophilus influenzae Rd
uugugauguaccaauuugua

SEQ ID NO: 2714198 - RNA, 11 nt, Haemophilus influenzae Rd
uugugauuacu

SEQ ID NO: 2714199 - RNA, 16 nt, Haemophilus influenzae Rd
uugugcaaaauaaccu

SEQ ID NO: 2714200 - RNA, 16 nt, Haemophilus influenzae Rd
uugugcacagauuuua

SEQ ID NO: 2714201 - RNA, 17 nt, Haemophilus influenzae Rd
uugugcagaauauugua

SEQ ID NO: 2714202 - RNA, 20 nt, Haemophilus influenzae Rd
uugugcagaauauuguaaug

SEQ ID NO: 2714203 - RNA, 20 nt, Haemophilus influenzae Rd
uugugcaucaaagcguucau

SEQ ID NO: 2714204 - RNA, 14 nt, Haemophilus influenzae Rd
uugugccaaauuca

SEQ ID NO: 2714205 - RNA, 14 nt, Haemophilus influenzae Rd
uugugccaauacuu

SEQ ID NO: 2714206 - RNA, 15 nt, Haemophilus influenzae Rd
uugugcuaaauuaaa

SEQ ID NO: 2714207 - RNA, 15 nt, Haemophilus influenzae Rd
uugugcuaaauuuuu

SEQ ID NO: 2714208 - RNA, 16 nt, Haemophilus influenzae Rd
uugugcuauacaaaau

SEQ ID NO: 2714209 - RNA, 18 nt, Haemophilus influenzae Rd
uugugcuauacaaaauuu

SEQ ID NO: 2714210 - RNA, 12 nt, Haemophilus influenzae Rd
uugugcuggagu

SEQ ID NO: 2714211 - RNA, 21 nt, Haemophilus influenzae Rd
uuuaaauacagcucaaaaugc

SEQ ID NO: 2714212 - RNA, 22 nt, Haemophilus influenzae Rd
uuuaaauacagcucaaaaugcu

SEQ ID NO: 2714213 - RNA, 13 nt, Haemophilus influenzae Rd
uuuaaauaguugu

SEQ ID NO: 2714214 - RNA, 21 nt, Haemophilus influenzae Rd
uuuaaaucaauuaacuauuua

SEQ ID NO: 2714215 - RNA, 21 nt, Haemophilus influenzae Rd
uuuaaaucuucuaucuacuac

SEQ ID NO: 2714216 - RNA, 22 nt, Haemophilus influenzae Rd
uuuaaauggaacuuguuuucca

SEQ ID NO: 2714217 - RNA, 12 nt, Haemophilus influenzae Rd
uuuaaauuauua

SEQ ID NO: 2714218 - RNA, 15 nt, Haemophilus influenzae Rd
uuuaaauucuccccg

SEQ ID NO: 2714219 - RNA, 15 nt, Haemophilus influenzae Rd
uuuaaauugagauaa

SEQ ID NO: 2714220 - RNA, 23 nt, Haemophilus influenzae Rd
uuuaaauuuuaaaaaauaauuua

SEQ ID NO: 2714221 - RNA, 13 nt, Haemophilus influenzae Rd
uuuaaauuuuccu

SEQ ID NO: 2714222 - RNA, 15 nt, Haemophilus influenzae Rd
uuuaaauuuugcuuu

SEQ ID NO: 2714223 - RNA, 13 nt, Haemophilus influenzae Rd
uuuaacaaauaca

SEQ ID NO: 2714224 - RNA, 17 nt, Haemophilus influenzae Rd
uuuaacaaauucacugu

SEQ ID NO: 2714225 - RNA, 22 nt, Haemophilus influenzae Rd
uuuaacacgaaaccaacgaaaa

SEQ ID NO: 2714226 - RNA, 22 nt, Haemophilus influenzae Rd
uuuaacaggaauuugcucaaua

SEQ ID NO: 2714227 - RNA, 15 nt, Haemophilus influenzae Rd
uuuaacauaacuuuc

SEQ ID NO: 2714228 - RNA, 15 nt, Haemophilus influenzae Rd
uuuaaccccugaauu

SEQ ID NO: 2714229 - RNA, 19 nt, Haemophilus influenzae Rd
uuuaaccgcacuuaagaua

SEQ ID NO: 2714230 - RNA, 17 nt, Haemophilus influenzae Rd
uuuaaccgcacuugcca

SEQ ID NO: 2714231 - RNA, 20 nt, Haemophilus influenzae Rd
uuuaaccgcacuuuuuguuu

SEQ ID NO: 2714232 - RNA, 17 nt, Haemophilus influenzae Rd
uuuaaccguaauuucaa

SEQ ID NO: 2714233 - RNA, 16 nt, Haemophilus influenzae Rd
uuuaaccguuauaacg

SEQ ID NO: 2714234 - RNA, 18 nt, Haemophilus influenzae Rd
uuuaaccugauuaaucaa

SEQ ID NO: 2714235 - RNA, 21 nt, Haemophilus influenzae Rd
uuuaacgcgcuacaauauuua

SEQ ID NO: 2714236 - RNA, 16 nt, Haemophilus influenzae Rd
uuuaacugaauuaaau

SEQ ID NO: 2714237 - RNA, 22 nt, Haemophilus influenzae Rd
uuuaacugcgauagaaucuaca

SEQ ID NO: 2714238 - RNA, 16 nt, Haemophilus influenzae Rd
uuuaagaaaaaauaua

SEQ ID NO: 2714239 - RNA, 17 nt, Haemophilus influenzae Rd
uuuaagaaaaaauauaa

SEQ ID NO: 2714240 - RNA, 16 nt, Haemophilus influenzae Rd
uuuaagaguaaauuua

SEQ ID NO: 2714241 - RNA, 21 nt, Haemophilus influenzae Rd
uuuaagauuuacagaacaaaa

SEQ ID NO: 2714242 - RNA, 13 nt, Haemophilus influenzae Rd
uuuaagcaaaauc

SEQ ID NO: 2714243 - RNA, 14 nt, Haemophilus influenzae Rd
uuuaaggacuaaau

SEQ ID NO: 2714244 - RNA, 20 nt, Haemophilus influenzae Rd
uuuaaguaaugcuaaauaua

SEQ ID NO: 2714245 - RNA, 22 nt, Haemophilus influenzae Rd
uuuaaguaaugcuaaauauaua

SEQ ID NO: 2714246 - RNA, 19 nt, Haemophilus influenzae Rd
uuuaaguaguauuuuauuu

SEQ ID NO: 2714247 - RNA, 17 nt, Haemophilus influenzae Rd
uuuaaguaguguuuuau

SEQ ID NO: 2714248 - RNA, 19 nt, Haemophilus influenzae Rd
uuuaaguaguguuuuauuu

SEQ ID NO: 2714249 - RNA, 19 nt, Haemophilus influenzae Rd
uuuaauaaaacaaauguaa

SEQ ID NO: 2714250 - RNA, 16 nt, Haemophilus influenzae Rd
uuuaauaaaauguuua

SEQ ID NO: 2714251 - RNA, 13 nt, Haemophilus influenzae Rd
uuuaauaaacaua

SEQ ID NO: 2714252 - RNA, 12 nt, Haemophilus influenzae Rd
uuuaauaaaccc

SEQ ID NO: 2714253 - RNA, 14 nt, Haemophilus influenzae Rd
uuuaauaaagauaa

SEQ ID NO: 2714254 - RNA, 17 nt, Haemophilus influenzae Rd
uuuaauaaaguaaaaua

SEQ ID NO: 2714255 - RNA, 15 nt, Haemophilus influenzae Rd
uuuaauaaaucuugg

SEQ ID NO: 2714256 - RNA, 19 nt, Haemophilus influenzae Rd
uuuaauaagauaauaaaug

SEQ ID NO: 2714257 - RNA, 16 nt, Haemophilus influenzae Rd
uuuaauaagccuugca

SEQ ID NO: 2714258 - RNA, 19 nt, Haemophilus influenzae Rd
uuuaauaaucaaaucuuug

SEQ ID NO: 2714259 - RNA, 20 nt, Haemophilus influenzae Rd
uuuaauaaucgaaaaaguuc

SEQ ID NO: 2714260 - RNA, 21 nt, Haemophilus influenzae Rd
uuuaauaaucuuaaauaauua

SEQ ID NO: 2714261 - RNA, 19 nt, Haemophilus influenzae Rd
uuuaauaaugaaagggaaa

SEQ ID NO: 2714262 - RNA, 19 nt, Haemophilus influenzae Rd
uuuaauaccauacauaaaa

SEQ ID NO: 2714263 - RNA, 14 nt, Haemophilus influenzae Rd
uuuaauagaauuuu

SEQ ID NO: 2714264 - RNA, 22 nt, Haemophilus influenzae Rd
uuuaauauaauugugauaaaug

SEQ ID NO: 2714265 - RNA, 20 nt, Haemophilus influenzae Rd
uuuaauaucuuccguuuuuu

SEQ ID NO: 2714266 - RNA, 16 nt, Haemophilus influenzae Rd
uuuaauaucuucuaau

SEQ ID NO: 2714267 - RNA, 22 nt, Haemophilus influenzae Rd
uuuaauaugccaaauaaaauua

SEQ ID NO: 2714268 - RNA, 11 nt, Haemophilus influenzae Rd
uuuaauauuuc

SEQ ID NO: 2714269 - RNA, 13 nt, Haemophilus influenzae Rd
uuuaauauuucuu

SEQ ID NO: 2714270 - RNA, 18 nt, Haemophilus influenzae Rd
uuuaauauuuuuuucaaa

SEQ ID NO: 2714271 - RNA, 14 nt, Haemophilus influenzae Rd
uuuaaucaaauaaa

SEQ ID NO: 2714272 - RNA, 21 nt, Haemophilus influenzae Rd
uuuaaucaaauaaaauauuuu

SEQ ID NO: 2714273 - RNA, 15 nt, Haemophilus influenzae Rd
uuuaaucauaaaaaa

SEQ ID NO: 2714274 - RNA, 23 nt, Haemophilus influenzae Rd
uuuaaucauaaaaaaaucugcac

SEQ ID NO: 2714275 - RNA, 17 nt, Haemophilus influenzae Rd
uuuaauccaaacuaaau

SEQ ID NO: 2714276 - RNA, 15 nt, Haemophilus influenzae Rd
uuuaauccguuaauu

SEQ ID NO: 2714277 - RNA, 19 nt, Haemophilus influenzae Rd
uuuaaucgcacuuaaaaga

SEQ ID NO: 2714278 - RNA, 15 nt, Haemophilus influenzae Rd
uuuaaucucccaaag

SEQ ID NO: 2714279 - RNA, 18 nt, Haemophilus influenzae Rd
uuuaaugaaccaaaucua

SEQ ID NO: 2714280 - RNA, 12 nt, Haemophilus influenzae Rd
uuuaaugaugaa

SEQ ID NO: 2714281 - RNA, 21 nt, Haemophilus influenzae Rd
uuuaaugccccuaauuauuua

SEQ ID NO: 2714282 - RNA, 19 nt, Haemophilus influenzae Rd
uuuaaugcuuacaaaauua

SEQ ID NO: 2714283 - RNA, 22 nt, Haemophilus influenzae Rd
uuuaauggauuccaucauugug

SEQ ID NO: 2714284 - RNA, 14 nt, Haemophilus influenzae Rd
uuuaauguauaaaa

SEQ ID NO: 2714285 - RNA, 21 nt, Haemophilus influenzae Rd
uuuaauguucccacaaagacu

SEQ ID NO: 2714286 - RNA, 17 nt, Haemophilus influenzae Rd
uuuaauguuuguuccac

SEQ ID NO: 2714287 - RNA, 15 nt, Haemophilus influenzae Rd
uuuaauuaaaauauu

SEQ ID NO: 2714288 - RNA, 22 nt, Haemophilus influenzae Rd
uuuaauuaaagccacauaauaa

SEQ ID NO: 2714289 - RNA, 14 nt, Haemophilus influenzae Rd
uuuaauuauagaaa

SEQ ID NO: 2714290 - RNA, 19 nt, Haemophilus influenzae Rd
uuuaauucgcugauuuauu

SEQ ID NO: 2714291 - RNA, 14 nt, Haemophilus influenzae Rd
uuuaauucuaaauu

SEQ ID NO: 2714292 - RNA, 18 nt, Haemophilus influenzae Rd
uuuaauucuaaauucuca

SEQ ID NO: 2714293 - RNA, 15 nt, Haemophilus influenzae Rd
uuuaauucugcccuu

SEQ ID NO: 2714294 - RNA, 23 nt, Haemophilus influenzae Rd
uuuaauugacguucuugcucagc

SEQ ID NO: 2714295 - RNA, 24 nt, Haemophilus influenzae Rd
uuuaauuggaaauaauauucaaaa

SEQ ID NO: 2714296 - RNA, 16 nt, Haemophilus influenzae Rd
uuuaauugucguugaa

SEQ ID NO: 2714297 - RNA, 20 nt, Haemophilus influenzae Rd
uuuaauugucguugaacuca

SEQ ID NO: 2714298 - RNA, 15 nt, Haemophilus influenzae Rd
uuuaauuuaaauaaa

SEQ ID NO: 2714299 - RNA, 17 nt, Haemophilus influenzae Rd
uuuaauuuauuuucuaa

SEQ ID NO: 2714300 - RNA, 18 nt, Haemophilus influenzae Rd
uuuaauuuauuuucuaau

SEQ ID NO: 2714301 - RNA, 20 nt, Haemophilus influenzae Rd
uuuaauuucauucaacaauu

SEQ ID NO: 2714302 - RNA, 22 nt, Haemophilus influenzae Rd
uuuaauuucuuuuccuugcuga

SEQ ID NO: 2714303 - RNA, 18 nt, Haemophilus influenzae Rd
uuuaauuugccccaauau

SEQ ID NO: 2714304 - RNA, 14 nt, Haemophilus influenzae Rd
uuuaauuuggugcu

SEQ ID NO: 2714305 - RNA, 13 nt, Haemophilus influenzae Rd
uuuaauuuuaugc

SEQ ID NO: 2714306 - RNA, 14 nt, Haemophilus influenzae Rd
uuuaauuuuccaaa

SEQ ID NO: 2714307 - RNA, 12 nt, Haemophilus influenzae Rd
uuuaauuuugaa

SEQ ID NO: 2714308 - RNA, 23 nt, Haemophilus influenzae Rd
uuuaauuuuuucuguuuuuccau

SEQ ID NO: 2714309 - RNA, 20 nt, Haemophilus influenzae Rd
uuuacaacgccaucuuuaaa

SEQ ID NO: 2714310 - RNA, 21 nt, Haemophilus influenzae Rd
uuuacaacgccaucuuuaaag

SEQ ID NO: 2714311 - RNA, 19 nt, Haemophilus influenzae Rd
uuuacaacugcaaaugaaa

SEQ ID NO: 2714312 - RNA, 16 nt, Haemophilus influenzae Rd
uuuacaagcugaaauu

SEQ ID NO: 2714313 - RNA, 18 nt, Haemophilus influenzae Rd
uuuacaaguuaaagcacc

SEQ ID NO: 2714314 - RNA, 14 nt, Haemophilus influenzae Rd
uuuacaaugagugu

SEQ ID NO: 2714315 - RNA, 17 nt, Haemophilus influenzae Rd
uuuacacauugccauau

SEQ ID NO: 2714316 - RNA, 21 nt, Haemophilus influenzae Rd
uuuauacuaaaaguaccaaaa

SEQ ID NO: 2714317 - RNA, 17 nt, Haemophilus influenzae Rd
uuuauagcauuuaaaua

SEQ ID NO: 2714318 - RNA, 22 nt, Haemophilus influenzae Rd
uuuauagccaacgucuuacuuu

SEQ ID NO: 2714319 - RNA, 18 nt, Haemophilus influenzae Rd
uuuauagccuucugccau

SEQ ID NO: 2714320 - RNA, 20 nt, Haemophilus influenzae Rd
uuuauagccuucugccauau

SEQ ID NO: 2714321 - RNA, 16 nt, Haemophilus influenzae Rd
uuuauaggcgcucuuc

SEQ ID NO: 2714322 - RNA, 14 nt, Haemophilus influenzae Rd
uuuauaguuuuauu

SEQ ID NO: 2714323 - RNA, 13 nt, Haemophilus influenzae Rd
uuuauauaauuua

SEQ ID NO: 2714324 - RNA, 19 nt, Haemophilus influenzae Rd
uuuauauaauuuaacauaa

SEQ ID NO: 2714325 - RNA, 16 nt, Haemophilus influenzae Rd
uuuauauauuaaaaaa

SEQ ID NO: 2714326 - RNA, 17 nt, Haemophilus influenzae Rd
uuuauauauugcuguca

SEQ ID NO: 2714327 - RNA, 20 nt, Haemophilus influenzae Rd
uuuauaucaagcugugcaaa

SEQ ID NO: 2714328 - RNA, 19 nt, Haemophilus influenzae Rd
uuuauauucauuuaaaaca

SEQ ID NO: 2714329 - RNA, 22 nt, Haemophilus influenzae Rd
uuuauauucauuuaaaacaaaa

SEQ ID NO: 2714330 - RNA, 13 nt, Haemophilus influenzae Rd
uuuauauugaaca

SEQ ID NO: 2714331 - RNA, 13 nt, Haemophilus influenzae Rd
uuuauauuuccau

SEQ ID NO: 2714332 - RNA, 18 nt, Haemophilus influenzae Rd
uuuauauuuccaucaaaa

SEQ ID NO: 2714333 - RNA, 16 nt, Haemophilus influenzae Rd
uuuaucaaaaaucuua

SEQ ID NO: 2714334 - RNA, 22 nt, Haemophilus influenzae Rd
uuuaucaacuaaaaaauaguua

SEQ ID NO: 2714335 - RNA, 13 nt, Haemophilus influenzae Rd
uuuaucacaaguu

SEQ ID NO: 2714336 - RNA, 16 nt, Haemophilus influenzae Rd
uuuaucacaaguuaaa

SEQ ID NO: 2714337 - RNA, 22 nt, Haemophilus influenzae Rd
uuuaucaggcggguauuuauau

SEQ ID NO: 2714338 - RNA, 18 nt, Haemophilus influenzae Rd
uuuaucauaacuauaauu

SEQ ID NO: 2714339 - RNA, 11 nt, Haemophilus influenzae Rd
uuuaucaucug

SEQ ID NO: 2714340 - RNA, 14 nt, Haemophilus influenzae Rd
uuuaucaucugcau

SEQ ID NO: 2714341 - RNA, 16 nt, Haemophilus influenzae Rd
uuuaucaucugcauaa

SEQ ID NO: 2714342 - RNA, 12 nt, Haemophilus influenzae Rd
uuuaucauugcu

SEQ ID NO: 2714343 - RNA, 20 nt, Haemophilus influenzae Rd
uuuaucauugcuccacuucu

SEQ ID NO: 2714344 - RNA, 21 nt, Haemophilus influenzae Rd
uuuauccaaccuacauuaauc

SEQ ID NO: 2714345 - RNA, 21 nt, Haemophilus influenzae Rd
uuuauccaauagauaaaauaa

SEQ ID NO: 2714346 - RNA, 19 nt, Haemophilus influenzae Rd
uuuauccacaugauauauu

SEQ ID NO: 2714347 - RNA, 15 nt, Haemophilus influenzae Rd
uuuauccaugaugaa

SEQ ID NO: 2714348 - RNA, 16 nt, Haemophilus influenzae Rd
uuuauccccaauuaag

SEQ ID NO: 2714349 - RNA, 19 nt, Haemophilus influenzae Rd
uuuauccgguuggaaaagc

SEQ ID NO: 2714350 - RNA, 19 nt, Haemophilus influenzae Rd
uuuauccuauuaauuuaau

SEQ ID NO: 2714351 - RNA, 14 nt, Haemophilus influenzae Rd
uuuaucgacaaauu

SEQ ID NO: 2714352 - RNA, 16 nt, Haemophilus influenzae Rd
uuuaucgacaaauuaa

SEQ ID NO: 2714353 - RNA, 16 nt, Haemophilus influenzae Rd
uuuaucgccauagaaa

SEQ ID NO: 2714354 - RNA, 22 nt, Haemophilus influenzae Rd
uuuaucgccauagaaaauagaa

SEQ ID NO: 2714355 - RNA, 16 nt, Haemophilus influenzae Rd
uuuaucgcucacuacg

SEQ ID NO: 2714356 - RNA, 22 nt, Haemophilus influenzae Rd
uuuaucggauauuuuauuugga

SEQ ID NO: 2714357 - RNA, 21 nt, Haemophilus influenzae Rd
uuuaucguguaaaaguuguuu

SEQ ID NO: 2714358 - RNA, 12 nt, Haemophilus influenzae Rd
uuuaucuaaaaa

SEQ ID NO: 2714359 - RNA, 12 nt, Haemophilus influenzae Rd
uuuaucuaaauu

SEQ ID NO: 2714360 - RNA, 15 nt, Haemophilus influenzae Rd
uuuaucuaaauuaau

SEQ ID NO: 2714361 - RNA, 21 nt, Haemophilus influenzae Rd
uuuaucuaaauuaauuaggac

SEQ ID NO: 2714362 - RNA, 19 nt, Haemophilus influenzae Rd
uuuaucuaaucauuaacaa

SEQ ID NO: 2714363 - RNA, 14 nt, Haemophilus influenzae Rd
uuuaucuaauugga

SEQ ID NO: 2714364 - RNA, 21 nt, Haemophilus influenzae Rd
uuuaucuaauuggacaagaaa

SEQ ID NO: 2714365 - RNA, 14 nt, Haemophilus influenzae Rd
uuuaucuauaaaaa

SEQ ID NO: 2714366 - RNA, 19 nt, Haemophilus influenzae Rd
uuuaucuucaaaauaguaa

SEQ ID NO: 2714367 - RNA, 15 nt, Haemophilus influenzae Rd
uuuaucuucuacaaa

SEQ ID NO: 2714368 - RNA, 23 nt, Haemophilus influenzae Rd
uuuaugaacucuguuugcauaua

SEQ ID NO: 2714369 - RNA, 17 nt, Haemophilus influenzae Rd
uuuaugaauguuucaaa

SEQ ID NO: 2714370 - RNA, 17 nt, Haemophilus influenzae Rd
uuuaugaccaaauacaa

SEQ ID NO: 2714371 - RNA, 16 nt, Haemophilus influenzae Rd
uuuaugauaaccaucu

SEQ ID NO: 2714372 - RNA, 15 nt, Haemophilus influenzae Rd
uuuaugauuaaaaug

SEQ ID NO: 2714373 - RNA, 14 nt, Haemophilus influenzae Rd
uuuauggaaauaaa

SEQ ID NO: 2714374 - RNA, 17 nt, Haemophilus influenzae Rd
uuuauguuacaaauugc

SEQ ID NO: 2714375 - RNA, 22 nt, Haemophilus influenzae Rd
uuuauguucuggauuguuguaa

SEQ ID NO: 2714376 - RNA, 14 nt, Haemophilus influenzae Rd
uuuauguuucucuc

SEQ ID NO: 2714377 - RNA, 14 nt, Haemophilus influenzae Rd
uuuauuaaaaauaa

SEQ ID NO: 2714378 - RNA, 12 nt, Haemophilus influenzae Rd
uuuauuaacaaa

SEQ ID NO: 2714379 - RNA, 14 nt, Haemophilus influenzae Rd
uuuauuaauaaacu

SEQ ID NO: 2714380 - RNA, 18 nt, Haemophilus influenzae Rd
uuuauuaauuauaaaaua

SEQ ID NO: 2714381 - RNA, 14 nt, Haemophilus influenzae Rd
uuuauuacauuaaa

SEQ ID NO: 2714382 - RNA, 20 nt, Haemophilus influenzae Rd
uuuauuacgauaguaaaaaa

SEQ ID NO: 2714383 - RNA, 22 nt, Haemophilus influenzae Rd
uuuauuacgauaguaaaaaauc

SEQ ID NO: 2714384 - RNA, 15 nt, Haemophilus influenzae Rd
uuuauuauaaaaaua

SEQ ID NO: 2714385 - RNA, 19 nt, Haemophilus influenzae Rd
uuuauuauaaaaauauuuu

SEQ ID NO: 2714386 - RNA, 15 nt, Haemophilus influenzae Rd
uuuauuaucuaaauc

SEQ ID NO: 2714387 - RNA, 18 nt, Haemophilus influenzae Rd
uuuauuauuaaauaaacg

SEQ ID NO: 2714388 - RNA, 13 nt, Haemophilus influenzae Rd
uuuauuauuuaau

SEQ ID NO: 2714389 - RNA, 13 nt, Haemophilus influenzae Rd
uuuauuauuuccu

SEQ ID NO: 2714390 - RNA, 14 nt, Haemophilus influenzae Rd
uuuauucaaaauaa

SEQ ID NO: 2714391 - RNA, 18 nt, Haemophilus influenzae Rd
uuuauucaauaauauauu

SEQ ID NO: 2714392 - RNA, 13 nt, Haemophilus influenzae Rd
uuuauucaguaaa

SEQ ID NO: 2714393 - RNA, 13 nt, Haemophilus influenzae Rd
uuuauucauaaau

SEQ ID NO: 2714394 - RNA, 17 nt, Haemophilus influenzae Rd
uuuauucauaaauuccu

SEQ ID NO: 2714395 - RNA, 17 nt, Haemophilus influenzae Rd
uuuauucuccaaauaua

SEQ ID NO: 2714396 - RNA, 23 nt, Haemophilus influenzae Rd
uuuauugccauauaccaauaauu

SEQ ID NO: 2714397 - RNA, 16 nt, Haemophilus influenzae Rd
uuuauugguaaauguc

SEQ ID NO: 2714398 - RNA, 19 nt, Haemophilus influenzae Rd
uuuauugguaacaacugcu

SEQ ID NO: 2714399 - RNA, 18 nt, Haemophilus influenzae Rd
uuuauuguagccuaguau

SEQ ID NO: 2714400 - RNA, 21 nt, Haemophilus influenzae Rd
uuuauuguagccuaguauuuu

SEQ ID NO: 2714401 - RNA, 14 nt, Haemophilus influenzae Rd
uuuauuuacaagcu

SEQ ID NO: 2714402 - RNA, 22 nt, Haemophilus influenzae Rd
uuuauuuacugauuuaaaaaaa

SEQ ID NO: 2714403 - RNA, 16 nt, Haemophilus influenzae Rd
uuuauuuauuaagaua

SEQ ID NO: 2714404 - RNA, 11 nt, Haemophilus influenzae Rd
uuuauuucuau

SEQ ID NO: 2714405 - RNA, 20 nt, Haemophilus influenzae Rd
uuuauuugaagcaagaaacg

SEQ ID NO: 2714406 - RNA, 20 nt, Haemophilus influenzae Rd
uuuauuugcggacaguauau

SEQ ID NO: 2714407 - RNA, 12 nt, Haemophilus influenzae Rd
uuuauuuuaaaa

SEQ ID NO: 2714408 - RNA, 16 nt, Haemophilus influenzae Rd
uuuauuuuauuaucaa

SEQ ID NO: 2714409 - RNA, 15 nt, Haemophilus influenzae Rd
uuuauuuucuuaauu

SEQ ID NO: 2714410 - RNA, 11 nt, Haemophilus influenzae Rd
uuuauuuugaa

SEQ ID NO: 2714411 - RNA, 18 nt, Haemophilus influenzae Rd
uuuauuuuguauauugug

SEQ ID NO: 2714412 - RNA, 13 nt, Haemophilus influenzae Rd
uuuauuuuuacuc

SEQ ID NO: 2714413 - RNA, 20 nt, Haemophilus influenzae Rd
uuuauuuuuaucauauauaa

SEQ ID NO: 2714414 - RNA, 22 nt, Haemophilus influenzae Rd
uuuauuuuuccuuuucauaaaa

SEQ ID NO: 2714415 - RNA, 17 nt, Haemophilus influenzae Rd
uuuauuuuuucaucauu

SEQ ID NO: 2714416 - RNA, 15 nt, Haemophilus influenzae Rd
uuuauuuuuucuaaa

SEQ ID NO: 2714417 - RNA, 13 nt, Haemophilus influenzae Rd
uuucaaaaagaua

SEQ ID NO: 2714418 - RNA, 15 nt, Haemophilus influenzae Rd
uuucaaaaagauauu

SEQ ID NO: 2714419 - RNA, 21 nt, Haemophilus influenzae Rd
uuucaaaaauagccuucauca

SEQ ID NO: 2714420 - RNA, 21 nt, Haemophilus influenzae Rd
uuucaaaacaguuuucaaauu

SEQ ID NO: 2714421 - RNA, 20 nt, Haemophilus influenzae Rd
uuucaaagcguuuuaaaauc

SEQ ID NO: 2714422 - RNA, 15 nt, Haemophilus influenzae Rd
uuuccaaaauuucug

SEQ ID NO: 2714423 - RNA, 21 nt, Haemophilus influenzae Rd
uuuccaaacauuuuuauuuuu

SEQ ID NO: 2714424 - RNA, 12 nt, Haemophilus influenzae Rd
uuuccaaccaau

SEQ ID NO: 2714425 - RNA, 18 nt, Haemophilus influenzae Rd
uuuccaagcguaaaagua

SEQ ID NO: 2714426 - RNA, 20 nt, Haemophilus influenzae Rd
uuuccauaauguucccuaua

SEQ ID NO: 2714427 - RNA, 21 nt, Haemophilus influenzae Rd
uuuccauaauguucccuauaa

SEQ ID NO: 2714428 - RNA, 17 nt, Haemophilus influenzae Rd
uuuccauaccucuauuu

SEQ ID NO: 2714429 - RNA, 17 nt, Haemophilus influenzae Rd
uuuccauaugaccauua

SEQ ID NO: 2714430 - RNA, 17 nt, Haemophilus influenzae Rd
uuuccaucuaaaaguug

SEQ ID NO: 2714431 - RNA, 16 nt, Haemophilus influenzae Rd
uuuccauuuuuuucua

SEQ ID NO: 2714432 - RNA, 16 nt, Haemophilus influenzae Rd
uuucccauuuaacccc

SEQ ID NO: 2714433 - RNA, 23 nt, Haemophilus influenzae Rd
uuucccauuugucucaaaaucca

SEQ ID NO: 2714434 - RNA, 23 nt, Haemophilus influenzae Rd
uuucccucaagacaaauuuguug

SEQ ID NO: 2714435 - RNA, 16 nt, Haemophilus influenzae Rd
uuucccuuuucuuauu

SEQ ID NO: 2714436 - RNA, 17 nt, Haemophilus influenzae Rd
uuuccgauuaauauacc

SEQ ID NO: 2714437 - RNA, 17 nt, Haemophilus influenzae Rd
uuuccgcaaaugcuaaa

SEQ ID NO: 2714438 - RNA, 21 nt, Haemophilus influenzae Rd
uuuccgcacuuuuuauucaaa

SEQ ID NO: 2714439 - RNA, 20 nt, Haemophilus influenzae Rd
uuuccgcauaaauaauaaag

SEQ ID NO: 2714440 - RNA, 15 nt, Haemophilus influenzae Rd
uuuccgugauuucuu

SEQ ID NO: 2714441 - RNA, 18 nt, Haemophilus influenzae Rd
uuuccgugauuucuuucg

SEQ ID NO: 2714442 - RNA, 22 nt, Haemophilus influenzae Rd
uuuccuacagugacuaaaacaa

SEQ ID NO: 2714443 - RNA, 15 nt, Haemophilus influenzae Rd
uuuccuaugccuuuu

SEQ ID NO: 2714444 - RNA, 15 nt, Haemophilus influenzae Rd
uuuccugaugaauuu

SEQ ID NO: 2714445 - RNA, 22 nt, Haemophilus influenzae Rd
uuuccuuauucgcugcaaaauc

SEQ ID NO: 2714446 - RNA, 16 nt, Haemophilus influenzae Rd
uuuccuucgccauuuu

SEQ ID NO: 2714447 - RNA, 20 nt, Haemophilus influenzae Rd
uuuccuucuauaucagaaaa

SEQ ID NO: 2714448 - RNA, 19 nt, Haemophilus influenzae Rd
uuuccuuugagccuucaaa

SEQ ID NO: 2714449 - RNA, 15 nt, Haemophilus influenzae Rd
uuuccuuugcugcca

SEQ ID NO: 2714450 - RNA, 16 nt, Haemophilus influenzae Rd
uuuccuuuuuuauuua

SEQ ID NO: 2714451 - RNA, 20 nt, Haemophilus influenzae Rd
uuucgacauucgcauauuuu

SEQ ID NO: 2714452 - RNA, 15 nt, Haemophilus influenzae Rd
uuucgauacuuucuu

SEQ ID NO: 2714453 - RNA, 17 nt, Haemophilus influenzae Rd
uuucgauucgccuugcu

SEQ ID NO: 2714454 - RNA, 20 nt, Haemophilus influenzae Rd
uuucgcagccacuugugcau

SEQ ID NO: 2714455 - RNA, 17 nt, Haemophilus influenzae Rd
uuucgcaggaucacaau

SEQ ID NO: 2714456 - RNA, 23 nt, Haemophilus influenzae Rd
uuucgcccaugcgaacagguuca

SEQ ID NO: 2714457 - RNA, 23 nt, Haemophilus influenzae Rd
uuucgccgaguaaauucaccaau

SEQ ID NO: 2714458 - RNA, 21 nt, Haemophilus influenzae Rd
uuucgcgccaccuccaauuag

SEQ ID NO: 2714459 - RNA, 16 nt, Haemophilus influenzae Rd
uuucgcggaauuucag

SEQ ID NO: 2714460 - RNA, 23 nt, Haemophilus influenzae Rd
uuucgcugcgaugugaccacgga

SEQ ID NO: 2714461 - RNA, 22 nt, Haemophilus influenzae Rd
uuucggaugacggaauacauca

SEQ ID NO: 2714462 - RNA, 19 nt, Haemophilus influenzae Rd
uuucggugcuuacuuuauu

SEQ ID NO: 2714463 - RNA, 20 nt, Haemophilus influenzae Rd
uuucgugggaaagacagaau

SEQ ID NO: 2714464 - RNA, 18 nt, Haemophilus influenzae Rd
uuucguuguuuuaauaaa

SEQ ID NO: 2714465 - RNA, 23 nt, Haemophilus influenzae Rd
uuucguuugacagcaauauauaa

SEQ ID NO: 2714466 - RNA, 13 nt, Haemophilus influenzae Rd
uuucuaaaaaacg

SEQ ID NO: 2714467 - RNA, 12 nt, Haemophilus influenzae Rd
uuucuaaaauaa

SEQ ID NO: 2714468 - RNA, 15 nt, Haemophilus influenzae Rd
uuucuaaaauaaacg

SEQ ID NO: 2714469 - RNA, 23 nt, Haemophilus influenzae Rd
uuucuaaaauaauaucacaacca

SEQ ID NO: 2714470 - RNA, 13 nt, Haemophilus influenzae Rd
uuucuaaaaucac

SEQ ID NO: 2714471 - RNA, 16 nt, Haemophilus influenzae Rd
uuucuaaauaaaauug

SEQ ID NO: 2714472 - RNA, 21 nt, Haemophilus influenzae Rd
uuucuaaaugaauaaaacuuc

SEQ ID NO: 2714473 - RNA, 23 nt, Haemophilus influenzae Rd
uuucuaaccgcacucuuucaaaa

SEQ ID NO: 2714474 - RNA, 18 nt, Haemophilus influenzae Rd
uuucuaacgcuuuuaaac

SEQ ID NO: 2714475 - RNA, 15 nt, Haemophilus influenzae Rd
uuucuaacuuuuaau

SEQ ID NO: 2714476 - RNA, 20 nt, Haemophilus influenzae Rd
uuucuaacuuuuaauucuug

SEQ ID NO: 2714477 - RNA, 20 nt, Haemophilus influenzae Rd
uuucuaagccugggcuugca

SEQ ID NO: 2714478 - RNA, 19 nt, Haemophilus influenzae Rd
uuucuaaguguuuccguga

SEQ ID NO: 2714479 - RNA, 17 nt, Haemophilus influenzae Rd
uuucuaauaacaaucuu

SEQ ID NO: 2714480 - RNA, 23 nt, Haemophilus influenzae Rd
uuucuaauaauccucuuuaaaau

SEQ ID NO: 2714481 - RNA, 15 nt, Haemophilus influenzae Rd
uuucuaauaccaauu

SEQ ID NO: 2714482 - RNA, 17 nt, Haemophilus influenzae Rd
uuucuaauauuucuuga

SEQ ID NO: 2714483 - RNA, 18 nt, Haemophilus influenzae Rd
uuucuaaugaaauuucuu

SEQ ID NO: 2714484 - RNA, 23 nt, Haemophilus influenzae Rd
uuucuaaugguuguaaauuuuca

SEQ ID NO: 2714485 - RNA, 12 nt, Haemophilus influenzae Rd
uuucuaauucuu

SEQ ID NO: 2714486 - RNA, 14 nt, Haemophilus influenzae Rd
uuucuaauucuucc

SEQ ID NO: 2714487 - RNA, 14 nt, Haemophilus influenzae Rd
uuucuaauuuuuca

SEQ ID NO: 2714488 - RNA, 13 nt, Haemophilus influenzae Rd
uuucuacaacgcu

SEQ ID NO: 2714489 - RNA, 14 nt, Haemophilus influenzae Rd
uuucuacgacauuu

SEQ ID NO: 2714490 - RNA, 22 nt, Haemophilus influenzae Rd
uuucuagcgguaaaccaacucu

SEQ ID NO: 2714491 - RNA, 13 nt, Haemophilus influenzae Rd
uuucuauuaaaaa

SEQ ID NO: 2714492 - RNA, 12 nt, Haemophilus influenzae Rd
uuucuauuuaaa

SEQ ID NO: 2714493 - RNA, 21 nt, Haemophilus influenzae Rd
uuucucaauuuuuucaaauaa

SEQ ID NO: 2714494 - RNA, 12 nt, Haemophilus influenzae Rd
uuucucaccaaa

SEQ ID NO: 2714495 - RNA, 23 nt, Haemophilus influenzae Rd
uuucucauuuaaccguaauuuca

SEQ ID NO: 2714496 - RNA, 20 nt, Haemophilus influenzae Rd
uuucucgaguaggcaauuca

SEQ ID NO: 2714497 - RNA, 18 nt, Haemophilus influenzae Rd
uuucucgggcugaaauac

SEQ ID NO: 2714498 - RNA, 21 nt, Haemophilus influenzae Rd
uuucucgugccuauuuauuua

SEQ ID NO: 2714499 - RNA, 14 nt, Haemophilus influenzae Rd
uuucucuacuaauu

SEQ ID NO: 2714500 - RNA, 20 nt, Haemophilus influenzae Rd
uuucucuagccgaacaagcc

SEQ ID NO: 2714501 - RNA, 14 nt, Haemophilus influenzae Rd
uuucucuuuucuca

SEQ ID NO: 2714502 - RNA, 15 nt, Haemophilus influenzae Rd
uuucucuuuucucaa

SEQ ID NO: 2714503 - RNA, 17 nt, Haemophilus influenzae Rd
uuucugaagguuuucuu

SEQ ID NO: 2714504 - RNA, 17 nt, Haemophilus influenzae Rd
uuucugauaauuuuuca

SEQ ID NO: 2714505 - RNA, 17 nt, Haemophilus influenzae Rd
uuucugcauuuaauggu

SEQ ID NO: 2714506 - RNA, 17 nt, Haemophilus influenzae Rd
uuucugcuucagauucu

SEQ ID NO: 2714507 - RNA, 17 nt, Haemophilus influenzae Rd
uuucugguacaaauuua

SEQ ID NO: 2714508 - RNA, 23 nt, Haemophilus influenzae Rd
uuucugguacaaauuuagauaac

SEQ ID NO: 2714509 - RNA, 14 nt, Haemophilus influenzae Rd
uuucugguuccauu

SEQ ID NO: 2714510 - RNA, 17 nt, Haemophilus influenzae Rd
uuucuguggcuaauucg

SEQ ID NO: 2714511 - RNA, 15 nt, Haemophilus influenzae Rd
uuucuguuacuaaau

SEQ ID NO: 2714512 - RNA, 14 nt, Haemophilus influenzae Rd
uuucuguugauuua

SEQ ID NO: 2714513 - RNA, 15 nt, Haemophilus influenzae Rd
uuucuguuuuuccau

SEQ ID NO: 2714514 - RNA, 16 nt, Haemophilus influenzae Rd
uuucuuaauuaagaua

SEQ ID NO: 2714515 - RNA, 17 nt, Haemophilus influenzae Rd
uuucuuagauuucuaau

SEQ ID NO: 2714516 - RNA, 18 nt, Haemophilus influenzae Rd
uuucuuauauauaaaaua

SEQ ID NO: 2714517 - RNA, 21 nt, Haemophilus influenzae Rd
uuucuuauauucaaauuucau

SEQ ID NO: 2714518 - RNA, 21 nt, Haemophilus influenzae Rd
uuucuuaugaaaaaaaauuua

SEQ ID NO: 2714519 - RNA, 14 nt, Haemophilus influenzae Rd
uuucuuaugaaccu

SEQ ID NO: 2714520 - RNA, 16 nt, Haemophilus influenzae Rd
uuucuuauuucuuucg

SEQ ID NO: 2714521 - RNA, 16 nt, Haemophilus influenzae Rd
uuucuucaaagcuuaa

SEQ ID NO: 2714522 - RNA, 23 nt, Haemophilus influenzae Rd
uuucuucaauaauugaagcaauu

SEQ ID NO: 2714523 - RNA, 16 nt, Haemophilus influenzae Rd
uuucuucacugcaucu

SEQ ID NO: 2714524 - RNA, 21 nt, Haemophilus influenzae Rd
uuucuucagcaucaacauaaa

SEQ ID NO: 2714525 - RNA, 22 nt, Haemophilus influenzae Rd
uuucuucagcuuguuuaaucac

SEQ ID NO: 2714526 - RNA, 20 nt, Haemophilus influenzae Rd
uuucuuccauuucaauaucu

SEQ ID NO: 2714527 - RNA, 23 nt, Haemophilus influenzae Rd
uuuggaguuguuuaaaauuagua

SEQ ID NO: 2714528 - RNA, 22 nt, Haemophilus influenzae Rd
uuuggauaauguucuuuuaaaa

SEQ ID NO: 2714529 - RNA, 21 nt, Haemophilus influenzae Rd
uuuggaucauuagcaacuucc

SEQ ID NO: 2714530 - RNA, 17 nt, Haemophilus influenzae Rd
uuuggauugguguuuaa

SEQ ID NO: 2714531 - RNA, 10 nt, Haemophilus influenzae Rd
uuuggcaaaa

SEQ ID NO: 2714532 - RNA, 16 nt, Haemophilus influenzae Rd
uuuggcaaaauaauca

SEQ ID NO: 2714533 - RNA, 23 nt, Haemophilus influenzae Rd
uuuggcaaauagcaaaaccgaua

SEQ ID NO: 2714534 - RNA, 15 nt, Haemophilus influenzae Rd
uuuggcacaacauca

SEQ ID NO: 2714535 - RNA, 17 nt, Haemophilus influenzae Rd
uuuggcacuaaagcaau

SEQ ID NO: 2714536 - RNA, 13 nt, Haemophilus influenzae Rd
uuuggcauuuuca

SEQ ID NO: 2714537 - RNA, 23 nt, Haemophilus influenzae Rd
uuuggcgcauuaaacucacuaaa

SEQ ID NO: 2714538 - RNA, 20 nt, Haemophilus influenzae Rd
uuuggcguaaauuauuuauu

SEQ ID NO: 2714539 - RNA, 15 nt, Haemophilus influenzae Rd
uuuggcucacaagac

SEQ ID NO: 2714540 - RNA, 22 nt, Haemophilus influenzae Rd
uuugggaaauggcuuuucaauu

SEQ ID NO: 2714541 - RNA, 22 nt, Haemophilus influenzae Rd
uuugguaagcaauagauucuaa

SEQ ID NO: 2714542 - RNA, 14 nt, Haemophilus influenzae Rd
uuugguaauguuua

SEQ ID NO: 2714543 - RNA, 14 nt, Haemophilus influenzae Rd
uuugguagaguaaa

SEQ ID NO: 2714544 - RNA, 14 nt, Haemophilus influenzae Rd
uuugguggcuuuuu

SEQ ID NO: 2714545 - RNA, 22 nt, Haemophilus influenzae Rd
uuugguguauuuauaacacaga

SEQ ID NO: 2714546 - RNA, 21 nt, Haemophilus influenzae Rd
uuuguaagauacguaaguucc

SEQ ID NO: 2714547 - RNA, 17 nt, Haemophilus influenzae Rd
uuuguaagcaacacaga

SEQ ID NO: 2714548 - RNA, 16 nt, Haemophilus influenzae Rd
uuuguaagcauuaaaa

SEQ ID NO: 2714549 - RNA, 17 nt, Haemophilus influenzae Rd
uuuguaauaaauuuuau

SEQ ID NO: 2714550 - RNA, 14 nt, Haemophilus influenzae Rd
uuuguaauuucuca

SEQ ID NO: 2714551 - RNA, 23 nt, Haemophilus influenzae Rd
uuuguagcgauauucuuuugaau

SEQ ID NO: 2714552 - RNA, 12 nt, Haemophilus influenzae Rd
uuuguauuuuau

SEQ ID NO: 2714553 - RNA, 18 nt, Haemophilus influenzae Rd
uuugucccaaaauauuuu

SEQ ID NO: 2714554 - RNA, 23 nt, Haemophilus influenzae Rd
uuugucccaaaauauuuucaaau

SEQ ID NO: 2714555 - RNA, 18 nt, Haemophilus influenzae Rd
uuuguccgccaccaaaau

SEQ ID NO: 2714556 - RNA, 15 nt, Haemophilus influenzae Rd
uuuguccuuuaucaa

SEQ ID NO: 2714557 - RNA, 23 nt, Haemophilus influenzae Rd
uuugucgccuuagauauuauuua

SEQ ID NO: 2714558 - RNA, 16 nt, Haemophilus influenzae Rd
uuugucucaaaaucca

SEQ ID NO: 2714559 - RNA, 17 nt, Haemophilus influenzae Rd
uuugucugaaauuuuua

SEQ ID NO: 2714560 - RNA, 17 nt, Haemophilus influenzae Rd
uuugucuuauucaaacu

SEQ ID NO: 2714561 - RNA, 15 nt, Haemophilus influenzae Rd
uuugugacauugcgu

SEQ ID NO: 2714562 - RNA, 21 nt, Haemophilus influenzae Rd
uuugugaggaaguuaaaauac

SEQ ID NO: 2714563 - RNA, 16 nt, Haemophilus influenzae Rd
uuugugaguucaagca

SEQ ID NO: 2714564 - RNA, 21 nt, Haemophilus influenzae Rd
uuugugccagcuggaaauucc

SEQ ID NO: 2714565 - RNA, 14 nt, Haemophilus influenzae Rd
uuugugccauuucu

SEQ ID NO: 2714566 - RNA, 16 nt, Haemophilus influenzae Rd
uuugugccauuucuaa

SEQ ID NO: 2714567 - RNA, 17 nt, Haemophilus influenzae Rd
uuugugcguuuuuuaau

SEQ ID NO: 2714568 - RNA, 19 nt, Haemophilus influenzae Rd
uuugugugauguauuuucu

SEQ ID NO: 2714569 - RNA, 17 nt, Haemophilus influenzae Rd
uuuguuacaacgccuca

SEQ ID NO: 2714570 - RNA, 23 nt, Haemophilus influenzae Rd
uuuguuacaucuucaaaaacaua

SEQ ID NO: 2714571 - RNA, 14 nt, Haemophilus influenzae Rd
uuuguuacucgcau

SEQ ID NO: 2714572 - RNA, 19 nt, Haemophilus influenzae Rd
uuuguuagaaauacauuau

SEQ ID NO: 2714573 - RNA, 19 nt, Haemophilus influenzae Rd
uuuguuagaucaaauuuga

SEQ ID NO: 2714574 - RNA, 13 nt, Haemophilus influenzae Rd
uuuguuauuaaau

SEQ ID NO: 2714575 - RNA, 14 nt, Haemophilus influenzae Rd
uuuguucauuuuaa

SEQ ID NO: 2714576 - RNA, 19 nt, Haemophilus influenzae Rd
uuuguuccacuucauaaau

SEQ ID NO: 2714577 - RNA, 17 nt, Haemophilus influenzae Rd
uuuguugauaaacauaa

SEQ ID NO: 2714578 - RNA, 12 nt, Haemophilus influenzae Rd
uuuguuuaauug

SEQ ID NO: 2714579 - RNA, 14 nt, Haemophilus influenzae Rd
uuuguuuaauugga

SEQ ID NO: 2714580 - RNA, 13 nt, Haemophilus influenzae Rd
uuuguuuaugaua

SEQ ID NO: 2714581 - RNA, 23 nt, Haemophilus influenzae Rd
uuuguuucuaaaaaugcguucag

SEQ ID NO: 2714582 - RNA, 13 nt, Haemophilus influenzae Rd
uuuguuucuaaau

SEQ ID NO: 2714583 - RNA, 15 nt, Haemophilus influenzae Rd
uuuguuuuauuuauu

SEQ ID NO: 2714584 - RNA, 15 nt, Haemophilus influenzae Rd
uuuuaaaaaauaauu

SEQ ID NO: 2714585 - RNA, 18 nt, Haemophilus influenzae Rd
uuuuaaaaaauaauuuag

SEQ ID NO: 2714586 - RNA, 22 nt, Haemophilus influenzae Rd
uuuuaaaaccacaauaaaauaa

SEQ ID NO: 2714587 - RNA, 12 nt, Haemophilus influenzae Rd
uuuuaaaacuau

SEQ ID NO: 2714588 - RNA, 15 nt, Haemophilus influenzae Rd
uuuuaaaacuauuuu

SEQ ID NO: 2714589 - RNA, 22 nt, Haemophilus influenzae Rd
uuuuaaaagaccacauucuaau

SEQ ID NO: 2714590 - RNA, 13 nt, Haemophilus influenzae Rd
uuuuaaaauacug

SEQ ID NO: 2714591 - RNA, 11 nt, Haemophilus influenzae Rd
uuuuaaaauag

SEQ ID NO: 2714592 - RNA, 18 nt, Haemophilus influenzae Rd
uuuuaaaauaucaaaguu

SEQ ID NO: 2714593 - RNA, 15 nt, Haemophilus influenzae Rd
uuuuaaaaucaucua

SEQ ID NO: 2714594 - RNA, 19 nt, Haemophilus influenzae Rd
uuuuaaaaugaacaaaaaa

SEQ ID NO: 2714595 - RNA, 14 nt, Haemophilus influenzae Rd
uuuuaaaauuuauu

SEQ ID NO: 2714596 - RNA, 15 nt, Haemophilus influenzae Rd
uuuuaaaauuuauuu

SEQ ID NO: 2714597 - RNA, 12 nt, Haemophilus influenzae Rd
uuuuaaaauuug

SEQ ID NO: 2714598 - RNA, 22 nt, Haemophilus influenzae Rd
uuuuaaaccgucauuuauaaaa

SEQ ID NO: 2714599 - RNA, 19 nt, Haemophilus influenzae Rd
uuuuaaacguuuauuuauu

SEQ ID NO: 2714600 - RNA, 15 nt, Haemophilus influenzae Rd
uuuuaaagaauauug

SEQ ID NO: 2714601 - RNA, 19 nt, Haemophilus influenzae Rd
uuuuaaaguaaauuuuaaa

SEQ ID NO: 2714602 - RNA, 15 nt, Haemophilus influenzae Rd
uuuuaaauaaaauau

SEQ ID NO: 2714603 - RNA, 16 nt, Haemophilus influenzae Rd
uuuuaaauaaaauauu

SEQ ID NO: 2714604 - RNA, 18 nt, Haemophilus influenzae Rd
uuuuaaauacagcucaaa

SEQ ID NO: 2714605 - RNA, 12 nt, Haemophilus influenzae Rd
uuuuaaauauca

SEQ ID NO: 2714606 - RNA, 15 nt, Haemophilus influenzae Rd
uuuuaaauauuuuua

SEQ ID NO: 2714607 - RNA, 18 nt, Haemophilus influenzae Rd
uuuuaaaucccaaucucc

SEQ ID NO: 2714608 - RNA, 13 nt, Haemophilus influenzae Rd
uuuuaaauuuuua

SEQ ID NO: 2714609 - RNA, 16 nt, Haemophilus influenzae Rd
uuuuaacacuuuuuca

SEQ ID NO: 2714610 - RNA, 14 nt, Haemophilus influenzae Rd
uuuuaaccauucuu

SEQ ID NO: 2714611 - RNA, 20 nt, Haemophilus influenzae Rd
uuuuaaccgcacuuuuuaau

SEQ ID NO: 2714612 - RNA, 21 nt, Haemophilus influenzae Rd
uuuuaaccgcacuuuuuaaua

SEQ ID NO: 2714613 - RNA, 22 nt, Haemophilus influenzae Rd
uuuuaaccgcacuuuuuaauaa

SEQ ID NO: 2714614 - RNA, 18 nt, Haemophilus influenzae Rd
uuuuaacuuaaucauuuu

SEQ ID NO: 2714615 - RNA, 21 nt, Haemophilus influenzae Rd
uuuuaacuuaaucauuuuuua

SEQ ID NO: 2714616 - RNA, 21 nt, Haemophilus influenzae Rd
uuuuaagucgcuaauuuuuuu

SEQ ID NO: 2714617 - RNA, 13 nt, Haemophilus influenzae Rd
uuuuaaguuucac

SEQ ID NO: 2714618 - RNA, 13 nt, Haemophilus influenzae Rd
uuuuaaguuuuca

SEQ ID NO: 2714619 - RNA, 21 nt, Haemophilus influenzae Rd
uuuuaauaaaauguuuauauu

SEQ ID NO: 2714620 - RNA, 15 nt, Haemophilus influenzae Rd
uuuuaauaaagauaa

SEQ ID NO: 2714621 - RNA, 19 nt, Haemophilus influenzae Rd
uuuuaauaaaguaaaauau

SEQ ID NO: 2714622 - RNA, 15 nt, Haemophilus influenzae Rd
uuuuaauaaaucaag

SEQ ID NO: 2714623 - RNA, 22 nt, Haemophilus influenzae Rd
uuuuaauaacauagaaaucacu

SEQ ID NO: 2714624 - RNA, 13 nt, Haemophilus influenzae Rd
uuuuaauaucuuc

SEQ ID NO: 2714625 - RNA, 22 nt, Haemophilus influenzae Rd
uuuuaaucguccaaagaaguuu

SEQ ID NO: 2714626 - RNA, 17 nt, Haemophilus influenzae Rd
uuuuaaugauaaauuuu

SEQ ID NO: 2714627 - RNA, 18 nt, Haemophilus influenzae Rd
uuuuaauguaauaaaaaa

SEQ ID NO: 2714628 - RNA, 15 nt, Haemophilus influenzae Rd
uuuuaauuacucacu

SEQ ID NO: 2714629 - RNA, 12 nt, Haemophilus influenzae Rd
uuuuaauucagg

SEQ ID NO: 2714630 - RNA, 16 nt, Haemophilus influenzae Rd
uuuuaauugugcaauu

SEQ ID NO: 2714631 - RNA, 14 nt, Haemophilus influenzae Rd
uuuuaauuguucuu

SEQ ID NO: 2714632 - RNA, 14 nt, Haemophilus influenzae Rd
uuuuaauuuaaaua

SEQ ID NO: 2714633 - RNA, 21 nt, Haemophilus influenzae Rd
uuuucaacaaacggucgaguu

SEQ ID NO: 2714634 - RNA, 14 nt, Haemophilus influenzae Rd
uuuucaacacuucc

SEQ ID NO: 2714635 - RNA, 20 nt, Haemophilus influenzae Rd
uuuucaagccaccagagaaa

SEQ ID NO: 2714636 - RNA, 12 nt, Haemophilus influenzae Rd
uuuucaauaacg

SEQ ID NO: 2714637 - RNA, 13 nt, Haemophilus influenzae Rd
uuuucaauaguuu

SEQ ID NO: 2714638 - RNA, 14 nt, Haemophilus influenzae Rd
uuuucaauaucaaa

SEQ ID NO: 2714639 - RNA, 13 nt, Haemophilus influenzae Rd
uuuucaauaucga

SEQ ID NO: 2714640 - RNA, 21 nt, Haemophilus influenzae Rd
uuuucaaucauuucuaagccu

SEQ ID NO: 2714641 - RNA, 19 nt, Haemophilus influenzae Rd
uuuucaauggcaucaauaa

SEQ ID NO: 2714642 - RNA, 21 nt, Haemophilus influenzae Rd
uuuucaauggcaucaauaaua

SEQ ID NO: 2714643 - RNA, 15 nt, Haemophilus influenzae Rd
uuuucaauuuuaaaa

SEQ ID NO: 2714644 - RNA, 19 nt, Haemophilus influenzae Rd
uuuucacaccgucuaaaaa

SEQ ID NO: 2714645 - RNA, 22 nt, Haemophilus influenzae Rd
uuuucacaccgucuaaaaaucc

SEQ ID NO: 2714646 - RNA, 12 nt, Haemophilus influenzae Rd
uuuucacagaaa

SEQ ID NO: 2714647 - RNA, 18 nt, Haemophilus influenzae Rd
uuuucacccaucuaaacu

SEQ ID NO: 2714648 - RNA, 23 nt, Haemophilus influenzae Rd
uuuucacccaucuaaacuuauau

SEQ ID NO: 2714649 - RNA, 17 nt, Haemophilus influenzae Rd
uuuucaccgcacuuucu

SEQ ID NO: 2714650 - RNA, 21 nt, Haemophilus influenzae Rd
uuuucaccgcacuuucuucuu

SEQ ID NO: 2714651 - RNA, 13 nt, Haemophilus influenzae Rd
uuuucaccuugau

SEQ ID NO: 2714652 - RNA, 20 nt, Haemophilus influenzae Rd
uuuucacgauauugcacaau

SEQ ID NO: 2714653 - RNA, 16 nt, Haemophilus influenzae Rd
uuuucacgccuuuguc

SEQ ID NO: 2714654 - RNA, 22 nt, Haemophilus influenzae Rd
uuuucacgguuuuccacuucuu

SEQ ID NO: 2714655 - RNA, 17 nt, Haemophilus influenzae Rd
uuuucagauaaucaaaa

SEQ ID NO: 2714656 - RNA, 14 nt, Haemophilus influenzae Rd
uuuucagcaaaaug

SEQ ID NO: 2714657 - RNA, 15 nt, Haemophilus influenzae Rd
uuuucagcaaaaugc

SEQ ID NO: 2714658 - RNA, 16 nt, Haemophilus influenzae Rd
uuuucagcaaaaugcg

SEQ ID NO: 2714659 - RNA, 22 nt, Haemophilus influenzae Rd
uuuucagguaaacgcucgcgau

SEQ ID NO: 2714660 - RNA, 16 nt, Haemophilus influenzae Rd
uuuucaguuguuugaa

SEQ ID NO: 2714661 - RNA, 18 nt, Haemophilus influenzae Rd
uuuucauaaauaucaaca

SEQ ID NO: 2714662 - RNA, 21 nt, Haemophilus influenzae Rd
uuuucauacaaucucuagauu

SEQ ID NO: 2714663 - RNA, 22 nt, Haemophilus influenzae Rd
uuuucauaucuuccguuguuuu

SEQ ID NO: 2714664 - RNA, 15 nt, Haemophilus influenzae Rd
uuuucauauucccaa

SEQ ID NO: 2714665 - RNA, 12 nt, Haemophilus influenzae Rd
uuuucaucaaug

SEQ ID NO: 2714666 - RNA, 18 nt, Haemophilus influenzae Rd
uuuucaucaauuuugaca

SEQ ID NO: 2714667 - RNA, 18 nt, Haemophilus influenzae Rd
uuuucaucguuaauuaau

SEQ ID NO: 2714668 - RNA, 17 nt, Haemophilus influenzae Rd
uuuucauuauauuuaau

SEQ ID NO: 2714669 - RNA, 17 nt, Haemophilus influenzae Rd
uuuucauugaaaaaguu

SEQ ID NO: 2714670 - RNA, 12 nt, Haemophilus influenzae Rd
uuuucauugcau

SEQ ID NO: 2714671 - RNA, 21 nt, Haemophilus influenzae Rd
uuuucauuuuagaauccaaaa

SEQ ID NO: 2714672 - RNA, 13 nt, Haemophilus influenzae Rd
uuuucauuuuuug

SEQ ID NO: 2714673 - RNA, 14 nt, Haemophilus influenzae Rd
uuuuccacauuuug

SEQ ID NO: 2714674 - RNA, 19 nt, Haemophilus influenzae Rd
uuuuccaccgcacuuugga

SEQ ID NO: 2714675 - RNA, 17 nt, Haemophilus influenzae Rd
uuuuccagcaaaaaaau

SEQ ID NO: 2714676 - RNA, 23 nt, Haemophilus influenzae Rd
uuuuccaucaccuucaacauaag

SEQ ID NO: 2714677 - RNA, 22 nt, Haemophilus influenzae Rd
uuuucccacaaagguaaaacuu

SEQ ID NO: 2714678 - RNA, 14 nt, Haemophilus influenzae Rd
uuuucccaguaaau

SEQ ID NO: 2714679 - RNA, 17 nt, Haemophilus influenzae Rd
uuuucccaguaaauauc

SEQ ID NO: 2714680 - RNA, 13 nt, Haemophilus influenzae Rd
uuuucccccagua

SEQ ID NO: 2714681 - RNA, 21 nt, Haemophilus influenzae Rd
uuuucccuaaugcuaaacguu

SEQ ID NO: 2714682 - RNA, 17 nt, Haemophilus influenzae Rd
uuuuccguuaaaaguuu

SEQ ID NO: 2714683 - RNA, 13 nt, Haemophilus influenzae Rd
uuuuccuaaaguu

SEQ ID NO: 2714684 - RNA, 16 nt, Haemophilus influenzae Rd
uuuuccuacagugacu

SEQ ID NO: 2714685 - RNA, 18 nt, Haemophilus influenzae Rd
uuuuccugaugaauuuag

SEQ ID NO: 2714686 - RNA, 17 nt, Haemophilus influenzae Rd
uuuuccuuaaucugaau

SEQ ID NO: 2714687 - RNA, 18 nt, Haemophilus influenzae Rd
uuuucgauuuaacacuuu

SEQ ID NO: 2714688 - RNA, 22 nt, Haemophilus influenzae Rd
uuuucgauuuaacacuuuuucu

SEQ ID NO: 2714689 - RNA, 16 nt, Haemophilus influenzae Rd
uuuucgcaaaauauca

SEQ ID NO: 2714690 - RNA, 17 nt, Haemophilus influenzae Rd
uuuucgcaaaauaucac

SEQ ID NO: 2714691 - RNA, 15 nt, Haemophilus influenzae Rd
uuuucgcaauaucau

SEQ ID NO: 2714692 - RNA, 20 nt, Haemophilus influenzae Rd
uuuucgcaauaucaucauca

SEQ ID NO: 2714693 - RNA, 19 nt, Haemophilus influenzae Rd
uuuucgcaccaaugccagu

SEQ ID NO: 2714694 - RNA, 21 nt, Haemophilus influenzae Rd
uuuucgcaggaucacaaucau

SEQ ID NO: 2714695 - RNA, 20 nt, Haemophilus influenzae Rd
uuuucgcaucaaucacagca

SEQ ID NO: 2714696 - RNA, 18 nt, Haemophilus influenzae Rd
uuuucgccccauuauuug

SEQ ID NO: 2714697 - RNA, 18 nt, Haemophilus influenzae Rd
uuuucgccuaauucaaua

SEQ ID NO: 2714698 - RNA, 23 nt, Haemophilus influenzae Rd
uuuucggacucgcuguaacauca

SEQ ID NO: 2714699 - RNA, 14 nt, Haemophilus influenzae Rd
uuuucguauuucgu

SEQ ID NO: 2714700 - RNA, 13 nt, Haemophilus influenzae Rd
uuuucgugauuuu

SEQ ID NO: 2714701 - RNA, 16 nt, Haemophilus influenzae Rd
uuuucguguuuaguuu

SEQ ID NO: 2714702 - RNA, 23 nt, Haemophilus influenzae Rd
uuuucuaaauagcuaacaauauc

SEQ ID NO: 2714703 - RNA, 14 nt, Haemophilus influenzae Rd
uuuucuaaauuuua

SEQ ID NO: 2714704 - RNA, 13 nt, Haemophilus influenzae Rd
uuuucuaauaauc

SEQ ID NO: 2714705 - RNA, 15 nt, Haemophilus influenzae Rd
uuuucuaauaauuca

SEQ ID NO: 2714706 - RNA, 15 nt, Haemophilus influenzae Rd
uuuucuaauauuucu

SEQ ID NO: 2714707 - RNA, 22 nt, Haemophilus influenzae Rd
uuuucuaccccucuuuucucaa

SEQ ID NO: 2714708 - RNA, 18 nt, Haemophilus influenzae Rd
uuuucuacgguuuuaaua

SEQ ID NO: 2714709 - RNA, 21 nt, Haemophilus influenzae Rd
uuuucuacuuccgauuuuaau

SEQ ID NO: 2714710 - RNA, 21 nt, Haemophilus influenzae Rd
uuuucucgugccuauuuauuu

SEQ ID NO: 2714711 - RNA, 11 nt, Haemophilus influenzae Rd
uuuucugcaga

SEQ ID NO: 2714712 - RNA, 17 nt, Haemophilus influenzae Rd
uuuucugcaguuucugg

SEQ ID NO: 2714713 - RNA, 20 nt, Haemophilus influenzae Rd
uuuucugcucuucaucaaaa

SEQ ID NO: 2714714 - RNA, 19 nt, Haemophilus influenzae Rd
uuuucugguacaaauuuag

SEQ ID NO: 2714715 - RNA, 17 nt, Haemophilus influenzae Rd
uuuucuguuuuuccauu

SEQ ID NO: 2714716 - RNA, 19 nt, Haemophilus influenzae Rd
uuuucuuaauuuuauuaau

SEQ ID NO: 2714717 - RNA, 12 nt, Haemophilus influenzae Rd
uuuucuuacaga

SEQ ID NO: 2714718 - RNA, 21 nt, Haemophilus influenzae Rd
uuuucuuauagauaaaauguu

SEQ ID NO: 2714719 - RNA, 13 nt, Haemophilus influenzae Rd
uuuucuuauuaau

SEQ ID NO: 2714720 - RNA, 13 nt, Haemophilus influenzae Rd
uuuucuuauuucu

SEQ ID NO: 2714721 - RNA, 16 nt, Haemophilus influenzae Rd
uuuucuucuaauucuu

SEQ ID NO: 2714722 - RNA, 15 nt, Haemophilus influenzae Rd
uuuucuucuuugacu

SEQ ID NO: 2714723 - RNA, 17 nt, Haemophilus influenzae Rd
uuuucuugaucuuugac

SEQ ID NO: 2714724 - RNA, 13 nt, Haemophilus influenzae Rd
uuuucuugccaaa

SEQ ID NO: 2714725 - RNA, 18 nt, Haemophilus influenzae Rd
uuuucuugccaaaauuca

SEQ ID NO: 2714726 - RNA, 20 nt, Haemophilus influenzae Rd
uuuucuugcuauucuuuaga

SEQ ID NO: 2714727 - RNA, 22 nt, Haemophilus influenzae Rd
uuuucuugcuauucuuuagauu

SEQ ID NO: 2714728 - RNA, 18 nt, Haemophilus influenzae Rd
uuuucuuguaaugcugua

SEQ ID NO: 2714729 - RNA, 18 nt, Haemophilus influenzae Rd
uuuucuuucaguuuugcu

SEQ ID NO: 2714730 - RNA, 13 nt, Haemophilus influenzae Rd
uuuucuuuccaac

SEQ ID NO: 2714731 - RNA, 16 nt, Haemophilus influenzae Rd
uuuucuuuuauacuua

SEQ ID NO: 2714732 - RNA, 15 nt, Haemophilus influenzae Rd
uuuucuuuucuucua

SEQ ID NO: 2714733 - RNA, 13 nt, Haemophilus influenzae Rd
uuuucuuuugccc

SEQ ID NO: 2714734 - RNA, 16 nt, Haemophilus influenzae Rd
uuuucuuuuuccugaa

SEQ ID NO: 2714735 - RNA, 13 nt, Haemophilus influenzae Rd
uuuugaacaaggu

SEQ ID NO: 2714736 - RNA, 16 nt, Haemophilus influenzae Rd
uuuugaacaagguuuc

SEQ ID NO: 2714737 - RNA, 13 nt, Haemophilus influenzae Rd
uuuugaacaaugu

SEQ ID NO: 2714738 - RNA, 18 nt, Haemophilus influenzae Rd
uuuugaaguuaucaauaa

SEQ ID NO: 2714739 - RNA, 22 nt, Haemophilus influenzae Rd
uuuuugcagggauuucaauaaa

SEQ ID NO: 2714740 - RNA, 18 nt, Haemophilus influenzae Rd
uuuuugccaaaauucugu

SEQ ID NO: 2714741 - RNA, 20 nt, Haemophilus influenzae Rd
uuuuugccaaaauucuguuu

SEQ ID NO: 2714742 - RNA, 16 nt, Haemophilus influenzae Rd
uuuuugccaauuuuuu

SEQ ID NO: 2714743 - RNA, 22 nt, Haemophilus influenzae Rd
uuuuugcuuucuuauauauaaa

SEQ ID NO: 2714744 - RNA, 15 nt, Haemophilus influenzae Rd
uuuuugcuuuucccu

SEQ ID NO: 2714745 - RNA, 19 nt, Haemophilus influenzae Rd
uuuuuggacuuuauuugau

SEQ ID NO: 2714746 - RNA, 11 nt, Haemophilus influenzae Rd
uuuuuggcugc

SEQ ID NO: 2714747 - RNA, 21 nt, Haemophilus influenzae Rd
uuuuugggagguuucaagaag

SEQ ID NO: 2714748 - RNA, 22 nt, Haemophilus influenzae Rd
uuuuuggugcuaccgaaagaua

SEQ ID NO: 2714749 - RNA, 13 nt, Haemophilus influenzae Rd
uuuuuguaaaaua

SEQ ID NO: 2714750 - RNA, 11 nt, Haemophilus influenzae Rd
uuuuugugauu

SEQ ID NO: 2714751 - RNA, 11 nt, Haemophilus influenzae Rd
uuuuuguugau

SEQ ID NO: 2714752 - RNA, 14 nt, Haemophilus influenzae Rd
uuuuuguuuuuccg

SEQ ID NO: 2714753 - RNA, 12 nt, Haemophilus influenzae Rd
uuuuuuaaagua

SEQ ID NO: 2714754 - RNA, 23 nt, Haemophilus influenzae Rd
uuuuuuaaucaauuaaagaaauu

SEQ ID NO: 2714755 - RNA, 11 nt, Haemophilus influenzae Rd
uuuuuuaauuc

SEQ ID NO: 2714756 - RNA, 19 nt, Haemophilus influenzae Rd
uuuuuuacucaaagaaaua

SEQ ID NO: 2714757 - RNA, 13 nt, Haemophilus influenzae Rd
uuuuuuacuugga

SEQ ID NO: 2714758 - RNA, 16 nt, Haemophilus influenzae Rd
uuuuuuagauuuauuu

SEQ ID NO: 2714759 - RNA, 17 nt, Haemophilus influenzae Rd
uuuuuuauaaaaaaauc

SEQ ID NO: 2714760 - RNA, 16 nt, Haemophilus influenzae Rd
uuuuuuauaaaauuuc

SEQ ID NO: 2714761 - RNA, 16 nt, Haemophilus influenzae Rd
uuuuuuaucaaaaauc

SEQ ID NO: 2714762 - RNA, 23 nt, Haemophilus influenzae Rd
uuuuuuauuaauuauaaaauagc

SEQ ID NO: 2714763 - RNA, 17 nt, Haemophilus influenzae Rd
uuuuuuauuacauuaaa

SEQ ID NO: 2714764 - RNA, 20 nt, Haemophilus influenzae Rd
uuuuuuauuaucuaaaucuc

SEQ ID NO: 2714765 - RNA, 12 nt, Haemophilus influenzae Rd
uuuuuuauuucu

SEQ ID NO: 2714766 - RNA, 13 nt, Haemophilus influenzae Rd
uuuuuuauuuuau

SEQ ID NO: 2714767 - RNA, 13 nt, Haemophilus influenzae Rd
uuuuuuauuuuuu

SEQ ID NO: 2714768 - RNA, 13 nt, Haemophilus influenzae Rd
uuuuuucaaucau

SEQ ID NO: 2714769 - RNA, 14 nt, Haemophilus influenzae Rd
uuuuuucuucaaug

SEQ ID NO: 2714770 - RNA, 11 nt, Haemophilus influenzae Rd
uuuuuuuaaau

SEQ ID NO: 2714771 - RNA, 18 nt, Haemophilus influenzae Rd
uuuuuuugcucaaaauca

SEQ ID NO: 2714772 - RNA, 18 nt, Haemophilus influenzae Rd
accaacguaaaaucgccu

SEQ ID NO: 2714773 - RNA, 17 nt, Haemophilus influenzae Rd
accaacguggcuuuucu

SEQ ID NO: 2714774 - RNA, 19 nt, Haemophilus influenzae Rd
accauugugccaaauucag

SEQ ID NO: 2714775 - RNA, 15 nt, Haemophilus influenzae Rd
accauuguuuaauuc

SEQ ID NO: 2714776 - RNA, 19 nt, Haemophilus influenzae Rd
accauuuaauaaaacaaau

SEQ ID NO: 2714777 - RNA, 21 nt, Haemophilus influenzae Rd
accauuuaauaaaacaaaugu

SEQ ID NO: 2714778 - RNA, 21 nt, Haemophilus influenzae Rd
accauuugguggcuuuuuuau

SEQ ID NO: 2714779 - RNA, 12 nt, Haemophilus influenzae Rd
accauuuuucca

SEQ ID NO: 2714780 - RNA, 21 nt, Haemophilus influenzae Rd
accauuuuuccagcaaaaaaa

SEQ ID NO: 2714781 - RNA, 13 nt, Haemophilus influenzae Rd
accauuuuucgug

SEQ ID NO: 2714782 - RNA, 14 nt, Haemophilus influenzae Rd
acccaaauuaaaaa

SEQ ID NO: 2714783 - RNA, 15 nt, Haemophilus influenzae Rd
acccaaauuaaaaaa

SEQ ID NO: 2714784 - RNA, 14 nt, Haemophilus influenzae Rd
acccaaauuaucaa

SEQ ID NO: 2714785 - RNA, 17 nt, Haemophilus influenzae Rd
acccaagccaauuauuu

SEQ ID NO: 2714786 - RNA, 18 nt, Haemophilus influenzae Rd
acccaagccaauuauuua

SEQ ID NO: 2714787 - RNA, 20 nt, Haemophilus influenzae Rd
acccaauuagaugauuuuaa

SEQ ID NO: 2714788 - RNA, 21 nt, Haemophilus influenzae Rd
acccaauuagaugauuuuaaa

SEQ ID NO: 2714789 - RNA, 17 nt, Haemophilus influenzae Rd
acccacuaaaauuugua

SEQ ID NO: 2714790 - RNA, 12 nt, Haemophilus influenzae Rd
acccacuaagua

SEQ ID NO: 2714791 - RNA, 16 nt, Haemophilus influenzae Rd
acccacugauuuuucu

SEQ ID NO: 2714792 - RNA, 22 nt, Haemophilus influenzae Rd
acccacuucacaacuuuuuaac

SEQ ID NO: 2714793 - RNA, 18 nt, Haemophilus influenzae Rd
acccacuucgauauuuuc

SEQ ID NO: 2714794 - RNA, 21 nt, Haemophilus influenzae Rd
acccaggaguaaccacaaaau

SEQ ID NO: 2714795 - RNA, 12 nt, Haemophilus influenzae Rd
acccauaaaauu

SEQ ID NO: 2714796 - RNA, 16 nt, Haemophilus influenzae Rd
acccauacuuuaacuu

SEQ ID NO: 2714797 - RNA, 14 nt, Haemophilus influenzae Rd
acccaucaaaucuu

SEQ ID NO: 2714798 - RNA, 15 nt, Haemophilus influenzae Rd
acccauucaaauggu

SEQ ID NO: 2714799 - RNA, 16 nt, Haemophilus influenzae Rd
acccauuggaagauuu

SEQ ID NO: 2714800 - RNA, 18 nt, Haemophilus influenzae Rd
acccauuggaagauuucu

SEQ ID NO: 2714801 - RNA, 19 nt, Haemophilus influenzae Rd
acccauuuugauugcuaca

SEQ ID NO: 2714802 - RNA, 23 nt, Haemophilus influenzae Rd
accccaaacuuggaucauacaua

SEQ ID NO: 2714803 - RNA, 15 nt, Haemophilus influenzae Rd
accccauuugccaaa

SEQ ID NO: 2714804 - RNA, 15 nt, Haemophilus influenzae Rd
accccugaauuuugu

SEQ ID NO: 2714805 - RNA, 14 nt, Haemophilus influenzae Rd
accccuucuguugc

SEQ ID NO: 2714806 - RNA, 17 nt, Haemophilus influenzae Rd
acccgaaccgauuuuaa

SEQ ID NO: 2714807 - RNA, 19 nt, Haemophilus influenzae Rd
acccgaaccgauuuuaaau

SEQ ID NO: 2714808 - RNA, 23 nt, Haemophilus influenzae Rd
acccgauaaaugcacauuuuuac

SEQ ID NO: 2714809 - RNA, 15 nt, Haemophilus influenzae Rd
acccgccuuaaucau

SEQ ID NO: 2714810 - RNA, 21 nt, Haemophilus influenzae Rd
acccgcuaaaguucucaaaaa

SEQ ID NO: 2714811 - RNA, 17 nt, Haemophilus influenzae Rd
acccgcuucaaucgcaa

SEQ ID NO: 2714812 - RNA, 18 nt, Haemophilus influenzae Rd
acccgcuuguuucaauau

SEQ ID NO: 2714813 - RNA, 16 nt, Haemophilus influenzae Rd
acccgcuuuaauagau

SEQ ID NO: 2714814 - RNA, 13 nt, Haemophilus influenzae Rd
acccguaauuaaa

SEQ ID NO: 2714815 - RNA, 20 nt, Haemophilus influenzae Rd
acccguaauuaaaaauaacc

SEQ ID NO: 2714816 - RNA, 21 nt, Haemophilus influenzae Rd
acccguuugaaguacauucaa

SEQ ID NO: 2714817 - RNA, 22 nt, Haemophilus influenzae Rd
acccuacaggcuuccaacaaaa

SEQ ID NO: 2714818 - RNA, 16 nt, Haemophilus influenzae Rd
acccuacgauacuuuu

SEQ ID NO: 2714819 - RNA, 22 nt, Haemophilus influenzae Rd
acccuacgauacuuuuaauuaa

SEQ ID NO: 2714820 - RNA, 15 nt, Haemophilus influenzae Rd
acccuauuacuuucc

SEQ ID NO: 2714821 - RNA, 16 nt, Haemophilus influenzae Rd
acccuauuacuuucca

SEQ ID NO: 2714822 - RNA, 19 nt, Haemophilus influenzae Rd
acccuauucgcugauaaac

SEQ ID NO: 2714823 - RNA, 16 nt, Haemophilus influenzae Rd
acccucaguuaccaua

SEQ ID NO: 2714824 - RNA, 22 nt, Haemophilus influenzae Rd
acccucaguuaccauacagccu

SEQ ID NO: 2714825 - RNA, 19 nt, Haemophilus influenzae Rd
acccugaauucccaaacgg

SEQ ID NO: 2714826 - RNA, 19 nt, Haemophilus influenzae Rd
acccuuguuacaccuuggc

SEQ ID NO: 2714827 - RNA, 14 nt, Haemophilus influenzae Rd
accgaaagcccaca

SEQ ID NO: 2714828 - RNA, 22 nt, Haemophilus influenzae Rd
accgaccauuggaacgauuaaa

SEQ ID NO: 2714829 - RNA, 16 nt, Haemophilus influenzae Rd
accgacucguccauca

SEQ ID NO: 2714830 - RNA, 19 nt, Haemophilus influenzae Rd
accgacuuuauauugacaa

SEQ ID NO: 2714831 - RNA, 20 nt, Haemophilus influenzae Rd
accgagaugcauuuuuuaau

SEQ ID NO: 2714832 - RNA, 23 nt, Haemophilus influenzae Rd
accgauaaaaccuaaaauugauu

SEQ ID NO: 2714833 - RNA, 16 nt, Haemophilus influenzae Rd
accgauaaggaaaaua

SEQ ID NO: 2714834 - RNA, 18 nt, Haemophilus influenzae Rd
accgauaauaugcaucac

SEQ ID NO: 2714835 - RNA, 19 nt, Haemophilus influenzae Rd
accgauagcuuuuguugcu

SEQ ID NO: 2714836 - RNA, 15 nt, Haemophilus influenzae Rd
accgauuaauucaac

SEQ ID NO: 2714837 - RNA, 16 nt, Haemophilus influenzae Rd
accgcaaaaauacuaa

SEQ ID NO: 2714838 - RNA, 14 nt, Haemophilus influenzae Rd
accgcaaaagccaa

SEQ ID NO: 2714839 - RNA, 15 nt, Haemophilus influenzae Rd
accgcaaaauuauuu

SEQ ID NO: 2714840 - RNA, 15 nt, Haemophilus influenzae Rd
accgcaaucuucaca

SEQ ID NO: 2714841 - RNA, 17 nt, Haemophilus influenzae Rd
accgcaaucuucacaaa

SEQ ID NO: 2714842 - RNA, 20 nt, Haemophilus influenzae Rd
accgcacuuagauuugaacc

SEQ ID NO: 2714843 - RNA, 21 nt, Haemophilus influenzae Rd
accgcacuuauuugacuuaaa

SEQ ID NO: 2714844 - RNA, 15 nt, Haemophilus influenzae Rd
accgcacuucaaaaa

SEQ ID NO: 2714845 - RNA, 19 nt, Haemophilus influenzae Rd
accgcacuucuaugaagaa

SEQ ID NO: 2714846 - RNA, 21 nt, Haemophilus influenzae Rd
accgcacuuuaaucugugccu

SEQ ID NO: 2714847 - RNA, 17 nt, Haemophilus influenzae Rd
accgcacuuuccccccu

SEQ ID NO: 2714848 - RNA, 22 nt, Haemophilus influenzae Rd
accgcacuuucgccgaguaaau

SEQ ID NO: 2714849 - RNA, 23 nt, Haemophilus influenzae Rd
accgcacuuugcacuuuaaagaa

SEQ ID NO: 2714850 - RNA, 21 nt, Haemophilus influenzae Rd
accgcacuuuggaauauucuu

SEQ ID NO: 2714851 - RNA, 20 nt, Haemophilus influenzae Rd
accgcacuuuggcaauaaaa

SEQ ID NO: 2714852 - RNA, 19 nt, Haemophilus influenzae Rd
accgcacuuuguggcuuuu

SEQ ID NO: 2714853 - RNA, 17 nt, Haemophilus influenzae Rd
accgcacuuuuaaaauu

SEQ ID NO: 2714854 - RNA, 17 nt, Haemophilus influenzae Rd
accgcacuuuuaauuaa

SEQ ID NO: 2714855 - RNA, 18 nt, Haemophilus influenzae Rd
accgcacuuuuauauuua

SEQ ID NO: 2714856 - RNA, 21 nt, Haemophilus influenzae Rd
accgcacuuuucaacaaaaaa

SEQ ID NO: 2714857 - RNA, 14 nt, Haemophilus influenzae Rd
accgcacuuuucuu

SEQ ID NO: 2714858 - RNA, 12 nt, Haemophilus influenzae Rd
accgcacuuuug

SEQ ID NO: 2714859 - RNA, 21 nt, Haemophilus influenzae Rd
accgcacuuuuuaauaaaaug

SEQ ID NO: 2714860 - RNA, 14 nt, Haemophilus influenzae Rd
accgcacuuuuuau

SEQ ID NO: 2714861 - RNA, 19 nt, Haemophilus influenzae Rd
accgcacuuuuuaucuaaa

SEQ ID NO: 2714862 - RNA, 20 nt, Haemophilus influenzae Rd
accgcacuuuuuaucuaaau

SEQ ID NO: 2714863 - RNA, 21 nt, Haemophilus influenzae Rd
accgcacuuuuucuugaucuu

SEQ ID NO: 2714864 - RNA, 13 nt, Haemophilus influenzae Rd
accgcacuuuuug

SEQ ID NO: 2714865 - RNA, 15 nt, Haemophilus influenzae Rd
accgcacuuuuuguu

SEQ ID NO: 2714866 - RNA, 19 nt, Haemophilus influenzae Rd
accgcacuuuuuguuuuau

SEQ ID NO: 2714867 - RNA, 21 nt, Haemophilus influenzae Rd
accgcacuuuuuuaugacuaa

SEQ ID NO: 2714868 - RNA, 21 nt, Haemophilus influenzae Rd
accgcacuuuuuucuaccgca

SEQ ID NO: 2714869 - RNA, 15 nt, Haemophilus influenzae Rd
accgcacuuuuuugu

SEQ ID NO: 2714870 - RNA, 18 nt, Haemophilus influenzae Rd
accgcacuuuuuuguuuu

SEQ ID NO: 2714871 - RNA, 21 nt, Haemophilus influenzae Rd
accgcacuuuuuuuauaucuu

SEQ ID NO: 2714872 - RNA, 12 nt, Haemophilus influenzae Rd
accgcauuaaua

SEQ ID NO: 2714873 - RNA, 14 nt, Haemophilus influenzae Rd
accgcauucuucuu

SEQ ID NO: 2714874 - RNA, 19 nt, Haemophilus influenzae Rd
accgccaagcgcugcagua

SEQ ID NO: 2714875 - RNA, 14 nt, Haemophilus influenzae Rd
accgccuacaugau

SEQ ID NO: 2714876 - RNA, 20 nt, Haemophilus influenzae Rd
accgccuacaugaucaccgu

SEQ ID NO: 2714877 - RNA, 24 nt, Haemophilus influenzae Rd
accgcguauuaucggaagaugaaa

SEQ ID NO: 2714878 - RNA, 19 nt, Haemophilus influenzae Rd
accgcuaucgucauuaaua

SEQ ID NO: 2714879 - RNA, 21 nt, Haemophilus influenzae Rd
accgcucuuuaacaaauucac

SEQ ID NO: 2714880 - RNA, 13 nt, Haemophilus influenzae Rd
accgcuucuuccu

SEQ ID NO: 2714881 - RNA, 19 nt, Haemophilus influenzae Rd
accgcuuucaauuaaugaa

SEQ ID NO: 2714882 - RNA, 15 nt, Haemophilus influenzae Rd
accguagucagauaa

SEQ ID NO: 2714883 - RNA, 13 nt, Haemophilus influenzae Rd
accgucagccaaa

SEQ ID NO: 2714884 - RNA, 18 nt, Haemophilus influenzae Rd
accgucagugcuuucaua

SEQ ID NO: 2714885 - RNA, 22 nt, Haemophilus influenzae Rd
accgucaucgcuucuaaaucua

SEQ ID NO: 2714886 - RNA, 19 nt, Haemophilus influenzae Rd
accgucaugggauaaacau

SEQ ID NO: 2714887 - RNA, 21 nt, Haemophilus influenzae Rd
accguccaagguuuuaauuuu

SEQ ID NO: 2714888 - RNA, 14 nt, Haemophilus influenzae Rd
accgucuuuaaaua

SEQ ID NO: 2714889 - RNA, 21 nt, Haemophilus influenzae Rd
accgugcgugaauguccauuu

SEQ ID NO: 2714890 - RNA, 18 nt, Haemophilus influenzae Rd
accgugggugugaaauau

SEQ ID NO: 2714891 - RNA, 15 nt, Haemophilus influenzae Rd
accguguuuuucacg

SEQ ID NO: 2714892 - RNA, 18 nt, Haemophilus influenzae Rd
accguguuuuucaucaau

SEQ ID NO: 2714893 - RNA, 21 nt, Haemophilus influenzae Rd
accguuaagcaaauuucuguu

SEQ ID NO: 2714894 - RNA, 14 nt, Haemophilus influenzae Rd
accguucuauauuu

SEQ ID NO: 2714895 - RNA, 18 nt, Haemophilus influenzae Rd
accguugaaugcuucuac

SEQ ID NO: 2714896 - RNA, 20 nt, Haemophilus influenzae Rd
accguuuuuauuuguucuac

SEQ ID NO: 2714897 - RNA, 14 nt, Haemophilus influenzae Rd
accguuuuuucuuu

SEQ ID NO: 2714898 - RNA, 14 nt, Haemophilus influenzae Rd
accuaaaaauuuaa

SEQ ID NO: 2714899 - RNA, 14 nt, Haemophilus influenzae Rd
accuaaaaauuuua

SEQ ID NO: 2714900 - RNA, 16 nt, Haemophilus influenzae Rd
accuaaaauaaauuuu

SEQ ID NO: 2714901 - RNA, 21 nt, Haemophilus influenzae Rd
accuaaaauagagcaaauaua

SEQ ID NO: 2714902 - RNA, 14 nt, Haemophilus influenzae Rd
accuaaaauauuua

SEQ ID NO: 2714903 - RNA, 14 nt, Haemophilus influenzae Rd
accuaaaauugauu

SEQ ID NO: 2714904 - RNA, 20 nt, Haemophilus influenzae Rd
accuaaaccuuauuuuaaau

SEQ ID NO: 2714905 - RNA, 18 nt, Haemophilus influenzae Rd
accuaaacgaucaucuau

SEQ ID NO: 2714906 - RNA, 19 nt, Haemophilus influenzae Rd
accuaaacgaucaucuaua

SEQ ID NO: 2714907 - RNA, 21 nt, Haemophilus influenzae Rd
accuaaacgaucaucuauacc

SEQ ID NO: 2714908 - RNA, 13 nt, Haemophilus influenzae Rd
accuaaaucuuua

SEQ ID NO: 2714909 - RNA, 17 nt, Haemophilus influenzae Rd
accuaaaucuuuaucaa

SEQ ID NO: 2714910 - RNA, 16 nt, Haemophilus influenzae Rd
accuaaauuguugcuc

SEQ ID NO: 2714911 - RNA, 16 nt, Haemophilus influenzae Rd
accuaacauaugacag

SEQ ID NO: 2714912 - RNA, 23 nt, Haemophilus influenzae Rd
accuaagcacaaagaaaaacuaa

SEQ ID NO: 2714913 - RNA, 16 nt, Haemophilus influenzae Rd
accuaagguuaauuuu

SEQ ID NO: 2714914 - RNA, 14 nt, Haemophilus influenzae Rd
accuaagucaggaa

SEQ ID NO: 2714915 - RNA, 13 nt, Haemophilus influenzae Rd
accuaauaaagcg

SEQ ID NO: 2714916 - RNA, 23 nt, Haemophilus influenzae Rd
accuaaugcaguaacuucugcug

SEQ ID NO: 2714917 - RNA, 22 nt, Haemophilus influenzae Rd
accuaauggauauagaaaucau

SEQ ID NO: 2714918 - RNA, 22 nt, Haemophilus influenzae Rd
accuacacccacugauuuuucu

SEQ ID NO: 2714919 - RNA, 16 nt, Haemophilus influenzae Rd
accuaccggaaaccag

SEQ ID NO: 2714920 - RNA, 16 nt, Haemophilus influenzae Rd
accuagaaauuuuggc

SEQ ID NO: 2714921 - RNA, 17 nt, Haemophilus influenzae Rd
accuagcgggauaagau

SEQ ID NO: 2714922 - RNA, 18 nt, Haemophilus influenzae Rd
accuaguuugcuauauua

SEQ ID NO: 2714923 - RNA, 16 nt, Haemophilus influenzae Rd
accuaucacaaaacaa

SEQ ID NO: 2714924 - RNA, 23 nt, Haemophilus influenzae Rd
accuaucucauccacuaaaccau

SEQ ID NO: 2714925 - RNA, 13 nt, Haemophilus influenzae Rd
accuauuuuuucc

SEQ ID NO: 2714926 - RNA, 15 nt, Haemophilus influenzae Rd
accucagaagaaauu

SEQ ID NO: 2714927 - RNA, 19 nt, Haemophilus influenzae Rd
accucgaauagcaauaucu

SEQ ID NO: 2714928 - RNA, 14 nt, Haemophilus influenzae Rd
accucgcuauaaau

SEQ ID NO: 2714929 - RNA, 22 nt, Haemophilus influenzae Rd
accucgugcuguuuucaauuuu

SEQ ID NO: 2714930 - RNA, 19 nt, Haemophilus influenzae Rd
accucguggcaaaagauca

SEQ ID NO: 2714931 - RNA, 16 nt, Haemophilus influenzae Rd
accugaaaaaccuugu

SEQ ID NO: 2714932 - RNA, 20 nt, Haemophilus influenzae Rd
accugaaaaaccuugugguu

SEQ ID NO: 2714933 - RNA, 14 nt, Haemophilus influenzae Rd
accugaagaauaca

SEQ ID NO: 2714934 - RNA, 18 nt, Haemophilus influenzae Rd
accugaugcuuuaacacc

SEQ ID NO: 2714935 - RNA, 22 nt, Haemophilus influenzae Rd
accugauucauugcauuuuuau

SEQ ID NO: 2714936 - RNA, 14 nt, Haemophilus influenzae Rd
accugcagaccaag

SEQ ID NO: 2714937 - RNA, 21 nt, Haemophilus influenzae Rd
accugcagccauaauauuuaa

SEQ ID NO: 2714938 - RNA, 20 nt, Haemophilus influenzae Rd
accugccauaauaacgccac

SEQ ID NO: 2714939 - RNA, 15 nt, Haemophilus influenzae Rd
accugcccugaagca

SEQ ID NO: 2714940 - RNA, 18 nt, Haemophilus influenzae Rd
accugcccugaagcaaca

SEQ ID NO: 2714941 - RNA, 17 nt, Haemophilus influenzae Rd
accugcggauuucacua

SEQ ID NO: 2714942 - RNA, 19 nt, Haemophilus influenzae Rd
accugguugcauaaaaucu

SEQ ID NO: 2714943 - RNA, 13 nt, Haemophilus influenzae Rd
accuguaaacaaa

SEQ ID NO: 2714944 - RNA, 21 nt, Haemophilus influenzae Rd
accugugaaaacacguccgca

SEQ ID NO: 2714945 - RNA, 23 nt, Haemophilus influenzae Rd
accuguuaccgcaccaaauucgu

SEQ ID NO: 2714946 - RNA, 22 nt, Haemophilus influenzae Rd
accuguuggaugaauugccacc

SEQ ID NO: 2714947 - RNA, 23 nt, Haemophilus influenzae Rd
accuguuucguacauuguuucaa

SEQ ID NO: 2714948 - RNA, 17 nt, Haemophilus influenzae Rd
accuuaaaggcugaaua

SEQ ID NO: 2714949 - RNA, 16 nt, Haemophilus influenzae Rd
accuuaaaucaaacaa

SEQ ID NO: 2714950 - RNA, 20 nt, Haemophilus influenzae Rd
accuuaaaucaaacaaaauu

SEQ ID NO: 2714951 - RNA, 21 nt, Haemophilus influenzae Rd
accuuagccaaaucaucuagc

SEQ ID NO: 2714952 - RNA, 13 nt, Haemophilus influenzae Rd
accuucaaacauc

SEQ ID NO: 2714953 - RNA, 17 nt, Haemophilus influenzae Rd
accuucaacauuuuuug

SEQ ID NO: 2714954 - RNA, 23 nt, Haemophilus influenzae Rd
accuucaauauagguuaauaguu

SEQ ID NO: 2714955 - RNA, 14 nt, Haemophilus influenzae Rd
accuucaccacuug

SEQ ID NO: 2714956 - RNA, 21 nt, Haemophilus influenzae Rd
accuucacuuggcgaaaauca

SEQ ID NO: 2714957 - RNA, 21 nt, Haemophilus influenzae Rd
accuucagcggcuucaucuaa

SEQ ID NO: 2714958 - RNA, 21 nt, Haemophilus influenzae Rd
accuucauaaacuucuauguu

SEQ ID NO: 2714959 - RNA, 16 nt, Haemophilus influenzae Rd
accuucaucaccugcu

SEQ ID NO: 2714960 - RNA, 14 nt, Haemophilus influenzae Rd
accuuccacuuuug

SEQ ID NO: 2714961 - RNA, 21 nt, Haemophilus influenzae Rd
accuuccccagcuguuggugg

SEQ ID NO: 2714962 - RNA, 22 nt, Haemophilus influenzae Rd
accuucugcaucaguauuaaga

SEQ ID NO: 2714963 - RNA, 23 nt, Haemophilus influenzae Rd
accuucugcugcaguuucuggau

SEQ ID NO: 2714964 - RNA, 22 nt, Haemophilus influenzae Rd
accuucuggguaaaauaaugca

SEQ ID NO: 2714965 - RNA, 16 nt, Haemophilus influenzae Rd
accuucuguuuucaau

SEQ ID NO: 2714966 - RNA, 17 nt, Haemophilus influenzae Rd
accuucuugauuauuua

SEQ ID NO: 2714967 - RNA, 19 nt, Haemophilus influenzae Rd
accuucuugauuauuuaau

SEQ ID NO: 2714968 - RNA, 17 nt, Haemophilus influenzae Rd
accuugaauugcauuuu

SEQ ID NO: 2714969 - RNA, 21 nt, Haemophilus influenzae Rd
accuugaauugcauuuucuuc

SEQ ID NO: 2714970 - RNA, 14 nt, Haemophilus influenzae Rd
accuugagaaauaa

SEQ ID NO: 2714971 - RNA, 20 nt, Haemophilus influenzae Rd
accuugagcaauauaaucuu

SEQ ID NO: 2714972 - RNA, 21 nt, Haemophilus influenzae Rd
accuugagcaauauaaucuuu

SEQ ID NO: 2714973 - RNA, 14 nt, Haemophilus influenzae Rd
accuugcaaauuuu

SEQ ID NO: 2714974 - RNA, 16 nt, Haemophilus influenzae Rd
accuugcgcaauggcu

SEQ ID NO: 2714975 - RNA, 16 nt, Haemophilus influenzae Rd
accuuggaauauccca

SEQ ID NO: 2714976 - RNA, 19 nt, Haemophilus influenzae Rd
accuuguaaacuuuccuca

SEQ ID NO: 2714977 - RNA, 13 nt, Haemophilus influenzae Rd
accuuguaaagca

SEQ ID NO: 2714978 - RNA, 22 nt, Haemophilus influenzae Rd
accuuguuccaggaaaauuuua

SEQ ID NO: 2714979 - RNA, 17 nt, Haemophilus influenzae Rd
accuuuaaauucuucga

SEQ ID NO: 2714980 - RNA, 17 nt, Haemophilus influenzae Rd
accuuuacguuuaacug

SEQ ID NO: 2714981 - RNA, 16 nt, Haemophilus influenzae Rd
accuuuauuaaagccu

SEQ ID NO: 2714982 - RNA, 15 nt, Haemophilus influenzae Rd
accuuucauauaaau

SEQ ID NO: 2714983 - RNA, 15 nt, Haemophilus influenzae Rd
accuuucuguaaaua

SEQ ID NO: 2714984 - RNA, 19 nt, Haemophilus influenzae Rd
accuuugcugacaauuucu

SEQ ID NO: 2714985 - RNA, 17 nt, Haemophilus influenzae Rd
accuuuucgaauuaaac

SEQ ID NO: 2714986 - RNA, 23 nt, Haemophilus influenzae Rd
accuuuucguagccaauuuuguc

SEQ ID NO: 2714987 - RNA, 13 nt, Haemophilus influenzae Rd
accuuuugaaaaa

SEQ ID NO: 2714988 - RNA, 15 nt, Haemophilus influenzae Rd
accuuuuguagaaaa

SEQ ID NO: 2714989 - RNA, 11 nt, Haemophilus influenzae Rd
accuuuuuccu

SEQ ID NO: 2714990 - RNA, 12 nt, Haemophilus influenzae Rd
accuuuuucuac

SEQ ID NO: 2714991 - RNA, 15 nt, Haemophilus influenzae Rd
accuuuuucuaccga

SEQ ID NO: 2714992 - RNA, 12 nt, Haemophilus influenzae Rd
accuuuuucuuc

SEQ ID NO: 2714993 - RNA, 20 nt, Haemophilus influenzae Rd
accuuuuugcguauccgcug

SEQ ID NO: 2714994 - RNA, 21 nt, Haemophilus influenzae Rd
accuuuuugcguauccgcugc

SEQ ID NO: 2714995 - RNA, 16 nt, Haemophilus influenzae Rd
accuuuuuuuagaauu

SEQ ID NO: 2714996 - RNA, 22 nt, Haemophilus influenzae Rd
accuuuuuuuagaauuaaauuu

SEQ ID NO: 2714997 - RNA, 15 nt, Haemophilus influenzae Rd
acgaaaaaaauaaaa

SEQ ID NO: 2714998 - RNA, 17 nt, Haemophilus influenzae Rd
acgaaaaaaauaaaaaa

SEQ ID NO: 2714999 - RNA, 14 nt, Haemophilus influenzae Rd
acgaaaaguugaaa

SEQ ID NO: 2715000 - RNA, 14 nt, Haemophilus influenzae Rd
acgaaaccaacgaa

SEQ ID NO: 2715001 - RNA, 18 nt, Haemophilus influenzae Rd
acgaaaccaacgaaaaua

SEQ ID NO: 2715002 - RNA, 12 nt, Haemophilus influenzae Rd
acgaaaugaaau

SEQ ID NO: 2715003 - RNA, 16 nt, Haemophilus influenzae Rd
acgaaaugaaauuaau

SEQ ID NO: 2715004 - RNA, 23 nt, Haemophilus influenzae Rd
acgaacgugggaauuuucccauu

SEQ ID NO: 2715005 - RNA, 21 nt, Haemophilus influenzae Rd
acgaacuaaaauggugcuuuu

SEQ ID NO: 2715006 - RNA, 12 nt, Haemophilus influenzae Rd
acgaagaaucca

SEQ ID NO: 2715007 - RNA, 16 nt, Haemophilus influenzae Rd
acgaagaauccacauu

SEQ ID NO: 2715008 - RNA, 13 nt, Haemophilus influenzae Rd
acgaaguaaaagc

SEQ ID NO: 2715009 - RNA, 22 nt, Haemophilus influenzae Rd
acgaagugcggaugaaauuuuu

SEQ ID NO: 2715010 - RNA, 18 nt, Haemophilus influenzae Rd
acgaagugcgguaaauuc

SEQ ID NO: 2715011 - RNA, 18 nt, Haemophilus influenzae Rd
acgaaguggcguuugcuc

SEQ ID NO: 2715012 - RNA, 18 nt, Haemophilus influenzae Rd
acgaaguguuaagcacca

SEQ ID NO: 2715013 - RNA, 13 nt, Haemophilus influenzae Rd
acgaauaagcacu

SEQ ID NO: 2715014 - RNA, 22 nt, Haemophilus influenzae Rd
acgaauaauuaaaucuucgccu

SEQ ID NO: 2715015 - RNA, 21 nt, Haemophilus influenzae Rd
acgaauaccccaaguuucuaa

SEQ ID NO: 2715016 - RNA, 21 nt, Haemophilus influenzae Rd
acgaauggcgacggcaucaaa

SEQ ID NO: 2715017 - RNA, 14 nt, Haemophilus influenzae Rd
acgaauuaaaucca

SEQ ID NO: 2715018 - RNA, 17 nt, Haemophilus influenzae Rd
acgaauuaagcgaacac

SEQ ID NO: 2715019 - RNA, 17 nt, Haemophilus influenzae Rd
acgaauugcaauaacca

SEQ ID NO: 2715020 - RNA, 20 nt, Haemophilus influenzae Rd
acgaauugguucuaaauauu

SEQ ID NO: 2715021 - RNA, 15 nt, Haemophilus influenzae Rd
acgacacacuauuaa

SEQ ID NO: 2715022 - RNA, 22 nt, Haemophilus influenzae Rd
acgacaucaaucaaauucaaca

SEQ ID NO: 2715023 - RNA, 14 nt, Haemophilus influenzae Rd
acgacaucuuaaau

SEQ ID NO: 2715024 - RNA, 19 nt, Haemophilus influenzae Rd
acgacaucuuaaauuauag

SEQ ID NO: 2715025 - RNA, 17 nt, Haemophilus influenzae Rd
acgaccauugaauccaa

SEQ ID NO: 2715026 - RNA, 13 nt, Haemophilus influenzae Rd
acgacuaaaacga

SEQ ID NO: 2715027 - RNA, 14 nt, Haemophilus influenzae Rd
acgagaacugaaag

SEQ ID NO: 2715028 - RNA, 13 nt, Haemophilus influenzae Rd
acgagaaguuaaa

SEQ ID NO: 2715029 - RNA, 22 nt, Haemophilus influenzae Rd
acgagaaguuaaaccugccaac

SEQ ID NO: 2715030 - RNA, 23 nt, Haemophilus influenzae Rd
acgagauaagcauuuuaucacaa

SEQ ID NO: 2715031 - RNA, 17 nt, Haemophilus influenzae Rd
acgagcaauauucaaaa

SEQ ID NO: 2715032 - RNA, 20 nt, Haemophilus influenzae Rd
acgagcaggaaaaccacaag

SEQ ID NO: 2715033 - RNA, 17 nt, Haemophilus influenzae Rd
acgagcauauuuuccau

SEQ ID NO: 2715034 - RNA, 19 nt, Haemophilus influenzae Rd
acgagcuugagcugcugca

SEQ ID NO: 2715035 - RNA, 13 nt, Haemophilus influenzae Rd
acgaguaaaaaau

SEQ ID NO: 2715036 - RNA, 21 nt, Haemophilus influenzae Rd
acgagugcgaguuggaucaca

SEQ ID NO: 2715037 - RNA, 23 nt, Haemophilus influenzae Rd
acgaguggcggacgggugaguaa

SEQ ID NO: 2715038 - RNA, 16 nt, Haemophilus influenzae Rd
acgaguucuuuuggua

SEQ ID NO: 2715039 - RNA, 16 nt, Haemophilus influenzae Rd
acgaguuugauuacca

SEQ ID NO: 2715040 - RNA, 16 nt, Haemophilus influenzae Rd
acgauaagauuugcuu

SEQ ID NO: 2715041 - RNA, 20 nt, Haemophilus influenzae Rd
acgauaauauuuuugccaau

SEQ ID NO: 2715042 - RNA, 21 nt, Haemophilus influenzae Rd
acgauagcggcgaauguggcu

SEQ ID NO: 2715043 - RNA, 15 nt, Haemophilus influenzae Rd
acgauaguaaaaaau

SEQ ID NO: 2715044 - RNA, 23 nt, Haemophilus influenzae Rd
acgauauucuugcguaaccaaag

SEQ ID NO: 2715045 - RNA, 16 nt, Haemophilus influenzae Rd
acgauauugcacaaua

SEQ ID NO: 2715046 - RNA, 13 nt, Haemophilus influenzae Rd
acgauauuuuuau

SEQ ID NO: 2715047 - RNA, 13 nt, Haemophilus influenzae Rd
acgaucugcaaca

SEQ ID NO: 2715048 - RNA, 19 nt, Haemophilus influenzae Rd
acgaugaugcaggaaaggc

SEQ ID NO: 2715049 - RNA, 23 nt, Haemophilus influenzae Rd
acgaugcaacgcauuagcaucca

SEQ ID NO: 2715050 - RNA, 11 nt, Haemophilus influenzae Rd
acgaugggcaa

SEQ ID NO: 2715051 - RNA, 16 nt, Haemophilus influenzae Rd
acgaugggcaauggca

SEQ ID NO: 2715052 - RNA, 13 nt, Haemophilus influenzae Rd
acgauuguugcau

SEQ ID NO: 2715053 - RNA, 18 nt, Haemophilus influenzae Rd
acgauuucaguaucaaua

SEQ ID NO: 2715054 - RNA, 18 nt, Haemophilus influenzae Rd
acgauuucuaucacgaaa

SEQ ID NO: 2715055 - RNA, 17 nt, Haemophilus influenzae Rd
acgauuuucaauacauc

SEQ ID NO: 2715056 - RNA, 20 nt, Haemophilus influenzae Rd
acgauuuuccgaaaaaacaa

SEQ ID NO: 2715057 - RNA, 19 nt, Haemophilus influenzae Rd
acgauuuuuuuauaaaaaa

SEQ ID NO: 2715058 - RNA, 23 nt, Haemophilus influenzae Rd
acgauuuuuuuauaaaaaaacua

SEQ ID NO: 2715059 - RNA, 21 nt, Haemophilus influenzae Rd
acgcaaccuugagcaauauaa

SEQ ID NO: 2715060 - RNA, 19 nt, Haemophilus influenzae Rd
acgcaagcaccaaagcaaa

SEQ ID NO: 2715061 - RNA, 21 nt, Haemophilus influenzae Rd
acgcaagcaccaaagcaaaau

SEQ ID NO: 2715062 - RNA, 14 nt, Haemophilus influenzae Rd
acgcaagguauuuu

SEQ ID NO: 2715063 - RNA, 18 nt, Haemophilus influenzae Rd
acgcaauuuagauacaaa

SEQ ID NO: 2715064 - RNA, 20 nt, Haemophilus influenzae Rd
acgcaccacuucauauaaau

SEQ ID NO: 2715065 - RNA, 18 nt, Haemophilus influenzae Rd
acgcacuugauuugcuug

SEQ ID NO: 2715066 - RNA, 16 nt, Haemophilus influenzae Rd
acgcagcaucugccac

SEQ ID NO: 2715067 - RNA, 13 nt, Haemophilus influenzae Rd
acgcauagaaauu

SEQ ID NO: 2715068 - RNA, 15 nt, Haemophilus influenzae Rd
acgcauaucacgaua

SEQ ID NO: 2715069 - RNA, 21 nt, Haemophilus influenzae Rd
acgcaucaccacaaaauaaau

SEQ ID NO: 2715070 - RNA, 16 nt, Haemophilus influenzae Rd
acgcaucgcccaauuu

SEQ ID NO: 2715071 - RNA, 15 nt, Haemophilus influenzae Rd
acgcauuagcaucca

SEQ ID NO: 2715072 - RNA, 16 nt, Haemophilus influenzae Rd
acgcauuccuucgccu

SEQ ID NO: 2715073 - RNA, 20 nt, Haemophilus influenzae Rd
acgcauuguuacaaauuccu

SEQ ID NO: 2715074 - RNA, 23 nt, Haemophilus influenzae Rd
acgcauuguuacaaauuccucug

SEQ ID NO: 2715075 - RNA, 17 nt, Haemophilus influenzae Rd
acgcauuuaaauaaaau

SEQ ID NO: 2715076 - RNA, 16 nt, Haemophilus influenzae Rd
acgccaauaaaaagua

SEQ ID NO: 2715077 - RNA, 13 nt, Haemophilus influenzae Rd
acgccaauuaaua

SEQ ID NO: 2715078 - RNA, 22 nt, Haemophilus influenzae Rd
acgccagaaguuguuuuucuuc

SEQ ID NO: 2715079 - RNA, 17 nt, Haemophilus influenzae Rd
acgccagucacuucuuc

SEQ ID NO: 2715080 - RNA, 17 nt, Haemophilus influenzae Rd
acgccauuaccacugca

SEQ ID NO: 2715081 - RNA, 17 nt, Haemophilus influenzae Rd
acgccccuacuuuaaag

SEQ ID NO: 2715082 - RNA, 20 nt, Haemophilus influenzae Rd
acgcccuacaaugcucacuu

SEQ ID NO: 2715083 - RNA, 21 nt, Haemophilus influenzae Rd
acgcccucgccuugcaaauuu

SEQ ID NO: 2715084 - RNA, 14 nt, Haemophilus influenzae Rd
acgcccuucaccuu

SEQ ID NO: 2715085 - RNA, 16 nt, Haemophilus influenzae Rd
acgccgauaccacauu

SEQ ID NO: 2715086 - RNA, 17 nt, Haemophilus influenzae Rd
acgccgccgauuccuac

SEQ ID NO: 2715087 - RNA, 20 nt, Haemophilus influenzae Rd
acgccguuagauacuuuacg

SEQ ID NO: 2715088 - RNA, 20 nt, Haemophilus influenzae Rd
acgccuaaacacauaauauu

SEQ ID NO: 2715089 - RNA, 15 nt, Haemophilus influenzae Rd
acgccuaauucaucu

SEQ ID NO: 2715090 - RNA, 17 nt, Haemophilus influenzae Rd
acgccuaauucuugcca

SEQ ID NO: 2715091 - RNA, 19 nt, Haemophilus influenzae Rd
acgccugcccaaguugugc

SEQ ID NO: 2715092 - RNA, 15 nt, Haemophilus influenzae Rd
acgccugcgaugccg

SEQ ID NO: 2715093 - RNA, 18 nt, Haemophilus influenzae Rd
acgccugcgaugccgaau

SEQ ID NO: 2715094 - RNA, 12 nt, Haemophilus influenzae Rd
acgccugcugca

SEQ ID NO: 2715095 - RNA, 22 nt, Haemophilus influenzae Rd
acgccuucagaaagauuacauu

SEQ ID NO: 2715096 - RNA, 11 nt, Haemophilus influenzae Rd
acgccuuggau

SEQ ID NO: 2715097 - RNA, 21 nt, Haemophilus influenzae Rd
acgccuuggaucguuuucucg

SEQ ID NO: 2715098 - RNA, 14 nt, Haemophilus influenzae Rd
acgccuuugucuua

SEQ ID NO: 2715099 - RNA, 18 nt, Haemophilus influenzae Rd
acgcgcacauacuucuuc

SEQ ID NO: 2715100 - RNA, 22 nt, Haemophilus influenzae Rd
acgcgcacauacuucuucuguu

SEQ ID NO: 2715101 - RNA, 17 nt, Haemophilus influenzae Rd
acgcgcugcucugugcc

SEQ ID NO: 2715102 - RNA, 20 nt, Haemophilus influenzae Rd
acgcggcggaacaggucgag

SEQ ID NO: 2715103 - RNA, 22 nt, Haemophilus influenzae Rd
acgcgucuuucugcaauuuuac

SEQ ID NO: 2715104 - RNA, 20 nt, Haemophilus influenzae Rd
acgcgugaugaaacaaucug

SEQ ID NO: 2715105 - RNA, 23 nt, Haemophilus influenzae Rd
acgcguuuuucuggguuuuaaaa

SEQ ID NO: 2715106 - RNA, 22 nt, Haemophilus influenzae Rd
acgcuaaggcaaaaaaaucaua

SEQ ID NO: 2715107 - RNA, 19 nt, Haemophilus influenzae Rd
acgcuacccguauuaaaua

SEQ ID NO: 2715108 - RNA, 21 nt, Haemophilus influenzae Rd
acgcucaacauaaguaagggu

SEQ ID NO: 2715109 - RNA, 17 nt, Haemophilus influenzae Rd
acgcucaacgccuacgc

SEQ ID NO: 2715110 - RNA, 22 nt, Haemophilus influenzae Rd
acgcucaaucucuuuacuguuc

SEQ ID NO: 2715111 - RNA, 20 nt, Haemophilus influenzae Rd
acgcucauaagcauuuugau

SEQ ID NO: 2715112 - RNA, 18 nt, Haemophilus influenzae Rd
acgcuggaauauuuuucu

SEQ ID NO: 2715113 - RNA, 17 nt, Haemophilus influenzae Rd
acgcuggaauuuucaca

SEQ ID NO: 2715114 - RNA, 14 nt, Haemophilus influenzae Rd
acgcuguacaaagc

SEQ ID NO: 2715115 - RNA, 14 nt, Haemophilus influenzae Rd
acgcuguucuucua

SEQ ID NO: 2715116 - RNA, 16 nt, Haemophilus influenzae Rd
acgcuguuucuuuuca

SEQ ID NO: 2715117 - RNA, 21 nt, Haemophilus influenzae Rd
acgcuguuucuuuucaucuuc

SEQ ID NO: 2715118 - RNA, 18 nt, Haemophilus influenzae Rd
acgcuuacgauacaugga

SEQ ID NO: 2715119 - RNA, 24 nt, Haemophilus influenzae Rd
acgcuucuuuaacuugcucugguu

SEQ ID NO: 2715120 - RNA, 17 nt, Haemophilus influenzae Rd
acgcuuggaaauguuua

SEQ ID NO: 2715121 - RNA, 21 nt, Haemophilus influenzae Rd
acgcuuuacuacaucagguuu

SEQ ID NO: 2715122 - RNA, 23 nt, Haemophilus influenzae Rd
acggaaaguauuuucuuuccaac

SEQ ID NO: 2715123 - RNA, 23 nt, Haemophilus influenzae Rd
acggaauacaucacgaacuucag

SEQ ID NO: 2715124 - RNA, 19 nt, Haemophilus influenzae Rd
acggacuaaauaaaucaca

SEQ ID NO: 2715125 - RNA, 23 nt, Haemophilus influenzae Rd
acggacuucuguugggaauaauu

SEQ ID NO: 2715126 - RNA, 14 nt, Haemophilus influenzae Rd
acggauuaaaaguc

SEQ ID NO: 2715127 - RNA, 16 nt, Haemophilus influenzae Rd
acggauuacaauaugc

SEQ ID NO: 2715128 - RNA, 23 nt, Haemophilus influenzae Rd
acggauuuauauauugcugucaa

SEQ ID NO: 2715129 - RNA, 13 nt, Haemophilus influenzae Rd
acggcaaaaauau

SEQ ID NO: 2715130 - RNA, 21 nt, Haemophilus influenzae Rd
acggcacaccuaacuguugga

SEQ ID NO: 2715131 - RNA, 15 nt, Haemophilus influenzae Rd
acggcguagaaugca

SEQ ID NO: 2715132 - RNA, 15 nt, Haemophilus influenzae Rd
acggcuaaacgaucu

SEQ ID NO: 2715133 - RNA, 12 nt, Haemophilus influenzae Rd
acggcuaaaucg

SEQ ID NO: 2715134 - RNA, 23 nt, Haemophilus influenzae Rd
acggcuaaguuugcuaucuuacc

SEQ ID NO: 2715135 - RNA, 13 nt, Haemophilus influenzae Rd
acgggaaauccag

SEQ ID NO: 2715136 - RNA, 15 nt, Haemophilus influenzae Rd
acgggcagaaugaau

SEQ ID NO: 2715137 - RNA, 21 nt, Haemophilus influenzae Rd
acggguauuaaugcuguuuaa

SEQ ID NO: 2715138 - RNA, 15 nt, Haemophilus influenzae Rd
acggguuggaagaau

SEQ ID NO: 2715139 - RNA, 21 nt, Haemophilus influenzae Rd
acgguaagccgcuauuucacu

SEQ ID NO: 2715140 - RNA, 16 nt, Haemophilus influenzae Rd
acgguagcaggagaaa

SEQ ID NO: 2715141 - RNA, 15 nt, Haemophilus influenzae Rd
acggucagucacuuc

SEQ ID NO: 2715142 - RNA, 21 nt, Haemophilus influenzae Rd
acggucgcaccaccuuuauua

SEQ ID NO: 2715143 - RNA, 21 nt, Haemophilus influenzae Rd
acggugggcugaagcccaccc

SEQ ID NO: 2715144 - RNA, 14 nt, Haemophilus influenzae Rd
acgguuaagucauu

SEQ ID NO: 2715145 - RNA, 15 nt, Haemophilus influenzae Rd
acgguuaauaaauuc

SEQ ID NO: 2715146 - RNA, 19 nt, Haemophilus influenzae Rd
acgguuucaauaugacgaa

SEQ ID NO: 2715147 - RNA, 21 nt, Haemophilus influenzae Rd
acgguuuuccacuucuucuuu

SEQ ID NO: 2715148 - RNA, 16 nt, Haemophilus influenzae Rd
acguaaaauaucuuuc

SEQ ID NO: 2715149 - RNA, 20 nt, Haemophilus influenzae Rd
acguaaaauaucuuucucuu

SEQ ID NO: 2715150 - RNA, 21 nt, Haemophilus influenzae Rd
acguaaaaucauuguuuccac

SEQ ID NO: 2715151 - RNA, 23 nt, Haemophilus influenzae Rd
acguaaaaucgccugacauuuuu

SEQ ID NO: 2715152 - RNA, 14 nt, Haemophilus influenzae Rd
acguaaauucaaua

SEQ ID NO: 2715153 - RNA, 17 nt, Haemophilus influenzae Rd
acguaaauucaauacuu

SEQ ID NO: 2715154 - RNA, 11 nt, Haemophilus influenzae Rd
acguaaccauu

SEQ ID NO: 2715155 - RNA, 20 nt, Haemophilus influenzae Rd
acguaaccauuguuuaauuc

SEQ ID NO: 2715156 - RNA, 14 nt, Haemophilus influenzae Rd
acguaagaaauaac

SEQ ID NO: 2715157 - RNA, 18 nt, Haemophilus influenzae Rd
acguaagcccauuccaca

SEQ ID NO: 2715158 - RNA, 16 nt, Haemophilus influenzae Rd
acguaaggaucuuuuu

SEQ ID NO: 2715159 - RNA, 18 nt, Haemophilus influenzae Rd
acguaaguuugcuaauuu

SEQ ID NO: 2715160 - RNA, 20 nt, Haemophilus influenzae Rd
acguaauaaguuuucaucaa

SEQ ID NO: 2715161 - RNA, 20 nt, Haemophilus influenzae Rd
acguaauacuuuugcuucac

SEQ ID NO: 2715162 - RNA, 14 nt, Haemophilus influenzae Rd
acguaauagauaaa

SEQ ID NO: 2715163 - RNA, 20 nt, Haemophilus influenzae Rd
acguaaucccauuucaucuu

SEQ ID NO: 2715164 - RNA, 14 nt, Haemophilus influenzae Rd
acguaauuguucca

SEQ ID NO: 2715165 - RNA, 18 nt, Haemophilus influenzae Rd
acguacauugucugacca

SEQ ID NO: 2715166 - RNA, 13 nt, Haemophilus influenzae Rd
acguagauacaua

SEQ ID NO: 2715167 - RNA, 17 nt, Haemophilus influenzae Rd
acguaguacaucauuug

SEQ ID NO: 2715168 - RNA, 14 nt, Haemophilus influenzae Rd
acguagugcuggau

SEQ ID NO: 2715169 - RNA, 16 nt, Haemophilus influenzae Rd
acguaguuaaaccaaa

SEQ ID NO: 2715170 - RNA, 19 nt, Haemophilus influenzae Rd
acguauagcgugcuuuaau

SEQ ID NO: 2715171 - RNA, 19 nt, Haemophilus influenzae Rd
acguauugaacuaaaauau

SEQ ID NO: 2715172 - RNA, 17 nt, Haemophilus influenzae Rd
acguauuuaaaaucgcu

SEQ ID NO: 2715173 - RNA, 21 nt, Haemophilus influenzae Rd
acguauuuuuuaauacgaaaa

SEQ ID NO: 2715174 - RNA, 15 nt, Haemophilus influenzae Rd
acgucaauugcuaaa

SEQ ID NO: 2715175 - RNA, 13 nt, Haemophilus influenzae Rd
acgucaccuacug

SEQ ID NO: 2715176 - RNA, 22 nt, Haemophilus influenzae Rd
acgucauaguauggcucuaaau

SEQ ID NO: 2715177 - RNA, 23 nt, Haemophilus influenzae Rd
acguccgcaaccagcagaaaaua

SEQ ID NO: 2715178 - RNA, 12 nt, Haemophilus influenzae Rd
acgucuaagaua

SEQ ID NO: 2715179 - RNA, 15 nt, Haemophilus influenzae Rd
acgucucaaaucguu

SEQ ID NO: 2715180 - RNA, 18 nt, Haemophilus influenzae Rd
acgucuuuuggcguuaaa

SEQ ID NO: 2715181 - RNA, 20 nt, Haemophilus influenzae Rd
acgugaaccaacccaauuua

SEQ ID NO: 2715182 - RNA, 14 nt, Haemophilus influenzae Rd
acgugauuuaccaa

SEQ ID NO: 2715183 - RNA, 17 nt, Haemophilus influenzae Rd
acgugcaaaguuauaaa

SEQ ID NO: 2715184 - RNA, 23 nt, Haemophilus influenzae Rd
acgugcaauuaauucuuuugcua

SEQ ID NO: 2715185 - RNA, 15 nt, Haemophilus influenzae Rd
acgugcgaauuuuua

SEQ ID NO: 2715186 - RNA, 16 nt, Haemophilus influenzae Rd
acgugcgaauuuuuau

SEQ ID NO: 2715187 - RNA, 13 nt, Haemophilus influenzae Rd
acgugcgauaaaa

SEQ ID NO: 2715188 - RNA, 17 nt, Haemophilus influenzae Rd
acgugcgauaaaaucaa

SEQ ID NO: 2715189 - RNA, 18 nt, Haemophilus influenzae Rd
acgugcgauaaaaucaaa

SEQ ID NO: 2715190 - RNA, 16 nt, Haemophilus influenzae Rd
acguggcgucaagccu

SEQ ID NO: 2715191 - RNA, 18 nt, Haemophilus influenzae Rd
acgugugccaguuuugug

SEQ ID NO: 2715192 - RNA, 21 nt, Haemophilus influenzae Rd
acgugugcgauucaucacuuc

SEQ ID NO: 2715193 - RNA, 14 nt, Haemophilus influenzae Rd
acguguuguggcau

SEQ ID NO: 2715194 - RNA, 13 nt, Haemophilus influenzae Rd
acguuaaaucacu

SEQ ID NO: 2715195 - RNA, 12 nt, Haemophilus influenzae Rd
acguuaaaugaa

SEQ ID NO: 2715196 - RNA, 13 nt, Haemophilus influenzae Rd
acguuaaauuuag

SEQ ID NO: 2715197 - RNA, 21 nt, Haemophilus influenzae Rd
acguuaauuaccacaugcauu

SEQ ID NO: 2715198 - RNA, 18 nt, Haemophilus influenzae Rd
acguuacgcgcagcacca

SEQ ID NO: 2715199 - RNA, 13 nt, Haemophilus influenzae Rd
acguuacuaaaau

SEQ ID NO: 2715200 - RNA, 16 nt, Haemophilus influenzae Rd
acguuacuaaaauccu

SEQ ID NO: 2715201 - RNA, 23 nt, Haemophilus influenzae Rd
acguuacuaaaauccuugcacca

SEQ ID NO: 2715202 - RNA, 16 nt, Haemophilus influenzae Rd
acguuaucaaagaaac

SEQ ID NO: 2715203 - RNA, 23 nt, Haemophilus influenzae Rd
acguuaucaucuguaaaccauuc

SEQ ID NO: 2715204 - RNA, 23 nt, Haemophilus influenzae Rd
acguuaugcguuuuuaauuuuau

SEQ ID NO: 2715205 - RNA, 13 nt, Haemophilus influenzae Rd
acguucaaaaaua

SEQ ID NO: 2715206 - RNA, 15 nt, Haemophilus influenzae Rd
acguucaaaaauauu

SEQ ID NO: 2715207 - RNA, 18 nt, Haemophilus influenzae Rd
acguucacguaaguagua

SEQ ID NO: 2715208 - RNA, 16 nt, Haemophilus influenzae Rd
acguucagcuuuacuc

SEQ ID NO: 2715209 - RNA, 17 nt, Haemophilus influenzae Rd
acguucauauuguuuca

SEQ ID NO: 2715210 - RNA, 18 nt, Haemophilus influenzae Rd
acguucauguaaauaguu

SEQ ID NO: 2715211 - RNA, 18 nt, Haemophilus influenzae Rd
acguucuaaacuuacuac

SEQ ID NO: 2715212 - RNA, 23 nt, Haemophilus influenzae Rd
acguuggguguguauccacaaaa

SEQ ID NO: 2715213 - RNA, 17 nt, Haemophilus influenzae Rd
acguuggguuugauuua

SEQ ID NO: 2715214 - RNA, 12 nt, Haemophilus influenzae Rd
acguugugcauc

SEQ ID NO: 2715215 - RNA, 17 nt, Haemophilus influenzae Rd
acguuuaguaaaauaaa

SEQ ID NO: 2715216 - RNA, 14 nt, Haemophilus influenzae Rd
acguuuauauugaa

SEQ ID NO: 2715217 - RNA, 17 nt, Haemophilus influenzae Rd
acguuuauauugaacaa

SEQ ID NO: 2715218 - RNA, 15 nt, Haemophilus influenzae Rd
acguuucaaaucguu

SEQ ID NO: 2715219 - RNA, 21 nt, Haemophilus influenzae Rd
acguuuuaaauuaauuaaguc

SEQ ID NO: 2715220 - RNA, 12 nt, Haemophilus influenzae Rd
acguuuucaaca

SEQ ID NO: 2715221 - RNA, 13 nt, Haemophilus influenzae Rd
acguuuucaacag

SEQ ID NO: 2715222 - RNA, 11 nt, Haemophilus influenzae Rd
acguuuugcuu

SEQ ID NO: 2715223 - RNA, 22 nt, Haemophilus influenzae Rd
acguuuugugccguugcucgag

SEQ ID NO: 2715224 - RNA, 19 nt, Haemophilus influenzae Rd
acguuuuuccauagauuau

SEQ ID NO: 2715225 - RNA, 23 nt, Haemophilus influenzae Rd
acguuuuugcgugaauuugauaa

SEQ ID NO: 2715226 - RNA, 22 nt, Haemophilus influenzae Rd
acguuuuuuacuugcgauaucu

SEQ ID NO: 2715227 - RNA, 19 nt, Haemophilus influenzae Rd
acguuuuuuacuuggaaua

SEQ ID NO: 2715228 - RNA, 13 nt, Haemophilus influenzae Rd
acguuuuuucgac

SEQ ID NO: 2715229 - RNA, 15 nt, Haemophilus influenzae Rd
acuaaaaaauuaaau

SEQ ID NO: 2715230 - RNA, 17 nt, Haemophilus influenzae Rd
acuaaaaacaaauauau

SEQ ID NO: 2715231 - RNA, 20 nt, Haemophilus influenzae Rd
acuaaaaagcccaaaugcaa

SEQ ID NO: 2715232 - RNA, 22 nt, Haemophilus influenzae Rd
acuaaaacaacaguagaaauca

SEQ ID NO: 2715233 - RNA, 20 nt, Haemophilus influenzae Rd
acuaaaaccacaucauuuuu

SEQ ID NO: 2715234 - RNA, 11 nt, Haemophilus influenzae Rd
acuaaaagcau

SEQ ID NO: 2715235 - RNA, 18 nt, Haemophilus influenzae Rd
acuaaaaguaccaaaauc

SEQ ID NO: 2715236 - RNA, 20 nt, Haemophilus influenzae Rd
acuaaaauaaccuuaaauca

SEQ ID NO: 2715237 - RNA, 13 nt, Haemophilus influenzae Rd
acuaaaauaauuu

SEQ ID NO: 2715238 - RNA, 17 nt, Haemophilus influenzae Rd
acuaaaauaucucuguu

SEQ ID NO: 2715239 - RNA, 15 nt, Haemophilus influenzae Rd
acuaaaccugcuucu

SEQ ID NO: 2715240 - RNA, 18 nt, Haemophilus influenzae Rd
acuaaaggcacaaaaaau

SEQ ID NO: 2715241 - RNA, 17 nt, Haemophilus influenzae Rd
acuaaauacauuuuuau

SEQ ID NO: 2715242 - RNA, 11 nt, Haemophilus influenzae Rd
acuaaaucaaa

SEQ ID NO: 2715243 - RNA, 23 nt, Haemophilus influenzae Rd
acuaaaucuuaugaaacagcuaa

SEQ ID NO: 2715244 - RNA, 20 nt, Haemophilus influenzae Rd
acuaaaucuugcuuuugguu

SEQ ID NO: 2715245 - RNA, 14 nt, Haemophilus influenzae Rd
acuaaaugaaguuc

SEQ ID NO: 2715246 - RNA, 19 nt, Haemophilus influenzae Rd
acuaaaugcucgaauauaa

SEQ ID NO: 2715247 - RNA, 23 nt, Haemophilus influenzae Rd
acuaaaugcuguagaaauuaaua

SEQ ID NO: 2715248 - RNA, 12 nt, Haemophilus influenzae Rd
acuaaaugugac

SEQ ID NO: 2715249 - RNA, 22 nt, Haemophilus influenzae Rd
acuaaauuagcucuaguccuaa

SEQ ID NO: 2715250 - RNA, 15 nt, Haemophilus influenzae Rd
acuaaauucaauuuu

SEQ ID NO: 2715251 - RNA, 14 nt, Haemophilus influenzae Rd
acuaaauucuuuug

SEQ ID NO: 2715252 - RNA, 19 nt, Haemophilus influenzae Rd
acuaacacacgaucaccaa

SEQ ID NO: 2715253 - RNA, 20 nt, Haemophilus influenzae Rd
acuaacacgcgcugcucugu

SEQ ID NO: 2715254 - RNA, 21 nt, Haemophilus influenzae Rd
acuaacccaccuaacagggca

SEQ ID NO: 2715255 - RNA, 23 nt, Haemophilus influenzae Rd
acuaaccgcacuuuggaauauuc

SEQ ID NO: 2715256 - RNA, 20 nt, Haemophilus influenzae Rd
acuaaccgcacuuuuucuug

SEQ ID NO: 2715257 - RNA, 15 nt, Haemophilus influenzae Rd
acuaacguuucuaau

SEQ ID NO: 2715258 - RNA, 14 nt, Haemophilus influenzae Rd
acuaacucaaaaua

SEQ ID NO: 2715259 - RNA, 16 nt, Haemophilus influenzae Rd
acuaacucaaaauacu

SEQ ID NO: 2715260 - RNA, 16 nt, Haemophilus influenzae Rd
acuaacucacauugcc

SEQ ID NO: 2715261 - RNA, 17 nt, Haemophilus influenzae Rd
acuaacucacauugcca

SEQ ID NO: 2715262 - RNA, 22 nt, Haemophilus influenzae Rd
acuaacucacauugccauuuuu

SEQ ID NO: 2715263 - RNA, 22 nt, Haemophilus influenzae Rd
acuaacuggcuguguaaaacau

SEQ ID NO: 2715264 - RNA, 16 nt, Haemophilus influenzae Rd
acuaaggugcagauuu

SEQ ID NO: 2715265 - RNA, 17 nt, Haemophilus influenzae Rd
acuaaggugcagauuuu

SEQ ID NO: 2715266 - RNA, 19 nt, Haemophilus influenzae Rd
acuaaggugcagauuuuuu

SEQ ID NO: 2715267 - RNA, 19 nt, Haemophilus influenzae Rd
acuaaguucgguauucaau

SEQ ID NO: 2715268 - RNA, 12 nt, Haemophilus influenzae Rd
acuaauaaaagc

SEQ ID NO: 2715269 - RNA, 14 nt, Haemophilus influenzae Rd
acuaauaaaccaau

SEQ ID NO: 2715270 - RNA, 17 nt, Haemophilus influenzae Rd
acuaauaaauagaaauu

SEQ ID NO: 2715271 - RNA, 16 nt, Haemophilus influenzae Rd
acuaauaccgcagcag

SEQ ID NO: 2715272 - RNA, 17 nt, Haemophilus influenzae Rd
acuaauacuucauagug

SEQ ID NO: 2715273 - RNA, 13 nt, Haemophilus influenzae Rd
acuaauauaaaga

SEQ ID NO: 2715274 - RNA, 19 nt, Haemophilus influenzae Rd
acuaaugccgcaaaaccua

SEQ ID NO: 2715275 - RNA, 11 nt, Haemophilus influenzae Rd
acuaauuaaaa

SEQ ID NO: 2715276 - RNA, 23 nt, Haemophilus influenzae Rd
acuaauuaaaaggacuaaaccua

SEQ ID NO: 2715277 - RNA, 19 nt, Haemophilus influenzae Rd
acuaauucaagcaaauauu

SEQ ID NO: 2715278 - RNA, 14 nt, Haemophilus influenzae Rd
acuaauucauuaca

SEQ ID NO: 2715279 - RNA, 15 nt, Haemophilus influenzae Rd
acuaauucguuucuu

SEQ ID NO: 2715280 - RNA, 20 nt, Haemophilus influenzae Rd
acuaauucguuucuugguuu

SEQ ID NO: 2715281 - RNA, 16 nt, Haemophilus influenzae Rd
acuaauuguuuuaaaa

SEQ ID NO: 2715282 - RNA, 20 nt, Haemophilus influenzae Rd
acuaauuguuuuaaaaugga

SEQ ID NO: 2715283 - RNA, 22 nt, Haemophilus influenzae Rd
acuaauuucacaccauuuuuaa

SEQ ID NO: 2715284 - RNA, 22 nt, Haemophilus influenzae Rd
acuaauuugacgauaauauuuu

SEQ ID NO: 2715285 - RNA, 15 nt, Haemophilus influenzae Rd
acuaauuugcuuuuu

SEQ ID NO: 2715286 - RNA, 23 nt, Haemophilus influenzae Rd
acuaauuuguggaaauugccaaa

SEQ ID NO: 2715287 - RNA, 19 nt, Haemophilus influenzae Rd
acuacaaacaaauuuuuac

SEQ ID NO: 2715288 - RNA, 18 nt, Haemophilus influenzae Rd
acuacaacuucaucaaug

SEQ ID NO: 2715289 - RNA, 17 nt, Haemophilus influenzae Rd
acuacacagcaaggcuu

SEQ ID NO: 2715290 - RNA, 13 nt, Haemophilus influenzae Rd
acuacaucagguu

SEQ ID NO: 2715291 - RNA, 22 nt, Haemophilus influenzae Rd
acuacauugaguuacuuuucuu

SEQ ID NO: 2715292 - RNA, 24 nt, Haemophilus influenzae Rd
acuacauugaguuacuuuucuuca

SEQ ID NO: 2715293 - RNA, 14 nt, Haemophilus influenzae Rd
acuaccaauauuau

SEQ ID NO: 2715294 - RNA, 13 nt, Haemophilus influenzae Rd
acuacccaaauuu

SEQ ID NO: 2715295 - RNA, 19 nt, Haemophilus influenzae Rd
acuaccgcccgcaucaaug

SEQ ID NO: 2715296 - RNA, 13 nt, Haemophilus influenzae Rd
acuaccuaauaaa

SEQ ID NO: 2715297 - RNA, 18 nt, Haemophilus influenzae Rd
acuacggacuaaauaaau

SEQ ID NO: 2715298 - RNA, 19 nt, Haemophilus influenzae Rd
acuacguguuaauaaccaa

SEQ ID NO: 2715299 - RNA, 18 nt, Haemophilus influenzae Rd
acuacuugaacuaauauc

SEQ ID NO: 2715300 - RNA, 22 nt, Haemophilus influenzae Rd
acuacuugaacuaauaucacuu

SEQ ID NO: 2715301 - RNA, 13 nt, Haemophilus influenzae Rd
acuacuuuccaau

SEQ ID NO: 2715302 - RNA, 20 nt, Haemophilus influenzae Rd
acuacuuucuauuaaaaaau

SEQ ID NO: 2715303 - RNA, 20 nt, Haemophilus influenzae Rd
acuacuuuggauuggauuuu

SEQ ID NO: 2715304 - RNA, 18 nt, Haemophilus influenzae Rd
acuagauauaaaaacuau

SEQ ID NO: 2715305 - RNA, 14 nt, Haemophilus influenzae Rd
acuagauuuucuuc

SEQ ID NO: 2715306 - RNA, 14 nt, Haemophilus influenzae Rd
acuagccaaucaua

SEQ ID NO: 2715307 - RNA, 19 nt, Haemophilus influenzae Rd
acuagcuccuugauauuca

SEQ ID NO: 2715308 - RNA, 16 nt, Haemophilus influenzae Rd
acuagugaaauauuua

SEQ ID NO: 2715309 - RNA, 13 nt, Haemophilus influenzae Rd
acuauacacauca

SEQ ID NO: 2715310 - RNA, 23 nt, Haemophilus influenzae Rd
acuauaggaauaucauuagcaua

SEQ ID NO: 2715311 - RNA, 21 nt, Haemophilus influenzae Rd
acuauauccaaaucaaaaagc

SEQ ID NO: 2715312 - RNA, 22 nt, Haemophilus influenzae Rd
acuauauccaaaucaaaaagcu

SEQ ID NO: 2715313 - RNA, 22 nt, Haemophilus influenzae Rd
acuauaugauauauaaaacccc

SEQ ID NO: 2715314 - RNA, 14 nt, Haemophilus influenzae Rd
acuaucuguuuuac

SEQ ID NO: 2715315 - RNA, 16 nt, Haemophilus influenzae Rd
acuaugaaaucaagga

SEQ ID NO: 2715316 - RNA, 19 nt, Haemophilus influenzae Rd
acuaugcagaaucagaaua

SEQ ID NO: 2715317 - RNA, 19 nt, Haemophilus influenzae Rd
acuauuaaugcucuauauc

SEQ ID NO: 2715318 - RNA, 15 nt, Haemophilus influenzae Rd
acuauuaauguuauu

SEQ ID NO: 2715319 - RNA, 18 nt, Haemophilus influenzae Rd
acuauuaauguuauuaaa

SEQ ID NO: 2715320 - RNA, 22 nt, Haemophilus influenzae Rd
acuauuaauguuauuaaauaua

SEQ ID NO: 2715321 - RNA, 15 nt, Haemophilus influenzae Rd
acuauuacccacuuc

SEQ ID NO: 2715322 - RNA, 17 nt, Haemophilus influenzae Rd
acuauuauuccaaauau

SEQ ID NO: 2715323 - RNA, 20 nt, Haemophilus influenzae Rd
acuauucuaaccgcacuuuu

SEQ ID NO: 2715324 - RNA, 13 nt, Haemophilus influenzae Rd
acuauucuucaau

SEQ ID NO: 2715325 - RNA, 16 nt, Haemophilus influenzae Rd
acuauugguagauaau

SEQ ID NO: 2715326 - RNA, 19 nt, Haemophilus influenzae Rd
acuauuucaucuuuaguga

SEQ ID NO: 2715327 - RNA, 13 nt, Haemophilus influenzae Rd
acuauuuuauaau

SEQ ID NO: 2715328 - RNA, 12 nt, Haemophilus influenzae Rd
acuauuuuuaau

SEQ ID NO: 2715329 - RNA, 17 nt, Haemophilus influenzae Rd
acuauuuuuuauuuaua

SEQ ID NO: 2715330 - RNA, 16 nt, Haemophilus influenzae Rd
acuauuuuuuucucug

SEQ ID NO: 2715331 - RNA, 16 nt, Haemophilus influenzae Rd
acucaaagaaauagau

SEQ ID NO: 2715332 - RNA, 17 nt, Haemophilus influenzae Rd
acucaacaccgcaaaaa

SEQ ID NO: 2715333 - RNA, 23 nt, Haemophilus influenzae Rd
acucaacaccgcaaaaauacuaa

SEQ ID NO: 2715334 - RNA, 16 nt, Haemophilus influenzae Rd
acucaagcaaccuaaa

SEQ ID NO: 2715335 - RNA, 20 nt, Haemophilus influenzae Rd
acucaagguugcccacaaaa

SEQ ID NO: 2715336 - RNA, 21 nt, Haemophilus influenzae Rd
acucaauaaggcuuuuuuaau

SEQ ID NO: 2715337 - RNA, 15 nt, Haemophilus influenzae Rd
acucaauuuacacau

SEQ ID NO: 2715338 - RNA, 14 nt, Haemophilus influenzae Rd
acucacaacaaaga

SEQ ID NO: 2715339 - RNA, 13 nt, Haemophilus influenzae Rd
acucacaauacca

SEQ ID NO: 2715340 - RNA, 19 nt, Haemophilus influenzae Rd
acucacaauugauguaaaa

SEQ ID NO: 2715341 - RNA, 22 nt, Haemophilus influenzae Rd
acucacagagccuuuuucuaau

SEQ ID NO: 2715342 - RNA, 13 nt, Haemophilus influenzae Rd
acucacauugcca

SEQ ID NO: 2715343 - RNA, 16 nt, Haemophilus influenzae Rd
acucacauugccauuu

SEQ ID NO: 2715344 - RNA, 16 nt, Haemophilus influenzae Rd
acucaccgcaauaaua

SEQ ID NO: 2715345 - RNA, 14 nt, Haemophilus influenzae Rd
acucacggcaauaa

SEQ ID NO: 2715346 - RNA, 17 nt, Haemophilus influenzae Rd
acucacuauaacuuuuc

SEQ ID NO: 2715347 - RNA, 15 nt, Haemophilus influenzae Rd
acucacuggcucaag

SEQ ID NO: 2715348 - RNA, 15 nt, Haemophilus influenzae Rd
acucacuuuuccuug

SEQ ID NO: 2715349 - RNA, 13 nt, Haemophilus influenzae Rd
acucagaauauaa

SEQ ID NO: 2715350 - RNA, 22 nt, Haemophilus influenzae Rd
acucagaauauaaguucuucca

SEQ ID NO: 2715351 - RNA, 21 nt, Haemophilus influenzae Rd
acucaguuuuugaggaaaguu

SEQ ID NO: 2715352 - RNA, 13 nt, Haemophilus influenzae Rd
acucaucauauaa

SEQ ID NO: 2715353 - RNA, 17 nt, Haemophilus influenzae Rd
acucauucgucaauguu

SEQ ID NO: 2715354 - RNA, 14 nt, Haemophilus influenzae Rd
acuccaaauaauac

SEQ ID NO: 2715355 - RNA, 16 nt, Haemophilus influenzae Rd
acuccacuauaaaaua

SEQ ID NO: 2715356 - RNA, 17 nt, Haemophilus influenzae Rd
acuccacuuugcucuaa

SEQ ID NO: 2715357 - RNA, 14 nt, Haemophilus influenzae Rd
acuccguccuucag

SEQ ID NO: 2715358 - RNA, 17 nt, Haemophilus influenzae Rd
acuccuauuaguauuua

SEQ ID NO: 2715359 - RNA, 20 nt, Haemophilus influenzae Rd
acuccuauuaguauuuaagc

SEQ ID NO: 2715360 - RNA, 13 nt, Haemophilus influenzae Rd
acucgaaaaggca

SEQ ID NO: 2715361 - RNA, 15 nt, Haemophilus influenzae Rd
acucgcaucaauauc

SEQ ID NO: 2715362 - RNA, 23 nt, Haemophilus influenzae Rd
acucgcgccgauuggaugcccaa

SEQ ID NO: 2715363 - RNA, 17 nt, Haemophilus influenzae Rd
acucgcuguaacaucaa

SEQ ID NO: 2715364 - RNA, 19 nt, Haemophilus influenzae Rd
acucguccaaauucauuuu

SEQ ID NO: 2715365 - RNA, 19 nt, Haemophilus influenzae Rd
acucguccaucaaaaaaau

SEQ ID NO: 2715366 - RNA, 13 nt, Haemophilus influenzae Rd
acucuaaauugau

SEQ ID NO: 2715367 - RNA, 21 nt, Haemophilus influenzae Rd
acucuaauaagugagaaaguu

SEQ ID NO: 2715368 - RNA, 15 nt, Haemophilus influenzae Rd
acucuaauuccaccg

SEQ ID NO: 2715369 - RNA, 21 nt, Haemophilus influenzae Rd
acucucugacuucuagccaua

SEQ ID NO: 2715370 - RNA, 18 nt, Haemophilus influenzae Rd
acucucuugggugguaaa

SEQ ID NO: 2715371 - RNA, 21 nt, Haemophilus influenzae Rd
acucucuugggugguaaaaau

SEQ ID NO: 2715372 - RNA, 22 nt, Haemophilus influenzae Rd
acucugacaguuuaucucuuuc

SEQ ID NO: 2715373 - RNA, 17 nt, Haemophilus influenzae Rd
acucugcuaguucgguu

SEQ ID NO: 2715374 - RNA, 15 nt, Haemophilus influenzae Rd
acucuuaacaaaaca

SEQ ID NO: 2715375 - RNA, 17 nt, Haemophilus influenzae Rd
acucuuaaccuaccgga

SEQ ID NO: 2715376 - RNA, 15 nt, Haemophilus influenzae Rd
acucuuaauuuuuga

SEQ ID NO: 2715377 - RNA, 13 nt, Haemophilus influenzae Rd
acucuucaaguuu

SEQ ID NO: 2715378 - RNA, 16 nt, Haemophilus influenzae Rd
acucuuccauuuuuau

SEQ ID NO: 2715379 - RNA, 17 nt, Haemophilus influenzae Rd
acucuuucaaaaaucaa

SEQ ID NO: 2715380 - RNA, 14 nt, Haemophilus influenzae Rd
acucuuuuuuagau

SEQ ID NO: 2715381 - RNA, 15 nt, Haemophilus influenzae Rd
acugaaaaaagugcg

SEQ ID NO: 2715382 - RNA, 12 nt, Haemophilus influenzae Rd
acugaaaucaag

SEQ ID NO: 2715383 - RNA, 23 nt, Haemophilus influenzae Rd
acugaaaugauuauaauuagugg

SEQ ID NO: 2715384 - RNA, 15 nt, Haemophilus influenzae Rd
acugaaauucauuca

SEQ ID NO: 2715385 - RNA, 14 nt, Haemophilus influenzae Rd
acugaaauucuguu

SEQ ID NO: 2715386 - RNA, 14 nt, Haemophilus influenzae Rd
acugaaccagccau

SEQ ID NO: 2715387 - RNA, 17 nt, Haemophilus influenzae Rd
acugaagcaaucgcauu

SEQ ID NO: 2715388 - RNA, 15 nt, Haemophilus influenzae Rd
acugaaucgcguaau

SEQ ID NO: 2715389 - RNA, 22 nt, Haemophilus influenzae Rd
acugaauuggacggcaaaaaua

SEQ ID NO: 2715390 - RNA, 12 nt, Haemophilus influenzae Rd
acugaauuucau

SEQ ID NO: 2715391 - RNA, 22 nt, Haemophilus influenzae Rd
acugaccuuuaggaucauuaaa

SEQ ID NO: 2715392 - RNA, 13 nt, Haemophilus influenzae Rd
acugacucagguu

SEQ ID NO: 2715393 - RNA, 14 nt, Haemophilus influenzae Rd
acugagaucucuau

SEQ ID NO: 2715394 - RNA, 15 nt, Haemophilus influenzae Rd
acugagaucucuaug

SEQ ID NO: 2715395 - RNA, 18 nt, Haemophilus influenzae Rd
acugagcccacaacuaca

SEQ ID NO: 2715396 - RNA, 22 nt, Haemophilus influenzae Rd
acugagcuuaucgcaaucacga

SEQ ID NO: 2715397 - RNA, 19 nt, Haemophilus influenzae Rd
acugaguucuguaauucac

SEQ ID NO: 2715398 - RNA, 17 nt, Haemophilus influenzae Rd
acugaguucugucauuc

SEQ ID NO: 2715399 - RNA, 21 nt, Haemophilus influenzae Rd
acugaucgccaucuucuucug

SEQ ID NO: 2715400 - RNA, 23 nt, Haemophilus influenzae Rd
acugaugauggccaugacaagca

SEQ ID NO: 2715401 - RNA, 15 nt, Haemophilus influenzae Rd
acugauuuaaaaaaa

SEQ ID NO: 2715402 - RNA, 15 nt, Haemophilus influenzae Rd
acugauuuaguucaa

SEQ ID NO: 2715403 - RNA, 12 nt, Haemophilus influenzae Rd
acugauuucacg

SEQ ID NO: 2715404 - RNA, 20 nt, Haemophilus influenzae Rd
acugauuuccuguaaaaaac

SEQ ID NO: 2715405 - RNA, 16 nt, Haemophilus influenzae Rd
acugauuuuaagaaau

SEQ ID NO: 2715406 - RNA, 21 nt, Haemophilus influenzae Rd
acugauuuugaguuaggcauu

SEQ ID NO: 2715407 - RNA, 18 nt, Haemophilus influenzae Rd
acugauuuuguuuucuuu

SEQ ID NO: 2715408 - RNA, 14 nt, Haemophilus influenzae Rd
acugauuuuuuuau

SEQ ID NO: 2715409 - RNA, 14 nt, Haemophilus influenzae Rd
acugcaauuaucaa

SEQ ID NO: 2715410 - RNA, 15 nt, Haemophilus influenzae Rd
acugcagcauuuaaa

SEQ ID NO: 2715411 - RNA, 14 nt, Haemophilus influenzae Rd
acugcaguaaaauc

SEQ ID NO: 2715412 - RNA, 20 nt, Haemophilus influenzae Rd
acugcauauucauaaaaggc

SEQ ID NO: 2715413 - RNA, 22 nt, Haemophilus influenzae Rd
acugcauauucauaaaaggcaa

SEQ ID NO: 2715414 - RNA, 17 nt, Haemophilus influenzae Rd
acugcaucugcauuucc

SEQ ID NO: 2715415 - RNA, 14 nt, Haemophilus influenzae Rd
acugcaucuguugu

SEQ ID NO: 2715416 - RNA, 13 nt, Haemophilus influenzae Rd
acugccaaacaaa

SEQ ID NO: 2715417 - RNA, 22 nt, Haemophilus influenzae Rd
acugccacugcgcccgcugcau

SEQ ID NO: 2715418 - RNA, 15 nt, Haemophilus influenzae Rd
acugccuuuuucuuc

SEQ ID NO: 2715419 - RNA, 20 nt, Haemophilus influenzae Rd
acugcgcagauuaauccgcu

SEQ ID NO: 2715420 - RNA, 18 nt, Haemophilus influenzae Rd
acugcucuuggauuuuuu

SEQ ID NO: 2715421 - RNA, 18 nt, Haemophilus influenzae Rd
acugcuuguucagcaaca

SEQ ID NO: 2715422 - RNA, 21 nt, Haemophilus influenzae Rd
acugcuuguucagcaacauca

SEQ ID NO: 2715423 - RNA, 17 nt, Haemophilus influenzae Rd
acugcuuuauuuucuuu

SEQ ID NO: 2715424 - RNA, 16 nt, Haemophilus influenzae Rd
acuggaaauucuucaa

SEQ ID NO: 2715425 - RNA, 22 nt, Haemophilus influenzae Rd
acuggaaauucuucaauaacaa

SEQ ID NO: 2715426 - RNA, 15 nt, Haemophilus influenzae Rd
acuggaauaaagcaa

SEQ ID NO: 2715427 - RNA, 13 nt, Haemophilus influenzae Rd
acuggacuccaag

SEQ ID NO: 2715428 - RNA, 16 nt, Haemophilus influenzae Rd
acuggagccuugggaa

SEQ ID NO: 2715429 - RNA, 20 nt, Haemophilus influenzae Rd
acuggagccuugggaauaug

SEQ ID NO: 2715430 - RNA, 18 nt, Haemophilus influenzae Rd
acuggcacuaaaccugcu

SEQ ID NO: 2715431 - RNA, 13 nt, Haemophilus influenzae Rd
acuggcagacaag

SEQ ID NO: 2715432 - RNA, 19 nt, Haemophilus influenzae Rd
acuggcagacaaguuuaau

SEQ ID NO: 2715433 - RNA, 21 nt, Haemophilus influenzae Rd
acuggcauuuuuuguugagca

SEQ ID NO: 2715434 - RNA, 20 nt, Haemophilus influenzae Rd
acuggcguaaucguagaaau

SEQ ID NO: 2715435 - RNA, 21 nt, Haemophilus influenzae Rd
acuggcucaaguaaugcuuua

SEQ ID NO: 2715436 - RNA, 20 nt, Haemophilus influenzae Rd
acuggcuugugaaauaaaau

SEQ ID NO: 2715437 - RNA, 13 nt, Haemophilus influenzae Rd
acugguucaaguc

SEQ ID NO: 2715438 - RNA, 13 nt, Haemophilus influenzae Rd
acuguaaauaaac

SEQ ID NO: 2715439 - RNA, 19 nt, Haemophilus influenzae Rd
acuguauauuguuugcuuu

SEQ ID NO: 2715440 - RNA, 20 nt, Haemophilus influenzae Rd
acuguaucuuuuuguaauuu

SEQ ID NO: 2715441 - RNA, 19 nt, Haemophilus influenzae Rd
acugucaccucguaaaaua

SEQ ID NO: 2715442 - RNA, 22 nt, Haemophilus influenzae Rd
acugucaccucguaaaauauua

SEQ ID NO: 2715443 - RNA, 16 nt, Haemophilus influenzae Rd
acugucgaaccaaguu

SEQ ID NO: 2715444 - RNA, 12 nt, Haemophilus influenzae Rd
acugucuacugg

SEQ ID NO: 2715445 - RNA, 22 nt, Haemophilus influenzae Rd
acugugagauugccuaaaucau

SEQ ID NO: 2715446 - RNA, 16 nt, Haemophilus influenzae Rd
acuguggauaauucau

SEQ ID NO: 2715447 - RNA, 22 nt, Haemophilus influenzae Rd
acuguggcuaauccaauuucac

SEQ ID NO: 2715448 - RNA, 22 nt, Haemophilus influenzae Rd
acuguuaccaauaacuaaaaau

SEQ ID NO: 2715449 - RNA, 20 nt, Haemophilus influenzae Rd
acuguuauuugcaaagauau

SEQ ID NO: 2715450 - RNA, 14 nt, Haemophilus influenzae Rd
acuguucaaauaag

SEQ ID NO: 2715451 - RNA, 23 nt, Haemophilus influenzae Rd
acuguucuucugggauuggcuug

SEQ ID NO: 2715452 - RNA, 17 nt, Haemophilus influenzae Rd
acuguugccauaaauuu

SEQ ID NO: 2715453 - RNA, 22 nt, Haemophilus influenzae Rd
acuguugccauaaauuuggaua

SEQ ID NO: 2715454 - RNA, 21 nt, Haemophilus influenzae Rd
acuguugugaaguuuuuuaag

SEQ ID NO: 2715455 - RNA, 13 nt, Haemophilus influenzae Rd
acuguuuauagcg

SEQ ID NO: 2715456 - RNA, 13 nt, Haemophilus influenzae Rd
acuguuuggcaaa

SEQ ID NO: 2715457 - RNA, 14 nt, Haemophilus influenzae Rd
acuuaaaaauaaag

SEQ ID NO: 2715458 - RNA, 16 nt, Haemophilus influenzae Rd
acuuaaaaauaaagua

SEQ ID NO: 2715459 - RNA, 16 nt, Haemophilus influenzae Rd
acuuaaaagauuaaaa

SEQ ID NO: 2715460 - RNA, 17 nt, Haemophilus influenzae Rd
acuuaaagaauacuuaa

SEQ ID NO: 2715461 - RNA, 16 nt, Haemophilus influenzae Rd
acuuaaaguuaucaaa

SEQ ID NO: 2715462 - RNA, 14 nt, Haemophilus influenzae Rd
acuuaaauacauug

SEQ ID NO: 2715463 - RNA, 16 nt, Haemophilus influenzae Rd
acuuaaauaguuaauu

SEQ ID NO: 2715464 - RNA, 22 nt, Haemophilus influenzae Rd
acuuaaauaguuaauugauuua

SEQ ID NO: 2715465 - RNA, 23 nt, Haemophilus influenzae Rd
acuuaaauuacgaccuuuacuuu

SEQ ID NO: 2715466 - RNA, 12 nt, Haemophilus influenzae Rd
acuuaacaucau

SEQ ID NO: 2715467 - RNA, 13 nt, Haemophilus influenzae Rd
acuuaaccaaaua

SEQ ID NO: 2715468 - RNA, 16 nt, Haemophilus influenzae Rd
acuuaaguugggcuua

SEQ ID NO: 2715469 - RNA, 20 nt, Haemophilus influenzae Rd
acuuaaguugggcuuauuaa

SEQ ID NO: 2715470 - RNA, 23 nt, Haemophilus influenzae Rd
acuuaaguugggcuuauuuguuu

SEQ ID NO: 2715471 - RNA, 13 nt, Haemophilus influenzae Rd
acuuaauaauaua

SEQ ID NO: 2715472 - RNA, 16 nt, Haemophilus influenzae Rd
acuuaauccuuucacu

SEQ ID NO: 2715473 - RNA, 22 nt, Haemophilus influenzae Rd
acuuaaugcaguaauaaauccu

SEQ ID NO: 2715474 - RNA, 20 nt, Haemophilus influenzae Rd
acuuaaugcuucggcugcuu

SEQ ID NO: 2715475 - RNA, 13 nt, Haemophilus influenzae Rd
acuuaauguuaau

SEQ ID NO: 2715476 - RNA, 20 nt, Haemophilus influenzae Rd
acuuaauguuaauaauuuau

SEQ ID NO: 2715477 - RNA, 18 nt, Haemophilus influenzae Rd
acuuaauugauuuuaaag

SEQ ID NO: 2715478 - RNA, 15 nt, Haemophilus influenzae Rd
acuuaauuucuuaau

SEQ ID NO: 2715479 - RNA, 21 nt, Haemophilus influenzae Rd
acuuaauuuugcuaaacccac

SEQ ID NO: 2715480 - RNA, 20 nt, Haemophilus influenzae Rd
acuuacaucugugauaacua

SEQ ID NO: 2715481 - RNA, 18 nt, Haemophilus influenzae Rd
acuuaccacguucuugua

SEQ ID NO: 2715482 - RNA, 18 nt, Haemophilus influenzae Rd
acuuaccaugccauuucc

SEQ ID NO: 2715483 - RNA, 20 nt, Haemophilus influenzae Rd
acuuaccuaaaaauuuaaau

SEQ ID NO: 2715484 - RNA, 23 nt, Haemophilus influenzae Rd
acuuacgccagcuaaagaaagca

SEQ ID NO: 2715485 - RNA, 17 nt, Haemophilus influenzae Rd
acuuagcccuuaaacua

SEQ ID NO: 2715486 - RNA, 20 nt, Haemophilus influenzae Rd
acuuagcccuuaaacuaaau

SEQ ID NO: 2715487 - RNA, 17 nt, Haemophilus influenzae Rd
acuuagcgcauuuuucu

SEQ ID NO: 2715488 - RNA, 20 nt, Haemophilus influenzae Rd
acuuagcgcauuuuucuuua

SEQ ID NO: 2715489 - RNA, 13 nt, Haemophilus influenzae Rd
acuuaguaauaua

SEQ ID NO: 2715490 - RNA, 14 nt, Haemophilus influenzae Rd
acuuauaaagauau

SEQ ID NO: 2715491 - RNA, 14 nt, Haemophilus influenzae Rd
acuuauaaauuuaa

SEQ ID NO: 2715492 - RNA, 17 nt, Haemophilus influenzae Rd
acuuauaaauuuaaagg

SEQ ID NO: 2715493 - RNA, 14 nt, Haemophilus influenzae Rd
acuuauauuauuua

SEQ ID NO: 2715494 - RNA, 15 nt, Haemophilus influenzae Rd
acuuaucuaaaaaga

SEQ ID NO: 2715495 - RNA, 16 nt, Haemophilus influenzae Rd
acuuaugugcaccuuc

SEQ ID NO: 2715496 - RNA, 20 nt, Haemophilus influenzae Rd
acuuauuaucuucuaaaaga

SEQ ID NO: 2715497 - RNA, 18 nt, Haemophilus influenzae Rd
acuuauuugacuuaaaug

SEQ ID NO: 2715498 - RNA, 22 nt, Haemophilus influenzae Rd
acuuauuugacuuaaaugaagu

SEQ ID NO: 2715499 - RNA, 17 nt, Haemophilus influenzae Rd
acuucaaauaccucaau

SEQ ID NO: 2715500 - RNA, 14 nt, Haemophilus influenzae Rd
acuucaaccacuuc

SEQ ID NO: 2715501 - RNA, 15 nt, Haemophilus influenzae Rd
acuucaaccacuuca

SEQ ID NO: 2715502 - RNA, 23 nt, Haemophilus influenzae Rd
acuucaacgccguauuuggcaaa

SEQ ID NO: 2715503 - RNA, 20 nt, Haemophilus influenzae Rd
acuucagaauucaucacauc

SEQ ID NO: 2715504 - RNA, 21 nt, Haemophilus influenzae Rd
acuucagcagauacaucuucu

SEQ ID NO: 2715505 - RNA, 18 nt, Haemophilus influenzae Rd
acuucagcagcaaaaucu

SEQ ID NO: 2715506 - RNA, 21 nt, Haemophilus influenzae Rd
acuucagcagcaaaaucuucu

SEQ ID NO: 2715507 - RNA, 15 nt, Haemophilus influenzae Rd
acuucagcuaauaaa

SEQ ID NO: 2715508 - RNA, 17 nt, Haemophilus influenzae Rd
acuucagcuaauaaagu

SEQ ID NO: 2715509 - RNA, 18 nt, Haemophilus influenzae Rd
acuucaggguuuucauca

SEQ ID NO: 2715510 - RNA, 19 nt, Haemophilus influenzae Rd
acuucaggguuuucaucau

SEQ ID NO: 2715511 - RNA, 22 nt, Haemophilus influenzae Rd
acuucagugcguaaugcaagca

SEQ ID NO: 2715512 - RNA, 16 nt, Haemophilus influenzae Rd
acuucauaaauccaau

SEQ ID NO: 2715513 - RNA, 20 nt, Haemophilus influenzae Rd
acuucaucaauggcaucgcu

SEQ ID NO: 2715514 - RNA, 19 nt, Haemophilus influenzae Rd
acuucaucacccaucaaau

SEQ ID NO: 2715515 - RNA, 10 nt, Haemophilus influenzae Rd
acuucaucca

SEQ ID NO: 2715516 - RNA, 13 nt, Haemophilus influenzae Rd
acuucaucgaaaa

SEQ ID NO: 2715517 - RNA, 17 nt, Haemophilus influenzae Rd
acuucaucuauauuaua

SEQ ID NO: 2715518 - RNA, 18 nt, Haemophilus influenzae Rd
acuuccaaaguauaaggu

SEQ ID NO: 2715519 - RNA, 20 nt, Haemophilus influenzae Rd
acuuccacaggcuugaguuu

SEQ ID NO: 2715520 - RNA, 18 nt, Haemophilus influenzae Rd
acuuccacuaguucauca

SEQ ID NO: 2715521 - RNA, 21 nt, Haemophilus influenzae Rd
acuuccacuucugaauccaau

SEQ ID NO: 2715522 - RNA, 22 nt, Haemophilus influenzae Rd
acuuccccuguaauaaaugcgu

SEQ ID NO: 2715523 - RNA, 20 nt, Haemophilus influenzae Rd
acuuccgauuuuaauugugc

SEQ ID NO: 2715524 - RNA, 20 nt, Haemophilus influenzae Rd
acuuccuaaacuacaacagc

SEQ ID NO: 2715525 - RNA, 13 nt, Haemophilus influenzae Rd
acuucgcuuacgc

SEQ ID NO: 2715526 - RNA, 18 nt, Haemophilus influenzae Rd
acuucgggcgaaaccuuu

SEQ ID NO: 2715527 - RNA, 22 nt, Haemophilus influenzae Rd
acuucggggaucauuucaucug

SEQ ID NO: 2715528 - RNA, 19 nt, Haemophilus influenzae Rd
acuucuaaaagcuguucug

SEQ ID NO: 2715529 - RNA, 19 nt, Haemophilus influenzae Rd
acuucuaaacgaaugaagu

SEQ ID NO: 2715530 - RNA, 16 nt, Haemophilus influenzae Rd
acuucuaacuaaaaaa

SEQ ID NO: 2715531 - RNA, 16 nt, Haemophilus influenzae Rd
acuucuacuucuugug

SEQ ID NO: 2715532 - RNA, 21 nt, Haemophilus influenzae Rd
acuucuaugaagaacaagggg

SEQ ID NO: 2715533 - RNA, 18 nt, Haemophilus influenzae Rd
acuucugaauccaaugca

SEQ ID NO: 2715534 - RNA, 18 nt, Haemophilus influenzae Rd
acuucugcgccuaaucca

SEQ ID NO: 2715535 - RNA, 15 nt, Haemophilus influenzae Rd
acuucugcugcacga

SEQ ID NO: 2715536 - RNA, 21 nt, Haemophilus influenzae Rd
acuucuguugggaauaauucu

SEQ ID NO: 2715537 - RNA, 23 nt, Haemophilus influenzae Rd
acuucuuacguuuaaauuuauga

SEQ ID NO: 2715538 - RNA, 13 nt, Haemophilus influenzae Rd
acuucuucaauac

SEQ ID NO: 2715539 - RNA, 14 nt, Haemophilus influenzae Rd
acuucuuccacuuu

SEQ ID NO: 2715540 - RNA, 15 nt, Haemophilus influenzae Rd
acuucuuccacuuuu

SEQ ID NO: 2715541 - RNA, 12 nt, Haemophilus influenzae Rd
acuucuuccgcu

SEQ ID NO: 2715542 - RNA, 13 nt, Haemophilus influenzae Rd
acuucuucuucgc

SEQ ID NO: 2715543 - RNA, 16 nt, Haemophilus influenzae Rd
acuucuuguggagauu

SEQ ID NO: 2715544 - RNA, 12 nt, Haemophilus influenzae Rd
acuucuuugaau

SEQ ID NO: 2715545 - RNA, 20 nt, Haemophilus influenzae Rd
acuugaauagcaagaacaau

SEQ ID NO: 2715546 - RNA, 15 nt, Haemophilus influenzae Rd
acuugaauugaagag

SEQ ID NO: 2715547 - RNA, 22 nt, Haemophilus influenzae Rd
acuugaccagagccaaauacaa

SEQ ID NO: 2715548 - RNA, 23 nt, Haemophilus influenzae Rd
acuugaccagagccaaauacaau

SEQ ID NO: 2715549 - RNA, 14 nt, Haemophilus influenzae Rd
acuugagauuuuuu

SEQ ID NO: 2715550 - RNA, 18 nt, Haemophilus influenzae Rd
acuugagcguaacccaaa

SEQ ID NO: 2715551 - RNA, 19 nt, Haemophilus influenzae Rd
acuugauaaucauugaaau

SEQ ID NO: 2715552 - RNA, 15 nt, Haemophilus influenzae Rd
acuugaucaccuauc

SEQ ID NO: 2715553 - RNA, 22 nt, Haemophilus influenzae Rd
acuugauuugcuuggaauaaau

SEQ ID NO: 2715554 - RNA, 13 nt, Haemophilus influenzae Rd
acuugcaaaccaa

SEQ ID NO: 2715555 - RNA, 20 nt, Haemophilus influenzae Rd
acuugcaagggauuugaaaa

SEQ ID NO: 2715556 - RNA, 21 nt, Haemophilus influenzae Rd
acuugcaagggauuugaaaau

SEQ ID NO: 2715557 - RNA, 22 nt, Haemophilus influenzae Rd
acuugcaagggauuugaaaauc

SEQ ID NO: 2715558 - RNA, 21 nt, Haemophilus influenzae Rd
acuugcacaauuacuucuuac

SEQ ID NO: 2715559 - RNA, 14 nt, Haemophilus influenzae Rd
acuugcaccaccaa

SEQ ID NO: 2715560 - RNA, 15 nt, Haemophilus influenzae Rd
acuugcaucuaaaaa

SEQ ID NO: 2715561 - RNA, 17 nt, Haemophilus influenzae Rd
acuugcaucuaaaaaua

SEQ ID NO: 2715562 - RNA, 14 nt, Haemophilus influenzae Rd
acuugccaaacauu

SEQ ID NO: 2715563 - RNA, 20 nt, Haemophilus influenzae Rd
acuugccaaacauuaccaag

SEQ ID NO: 2715564 - RNA, 22 nt, Haemophilus influenzae Rd
acuugccacaacugaagcuucu

SEQ ID NO: 2715565 - RNA, 16 nt, Haemophilus influenzae Rd
acuugccucuuuccuu

SEQ ID NO: 2715566 - RNA, 14 nt, Haemophilus influenzae Rd
acuugcuauuuucu

SEQ ID NO: 2715567 - RNA, 22 nt, Haemophilus influenzae Rd
acuugcuguuaagaccaauucu

SEQ ID NO: 2715568 - RNA, 16 nt, Haemophilus influenzae Rd
acuugcuuaugcaaag

SEQ ID NO: 2715569 - RNA, 15 nt, Haemophilus influenzae Rd
acuuggaugaaauca

SEQ ID NO: 2715570 - RNA, 17 nt, Haemophilus influenzae Rd
acuuggaugaaaucaaa

SEQ ID NO: 2715571 - RNA, 15 nt, Haemophilus influenzae Rd
acuugggcugcauga

SEQ ID NO: 2715572 - RNA, 16 nt, Haemophilus influenzae Rd
acuuggugaucaccga

SEQ ID NO: 2715573 - RNA, 17 nt, Haemophilus influenzae Rd
acuuggugcaauaaaau

SEQ ID NO: 2715574 - RNA, 14 nt, Haemophilus influenzae Rd
acuugguguaauuu

SEQ ID NO: 2715575 - RNA, 19 nt, Haemophilus influenzae Rd
acuuguacaguaauuguug

SEQ ID NO: 2715576 - RNA, 16 nt, Haemophilus influenzae Rd
acuugucauuaaaaaa

SEQ ID NO: 2715577 - RNA, 20 nt, Haemophilus influenzae Rd
acuugugcgauuaacaauaa

SEQ ID NO: 2715578 - RNA, 23 nt, Haemophilus influenzae Rd
acuugugcuucauagaaaccaau

SEQ ID NO: 2715579 - RNA, 13 nt, Haemophilus influenzae Rd
acuuguucaaaaa

SEQ ID NO: 2715580 - RNA, 21 nt, Haemophilus influenzae Rd
acuuguucaggugucaucacu

SEQ ID NO: 2715581 - RNA, 20 nt, Haemophilus influenzae Rd
acuuguuggauaucuuguug

SEQ ID NO: 2715582 - RNA, 16 nt, Haemophilus influenzae Rd
acuuguuggcauugaa

SEQ ID NO: 2715583 - RNA, 20 nt, Haemophilus influenzae Rd
acuuguuuacugaauaaaaa

SEQ ID NO: 2715584 - RNA, 23 nt, Haemophilus influenzae Rd
acuuguuuuccaaacauuuuuau

SEQ ID NO: 2715585 - RNA, 21 nt, Haemophilus influenzae Rd
acuuuaaaaguuuacuauuaa

SEQ ID NO: 2715586 - RNA, 15 nt, Haemophilus influenzae Rd
acuuuaaagaauauu

SEQ ID NO: 2715587 - RNA, 23 nt, Haemophilus influenzae Rd
acuuuaaagaauauucuuuucuc

SEQ ID NO: 2715588 - RNA, 14 nt, Haemophilus influenzae Rd
acuuuaaauauuua

SEQ ID NO: 2715589 - RNA, 16 nt, Haemophilus influenzae Rd
acuuuaaauauuuaaa

SEQ ID NO: 2715590 - RNA, 15 nt, Haemophilus influenzae Rd
acuuuaaauuuuccu

SEQ ID NO: 2715591 - RNA, 14 nt, Haemophilus influenzae Rd
acuuuaaguaauca

SEQ ID NO: 2715592 - RNA, 18 nt, Haemophilus influenzae Rd
acuuuaaucgaaaucaca

SEQ ID NO: 2715593 - RNA, 14 nt, Haemophilus influenzae Rd
acuuuaauuuucca

SEQ ID NO: 2715594 - RNA, 22 nt, Haemophilus influenzae Rd
acuuuaauuuuccaaauuccau

SEQ ID NO: 2715595 - RNA, 22 nt, Haemophilus influenzae Rd
acuuuaccauugcguucacuca

SEQ ID NO: 2715596 - RNA, 21 nt, Haemophilus influenzae Rd
acuuuaccgaucgcuuucauu

SEQ ID NO: 2715597 - RNA, 21 nt, Haemophilus influenzae Rd
acuuuacguaaaguaaaugcu

SEQ ID NO: 2715598 - RNA, 22 nt, Haemophilus influenzae Rd
acuuuagaaauucgauugcauu

SEQ ID NO: 2715599 - RNA, 20 nt, Haemophilus influenzae Rd
acuuuauacuaaaaguacca

SEQ ID NO: 2715600 - RNA, 17 nt, Haemophilus influenzae Rd
acuuuauauugacaaag

SEQ ID NO: 2715601 - RNA, 15 nt, Haemophilus influenzae Rd
acuuuauccccuaca

SEQ ID NO: 2715602 - RNA, 20 nt, Haemophilus influenzae Rd
acuuuaucuagacaaaaccu

SEQ ID NO: 2715603 - RNA, 23 nt, Haemophilus influenzae Rd
acuuuaucuagacaaaaccugca

SEQ ID NO: 2715604 - RNA, 15 nt, Haemophilus influenzae Rd
acuuuauuagaaaua

SEQ ID NO: 2715605 - RNA, 16 nt, Haemophilus influenzae Rd
acuuuauuagaaauau

SEQ ID NO: 2715606 - RNA, 17 nt, Haemophilus influenzae Rd
acuuuauuagaaauaua

SEQ ID NO: 2715607 - RNA, 21 nt, Haemophilus influenzae Rd
acuuuauuugauuguugcuug

SEQ ID NO: 2715608 - RNA, 13 nt, Haemophilus influenzae Rd
acuuuauuuuuaa

SEQ ID NO: 2715609 - RNA, 18 nt, Haemophilus influenzae Rd
acuuucaacuguucuucu

SEQ ID NO: 2715610 - RNA, 22 nt, Haemophilus influenzae Rd
acuuucaacuguucuucuggga

SEQ ID NO: 2715611 - RNA, 20 nt, Haemophilus influenzae Rd
acuuucaaucgaaaguggcu

SEQ ID NO: 2715612 - RNA, 19 nt, Haemophilus influenzae Rd
acuuucacacccaugaauc

SEQ ID NO: 2715613 - RNA, 18 nt, Haemophilus influenzae Rd
acuuucacauaaauuaca

SEQ ID NO: 2715614 - RNA, 20 nt, Haemophilus influenzae Rd
acuuucacgguacgcugcau

SEQ ID NO: 2715615 - RNA, 20 nt, Haemophilus influenzae Rd
acuuucaguuaaauuuucaa

SEQ ID NO: 2715616 - RNA, 20 nt, Haemophilus influenzae Rd
acuuucauccucucgccaaa

SEQ ID NO: 2715617 - RNA, 23 nt, Haemophilus influenzae Rd
acuuucauuccugccguaaugcu

SEQ ID NO: 2715618 - RNA, 21 nt, Haemophilus influenzae Rd
acuuucauucguauaaauauu

SEQ ID NO: 2715619 - RNA, 22 nt, Haemophilus influenzae Rd
acuuuccauacccuugcuucug

SEQ ID NO: 2715620 - RNA, 17 nt, Haemophilus influenzae Rd
acuuuccaucauugcuc

SEQ ID NO: 2715621 - RNA, 14 nt, Haemophilus influenzae Rd
acuuucuucguuaa

SEQ ID NO: 2715622 - RNA, 12 nt, Haemophilus influenzae Rd
acuuucuucuuu

SEQ ID NO: 2715623 - RNA, 14 nt, Haemophilus influenzae Rd
acuuucuucuuuua

SEQ ID NO: 2715624 - RNA, 13 nt, Haemophilus influenzae Rd
acuuucuugcugu

SEQ ID NO: 2715625 - RNA, 23 nt, Haemophilus influenzae Rd
acuuucuuuuuguuuaaaagccc

SEQ ID NO: 2715626 - RNA, 14 nt, Haemophilus influenzae Rd
acuuugauaauaca

SEQ ID NO: 2715627 - RNA, 14 nt, Haemophilus influenzae Rd
acuuugauuuugag

SEQ ID NO: 2715628 - RNA, 14 nt, Haemophilus influenzae Rd
acuuugcacuuuaa

SEQ ID NO: 2715629 - RNA, 22 nt, Haemophilus influenzae Rd
acuuugcagugcauuaaugccu

SEQ ID NO: 2715630 - RNA, 22 nt, Haemophilus influenzae Rd
acuuugcgccuguacugcaagc

SEQ ID NO: 2715631 - RNA, 20 nt, Haemophilus influenzae Rd
acuuuggauuggauuuugaa

SEQ ID NO: 2715632 - RNA, 18 nt, Haemophilus influenzae Rd
acuuuguacaccaaaaua

SEQ ID NO: 2715633 - RNA, 18 nt, Haemophilus influenzae Rd
acuuugucaauauaaagu

SEQ ID NO: 2715634 - RNA, 15 nt, Haemophilus influenzae Rd
acuuuguucauuuuu

SEQ ID NO: 2715635 - RNA, 18 nt, Haemophilus influenzae Rd
acuuuguucauuuuuacu

SEQ ID NO: 2715636 - RNA, 17 nt, Haemophilus influenzae Rd
acuuuuaacuuaaucau

SEQ ID NO: 2715637 - RNA, 18 nt, Haemophilus influenzae Rd
acuuuuaacuuaaucauu

SEQ ID NO: 2715638 - RNA, 14 nt, Haemophilus influenzae Rd
acuuuuaauuaaau

SEQ ID NO: 2715639 - RNA, 18 nt, Haemophilus influenzae Rd
acuuuuaauuaaauacaa

SEQ ID NO: 2715640 - RNA, 17 nt, Haemophilus influenzae Rd
acuuuuaauuaauauua

SEQ ID NO: 2715641 - RNA, 14 nt, Haemophilus influenzae Rd
acuuuuaauucauu

SEQ ID NO: 2715642 - RNA, 13 nt, Haemophilus influenzae Rd
acuuuuacaucau

SEQ ID NO: 2715643 - RNA, 20 nt, Haemophilus influenzae Rd
acuuuuacaucauuguaguu

SEQ ID NO: 2715644 - RNA, 20 nt, Haemophilus influenzae Rd
acuuuuagaauaaauuaaaa

SEQ ID NO: 2715645 - RNA, 13 nt, Haemophilus influenzae Rd
acuuuuagauaaa

SEQ ID NO: 2715646 - RNA, 17 nt, Haemophilus influenzae Rd
acuuuuagcuaaaacua

SEQ ID NO: 2715647 - RNA, 15 nt, Haemophilus influenzae Rd
acuuuuauaucuaua

SEQ ID NO: 2715648 - RNA, 23 nt, Haemophilus influenzae Rd
acuuuuauccacaugauauauuu

SEQ ID NO: 2715649 - RNA, 19 nt, Haemophilus influenzae Rd
acuuuuaucuauaaaaaga

SEQ ID NO: 2715650 - RNA, 21 nt, Haemophilus influenzae Rd
acuuuuaucuauaaaaagaac

SEQ ID NO: 2715651 - RNA, 20 nt, Haemophilus influenzae Rd
acuuuuauugguaaaugucu

SEQ ID NO: 2715652 - RNA, 14 nt, Haemophilus influenzae Rd
acuuuucaacaaaa

SEQ ID NO: 2715653 - RNA, 18 nt, Haemophilus influenzae Rd
acuuuuccuaaaguuuuu

SEQ ID NO: 2715654 - RNA, 17 nt, Haemophilus influenzae Rd
acuuuucgauagaacaa

SEQ ID NO: 2715655 - RNA, 19 nt, Haemophilus influenzae Rd
acuuuucgauagaacaaau

SEQ ID NO: 2715656 - RNA, 21 nt, Haemophilus influenzae Rd
acuuuucuuauaauuacagaa

SEQ ID NO: 2715657 - RNA, 18 nt, Haemophilus influenzae Rd
acuuuucuucaauuaccu

SEQ ID NO: 2715658 - RNA, 18 nt, Haemophilus influenzae Rd
acuuuugauuuauuaaua

SEQ ID NO: 2715659 - RNA, 18 nt, Haemophilus influenzae Rd
acuuuugcacugcaauga

SEQ ID NO: 2715660 - RNA, 21 nt, Haemophilus influenzae Rd
acuuuugcauuugcuaagauu

SEQ ID NO: 2715661 - RNA, 22 nt, Haemophilus influenzae Rd
acuuuugcccacgcacuuuucc

SEQ ID NO: 2715662 - RNA, 24 nt, Haemophilus influenzae Rd
acuuuuggauaaaguauucauaua

SEQ ID NO: 2715663 - RNA, 21 nt, Haemophilus influenzae Rd
acuuuuggcaucgugaugauu

SEQ ID NO: 2715664 - RNA, 18 nt, Haemophilus influenzae Rd
acuuuugguggauuauaa

SEQ ID NO: 2715665 - RNA, 21 nt, Haemophilus influenzae Rd
acuuuuguuaucuacuuaauu

SEQ ID NO: 2715666 - RNA, 14 nt, Haemophilus influenzae Rd
acuuuuuaauaaau

SEQ ID NO: 2715667 - RNA, 20 nt, Haemophilus influenzae Rd
acuuuuuaucuaaaaaagag

SEQ ID NO: 2715668 - RNA, 16 nt, Haemophilus influenzae Rd
acuuuuuauguuuugu

SEQ ID NO: 2715669 - RNA, 21 nt, Haemophilus influenzae Rd
acuuuuuauucaaaucgauca

SEQ ID NO: 2715670 - RNA, 15 nt, Haemophilus influenzae Rd
acuuuuucaccauug

SEQ ID NO: 2715671 - RNA, 15 nt, Haemophilus influenzae Rd
acuuuuucaucuuua

SEQ ID NO: 2715672 - RNA, 22 nt, Haemophilus influenzae Rd
acuuuuucauguacaagugaau

SEQ ID NO: 2715673 - RNA, 18 nt, Haemophilus influenzae Rd
acuuuuucauuaucuuua

SEQ ID NO: 2715674 - RNA, 15 nt, Haemophilus influenzae Rd
acuuuuuggacuuua

SEQ ID NO: 2715675 - RNA, 12 nt, Haemophilus influenzae Rd
acuuuuuguuuu

SEQ ID NO: 2715676 - RNA, 16 nt, Haemophilus influenzae Rd
acuuuuuuaaguagua

SEQ ID NO: 2715677 - RNA, 21 nt, Haemophilus influenzae Rd
acuuuuuuaaguaguauuuua

SEQ ID NO: 2715678 - RNA, 19 nt, Haemophilus influenzae Rd
acuuuuuuaccuucagcac

SEQ ID NO: 2715679 - RNA, 23 nt, Haemophilus influenzae Rd
acuuuuuuauaaucuuuaaauuu

SEQ ID NO: 2715680 - RNA, 21 nt, Haemophilus influenzae Rd
acuuuuuucagucuauuauaa

SEQ ID NO: 2715681 - RNA, 14 nt, Haemophilus influenzae Rd
acuuuuuucuaccg

SEQ ID NO: 2715682 - RNA, 15 nt, Haemophilus influenzae Rd
acuuuuuucuuaaau

SEQ ID NO: 2715683 - RNA, 15 nt, Haemophilus influenzae Rd
agaaaaagaaaaccu

SEQ ID NO: 2715684 - RNA, 21 nt, Haemophilus influenzae Rd
agaaaaaucgaagaaauauga

SEQ ID NO: 2715685 - RNA, 15 nt, Haemophilus influenzae Rd
agaaaaauuguguaa

SEQ ID NO: 2715686 - RNA, 12 nt, Haemophilus influenzae Rd
agaaaacaaacg

SEQ ID NO: 2715687 - RNA, 12 nt, Haemophilus influenzae Rd
agaaaacaauaa

SEQ ID NO: 2715688 - RNA, 16 nt, Haemophilus influenzae Rd
agaaaacucgacuuuu

SEQ ID NO: 2715689 - RNA, 13 nt, Haemophilus influenzae Rd
agaaaacuuauaa

SEQ ID NO: 2715690 - RNA, 16 nt, Haemophilus influenzae Rd
agaaaagacaauaauu

SEQ ID NO: 2715691 - RNA, 18 nt, Haemophilus influenzae Rd
agaaaagacaauaauuca

SEQ ID NO: 2715692 - RNA, 16 nt, Haemophilus influenzae Rd
agaaaagcauuaauag

SEQ ID NO: 2715693 - RNA, 14 nt, Haemophilus influenzae Rd
agaaaauaaauaag

SEQ ID NO: 2715694 - RNA, 15 nt, Haemophilus influenzae Rd
agaaaauaaauaagg

SEQ ID NO: 2715695 - RNA, 18 nt, Haemophilus influenzae Rd
agaaaauaaauaaggcac

SEQ ID NO: 2715696 - RNA, 20 nt, Haemophilus influenzae Rd
agaaaauaaccaauauaauu

SEQ ID NO: 2715697 - RNA, 21 nt, Haemophilus influenzae Rd
agaaaauagaagccaaaucau

SEQ ID NO: 2715698 - RNA, 20 nt, Haemophilus influenzae Rd
agaaaauauuuaacuaauuu

SEQ ID NO: 2715699 - RNA, 21 nt, Haemophilus influenzae Rd
agaaaaucagauuauguucau

SEQ ID NO: 2715700 - RNA, 22 nt, Haemophilus influenzae Rd
agaaaaucguaucuuuccaaua

SEQ ID NO: 2715701 - RNA, 18 nt, Haemophilus influenzae Rd
agaaaaucguauucucau

SEQ ID NO: 2715702 - RNA, 17 nt, Haemophilus influenzae Rd
agaaaauuaaaaauuua

SEQ ID NO: 2715703 - RNA, 23 nt, Haemophilus influenzae Rd
agaaaauuaaaaauuuaauacuu

SEQ ID NO: 2715704 - RNA, 12 nt, Haemophilus influenzae Rd
agaaaauuaucu

SEQ ID NO: 2715705 - RNA, 21 nt, Haemophilus influenzae Rd
agaaaauugucgcuaacauau

SEQ ID NO: 2715706 - RNA, 24 nt, Haemophilus influenzae Rd
agaaaauuucugcggcagaauuuc

SEQ ID NO: 2715707 - RNA, 11 nt, Haemophilus influenzae Rd
agaaaauuuga

SEQ ID NO: 2715708 - RNA, 13 nt, Haemophilus influenzae Rd
agaaacaaauccu

SEQ ID NO: 2715709 - RNA, 16 nt, Haemophilus influenzae Rd
agaaacagaaauaaca

SEQ ID NO: 2715710 - RNA, 14 nt, Haemophilus influenzae Rd
agaaacauuuuucc

SEQ ID NO: 2715711 - RNA, 13 nt, Haemophilus influenzae Rd
agaaaccaacaga

SEQ ID NO: 2715712 - RNA, 21 nt, Haemophilus influenzae Rd
agaaaccacuaucggugaaga

SEQ ID NO: 2715713 - RNA, 11 nt, Haemophilus influenzae Rd
agaaacguuuu

SEQ ID NO: 2715714 - RNA, 19 nt, Haemophilus influenzae Rd
agaaacuaauuaguuuuua

SEQ ID NO: 2715715 - RNA, 20 nt, Haemophilus influenzae Rd
agaaacuaauuaguuuuuaa

SEQ ID NO: 2715716 - RNA, 23 nt, Haemophilus influenzae Rd
agaaacugaccgcacuuuugcga

SEQ ID NO: 2715717 - RNA, 17 nt, Haemophilus influenzae Rd
agaaacuuucaaaauac

SEQ ID NO: 2715718 - RNA, 19 nt, Haemophilus influenzae Rd
agaaacuuucaaaauacga

SEQ ID NO: 2715719 - RNA, 11 nt, Haemophilus influenzae Rd
agaaagaaauc

SEQ ID NO: 2715720 - RNA, 13 nt, Haemophilus influenzae Rd
agaaagaauauaa

SEQ ID NO: 2715721 - RNA, 23 nt, Haemophilus influenzae Rd
agaaagaauauaaauaaaacaag

SEQ ID NO: 2715722 - RNA, 19 nt, Haemophilus influenzae Rd
agaaagaccaaaaaucgca

SEQ ID NO: 2715723 - RNA, 20 nt, Haemophilus influenzae Rd
agaaagacgauauuuuccuu

SEQ ID NO: 2715724 - RNA, 20 nt, Haemophilus influenzae Rd
agaaagcaauguaguuggca

SEQ ID NO: 2715725 - RNA, 20 nt, Haemophilus influenzae Rd
agaaagccccaguuuauuca

SEQ ID NO: 2715726 - RNA, 15 nt, Haemophilus influenzae Rd
agaaagccuuuuaaa

SEQ ID NO: 2715727 - RNA, 17 nt, Haemophilus influenzae Rd
agaaagccuuuuaaaau

SEQ ID NO: 2715728 - RNA, 20 nt, Haemophilus influenzae Rd
agaaagccuuuuauuucuua

SEQ ID NO: 2715729 - RNA, 23 nt, Haemophilus influenzae Rd
agaaagcuaaugguuggaagaaa

SEQ ID NO: 2715730 - RNA, 14 nt, Haemophilus influenzae Rd
agaaagggauuuua

SEQ ID NO: 2715731 - RNA, 15 nt, Haemophilus influenzae Rd
agaaagggauuuuaa

SEQ ID NO: 2715732 - RNA, 16 nt, Haemophilus influenzae Rd
agaaagggauuuuaau

SEQ ID NO: 2715733 - RNA, 14 nt, Haemophilus influenzae Rd
agaaagggcaucaa

SEQ ID NO: 2715734 - RNA, 18 nt, Haemophilus influenzae Rd
agaaagguguaauuccau

SEQ ID NO: 2715735 - RNA, 16 nt, Haemophilus influenzae Rd
agaaaguauuaaauau

SEQ ID NO: 2715736 - RNA, 14 nt, Haemophilus influenzae Rd
agaaagucauuaau

SEQ ID NO: 2715737 - RNA, 22 nt, Haemophilus influenzae Rd
agaaaguuaagccugauagcau

SEQ ID NO: 2715738 - RNA, 15 nt, Haemophilus influenzae Rd
agaaaguuaaucaaa

SEQ ID NO: 2715739 - RNA, 20 nt, Haemophilus influenzae Rd
agaaaguucuaauucauuuu

SEQ ID NO: 2715740 - RNA, 22 nt, Haemophilus influenzae Rd
agaaaguuguacuauuuuauaa

SEQ ID NO: 2715741 - RNA, 23 nt, Haemophilus influenzae Rd
agaaaguuucacggauuucggcu

SEQ ID NO: 2715742 - RNA, 16 nt, Haemophilus influenzae Rd
agaaaguuuuauccau

SEQ ID NO: 2715743 - RNA, 23 nt, Haemophilus influenzae Rd
agaaauaaaagauaaacaaaccu

SEQ ID NO: 2715744 - RNA, 23 nt, Haemophilus influenzae Rd
agaaauaacgauaagauuugcuu

SEQ ID NO: 2715745 - RNA, 18 nt, Haemophilus influenzae Rd
agaaauaacgucauuaau

SEQ ID NO: 2715746 - RNA, 16 nt, Haemophilus influenzae Rd
agaaauaauauaaccu

SEQ ID NO: 2715747 - RNA, 20 nt, Haemophilus influenzae Rd
agaaauaccgauaauauguu

SEQ ID NO: 2715748 - RNA, 21 nt, Haemophilus influenzae Rd
agaaauaccgauaauauguuu

SEQ ID NO: 2715749 - RNA, 22 nt, Haemophilus influenzae Rd
agaaauaccgauaauauguuuu

SEQ ID NO: 2715750 - RNA, 17 nt, Haemophilus influenzae Rd
agaaauacgagaaagcu

SEQ ID NO: 2715751 - RNA, 23 nt, Haemophilus influenzae Rd
agaaauacuuuuagcuccuaaau

SEQ ID NO: 2715752 - RNA, 16 nt, Haemophilus influenzae Rd
agaaauauaauaaaua

SEQ ID NO: 2715753 - RNA, 19 nt, Haemophilus influenzae Rd
agaaauauaauaaauaugu

SEQ ID NO: 2715754 - RNA, 19 nt, Haemophilus influenzae Rd
agaaauauauuuguuuuua

SEQ ID NO: 2715755 - RNA, 13 nt, Haemophilus influenzae Rd
agaaauaucuacu

SEQ ID NO: 2715756 - RNA, 20 nt, Haemophilus influenzae Rd
agaaauaugaaauuucuuua

SEQ ID NO: 2715757 - RNA, 17 nt, Haemophilus influenzae Rd
agaaauaugauuuagaa

SEQ ID NO: 2715758 - RNA, 13 nt, Haemophilus influenzae Rd
agaaaucacaaua

SEQ ID NO: 2715759 - RNA, 15 nt, Haemophilus influenzae Rd
agaaaucacaauaaa

SEQ ID NO: 2715760 - RNA, 17 nt, Haemophilus influenzae Rd
agaaaucacaauaaaag

SEQ ID NO: 2715761 - RNA, 18 nt, Haemophilus influenzae Rd
agaaaucacuaaauuuca

SEQ ID NO: 2715762 - RNA, 22 nt, Haemophilus influenzae Rd
agaaaucacuaaauuucagcuu

SEQ ID NO: 2715763 - RNA, 9 nt, Haemophilus influenzae Rd
agaaaucau

SEQ ID NO: 2715764 - RNA, 13 nt, Haemophilus influenzae Rd
agaaaucaucaaa

SEQ ID NO: 2715765 - RNA, 18 nt, Haemophilus influenzae Rd
agaaaucaucucuaaccu

SEQ ID NO: 2715766 - RNA, 13 nt, Haemophilus influenzae Rd
agaaaucauuuca

SEQ ID NO: 2715767 - RNA, 15 nt, Haemophilus influenzae Rd
agaaaucauuucaau

SEQ ID NO: 2715768 - RNA, 22 nt, Haemophilus influenzae Rd
agaaaucauuucaauguuugga

SEQ ID NO: 2715769 - RNA, 14 nt, Haemophilus influenzae Rd
agaaauccacaaaa

SEQ ID NO: 2715770 - RNA, 13 nt, Haemophilus influenzae Rd
agaaaucccaccu

SEQ ID NO: 2715771 - RNA, 16 nt, Haemophilus influenzae Rd
agaaaucccuugacca

SEQ ID NO: 2715772 - RNA, 22 nt, Haemophilus influenzae Rd
agaaaucucuuucaauuucaaa

SEQ ID NO: 2715773 - RNA, 20 nt, Haemophilus influenzae Rd
agaaaugaucaaaucaaauu

SEQ ID NO: 2715774 - RNA, 17 nt, Haemophilus influenzae Rd
agaaaugcgauuuccaa

SEQ ID NO: 2715775 - RNA, 20 nt, Haemophilus influenzae Rd
agaaaugcuuacaggaaagu

SEQ ID NO: 2715776 - RNA, 22 nt, Haemophilus influenzae Rd
agaaauggcgcacccgaaagga

SEQ ID NO: 2715777 - RNA, 23 nt, Haemophilus influenzae Rd
agaaauucacucaauucaaagaa

SEQ ID NO: 2715778 - RNA, 17 nt, Haemophilus influenzae Rd
agaaauugccauauaag

SEQ ID NO: 2715779 - RNA, 20 nt, Haemophilus influenzae Rd
agaaauugccauauaagcaa

SEQ ID NO: 2715780 - RNA, 19 nt, Haemophilus influenzae Rd
agaaauuuuaaccgcacuu

SEQ ID NO: 2715781 - RNA, 13 nt, Haemophilus influenzae Rd
agaaauuuuaauc

SEQ ID NO: 2715782 - RNA, 19 nt, Haemophilus influenzae Rd
agaaauuuuauccaucaaa

SEQ ID NO: 2715783 - RNA, 17 nt, Haemophilus influenzae Rd
agaaauuuuguuuuguu

SEQ ID NO: 2715784 - RNA, 21 nt, Haemophilus influenzae Rd
agaaauuuuuuugcuggaaaa

SEQ ID NO: 2715785 - RNA, 17 nt, Haemophilus influenzae Rd
agaacaaaauaauuaug

SEQ ID NO: 2715786 - RNA, 22 nt, Haemophilus influenzae Rd
agaacaaaugucgaaauuuuuc

SEQ ID NO: 2715787 - RNA, 16 nt, Haemophilus influenzae Rd
agaacaacaauacguu

SEQ ID NO: 2715788 - RNA, 17 nt, Haemophilus influenzae Rd
agaacaagcauuuuuca

SEQ ID NO: 2715789 - RNA, 22 nt, Haemophilus influenzae Rd
agaacaaggggaaaauauuaug

SEQ ID NO: 2715790 - RNA, 13 nt, Haemophilus influenzae Rd
agaacaauauuua

SEQ ID NO: 2715791 - RNA, 22 nt, Haemophilus influenzae Rd
agaacaccgagaugcauuuuuu

SEQ ID NO: 2715792 - RNA, 17 nt, Haemophilus influenzae Rd
agaacagguugcugaua

SEQ ID NO: 2715793 - RNA, 16 nt, Haemophilus influenzae Rd
agaacauugauaagau

SEQ ID NO: 2715794 - RNA, 15 nt, Haemophilus influenzae Rd
agaacauugugacau

SEQ ID NO: 2715795 - RNA, 17 nt, Haemophilus influenzae Rd
agaaccacaaacagggc

SEQ ID NO: 2715796 - RNA, 16 nt, Haemophilus influenzae Rd
agaaccgaaagcccac

SEQ ID NO: 2715797 - RNA, 15 nt, Haemophilus influenzae Rd
agaaccgucuuuaaa

SEQ ID NO: 2715798 - RNA, 16 nt, Haemophilus influenzae Rd
agaaccuaaugcagua

SEQ ID NO: 2715799 - RNA, 16 nt, Haemophilus influenzae Rd
agaaccugucgcaaug

SEQ ID NO: 2715800 - RNA, 18 nt, Haemophilus influenzae Rd
agaaccuuggaaauuaac

SEQ ID NO: 2715801 - RNA, 14 nt, Haemophilus influenzae Rd
agaacggucaaaau

SEQ ID NO: 2715802 - RNA, 15 nt, Haemophilus influenzae Rd
agaacguaauaauuc

SEQ ID NO: 2715803 - RNA, 12 nt, Haemophilus influenzae Rd
agaacguauuau

SEQ ID NO: 2715804 - RNA, 15 nt, Haemophilus influenzae Rd
agaacuggcuuccaa

SEQ ID NO: 2715805 - RNA, 21 nt, Haemophilus influenzae Rd
agaacuuguaguucucccuga

SEQ ID NO: 2715806 - RNA, 23 nt, Haemophilus influenzae Rd
agaagaaccacagccaagguuuu

SEQ ID NO: 2715807 - RNA, 14 nt, Haemophilus influenzae Rd
agaagccaaaucau

SEQ ID NO: 2715808 - RNA, 15 nt, Haemophilus influenzae Rd
agaagcccgaauacu

SEQ ID NO: 2715809 - RNA, 14 nt, Haemophilus influenzae Rd
agaagcguucaaaa

SEQ ID NO: 2715810 - RNA, 15 nt, Haemophilus influenzae Rd
agaagcguucaaaaa

SEQ ID NO: 2715811 - RNA, 18 nt, Haemophilus influenzae Rd
agaagcguucaaaaagaa

SEQ ID NO: 2715812 - RNA, 14 nt, Haemophilus influenzae Rd
agaagcuuuccauc

SEQ ID NO: 2715813 - RNA, 22 nt, Haemophilus influenzae Rd
agaaggaauauucuuuaaauau

SEQ ID NO: 2715814 - RNA, 21 nt, Haemophilus influenzae Rd
agaagggaugauugacgaaaa

SEQ ID NO: 2715815 - RNA, 16 nt, Haemophilus influenzae Rd
agaaguaaaauagcug

SEQ ID NO: 2715816 - RNA, 14 nt, Haemophilus influenzae Rd
agaagugaaauauu

SEQ ID NO: 2715817 - RNA, 14 nt, Haemophilus influenzae Rd
agaagugagaaaua

SEQ ID NO: 2715818 - RNA, 15 nt, Haemophilus influenzae Rd
agaaguugaaaauaa

SEQ ID NO: 2715819 - RNA, 16 nt, Haemophilus influenzae Rd
agaaguuuaagaaaag

SEQ ID NO: 2715820 - RNA, 21 nt, Haemophilus influenzae Rd
agaaguuuuccagauuuuacg

SEQ ID NO: 2715821 - RNA, 14 nt, Haemophilus influenzae Rd
agaaguuuuccauc

SEQ ID NO: 2715822 - RNA, 14 nt, Haemophilus influenzae Rd
agaauaaaauguaa

SEQ ID NO: 2715823 - RNA, 20 nt, Haemophilus influenzae Rd
agaauaaaccaaugagaaaa

SEQ ID NO: 2715824 - RNA, 14 nt, Haemophilus influenzae Rd
agaauaaacuaauu

SEQ ID NO: 2715825 - RNA, 14 nt, Haemophilus influenzae Rd
agaauaaagggaag

SEQ ID NO: 2715826 - RNA, 13 nt, Haemophilus influenzae Rd
agaauaauauuaa

SEQ ID NO: 2715827 - RNA, 13 nt, Haemophilus influenzae Rd
agaauaaucagga

SEQ ID NO: 2715828 - RNA, 20 nt, Haemophilus influenzae Rd
agaauaauuaacaaauaauu

SEQ ID NO: 2715829 - RNA, 16 nt, Haemophilus influenzae Rd
agaauagccgcaauca

SEQ ID NO: 2715830 - RNA, 14 nt, Haemophilus influenzae Rd
agaauauaaauaaa

SEQ ID NO: 2715831 - RNA, 19 nt, Haemophilus influenzae Rd
agaauauaaauaaaacaag

SEQ ID NO: 2715832 - RNA, 16 nt, Haemophilus influenzae Rd
agaauauaacaccaaa

SEQ ID NO: 2715833 - RNA, 13 nt, Haemophilus influenzae Rd
agaauauaaguuc

SEQ ID NO: 2715834 - RNA, 15 nt, Haemophilus influenzae Rd
agaauauuucacacc

SEQ ID NO: 2715835 - RNA, 14 nt, Haemophilus influenzae Rd
agaauauuuccacu

SEQ ID NO: 2715836 - RNA, 23 nt, Haemophilus influenzae Rd
agaauauuuuaaugaaaguaaca

SEQ ID NO: 2715837 - RNA, 15 nt, Haemophilus influenzae Rd
agaaucaaggcugga

SEQ ID NO: 2715838 - RNA, 20 nt, Haemophilus influenzae Rd
agaaucaucuucaucugcau

SEQ ID NO: 2715839 - RNA, 22 nt, Haemophilus influenzae Rd
agaaucaucuucaucugcauca

SEQ ID NO: 2715840 - RNA, 14 nt, Haemophilus influenzae Rd
agaaucauuuucac

SEQ ID NO: 2715841 - RNA, 16 nt, Haemophilus influenzae Rd
agaauccaaaauuacu

SEQ ID NO: 2715842 - RNA, 23 nt, Haemophilus influenzae Rd
agaaucgcccacgaaaagcacuu

SEQ ID NO: 2715843 - RNA, 19 nt, Haemophilus influenzae Rd
agaaucuucuaauuugcca

SEQ ID NO: 2715844 - RNA, 17 nt, Haemophilus influenzae Rd
agaaugauuaucuagaa

SEQ ID NO: 2715845 - RNA, 21 nt, Haemophilus influenzae Rd
agaaugauuaucuagaaaacu

SEQ ID NO: 2715846 - RNA, 13 nt, Haemophilus influenzae Rd
agaaugcaaacau

SEQ ID NO: 2715847 - RNA, 16 nt, Haemophilus influenzae Rd
agaaugcaaacauuug

SEQ ID NO: 2715848 - RNA, 18 nt, Haemophilus influenzae Rd
agaaugcggugaaauuuc

SEQ ID NO: 2715849 - RNA, 21 nt, Haemophilus influenzae Rd
agaaugcggugaaauuucacc

SEQ ID NO: 2715850 - RNA, 15 nt, Haemophilus influenzae Rd
agaaugggcauugac

SEQ ID NO: 2715851 - RNA, 23 nt, Haemophilus influenzae Rd
agaauggugacgagaacuuuuga

SEQ ID NO: 2715852 - RNA, 14 nt, Haemophilus influenzae Rd
agaauguaaauuau

SEQ ID NO: 2715853 - RNA, 15 nt, Haemophilus influenzae Rd
agaauguuuugauug

SEQ ID NO: 2715854 - RNA, 14 nt, Haemophilus influenzae Rd
agaauuaaaaaugg

SEQ ID NO: 2715855 - RNA, 16 nt, Haemophilus influenzae Rd
agaauuaccacaagau

SEQ ID NO: 2715856 - RNA, 18 nt, Haemophilus influenzae Rd
agaauuaccgcacuuuaa

SEQ ID NO: 2715857 - RNA, 16 nt, Haemophilus influenzae Rd
agaauuaguaaagaaa

SEQ ID NO: 2715858 - RNA, 20 nt, Haemophilus influenzae Rd
agaauuaguuuuuuauuucu

SEQ ID NO: 2715859 - RNA, 21 nt, Haemophilus influenzae Rd
agaauuggcgaaccuucacuu

SEQ ID NO: 2715860 - RNA, 15 nt, Haemophilus influenzae Rd
agaauuggggucgcu

SEQ ID NO: 2715861 - RNA, 23 nt, Haemophilus influenzae Rd
agaauuggugcgucuuuuaacau

SEQ ID NO: 2715862 - RNA, 16 nt, Haemophilus influenzae Rd
agaauuucgucaaaaa

SEQ ID NO: 2715863 - RNA, 18 nt, Haemophilus influenzae Rd
agaauuuguuguuugcuu

SEQ ID NO: 2715864 - RNA, 19 nt, Haemophilus influenzae Rd
agaauuuguuguuugcuuu

SEQ ID NO: 2715865 - RNA, 17 nt, Haemophilus influenzae Rd
agaauuuugguuaaacu

SEQ ID NO: 2715866 - RNA, 18 nt, Haemophilus influenzae Rd
agacaaauuuguugcauu

SEQ ID NO: 2715867 - RNA, 20 nt, Haemophilus influenzae Rd
agacaaauuuguugcauuuc

SEQ ID NO: 2715868 - RNA, 17 nt, Haemophilus influenzae Rd
agacaacaacuuuucua

SEQ ID NO: 2715869 - RNA, 18 nt, Haemophilus influenzae Rd
agacaacaacuuuucuaa

SEQ ID NO: 2715870 - RNA, 22 nt, Haemophilus influenzae Rd
agacaacgcuucuuuaacuugc

SEQ ID NO: 2715871 - RNA, 18 nt, Haemophilus influenzae Rd
agacaauauugaaauaag

SEQ ID NO: 2715872 - RNA, 19 nt, Haemophilus influenzae Rd
agacaauauugaaauaaga

SEQ ID NO: 2715873 - RNA, 13 nt, Haemophilus influenzae Rd
agacaauggcuuu

SEQ ID NO: 2715874 - RNA, 18 nt, Haemophilus influenzae Rd
agacagaagaaguaaaaa

SEQ ID NO: 2715875 - RNA, 21 nt, Haemophilus influenzae Rd
agacagacuauuucuguauuu

SEQ ID NO: 2715876 - RNA, 17 nt, Haemophilus influenzae Rd
agacagcuauuaaaaaa

SEQ ID NO: 2715877 - RNA, 22 nt, Haemophilus influenzae Rd
agacauagaaaguuuaacuuuc

SEQ ID NO: 2715878 - RNA, 20 nt, Haemophilus influenzae Rd
agacauauccucaacaucaa

SEQ ID NO: 2715879 - RNA, 14 nt, Haemophilus influenzae Rd
agacauuaaggcuu

SEQ ID NO: 2715880 - RNA, 16 nt, Haemophilus influenzae Rd
agaccgauuucuacca

SEQ ID NO: 2715881 - RNA, 16 nt, Haemophilus influenzae Rd
agaccguuuaacgcag

SEQ ID NO: 2715882 - RNA, 16 nt, Haemophilus influenzae Rd
agacgaagaaacaacc

SEQ ID NO: 2715883 - RNA, 18 nt, Haemophilus influenzae Rd
agacgaaguguuaagcac

SEQ ID NO: 2715884 - RNA, 16 nt, Haemophilus influenzae Rd
agacgauauuuuccuu

SEQ ID NO: 2715885 - RNA, 14 nt, Haemophilus influenzae Rd
agacgccuuuaaaa

SEQ ID NO: 2715886 - RNA, 16 nt, Haemophilus influenzae Rd
agacgcugcccaaaua

SEQ ID NO: 2715887 - RNA, 14 nt, Haemophilus influenzae Rd
agacgggaaacaau

SEQ ID NO: 2715888 - RNA, 15 nt, Haemophilus influenzae Rd
agacggucaaauuca

SEQ ID NO: 2715889 - RNA, 22 nt, Haemophilus influenzae Rd
agacguuugauuguaaaagucc

SEQ ID NO: 2715890 - RNA, 13 nt, Haemophilus influenzae Rd
agacuaauagcca

SEQ ID NO: 2715891 - RNA, 23 nt, Haemophilus influenzae Rd
agacuaauucguuucuugguuua

SEQ ID NO: 2715892 - RNA, 19 nt, Haemophilus influenzae Rd
agacuagcaucaaaauaaa

SEQ ID NO: 2715893 - RNA, 18 nt, Haemophilus influenzae Rd
agacuagugaaauauuua

SEQ ID NO: 2715894 - RNA, 13 nt, Haemophilus influenzae Rd
agacuaugaaauc

SEQ ID NO: 2715895 - RNA, 21 nt, Haemophilus influenzae Rd
agacugaaaaaagugcgauau

SEQ ID NO: 2715896 - RNA, 19 nt, Haemophilus influenzae Rd
agacugaauuuuacaggug

SEQ ID NO: 2715897 - RNA, 15 nt, Haemophilus influenzae Rd
agacuuaaccaaaua

SEQ ID NO: 2715898 - RNA, 18 nt, Haemophilus influenzae Rd
agacuuaaccaaauaggc

SEQ ID NO: 2715899 - RNA, 16 nt, Haemophilus influenzae Rd
agacuuaauuucacau

SEQ ID NO: 2715900 - RNA, 20 nt, Haemophilus influenzae Rd
agacuucaagugauuauuuc

SEQ ID NO: 2715901 - RNA, 14 nt, Haemophilus influenzae Rd
agacuugaacuggc

SEQ ID NO: 2715902 - RNA, 19 nt, Haemophilus influenzae Rd
agacuuucuuguauugcca

SEQ ID NO: 2715903 - RNA, 23 nt, Haemophilus influenzae Rd
agagaaaacggcgugaguugcau

SEQ ID NO: 2715904 - RNA, 16 nt, Haemophilus influenzae Rd
agagaaacauaaaaga

SEQ ID NO: 2715905 - RNA, 19 nt, Haemophilus influenzae Rd
agagaagcugaauaaaaga

SEQ ID NO: 2715906 - RNA, 21 nt, Haemophilus influenzae Rd
agagaauagcuauuuuucaau

SEQ ID NO: 2715907 - RNA, 22 nt, Haemophilus influenzae Rd
agagaauauuuagauuacuuuu

SEQ ID NO: 2715908 - RNA, 16 nt, Haemophilus influenzae Rd
agagaauuuucaucaa

SEQ ID NO: 2715909 - RNA, 17 nt, Haemophilus influenzae Rd
agagaauuuucaucaau

SEQ ID NO: 2715910 - RNA, 13 nt, Haemophilus influenzae Rd
agagacaaacaac

SEQ ID NO: 2715911 - RNA, 15 nt, Haemophilus influenzae Rd
agagaccagcagagg

SEQ ID NO: 2715912 - RNA, 22 nt, Haemophilus influenzae Rd
agagaccagcagaggcugaacu

SEQ ID NO: 2715913 - RNA, 12 nt, Haemophilus influenzae Rd
agagagaaaaau

SEQ ID NO: 2715914 - RNA, 15 nt, Haemophilus influenzae Rd
agagauaauaaauau

SEQ ID NO: 2715915 - RNA, 16 nt, Haemophilus influenzae Rd
agagauaauaaauaua

SEQ ID NO: 2715916 - RNA, 22 nt, Haemophilus influenzae Rd
agagauauaauacguaaauuca

SEQ ID NO: 2715917 - RNA, 22 nt, Haemophilus influenzae Rd
agagaugugcauaucaagagaa

SEQ ID NO: 2715918 - RNA, 15 nt, Haemophilus influenzae Rd
agagauuauuugcau

SEQ ID NO: 2715919 - RNA, 23 nt, Haemophilus influenzae Rd
agagauuauuugcauauaaaaaa

SEQ ID NO: 2715920 - RNA, 21 nt, Haemophilus influenzae Rd
agagauuuagauaauaaaaaa

SEQ ID NO: 2715921 - RNA, 23 nt, Haemophilus influenzae Rd
agagauuuagauaauaaaaaaac

SEQ ID NO: 2715922 - RNA, 19 nt, Haemophilus influenzae Rd
agagcaaauuuaaauaaua

SEQ ID NO: 2715923 - RNA, 16 nt, Haemophilus influenzae Rd
agagcaagcaauauaa

SEQ ID NO: 2715924 - RNA, 18 nt, Haemophilus influenzae Rd
agagcaccaaauuaaaaa

SEQ ID NO: 2715925 - RNA, 19 nt, Haemophilus influenzae Rd
agagcaccaaauuaaaaau

SEQ ID NO: 2715926 - RNA, 17 nt, Haemophilus influenzae Rd
agagcaggggauugaaa

SEQ ID NO: 2715927 - RNA, 22 nt, Haemophilus influenzae Rd
agagccuccacaagcaacaaua

SEQ ID NO: 2715928 - RNA, 20 nt, Haemophilus influenzae Rd
agagcuuacuucuacuucuu

SEQ ID NO: 2715929 - RNA, 22 nt, Haemophilus influenzae Rd
agaggaaguuaauggguuaaaa

SEQ ID NO: 2715930 - RNA, 22 nt, Haemophilus influenzae Rd
agaggcauaacccaccaaauua

SEQ ID NO: 2715931 - RNA, 20 nt, Haemophilus influenzae Rd
agaggcauuauguaauauaa

SEQ ID NO: 2715932 - RNA, 11 nt, Haemophilus influenzae Rd
agaggccucua

SEQ ID NO: 2715933 - RNA, 19 nt, Haemophilus influenzae Rd
agaggcucugaucacaaug

SEQ ID NO: 2715934 - RNA, 13 nt, Haemophilus influenzae Rd
agagguggaacaa

SEQ ID NO: 2715935 - RNA, 20 nt, Haemophilus influenzae Rd
agaguaaauuuaacaauccc

SEQ ID NO: 2715936 - RNA, 19 nt, Haemophilus influenzae Rd
agaguaauagcuucuuuua

SEQ ID NO: 2715937 - RNA, 13 nt, Haemophilus influenzae Rd
agaguaauccaag

SEQ ID NO: 2715938 - RNA, 19 nt, Haemophilus influenzae Rd
agagucauuuacagguugc

SEQ ID NO: 2715939 - RNA, 16 nt, Haemophilus influenzae Rd
agagugaccagucauu

SEQ ID NO: 2715940 - RNA, 20 nt, Haemophilus influenzae Rd
agaguuuccuuauauucaga

SEQ ID NO: 2715941 - RNA, 17 nt, Haemophilus influenzae Rd
agauaaaaauuucagac

SEQ ID NO: 2715942 - RNA, 20 nt, Haemophilus influenzae Rd
agauaaaagugcgguuaaaa

SEQ ID NO: 2715943 - RNA, 21 nt, Haemophilus influenzae Rd
agauaaaagugcgguuaaaaa

SEQ ID NO: 2715944 - RNA, 20 nt, Haemophilus influenzae Rd
agauaaaauaaaacccaguu

SEQ ID NO: 2715945 - RNA, 15 nt, Haemophilus influenzae Rd
agauaaaauauucaa

SEQ ID NO: 2715946 - RNA, 17 nt, Haemophilus influenzae Rd
agauaaaauauucaaac

SEQ ID NO: 2715947 - RNA, 12 nt, Haemophilus influenzae Rd
agauaaacgcau

SEQ ID NO: 2715948 - RNA, 12 nt, Haemophilus influenzae Rd
agauaaauaaag

SEQ ID NO: 2715949 - RNA, 15 nt, Haemophilus influenzae Rd
agauaaauaaauuca

SEQ ID NO: 2715950 - RNA, 14 nt, Haemophilus influenzae Rd
agauaaauaucaaa

SEQ ID NO: 2715951 - RNA, 14 nt, Haemophilus influenzae Rd
agauaaauuauauu

SEQ ID NO: 2715952 - RNA, 14 nt, Haemophilus influenzae Rd
agauaaauuuaaag

SEQ ID NO: 2715953 - RNA, 16 nt, Haemophilus influenzae Rd
agauaaauuucaauua

SEQ ID NO: 2715954 - RNA, 19 nt, Haemophilus influenzae Rd
agauaacaaugaaaucgca

SEQ ID NO: 2715955 - RNA, 16 nt, Haemophilus influenzae Rd
agauaacuucuucauu

SEQ ID NO: 2715956 - RNA, 12 nt, Haemophilus influenzae Rd
agauaagaaaau

SEQ ID NO: 2715957 - RNA, 21 nt, Haemophilus influenzae Rd
agauaagagcuuacuucuacu

SEQ ID NO: 2715958 - RNA, 17 nt, Haemophilus influenzae Rd
agauaagcauuuuauca

SEQ ID NO: 2715959 - RNA, 23 nt, Haemophilus influenzae Rd
agauaagccauuaacauuuaaca

SEQ ID NO: 2715960 - RNA, 18 nt, Haemophilus influenzae Rd
agauaaguggggaaaaau

SEQ ID NO: 2715961 - RNA, 20 nt, Haemophilus influenzae Rd
agauaaguggggaaaaauau

SEQ ID NO: 2715962 - RNA, 14 nt, Haemophilus influenzae Rd
agauaauaaaaaaa

SEQ ID NO: 2715963 - RNA, 15 nt, Haemophilus influenzae Rd
agauaauaaaaaaac

SEQ ID NO: 2715964 - RNA, 12 nt, Haemophilus influenzae Rd
agauaauaaaau

SEQ ID NO: 2715965 - RNA, 14 nt, Haemophilus influenzae Rd
agauaauaaaaugg

SEQ ID NO: 2715966 - RNA, 12 nt, Haemophilus influenzae Rd
agauaauaaaua

SEQ ID NO: 2715967 - RNA, 17 nt, Haemophilus influenzae Rd
agauaauaaauauaauu

SEQ ID NO: 2715968 - RNA, 17 nt, Haemophilus influenzae Rd
agauaauauuccaaaaa

SEQ ID NO: 2715969 - RNA, 20 nt, Haemophilus influenzae Rd
agauaaucagugauuauauu

SEQ ID NO: 2715970 - RNA, 20 nt, Haemophilus influenzae Rd
agauaaucgcaaagaauuug

SEQ ID NO: 2715971 - RNA, 19 nt, Haemophilus influenzae Rd
agauaaucuacaaaacaua

SEQ ID NO: 2715972 - RNA, 20 nt, Haemophilus influenzae Rd
agauaaucuacaaaacauaa

SEQ ID NO: 2715973 - RNA, 23 nt, Haemophilus influenzae Rd
agauaaucuacaaaacauaauaa

SEQ ID NO: 2715974 - RNA, 20 nt, Haemophilus influenzae Rd
agauaaugauagaugaauua

SEQ ID NO: 2715975 - RNA, 16 nt, Haemophilus influenzae Rd
agauaaugaugaaugc

SEQ ID NO: 2715976 - RNA, 20 nt, Haemophilus influenzae Rd
agauaaugguuacagaaaua

SEQ ID NO: 2715977 - RNA, 20 nt, Haemophilus influenzae Rd
agauaauuaaaaucccuuuc

SEQ ID NO: 2715978 - RNA, 22 nt, Haemophilus influenzae Rd
agauaauuacgccuaaccaagc

SEQ ID NO: 2715979 - RNA, 13 nt, Haemophilus influenzae Rd
agauaauuuuucu

SEQ ID NO: 2715980 - RNA, 18 nt, Haemophilus influenzae Rd
agauacaaauaacacaga

SEQ ID NO: 2715981 - RNA, 20 nt, Haemophilus influenzae Rd
agauacacucacuuuuccuu

SEQ ID NO: 2715982 - RNA, 19 nt, Haemophilus influenzae Rd
agauacauuuguuuaagga

SEQ ID NO: 2715983 - RNA, 23 nt, Haemophilus influenzae Rd
agauacccauuucgaucauaucg

SEQ ID NO: 2715984 - RNA, 15 nt, Haemophilus influenzae Rd
agauacgaaauagcg

SEQ ID NO: 2715985 - RNA, 17 nt, Haemophilus influenzae Rd
agauacgaaauagcguu

SEQ ID NO: 2715986 - RNA, 16 nt, Haemophilus influenzae Rd
agauacuacacccaaa

SEQ ID NO: 2715987 - RNA, 21 nt, Haemophilus influenzae Rd
agauacuauauuuucuucugc

SEQ ID NO: 2715988 - RNA, 15 nt, Haemophilus influenzae Rd
agauagcaaaauaug

SEQ ID NO: 2715989 - RNA, 16 nt, Haemophilus influenzae Rd
agauauaaacugauuu

SEQ ID NO: 2715990 - RNA, 14 nt, Haemophilus influenzae Rd
agauauaagaaaua

SEQ ID NO: 2715991 - RNA, 20 nt, Haemophilus influenzae Rd
agauauaaggcacagggcug

SEQ ID NO: 2715992 - RNA, 19 nt, Haemophilus influenzae Rd
agauauauugguuugcuua

SEQ ID NO: 2715993 - RNA, 20 nt, Haemophilus influenzae Rd
agauaugaaauaaagaaagg

SEQ ID NO: 2715994 - RNA, 20 nt, Haemophilus influenzae Rd
agauaugugaauaaaaucaa

SEQ ID NO: 2715995 - RNA, 19 nt, Haemophilus influenzae Rd
agauauuucucacuucuuu

SEQ ID NO: 2715996 - RNA, 17 nt, Haemophilus influenzae Rd
agaucaagcacuuuucc

SEQ ID NO: 2715997 - RNA, 18 nt, Haemophilus influenzae Rd
agaucaagcacuuuuccu

SEQ ID NO: 2715998 - RNA, 19 nt, Haemophilus influenzae Rd
agaucaagcacuuuuccuu

SEQ ID NO: 2715999 - RNA, 19 nt, Haemophilus influenzae Rd
agaucaauggguuuaaaaa

SEQ ID NO: 2716000 - RNA, 20 nt, Haemophilus influenzae Rd
agaucacaguugugaaaaaa

SEQ ID NO: 2716001 - RNA, 15 nt, Haemophilus influenzae Rd
agaucagauuuuuuu

SEQ ID NO: 2716002 - RNA, 22 nt, Haemophilus influenzae Rd
agaucagauuuuuuucagaaau

SEQ ID NO: 2716003 - RNA, 16 nt, Haemophilus influenzae Rd
agaucaggaucaaaaa

SEQ ID NO: 2716004 - RNA, 14 nt, Haemophilus influenzae Rd
agaucaguuaccau

SEQ ID NO: 2716005 - RNA, 22 nt, Haemophilus influenzae Rd
agaucauuuuuuuaaauauuuu

SEQ ID NO: 2716006 - RNA, 24 nt, Haemophilus influenzae Rd
agauccauugauauauucuucuuc

SEQ ID NO: 2716007 - RNA, 22 nt, Haemophilus influenzae Rd
agaucccgcuccaccuugaauu

SEQ ID NO: 2716008 - RNA, 18 nt, Haemophilus influenzae Rd
agauccuuucacaaaaua

SEQ ID NO: 2716009 - RNA, 15 nt, Haemophilus influenzae Rd
agaucgaaauuaggu

SEQ ID NO: 2716010 - RNA, 14 nt, Haemophilus influenzae Rd
agaucgauuuuccu

SEQ ID NO: 2716011 - RNA, 23 nt, Haemophilus influenzae Rd
agaucuucgaugugcauuuuuca

SEQ ID NO: 2716012 - RNA, 13 nt, Haemophilus influenzae Rd
agaucuucuuugc

SEQ ID NO: 2716013 - RNA, 12 nt, Haemophilus influenzae Rd
agaucuuugcca

SEQ ID NO: 2716014 - RNA, 17 nt, Haemophilus influenzae Rd
agaugaaaugccgauaa

SEQ ID NO: 2716015 - RNA, 22 nt, Haemophilus influenzae Rd
agaugaacucaauuccuucauc

SEQ ID NO: 2716016 - RNA, 18 nt, Haemophilus influenzae Rd
agaugacgaaaugaaauu

SEQ ID NO: 2716017 - RNA, 23 nt, Haemophilus influenzae Rd
agaugacuuguuucauaaaaaau

SEQ ID NO: 2716018 - RNA, 12 nt, Haemophilus influenzae Rd
agaugauaaauu

SEQ ID NO: 2716019 - RNA, 22 nt, Haemophilus influenzae Rd
agaugaucaaggguacaacaaa

SEQ ID NO: 2716020 - RNA, 12 nt, Haemophilus influenzae Rd
agaugcauuuuu

SEQ ID NO: 2716021 - RNA, 17 nt, Haemophilus influenzae Rd
agauggcuauuuaagcc

SEQ ID NO: 2716022 - RNA, 19 nt, Haemophilus influenzae Rd
agauggcuauuuaagccuu

SEQ ID NO: 2716023 - RNA, 22 nt, Haemophilus influenzae Rd
agauuaauuuuuuauaaaauuu

SEQ ID NO: 2716024 - RNA, 23 nt, Haemophilus influenzae Rd
agauuaauuuuuuauaaaauuuc

SEQ ID NO: 2716025 - RNA, 16 nt, Haemophilus influenzae Rd
agauuacgcuuuacua

SEQ ID NO: 2716026 - RNA, 19 nt, Haemophilus influenzae Rd
agauuacuuuuagauaaau

SEQ ID NO: 2716027 - RNA, 22 nt, Haemophilus influenzae Rd
agauuagaucgauuuuccucuu

SEQ ID NO: 2716028 - RNA, 19 nt, Haemophilus influenzae Rd
agauuaucgccuaaaauug

SEQ ID NO: 2716029 - RNA, 18 nt, Haemophilus influenzae Rd
agauuauguucauuuucu

SEQ ID NO: 2716030 - RNA, 17 nt, Haemophilus influenzae Rd
agauuauugcacuaaua

SEQ ID NO: 2716031 - RNA, 23 nt, Haemophilus influenzae Rd
agauuauugcccgugaguaaaau

SEQ ID NO: 2716032 - RNA, 12 nt, Haemophilus influenzae Rd
agauuauuucua

SEQ ID NO: 2716033 - RNA, 14 nt, Haemophilus influenzae Rd
agauuauuucuccu

SEQ ID NO: 2716034 - RNA, 19 nt, Haemophilus influenzae Rd
agauuauuugcauauaaaa

SEQ ID NO: 2716035 - RNA, 13 nt, Haemophilus influenzae Rd
agauuauuuuuag

SEQ ID NO: 2716036 - RNA, 19 nt, Haemophilus influenzae Rd
agauucaacaauaauuuuu

SEQ ID NO: 2716037 - RNA, 20 nt, Haemophilus influenzae Rd
agauucaacaauaauuuuua

SEQ ID NO: 2716038 - RNA, 16 nt, Haemophilus influenzae Rd
agauucaucaaaguaa

SEQ ID NO: 2716039 - RNA, 21 nt, Haemophilus influenzae Rd
agauucauuguuucucaauaa

SEQ ID NO: 2716040 - RNA, 18 nt, Haemophilus influenzae Rd
agauucuaauuccccuuc

SEQ ID NO: 2716041 - RNA, 20 nt, Haemophilus influenzae Rd
agauucuaauuccccuucaa

SEQ ID NO: 2716042 - RNA, 14 nt, Haemophilus influenzae Rd
agauucuugcguuu

SEQ ID NO: 2716043 - RNA, 14 nt, Haemophilus influenzae Rd
agauugaacguuua

SEQ ID NO: 2716044 - RNA, 18 nt, Haemophilus influenzae Rd
agauugaacguuuaacuu

SEQ ID NO: 2716045 - RNA, 19 nt, Haemophilus influenzae Rd
agauugaacguuuaacuuc

SEQ ID NO: 2716046 - RNA, 17 nt, Haemophilus influenzae Rd
agauugaauguuuuuca

SEQ ID NO: 2716047 - RNA, 14 nt, Haemophilus influenzae Rd
agauugauuuaguu

SEQ ID NO: 2716048 - RNA, 14 nt, Haemophilus influenzae Rd
agauugauuuucuu

SEQ ID NO: 2716049 - RNA, 21 nt, Haemophilus influenzae Rd
agauugcggcagaauuuuggu

SEQ ID NO: 2716050 - RNA, 23 nt, Haemophilus influenzae Rd
agauugcuccuacuuuuacaaac

SEQ ID NO: 2716051 - RNA, 17 nt, Haemophilus influenzae Rd
agauuguaugaaaaaug

SEQ ID NO: 2716052 - RNA, 14 nt, Haemophilus influenzae Rd
agauugugaaauuu

SEQ ID NO: 2716053 - RNA, 23 nt, Haemophilus influenzae Rd
agauuguuuuuucauauuuuaaa

SEQ ID NO: 2716054 - RNA, 15 nt, Haemophilus influenzae Rd
agauuuaagcaauaa

SEQ ID NO: 2716055 - RNA, 21 nt, Haemophilus influenzae Rd
agauuuaagcaauaaacaaag

SEQ ID NO: 2716056 - RNA, 17 nt, Haemophilus influenzae Rd
agauuuaauaccauaca

SEQ ID NO: 2716057 - RNA, 14 nt, Haemophilus influenzae Rd
agauuuacagaaca

SEQ ID NO: 2716058 - RNA, 16 nt, Haemophilus influenzae Rd
agauuuacagaacaaa

SEQ ID NO: 2716059 - RNA, 17 nt, Haemophilus influenzae Rd
agauuuacagaacaaaa

SEQ ID NO: 2716060 - RNA, 20 nt, Haemophilus influenzae Rd
agauuuacccaaauuaucaa

SEQ ID NO: 2716061 - RNA, 16 nt, Haemophilus influenzae Rd
agauuuacccaacaaa

SEQ ID NO: 2716062 - RNA, 16 nt, Haemophilus influenzae Rd
agauuuagauaauaaa

SEQ ID NO: 2716063 - RNA, 19 nt, Haemophilus influenzae Rd
agauuuagauaauaaaaaa

SEQ ID NO: 2716064 - RNA, 18 nt, Haemophilus influenzae Rd
agauuuauuuacugauuu

SEQ ID NO: 2716065 - RNA, 15 nt, Haemophilus influenzae Rd
agauuuauuucugaa

SEQ ID NO: 2716066 - RNA, 19 nt, Haemophilus influenzae Rd
agauuuccuccccacacuu

SEQ ID NO: 2716067 - RNA, 15 nt, Haemophilus influenzae Rd
agauuucuaauaaca

SEQ ID NO: 2716068 - RNA, 12 nt, Haemophilus influenzae Rd
agauuucuuuga

SEQ ID NO: 2716069 - RNA, 16 nt, Haemophilus influenzae Rd
agauuugccaaaauca

SEQ ID NO: 2716070 - RNA, 13 nt, Haemophilus influenzae Rd
agauuugcugcug

SEQ ID NO: 2716071 - RNA, 18 nt, Haemophilus influenzae Rd
agauuuuaguauuuuuga

SEQ ID NO: 2716072 - RNA, 16 nt, Haemophilus influenzae Rd
agauuuuauucauaaa

SEQ ID NO: 2716073 - RNA, 13 nt, Haemophilus influenzae Rd
agauuuucaucgu

SEQ ID NO: 2716074 - RNA, 18 nt, Haemophilus influenzae Rd
agauuuugccuaaucgua

SEQ ID NO: 2716075 - RNA, 18 nt, Haemophilus influenzae Rd
agauuuuuaccaauagau

SEQ ID NO: 2716076 - RNA, 14 nt, Haemophilus influenzae Rd
agauuuuuauucaa

SEQ ID NO: 2716077 - RNA, 12 nt, Haemophilus influenzae Rd
agauuuuugcca

SEQ ID NO: 2716078 - RNA, 14 nt, Haemophilus influenzae Rd
agauuuuuugaccg

SEQ ID NO: 2716079 - RNA, 14 nt, Haemophilus influenzae Rd
agauuuuuuuauga

SEQ ID NO: 2716080 - RNA, 20 nt, Haemophilus influenzae Rd
agauuuuuuucaaugaaaua

SEQ ID NO: 2716081 - RNA, 18 nt, Haemophilus influenzae Rd
agauuuuuuucagaaaug

SEQ ID NO: 2716082 - RNA, 21 nt, Haemophilus influenzae Rd
agauuuuuuucagaaaugacc

SEQ ID NO: 2716083 - RNA, 17 nt, Haemophilus influenzae Rd
agauuuuuuuuauaucu

SEQ ID NO: 2716084 - RNA, 19 nt, Haemophilus influenzae Rd
agauuuuuuuuauaucuuc

SEQ ID NO: 2716085 - RNA, 20 nt, Haemophilus influenzae Rd
agcaaaaagucaaaauaagu

SEQ ID NO: 2716086 - RNA, 18 nt, Haemophilus influenzae Rd
agcaaaacaagacaaaau

SEQ ID NO: 2716087 - RNA, 22 nt, Haemophilus influenzae Rd
agcaaaacaagacaaaauaagg

SEQ ID NO: 2716088 - RNA, 23 nt, Haemophilus influenzae Rd
agcaaaacuuuuuccuucugcca

SEQ ID NO: 2716089 - RNA, 12 nt, Haemophilus influenzae Rd
agcaaaagaaau

SEQ ID NO: 2716090 - RNA, 15 nt, Haemophilus influenzae Rd
agcaaaagcaauaau

SEQ ID NO: 2716091 - RNA, 18 nt, Haemophilus influenzae Rd
agcaaaauaugcuugagc

SEQ ID NO: 2716092 - RNA, 12 nt, Haemophilus influenzae Rd
agcaaaaucacu

SEQ ID NO: 2716093 - RNA, 13 nt, Haemophilus influenzae Rd
agcaaaaucacuc

SEQ ID NO: 2716094 - RNA, 18 nt, Haemophilus influenzae Rd
agcaaacaaguuucuaaa

SEQ ID NO: 2716095 - RNA, 22 nt, Haemophilus influenzae Rd
agcaaacaaguuucuaaaauca

SEQ ID NO: 2716096 - RNA, 14 nt, Haemophilus influenzae Rd
agcaaacagcaaua

SEQ ID NO: 2716097 - RNA, 15 nt, Haemophilus influenzae Rd
agcaaacagcaauaa

SEQ ID NO: 2716098 - RNA, 18 nt, Haemophilus influenzae Rd
agcaaacagcaauaaaua

SEQ ID NO: 2716099 - RNA, 18 nt, Haemophilus influenzae Rd
agcaaacuagguaauaau

SEQ ID NO: 2716100 - RNA, 18 nt, Haemophilus influenzae Rd
agcaaacuuaaauacauu

SEQ ID NO: 2716101 - RNA, 16 nt, Haemophilus influenzae Rd
agcaaagaaauuuuaa

SEQ ID NO: 2716102 - RNA, 15 nt, Haemophilus influenzae Rd
agcaaagaauuaaaa

SEQ ID NO: 2716103 - RNA, 21 nt, Haemophilus influenzae Rd
agcaaauauuuagccccuuuu

SEQ ID NO: 2716104 - RNA, 15 nt, Haemophilus influenzae Rd
agcaaaucaaaaccu

SEQ ID NO: 2716105 - RNA, 15 nt, Haemophilus influenzae Rd
agcaaauccuugaau

SEQ ID NO: 2716106 - RNA, 16 nt, Haemophilus influenzae Rd
agcaaaugaggaaaau

SEQ ID NO: 2716107 - RNA, 20 nt, Haemophilus influenzae Rd
agcaaaugaggaaaauaaag

SEQ ID NO: 2716108 - RNA, 21 nt, Haemophilus influenzae Rd
agcaaauggacuaaauuuagu

SEQ ID NO: 2716109 - RNA, 18 nt, Haemophilus influenzae Rd
agcaaauuguuugaaauc

SEQ ID NO: 2716110 - RNA, 23 nt, Haemophilus influenzae Rd
agcaaauuguuugaaaucaaauu

SEQ ID NO: 2716111 - RNA, 16 nt, Haemophilus influenzae Rd
agcaaauuuaaauaau

SEQ ID NO: 2716112 - RNA, 22 nt, Haemophilus influenzae Rd
agcaaauuucuguugaaaucaa

SEQ ID NO: 2716113 - RNA, 20 nt, Haemophilus influenzae Rd
agcaacaucauaagguacaa

SEQ ID NO: 2716114 - RNA, 12 nt, Haemophilus influenzae Rd
agcaaccacuaa

SEQ ID NO: 2716115 - RNA, 14 nt, Haemophilus influenzae Rd
agcaaccacuaaaa

SEQ ID NO: 2716116 - RNA, 22 nt, Haemophilus influenzae Rd
agcaaccuaaacccgcaauuaa

SEQ ID NO: 2716117 - RNA, 22 nt, Haemophilus influenzae Rd
agcaacgguguggaaagaucca

SEQ ID NO: 2716118 - RNA, 22 nt, Haemophilus influenzae Rd
agcaacuugagcguaacccaaa

SEQ ID NO: 2716119 - RNA, 22 nt, Haemophilus influenzae Rd
agcaacuuuacgugcaauagau

SEQ ID NO: 2716120 - RNA, 22 nt, Haemophilus influenzae Rd
agcaagaaagcguucaucaauu

SEQ ID NO: 2716121 - RNA, 15 nt, Haemophilus influenzae Rd
agcaagaacagccag

SEQ ID NO: 2716122 - RNA, 19 nt, Haemophilus influenzae Rd
agcaagaccccaagcaaau

SEQ ID NO: 2716123 - RNA, 22 nt, Haemophilus influenzae Rd
agcaagaccccaagcaaaugga

SEQ ID NO: 2716124 - RNA, 22 nt, Haemophilus influenzae Rd
agcaagaucaauauaaccuugu

SEQ ID NO: 2716125 - RNA, 18 nt, Haemophilus influenzae Rd
agcaagaugaauuaagac

SEQ ID NO: 2716126 - RNA, 17 nt, Haemophilus influenzae Rd
agcaaggcguucaauau

SEQ ID NO: 2716127 - RNA, 21 nt, Haemophilus influenzae Rd
agcaaggcuugugcgguucau

SEQ ID NO: 2716128 - RNA, 14 nt, Haemophilus influenzae Rd
agcaaguaauuuaa

SEQ ID NO: 2716129 - RNA, 22 nt, Haemophilus influenzae Rd
agcaaguacaacugagcccaca

SEQ ID NO: 2716130 - RNA, 20 nt, Haemophilus influenzae Rd
agcaaguuugcgaucaucac

SEQ ID NO: 2716131 - RNA, 15 nt, Haemophilus influenzae Rd
agcaauaaacaaaga

SEQ ID NO: 2716132 - RNA, 22 nt, Haemophilus influenzae Rd
agcaauaaacagaaauauuguc

SEQ ID NO: 2716133 - RNA, 15 nt, Haemophilus influenzae Rd
agcaauaaauaauag

SEQ ID NO: 2716134 - RNA, 17 nt, Haemophilus influenzae Rd
agcaauaaccaauaacg

SEQ ID NO: 2716135 - RNA, 13 nt, Haemophilus influenzae Rd
agcaauaauauca

SEQ ID NO: 2716136 - RNA, 21 nt, Haemophilus influenzae Rd
agcaauaaugauguaccaaaa

SEQ ID NO: 2716137 - RNA, 20 nt, Haemophilus influenzae Rd
agcaauaauggcgguaaaaa

SEQ ID NO: 2716138 - RNA, 23 nt, Haemophilus influenzae Rd
agcaauacccgcuucaaucgcaa

SEQ ID NO: 2716139 - RNA, 15 nt, Haemophilus influenzae Rd
agcaauauaaucauu

SEQ ID NO: 2716140 - RNA, 11 nt, Haemophilus influenzae Rd
agcaauauggg

SEQ ID NO: 2716141 - RNA, 15 nt, Haemophilus influenzae Rd
agcaaucaaaaauga

SEQ ID NO: 2716142 - RNA, 14 nt, Haemophilus influenzae Rd
agcaaucaacacac

SEQ ID NO: 2716143 - RNA, 14 nt, Haemophilus influenzae Rd
agcaaucgcauugc

SEQ ID NO: 2716144 - RNA, 22 nt, Haemophilus influenzae Rd
agcaaucuugcccaucuugcca

SEQ ID NO: 2716145 - RNA, 21 nt, Haemophilus influenzae Rd
agcaaucuuuuucuuucaguu

SEQ ID NO: 2716146 - RNA, 18 nt, Haemophilus influenzae Rd
agcaaugccaaucuaaac

SEQ ID NO: 2716147 - RNA, 23 nt, Haemophilus influenzae Rd
agcaaugcuuuaaucauuuucac

SEQ ID NO: 2716148 - RNA, 22 nt, Haemophilus influenzae Rd
agcaauguaguuggcauaucaa

SEQ ID NO: 2716149 - RNA, 20 nt, Haemophilus influenzae Rd
agcaauuaauucguccauuc

SEQ ID NO: 2716150 - RNA, 20 nt, Haemophilus influenzae Rd
agcaauugccgacacuaaaa

SEQ ID NO: 2716151 - RNA, 15 nt, Haemophilus influenzae Rd
agcaauugcuaaaaa

SEQ ID NO: 2716152 - RNA, 14 nt, Haemophilus influenzae Rd
agcaauuucacgau

SEQ ID NO: 2716153 - RNA, 16 nt, Haemophilus influenzae Rd
agcaauuucaucacau

SEQ ID NO: 2716154 - RNA, 14 nt, Haemophilus influenzae Rd
agcaauuucucugg

SEQ ID NO: 2716155 - RNA, 17 nt, Haemophilus influenzae Rd
agcaauuugaauuaaua

SEQ ID NO: 2716156 - RNA, 16 nt, Haemophilus influenzae Rd
agcaauuuucugcaga

SEQ ID NO: 2716157 - RNA, 15 nt, Haemophilus influenzae Rd
agcacaaagaaaaac

SEQ ID NO: 2716158 - RNA, 18 nt, Haemophilus influenzae Rd
agcacaagauuugccaaa

SEQ ID NO: 2716159 - RNA, 21 nt, Haemophilus influenzae Rd
agcacaagauuugccaaaauc

SEQ ID NO: 2716160 - RNA, 20 nt, Haemophilus influenzae Rd
agcacaaucgcaucgucuuu

SEQ ID NO: 2716161 - RNA, 14 nt, Haemophilus influenzae Rd
agcacacaagguug

SEQ ID NO: 2716162 - RNA, 19 nt, Haemophilus influenzae Rd
agcacacaagguuguaagc

SEQ ID NO: 2716163 - RNA, 17 nt, Haemophilus influenzae Rd
agcacacuaauaagaau

SEQ ID NO: 2716164 - RNA, 21 nt, Haemophilus influenzae Rd
agcaccaaaauuuguuaagug

SEQ ID NO: 2716165 - RNA, 21 nt, Haemophilus influenzae Rd
agcaccaaauaucgcaaucaa

SEQ ID NO: 2716166 - RNA, 21 nt, Haemophilus influenzae Rd
agcaccacguucauaaacucu

SEQ ID NO: 2716167 - RNA, 16 nt, Haemophilus influenzae Rd
agcaccagucaagguu

SEQ ID NO: 2716168 - RNA, 16 nt, Haemophilus influenzae Rd
agcacccauuugccaa

SEQ ID NO: 2716169 - RNA, 16 nt, Haemophilus influenzae Rd
agcaccuaaaaauuuu

SEQ ID NO: 2716170 - RNA, 23 nt, Haemophilus influenzae Rd
agcaccuaaaucggcuuuaucau

SEQ ID NO: 2716171 - RNA, 19 nt, Haemophilus influenzae Rd
agcacgaccuugccaaggu

SEQ ID NO: 2716172 - RNA, 20 nt, Haemophilus influenzae Rd
agcacgaucuaauugcggaa

SEQ ID NO: 2716173 - RNA, 22 nt, Haemophilus influenzae Rd
agcacgauuuucaauacaucag

SEQ ID NO: 2716174 - RNA, 16 nt, Haemophilus influenzae Rd
agcacgccuaauacca

SEQ ID NO: 2716175 - RNA, 15 nt, Haemophilus influenzae Rd
agcacgcgaacuuua

SEQ ID NO: 2716176 - RNA, 13 nt, Haemophilus influenzae Rd
agcacugaaauuc

SEQ ID NO: 2716177 - RNA, 14 nt, Haemophilus influenzae Rd
agcacuuaauacga

SEQ ID NO: 2716178 - RNA, 23 nt, Haemophilus influenzae Rd
agcagaaaauaacgcaucaccac

SEQ ID NO: 2716179 - RNA, 14 nt, Haemophilus influenzae Rd
agcagaagaaucuu

SEQ ID NO: 2716180 - RNA, 20 nt, Haemophilus influenzae Rd
agcagauuauugcacuaaua

SEQ ID NO: 2716181 - RNA, 13 nt, Haemophilus influenzae Rd
agcagcuaaaagu

SEQ ID NO: 2716182 - RNA, 13 nt, Haemophilus influenzae Rd
agcaggaagaaca

SEQ ID NO: 2716183 - RNA, 15 nt, Haemophilus influenzae Rd
agcagggauuuucau

SEQ ID NO: 2716184 - RNA, 23 nt, Haemophilus influenzae Rd
agcagguuuuccuacagugacua

SEQ ID NO: 2716185 - RNA, 15 nt, Haemophilus influenzae Rd
agcagugccaaccac

SEQ ID NO: 2716186 - RNA, 20 nt, Haemophilus influenzae Rd
agcagugccaaccacccaaa

SEQ ID NO: 2716187 - RNA, 22 nt, Haemophilus influenzae Rd
agcaguggcuugcgccauuucc

SEQ ID NO: 2716188 - RNA, 23 nt, Haemophilus influenzae Rd
agcaguggcuugcgccauuuccc

SEQ ID NO: 2716189 - RNA, 17 nt, Haemophilus influenzae Rd
agcaguuaaacagcuuu

SEQ ID NO: 2716190 - RNA, 17 nt, Haemophilus influenzae Rd
agcaguugcuaaaucac

SEQ ID NO: 2716191 - RNA, 21 nt, Haemophilus influenzae Rd
agcaguuuggcaagucuuaau

SEQ ID NO: 2716192 - RNA, 20 nt, Haemophilus influenzae Rd
agcauaaaagugcgguaaaa

SEQ ID NO: 2716193 - RNA, 14 nt, Haemophilus influenzae Rd
agcauaaacaaaau

SEQ ID NO: 2716194 - RNA, 21 nt, Haemophilus influenzae Rd
agcauaaacaaaauaaacuca

SEQ ID NO: 2716195 - RNA, 16 nt, Haemophilus influenzae Rd
agcauaaacuaaaaua

SEQ ID NO: 2716196 - RNA, 20 nt, Haemophilus influenzae Rd
agcauaaacuaaaauaucug

SEQ ID NO: 2716197 - RNA, 14 nt, Haemophilus influenzae Rd
agcauaaagagaau

SEQ ID NO: 2716198 - RNA, 15 nt, Haemophilus influenzae Rd
agcauaaagagaaua

SEQ ID NO: 2716199 - RNA, 19 nt, Haemophilus influenzae Rd
agcauaacguauuuucuca

SEQ ID NO: 2716200 - RNA, 13 nt, Haemophilus influenzae Rd
agcauaaggacca

SEQ ID NO: 2716201 - RNA, 18 nt, Haemophilus influenzae Rd
agcauaaggaccaagcaa

SEQ ID NO: 2716202 - RNA, 15 nt, Haemophilus influenzae Rd
agcauaauaaaaaaa

SEQ ID NO: 2716203 - RNA, 19 nt, Haemophilus influenzae Rd
agcauaccuagcauacgug

SEQ ID NO: 2716204 - RNA, 13 nt, Haemophilus influenzae Rd
agcauauuuucca

SEQ ID NO: 2716205 - RNA, 18 nt, Haemophilus influenzae Rd
agcaucaaaauaaauaaa

SEQ ID NO: 2716206 - RNA, 16 nt, Haemophilus influenzae Rd
agcaucaacauaaaua

SEQ ID NO: 2716207 - RNA, 14 nt, Haemophilus influenzae Rd
agcaucggauacuu

SEQ ID NO: 2716208 - RNA, 19 nt, Haemophilus influenzae Rd
agcaucggauacuuugaac

SEQ ID NO: 2716209 - RNA, 16 nt, Haemophilus influenzae Rd
agcaucggcuaaauaa

SEQ ID NO: 2716210 - RNA, 17 nt, Haemophilus influenzae Rd
agcaucuagcuuaacaa

SEQ ID NO: 2716211 - RNA, 14 nt, Haemophilus influenzae Rd
agcaucugauuuuc

SEQ ID NO: 2716212 - RNA, 12 nt, Haemophilus influenzae Rd
agcaucugccac

SEQ ID NO: 2716213 - RNA, 17 nt, Haemophilus influenzae Rd
agcaucugccacuucuu

SEQ ID NO: 2716214 - RNA, 16 nt, Haemophilus influenzae Rd
agcaugaauaaaaaug

SEQ ID NO: 2716215 - RNA, 19 nt, Haemophilus influenzae Rd
agcaugagcuucaaaauca

SEQ ID NO: 2716216 - RNA, 15 nt, Haemophilus influenzae Rd
agcauggauuuuucu

SEQ ID NO: 2716217 - RNA, 18 nt, Haemophilus influenzae Rd
agcauuaaauauugagca

SEQ ID NO: 2716218 - RNA, 14 nt, Haemophilus influenzae Rd
agcauuuaaauauu

SEQ ID NO: 2716219 - RNA, 13 nt, Haemophilus influenzae Rd
agcauuuaccauc

SEQ ID NO: 2716220 - RNA, 18 nt, Haemophilus influenzae Rd
agcauuuagucaauuuac

SEQ ID NO: 2716221 - RNA, 19 nt, Haemophilus influenzae Rd
agcauuuuucauacaaucu

SEQ ID NO: 2716222 - RNA, 21 nt, Haemophilus influenzae Rd
agcauuuuuuauuaaaaaagu

SEQ ID NO: 2716223 - RNA, 16 nt, Haemophilus influenzae Rd
agccaaauuuaaaaaa

SEQ ID NO: 2716224 - RNA, 14 nt, Haemophilus influenzae Rd
agccaaauuuuucu

SEQ ID NO: 2716225 - RNA, 15 nt, Haemophilus influenzae Rd
agccaacuuuuucua

SEQ ID NO: 2716226 - RNA, 18 nt, Haemophilus influenzae Rd
agccaagaucaagcacuu

SEQ ID NO: 2716227 - RNA, 16 nt, Haemophilus influenzae Rd
agccaaggcgauuaau

SEQ ID NO: 2716228 - RNA, 23 nt, Haemophilus influenzae Rd
agccaaggcgauuaaucgaagua

SEQ ID NO: 2716229 - RNA, 22 nt, Haemophilus influenzae Rd
agccaagugcggucagcauaaa

SEQ ID NO: 2716230 - RNA, 14 nt, Haemophilus influenzae Rd
agccaauaacuucu

SEQ ID NO: 2716231 - RNA, 16 nt, Haemophilus influenzae Rd
agccaauaacuucuaa

SEQ ID NO: 2716232 - RNA, 18 nt, Haemophilus influenzae Rd
agccaauaauuucuuguu

SEQ ID NO: 2716233 - RNA, 23 nt, Haemophilus influenzae Rd
agccaauauggaacaguugaaaa

SEQ ID NO: 2716234 - RNA, 15 nt, Haemophilus influenzae Rd
agccaaucauugcua

SEQ ID NO: 2716235 - RNA, 18 nt, Haemophilus influenzae Rd
agccaaugcaacuugcau

SEQ ID NO: 2716236 - RNA, 17 nt, Haemophilus influenzae Rd
agccaaugccaaaacca

SEQ ID NO: 2716237 - RNA, 19 nt, Haemophilus influenzae Rd
agccaaugcggcuauggca

SEQ ID NO: 2716238 - RNA, 17 nt, Haemophilus influenzae Rd
agccaauggaaauacca

SEQ ID NO: 2716239 - RNA, 14 nt, Haemophilus influenzae Rd
agccaauuuuucaa

SEQ ID NO: 2716240 - RNA, 18 nt, Haemophilus influenzae Rd
agccacauaauaagaaag

SEQ ID NO: 2716241 - RNA, 15 nt, Haemophilus influenzae Rd
agccacugugcauua

SEQ ID NO: 2716242 - RNA, 21 nt, Haemophilus influenzae Rd
agccacugugcauuaaaucaa

SEQ ID NO: 2716243 - RNA, 18 nt, Haemophilus influenzae Rd
agccacuucuucaaagau

SEQ ID NO: 2716244 - RNA, 20 nt, Haemophilus influenzae Rd
agccacuugugcaucaaagc

SEQ ID NO: 2716245 - RNA, 13 nt, Haemophilus influenzae Rd
agccauaaauaaa

SEQ ID NO: 2716246 - RNA, 22 nt, Haemophilus influenzae Rd
agccauagcgaagcguaaaagu

SEQ ID NO: 2716247 - RNA, 20 nt, Haemophilus influenzae Rd
agccauauccguaucauuua

SEQ ID NO: 2716248 - RNA, 16 nt, Haemophilus influenzae Rd
agccaucaauaaaaag

SEQ ID NO: 2716249 - RNA, 15 nt, Haemophilus influenzae Rd
agccaucacuauaua

SEQ ID NO: 2716250 - RNA, 16 nt, Haemophilus influenzae Rd
agccauccccaaaaca

SEQ ID NO: 2716251 - RNA, 13 nt, Haemophilus influenzae Rd
agccauuaacauu

SEQ ID NO: 2716252 - RNA, 15 nt, Haemophilus influenzae Rd
agccauuaacauuua

SEQ ID NO: 2716253 - RNA, 18 nt, Haemophilus influenzae Rd
agccauuaacauuuaaca

SEQ ID NO: 2716254 - RNA, 21 nt, Haemophilus influenzae Rd
agccauuuaauguucccacaa

SEQ ID NO: 2716255 - RNA, 22 nt, Haemophilus influenzae Rd
agccauuuucgcaucaaucaca

SEQ ID NO: 2716256 - RNA, 14 nt, Haemophilus influenzae Rd
agccauuuugcuca

SEQ ID NO: 2716257 - RNA, 13 nt, Haemophilus influenzae Rd
agccauuuuggaa

SEQ ID NO: 2716258 - RNA, 16 nt, Haemophilus influenzae Rd
agcccaaaugcaacaa

SEQ ID NO: 2716259 - RNA, 22 nt, Haemophilus influenzae Rd
agcccaacuuaaguugggcuua

SEQ ID NO: 2716260 - RNA, 15 nt, Haemophilus influenzae Rd
agcccaagcuuuuuc

SEQ ID NO: 2716261 - RNA, 21 nt, Haemophilus influenzae Rd
agcccaagcuuuuucuuguuc

SEQ ID NO: 2716262 - RNA, 17 nt, Haemophilus influenzae Rd
agcccaaguaauacacc

SEQ ID NO: 2716263 - RNA, 15 nt, Haemophilus influenzae Rd
agcccacaacuacag

SEQ ID NO: 2716264 - RNA, 15 nt, Haemophilus influenzae Rd
agcccacauuuggaa

SEQ ID NO: 2716265 - RNA, 22 nt, Haemophilus influenzae Rd
agcccaccaauuaaccauaaaa

SEQ ID NO: 2716266 - RNA, 13 nt, Haemophilus influenzae Rd
agccccaguuuau

SEQ ID NO: 2716267 - RNA, 15 nt, Haemophilus influenzae Rd
agccccucagauaau

SEQ ID NO: 2716268 - RNA, 15 nt, Haemophilus influenzae Rd
agcccgaauucugag

SEQ ID NO: 2716269 - RNA, 16 nt, Haemophilus influenzae Rd
agcccgaauucugagc

SEQ ID NO: 2716270 - RNA, 14 nt, Haemophilus influenzae Rd
agcccuuauuuuuu

SEQ ID NO: 2716271 - RNA, 15 nt, Haemophilus influenzae Rd
agcccuuccaucuuu

SEQ ID NO: 2716272 - RNA, 15 nt, Haemophilus influenzae Rd
agcccuuuguuuuaa

SEQ ID NO: 2716273 - RNA, 20 nt, Haemophilus influenzae Rd
agcccuuuuaguuuccccug

SEQ ID NO: 2716274 - RNA, 21 nt, Haemophilus influenzae Rd
agccgaacaagccccacaggu

SEQ ID NO: 2716275 - RNA, 21 nt, Haemophilus influenzae Rd
agccgacuauuacaagauaau

SEQ ID NO: 2716276 - RNA, 15 nt, Haemophilus influenzae Rd
agccgcaccuugaga

SEQ ID NO: 2716277 - RNA, 18 nt, Haemophilus influenzae Rd
agccgccuuuuucauauu

SEQ ID NO: 2716278 - RNA, 19 nt, Haemophilus influenzae Rd
agccgcgaugauagaacca

SEQ ID NO: 2716279 - RNA, 15 nt, Haemophilus influenzae Rd
agccgcuauuucacu

SEQ ID NO: 2716280 - RNA, 15 nt, Haemophilus influenzae Rd
agccgcuggaaacaa

SEQ ID NO: 2716281 - RNA, 16 nt, Haemophilus influenzae Rd
agccguucuuaucuac

SEQ ID NO: 2716282 - RNA, 15 nt, Haemophilus influenzae Rd
agccguuuugcguug

SEQ ID NO: 2716283 - RNA, 14 nt, Haemophilus influenzae Rd
agccuaaauauuua

SEQ ID NO: 2716284 - RNA, 19 nt, Haemophilus influenzae Rd
agccuaagccaaauccaac

SEQ ID NO: 2716285 - RNA, 16 nt, Haemophilus influenzae Rd
agccuaguauuuuugu

SEQ ID NO: 2716286 - RNA, 23 nt, Haemophilus influenzae Rd
agccuagugcuaaaauaaaaccu

SEQ ID NO: 2716287 - RNA, 21 nt, Haemophilus influenzae Rd
agccuauaauuaaaguuacuu

SEQ ID NO: 2716288 - RNA, 13 nt, Haemophilus influenzae Rd
agccuauuuuuag

SEQ ID NO: 2716289 - RNA, 15 nt, Haemophilus influenzae Rd
agccuauuuuuagaa

SEQ ID NO: 2716290 - RNA, 21 nt, Haemophilus influenzae Rd
agccucaucuaaggucauuaa

SEQ ID NO: 2716291 - RNA, 17 nt, Haemophilus influenzae Rd
agccuccacaagcaaca

SEQ ID NO: 2716292 - RNA, 20 nt, Haemophilus influenzae Rd
agccucugcagggaaaaauu

SEQ ID NO: 2716293 - RNA, 16 nt, Haemophilus influenzae Rd
agccugaaaaagcuaa

SEQ ID NO: 2716294 - RNA, 20 nt, Haemophilus influenzae Rd
agccugaaaaagcuaaaaaa

SEQ ID NO: 2716295 - RNA, 20 nt, Haemophilus influenzae Rd
agccugaaucgacacaucua

SEQ ID NO: 2716296 - RNA, 16 nt, Haemophilus influenzae Rd
agccugcuacagaagc

SEQ ID NO: 2716297 - RNA, 13 nt, Haemophilus influenzae Rd
agccugcuacauu

SEQ ID NO: 2716298 - RNA, 20 nt, Haemophilus influenzae Rd
agccugggcuugcauucacu

SEQ ID NO: 2716299 - RNA, 14 nt, Haemophilus influenzae Rd
agccuguucuucca

SEQ ID NO: 2716300 - RNA, 20 nt, Haemophilus influenzae Rd
agccuucaucacaaaucuuc

SEQ ID NO: 2716301 - RNA, 18 nt, Haemophilus influenzae Rd
agccuucgcuauuuuucg

SEQ ID NO: 2716302 - RNA, 13 nt, Haemophilus influenzae Rd
agccuucugccau

SEQ ID NO: 2716303 - RNA, 21 nt, Haemophilus influenzae Rd
agccuugacgaauaccccaag

SEQ ID NO: 2716304 - RNA, 19 nt, Haemophilus influenzae Rd
agccuugauucuacugaaa

SEQ ID NO: 2716305 - RNA, 23 nt, Haemophilus influenzae Rd
agccuugauuucaguagaaucaa

SEQ ID NO: 2716306 - RNA, 19 nt, Haemophilus influenzae Rd
agccuuguaaaauuggugg

SEQ ID NO: 2716307 - RNA, 13 nt, Haemophilus influenzae Rd
agccuuucuggcu

SEQ ID NO: 2716308 - RNA, 14 nt, Haemophilus influenzae Rd
agccuuuuaaaaug

SEQ ID NO: 2716309 - RNA, 15 nt, Haemophilus influenzae Rd
agccuuuuaaaauga

SEQ ID NO: 2716310 - RNA, 15 nt, Haemophilus influenzae Rd
agccuuuuauuucuu

SEQ ID NO: 2716311 - RNA, 12 nt, Haemophilus influenzae Rd
agccuuuucuag

SEQ ID NO: 2716312 - RNA, 13 nt, Haemophilus influenzae Rd
agccuuuuucuaa

SEQ ID NO: 2716313 - RNA, 21 nt, Haemophilus influenzae Rd
agcgaacauuuuugguuucau

SEQ ID NO: 2716314 - RNA, 24 nt, Haemophilus influenzae Rd
agcgaaccgcccgguaaaucuacu

SEQ ID NO: 2716315 - RNA, 16 nt, Haemophilus influenzae Rd
agcgaauuaaagugca

SEQ ID NO: 2716316 - RNA, 14 nt, Haemophilus influenzae Rd
agcgaccaccaaug

SEQ ID NO: 2716317 - RNA, 22 nt, Haemophilus influenzae Rd
agcgacuuuguuucuaaaaaug

SEQ ID NO: 2716318 - RNA, 18 nt, Haemophilus influenzae Rd
agcgaguaagggcaaaaa

SEQ ID NO: 2716319 - RNA, 21 nt, Haemophilus influenzae Rd
agcgaguauaagcaaugcaag

SEQ ID NO: 2716320 - RNA, 13 nt, Haemophilus influenzae Rd
agcgauagaaaua

SEQ ID NO: 2716321 - RNA, 15 nt, Haemophilus influenzae Rd
agcgauagaaauaaa

SEQ ID NO: 2716322 - RNA, 18 nt, Haemophilus influenzae Rd
agcgauauucuuuugaau

SEQ ID NO: 2716323 - RNA, 16 nt, Haemophilus influenzae Rd
agcgauccuaaaaaac

SEQ ID NO: 2716324 - RNA, 21 nt, Haemophilus influenzae Rd
agcgaugucuaaaugugccca

SEQ ID NO: 2716325 - RNA, 19 nt, Haemophilus influenzae Rd
agcgcguuuaucaucugca

SEQ ID NO: 2716326 - RNA, 21 nt, Haemophilus influenzae Rd
agcggaaacuacggacuaaau

SEQ ID NO: 2716327 - RNA, 14 nt, Haemophilus influenzae Rd
agcggacuuuuaau

SEQ ID NO: 2716328 - RNA, 14 nt, Haemophilus influenzae Rd
agcggauaaaauaa

SEQ ID NO: 2716329 - RNA, 15 nt, Haemophilus influenzae Rd
agcggauaaccaaaa

SEQ ID NO: 2716330 - RNA, 15 nt, Haemophilus influenzae Rd
agcggcgaauguggc

SEQ ID NO: 2716331 - RNA, 20 nt, Haemophilus influenzae Rd
agcgggauaagauuugcucg

SEQ ID NO: 2716332 - RNA, 15 nt, Haemophilus influenzae Rd
agcggucaauuuuuu

SEQ ID NO: 2716333 - RNA, 22 nt, Haemophilus influenzae Rd
agcgguuggcuuccagaaaauu

SEQ ID NO: 2716334 - RNA, 17 nt, Haemophilus influenzae Rd
agcgguuguaauuguug

SEQ ID NO: 2716335 - RNA, 15 nt, Haemophilus influenzae Rd
agcgguuuuuccauu

SEQ ID NO: 2716336 - RNA, 16 nt, Haemophilus influenzae Rd
agcguaacccaaagca

SEQ ID NO: 2716337 - RNA, 16 nt, Haemophilus influenzae Rd
agcguaacuuaaugca

SEQ ID NO: 2716338 - RNA, 19 nt, Haemophilus influenzae Rd
agcguaaucacauagauuu

SEQ ID NO: 2716339 - RNA, 16 nt, Haemophilus influenzae Rd
agcguaccgccaguau

SEQ ID NO: 2716340 - RNA, 20 nt, Haemophilus influenzae Rd
agcguauuuuguucuaauuu

SEQ ID NO: 2716341 - RNA, 16 nt, Haemophilus influenzae Rd
agcguccuacuacagc

SEQ ID NO: 2716342 - RNA, 15 nt, Haemophilus influenzae Rd
agcgucuuuuugcac

SEQ ID NO: 2716343 - RNA, 21 nt, Haemophilus influenzae Rd
agcgucuuuuugcacguucuu

SEQ ID NO: 2716344 - RNA, 22 nt, Haemophilus influenzae Rd
agcguuauccaucaagaaaguu

SEQ ID NO: 2716345 - RNA, 12 nt, Haemophilus influenzae Rd
agcguucaucaa

SEQ ID NO: 2716346 - RNA, 15 nt, Haemophilus influenzae Rd
agcguucguuaucau

SEQ ID NO: 2716347 - RNA, 16 nt, Haemophilus influenzae Rd
agcguugaaaauaaau

SEQ ID NO: 2716348 - RNA, 13 nt, Haemophilus influenzae Rd
agcguugaguaaa

SEQ ID NO: 2716349 - RNA, 15 nt, Haemophilus influenzae Rd
agcguugaguaaaua

SEQ ID NO: 2716350 - RNA, 15 nt, Haemophilus influenzae Rd
agcguuguucaucug

SEQ ID NO: 2716351 - RNA, 13 nt, Haemophilus influenzae Rd
agcguuuuucuac

SEQ ID NO: 2716352 - RNA, 18 nt, Haemophilus influenzae Rd
agcguuuuucuacauaau

SEQ ID NO: 2716353 - RNA, 14 nt, Haemophilus influenzae Rd
agcuaaaaauaauu

SEQ ID NO: 2716354 - RNA, 20 nt, Haemophilus influenzae Rd
agcuaaaauuaccccaauuc

SEQ ID NO: 2716355 - RNA, 13 nt, Haemophilus influenzae Rd
agcuaaagaaagc

SEQ ID NO: 2716356 - RNA, 16 nt, Haemophilus influenzae Rd
agcuaaagcaauugcc

SEQ ID NO: 2716357 - RNA, 13 nt, Haemophilus influenzae Rd
agcuaaauccaga

SEQ ID NO: 2716358 - RNA, 15 nt, Haemophilus influenzae Rd
agcuaagaaaaucca

SEQ ID NO: 2716359 - RNA, 18 nt, Haemophilus influenzae Rd
agcuaagauugacaacgc

SEQ ID NO: 2716360 - RNA, 14 nt, Haemophilus influenzae Rd
agcuaagcauuuca

SEQ ID NO: 2716361 - RNA, 18 nt, Haemophilus influenzae Rd
agcuaauaaaguuugcaa

SEQ ID NO: 2716362 - RNA, 14 nt, Haemophilus influenzae Rd
agcuaauaacacau

SEQ ID NO: 2716363 - RNA, 16 nt, Haemophilus influenzae Rd
agcuaauaacacaucu

SEQ ID NO: 2716364 - RNA, 24 nt, Haemophilus influenzae Rd
agcuaauaggcuuaauucuugcca

SEQ ID NO: 2716365 - RNA, 17 nt, Haemophilus influenzae Rd
agcuaauccaaaucaag

SEQ ID NO: 2716366 - RNA, 22 nt, Haemophilus influenzae Rd
agcuaauccuuuaccaaccggu

SEQ ID NO: 2716367 - RNA, 21 nt, Haemophilus influenzae Rd
agcuaaugcuuuaauuuguuu

SEQ ID NO: 2716368 - RNA, 20 nt, Haemophilus influenzae Rd
agcuaauucagcuaaacauu

SEQ ID NO: 2716369 - RNA, 23 nt, Haemophilus influenzae Rd
agcuaauucuucuauuuuaucaa

SEQ ID NO: 2716370 - RNA, 21 nt, Haemophilus influenzae Rd
agcuaauuggggugcagauuu

SEQ ID NO: 2716371 - RNA, 13 nt, Haemophilus influenzae Rd
agcuaauuuuuca

SEQ ID NO: 2716372 - RNA, 17 nt, Haemophilus influenzae Rd
agcuacauucaucaaaa

SEQ ID NO: 2716373 - RNA, 17 nt, Haemophilus influenzae Rd
agcuacgguuauuuuuu

SEQ ID NO: 2716374 - RNA, 17 nt, Haemophilus influenzae Rd
agcuacuaaaaauugcu

SEQ ID NO: 2716375 - RNA, 16 nt, Haemophilus influenzae Rd
agcuagaaagcaaugu

SEQ ID NO: 2716376 - RNA, 16 nt, Haemophilus influenzae Rd
agcuagaggcugaagc

SEQ ID NO: 2716377 - RNA, 21 nt, Haemophilus influenzae Rd
agcuaggaaugaucugcaccc

SEQ ID NO: 2716378 - RNA, 12 nt, Haemophilus influenzae Rd
agcuaguccugc

SEQ ID NO: 2716379 - RNA, 13 nt, Haemophilus influenzae Rd
agcuauuaaaaaa

SEQ ID NO: 2716380 - RNA, 12 nt, Haemophilus influenzae Rd
agcuauuaaauu

SEQ ID NO: 2716381 - RNA, 18 nt, Haemophilus influenzae Rd
agcuauuucggcaguacu

SEQ ID NO: 2716382 - RNA, 12 nt, Haemophilus influenzae Rd
agcuauuuuuca

SEQ ID NO: 2716383 - RNA, 16 nt, Haemophilus influenzae Rd
agcucaagcaacauag

SEQ ID NO: 2716384 - RNA, 22 nt, Haemophilus influenzae Rd
agcucacuugcauauccgcugc

SEQ ID NO: 2716385 - RNA, 12 nt, Haemophilus influenzae Rd
agcucagccaaa

SEQ ID NO: 2716386 - RNA, 17 nt, Haemophilus influenzae Rd
agcucaguugguagagc

SEQ ID NO: 2716387 - RNA, 16 nt, Haemophilus influenzae Rd
agcuccuacauuaaaa

SEQ ID NO: 2716388 - RNA, 12 nt, Haemophilus influenzae Rd
agcucggaaugu

SEQ ID NO: 2716389 - RNA, 17 nt, Haemophilus influenzae Rd
agcucguaaagaucauu

SEQ ID NO: 2716390 - RNA, 14 nt, Haemophilus influenzae Rd
agcucguugccaua

SEQ ID NO: 2716391 - RNA, 20 nt, Haemophilus influenzae Rd
agcucguugccauaaaaaau

SEQ ID NO: 2716392 - RNA, 23 nt, Haemophilus influenzae Rd
agcucguugccauaaaaaauuaa

SEQ ID NO: 2716393 - RNA, 20 nt, Haemophilus influenzae Rd
agcucuguaaaacauuucau

SEQ ID NO: 2716394 - RNA, 17 nt, Haemophilus influenzae Rd
agcugaaaaauaaaaaa

SEQ ID NO: 2716395 - RNA, 17 nt, Haemophilus influenzae Rd
agcugaaauuuagugau

SEQ ID NO: 2716396 - RNA, 15 nt, Haemophilus influenzae Rd
agcugaauaaaagag

SEQ ID NO: 2716397 - RNA, 23 nt, Haemophilus influenzae Rd
agcugaauaaauaaaccagcuaa

SEQ ID NO: 2716398 - RNA, 15 nt, Haemophilus influenzae Rd
agcugauauaaaaau

SEQ ID NO: 2716399 - RNA, 11 nt, Haemophilus influenzae Rd
agcugcaauaa

SEQ ID NO: 2716400 - RNA, 16 nt, Haemophilus influenzae Rd
agcugcacaagcacca

SEQ ID NO: 2716401 - RNA, 17 nt, Haemophilus influenzae Rd
agcugcacaagcaccac

SEQ ID NO: 2716402 - RNA, 20 nt, Haemophilus influenzae Rd
agcugcauuucaauuucacu

SEQ ID NO: 2716403 - RNA, 21 nt, Haemophilus influenzae Rd
agcugcucuuuaggaucacua

SEQ ID NO: 2716404 - RNA, 22 nt, Haemophilus influenzae Rd
agcugcucuuuaggaucacuaa

SEQ ID NO: 2716405 - RNA, 17 nt, Haemophilus influenzae Rd
agcugcugcaagauuug

SEQ ID NO: 2716406 - RNA, 15 nt, Haemophilus influenzae Rd
agcugcugcuuuaac

SEQ ID NO: 2716407 - RNA, 22 nt, Haemophilus influenzae Rd
agcugcuuaauuaacgggcuua

SEQ ID NO: 2716408 - RNA, 14 nt, Haemophilus influenzae Rd
agcuggaaauucca

SEQ ID NO: 2716409 - RNA, 16 nt, Haemophilus influenzae Rd
agcuggaaauuccacu

SEQ ID NO: 2716410 - RNA, 17 nt, Haemophilus influenzae Rd
agcuggaaauuccacuu

SEQ ID NO: 2716411 - RNA, 13 nt, Haemophilus influenzae Rd
agcuggauuaaau

SEQ ID NO: 2716412 - RNA, 21 nt, Haemophilus influenzae Rd
agcuggauuaaauaaccaacu

SEQ ID NO: 2716413 - RNA, 22 nt, Haemophilus influenzae Rd
agcuggauucauuugcaaauca

SEQ ID NO: 2716414 - RNA, 15 nt, Haemophilus influenzae Rd
agcuggcgguuugaa

SEQ ID NO: 2716415 - RNA, 15 nt, Haemophilus influenzae Rd
agcuggcguuuacuu

SEQ ID NO: 2716416 - RNA, 15 nt, Haemophilus influenzae Rd
agcugggcaaaauca

SEQ ID NO: 2716417 - RNA, 16 nt, Haemophilus influenzae Rd
agcuguaccagcgaug

SEQ ID NO: 2716418 - RNA, 16 nt, Haemophilus influenzae Rd
agcugucuaauuuuuu

SEQ ID NO: 2716419 - RNA, 14 nt, Haemophilus influenzae Rd
agcugugcaaaacu

SEQ ID NO: 2716420 - RNA, 14 nt, Haemophilus influenzae Rd
agcuguguaagcug

SEQ ID NO: 2716421 - RNA, 15 nt, Haemophilus influenzae Rd
agcuguuuaucaaua

SEQ ID NO: 2716422 - RNA, 22 nt, Haemophilus influenzae Rd
agcuuaauagagaauaauuaag

SEQ ID NO: 2716423 - RNA, 16 nt, Haemophilus influenzae Rd
agcuuaauauguucuu

SEQ ID NO: 2716424 - RNA, 19 nt, Haemophilus influenzae Rd
agcuuaauauguucuuugu

SEQ ID NO: 2716425 - RNA, 16 nt, Haemophilus influenzae Rd
agcuuagauacauaaa

SEQ ID NO: 2716426 - RNA, 12 nt, Haemophilus influenzae Rd
agcuucaucuuc

SEQ ID NO: 2716427 - RNA, 13 nt, Haemophilus influenzae Rd
agcuuccauccac

SEQ ID NO: 2716428 - RNA, 23 nt, Haemophilus influenzae Rd
agcuuccauuuuuuaugguaaau

SEQ ID NO: 2716429 - RNA, 19 nt, Haemophilus influenzae Rd
agcuuccuuuaaucuguca

SEQ ID NO: 2716430 - RNA, 11 nt, Haemophilus influenzae Rd
agcuucugcca

SEQ ID NO: 2716431 - RNA, 14 nt, Haemophilus influenzae Rd
agcuucuucaucgc

SEQ ID NO: 2716432 - RNA, 19 nt, Haemophilus influenzae Rd
agcuugaguugucacaaca

SEQ ID NO: 2716433 - RNA, 20 nt, Haemophilus influenzae Rd
agcuugaguugucacaacag

SEQ ID NO: 2716434 - RNA, 12 nt, Haemophilus influenzae Rd
agcuugauuuuc

SEQ ID NO: 2716435 - RNA, 13 nt, Haemophilus influenzae Rd
agcuugauuuuca

SEQ ID NO: 2716436 - RNA, 17 nt, Haemophilus influenzae Rd
agcuugcagauugcuga

SEQ ID NO: 2716437 - RNA, 21 nt, Haemophilus influenzae Rd
agcuugccgcugcagcaggaa

SEQ ID NO: 2716438 - RNA, 16 nt, Haemophilus influenzae Rd
agcuugcguaauguuu

SEQ ID NO: 2716439 - RNA, 18 nt, Haemophilus influenzae Rd
agcuugugcucgauuuuu

SEQ ID NO: 2716440 - RNA, 19 nt, Haemophilus influenzae Rd
agcuugugcucgauuuuua

SEQ ID NO: 2716441 - RNA, 17 nt, Haemophilus influenzae Rd
agcuuguuggaaaaaug

SEQ ID NO: 2716442 - RNA, 13 nt, Haemophilus influenzae Rd
agcuuguuucauc

SEQ ID NO: 2716443 - RNA, 11 nt, Haemophilus influenzae Rd
agcuuuaaggc

SEQ ID NO: 2716444 - RNA, 18 nt, Haemophilus influenzae Rd
agcuuuaccgucagccaa

SEQ ID NO: 2716445 - RNA, 14 nt, Haemophilus influenzae Rd
agcuuuccaaacaa

SEQ ID NO: 2716446 - RNA, 18 nt, Haemophilus influenzae Rd
agcuuuccuguacucgaa

SEQ ID NO: 2716447 - RNA, 21 nt, Haemophilus influenzae Rd
aggaaaaaggcaucuuuauca

SEQ ID NO: 2716448 - RNA, 12 nt, Haemophilus influenzae Rd
aggaaaaauaaa

SEQ ID NO: 2716449 - RNA, 16 nt, Haemophilus influenzae Rd
aggaaacguaaaauau

SEQ ID NO: 2716450 - RNA, 17 nt, Haemophilus influenzae Rd
aggaaacuacuuucuau

SEQ ID NO: 2716451 - RNA, 23 nt, Haemophilus influenzae Rd
aggaaagugcggucaacauaaag

SEQ ID NO: 2716452 - RNA, 17 nt, Haemophilus influenzae Rd
aggaacaagaccugcuu

SEQ ID NO: 2716453 - RNA, 13 nt, Haemophilus influenzae Rd
aggaagcauuucu

SEQ ID NO: 2716454 - RNA, 19 nt, Haemophilus influenzae Rd
aggaagcucgguaaaaauc

SEQ ID NO: 2716455 - RNA, 23 nt, Haemophilus influenzae Rd
aggaagcucgguaaaaaucauua

SEQ ID NO: 2716456 - RNA, 17 nt, Haemophilus influenzae Rd
aggaaguuaaaauacuu

SEQ ID NO: 2716457 - RNA, 23 nt, Haemophilus influenzae Rd
aggaauaaauugaauaucuaaau

SEQ ID NO: 2716458 - RNA, 12 nt, Haemophilus influenzae Rd
aggaauaacaca

SEQ ID NO: 2716459 - RNA, 17 nt, Haemophilus influenzae Rd
aggaauacucuccccuu

SEQ ID NO: 2716460 - RNA, 16 nt, Haemophilus influenzae Rd
aggaauagauuuauac

SEQ ID NO: 2716461 - RNA, 23 nt, Haemophilus influenzae Rd
aggaauaucuuugacuaaaucau

SEQ ID NO: 2716462 - RNA, 16 nt, Haemophilus influenzae Rd
aggaauauucuuuaaa

SEQ ID NO: 2716463 - RNA, 20 nt, Haemophilus influenzae Rd
aggaauauucuuuaaauauu

SEQ ID NO: 2716464 - RNA, 23 nt, Haemophilus influenzae Rd
aggaauauucuuuaaauauucaa

SEQ ID NO: 2716465 - RNA, 18 nt, Haemophilus influenzae Rd
aggaaucgaaauuaaaau

SEQ ID NO: 2716466 - RNA, 21 nt, Haemophilus influenzae Rd
aggaauuugcucaauaauuuc

SEQ ID NO: 2716467 - RNA, 17 nt, Haemophilus influenzae Rd
aggacaauaauaagcac

SEQ ID NO: 2716468 - RNA, 19 nt, Haemophilus influenzae Rd
aggacaauaauaagcacaa

SEQ ID NO: 2716469 - RNA, 13 nt, Haemophilus influenzae Rd
aggacaauauuua

SEQ ID NO: 2716470 - RNA, 12 nt, Haemophilus influenzae Rd
aggacuaaauua

SEQ ID NO: 2716471 - RNA, 16 nt, Haemophilus influenzae Rd
aggacuuaaauuuggc

SEQ ID NO: 2716472 - RNA, 15 nt, Haemophilus influenzae Rd
aggagaaagcuugcu

SEQ ID NO: 2716473 - RNA, 13 nt, Haemophilus influenzae Rd
aggagcaaucuuu

SEQ ID NO: 2716474 - RNA, 23 nt, Haemophilus influenzae Rd
aggagcaaucuuuuucuuucagu

SEQ ID NO: 2716475 - RNA, 18 nt, Haemophilus influenzae Rd
aggagccaaauuuaaaaa

SEQ ID NO: 2716476 - RNA, 20 nt, Haemophilus influenzae Rd
aggagccaaauuuaaaaaag

SEQ ID NO: 2716477 - RNA, 23 nt, Haemophilus influenzae Rd
aggagccaaauuuaaaaaagccg

SEQ ID NO: 2716478 - RNA, 22 nt, Haemophilus influenzae Rd
aggagcgguuaaaacaaaagaa

SEQ ID NO: 2716479 - RNA, 18 nt, Haemophilus influenzae Rd
aggagcuggauucauuug

SEQ ID NO: 2716480 - RNA, 17 nt, Haemophilus influenzae Rd
aggaguaaaaauauuau

SEQ ID NO: 2716481 - RNA, 13 nt, Haemophilus influenzae Rd
aggauaaaaaugg

SEQ ID NO: 2716482 - RNA, 22 nt, Haemophilus influenzae Rd
aggauaaaaauggaaaaagcaa

SEQ ID NO: 2716483 - RNA, 13 nt, Haemophilus influenzae Rd
aggauaaaacaau

SEQ ID NO: 2716484 - RNA, 15 nt, Haemophilus influenzae Rd
aggauagagaaacua

SEQ ID NO: 2716485 - RNA, 13 nt, Haemophilus influenzae Rd
aggaucacuaauu

SEQ ID NO: 2716486 - RNA, 12 nt, Haemophilus influenzae Rd
aggaucauuaaa

SEQ ID NO: 2716487 - RNA, 16 nt, Haemophilus influenzae Rd
aggauccauuacaaau

SEQ ID NO: 2716488 - RNA, 13 nt, Haemophilus influenzae Rd
aggaugacguaau

SEQ ID NO: 2716489 - RNA, 19 nt, Haemophilus influenzae Rd
aggaugugaauaagcaaag

SEQ ID NO: 2716490 - RNA, 19 nt, Haemophilus influenzae Rd
aggauuaacguaagaaaua

SEQ ID NO: 2716491 - RNA, 21 nt, Haemophilus influenzae Rd
aggauuaaugcuauaaaucca

SEQ ID NO: 2716492 - RNA, 22 nt, Haemophilus influenzae Rd
aggauugaccgcccaacauuuc

SEQ ID NO: 2716493 - RNA, 19 nt, Haemophilus influenzae Rd
aggauuguugauuuugguu

SEQ ID NO: 2716494 - RNA, 19 nt, Haemophilus influenzae Rd
aggauuucuaaaguuucuu

SEQ ID NO: 2716495 - RNA, 18 nt, Haemophilus influenzae Rd
aggauuugccucuucuuu

SEQ ID NO: 2716496 - RNA, 20 nt, Haemophilus influenzae Rd
aggauuuggcacuaaagcaa

SEQ ID NO: 2716497 - RNA, 15 nt, Haemophilus influenzae Rd
aggauuuuauggcug

SEQ ID NO: 2716498 - RNA, 14 nt, Haemophilus influenzae Rd
aggcaaaucaccuu

SEQ ID NO: 2716499 - RNA, 17 nt, Haemophilus influenzae Rd
aggcaagcuaggaauga

SEQ ID NO: 2716500 - RNA, 15 nt, Haemophilus influenzae Rd
aggcaagcucuauuu

SEQ ID NO: 2716501 - RNA, 19 nt, Haemophilus influenzae Rd
aggcaagguaucuauaauu

SEQ ID NO: 2716502 - RNA, 17 nt, Haemophilus influenzae Rd
aggcaaguucguuuuuu

SEQ ID NO: 2716503 - RNA, 21 nt, Haemophilus influenzae Rd
aggcaauaugauuagucuaca

SEQ ID NO: 2716504 - RNA, 22 nt, Haemophilus influenzae Rd
aggcaauguauucaaacgcugu

SEQ ID NO: 2716505 - RNA, 14 nt, Haemophilus influenzae Rd
aggcacaaaaaauu

SEQ ID NO: 2716506 - RNA, 20 nt, Haemophilus influenzae Rd
aggcacauaaguaaaauagu

SEQ ID NO: 2716507 - RNA, 19 nt, Haemophilus influenzae Rd
aggcaccgugcgugaaugu

SEQ ID NO: 2716508 - RNA, 19 nt, Haemophilus influenzae Rd
aggcaccgugggugugaaa

SEQ ID NO: 2716509 - RNA, 14 nt, Haemophilus influenzae Rd
aggcagcaagaaag

SEQ ID NO: 2716510 - RNA, 17 nt, Haemophilus influenzae Rd
aggcauuagauuugaau

SEQ ID NO: 2716511 - RNA, 15 nt, Haemophilus influenzae Rd
aggcauuauguaaua

SEQ ID NO: 2716512 - RNA, 15 nt, Haemophilus influenzae Rd
aggcauuuucaacuu

SEQ ID NO: 2716513 - RNA, 18 nt, Haemophilus influenzae Rd
aggcauuuuuucugcauu

SEQ ID NO: 2716514 - RNA, 20 nt, Haemophilus influenzae Rd
aggcgaauuugugagguuuu

SEQ ID NO: 2716515 - RNA, 16 nt, Haemophilus influenzae Rd
aggcgagggauuuuaa

SEQ ID NO: 2716516 - RNA, 18 nt, Haemophilus influenzae Rd
aggcgagugcggcaaagg

SEQ ID NO: 2716517 - RNA, 13 nt, Haemophilus influenzae Rd
aggcguaaaacua

SEQ ID NO: 2716518 - RNA, 16 nt, Haemophilus influenzae Rd
aggcuaacuggcaaua

SEQ ID NO: 2716519 - RNA, 14 nt, Haemophilus influenzae Rd
aggcuaauuauuua

SEQ ID NO: 2716520 - RNA, 18 nt, Haemophilus influenzae Rd
aggcuaauucuacaccag

SEQ ID NO: 2716521 - RNA, 20 nt, Haemophilus influenzae Rd
aggcuacuuuauuuacccaa

SEQ ID NO: 2716522 - RNA, 15 nt, Haemophilus influenzae Rd
aggcuaguucuuccu

SEQ ID NO: 2716523 - RNA, 17 nt, Haemophilus influenzae Rd
aggcuaguucuuccuug

SEQ ID NO: 2716524 - RNA, 16 nt, Haemophilus influenzae Rd
aggcuaucaucaucau

SEQ ID NO: 2716525 - RNA, 20 nt, Haemophilus influenzae Rd
aggcuauuuuauaauuaaua

SEQ ID NO: 2716526 - RNA, 19 nt, Haemophilus influenzae Rd
aggcucaacaccuaauauc

SEQ ID NO: 2716527 - RNA, 13 nt, Haemophilus influenzae Rd
aggcucacaaagg

SEQ ID NO: 2716528 - RNA, 21 nt, Haemophilus influenzae Rd
aggcucacaaaggugguuuca

SEQ ID NO: 2716529 - RNA, 23 nt, Haemophilus influenzae Rd
aggcucaucauuaugaaaaaaag

SEQ ID NO: 2716530 - RNA, 17 nt, Haemophilus influenzae Rd
aggcucauuuuuucucu

SEQ ID NO: 2716531 - RNA, 18 nt, Haemophilus influenzae Rd
aggcucggucgauggcug

SEQ ID NO: 2716532 - RNA, 17 nt, Haemophilus influenzae Rd
aggcucuaccuaaaaua

SEQ ID NO: 2716533 - RNA, 23 nt, Haemophilus influenzae Rd
aggcucuguaauugggcgcauaa

SEQ ID NO: 2716534 - RNA, 14 nt, Haemophilus influenzae Rd
aggcugaaaaaaua

SEQ ID NO: 2716535 - RNA, 12 nt, Haemophilus influenzae Rd
aggcugaacuuu

SEQ ID NO: 2716536 - RNA, 13 nt, Haemophilus influenzae Rd
aggcuuaauucuu

SEQ ID NO: 2716537 - RNA, 21 nt, Haemophilus influenzae Rd
aggcuuauuuuuaaacaauau

SEQ ID NO: 2716538 - RNA, 17 nt, Haemophilus influenzae Rd
aggcuucgccauuuuua

SEQ ID NO: 2716539 - RNA, 19 nt, Haemophilus influenzae Rd
aggcuucgccauuuuuaaa

SEQ ID NO: 2716540 - RNA, 17 nt, Haemophilus influenzae Rd
aggcuucggccuauuaa

SEQ ID NO: 2716541 - RNA, 13 nt, Haemophilus influenzae Rd
aggcuucuuguuu

SEQ ID NO: 2716542 - RNA, 19 nt, Haemophilus influenzae Rd
aggcuuguuguucaaaauu

SEQ ID NO: 2716543 - RNA, 21 nt, Haemophilus influenzae Rd
aggcuuuaauuuuaucuaauc

SEQ ID NO: 2716544 - RNA, 13 nt, Haemophilus influenzae Rd
aggcuuucaccaa

SEQ ID NO: 2716545 - RNA, 16 nt, Haemophilus influenzae Rd
aggcuuucauuuucca

SEQ ID NO: 2716546 - RNA, 18 nt, Haemophilus influenzae Rd
aggcuuugccuaauuggu

SEQ ID NO: 2716547 - RNA, 20 nt, Haemophilus influenzae Rd
aggcuuuuuacguucaugua

SEQ ID NO: 2716548 - RNA, 22 nt, Haemophilus influenzae Rd
aggcuuuuuacguucauguaaa

SEQ ID NO: 2716549 - RNA, 18 nt, Haemophilus influenzae Rd
agggaaaauuuuaaacag

SEQ ID NO: 2716550 - RNA, 22 nt, Haemophilus influenzae Rd
agggaaaauuuuaaacagcaaa

SEQ ID NO: 2716551 - RNA, 23 nt, Haemophilus influenzae Rd
agggaaauguacuggcucuucuu

SEQ ID NO: 2716552 - RNA, 21 nt, Haemophilus influenzae Rd
agggaacgguucgccugauuu

SEQ ID NO: 2716553 - RNA, 23 nt, Haemophilus influenzae Rd
agggaauaaaaaagccuugauuu

SEQ ID NO: 2716554 - RNA, 15 nt, Haemophilus influenzae Rd
agggagcaauggagg

SEQ ID NO: 2716555 - RNA, 22 nt, Haemophilus influenzae Rd
agggaguaugggguuaaaaagc

SEQ ID NO: 2716556 - RNA, 13 nt, Haemophilus influenzae Rd
agggauuuuaaau

SEQ ID NO: 2716557 - RNA, 19 nt, Haemophilus influenzae Rd
agggauuuuaaguuucacu

SEQ ID NO: 2716558 - RNA, 12 nt, Haemophilus influenzae Rd
agggauuuucau

SEQ ID NO: 2716559 - RNA, 13 nt, Haemophilus influenzae Rd
agggcaaaaaauc

SEQ ID NO: 2716560 - RNA, 13 nt, Haemophilus influenzae Rd
agggcauucauug

SEQ ID NO: 2716561 - RNA, 19 nt, Haemophilus influenzae Rd
agggcgaaguaaaaaguca

SEQ ID NO: 2716562 - RNA, 17 nt, Haemophilus influenzae Rd
agggcgacaauuuaucg

SEQ ID NO: 2716563 - RNA, 19 nt, Haemophilus influenzae Rd
agggcucaaauuuucuguu

SEQ ID NO: 2716564 - RNA, 17 nt, Haemophilus influenzae Rd
agggcugauuuuaaaua

SEQ ID NO: 2716565 - RNA, 23 nt, Haemophilus influenzae Rd
aggggauucgauuucguucccaa

SEQ ID NO: 2716566 - RNA, 16 nt, Haemophilus influenzae Rd
aggggcugaucuacac

SEQ ID NO: 2716567 - RNA, 13 nt, Haemophilus influenzae Rd
aggguaaauaaaa

SEQ ID NO: 2716568 - RNA, 15 nt, Haemophilus influenzae Rd
aggguaaauaaaaau

SEQ ID NO: 2716569 - RNA, 13 nt, Haemophilus influenzae Rd
aggguaauuuuuu

SEQ ID NO: 2716570 - RNA, 22 nt, Haemophilus influenzae Rd
aggguauuucgguuucaugauu

SEQ ID NO: 2716571 - RNA, 14 nt, Haemophilus influenzae Rd
aggguguucaacuu

SEQ ID NO: 2716572 - RNA, 19 nt, Haemophilus influenzae Rd
aggguuauauucagcaaaa

SEQ ID NO: 2716573 - RNA, 14 nt, Haemophilus influenzae Rd
aggguuuucaucau

SEQ ID NO: 2716574 - RNA, 15 nt, Haemophilus influenzae Rd
aggguuuucaucauu

SEQ ID NO: 2716575 - RNA, 18 nt, Haemophilus influenzae Rd
agguaaauuugguucaau

SEQ ID NO: 2716576 - RNA, 13 nt, Haemophilus influenzae Rd
agguaacagguga

SEQ ID NO: 2716577 - RNA, 16 nt, Haemophilus influenzae Rd
agguaagcugaaguuu

SEQ ID NO: 2716578 - RNA, 22 nt, Haemophilus influenzae Rd
agguaauguuucauaaaucggu

SEQ ID NO: 2716579 - RNA, 22 nt, Haemophilus influenzae Rd
agguaauuuguuagaucaaauu

SEQ ID NO: 2716580 - RNA, 18 nt, Haemophilus influenzae Rd
agguacaaguaacgccgc

SEQ ID NO: 2716581 - RNA, 24 nt, Haemophilus influenzae Rd
agguacuaauuguuguaaaauagu

SEQ ID NO: 2716582 - RNA, 21 nt, Haemophilus influenzae Rd
agguacuuggauugcaugaaa

SEQ ID NO: 2716583 - RNA, 20 nt, Haemophilus influenzae Rd
agguacuuuuacgacuaauu

SEQ ID NO: 2716584 - RNA, 20 nt, Haemophilus influenzae Rd
agguaguuuagcuaauccuu

SEQ ID NO: 2716585 - RNA, 14 nt, Haemophilus influenzae Rd
agguaguuuucaau

SEQ ID NO: 2716586 - RNA, 14 nt, Haemophilus influenzae Rd
agguauccacuuuu

SEQ ID NO: 2716587 - RNA, 20 nt, Haemophilus influenzae Rd
agguauuucuucaauauguu

SEQ ID NO: 2716588 - RNA, 15 nt, Haemophilus influenzae Rd
aggucagcaaauuau

SEQ ID NO: 2716589 - RNA, 20 nt, Haemophilus influenzae Rd
aggucauuagagccuacauu

SEQ ID NO: 2716590 - RNA, 14 nt, Haemophilus influenzae Rd
aggucugcaauaau

SEQ ID NO: 2716591 - RNA, 17 nt, Haemophilus influenzae Rd
aggucuuaauagcauug

SEQ ID NO: 2716592 - RNA, 23 nt, Haemophilus influenzae Rd
aggucuuacaccuaacauaugac

SEQ ID NO: 2716593 - RNA, 16 nt, Haemophilus influenzae Rd
aggugcguucuacacg

SEQ ID NO: 2716594 - RNA, 18 nt, Haemophilus influenzae Rd
aggugcuuuuaaauuuuu

SEQ ID NO: 2716595 - RNA, 15 nt, Haemophilus influenzae Rd
aggugcuuuuugcua

SEQ ID NO: 2716596 - RNA, 16 nt, Haemophilus influenzae Rd
agguggaacucuuuca

SEQ ID NO: 2716597 - RNA, 22 nt, Haemophilus influenzae Rd
agguguguuuuucaaaaaaugg

SEQ ID NO: 2716598 - RNA, 18 nt, Haemophilus influenzae Rd
agguguuguuucugguau

SEQ ID NO: 2716599 - RNA, 20 nt, Haemophilus influenzae Rd
agguuaauaguuguuuguga

SEQ ID NO: 2716600 - RNA, 16 nt, Haemophilus influenzae Rd
agguuagaauaaacca

SEQ ID NO: 2716601 - RNA, 11 nt, Haemophilus influenzae Rd
agguucauuaa

SEQ ID NO: 2716602 - RNA, 22 nt, Haemophilus influenzae Rd
agguucgucaucuucauuaaac

SEQ ID NO: 2716603 - RNA, 22 nt, Haemophilus influenzae Rd
agguugcgguaaaucuacuuua

SEQ ID NO: 2716604 - RNA, 17 nt, Haemophilus influenzae Rd
agguugcuaugcccaag

SEQ ID NO: 2716605 - RNA, 18 nt, Haemophilus influenzae Rd
agguugcugauaaagaua

SEQ ID NO: 2716606 - RNA, 15 nt, Haemophilus influenzae Rd
agguuggcaauaaac

SEQ ID NO: 2716607 - RNA, 21 nt, Haemophilus influenzae Rd
agguuggccuguuggaauuuc

SEQ ID NO: 2716608 - RNA, 20 nt, Haemophilus influenzae Rd
agguuuaguggguaaaccaa

SEQ ID NO: 2716609 - RNA, 17 nt, Haemophilus influenzae Rd
agguuucuaaaugaaua

SEQ ID NO: 2716610 - RNA, 20 nt, Haemophilus influenzae Rd
agguuucuaaaugaauaaaa

SEQ ID NO: 2716611 - RNA, 21 nt, Haemophilus influenzae Rd
agguuuuucuuuuaauuuuua

SEQ ID NO: 2716612 - RNA, 13 nt, Haemophilus influenzae Rd
agguuuuuuagau

SEQ ID NO: 2716613 - RNA, 18 nt, Haemophilus influenzae Rd
aguaaaaagaaaagugcg

SEQ ID NO: 2716614 - RNA, 22 nt, Haemophilus influenzae Rd
aguaaaaagucaaugaacuuau

SEQ ID NO: 2716615 - RNA, 15 nt, Haemophilus influenzae Rd
aguaaaaauaaaaug

SEQ ID NO: 2716616 - RNA, 19 nt, Haemophilus influenzae Rd
aguaaaacuugcaaaccaa

SEQ ID NO: 2716617 - RNA, 11 nt, Haemophilus influenzae Rd
aguaaaauacg

SEQ ID NO: 2716618 - RNA, 15 nt, Haemophilus influenzae Rd
aguaaaauagucacu

SEQ ID NO: 2716619 - RNA, 13 nt, Haemophilus influenzae Rd
aguaaaauauagc

SEQ ID NO: 2716620 - RNA, 19 nt, Haemophilus influenzae Rd
aguaaacacuuaaauaguu

SEQ ID NO: 2716621 - RNA, 17 nt, Haemophilus influenzae Rd
aguaaaccacaauacuu

SEQ ID NO: 2716622 - RNA, 18 nt, Haemophilus influenzae Rd
aguaaaccgugguuuaaa

SEQ ID NO: 2716623 - RNA, 11 nt, Haemophilus influenzae Rd
aguaaauaauu

SEQ ID NO: 2716624 - RNA, 20 nt, Haemophilus influenzae Rd
aguaaauagcucaacgcuuu

SEQ ID NO: 2716625 - RNA, 13 nt, Haemophilus influenzae Rd
aguaaauauuuuu

SEQ ID NO: 2716626 - RNA, 14 nt, Haemophilus influenzae Rd
aguaaauauuuuuu

SEQ ID NO: 2716627 - RNA, 20 nt, Haemophilus influenzae Rd
aguaaaugcgcuuuuaauuu

SEQ ID NO: 2716628 - RNA, 12 nt, Haemophilus influenzae Rd
aguaaaugcuga

SEQ ID NO: 2716629 - RNA, 14 nt, Haemophilus influenzae Rd
aguaaauucaccaa

SEQ ID NO: 2716630 - RNA, 22 nt, Haemophilus influenzae Rd
aguaaauucaguuaagaaaaua

SEQ ID NO: 2716631 - RNA, 23 nt, Haemophilus influenzae Rd
aguaaauucaguuaagaaaauaa

SEQ ID NO: 2716632 - RNA, 14 nt, Haemophilus influenzae Rd
aguaaauuuaacaa

SEQ ID NO: 2716633 - RNA, 15 nt, Haemophilus influenzae Rd
aguaaauuuuaaaau

SEQ ID NO: 2716634 - RNA, 18 nt, Haemophilus influenzae Rd
aguaaauuuuuccacauu

SEQ ID NO: 2716635 - RNA, 12 nt, Haemophilus influenzae Rd
aguaacuuuaau

SEQ ID NO: 2716636 - RNA, 14 nt, Haemophilus influenzae Rd
aguaacuuucacaa

SEQ ID NO: 2716637 - RNA, 12 nt, Haemophilus influenzae Rd
aguaagaaacuu

SEQ ID NO: 2716638 - RNA, 14 nt, Haemophilus influenzae Rd
aguaagcauauuug

SEQ ID NO: 2716639 - RNA, 11 nt, Haemophilus influenzae Rd
aguaaggcacu

SEQ ID NO: 2716640 - RNA, 14 nt, Haemophilus influenzae Rd
aguaagguuauacu

SEQ ID NO: 2716641 - RNA, 18 nt, Haemophilus influenzae Rd
aguaaguaggcugaauac

SEQ ID NO: 2716642 - RNA, 18 nt, Haemophilus influenzae Rd
aguaagucgugaucugca

SEQ ID NO: 2716643 - RNA, 20 nt, Haemophilus influenzae Rd
aguaagucgugaucugcauc

SEQ ID NO: 2716644 - RNA, 17 nt, Haemophilus influenzae Rd
aguaaguuuuacaccaa

SEQ ID NO: 2716645 - RNA, 21 nt, Haemophilus influenzae Rd
aguaauaaggcuugcacaaua

SEQ ID NO: 2716646 - RNA, 19 nt, Haemophilus influenzae Rd
aguaauacaccaauaauua

SEQ ID NO: 2716647 - RNA, 22 nt, Haemophilus influenzae Rd
aguaauacaccaauaauuaaac

SEQ ID NO: 2716648 - RNA, 18 nt, Haemophilus influenzae Rd
aguaauaugauccgccuu

SEQ ID NO: 2716649 - RNA, 11 nt, Haemophilus influenzae Rd
aguaauauuuc

SEQ ID NO: 2716650 - RNA, 14 nt, Haemophilus influenzae Rd
aguaauauuucuug

SEQ ID NO: 2716651 - RNA, 16 nt, Haemophilus influenzae Rd
aguaauccaaguauaa

SEQ ID NO: 2716652 - RNA, 15 nt, Haemophilus influenzae Rd
aguaaucgccccaaa

SEQ ID NO: 2716653 - RNA, 16 nt, Haemophilus influenzae Rd
aguaaucuaauucuug

SEQ ID NO: 2716654 - RNA, 13 nt, Haemophilus influenzae Rd
aguaaugcuaaau

SEQ ID NO: 2716655 - RNA, 19 nt, Haemophilus influenzae Rd
aguaaugguuacuuuauca

SEQ ID NO: 2716656 - RNA, 22 nt, Haemophilus influenzae Rd
aguaaugguuacuuuaucacaa

SEQ ID NO: 2716657 - RNA, 12 nt, Haemophilus influenzae Rd
aguaauguucua

SEQ ID NO: 2716658 - RNA, 13 nt, Haemophilus influenzae Rd
aguaauguucuac

SEQ ID NO: 2716659 - RNA, 21 nt, Haemophilus influenzae Rd
aguaauguucuacguaauuua

SEQ ID NO: 2716660 - RNA, 22 nt, Haemophilus influenzae Rd
aguaauguucuacguaauuuaa

SEQ ID NO: 2716661 - RNA, 17 nt, Haemophilus influenzae Rd
aguaauucuuuuuguuc

SEQ ID NO: 2716662 - RNA, 13 nt, Haemophilus influenzae Rd
aguaauuuaaaaa

SEQ ID NO: 2716663 - RNA, 16 nt, Haemophilus influenzae Rd
aguaauuucauaucuu

SEQ ID NO: 2716664 - RNA, 13 nt, Haemophilus influenzae Rd
aguacaaaagagc

SEQ ID NO: 2716665 - RNA, 22 nt, Haemophilus influenzae Rd
aguacaauuaaauccaucaauu

SEQ ID NO: 2716666 - RNA, 18 nt, Haemophilus influenzae Rd
aguacaauuaauuaaaua

SEQ ID NO: 2716667 - RNA, 13 nt, Haemophilus influenzae Rd
aguacaucauuug

SEQ ID NO: 2716668 - RNA, 20 nt, Haemophilus influenzae Rd
aguacaucauuugcaauauc

SEQ ID NO: 2716669 - RNA, 22 nt, Haemophilus influenzae Rd
aguacauuauugaauuugguaa

SEQ ID NO: 2716670 - RNA, 18 nt, Haemophilus influenzae Rd
aguacgaauuaagcgaac

SEQ ID NO: 2716671 - RNA, 20 nt, Haemophilus influenzae Rd
aguacgacaucuuaaauuau

SEQ ID NO: 2716672 - RNA, 15 nt, Haemophilus influenzae Rd
aguacuuucacaccc

SEQ ID NO: 2716673 - RNA, 14 nt, Haemophilus influenzae Rd
aguagaaaucacaa

SEQ ID NO: 2716674 - RNA, 17 nt, Haemophilus influenzae Rd
aguagaaaucacaauaa

SEQ ID NO: 2716675 - RNA, 19 nt, Haemophilus influenzae Rd
aguagauaacaaaagugcg

SEQ ID NO: 2716676 - RNA, 16 nt, Haemophilus influenzae Rd
aguagauuuuuauuca

SEQ ID NO: 2716677 - RNA, 18 nt, Haemophilus influenzae Rd
aguagauuuuuauucaau

SEQ ID NO: 2716678 - RNA, 14 nt, Haemophilus influenzae Rd
aguagccuauaacg

SEQ ID NO: 2716679 - RNA, 18 nt, Haemophilus influenzae Rd
aguaguagcguaaaucaa

SEQ ID NO: 2716680 - RNA, 22 nt, Haemophilus influenzae Rd
aguaguggugguggaauaaaua

SEQ ID NO: 2716681 - RNA, 13 nt, Haemophilus influenzae Rd
aguaguguuuuau

SEQ ID NO: 2716682 - RNA, 14 nt, Haemophilus influenzae Rd
aguauaaaccgcau

SEQ ID NO: 2716683 - RNA, 14 nt, Haemophilus influenzae Rd
aguauaaacuuuau

SEQ ID NO: 2716684 - RNA, 23 nt, Haemophilus influenzae Rd
aguauaacguagcgauaaaauau

SEQ ID NO: 2716685 - RNA, 17 nt, Haemophilus influenzae Rd
aguauaacuaauuaaga

SEQ ID NO: 2716686 - RNA, 16 nt, Haemophilus influenzae Rd
aguauagcuuuuugca

SEQ ID NO: 2716687 - RNA, 19 nt, Haemophilus influenzae Rd
aguauagggaauaaaaaag

SEQ ID NO: 2716688 - RNA, 23 nt, Haemophilus influenzae Rd
aguauaucgaauuaaagaaaaac

SEQ ID NO: 2716689 - RNA, 17 nt, Haemophilus influenzae Rd
aguaucaaaacuugcua

SEQ ID NO: 2716690 - RNA, 14 nt, Haemophilus influenzae Rd
aguaucaaauacac

SEQ ID NO: 2716691 - RNA, 22 nt, Haemophilus influenzae Rd
aguaucaaauacacaaaucaca

SEQ ID NO: 2716692 - RNA, 22 nt, Haemophilus influenzae Rd
aguaucacgcacaccaccugau

SEQ ID NO: 2716693 - RNA, 22 nt, Haemophilus influenzae Rd
aguaucagauuuaggcaauaaa

SEQ ID NO: 2716694 - RNA, 21 nt, Haemophilus influenzae Rd
aguaucuugcuuuuuuaauca

SEQ ID NO: 2716695 - RNA, 15 nt, Haemophilus influenzae Rd
aguaugccauaaaau

SEQ ID NO: 2716696 - RNA, 16 nt, Haemophilus influenzae Rd
aguaugccauaaaaua

SEQ ID NO: 2716697 - RNA, 13 nt, Haemophilus influenzae Rd
aguauguugcuuu

SEQ ID NO: 2716698 - RNA, 13 nt, Haemophilus influenzae Rd
aguauguuuugau

SEQ ID NO: 2716699 - RNA, 17 nt, Haemophilus influenzae Rd
aguauuaaauuuuuaau

SEQ ID NO: 2716700 - RNA, 20 nt, Haemophilus influenzae Rd
aguauucagugccuaaauuu

SEQ ID NO: 2716701 - RNA, 21 nt, Haemophilus influenzae Rd
aguauucauauaauucauuag

SEQ ID NO: 2716702 - RNA, 17 nt, Haemophilus influenzae Rd
aguauuuaagcugaaau

SEQ ID NO: 2716703 - RNA, 18 nt, Haemophilus influenzae Rd
aguauuuagcggaauuuu

SEQ ID NO: 2716704 - RNA, 20 nt, Haemophilus influenzae Rd
aguauuuuauuuaagcuuuc

SEQ ID NO: 2716705 - RNA, 18 nt, Haemophilus influenzae Rd
aguauuuuccuucugcca

SEQ ID NO: 2716706 - RNA, 19 nt, Haemophilus influenzae Rd
aguauuuugcagaauacug

SEQ ID NO: 2716707 - RNA, 18 nt, Haemophilus influenzae Rd
agucaaaaaugugguugc

SEQ ID NO: 2716708 - RNA, 14 nt, Haemophilus influenzae Rd
agucaaauaacccu

SEQ ID NO: 2716709 - RNA, 20 nt, Haemophilus influenzae Rd
agucaagguugcaacaucaa

SEQ ID NO: 2716710 - RNA, 22 nt, Haemophilus influenzae Rd
agucacuucaggguuuucauca

SEQ ID NO: 2716711 - RNA, 15 nt, Haemophilus influenzae Rd
agucagcauaaacaa

SEQ ID NO: 2716712 - RNA, 19 nt, Haemophilus influenzae Rd
agucagcauaaacaaaaua

SEQ ID NO: 2716713 - RNA, 20 nt, Haemophilus influenzae Rd
agucagcauaaacaaaauaa

SEQ ID NO: 2716714 - RNA, 15 nt, Haemophilus influenzae Rd
agucagcgcagcaau

SEQ ID NO: 2716715 - RNA, 18 nt, Haemophilus influenzae Rd
agucagcgcagcaauuaa

SEQ ID NO: 2716716 - RNA, 14 nt, Haemophilus influenzae Rd
agucagcucaagca

SEQ ID NO: 2716717 - RNA, 18 nt, Haemophilus influenzae Rd
agucauauugauuucucu

SEQ ID NO: 2716718 - RNA, 20 nt, Haemophilus influenzae Rd
agucaucuaauugauucaaa

SEQ ID NO: 2716719 - RNA, 20 nt, Haemophilus influenzae Rd
agucauucaaugcagaaaua

SEQ ID NO: 2716720 - RNA, 13 nt, Haemophilus influenzae Rd
agucauugauuua

SEQ ID NO: 2716721 - RNA, 15 nt, Haemophilus influenzae Rd
agucauuuuuuacau

SEQ ID NO: 2716722 - RNA, 20 nt, Haemophilus influenzae Rd
aguccaaguuuuuuaucuuu

SEQ ID NO: 2716723 - RNA, 23 nt, Haemophilus influenzae Rd
aguccacuguauauuguuugcuu

SEQ ID NO: 2716724 - RNA, 20 nt, Haemophilus influenzae Rd
aguccccauaucucugccau

SEQ ID NO: 2716725 - RNA, 22 nt, Haemophilus influenzae Rd
agucccuguucaaauucugcuu

SEQ ID NO: 2716726 - RNA, 21 nt, Haemophilus influenzae Rd
aguccgauccauacaguaaaa

SEQ ID NO: 2716727 - RNA, 23 nt, Haemophilus influenzae Rd
aguccgauccauacaguaaaaau

SEQ ID NO: 2716728 - RNA, 16 nt, Haemophilus influenzae Rd
aguccugcagccgcca

SEQ ID NO: 2716729 - RNA, 11 nt, Haemophilus influenzae Rd
aguccuucugc

SEQ ID NO: 2716730 - RNA, 20 nt, Haemophilus influenzae Rd
aguccuuuuaguuuccccug

SEQ ID NO: 2716731 - RNA, 14 nt, Haemophilus influenzae Rd
agucgaaaucauaa

SEQ ID NO: 2716732 - RNA, 23 nt, Haemophilus influenzae Rd
agucgaugccaagggcugaagcu

SEQ ID NO: 2716733 - RNA, 15 nt, Haemophilus influenzae Rd
agucgauucaaauaa

SEQ ID NO: 2716734 - RNA, 16 nt, Haemophilus influenzae Rd
agucgauucaaauaac

SEQ ID NO: 2716735 - RNA, 15 nt, Haemophilus influenzae Rd
agucgcuaauuuuuu

SEQ ID NO: 2716736 - RNA, 15 nt, Haemophilus influenzae Rd
agucgcuuucaacac

SEQ ID NO: 2716737 - RNA, 20 nt, Haemophilus influenzae Rd
agucguucuugaugauaauc

SEQ ID NO: 2716738 - RNA, 23 nt, Haemophilus influenzae Rd
agucguuuaaccacguauuuuuu

SEQ ID NO: 2716739 - RNA, 18 nt, Haemophilus influenzae Rd
agucuacaagaaaccaaa

SEQ ID NO: 2716740 - RNA, 20 nt, Haemophilus influenzae Rd
agucuaguaacuguucgguu

SEQ ID NO: 2716741 - RNA, 15 nt, Haemophilus influenzae Rd
agucuauaaaagaag

SEQ ID NO: 2716742 - RNA, 13 nt, Haemophilus influenzae Rd
agucuauuauaaa

SEQ ID NO: 2716743 - RNA, 18 nt, Haemophilus influenzae Rd
agucucaaauuuuucaca

SEQ ID NO: 2716744 - RNA, 22 nt, Haemophilus influenzae Rd
agucucuaugauuuuuuugccu

SEQ ID NO: 2716745 - RNA, 22 nt, Haemophilus influenzae Rd
agucucuuuauuuuuucaucau

SEQ ID NO: 2716746 - RNA, 22 nt, Haemophilus influenzae Rd
agucucuuuugaggcuaauaau

SEQ ID NO: 2716747 - RNA, 19 nt, Haemophilus influenzae Rd
agucugcacgggaaaucca

SEQ ID NO: 2716748 - RNA, 21 nt, Haemophilus influenzae Rd
agucugcacgggaaauccagc

SEQ ID NO: 2716749 - RNA, 21 nt, Haemophilus influenzae Rd
agucugcgccuaaaauauuuu

SEQ ID NO: 2716750 - RNA, 12 nt, Haemophilus influenzae Rd
agucugcuaaug

SEQ ID NO: 2716751 - RNA, 16 nt, Haemophilus influenzae Rd
agucugcugaaauaca

SEQ ID NO: 2716752 - RNA, 14 nt, Haemophilus influenzae Rd
agucuuaauuuguu

SEQ ID NO: 2716753 - RNA, 13 nt, Haemophilus influenzae Rd
agucuucauaguu

SEQ ID NO: 2716754 - RNA, 12 nt, Haemophilus influenzae Rd
agucuucaucuu

SEQ ID NO: 2716755 - RNA, 21 nt, Haemophilus influenzae Rd
agucuugccaacgcagguaca

SEQ ID NO: 2716756 - RNA, 16 nt, Haemophilus influenzae Rd
agucuugcuuuuuaau

SEQ ID NO: 2716757 - RNA, 22 nt, Haemophilus influenzae Rd
agucuuuuuaauuuaaauaaag

SEQ ID NO: 2716758 - RNA, 13 nt, Haemophilus influenzae Rd
agugaaaagaaaa

SEQ ID NO: 2716759 - RNA, 14 nt, Haemophilus influenzae Rd
agugaaaagaaaac

SEQ ID NO: 2716760 - RNA, 21 nt, Haemophilus influenzae Rd
agugaaaagaaaacuuauaaa

SEQ ID NO: 2716761 - RNA, 17 nt, Haemophilus influenzae Rd
agugaaaccaaagaguu

SEQ ID NO: 2716762 - RNA, 21 nt, Haemophilus influenzae Rd
agugaaaccaaagaguuugaa

SEQ ID NO: 2716763 - RNA, 13 nt, Haemophilus influenzae Rd
agugaaagauaaa

SEQ ID NO: 2716764 - RNA, 20 nt, Haemophilus influenzae Rd
agugaaaugcucuaaauccc

SEQ ID NO: 2716765 - RNA, 20 nt, Haemophilus influenzae Rd
agugaaugaugccauuuuuu

SEQ ID NO: 2716766 - RNA, 22 nt, Haemophilus influenzae Rd
agugagaaaguuaaucaaacuu

SEQ ID NO: 2716767 - RNA, 14 nt, Haemophilus influenzae Rd
agugagauaaaugg

SEQ ID NO: 2716768 - RNA, 22 nt, Haemophilus influenzae Rd
agugaguacccgugccuaauuc

SEQ ID NO: 2716769 - RNA, 23 nt, Haemophilus influenzae Rd
agugaguugauuuaaauugaaaa

SEQ ID NO: 2716770 - RNA, 21 nt, Haemophilus influenzae Rd
agugauagcugugguaaauaa

SEQ ID NO: 2716771 - RNA, 22 nt, Haemophilus influenzae Rd
agugauauccgcuuuuaaaaua

SEQ ID NO: 2716772 - RNA, 21 nt, Haemophilus influenzae Rd
agugaucuugauccccauaca

SEQ ID NO: 2716773 - RNA, 21 nt, Haemophilus influenzae Rd
agugaugaugguguucugguu

SEQ ID NO: 2716774 - RNA, 18 nt, Haemophilus influenzae Rd
agugauguaaauuuucag

SEQ ID NO: 2716775 - RNA, 12 nt, Haemophilus influenzae Rd
agugauuauuua

SEQ ID NO: 2716776 - RNA, 20 nt, Haemophilus influenzae Rd
agugauugcgccgaauaaac

SEQ ID NO: 2716777 - RNA, 23 nt, Haemophilus influenzae Rd
agugauuucuauguuauuaaaau

SEQ ID NO: 2716778 - RNA, 18 nt, Haemophilus influenzae Rd
agugauuuuaaaucccaa

SEQ ID NO: 2716779 - RNA, 19 nt, Haemophilus influenzae Rd
agugauuuuaaaucccaau

SEQ ID NO: 2716780 - RNA, 16 nt, Haemophilus influenzae Rd
agugcaacaacaaagu

SEQ ID NO: 2716781 - RNA, 21 nt, Haemophilus influenzae Rd
agugcaagccccugaagccaa

SEQ ID NO: 2716782 - RNA, 18 nt, Haemophilus influenzae Rd
agugcagaucgcuauuua

SEQ ID NO: 2716783 - RNA, 15 nt, Haemophilus influenzae Rd
agugcagauuuuuau

SEQ ID NO: 2716784 - RNA, 17 nt, Haemophilus influenzae Rd
agugcagcccaaauaaa

SEQ ID NO: 2716785 - RNA, 18 nt, Haemophilus influenzae Rd
agugcagcccaaauaaag

SEQ ID NO: 2716786 - RNA, 19 nt, Haemophilus influenzae Rd
agugcagcccaaauaaaga

SEQ ID NO: 2716787 - RNA, 17 nt, Haemophilus influenzae Rd
agugcaguuucaguauc

SEQ ID NO: 2716788 - RNA, 15 nt, Haemophilus influenzae Rd
agugcggaaaauuuu

SEQ ID NO: 2716789 - RNA, 14 nt, Haemophilus influenzae Rd
agugcggagaaaau

SEQ ID NO: 2716790 - RNA, 18 nt, Haemophilus influenzae Rd
agugcggcaaaaaauggc

SEQ ID NO: 2716791 - RNA, 17 nt, Haemophilus influenzae Rd
agugcggcaaagguuuu

SEQ ID NO: 2716792 - RNA, 18 nt, Haemophilus influenzae Rd
agugcgguaaaaauuaac

SEQ ID NO: 2716793 - RNA, 18 nt, Haemophilus influenzae Rd
agugcgguaaaaauuucu

SEQ ID NO: 2716794 - RNA, 17 nt, Haemophilus influenzae Rd
agugcgguaaaauuuca

SEQ ID NO: 2716795 - RNA, 17 nt, Haemophilus influenzae Rd
agugcgguaaaauuuuu

SEQ ID NO: 2716796 - RNA, 19 nt, Haemophilus influenzae Rd
agugcgguaaaauuuuucu

SEQ ID NO: 2716797 - RNA, 17 nt, Haemophilus influenzae Rd
agugcgguaaauuuuua

SEQ ID NO: 2716798 - RNA, 16 nt, Haemophilus influenzae Rd
agugcgguaauuuuua

SEQ ID NO: 2716799 - RNA, 15 nt, Haemophilus influenzae Rd
agugcggucaacaua

SEQ ID NO: 2716800 - RNA, 17 nt, Haemophilus influenzae Rd
agugcggucaauuuuuc

SEQ ID NO: 2716801 - RNA, 17 nt, Haemophilus influenzae Rd
agugcggucauuuuuca

SEQ ID NO: 2716802 - RNA, 21 nt, Haemophilus influenzae Rd
agugcggugaaauuucaccgc

SEQ ID NO: 2716803 - RNA, 22 nt, Haemophilus influenzae Rd
agugcggugcaauuugaaaaga

SEQ ID NO: 2716804 - RNA, 13 nt, Haemophilus influenzae Rd
agugcgguuaaaa

SEQ ID NO: 2716805 - RNA, 21 nt, Haemophilus influenzae Rd
agugcgguuaaaauucaccgc

SEQ ID NO: 2716806 - RNA, 22 nt, Haemophilus influenzae Rd
agugcgguuaaauauuucagua

SEQ ID NO: 2716807 - RNA, 14 nt, Haemophilus influenzae Rd
agugcgguuaaauu

SEQ ID NO: 2716808 - RNA, 16 nt, Haemophilus influenzae Rd
agugcgguuaauuuuu

SEQ ID NO: 2716809 - RNA, 17 nt, Haemophilus influenzae Rd
agugcgguuaauuuuuu

SEQ ID NO: 2716810 - RNA, 15 nt, Haemophilus influenzae Rd
agugcgguugaaaaa

SEQ ID NO: 2716811 - RNA, 17 nt, Haemophilus influenzae Rd
agugcgguugauuuucc

SEQ ID NO: 2716812 - RNA, 16 nt, Haemophilus influenzae Rd
agugcuaaaauaaaac

SEQ ID NO: 2716813 - RNA, 16 nt, Haemophilus influenzae Rd
agugcuguacacacac

SEQ ID NO: 2716814 - RNA, 13 nt, Haemophilus influenzae Rd
agugcuuuaccug

SEQ ID NO: 2716815 - RNA, 15 nt, Haemophilus influenzae Rd
agugcuuucauagau

SEQ ID NO: 2716816 - RNA, 19 nt, Haemophilus influenzae Rd
aguggagaaacauuuuucc

SEQ ID NO: 2716817 - RNA, 15 nt, Haemophilus influenzae Rd
aguggauagaugauc

SEQ ID NO: 2716818 - RNA, 16 nt, Haemophilus influenzae Rd
aguggaugaccaacac

SEQ ID NO: 2716819 - RNA, 17 nt, Haemophilus influenzae Rd
aguggcaauaacuacaa

SEQ ID NO: 2716820 - RNA, 15 nt, Haemophilus influenzae Rd
aguggcauaaagaaa

SEQ ID NO: 2716821 - RNA, 22 nt, Haemophilus influenzae Rd
aguggcggcguauugggcggau

SEQ ID NO: 2716822 - RNA, 13 nt, Haemophilus influenzae Rd
aguggcuuuaaag

SEQ ID NO: 2716823 - RNA, 13 nt, Haemophilus influenzae Rd
aguggguaaacca

SEQ ID NO: 2716824 - RNA, 16 nt, Haemophilus influenzae Rd
aguggguaaaccaaac

SEQ ID NO: 2716825 - RNA, 22 nt, Haemophilus influenzae Rd
agugguccugucaguuugcuuu

SEQ ID NO: 2716826 - RNA, 17 nt, Haemophilus influenzae Rd
agugguggaauaaaagu

SEQ ID NO: 2716827 - RNA, 21 nt, Haemophilus influenzae Rd
agugguggaauaaaagucagu

SEQ ID NO: 2716828 - RNA, 20 nt, Haemophilus influenzae Rd
aguggugggucgugaaggau

SEQ ID NO: 2716829 - RNA, 21 nt, Haemophilus influenzae Rd
aguggugguggaauaaauaac

SEQ ID NO: 2716830 - RNA, 15 nt, Haemophilus influenzae Rd
agugguucagauuuc

SEQ ID NO: 2716831 - RNA, 13 nt, Haemophilus influenzae Rd
agugguuuauuuu

SEQ ID NO: 2716832 - RNA, 13 nt, Haemophilus influenzae Rd
aguguaauguuuu

SEQ ID NO: 2716833 - RNA, 13 nt, Haemophilus influenzae Rd
aguguauaaauau

SEQ ID NO: 2716834 - RNA, 23 nt, Haemophilus influenzae Rd
aguguauaacaaauaggauaaaa

SEQ ID NO: 2716835 - RNA, 19 nt, Haemophilus influenzae Rd
aguguggcuuuuuuuccuu

SEQ ID NO: 2716836 - RNA, 18 nt, Haemophilus influenzae Rd
aguguugcagggaaaguc

SEQ ID NO: 2716837 - RNA, 15 nt, Haemophilus influenzae Rd
aguguugcuuugcca

SEQ ID NO: 2716838 - RNA, 22 nt, Haemophilus influenzae Rd
aguguuuccgugauuucuuucg

SEQ ID NO: 2716839 - RNA, 17 nt, Haemophilus influenzae Rd
aguguuuuauuuaucag

SEQ ID NO: 2716840 - RNA, 18 nt, Haemophilus influenzae Rd
aguuaaacagcuuuccug

SEQ ID NO: 2716841 - RNA, 14 nt, Haemophilus influenzae Rd
aguuaaacaucgca

SEQ ID NO: 2716842 - RNA, 12 nt, Haemophilus influenzae Rd
aguuaaaccaaa

SEQ ID NO: 2716843 - RNA, 23 nt, Haemophilus influenzae Rd
aguuaaaccaaauuuugaugaaa

SEQ ID NO: 2716844 - RNA, 20 nt, Haemophilus influenzae Rd
aguuaagcuaccugccauaa

SEQ ID NO: 2716845 - RNA, 20 nt, Haemophilus influenzae Rd
aguuaauccuaaauuaugcu

SEQ ID NO: 2716846 - RNA, 13 nt, Haemophilus influenzae Rd
aguuaaucgaaaa

SEQ ID NO: 2716847 - RNA, 16 nt, Haemophilus influenzae Rd
aguuaaugcaguuuug

SEQ ID NO: 2716848 - RNA, 19 nt, Haemophilus influenzae Rd
aguuaauuauuuuaaauaa

SEQ ID NO: 2716849 - RNA, 17 nt, Haemophilus influenzae Rd
aguuacaaacaaucuua

SEQ ID NO: 2716850 - RNA, 18 nt, Haemophilus influenzae Rd
aguuaccgcuucuuccug

SEQ ID NO: 2716851 - RNA, 23 nt, Haemophilus influenzae Rd
aguuacgagguugaucuacauca

SEQ ID NO: 2716852 - RNA, 20 nt, Haemophilus influenzae Rd
aguuacgauuguauuuuaaa

SEQ ID NO: 2716853 - RNA, 14 nt, Haemophilus influenzae Rd
aguuacguuuagua

SEQ ID NO: 2716854 - RNA, 21 nt, Haemophilus influenzae Rd
aguuacucuuggauuaguggu

SEQ ID NO: 2716855 - RNA, 20 nt, Haemophilus influenzae Rd
aguuacuuauuuagcaagcg

SEQ ID NO: 2716856 - RNA, 14 nt, Haemophilus influenzae Rd
aguuacuuugcauu

SEQ ID NO: 2716857 - RNA, 16 nt, Haemophilus influenzae Rd
aguuagaaacagaagu

SEQ ID NO: 2716858 - RNA, 16 nt, Haemophilus influenzae Rd
aguuagaccaucuaaa

SEQ ID NO: 2716859 - RNA, 20 nt, Haemophilus influenzae Rd
aguuagacugauuuaguuca

SEQ ID NO: 2716860 - RNA, 22 nt, Haemophilus influenzae Rd
aguuagauugaacguuuaacuu

SEQ ID NO: 2716861 - RNA, 19 nt, Haemophilus influenzae Rd
aguuaguacgcuuaacuaa

SEQ ID NO: 2716862 - RNA, 13 nt, Haemophilus influenzae Rd
aguuaguuuuuua

SEQ ID NO: 2716863 - RNA, 14 nt, Haemophilus influenzae Rd
aguuauaaacccau

SEQ ID NO: 2716864 - RNA, 22 nt, Haemophilus influenzae Rd
aguuauaaacccaucauaaaua

SEQ ID NO: 2716865 - RNA, 20 nt, Haemophilus influenzae Rd
aguuauaauaaccauacaac

SEQ ID NO: 2716866 - RNA, 12 nt, Haemophilus influenzae Rd
aguuaucauuug

SEQ ID NO: 2716867 - RNA, 21 nt, Haemophilus influenzae Rd
aguuaugggcugacauaaaua

SEQ ID NO: 2716868 - RNA, 16 nt, Haemophilus influenzae Rd
aguuauugauaaaaau

SEQ ID NO: 2716869 - RNA, 15 nt, Haemophilus influenzae Rd
aguuauuuauuuaag

SEQ ID NO: 2716870 - RNA, 14 nt, Haemophilus influenzae Rd
aguuauuucuuuaa

SEQ ID NO: 2716871 - RNA, 16 nt, Haemophilus influenzae Rd
aguucaagugugugaa

SEQ ID NO: 2716872 - RNA, 19 nt, Haemophilus influenzae Rd
aguucacaaaucuaaaaau

SEQ ID NO: 2716873 - RNA, 23 nt, Haemophilus influenzae Rd
aguucacaaaucuaaaaauaugu

SEQ ID NO: 2716874 - RNA, 15 nt, Haemophilus influenzae Rd
aguucagaaagagac

SEQ ID NO: 2716875 - RNA, 23 nt, Haemophilus influenzae Rd
aguucagaaagagacucuguucc

SEQ ID NO: 2716876 - RNA, 17 nt, Haemophilus influenzae Rd
aguucagcgauuuuaac

SEQ ID NO: 2716877 - RNA, 18 nt, Haemophilus influenzae Rd
aguucagcgauuuuaacu

SEQ ID NO: 2716878 - RNA, 19 nt, Haemophilus influenzae Rd
aguucauaagcucgaaguu

SEQ ID NO: 2716879 - RNA, 20 nt, Haemophilus influenzae Rd
aguucauuuucacugauaua

SEQ ID NO: 2716880 - RNA, 23 nt, Haemophilus influenzae Rd
aguuccaccacccuucuuucaaa

SEQ ID NO: 2716881 - RNA, 15 nt, Haemophilus influenzae Rd
aguucgguuugcucg

SEQ ID NO: 2716882 - RNA, 17 nt, Haemophilus influenzae Rd
aguucguuuuuuccagc

SEQ ID NO: 2716883 - RNA, 15 nt, Haemophilus influenzae Rd
aguucuaaaauuaua

SEQ ID NO: 2716884 - RNA, 15 nt, Haemophilus influenzae Rd
aguucuaauucauuu

SEQ ID NO: 2716885 - RNA, 19 nt, Haemophilus influenzae Rd
aguucuacccauucaaaug

SEQ ID NO: 2716886 - RNA, 19 nt, Haemophilus influenzae Rd
aguucucaaaaaguuaaau

SEQ ID NO: 2716887 - RNA, 21 nt, Haemophilus influenzae Rd
aguucucguugcaucuucuau

SEQ ID NO: 2716888 - RNA, 14 nt, Haemophilus influenzae Rd
aguucuguaauuca

SEQ ID NO: 2716889 - RNA, 13 nt, Haemophilus influenzae Rd
aguucuuccccuc

SEQ ID NO: 2716890 - RNA, 22 nt, Haemophilus influenzae Rd
aguucuuucugucaucacaucu

SEQ ID NO: 2716891 - RNA, 16 nt, Haemophilus influenzae Rd
aguucuuuuuuggcuu

SEQ ID NO: 2716892 - RNA, 19 nt, Haemophilus influenzae Rd
aguugaagagaauuuucau

SEQ ID NO: 2716893 - RNA, 22 nt, Haemophilus influenzae Rd
aguugaagagaauuuucaucaa

SEQ ID NO: 2716894 - RNA, 18 nt, Haemophilus influenzae Rd
aguugagaauuuuuucuu

SEQ ID NO: 2716895 - RNA, 17 nt, Haemophilus influenzae Rd
aguugagcuaaagugcg

SEQ ID NO: 2716896 - RNA, 18 nt, Haemophilus influenzae Rd
aguugagcuaaagugcgg

SEQ ID NO: 2716897 - RNA, 13 nt, Haemophilus influenzae Rd
aguugcagauuua

SEQ ID NO: 2716898 - RNA, 19 nt, Haemophilus influenzae Rd
aguugcauaacuucaccaa

SEQ ID NO: 2716899 - RNA, 16 nt, Haemophilus influenzae Rd
aguugcauaagcaaaa

SEQ ID NO: 2716900 - RNA, 20 nt, Haemophilus influenzae Rd
aguugcgguggugaaaaucu

SEQ ID NO: 2716901 - RNA, 20 nt, Haemophilus influenzae Rd
aguugcuaaaucaccuaaau

SEQ ID NO: 2716902 - RNA, 15 nt, Haemophilus influenzae Rd
aguugcugaauaucc

SEQ ID NO: 2716903 - RNA, 13 nt, Haemophilus influenzae Rd
aguugcuucgcca

SEQ ID NO: 2716904 - RNA, 19 nt, Haemophilus influenzae Rd
aguuggaaccaccccauuu

SEQ ID NO: 2716905 - RNA, 19 nt, Haemophilus influenzae Rd
aguuggacuaaacaacuaa

SEQ ID NO: 2716906 - RNA, 14 nt, Haemophilus influenzae Rd
aguuggauuaaaca

SEQ ID NO: 2716907 - RNA, 20 nt, Haemophilus influenzae Rd
aguuggauucauuaaguuuu

SEQ ID NO: 2716908 - RNA, 20 nt, Haemophilus influenzae Rd
aguuggccaauuugcauaug

SEQ ID NO: 2716909 - RNA, 20 nt, Haemophilus influenzae Rd
aguugggcuuauuuguuuua

SEQ ID NO: 2716910 - RNA, 15 nt, Haemophilus influenzae Rd
aguuggguaaucaaa

SEQ ID NO: 2716911 - RNA, 15 nt, Haemophilus influenzae Rd
aguuggguuaaauau

SEQ ID NO: 2716912 - RNA, 23 nt, Haemophilus influenzae Rd
aguugguugcacuuggguaaaua

SEQ ID NO: 2716913 - RNA, 14 nt, Haemophilus influenzae Rd
aguugguuuugcaa

SEQ ID NO: 2716914 - RNA, 14 nt, Haemophilus influenzae Rd
aguuguaaaagugc

SEQ ID NO: 2716915 - RNA, 14 nt, Haemophilus influenzae Rd
aguuguacuauuuu

SEQ ID NO: 2716916 - RNA, 22 nt, Haemophilus influenzae Rd
aguuguaggauguucaaguaaa

SEQ ID NO: 2716917 - RNA, 19 nt, Haemophilus influenzae Rd
aguugucccgcauauaaaa

SEQ ID NO: 2716918 - RNA, 21 nt, Haemophilus influenzae Rd
aguugucccgcauauaaaaua

SEQ ID NO: 2716919 - RNA, 23 nt, Haemophilus influenzae Rd
aguugugaguaaaccacaauacu

SEQ ID NO: 2716920 - RNA, 23 nt, Haemophilus influenzae Rd
aguugugauuuucagcaaaaugc

SEQ ID NO: 2716921 - RNA, 12 nt, Haemophilus influenzae Rd
aguugugccaau

SEQ ID NO: 2716922 - RNA, 12 nt, Haemophilus influenzae Rd
aguuguuuaaaa

SEQ ID NO: 2716923 - RNA, 16 nt, Haemophilus influenzae Rd
aguuguuuaaaauuag

SEQ ID NO: 2716924 - RNA, 17 nt, Haemophilus influenzae Rd
aguuguuuaaaauuagu

SEQ ID NO: 2716925 - RNA, 14 nt, Haemophilus influenzae Rd
aguuguuucaccau

SEQ ID NO: 2716926 - RNA, 20 nt, Haemophilus influenzae Rd
aguuguuucaccauuuccuu

SEQ ID NO: 2716927 - RNA, 13 nt, Haemophilus influenzae Rd
aguuguuugugaa

SEQ ID NO: 2716928 - RNA, 15 nt, Haemophilus influenzae Rd
aguuguuuuucuucc

SEQ ID NO: 2716929 - RNA, 23 nt, Haemophilus influenzae Rd
aguuguuuuuucaguuguuugaa

SEQ ID NO: 2716930 - RNA, 14 nt, Haemophilus influenzae Rd
aguuuaauucuucg

SEQ ID NO: 2716931 - RNA, 21 nt, Haemophilus influenzae Rd
aguuuaguccuuaauuuaauu

SEQ ID NO: 2716932 - RNA, 22 nt, Haemophilus influenzae Rd
aguuuagucuuuuuaauuuaaa

SEQ ID NO: 2716933 - RNA, 13 nt, Haemophilus influenzae Rd
aguuuaguuuaau

SEQ ID NO: 2716934 - RNA, 13 nt, Haemophilus influenzae Rd
aguuuauaaaaaa

SEQ ID NO: 2716935 - RNA, 13 nt, Haemophilus influenzae Rd
aguuuaucucuuu

SEQ ID NO: 2716936 - RNA, 16 nt, Haemophilus influenzae Rd
aguuuaucucuuucuu

SEQ ID NO: 2716937 - RNA, 21 nt, Haemophilus influenzae Rd
aguuuaucucuuucuuaaaau

SEQ ID NO: 2716938 - RNA, 15 nt, Haemophilus influenzae Rd
aguuuauuaauuugc

SEQ ID NO: 2716939 - RNA, 15 nt, Haemophilus influenzae Rd
aguuuauucagugcu

SEQ ID NO: 2716940 - RNA, 12 nt, Haemophilus influenzae Rd
aguuucaagcac

SEQ ID NO: 2716941 - RNA, 21 nt, Haemophilus influenzae Rd
aguuucaagucguuauuuucu

SEQ ID NO: 2716942 - RNA, 21 nt, Haemophilus influenzae Rd
aguuucacucuaccaucuaaa

SEQ ID NO: 2716943 - RNA, 23 nt, Haemophilus influenzae Rd
aguuucacucuaccaucuaaagu

SEQ ID NO: 2716944 - RNA, 18 nt, Haemophilus influenzae Rd
aguuuccacguuuucaac

SEQ ID NO: 2716945 - RNA, 23 nt, Haemophilus influenzae Rd
aguuucgccagcaccacguucau

SEQ ID NO: 2716946 - RNA, 14 nt, Haemophilus influenzae Rd
aguuucuaauucuu

SEQ ID NO: 2716947 - RNA, 16 nt, Haemophilus influenzae Rd
aguuucuaauucuucc

SEQ ID NO: 2716948 - RNA, 17 nt, Haemophilus influenzae Rd
aguuucuaauucuucca

SEQ ID NO: 2716949 - RNA, 12 nt, Haemophilus influenzae Rd
aguuucugguuc

SEQ ID NO: 2716950 - RNA, 19 nt, Haemophilus influenzae Rd
aguuucugguuccauuacg

SEQ ID NO: 2716951 - RNA, 20 nt, Haemophilus influenzae Rd
aguuucuugggauuuugccg

SEQ ID NO: 2716952 - RNA, 14 nt, Haemophilus influenzae Rd
aguuucuuuuacau

SEQ ID NO: 2716953 - RNA, 15 nt, Haemophilus influenzae Rd
aguuugacuauucua

SEQ ID NO: 2716954 - RNA, 12 nt, Haemophilus influenzae Rd
aguuugcaacau

SEQ ID NO: 2716955 - RNA, 21 nt, Haemophilus influenzae Rd
aguuugccgccaaucccgauu

SEQ ID NO: 2716956 - RNA, 17 nt, Haemophilus influenzae Rd
aguuugcgaucaucacg

SEQ ID NO: 2716957 - RNA, 20 nt, Haemophilus influenzae Rd
aguuuggaaagaguaagcaa

SEQ ID NO: 2716958 - RNA, 18 nt, Haemophilus influenzae Rd
aguuuggcucuucuuuaa

SEQ ID NO: 2716959 - RNA, 16 nt, Haemophilus influenzae Rd
aguuuguaauccugca

SEQ ID NO: 2716960 - RNA, 22 nt, Haemophilus influenzae Rd
aguuuguagcgauauucuuuug

SEQ ID NO: 2716961 - RNA, 17 nt, Haemophilus influenzae Rd
aguuuguuucucaaguu

SEQ ID NO: 2716962 - RNA, 20 nt, Haemophilus influenzae Rd
aguuuguuugcugcaccaau

SEQ ID NO: 2716963 - RNA, 15 nt, Haemophilus influenzae Rd
aguuuuaagguuguu

SEQ ID NO: 2716964 - RNA, 18 nt, Haemophilus influenzae Rd
aguuuuacugauucuucg

SEQ ID NO: 2716965 - RNA, 20 nt, Haemophilus influenzae Rd
aguuuuacugauucuucgcc

SEQ ID NO: 2716966 - RNA, 18 nt, Haemophilus influenzae Rd
aguuuuagggaagauuaa

SEQ ID NO: 2716967 - RNA, 20 nt, Haemophilus influenzae Rd
aguuuuauaagcaaauuauu

SEQ ID NO: 2716968 - RNA, 16 nt, Haemophilus influenzae Rd
aguuuuaucuucaaaa

SEQ ID NO: 2716969 - RNA, 17 nt, Haemophilus influenzae Rd
aguuuuaugcugcaaaa

SEQ ID NO: 2716970 - RNA, 19 nt, Haemophilus influenzae Rd
aguuuuauuugagaaaaau

SEQ ID NO: 2716971 - RNA, 21 nt, Haemophilus influenzae Rd
aguuuuauuugagaaaaaugu

SEQ ID NO: 2716972 - RNA, 14 nt, Haemophilus influenzae Rd
aguuuuauuuucca

SEQ ID NO: 2716973 - RNA, 22 nt, Haemophilus influenzae Rd
aguuuucaauaucaaagaaaaa

SEQ ID NO: 2716974 - RNA, 12 nt, Haemophilus influenzae Rd
aguuuucacgcu

SEQ ID NO: 2716975 - RNA, 14 nt, Haemophilus influenzae Rd
aguuuucaucaaug

SEQ ID NO: 2716976 - RNA, 19 nt, Haemophilus influenzae Rd
aguuuucauuaaagaagaa

SEQ ID NO: 2716977 - RNA, 12 nt, Haemophilus influenzae Rd
aguuuucauuuu

SEQ ID NO: 2716978 - RNA, 21 nt, Haemophilus influenzae Rd
aguuuuccgacaacacuugcu

SEQ ID NO: 2716979 - RNA, 14 nt, Haemophilus influenzae Rd
aguuuuccuuucuu

SEQ ID NO: 2716980 - RNA, 17 nt, Haemophilus influenzae Rd
aguuuuccuuuuucuaa

SEQ ID NO: 2716981 - RNA, 16 nt, Haemophilus influenzae Rd
aguuuucuguauacca

SEQ ID NO: 2716982 - RNA, 10 nt, Haemophilus influenzae Rd
aguuuugcuu

SEQ ID NO: 2716983 - RNA, 17 nt, Haemophilus influenzae Rd
aguuuuggcucuacuuu

SEQ ID NO: 2716984 - RNA, 22 nt, Haemophilus influenzae Rd
aguuuugggauaaucugauuga

SEQ ID NO: 2716985 - RNA, 18 nt, Haemophilus influenzae Rd
aguuuuggucaauauauu

SEQ ID NO: 2716986 - RNA, 13 nt, Haemophilus influenzae Rd
aguuuuucaccca

SEQ ID NO: 2716987 - RNA, 19 nt, Haemophilus influenzae Rd
aguuuuucagugaguucau

SEQ ID NO: 2716988 - RNA, 15 nt, Haemophilus influenzae Rd
aguuuuucgcugcag

SEQ ID NO: 2716989 - RNA, 19 nt, Haemophilus influenzae Rd
aguuuuuuaaguuuccaag

SEQ ID NO: 2716990 - RNA, 12 nt, Haemophilus influenzae Rd
aguuuuuucacu

SEQ ID NO: 2716991 - RNA, 13 nt, Haemophilus influenzae Rd
aguuuuuucacuu

SEQ ID NO: 2716992 - RNA, 14 nt, Haemophilus influenzae Rd
aguuuuuugccaaa

SEQ ID NO: 2716993 - RNA, 14 nt, Haemophilus influenzae Rd
aguuuuuuuauaaa

SEQ ID NO: 2716994 - RNA, 17 nt, Haemophilus influenzae Rd
aguuuuuuuauaaaaaa

SEQ ID NO: 2716995 - RNA, 11 nt, Haemophilus influenzae Rd
auaaaaaaauc

SEQ ID NO: 2716996 - RNA, 13 nt, Haemophilus influenzae Rd
auaaaaaauaaag

SEQ ID NO: 2716997 - RNA, 15 nt, Haemophilus influenzae Rd
auaaaaaauccacac

SEQ ID NO: 2716998 - RNA, 15 nt, Haemophilus influenzae Rd
auaaaaaauggaaua

SEQ ID NO: 2716999 - RNA, 13 nt, Haemophilus influenzae Rd
auaaaaaauuaag

SEQ ID NO: 2717000 - RNA, 11 nt, Haemophilus influenzae Rd
auaaaaacaau

SEQ ID NO: 2717001 - RNA, 14 nt, Haemophilus influenzae Rd
auaaaaaccagaua

SEQ ID NO: 2717002 - RNA, 19 nt, Haemophilus influenzae Rd
auaaaaaccagauaaaaac

SEQ ID NO: 2717003 - RNA, 23 nt, Haemophilus influenzae Rd
auaaaaaccagauaaaaacugug

SEQ ID NO: 2717004 - RNA, 15 nt, Haemophilus influenzae Rd
auaaaaaguaggcau

SEQ ID NO: 2717005 - RNA, 22 nt, Haemophilus influenzae Rd
auaaaaagugcgguuaauuuuu

SEQ ID NO: 2717006 - RNA, 14 nt, Haemophilus influenzae Rd
auaaaaagugggua

SEQ ID NO: 2717007 - RNA, 14 nt, Haemophilus influenzae Rd
auaaaaauauauuu

SEQ ID NO: 2717008 - RNA, 12 nt, Haemophilus influenzae Rd
auaaaaauccuu

SEQ ID NO: 2717009 - RNA, 21 nt, Haemophilus influenzae Rd
auaaaaaugaugauaauuuuu

SEQ ID NO: 2717010 - RNA, 12 nt, Haemophilus influenzae Rd
auaaaaauuauu

SEQ ID NO: 2717011 - RNA, 21 nt, Haemophilus influenzae Rd
auaaaaauugaucuaaauuau

SEQ ID NO: 2717012 - RNA, 18 nt, Haemophilus influenzae Rd
auaaaacacaguuauuuu

SEQ ID NO: 2717013 - RNA, 17 nt, Haemophilus influenzae Rd
auaaaacagagaaaaaa

SEQ ID NO: 2717014 - RNA, 20 nt, Haemophilus influenzae Rd
auaaaacagagaaaaaaaua

SEQ ID NO: 2717015 - RNA, 14 nt, Haemophilus influenzae Rd
auaaaacccaguuu

SEQ ID NO: 2717016 - RNA, 15 nt, Haemophilus influenzae Rd
auaaaaccuaaaauu

SEQ ID NO: 2717017 - RNA, 17 nt, Haemophilus influenzae Rd
auaaaaccuaaaauuga

SEQ ID NO: 2717018 - RNA, 20 nt, Haemophilus influenzae Rd
auaaaacgaacaauuucuuu

SEQ ID NO: 2717019 - RNA, 16 nt, Haemophilus influenzae Rd
auaaaacggcucaaau

SEQ ID NO: 2717020 - RNA, 18 nt, Haemophilus influenzae Rd
auaaaacgggaucuauuu

SEQ ID NO: 2717021 - RNA, 16 nt, Haemophilus influenzae Rd
auaaaacuuccuaaug

SEQ ID NO: 2717022 - RNA, 21 nt, Haemophilus influenzae Rd
auaaaacuuuauuuuauucug

SEQ ID NO: 2717023 - RNA, 19 nt, Haemophilus influenzae Rd
auaaaacuuuucuuauaau

SEQ ID NO: 2717024 - RNA, 12 nt, Haemophilus influenzae Rd
auaaaagaauuu

SEQ ID NO: 2717025 - RNA, 17 nt, Haemophilus influenzae Rd
auaaaagaccucucuag

SEQ ID NO: 2717026 - RNA, 19 nt, Haemophilus influenzae Rd
auaaaagagagcuucucuu

SEQ ID NO: 2717027 - RNA, 20 nt, Haemophilus influenzae Rd
auaaaagagagcuucucuuu

SEQ ID NO: 2717028 - RNA, 13 nt, Haemophilus influenzae Rd
auaaaagcaauaa

SEQ ID NO: 2717029 - RNA, 19 nt, Haemophilus influenzae Rd
auaaaagugcgguaaauuu

SEQ ID NO: 2717030 - RNA, 21 nt, Haemophilus influenzae Rd
auaaaagugcgguaaauuuuu

SEQ ID NO: 2717031 - RNA, 23 nt, Haemophilus influenzae Rd
auaaaagugcgguauuuuuuauu

SEQ ID NO: 2717032 - RNA, 14 nt, Haemophilus influenzae Rd
auaaaauaaaauuc

SEQ ID NO: 2717033 - RNA, 11 nt, Haemophilus influenzae Rd
auaaaauaaac

SEQ ID NO: 2717034 - RNA, 17 nt, Haemophilus influenzae Rd
auaaaauaaacauuuuu

SEQ ID NO: 2717035 - RNA, 19 nt, Haemophilus influenzae Rd
auaaaauaaacauuuuuca

SEQ ID NO: 2717036 - RNA, 20 nt, Haemophilus influenzae Rd
auaaaauaaacauuuuucau

SEQ ID NO: 2717037 - RNA, 17 nt, Haemophilus influenzae Rd
auaaaauaaagaaacgu

SEQ ID NO: 2717038 - RNA, 12 nt, Haemophilus influenzae Rd
auaaaauaacuu

SEQ ID NO: 2717039 - RNA, 18 nt, Haemophilus influenzae Rd
auaaaauaauauauuaug

SEQ ID NO: 2717040 - RNA, 22 nt, Haemophilus influenzae Rd
auaaaauagccuaaauauuuau

SEQ ID NO: 2717041 - RNA, 21 nt, Haemophilus influenzae Rd
auaaaauauaugggaaacaau

SEQ ID NO: 2717042 - RNA, 16 nt, Haemophilus influenzae Rd
auaaaauauauuaauu

SEQ ID NO: 2717043 - RNA, 14 nt, Haemophilus influenzae Rd
auaaaauauucaaa

SEQ ID NO: 2717044 - RNA, 13 nt, Haemophilus influenzae Rd
auaaaauauuuaa

SEQ ID NO: 2717045 - RNA, 19 nt, Haemophilus influenzae Rd
auaaaauauuuaauuucau

SEQ ID NO: 2717046 - RNA, 13 nt, Haemophilus influenzae Rd
auaaaauauuuuu

SEQ ID NO: 2717047 - RNA, 14 nt, Haemophilus influenzae Rd
auaaaauauuuuuu

SEQ ID NO: 2717048 - RNA, 17 nt, Haemophilus influenzae Rd
auaaaauauuuuuuauu

SEQ ID NO: 2717049 - RNA, 15 nt, Haemophilus influenzae Rd
auaaaaucaauaaua

SEQ ID NO: 2717050 - RNA, 15 nt, Haemophilus influenzae Rd
auaaaaucuucuaag

SEQ ID NO: 2717051 - RNA, 16 nt, Haemophilus influenzae Rd
auaaaauggcuaucau

SEQ ID NO: 2717052 - RNA, 20 nt, Haemophilus influenzae Rd
auaaaauggcuaucauuacc

SEQ ID NO: 2717053 - RNA, 18 nt, Haemophilus influenzae Rd
auaaaauuacaaaaccaa

SEQ ID NO: 2717054 - RNA, 21 nt, Haemophilus influenzae Rd
auaaaauugcuuuguuaauuc

SEQ ID NO: 2717055 - RNA, 19 nt, Haemophilus influenzae Rd
auaaaauuuauuacaaaca

SEQ ID NO: 2717056 - RNA, 21 nt, Haemophilus influenzae Rd
auaaaauuuauuacaaacaaa

SEQ ID NO: 2717057 - RNA, 15 nt, Haemophilus influenzae Rd
auaaaauuuuuaaag

SEQ ID NO: 2717058 - RNA, 19 nt, Haemophilus influenzae Rd
auaaaauuuuuaaaguuau

SEQ ID NO: 2717059 - RNA, 23 nt, Haemophilus influenzae Rd
auaaaauuuuuaccauauccauu

SEQ ID NO: 2717060 - RNA, 18 nt, Haemophilus influenzae Rd
auaaacaaaauaaacuca

SEQ ID NO: 2717061 - RNA, 20 nt, Haemophilus influenzae Rd
auaaacaaagaaucuuaaau

SEQ ID NO: 2717062 - RNA, 13 nt, Haemophilus influenzae Rd
auaaacaaauugc

SEQ ID NO: 2717063 - RNA, 14 nt, Haemophilus influenzae Rd
auaaacaaauugca

SEQ ID NO: 2717064 - RNA, 16 nt, Haemophilus influenzae Rd
auaaacaauauaacca

SEQ ID NO: 2717065 - RNA, 16 nt, Haemophilus influenzae Rd
auaaacaauuccccuu

SEQ ID NO: 2717066 - RNA, 22 nt, Haemophilus influenzae Rd
auaaacagccauggcuuuuucc

SEQ ID NO: 2717067 - RNA, 21 nt, Haemophilus influenzae Rd
auaaacagggugucguagaaa

SEQ ID NO: 2717068 - RNA, 23 nt, Haemophilus influenzae Rd
auaaacagggugucguagaaaua

SEQ ID NO: 2717069 - RNA, 17 nt, Haemophilus influenzae Rd
auaaacauacaucuaau

SEQ ID NO: 2717070 - RNA, 19 nt, Haemophilus influenzae Rd
auaaacauacaucuaauuu

SEQ ID NO: 2717071 - RNA, 21 nt, Haemophilus influenzae Rd
auaaacaucuugcauaaacca

SEQ ID NO: 2717072 - RNA, 18 nt, Haemophilus influenzae Rd
auaaacauuaugaaaaaa

SEQ ID NO: 2717073 - RNA, 11 nt, Haemophilus influenzae Rd
auaaacauuuu

SEQ ID NO: 2717074 - RNA, 13 nt, Haemophilus influenzae Rd
auaaacauuuuuc

SEQ ID NO: 2717075 - RNA, 14 nt, Haemophilus influenzae Rd
auaaacauuuuuca

SEQ ID NO: 2717076 - RNA, 15 nt, Haemophilus influenzae Rd
auaaacauuuuucau

SEQ ID NO: 2717077 - RNA, 14 nt, Haemophilus influenzae Rd
auaaacauuuuuuc

SEQ ID NO: 2717078 - RNA, 19 nt, Haemophilus influenzae Rd
auaaaccaacauacauuaa

SEQ ID NO: 2717079 - RNA, 19 nt, Haemophilus influenzae Rd
auaaaccaaugagaaaaag

SEQ ID NO: 2717080 - RNA, 18 nt, Haemophilus influenzae Rd
auaaaccaauuuuacaaa

SEQ ID NO: 2717081 - RNA, 23 nt, Haemophilus influenzae Rd
auaaaccaccgauuaauaaaauc

SEQ ID NO: 2717082 - RNA, 15 nt, Haemophilus influenzae Rd
auaaaccaguuaaau

SEQ ID NO: 2717083 - RNA, 14 nt, Haemophilus influenzae Rd
auaaacccaaaaaa

SEQ ID NO: 2717084 - RNA, 18 nt, Haemophilus influenzae Rd
auaaacccaucauaaaua

SEQ ID NO: 2717085 - RNA, 23 nt, Haemophilus influenzae Rd
auaaaccgcaucaaaauuauaaa

SEQ ID NO: 2717086 - RNA, 19 nt, Haemophilus influenzae Rd
auaaaccgccaaaaauuaa

SEQ ID NO: 2717087 - RNA, 24 nt, Haemophilus influenzae Rd
auaaaccguuagguuuaaaagaua

SEQ ID NO: 2717088 - RNA, 15 nt, Haemophilus influenzae Rd
auaaaccuaaagcca

SEQ ID NO: 2717089 - RNA, 21 nt, Haemophilus influenzae Rd
auaaacgauaugguaagaacg

SEQ ID NO: 2717090 - RNA, 15 nt, Haemophilus influenzae Rd
auaaacgcaccacaa

SEQ ID NO: 2717091 - RNA, 15 nt, Haemophilus influenzae Rd
auaaacgcauagaaa

SEQ ID NO: 2717092 - RNA, 18 nt, Haemophilus influenzae Rd
auaaacgcuguuuugcuu

SEQ ID NO: 2717093 - RNA, 21 nt, Haemophilus influenzae Rd
auaaacggagcgauguuuucc

SEQ ID NO: 2717094 - RNA, 18 nt, Haemophilus influenzae Rd
auaaacggauugcauaua

SEQ ID NO: 2717095 - RNA, 22 nt, Haemophilus influenzae Rd
auaaacggcugccgcaucaacu

SEQ ID NO: 2717096 - RNA, 21 nt, Haemophilus influenzae Rd
auaaacgucauaguauggcuc

SEQ ID NO: 2717097 - RNA, 19 nt, Haemophilus influenzae Rd
auaaacguugagcaacaag

SEQ ID NO: 2717098 - RNA, 16 nt, Haemophilus influenzae Rd
auaaacuacuucuaaa

SEQ ID NO: 2717099 - RNA, 16 nt, Haemophilus influenzae Rd
auaaacucacauuguu

SEQ ID NO: 2717100 - RNA, 22 nt, Haemophilus influenzae Rd
auaaacucauugaacuguuugu

SEQ ID NO: 2717101 - RNA, 14 nt, Haemophilus influenzae Rd
auaaacugauuuug

SEQ ID NO: 2717102 - RNA, 16 nt, Haemophilus influenzae Rd
auaaacugauuuugau

SEQ ID NO: 2717103 - RNA, 21 nt, Haemophilus influenzae Rd
auaaacugauuuugauuuagc

SEQ ID NO: 2717104 - RNA, 20 nt, Haemophilus influenzae Rd
auaaacugcgaucuucugau

SEQ ID NO: 2717105 - RNA, 23 nt, Haemophilus influenzae Rd
auaaacuuuauccccuacaguga

SEQ ID NO: 2717106 - RNA, 16 nt, Haemophilus influenzae Rd
auaaagaagaaaaucu

SEQ ID NO: 2717107 - RNA, 19 nt, Haemophilus influenzae Rd
auaaagaauaauuuucaaa

SEQ ID NO: 2717108 - RNA, 19 nt, Haemophilus influenzae Rd
auaaagacgcuguuucuuu

SEQ ID NO: 2717109 - RNA, 13 nt, Haemophilus influenzae Rd
auaaagagaauau

SEQ ID NO: 2717110 - RNA, 14 nt, Haemophilus influenzae Rd
auaaagagaauauu

SEQ ID NO: 2717111 - RNA, 14 nt, Haemophilus influenzae Rd
auaaagagauuauu

SEQ ID NO: 2717112 - RNA, 19 nt, Haemophilus influenzae Rd
auaaagagcggucaauuuu

SEQ ID NO: 2717113 - RNA, 21 nt, Haemophilus influenzae Rd
auaaagcucuaauugaaauag

SEQ ID NO: 2717114 - RNA, 19 nt, Haemophilus influenzae Rd
auaaagcucucgaacauuc

SEQ ID NO: 2717115 - RNA, 15 nt, Haemophilus influenzae Rd
auaaagcuugaaaaa

SEQ ID NO: 2717116 - RNA, 16 nt, Haemophilus influenzae Rd
auaaagcuugaaaaaa

SEQ ID NO: 2717117 - RNA, 14 nt, Haemophilus influenzae Rd
auaaaggauuaaau

SEQ ID NO: 2717118 - RNA, 16 nt, Haemophilus influenzae Rd
auaaaggauuaaauaa

SEQ ID NO: 2717119 - RNA, 16 nt, Haemophilus influenzae Rd
auaaaggauuuuauca

SEQ ID NO: 2717120 - RNA, 17 nt, Haemophilus influenzae Rd
auaaaggauuuuaucau

SEQ ID NO: 2717121 - RNA, 23 nt, Haemophilus influenzae Rd
auaaaggcacaggaugcaccaau

SEQ ID NO: 2717122 - RNA, 22 nt, Haemophilus influenzae Rd
auaaagggauaaacccaaaaaa

SEQ ID NO: 2717123 - RNA, 14 nt, Haemophilus influenzae Rd
auaaaguaaaauau

SEQ ID NO: 2717124 - RNA, 21 nt, Haemophilus influenzae Rd
auaaaguaguuuuaguaauuu

SEQ ID NO: 2717125 - RNA, 14 nt, Haemophilus influenzae Rd
auaaaguauacuuu

SEQ ID NO: 2717126 - RNA, 18 nt, Haemophilus influenzae Rd
auaaaguccauaauauca

SEQ ID NO: 2717127 - RNA, 21 nt, Haemophilus influenzae Rd
auaaagucgguucauuugggg

SEQ ID NO: 2717128 - RNA, 23 nt, Haemophilus influenzae Rd
auaaagugcggucaauuuucaaa

SEQ ID NO: 2717129 - RNA, 19 nt, Haemophilus influenzae Rd
auaaagugcgguuauuuuu

SEQ ID NO: 2717130 - RNA, 23 nt, Haemophilus influenzae Rd
auaaaguggagcuggauguggcu

SEQ ID NO: 2717131 - RNA, 15 nt, Haemophilus influenzae Rd
auaaaguuugcaauu

SEQ ID NO: 2717132 - RNA, 23 nt, Haemophilus influenzae Rd
auaaauaaaaaaccgagucuuag

SEQ ID NO: 2717133 - RNA, 16 nt, Haemophilus influenzae Rd
auaaauaaaacaagga

SEQ ID NO: 2717134 - RNA, 13 nt, Haemophilus influenzae Rd
auaaauaaaauau

SEQ ID NO: 2717135 - RNA, 15 nt, Haemophilus influenzae Rd
auaaauaaaucaaua

SEQ ID NO: 2717136 - RNA, 11 nt, Haemophilus influenzae Rd
auaaauaacau

SEQ ID NO: 2717137 - RNA, 12 nt, Haemophilus influenzae Rd
auaaauacacca

SEQ ID NO: 2717138 - RNA, 21 nt, Haemophilus influenzae Rd
auaaauagauacaagaaagaa

SEQ ID NO: 2717139 - RNA, 20 nt, Haemophilus influenzae Rd
auaaauagcccgauugaauc

SEQ ID NO: 2717140 - RNA, 21 nt, Haemophilus influenzae Rd
auaaauaggaaaggcauuuuu

SEQ ID NO: 2717141 - RNA, 17 nt, Haemophilus influenzae Rd
auaaauaggcucauuuu

SEQ ID NO: 2717142 - RNA, 23 nt, Haemophilus influenzae Rd
auaaauauuacuuaacaucauca

SEQ ID NO: 2717143 - RNA, 15 nt, Haemophilus influenzae Rd
auaaauauuauuaaa

SEQ ID NO: 2717144 - RNA, 17 nt, Haemophilus influenzae Rd
auaaauauugauuaccc

SEQ ID NO: 2717145 - RNA, 14 nt, Haemophilus influenzae Rd
auaaaucaaaagaa

SEQ ID NO: 2717146 - RNA, 15 nt, Haemophilus influenzae Rd
auaaaucaaaagaau

SEQ ID NO: 2717147 - RNA, 23 nt, Haemophilus influenzae Rd
auaaaucaauacgccuaaaacaa

SEQ ID NO: 2717148 - RNA, 16 nt, Haemophilus influenzae Rd
auaaaucacuuaauuu

SEQ ID NO: 2717149 - RNA, 18 nt, Haemophilus influenzae Rd
auaaaucacuuaauuucu

SEQ ID NO: 2717150 - RNA, 23 nt, Haemophilus influenzae Rd
auaaaucacuuaauuucuuaauu

SEQ ID NO: 2717151 - RNA, 24 nt, Haemophilus influenzae Rd
auaaaucaucccuguauaaagaua

SEQ ID NO: 2717152 - RNA, 12 nt, Haemophilus influenzae Rd
auaaauccaauc

SEQ ID NO: 2717153 - RNA, 17 nt, Haemophilus influenzae Rd
auaaauccaauccaacu

SEQ ID NO: 2717154 - RNA, 19 nt, Haemophilus influenzae Rd
auaaauccuguuuauuuuu

SEQ ID NO: 2717155 - RNA, 23 nt, Haemophilus influenzae Rd
auaaauccuucaggauaaaacaa

SEQ ID NO: 2717156 - RNA, 17 nt, Haemophilus influenzae Rd
auaaaucggcguauuuu

SEQ ID NO: 2717157 - RNA, 14 nt, Haemophilus influenzae Rd
auaaaucuuuaaau

SEQ ID NO: 2717158 - RNA, 20 nt, Haemophilus influenzae Rd
auaaaugacauauaauauua

SEQ ID NO: 2717159 - RNA, 22 nt, Haemophilus influenzae Rd
auaaaugauuauccacuaaaaa

SEQ ID NO: 2717160 - RNA, 16 nt, Haemophilus influenzae Rd
auaaaugcacauuuuu

SEQ ID NO: 2717161 - RNA, 20 nt, Haemophilus influenzae Rd
auaaaugcaucauuaauaca

SEQ ID NO: 2717162 - RNA, 22 nt, Haemophilus influenzae Rd
auaaaugcgucgcagccuuguu

SEQ ID NO: 2717163 - RNA, 23 nt, Haemophilus influenzae Rd
auaaaugcgucgcagccuuguuc

SEQ ID NO: 2717164 - RNA, 15 nt, Haemophilus influenzae Rd
auaaaugcuaaaauu

SEQ ID NO: 2717165 - RNA, 17 nt, Haemophilus influenzae Rd
auaaaugcuaaaauuaa

SEQ ID NO: 2717166 - RNA, 17 nt, Haemophilus influenzae Rd
auaaaugcuacuugaau

SEQ ID NO: 2717167 - RNA, 18 nt, Haemophilus influenzae Rd
auaaauggaaaccauuga

SEQ ID NO: 2717168 - RNA, 15 nt, Haemophilus influenzae Rd
auaaauggcucaagu

SEQ ID NO: 2717169 - RNA, 17 nt, Haemophilus influenzae Rd
auaaauggcucaaguau

SEQ ID NO: 2717170 - RNA, 12 nt, Haemophilus influenzae Rd
auaaauggguuu

SEQ ID NO: 2717171 - RNA, 10 nt, Haemophilus influenzae Rd
auaaauuagc

SEQ ID NO: 2717172 - RNA, 19 nt, Haemophilus influenzae Rd
auaaauuagcuuaauaaau

SEQ ID NO: 2717173 - RNA, 17 nt, Haemophilus influenzae Rd
auaaauuauauuuuuaa

SEQ ID NO: 2717174 - RNA, 12 nt, Haemophilus influenzae Rd
auaaauucaucu

SEQ ID NO: 2717175 - RNA, 17 nt, Haemophilus influenzae Rd
auaaauuccuuuuuaau

SEQ ID NO: 2717176 - RNA, 18 nt, Haemophilus influenzae Rd
auaaauucguacaaauga

SEQ ID NO: 2717177 - RNA, 23 nt, Haemophilus influenzae Rd
auaaauucucgccauaauaaaaa

SEQ ID NO: 2717178 - RNA, 13 nt, Haemophilus influenzae Rd
auaaauugcccuc

SEQ ID NO: 2717179 - RNA, 16 nt, Haemophilus influenzae Rd
auaaauuguuuuuccc

SEQ ID NO: 2717180 - RNA, 17 nt, Haemophilus influenzae Rd
auaaauuuaaauuauua

SEQ ID NO: 2717181 - RNA, 21 nt, Haemophilus influenzae Rd
auaaauuuaaccacuaaaaaa

SEQ ID NO: 2717182 - RNA, 24 nt, Haemophilus influenzae Rd
auaaauuuauuuaauaauaucaau

SEQ ID NO: 2717183 - RNA, 21 nt, Haemophilus influenzae Rd
auaaauuucaauuaaaucaaa

SEQ ID NO: 2717184 - RNA, 22 nt, Haemophilus influenzae Rd
auaaauuugaucguuaauauca

SEQ ID NO: 2717185 - RNA, 23 nt, Haemophilus influenzae Rd
auaaauuugaucguuaauaucau

SEQ ID NO: 2717186 - RNA, 20 nt, Haemophilus influenzae Rd
auaaauuuggguaguuuaua

SEQ ID NO: 2717187 - RNA, 23 nt, Haemophilus influenzae Rd
auaaauuuggguaguuuauaaaa

SEQ ID NO: 2717188 - RNA, 14 nt, Haemophilus influenzae Rd
auaaauuugugugg

SEQ ID NO: 2717189 - RNA, 12 nt, Haemophilus influenzae Rd
auaaauuuuauu

SEQ ID NO: 2717190 - RNA, 13 nt, Haemophilus influenzae Rd
auaaauuuugccc

SEQ ID NO: 2717191 - RNA, 14 nt, Haemophilus influenzae Rd
auaaauuuuuagcu

SEQ ID NO: 2717192 - RNA, 19 nt, Haemophilus influenzae Rd
auaaauuuuuuaauucagu

SEQ ID NO: 2717193 - RNA, 11 nt, Haemophilus influenzae Rd
auaacaaaaac

SEQ ID NO: 2717194 - RNA, 23 nt, Haemophilus influenzae Rd
auaacaaaagugcgguaaaaauu

SEQ ID NO: 2717195 - RNA, 19 nt, Haemophilus influenzae Rd
auaacaaaauggcuuuuuu

SEQ ID NO: 2717196 - RNA, 11 nt, Haemophilus influenzae Rd
auaacaaauag

SEQ ID NO: 2717197 - RNA, 14 nt, Haemophilus influenzae Rd
auaacaaauugcuu

SEQ ID NO: 2717198 - RNA, 14 nt, Haemophilus influenzae Rd
auaacaacccuauu

SEQ ID NO: 2717199 - RNA, 14 nt, Haemophilus influenzae Rd
auaacaacuaaaaa

SEQ ID NO: 2717200 - RNA, 19 nt, Haemophilus influenzae Rd
auaacaacuggaauuugua

SEQ ID NO: 2717201 - RNA, 16 nt, Haemophilus influenzae Rd
auaacaagcgaaaaac

SEQ ID NO: 2717202 - RNA, 22 nt, Haemophilus influenzae Rd
auaacaagcucagguucaaaac

SEQ ID NO: 2717203 - RNA, 22 nt, Haemophilus influenzae Rd
auaacaaucuuguuggaucuuc

SEQ ID NO: 2717204 - RNA, 13 nt, Haemophilus influenzae Rd
auaacaauuuuug

SEQ ID NO: 2717205 - RNA, 14 nt, Haemophilus influenzae Rd
auaacaauuuuugc

SEQ ID NO: 2717206 - RNA, 17 nt, Haemophilus influenzae Rd
auaacaauuuuugcauu

SEQ ID NO: 2717207 - RNA, 18 nt, Haemophilus influenzae Rd
auaacaauuuuugcauuu

SEQ ID NO: 2717208 - RNA, 19 nt, Haemophilus influenzae Rd
auaacacaaccaucuucaa

SEQ ID NO: 2717209 - RNA, 19 nt, Haemophilus influenzae Rd
auaacacaccaacaacgau

SEQ ID NO: 2717210 - RNA, 17 nt, Haemophilus influenzae Rd
auaacacagaugaaaau

SEQ ID NO: 2717211 - RNA, 16 nt, Haemophilus influenzae Rd
auaacaccagugaaua

SEQ ID NO: 2717212 - RNA, 13 nt, Haemophilus influenzae Rd
auaacacccucaa

SEQ ID NO: 2717213 - RNA, 18 nt, Haemophilus influenzae Rd
auaacaccgcuaauaaaa

SEQ ID NO: 2717214 - RNA, 19 nt, Haemophilus influenzae Rd
auaacacgaccauugaauc

SEQ ID NO: 2717215 - RNA, 22 nt, Haemophilus influenzae Rd
auaacacgaccauugaauccaa

SEQ ID NO: 2717216 - RNA, 19 nt, Haemophilus influenzae Rd
auaacauaauugcaaugua

SEQ ID NO: 2717217 - RNA, 21 nt, Haemophilus influenzae Rd
auaacauaccuagauugcuuu

SEQ ID NO: 2717218 - RNA, 22 nt, Haemophilus influenzae Rd
auaacauaccuagauugcuuug

SEQ ID NO: 2717219 - RNA, 21 nt, Haemophilus influenzae Rd
auaacauuccguuuuuaaucu

SEQ ID NO: 2717220 - RNA, 12 nt, Haemophilus influenzae Rd
auaaccaagaaa

SEQ ID NO: 2717221 - RNA, 16 nt, Haemophilus influenzae Rd
auaaccaagaaagcau

SEQ ID NO: 2717222 - RNA, 23 nt, Haemophilus influenzae Rd
auaaccaagaaagcaugaauaaa

SEQ ID NO: 2717223 - RNA, 16 nt, Haemophilus influenzae Rd
auaaccacguaauucu

SEQ ID NO: 2717224 - RNA, 17 nt, Haemophilus influenzae Rd
auaaccacguaauucuu

SEQ ID NO: 2717225 - RNA, 17 nt, Haemophilus influenzae Rd
auaaccauaucugaaaa

SEQ ID NO: 2717226 - RNA, 13 nt, Haemophilus influenzae Rd
auaaccaucuaua

SEQ ID NO: 2717227 - RNA, 16 nt, Haemophilus influenzae Rd
auaacccaccaaauua

SEQ ID NO: 2717228 - RNA, 16 nt, Haemophilus influenzae Rd
auaacccuaaagugac

SEQ ID NO: 2717229 - RNA, 19 nt, Haemophilus influenzae Rd
auaacccuccgcauuaauc

SEQ ID NO: 2717230 - RNA, 23 nt, Haemophilus influenzae Rd
auaacccuuguaacguauuuaaa

SEQ ID NO: 2717231 - RNA, 18 nt, Haemophilus influenzae Rd
auaaccgcacuucaaaaa

SEQ ID NO: 2717232 - RNA, 14 nt, Haemophilus influenzae Rd
auaaccuaaaauau

SEQ ID NO: 2717233 - RNA, 17 nt, Haemophilus influenzae Rd
auaaccuaucccaaaau

SEQ ID NO: 2717234 - RNA, 21 nt, Haemophilus influenzae Rd
auaaccuuacugccuuuuucu

SEQ ID NO: 2717235 - RNA, 22 nt, Haemophilus influenzae Rd
auaaccuugcgcugcuuuauuu

SEQ ID NO: 2717236 - RNA, 22 nt, Haemophilus influenzae Rd
auaaccuugcugauaaauuccu

SEQ ID NO: 2717237 - RNA, 21 nt, Haemophilus influenzae Rd
auaaccuuuaccgucaauaaa

SEQ ID NO: 2717238 - RNA, 16 nt, Haemophilus influenzae Rd
auaaccuuuagacaac

SEQ ID NO: 2717239 - RNA, 19 nt, Haemophilus influenzae Rd
auaacgauaagauuugcuu

SEQ ID NO: 2717240 - RNA, 14 nt, Haemophilus influenzae Rd
auaacgauauguua

SEQ ID NO: 2717241 - RNA, 16 nt, Haemophilus influenzae Rd
auaacgauauucuugc

SEQ ID NO: 2717242 - RNA, 19 nt, Haemophilus influenzae Rd
auaacgcaucaccacaaaa

SEQ ID NO: 2717243 - RNA, 19 nt, Haemophilus influenzae Rd
auaacgccaugaacguuug

SEQ ID NO: 2717244 - RNA, 16 nt, Haemophilus influenzae Rd
auaacgcuaucuuuug

SEQ ID NO: 2717245 - RNA, 20 nt, Haemophilus influenzae Rd
auaacgcugcuuaaagcaau

SEQ ID NO: 2717246 - RNA, 21 nt, Haemophilus influenzae Rd
auaacgcugcuuaaagcaauc

SEQ ID NO: 2717247 - RNA, 20 nt, Haemophilus influenzae Rd
auaacggcaaaaucauuaaa

SEQ ID NO: 2717248 - RNA, 14 nt, Haemophilus influenzae Rd
auaacggcaagcaa

SEQ ID NO: 2717249 - RNA, 16 nt, Haemophilus influenzae Rd
auaacggcaagcaaac

SEQ ID NO: 2717250 - RNA, 15 nt, Haemophilus influenzae Rd
auaacgggcauuuuu

SEQ ID NO: 2717251 - RNA, 16 nt, Haemophilus influenzae Rd
auaacgggcauuuuuc

SEQ ID NO: 2717252 - RNA, 20 nt, Haemophilus influenzae Rd
auaacguagcgauaaaauau

SEQ ID NO: 2717253 - RNA, 18 nt, Haemophilus influenzae Rd
auaacgucauuaauuuuu

SEQ ID NO: 2717254 - RNA, 15 nt, Haemophilus influenzae Rd
auaacguuaauucaa

SEQ ID NO: 2717255 - RNA, 12 nt, Haemophilus influenzae Rd
auaacuaaaaau

SEQ ID NO: 2717256 - RNA, 13 nt, Haemophilus influenzae Rd
auaacuaaaaaua

SEQ ID NO: 2717257 - RNA, 13 nt, Haemophilus influenzae Rd
auaacuaauuaag

SEQ ID NO: 2717258 - RNA, 13 nt, Haemophilus influenzae Rd
auaacuagcaauc

SEQ ID NO: 2717259 - RNA, 18 nt, Haemophilus influenzae Rd
auaacuaucacuaauauu

SEQ ID NO: 2717260 - RNA, 19 nt, Haemophilus influenzae Rd
auaacuauuggcaucaaaa

SEQ ID NO: 2717261 - RNA, 23 nt, Haemophilus influenzae Rd
auaacucaacaccgcaaaaauac

SEQ ID NO: 2717262 - RNA, 13 nt, Haemophilus influenzae Rd
auaacucaagcaa

SEQ ID NO: 2717263 - RNA, 14 nt, Haemophilus influenzae Rd
auaacugaauaauu

SEQ ID NO: 2717264 - RNA, 20 nt, Haemophilus influenzae Rd
auaacugaucggauuucuuu

SEQ ID NO: 2717265 - RNA, 20 nt, Haemophilus influenzae Rd
auaacugauuguccaaagaa

SEQ ID NO: 2717266 - RNA, 23 nt, Haemophilus influenzae Rd
auaacugauuguccaaagaauaa

SEQ ID NO: 2717267 - RNA, 15 nt, Haemophilus influenzae Rd
auaacugccacauca

SEQ ID NO: 2717268 - RNA, 19 nt, Haemophilus influenzae Rd
auaacugcgccaauauaag

SEQ ID NO: 2717269 - RNA, 14 nt, Haemophilus influenzae Rd
auaacuuaaaucaa

SEQ ID NO: 2717270 - RNA, 15 nt, Haemophilus influenzae Rd
auaacuuagaaaaua

SEQ ID NO: 2717271 - RNA, 16 nt, Haemophilus influenzae Rd
auaacuuagaaaauau

SEQ ID NO: 2717272 - RNA, 17 nt, Haemophilus influenzae Rd
auaacuuagaaaauauc

SEQ ID NO: 2717273 - RNA, 18 nt, Haemophilus influenzae Rd
auaacuuagaaaauaucu

SEQ ID NO: 2717274 - RNA, 15 nt, Haemophilus influenzae Rd
auaacuuaugaauaa

SEQ ID NO: 2717275 - RNA, 16 nt, Haemophilus influenzae Rd
auaacuucauccauuu

SEQ ID NO: 2717276 - RNA, 20 nt, Haemophilus influenzae Rd
auaacuuucaguuaaauuuu

SEQ ID NO: 2717277 - RNA, 21 nt, Haemophilus influenzae Rd
auaagaaaauagaaagaauau

SEQ ID NO: 2717278 - RNA, 12 nt, Haemophilus influenzae Rd
auaagaaauaau

SEQ ID NO: 2717279 - RNA, 22 nt, Haemophilus influenzae Rd
auaagaaguuaucauuugaauu

SEQ ID NO: 2717280 - RNA, 21 nt, Haemophilus influenzae Rd
auaagauaacaagaaaaauca

SEQ ID NO: 2717281 - RNA, 14 nt, Haemophilus influenzae Rd
auaagauagaaaug

SEQ ID NO: 2717282 - RNA, 16 nt, Haemophilus influenzae Rd
auaagaucuucuuugc

SEQ ID NO: 2717283 - RNA, 22 nt, Haemophilus influenzae Rd
auaagauuacccacuaaguauu

SEQ ID NO: 2717284 - RNA, 17 nt, Haemophilus influenzae Rd
auaagauugugcaauaa

SEQ ID NO: 2717285 - RNA, 16 nt, Haemophilus influenzae Rd
auaagauuugcuuuuu

SEQ ID NO: 2717286 - RNA, 18 nt, Haemophilus influenzae Rd
auaagauuugcuuuuugu

SEQ ID NO: 2717287 - RNA, 15 nt, Haemophilus influenzae Rd
auaagcaaagaaauu

SEQ ID NO: 2717288 - RNA, 23 nt, Haemophilus influenzae Rd
auaagcauuuuaucacaaguuaa

SEQ ID NO: 2717289 - RNA, 18 nt, Haemophilus influenzae Rd
auaagccauuaacauuua

SEQ ID NO: 2717290 - RNA, 17 nt, Haemophilus influenzae Rd
auaagcccgaacagaaa

SEQ ID NO: 2717291 - RNA, 20 nt, Haemophilus influenzae Rd
auaagcuaucgucaaauuua

SEQ ID NO: 2717292 - RNA, 22 nt, Haemophilus influenzae Rd
auaagcuaugaagaagaaaguu

SEQ ID NO: 2717293 - RNA, 22 nt, Haemophilus influenzae Rd
auaagcucccagugcugaaaua

SEQ ID NO: 2717294 - RNA, 19 nt, Haemophilus influenzae Rd
auaagcucgaaguuuugcu

SEQ ID NO: 2717295 - RNA, 16 nt, Haemophilus influenzae Rd
auaagcugcaucaaua

SEQ ID NO: 2717296 - RNA, 21 nt, Haemophilus influenzae Rd
auaagcuugcguaauguuuaa

SEQ ID NO: 2717297 - RNA, 22 nt, Haemophilus influenzae Rd
auaagcuuggcuuauuuacuuu

SEQ ID NO: 2717298 - RNA, 14 nt, Haemophilus influenzae Rd
auaaggaaaauacu

SEQ ID NO: 2717299 - RNA, 14 nt, Haemophilus influenzae Rd
auaaggaaauugca

SEQ ID NO: 2717300 - RNA, 17 nt, Haemophilus influenzae Rd
auaaggaaauugcaggc

SEQ ID NO: 2717301 - RNA, 14 nt, Haemophilus influenzae Rd
auaaggaccaagca

SEQ ID NO: 2717302 - RNA, 15 nt, Haemophilus influenzae Rd
auaaggaccaagcaa

SEQ ID NO: 2717303 - RNA, 18 nt, Haemophilus influenzae Rd
auaaggauuaauguguuc

SEQ ID NO: 2717304 - RNA, 18 nt, Haemophilus influenzae Rd
auaaggcaccuuuuugcu

SEQ ID NO: 2717305 - RNA, 20 nt, Haemophilus influenzae Rd
auaaggcaccuuuuugcucu

SEQ ID NO: 2717306 - RNA, 15 nt, Haemophilus influenzae Rd
auaaggcagaaauga

SEQ ID NO: 2717307 - RNA, 16 nt, Haemophilus influenzae Rd
auaaggcguaaaacua

SEQ ID NO: 2717308 - RNA, 19 nt, Haemophilus influenzae Rd
auaaggcuugcacaauaau

SEQ ID NO: 2717309 - RNA, 15 nt, Haemophilus influenzae Rd
auaagggcgauauuu

SEQ ID NO: 2717310 - RNA, 17 nt, Haemophilus influenzae Rd
auaagggcugauuuuaa

SEQ ID NO: 2717311 - RNA, 18 nt, Haemophilus influenzae Rd
auaagguaguuuuccuuu

SEQ ID NO: 2717312 - RNA, 20 nt, Haemophilus influenzae Rd
auaaggucagcaaauuaucu

SEQ ID NO: 2717313 - RNA, 13 nt, Haemophilus influenzae Rd
auaaggugcauua

SEQ ID NO: 2717314 - RNA, 19 nt, Haemophilus influenzae Rd
auaaggugcauuaggguua

SEQ ID NO: 2717315 - RNA, 19 nt, Haemophilus influenzae Rd
auaaggugcuaauuaaacu

SEQ ID NO: 2717316 - RNA, 12 nt, Haemophilus influenzae Rd
auaaguaacuuu

SEQ ID NO: 2717317 - RNA, 13 nt, Haemophilus influenzae Rd
auaaguaaugaaa

SEQ ID NO: 2717318 - RNA, 14 nt, Haemophilus influenzae Rd
auaaguaaugaaaa

SEQ ID NO: 2717319 - RNA, 13 nt, Haemophilus influenzae Rd
auaaguaggcaaa

SEQ ID NO: 2717320 - RNA, 14 nt, Haemophilus influenzae Rd
auaaguaggcaaaa

SEQ ID NO: 2717321 - RNA, 23 nt, Haemophilus influenzae Rd
auaaguauaacuuaaaucaacuu

SEQ ID NO: 2717322 - RNA, 16 nt, Haemophilus influenzae Rd
auaaguaugugaugua

SEQ ID NO: 2717323 - RNA, 21 nt, Haemophilus influenzae Rd
auaaguauuuugcagaauacu

SEQ ID NO: 2717324 - RNA, 21 nt, Haemophilus influenzae Rd
auaagugagaaaguuaaucaa

SEQ ID NO: 2717325 - RNA, 23 nt, Haemophilus influenzae Rd
auaagugagaaaguuaaucaaac

SEQ ID NO: 2717326 - RNA, 13 nt, Haemophilus influenzae Rd
auaagugccaaca

SEQ ID NO: 2717327 - RNA, 17 nt, Haemophilus influenzae Rd
auaagugccaacaauau

SEQ ID NO: 2717328 - RNA, 19 nt, Haemophilus influenzae Rd
auaaguggggaaaaauauu

SEQ ID NO: 2717329 - RNA, 23 nt, Haemophilus influenzae Rd
auaagugugaguccgauccauac

SEQ ID NO: 2717330 - RNA, 20 nt, Haemophilus influenzae Rd
auaaguuaccgcuucuuccu

SEQ ID NO: 2717331 - RNA, 16 nt, Haemophilus influenzae Rd
auaaguuauuuauaua

SEQ ID NO: 2717332 - RNA, 14 nt, Haemophilus influenzae Rd
auaaguucaucaac

SEQ ID NO: 2717333 - RNA, 17 nt, Haemophilus influenzae Rd
auaaguucaucaacugc

SEQ ID NO: 2717334 - RNA, 17 nt, Haemophilus influenzae Rd
auaaguucuaaauaaac

SEQ ID NO: 2717335 - RNA, 22 nt, Haemophilus influenzae Rd
auaaguuuugucugaaauuuuu

SEQ ID NO: 2717336 - RNA, 15 nt, Haemophilus influenzae Rd
auaaguuuuuugcca

SEQ ID NO: 2717337 - RNA, 14 nt, Haemophilus influenzae Rd
auaauaaaaaaacc

SEQ ID NO: 2717338 - RNA, 13 nt, Haemophilus influenzae Rd
auaauaaaaauua

SEQ ID NO: 2717339 - RNA, 22 nt, Haemophilus influenzae Rd
auaauaaaauuuauuacaaaca

SEQ ID NO: 2717340 - RNA, 20 nt, Haemophilus influenzae Rd
auaauaaacggaguuuucca

SEQ ID NO: 2717341 - RNA, 22 nt, Haemophilus influenzae Rd
auaauaaacggaguuuuccauu

SEQ ID NO: 2717342 - RNA, 14 nt, Haemophilus influenzae Rd
auaauaaauauaau

SEQ ID NO: 2717343 - RNA, 13 nt, Haemophilus influenzae Rd
auaauaacgccac

SEQ ID NO: 2717344 - RNA, 19 nt, Haemophilus influenzae Rd
auaauaagaaaguaauugc

SEQ ID NO: 2717345 - RNA, 12 nt, Haemophilus influenzae Rd
auaauaagcaca

SEQ ID NO: 2717346 - RNA, 22 nt, Haemophilus influenzae Rd
auaauaagccgaagaagauaau

SEQ ID NO: 2717347 - RNA, 22 nt, Haemophilus influenzae Rd
auaauaagcgauugcucguuau

SEQ ID NO: 2717348 - RNA, 13 nt, Haemophilus influenzae Rd
auaauaaucacaa

SEQ ID NO: 2717349 - RNA, 23 nt, Haemophilus influenzae Rd
auaauaaucuucuugaagaucuu

SEQ ID NO: 2717350 - RNA, 18 nt, Haemophilus influenzae Rd
auaauaauuagcuaaaua

SEQ ID NO: 2717351 - RNA, 19 nt, Haemophilus influenzae Rd
auaauaauuagcuaaauac

SEQ ID NO: 2717352 - RNA, 13 nt, Haemophilus influenzae Rd
auaauaauuuuuc

SEQ ID NO: 2717353 - RNA, 14 nt, Haemophilus influenzae Rd
auaauaauuuuucc

SEQ ID NO: 2717354 - RNA, 18 nt, Haemophilus influenzae Rd
auaauacagaaauaugaa

SEQ ID NO: 2717355 - RNA, 14 nt, Haemophilus influenzae Rd
auaauacguaaauu

SEQ ID NO: 2717356 - RNA, 23 nt, Haemophilus influenzae Rd
auaauacuugaccaaaauugccu

SEQ ID NO: 2717357 - RNA, 18 nt, Haemophilus influenzae Rd
auaauagaaacuaaacuu

SEQ ID NO: 2717358 - RNA, 15 nt, Haemophilus influenzae Rd
auaauagacugaaaa

SEQ ID NO: 2717359 - RNA, 18 nt, Haemophilus influenzae Rd
auaauagccauauuaucu

SEQ ID NO: 2717360 - RNA, 21 nt, Haemophilus influenzae Rd
auaauagcguccuacuacagc

SEQ ID NO: 2717361 - RNA, 20 nt, Haemophilus influenzae Rd
auaauaggauaaauaaacua

SEQ ID NO: 2717362 - RNA, 16 nt, Haemophilus influenzae Rd
auaauaggcgaaucaa

SEQ ID NO: 2717363 - RNA, 18 nt, Haemophilus influenzae Rd
auaauaggcgaaucaaaa

SEQ ID NO: 2717364 - RNA, 23 nt, Haemophilus influenzae Rd
auaauaucaaucacuucucugac

SEQ ID NO: 2717365 - RNA, 12 nt, Haemophilus influenzae Rd
auaauaucacaa

SEQ ID NO: 2717366 - RNA, 18 nt, Haemophilus influenzae Rd
auaauaucagagaaaagu

SEQ ID NO: 2717367 - RNA, 18 nt, Haemophilus influenzae Rd
auaauaucauuuuuagaa

SEQ ID NO: 2717368 - RNA, 16 nt, Haemophilus influenzae Rd
auaauaucugcuuuuu

SEQ ID NO: 2717369 - RNA, 16 nt, Haemophilus influenzae Rd
auaauauuaaagaaaa

SEQ ID NO: 2717370 - RNA, 15 nt, Haemophilus influenzae Rd
auaauauucaaaaca

SEQ ID NO: 2717371 - RNA, 16 nt, Haemophilus influenzae Rd
auaauauucaaaacau

SEQ ID NO: 2717372 - RNA, 17 nt, Haemophilus influenzae Rd
auaauauuccaaaaaau

SEQ ID NO: 2717373 - RNA, 19 nt, Haemophilus influenzae Rd
auaauauuccaaaaaauaa

SEQ ID NO: 2717374 - RNA, 17 nt, Haemophilus influenzae Rd
auaauauuccuuagaaa

SEQ ID NO: 2717375 - RNA, 13 nt, Haemophilus influenzae Rd
auaauauuuaaaa

SEQ ID NO: 2717376 - RNA, 13 nt, Haemophilus influenzae Rd
auaauauuuuggc

SEQ ID NO: 2717377 - RNA, 17 nt, Haemophilus influenzae Rd
auaauauuuuggcaauc

SEQ ID NO: 2717378 - RNA, 15 nt, Haemophilus influenzae Rd
auaauauuuuugcca

SEQ ID NO: 2717379 - RNA, 14 nt, Haemophilus influenzae Rd
auaaucaaaaaugc

SEQ ID NO: 2717380 - RNA, 15 nt, Haemophilus influenzae Rd
auaaucaaaaaugcu

SEQ ID NO: 2717381 - RNA, 22 nt, Haemophilus influenzae Rd
auaaucaaaauuacgccugcaa

SEQ ID NO: 2717382 - RNA, 21 nt, Haemophilus influenzae Rd
auaaucacaguaccuacauuu

SEQ ID NO: 2717383 - RNA, 23 nt, Haemophilus influenzae Rd
auaaucacaguaccuacauuuaa

SEQ ID NO: 2717384 - RNA, 19 nt, Haemophilus influenzae Rd
auaaucacuugauaaaaau

SEQ ID NO: 2717385 - RNA, 21 nt, Haemophilus influenzae Rd
auaaucacuugauaaaaauga

SEQ ID NO: 2717386 - RNA, 22 nt, Haemophilus influenzae Rd
auaaucagcccaagcuuuuucu

SEQ ID NO: 2717387 - RNA, 19 nt, Haemophilus influenzae Rd
auaaucaggauauuuuauu

SEQ ID NO: 2717388 - RNA, 16 nt, Haemophilus influenzae Rd
auaaucauugaaaugu

SEQ ID NO: 2717389 - RNA, 11 nt, Haemophilus influenzae Rd
auaauccaacg

SEQ ID NO: 2717390 - RNA, 21 nt, Haemophilus influenzae Rd
auaauccagcaugagcuucaa

SEQ ID NO: 2717391 - RNA, 19 nt, Haemophilus influenzae Rd
auaauccagcuacauucau

SEQ ID NO: 2717392 - RNA, 21 nt, Haemophilus influenzae Rd
auaauccagcuacauucauca

SEQ ID NO: 2717393 - RNA, 16 nt, Haemophilus influenzae Rd
auaauccauucagccc

SEQ ID NO: 2717394 - RNA, 15 nt, Haemophilus influenzae Rd
auaauccguuaaauu

SEQ ID NO: 2717395 - RNA, 18 nt, Haemophilus influenzae Rd
auaauccuagaguaagua

SEQ ID NO: 2717396 - RNA, 16 nt, Haemophilus influenzae Rd
auaauccucuuuaaaa

SEQ ID NO: 2717397 - RNA, 22 nt, Haemophilus influenzae Rd
auaauccugguauuuacaaguc

SEQ ID NO: 2717398 - RNA, 13 nt, Haemophilus influenzae Rd
auaauccuuuuuu

SEQ ID NO: 2717399 - RNA, 14 nt, Haemophilus influenzae Rd
auaauccuuuuuuu

SEQ ID NO: 2717400 - RNA, 15 nt, Haemophilus influenzae Rd
auaauccuuuuuuug

SEQ ID NO: 2717401 - RNA, 14 nt, Haemophilus influenzae Rd
auaaucgaaaaagu

SEQ ID NO: 2717402 - RNA, 19 nt, Haemophilus influenzae Rd
auaaucgccaaaaucauca

SEQ ID NO: 2717403 - RNA, 16 nt, Haemophilus influenzae Rd
auaaucuaauccaaau

SEQ ID NO: 2717404 - RNA, 15 nt, Haemophilus influenzae Rd
auaaucuacaaaaca

SEQ ID NO: 2717405 - RNA, 16 nt, Haemophilus influenzae Rd
auaaucucuucuaaaa

SEQ ID NO: 2717406 - RNA, 21 nt, Haemophilus influenzae Rd
auaaucugauugagaaaaugu

SEQ ID NO: 2717407 - RNA, 14 nt, Haemophilus influenzae Rd
auaaucuuaaauaa

SEQ ID NO: 2717408 - RNA, 18 nt, Haemophilus influenzae Rd
auaaucuuaaauaauuaa

SEQ ID NO: 2717409 - RNA, 15 nt, Haemophilus influenzae Rd
auaaucuuuaaaaug

SEQ ID NO: 2717410 - RNA, 20 nt, Haemophilus influenzae Rd
auaaucuuuaaauuuugcuu

SEQ ID NO: 2717411 - RNA, 17 nt, Haemophilus influenzae Rd
auaaugaauauauucau

SEQ ID NO: 2717412 - RNA, 11 nt, Haemophilus influenzae Rd
auaaugaugag

SEQ ID NO: 2717413 - RNA, 17 nt, Haemophilus influenzae Rd
auaaugcaaaaacaagu

SEQ ID NO: 2717414 - RNA, 15 nt, Haemophilus influenzae Rd
auaaugcauagccaa

SEQ ID NO: 2717415 - RNA, 21 nt, Haemophilus influenzae Rd
auaaugcccgcacuuuuaacc

SEQ ID NO: 2717416 - RNA, 20 nt, Haemophilus influenzae Rd
auaaugccuacuuuuuaugu

SEQ ID NO: 2717417 - RNA, 14 nt, Haemophilus influenzae Rd
auaaugccucuuua

SEQ ID NO: 2717418 - RNA, 16 nt, Haemophilus influenzae Rd
auaaugccucuuuaac

SEQ ID NO: 2717419 - RNA, 15 nt, Haemophilus influenzae Rd
auaaugcgaucuuuu

SEQ ID NO: 2717420 - RNA, 21 nt, Haemophilus influenzae Rd
auaaugcgaucuuuuguuacu

SEQ ID NO: 2717421 - RNA, 23 nt, Haemophilus influenzae Rd
auaaugcgaucuuuuguuacuuu

SEQ ID NO: 2717422 - RNA, 22 nt, Haemophilus influenzae Rd
auaauggcuuuucucaaaacau

SEQ ID NO: 2717423 - RNA, 20 nt, Haemophilus influenzae Rd
auaaugguuacagaaauauu

SEQ ID NO: 2717424 - RNA, 22 nt, Haemophilus influenzae Rd
auaaugguuacagaaauauuau

SEQ ID NO: 2717425 - RNA, 22 nt, Haemophilus influenzae Rd
auaaugugagaauaaccacaua

SEQ ID NO: 2717426 - RNA, 14 nt, Haemophilus influenzae Rd
auaaugugcaaaaa

SEQ ID NO: 2717427 - RNA, 17 nt, Haemophilus influenzae Rd
auaaugugcaaaaauau

SEQ ID NO: 2717428 - RNA, 16 nt, Haemophilus influenzae Rd
auaauguggugcuguu

SEQ ID NO: 2717429 - RNA, 20 nt, Haemophilus influenzae Rd
auaauguguugauuucuaca

SEQ ID NO: 2717430 - RNA, 20 nt, Haemophilus influenzae Rd
auaauguucccuauaaauaa

SEQ ID NO: 2717431 - RNA, 17 nt, Haemophilus influenzae Rd
auaauguugcugauugc

SEQ ID NO: 2717432 - RNA, 22 nt, Haemophilus influenzae Rd
auaauguugcugauugcacauu

SEQ ID NO: 2717433 - RNA, 13 nt, Haemophilus influenzae Rd
auaauguuucacu

SEQ ID NO: 2717434 - RNA, 14 nt, Haemophilus influenzae Rd
auaauguuuucauu

SEQ ID NO: 2717435 - RNA, 13 nt, Haemophilus influenzae Rd
auaauuaaaaaua

SEQ ID NO: 2717436 - RNA, 15 nt, Haemophilus influenzae Rd
auaauuaaaaauaaa

SEQ ID NO: 2717437 - RNA, 16 nt, Haemophilus influenzae Rd
auaauuaaaaauaaau

SEQ ID NO: 2717438 - RNA, 19 nt, Haemophilus influenzae Rd
auaauuaaacagccaaaca

SEQ ID NO: 2717439 - RNA, 14 nt, Haemophilus influenzae Rd
auaauuaaacauuu

SEQ ID NO: 2717440 - RNA, 14 nt, Haemophilus influenzae Rd
auaauuaaacuuuc

SEQ ID NO: 2717441 - RNA, 15 nt, Haemophilus influenzae Rd
auaauuaaagccgaa

SEQ ID NO: 2717442 - RNA, 17 nt, Haemophilus influenzae Rd
auaauuaaaucuucgcc

SEQ ID NO: 2717443 - RNA, 11 nt, Haemophilus influenzae Rd
auaauuaaauu

SEQ ID NO: 2717444 - RNA, 13 nt, Haemophilus influenzae Rd
auaauuaaauuaa

SEQ ID NO: 2717445 - RNA, 15 nt, Haemophilus influenzae Rd
auaauuaacaaauaa

SEQ ID NO: 2717446 - RNA, 17 nt, Haemophilus influenzae Rd
auaauuaacaaauaauu

SEQ ID NO: 2717447 - RNA, 21 nt, Haemophilus influenzae Rd
auaauuaaggucuuacaccua

SEQ ID NO: 2717448 - RNA, 14 nt, Haemophilus influenzae Rd
auaauuaauaaaaa

SEQ ID NO: 2717449 - RNA, 15 nt, Haemophilus influenzae Rd
auaauuaauaaaaaa

SEQ ID NO: 2717450 - RNA, 20 nt, Haemophilus influenzae Rd
auaauuaaucugcaccuuaa

SEQ ID NO: 2717451 - RNA, 18 nt, Haemophilus influenzae Rd
auaauuaccugugaaaac

SEQ ID NO: 2717452 - RNA, 22 nt, Haemophilus influenzae Rd
auaauuacgcaacgcuuguuug

SEQ ID NO: 2717453 - RNA, 18 nt, Haemophilus influenzae Rd
auaauuacgccuaaccaa

SEQ ID NO: 2717454 - RNA, 13 nt, Haemophilus influenzae Rd
auaauuagauaau

SEQ ID NO: 2717455 - RNA, 10 nt, Haemophilus influenzae Rd
auaauuauua

SEQ ID NO: 2717456 - RNA, 12 nt, Haemophilus influenzae Rd
auaauuauuauc

SEQ ID NO: 2717457 - RNA, 22 nt, Haemophilus influenzae Rd
auaauucaagaugauauuuaau

SEQ ID NO: 2717458 - RNA, 20 nt, Haemophilus influenzae Rd
auaauucagcgagagaauau

SEQ ID NO: 2717459 - RNA, 15 nt, Haemophilus influenzae Rd
auaauucaucaaaau

SEQ ID NO: 2717460 - RNA, 17 nt, Haemophilus influenzae Rd
auaauuccuaaaauaca

SEQ ID NO: 2717461 - RNA, 12 nt, Haemophilus influenzae Rd
auaauuccuuuu

SEQ ID NO: 2717462 - RNA, 14 nt, Haemophilus influenzae Rd
auaauucuuuaauc

SEQ ID NO: 2717463 - RNA, 15 nt, Haemophilus influenzae Rd
auaauugaugcuaaa

SEQ ID NO: 2717464 - RNA, 19 nt, Haemophilus influenzae Rd
auaauugaugcuaaauuau

SEQ ID NO: 2717465 - RNA, 20 nt, Haemophilus influenzae Rd
auaauuuagcccgaaaauua

SEQ ID NO: 2717466 - RNA, 21 nt, Haemophilus influenzae Rd
auaauuuagcccgaaaauuaa

SEQ ID NO: 2717467 - RNA, 17 nt, Haemophilus influenzae Rd
auaauuuaguuauaugc

SEQ ID NO: 2717468 - RNA, 12 nt, Haemophilus influenzae Rd
auaauuuauuca

SEQ ID NO: 2717469 - RNA, 14 nt, Haemophilus influenzae Rd
auaauuuauucaaa

SEQ ID NO: 2717470 - RNA, 16 nt, Haemophilus influenzae Rd
auaauuuauucaaaau

SEQ ID NO: 2717471 - RNA, 21 nt, Haemophilus influenzae Rd
auaauuuauuugcuaguuuag

SEQ ID NO: 2717472 - RNA, 22 nt, Haemophilus influenzae Rd
auaauuucaauauaaguuguag

SEQ ID NO: 2717473 - RNA, 22 nt, Haemophilus influenzae Rd
auaauuucaucgcguuuuuucu

SEQ ID NO: 2717474 - RNA, 13 nt, Haemophilus influenzae Rd
auaauuucauugu

SEQ ID NO: 2717475 - RNA, 17 nt, Haemophilus influenzae Rd
auaauuucauuguuaaa

SEQ ID NO: 2717476 - RNA, 18 nt, Haemophilus influenzae Rd
auaauuucccuaaaaucu

SEQ ID NO: 2717477 - RNA, 17 nt, Haemophilus influenzae Rd
auaauuuccuauacuaa

SEQ ID NO: 2717478 - RNA, 22 nt, Haemophilus influenzae Rd
auaauuuccuuuuuuauuuauu

SEQ ID NO: 2717479 - RNA, 20 nt, Haemophilus influenzae Rd
auaauuucuuguuuaaauuc

SEQ ID NO: 2717480 - RNA, 21 nt, Haemophilus influenzae Rd
auaauuugaccuucauaaacu

SEQ ID NO: 2717481 - RNA, 16 nt, Haemophilus influenzae Rd
auaauuugcaucauuu

SEQ ID NO: 2717482 - RNA, 24 nt, Haemophilus influenzae Rd
auaauuuuacguuucauuuuugca

SEQ ID NO: 2717483 - RNA, 12 nt, Haemophilus influenzae Rd
auaauuuuagaa

SEQ ID NO: 2717484 - RNA, 12 nt, Haemophilus influenzae Rd
auaauuuucaaa

SEQ ID NO: 2717485 - RNA, 13 nt, Haemophilus influenzae Rd
auaauuuucaaua

SEQ ID NO: 2717486 - RNA, 17 nt, Haemophilus influenzae Rd
auaauuuucaauagcca

SEQ ID NO: 2717487 - RNA, 18 nt, Haemophilus influenzae Rd
auaauuuucuuugccaca

SEQ ID NO: 2717488 - RNA, 20 nt, Haemophilus influenzae Rd
auaauuuugaugugauuauu

SEQ ID NO: 2717489 - RNA, 21 nt, Haemophilus influenzae Rd
auaauuuuggaucauuagcaa

SEQ ID NO: 2717490 - RNA, 13 nt, Haemophilus influenzae Rd
auaauuuuuaauu

SEQ ID NO: 2717491 - RNA, 15 nt, Haemophilus influenzae Rd
auaauuuuucacaua

SEQ ID NO: 2717492 - RNA, 13 nt, Haemophilus influenzae Rd
auaauuuuucuuc

SEQ ID NO: 2717493 - RNA, 18 nt, Haemophilus influenzae Rd
auaauuuuucuucagcau

SEQ ID NO: 2717494 - RNA, 23 nt, Haemophilus influenzae Rd
auaauuuuucuucagcaucaaca

SEQ ID NO: 2717495 - RNA, 22 nt, Haemophilus influenzae Rd
auacaaaaagugcgguuaaaaa

SEQ ID NO: 2717496 - RNA, 11 nt, Haemophilus influenzae Rd
auacaaaauuu

SEQ ID NO: 2717497 - RNA, 14 nt, Haemophilus influenzae Rd
auacaaaauuuugu

SEQ ID NO: 2717498 - RNA, 12 nt, Haemophilus influenzae Rd
auacaaagauuu

SEQ ID NO: 2717499 - RNA, 17 nt, Haemophilus influenzae Rd
auacaaauaacacagaa

SEQ ID NO: 2717500 - RNA, 17 nt, Haemophilus influenzae Rd
auacaagaccaauauaa

SEQ ID NO: 2717501 - RNA, 16 nt, Haemophilus influenzae Rd
auacaagcggcugaca

SEQ ID NO: 2717502 - RNA, 16 nt, Haemophilus influenzae Rd
auacaagguacuugaa

SEQ ID NO: 2717503 - RNA, 16 nt, Haemophilus influenzae Rd
auacaaguauuuuccu

SEQ ID NO: 2717504 - RNA, 20 nt, Haemophilus influenzae Rd
auacaaguggcgguaaaaau

SEQ ID NO: 2717505 - RNA, 21 nt, Haemophilus influenzae Rd
auacaaguggcgguaaaaaug

SEQ ID NO: 2717506 - RNA, 22 nt, Haemophilus influenzae Rd
auacaaguggcgguaaaaaugc

SEQ ID NO: 2717507 - RNA, 20 nt, Haemophilus influenzae Rd
auacaaucacgaucugcaac

SEQ ID NO: 2717508 - RNA, 19 nt, Haemophilus influenzae Rd
auacaauccaccaaaugca

SEQ ID NO: 2717509 - RNA, 19 nt, Haemophilus influenzae Rd
auacaaucgguuaaaagua

SEQ ID NO: 2717510 - RNA, 23 nt, Haemophilus influenzae Rd
auacaaucgguuaaaaguaagca

SEQ ID NO: 2717511 - RNA, 14 nt, Haemophilus influenzae Rd
auacacaccaucaa

SEQ ID NO: 2717512 - RNA, 23 nt, Haemophilus influenzae Rd
auacacaucagagcgaauacugu

SEQ ID NO: 2717513 - RNA, 20 nt, Haemophilus influenzae Rd
auacacauggccaauuucau

SEQ ID NO: 2717514 - RNA, 13 nt, Haemophilus influenzae Rd
auacaccaauaau

SEQ ID NO: 2717515 - RNA, 15 nt, Haemophilus influenzae Rd
auacaccccaaaauc

SEQ ID NO: 2717516 - RNA, 20 nt, Haemophilus influenzae Rd
auacacucacuuuuccuugu

SEQ ID NO: 2717517 - RNA, 14 nt, Haemophilus influenzae Rd
auacacuucuaaaa

SEQ ID NO: 2717518 - RNA, 14 nt, Haemophilus influenzae Rd
auacacuuuaaauu

SEQ ID NO: 2717519 - RNA, 16 nt, Haemophilus influenzae Rd
auacacuuuaaauuuu

SEQ ID NO: 2717520 - RNA, 23 nt, Haemophilus influenzae Rd
auacacuuuaaauuuuccuguuu

SEQ ID NO: 2717521 - RNA, 14 nt, Haemophilus influenzae Rd
auacagccacuauu

SEQ ID NO: 2717522 - RNA, 17 nt, Haemophilus influenzae Rd
auacagcgaacauuuuu

SEQ ID NO: 2717523 - RNA, 13 nt, Haemophilus influenzae Rd
auacaguaaaaau

SEQ ID NO: 2717524 - RNA, 20 nt, Haemophilus influenzae Rd
auacagugcagaaaauugcc

SEQ ID NO: 2717525 - RNA, 21 nt, Haemophilus influenzae Rd
auacagugcagaaaauugcca

SEQ ID NO: 2717526 - RNA, 14 nt, Haemophilus influenzae Rd
auacaguuagaaca

SEQ ID NO: 2717527 - RNA, 17 nt, Haemophilus influenzae Rd
auacauaaaaaacacag

SEQ ID NO: 2717528 - RNA, 21 nt, Haemophilus influenzae Rd
auacauaaagaauaauuuuca

SEQ ID NO: 2717529 - RNA, 21 nt, Haemophilus influenzae Rd
auacauaacgccaagguuauu

SEQ ID NO: 2717530 - RNA, 12 nt, Haemophilus influenzae Rd
auacauaauauu

SEQ ID NO: 2717531 - RNA, 18 nt, Haemophilus influenzae Rd
auacauagaacguuuuuu

SEQ ID NO: 2717532 - RNA, 17 nt, Haemophilus influenzae Rd
auacaucacuaauacgc

SEQ ID NO: 2717533 - RNA, 23 nt, Haemophilus influenzae Rd
auacaucaggaggaauaaugaau

SEQ ID NO: 2717534 - RNA, 13 nt, Haemophilus influenzae Rd
auacaucuucaca

SEQ ID NO: 2717535 - RNA, 15 nt, Haemophilus influenzae Rd
auacauuaacaaugc

SEQ ID NO: 2717536 - RNA, 15 nt, Haemophilus influenzae Rd
auacauuaaguauau

SEQ ID NO: 2717537 - RNA, 14 nt, Haemophilus influenzae Rd
auacauuauuaaaa

SEQ ID NO: 2717538 - RNA, 14 nt, Haemophilus influenzae Rd
auacauuucuaaaa

SEQ ID NO: 2717539 - RNA, 16 nt, Haemophilus influenzae Rd
auacauuucuaaaaua

SEQ ID NO: 2717540 - RNA, 20 nt, Haemophilus influenzae Rd
auacauuucuaaaauaauau

SEQ ID NO: 2717541 - RNA, 19 nt, Haemophilus influenzae Rd
auacauuuuguuucuaaau

SEQ ID NO: 2717542 - RNA, 18 nt, Haemophilus influenzae Rd
auaccaaggcauuuuuuc

SEQ ID NO: 2717543 - RNA, 21 nt, Haemophilus influenzae Rd
auaccaagugcugguagcaau

SEQ ID NO: 2717544 - RNA, 17 nt, Haemophilus influenzae Rd
auaccaauaauaauauc

SEQ ID NO: 2717545 - RNA, 19 nt, Haemophilus influenzae Rd
auaccacacccuuuucaaa

SEQ ID NO: 2717546 - RNA, 12 nt, Haemophilus influenzae Rd
auaccacauucc

SEQ ID NO: 2717547 - RNA, 13 nt, Haemophilus influenzae Rd
auaccacauucca

SEQ ID NO: 2717548 - RNA, 14 nt, Haemophilus influenzae Rd
auaccacauuccau

SEQ ID NO: 2717549 - RNA, 22 nt, Haemophilus influenzae Rd
auaccaccgccgauaguuaaug

SEQ ID NO: 2717550 - RNA, 22 nt, Haemophilus influenzae Rd
auaccagccugaauggcgaauu

SEQ ID NO: 2717551 - RNA, 22 nt, Haemophilus influenzae Rd
auaccauuaauggguaaucaau

SEQ ID NO: 2717552 - RNA, 12 nt, Haemophilus influenzae Rd
auaccauuacau

SEQ ID NO: 2717553 - RNA, 20 nt, Haemophilus influenzae Rd
auaccauucuuucaauaauu

SEQ ID NO: 2717554 - RNA, 16 nt, Haemophilus influenzae Rd
auaccauuuaaaagua

SEQ ID NO: 2717555 - RNA, 13 nt, Haemophilus influenzae Rd
auaccauuugauu

SEQ ID NO: 2717556 - RNA, 21 nt, Haemophilus influenzae Rd
auacccauuggaagauuucuu

SEQ ID NO: 2717557 - RNA, 23 nt, Haemophilus influenzae Rd
auacccgcuucuaaggcagcaag

SEQ ID NO: 2717558 - RNA, 23 nt, Haemophilus influenzae Rd
auaccgauaauauguuuugccaa

SEQ ID NO: 2717559 - RNA, 12 nt, Haemophilus influenzae Rd
auaccgcccauu

SEQ ID NO: 2717560 - RNA, 12 nt, Haemophilus influenzae Rd
auaccguauuuu

SEQ ID NO: 2717561 - RNA, 22 nt, Haemophilus influenzae Rd
auaccguguaaugcuuuuguag

SEQ ID NO: 2717562 - RNA, 22 nt, Haemophilus influenzae Rd
auaccuagucccgcuuuugcca

SEQ ID NO: 2717563 - RNA, 16 nt, Haemophilus influenzae Rd
auaccuaucuuauuaa

SEQ ID NO: 2717564 - RNA, 13 nt, Haemophilus influenzae Rd
auacgaaaaauua

SEQ ID NO: 2717565 - RNA, 19 nt, Haemophilus influenzae Rd
auacgaaauagcguuuuuc

SEQ ID NO: 2717566 - RNA, 21 nt, Haemophilus influenzae Rd
auacgaauguuugaucgguuu

SEQ ID NO: 2717567 - RNA, 21 nt, Haemophilus influenzae Rd
auacgaauugcgguuucaguu

SEQ ID NO: 2717568 - RNA, 14 nt, Haemophilus influenzae Rd
auacgaucugcauc

SEQ ID NO: 2717569 - RNA, 22 nt, Haemophilus influenzae Rd
auacgccaacgcuuaaugaacu

SEQ ID NO: 2717570 - RNA, 18 nt, Haemophilus influenzae Rd
auacgccaagauaacuca

SEQ ID NO: 2717571 - RNA, 22 nt, Haemophilus influenzae Rd
auacgcccauugaaauaacaca

SEQ ID NO: 2717572 - RNA, 20 nt, Haemophilus influenzae Rd
auacgcgcccauucauuuug

SEQ ID NO: 2717573 - RNA, 22 nt, Haemophilus influenzae Rd
auacggauauuaguaauauauu

SEQ ID NO: 2717574 - RNA, 14 nt, Haemophilus influenzae Rd
auacggugaaauuu

SEQ ID NO: 2717575 - RNA, 14 nt, Haemophilus influenzae Rd
auacguaaauucaa

SEQ ID NO: 2717576 - RNA, 21 nt, Haemophilus influenzae Rd
auacguaaucccauuucaucu

SEQ ID NO: 2717577 - RNA, 22 nt, Haemophilus influenzae Rd
auacguaaucccauuucaucuu

SEQ ID NO: 2717578 - RNA, 23 nt, Haemophilus influenzae Rd
auacgucgucuuugaaacggcga

SEQ ID NO: 2717579 - RNA, 16 nt, Haemophilus influenzae Rd
auacgugauaaugccu

SEQ ID NO: 2717580 - RNA, 15 nt, Haemophilus influenzae Rd
auacguuguuuuucu

SEQ ID NO: 2717581 - RNA, 16 nt, Haemophilus influenzae Rd
auacguuuaauauagu

SEQ ID NO: 2717582 - RNA, 13 nt, Haemophilus influenzae Rd
auacguuucauau

SEQ ID NO: 2717583 - RNA, 20 nt, Haemophilus influenzae Rd
auacuaaaaaauuaaauugu

SEQ ID NO: 2717584 - RNA, 19 nt, Haemophilus influenzae Rd
auacuaaauacauuuuuau

SEQ ID NO: 2717585 - RNA, 19 nt, Haemophilus influenzae Rd
auacuaaggguauacuuua

SEQ ID NO: 2717586 - RNA, 22 nt, Haemophilus influenzae Rd
auacuaauuuuaguauucuuua

SEQ ID NO: 2717587 - RNA, 22 nt, Haemophilus influenzae Rd
auacuacggcguagaaugcaaa

SEQ ID NO: 2717588 - RNA, 20 nt, Haemophilus influenzae Rd
auacuauuacccacuucaca

SEQ ID NO: 2717589 - RNA, 16 nt, Haemophilus influenzae Rd
auacucacagagccuu

SEQ ID NO: 2717590 - RNA, 21 nt, Haemophilus influenzae Rd
auacucacagagccuuuuucu

SEQ ID NO: 2717591 - RNA, 18 nt, Haemophilus influenzae Rd
auacuccaacccagaaua

SEQ ID NO: 2717592 - RNA, 14 nt, Haemophilus influenzae Rd
auacucuccccuug

SEQ ID NO: 2717593 - RNA, 17 nt, Haemophilus influenzae Rd
auacucuuaacaaaaca

SEQ ID NO: 2717594 - RNA, 16 nt, Haemophilus influenzae Rd
auacugaaaugauuau

SEQ ID NO: 2717595 - RNA, 16 nt, Haemophilus influenzae Rd
auacugagaucucuau

SEQ ID NO: 2717596 - RNA, 15 nt, Haemophilus influenzae Rd
auacugccuuuaaag

SEQ ID NO: 2717597 - RNA, 18 nt, Haemophilus influenzae Rd
auacugccuuuaaagaag

SEQ ID NO: 2717598 - RNA, 19 nt, Haemophilus influenzae Rd
auacugccuuuaaagaagu

SEQ ID NO: 2717599 - RNA, 22 nt, Haemophilus influenzae Rd
auacugcuuucuagaugaugaa

SEQ ID NO: 2717600 - RNA, 22 nt, Haemophilus influenzae Rd
auacuguuaccaauaacuaaaa

SEQ ID NO: 2717601 - RNA, 17 nt, Haemophilus influenzae Rd
auacuguuuggcaaaua

SEQ ID NO: 2717602 - RNA, 18 nt, Haemophilus influenzae Rd
auacuuaauagcugggca

SEQ ID NO: 2717603 - RNA, 12 nt, Haemophilus influenzae Rd
auacuuaaucaa

SEQ ID NO: 2717604 - RNA, 12 nt, Haemophilus influenzae Rd
auacuuaauuuc

SEQ ID NO: 2717605 - RNA, 16 nt, Haemophilus influenzae Rd
auacuuacucaauaug

SEQ ID NO: 2717606 - RNA, 18 nt, Haemophilus influenzae Rd
auacuucggggaucauuu

SEQ ID NO: 2717607 - RNA, 21 nt, Haemophilus influenzae Rd
auacuucuuuagcugcaauaa

SEQ ID NO: 2717608 - RNA, 14 nt, Haemophilus influenzae Rd
auacuugccacagg

SEQ ID NO: 2717609 - RNA, 18 nt, Haemophilus influenzae Rd
auacuugccacagguaaa

SEQ ID NO: 2717610 - RNA, 22 nt, Haemophilus influenzae Rd
auacuuggugcaauaaaaucau

SEQ ID NO: 2717611 - RNA, 16 nt, Haemophilus influenzae Rd
auacuuucagcuucca

SEQ ID NO: 2717612 - RNA, 23 nt, Haemophilus influenzae Rd
auacuuucagcuuccauccacca

SEQ ID NO: 2717613 - RNA, 23 nt, Haemophilus influenzae Rd
auacuuugcuugaguauuuacua

SEQ ID NO: 2717614 - RNA, 19 nt, Haemophilus influenzae Rd
auacuuuuaauuaaauaca

SEQ ID NO: 2717615 - RNA, 13 nt, Haemophilus influenzae Rd
auacuuuugcuuc

SEQ ID NO: 2717616 - RNA, 23 nt, Haemophilus influenzae Rd
auacuuuuguauguuggcgaauu

SEQ ID NO: 2717617 - RNA, 12 nt, Haemophilus influenzae Rd
auagaaaagccc

SEQ ID NO: 2717618 - RNA, 16 nt, Haemophilus influenzae Rd
auagaaauaaagauag

SEQ ID NO: 2717619 - RNA, 15 nt, Haemophilus influenzae Rd
auagaaaucauaaac

SEQ ID NO: 2717620 - RNA, 21 nt, Haemophilus influenzae Rd
auagaaccgucuuuaaauaga

SEQ ID NO: 2717621 - RNA, 18 nt, Haemophilus influenzae Rd
auagaagugcgguugcuu

SEQ ID NO: 2717622 - RNA, 23 nt, Haemophilus influenzae Rd
auagaaugaaaaacauucaaucu

SEQ ID NO: 2717623 - RNA, 23 nt, Haemophilus influenzae Rd
auagaauuuugcaagccaauaga

SEQ ID NO: 2717624 - RNA, 16 nt, Haemophilus influenzae Rd
auagacauagaaaguu

SEQ ID NO: 2717625 - RNA, 21 nt, Haemophilus influenzae Rd
auagaccacaugaauuucuaa

SEQ ID NO: 2717626 - RNA, 12 nt, Haemophilus influenzae Rd
auagacuucaag

SEQ ID NO: 2717627 - RNA, 22 nt, Haemophilus influenzae Rd
auagacuucaagugauuauuuc

SEQ ID NO: 2717628 - RNA, 16 nt, Haemophilus influenzae Rd
auagagcuucauagaa

SEQ ID NO: 2717629 - RNA, 16 nt, Haemophilus influenzae Rd
auagaggaaccaugua

SEQ ID NO: 2717630 - RNA, 18 nt, Haemophilus influenzae Rd
auagauaaauaucaaaau

SEQ ID NO: 2717631 - RNA, 21 nt, Haemophilus influenzae Rd
auagauaacuucuucauuccc

SEQ ID NO: 2717632 - RNA, 16 nt, Haemophilus influenzae Rd
auagauaugugaauaa

SEQ ID NO: 2717633 - RNA, 13 nt, Haemophilus influenzae Rd
auagaugaaauuu

SEQ ID NO: 2717634 - RNA, 16 nt, Haemophilus influenzae Rd
auagaugaaauuuauu

SEQ ID NO: 2717635 - RNA, 16 nt, Haemophilus influenzae Rd
auagaugaauuagaaa

SEQ ID NO: 2717636 - RNA, 23 nt, Haemophilus influenzae Rd
auagaugaauuagaaaaauuuaa

SEQ ID NO: 2717637 - RNA, 12 nt, Haemophilus influenzae Rd
auagauguuaau

SEQ ID NO: 2717638 - RNA, 22 nt, Haemophilus influenzae Rd
auagauuauuagcauaauaaaa

SEQ ID NO: 2717639 - RNA, 14 nt, Haemophilus influenzae Rd
auagauuuccuuug

SEQ ID NO: 2717640 - RNA, 19 nt, Haemophilus influenzae Rd
auagcaaugccaaucuaaa

SEQ ID NO: 2717641 - RNA, 21 nt, Haemophilus influenzae Rd
auagcaaugccaaucuaaaca

SEQ ID NO: 2717642 - RNA, 15 nt, Haemophilus influenzae Rd
auagcaucugauuuu

SEQ ID NO: 2717643 - RNA, 20 nt, Haemophilus influenzae Rd
auagccaacgucuuacuuuu

SEQ ID NO: 2717644 - RNA, 16 nt, Haemophilus influenzae Rd
auagccaagugcuuua

SEQ ID NO: 2717645 - RNA, 22 nt, Haemophilus influenzae Rd
auagccgacaucuauuuugcuu

SEQ ID NO: 2717646 - RNA, 15 nt, Haemophilus influenzae Rd
auagccguccauuuc

SEQ ID NO: 2717647 - RNA, 15 nt, Haemophilus influenzae Rd
auagccuauaauuaa

SEQ ID NO: 2717648 - RNA, 20 nt, Haemophilus influenzae Rd
auagccuauaauuaaaguua

SEQ ID NO: 2717649 - RNA, 13 nt, Haemophilus influenzae Rd
auagccucuaaga

SEQ ID NO: 2717650 - RNA, 17 nt, Haemophilus influenzae Rd
auagccucuucuuuuga

SEQ ID NO: 2717651 - RNA, 16 nt, Haemophilus influenzae Rd
auagccuguaaauuua

SEQ ID NO: 2717652 - RNA, 13 nt, Haemophilus influenzae Rd
auagccuuuucua

SEQ ID NO: 2717653 - RNA, 23 nt, Haemophilus influenzae Rd
auagcgaucugcugguacgagca

SEQ ID NO: 2717654 - RNA, 14 nt, Haemophilus influenzae Rd
auagcggucaucua

SEQ ID NO: 2717655 - RNA, 20 nt, Haemophilus influenzae Rd
auagcggucaucuacccaca

SEQ ID NO: 2717656 - RNA, 18 nt, Haemophilus influenzae Rd
auagcuaacaaauuuaau

SEQ ID NO: 2717657 - RNA, 14 nt, Haemophilus influenzae Rd
auagcuaacaauau

SEQ ID NO: 2717658 - RNA, 19 nt, Haemophilus influenzae Rd
auagcuacgguuauuuuuu

SEQ ID NO: 2717659 - RNA, 22 nt, Haemophilus influenzae Rd
auagcuagaaagcaauguugca

SEQ ID NO: 2717660 - RNA, 20 nt, Haemophilus influenzae Rd
auagcucagucgguagagca

SEQ ID NO: 2717661 - RNA, 20 nt, Haemophilus influenzae Rd
auagcucaguugguagagca

SEQ ID NO: 2717662 - RNA, 15 nt, Haemophilus influenzae Rd
auagcucgaugagaa

SEQ ID NO: 2717663 - RNA, 17 nt, Haemophilus influenzae Rd
auagcugaaaaauaaaa

SEQ ID NO: 2717664 - RNA, 22 nt, Haemophilus influenzae Rd
auagcugaaaaauaaaaaauau

SEQ ID NO: 2717665 - RNA, 19 nt, Haemophilus influenzae Rd
auagcugggcaaaaucauc

SEQ ID NO: 2717666 - RNA, 17 nt, Haemophilus influenzae Rd
auagcuucugccagcau

SEQ ID NO: 2717667 - RNA, 18 nt, Haemophilus influenzae Rd
auagcuugaauugcuccu

SEQ ID NO: 2717668 - RNA, 18 nt, Haemophilus influenzae Rd
auagcuuuuuaauugugu

SEQ ID NO: 2717669 - RNA, 17 nt, Haemophilus influenzae Rd
auaggaagcauuucuaa

SEQ ID NO: 2717670 - RNA, 15 nt, Haemophilus influenzae Rd
auaggauaaauaaac

SEQ ID NO: 2717671 - RNA, 20 nt, Haemophilus influenzae Rd
auaggauuaacguaagaaau

SEQ ID NO: 2717672 - RNA, 13 nt, Haemophilus influenzae Rd
auaggauuauuca

SEQ ID NO: 2717673 - RNA, 19 nt, Haemophilus influenzae Rd
auaggcaaguucguuuuuu

SEQ ID NO: 2717674 - RNA, 20 nt, Haemophilus influenzae Rd
auaggcgguaucaaugccau

SEQ ID NO: 2717675 - RNA, 22 nt, Haemophilus influenzae Rd
auaggguaaacgauaagaaugu

SEQ ID NO: 2717676 - RNA, 15 nt, Haemophilus influenzae Rd
auaggguaaauaaaa

SEQ ID NO: 2717677 - RNA, 15 nt, Haemophilus influenzae Rd
auaggguaauaaaaa

SEQ ID NO: 2717678 - RNA, 18 nt, Haemophilus influenzae Rd
auaggguaauaaaaaaua

SEQ ID NO: 2717679 - RNA, 15 nt, Haemophilus influenzae Rd
auagguauagccuuc

SEQ ID NO: 2717680 - RNA, 14 nt, Haemophilus influenzae Rd
auagguuauaaguu

SEQ ID NO: 2717681 - RNA, 17 nt, Haemophilus influenzae Rd
  misc_feature (5)..(5): n is a, c, g or u
auagnaaaaauuuaggg

SEQ ID NO: 2717682 - RNA, 17 nt, Haemophilus influenzae Rd
auaguaaaaaaucaagc

SEQ ID NO: 2717683 - RNA, 19 nt, Haemophilus influenzae Rd
auaguaaagaauauuuuaa

SEQ ID NO: 2717684 - RNA, 22 nt, Haemophilus influenzae Rd
auaguaagcaccaaaauuuguu

SEQ ID NO: 2717685 - RNA, 12 nt, Haemophilus influenzae Rd
auaguaauguuc

SEQ ID NO: 2717686 - RNA, 22 nt, Haemophilus influenzae Rd
auaguaauguucuacguaauuu

SEQ ID NO: 2717687 - RNA, 20 nt, Haemophilus influenzae Rd
auaguagaauguaaauuauu

SEQ ID NO: 2717688 - RNA, 17 nt, Haemophilus influenzae Rd
auaguagagucauuuac

SEQ ID NO: 2717689 - RNA, 14 nt, Haemophilus influenzae Rd
auaguaguaaugaa

SEQ ID NO: 2717690 - RNA, 13 nt, Haemophilus influenzae Rd
auaguauauuuau

SEQ ID NO: 2717691 - RNA, 16 nt, Haemophilus influenzae Rd
auagucaaauaacccu

SEQ ID NO: 2717692 - RNA, 20 nt, Haemophilus influenzae Rd
auagucgcuggaacuucuaa

SEQ ID NO: 2717693 - RNA, 15 nt, Haemophilus influenzae Rd
auagucguuuaacca

SEQ ID NO: 2717694 - RNA, 18 nt, Haemophilus influenzae Rd
auagugaaaaaauaacca

SEQ ID NO: 2717695 - RNA, 12 nt, Haemophilus influenzae Rd
auagugauuauu

SEQ ID NO: 2717696 - RNA, 20 nt, Haemophilus influenzae Rd
auagugcccgcuacaaauaa

SEQ ID NO: 2717697 - RNA, 15 nt, Haemophilus influenzae Rd
auaguggcuuuaaag

SEQ ID NO: 2717698 - RNA, 12 nt, Haemophilus influenzae Rd
auaguuuaaacu

SEQ ID NO: 2717699 - RNA, 21 nt, Haemophilus influenzae Rd
auaguuuaaacucagaauaua

SEQ ID NO: 2717700 - RNA, 16 nt, Haemophilus influenzae Rd
auaguuuggcucuucu

SEQ ID NO: 2717701 - RNA, 21 nt, Haemophilus influenzae Rd
auaguuuggcugaaauucuaa

SEQ ID NO: 2717702 - RNA, 16 nt, Haemophilus influenzae Rd
auaguuuuauuuuaau

SEQ ID NO: 2717703 - RNA, 20 nt, Haemophilus influenzae Rd
auaguuuucugauuuaaaac

SEQ ID NO: 2717704 - RNA, 24 nt, Haemophilus influenzae Rd
auauaaaaaaagaccgcacuuuua

SEQ ID NO: 2717705 - RNA, 10 nt, Haemophilus influenzae Rd
auauaaaaua

SEQ ID NO: 2717706 - RNA, 13 nt, Haemophilus influenzae Rd
auauaaaauaaag

SEQ ID NO: 2717707 - RNA, 15 nt, Haemophilus influenzae Rd
auauaaacaauuccc

SEQ ID NO: 2717708 - RNA, 15 nt, Haemophilus influenzae Rd
auauaaaggauuuua

SEQ ID NO: 2717709 - RNA, 15 nt, Haemophilus influenzae Rd
auauaaauaaaacaa

SEQ ID NO: 2717710 - RNA, 21 nt, Haemophilus influenzae Rd
auauaaauaacuaccuaauaa

SEQ ID NO: 2717711 - RNA, 18 nt, Haemophilus influenzae Rd
auauaaauccguaaaaua

SEQ ID NO: 2717712 - RNA, 14 nt, Haemophilus influenzae Rd
auauaaauuauguu

SEQ ID NO: 2717713 - RNA, 14 nt, Haemophilus influenzae Rd
auauaaauuuagaa

SEQ ID NO: 2717714 - RNA, 13 nt, Haemophilus influenzae Rd
auauaacaccaaa

SEQ ID NO: 2717715 - RNA, 15 nt, Haemophilus influenzae Rd
auauaagaaauaauc

SEQ ID NO: 2717716 - RNA, 23 nt, Haemophilus influenzae Rd
auauaaggcacagggcugauaaa

SEQ ID NO: 2717717 - RNA, 21 nt, Haemophilus influenzae Rd
auauaaguuauuuauauaauu

SEQ ID NO: 2717718 - RNA, 19 nt, Haemophilus influenzae Rd
auauaauaaauauguugaa

SEQ ID NO: 2717719 - RNA, 15 nt, Haemophilus influenzae Rd
auauaauauuuuggc

SEQ ID NO: 2717720 - RNA, 13 nt, Haemophilus influenzae Rd
auauaaucauugc

SEQ ID NO: 2717721 - RNA, 20 nt, Haemophilus influenzae Rd
auauaaucgcauuguuuuau

SEQ ID NO: 2717722 - RNA, 19 nt, Haemophilus influenzae Rd
auauaaugguggcguuuua

SEQ ID NO: 2717723 - RNA, 21 nt, Haemophilus influenzae Rd
auauaauuuccuauacuaauu

SEQ ID NO: 2717724 - RNA, 13 nt, Haemophilus influenzae Rd
auauacaguucac

SEQ ID NO: 2717725 - RNA, 22 nt, Haemophilus influenzae Rd
auauacaucucauaaaguauac

SEQ ID NO: 2717726 - RNA, 15 nt, Haemophilus influenzae Rd
auauacauuaacaau

SEQ ID NO: 2717727 - RNA, 13 nt, Haemophilus influenzae Rd
auauaccauucuu

SEQ ID NO: 2717728 - RNA, 17 nt, Haemophilus influenzae Rd
auauacucguucguuau

SEQ ID NO: 2717729 - RNA, 20 nt, Haemophilus influenzae Rd
auauacuuccacaucgcugc

SEQ ID NO: 2717730 - RNA, 12 nt, Haemophilus influenzae Rd
auauacuuuuuu

SEQ ID NO: 2717731 - RNA, 16 nt, Haemophilus influenzae Rd
auauagaugaagugaa

SEQ ID NO: 2717732 - RNA, 22 nt, Haemophilus influenzae Rd
auauagaugaagugaacuucau

SEQ ID NO: 2717733 - RNA, 19 nt, Haemophilus influenzae Rd
auauagccuagaaauaucu

SEQ ID NO: 2717734 - RNA, 18 nt, Haemophilus influenzae Rd
auauagggcucaaauuuu

SEQ ID NO: 2717735 - RNA, 17 nt, Haemophilus influenzae Rd
auauagguuaauaguug

SEQ ID NO: 2717736 - RNA, 15 nt, Haemophilus influenzae Rd
auauagucaaauaac

SEQ ID NO: 2717737 - RNA, 12 nt, Haemophilus influenzae Rd
auauauaaaaua

SEQ ID NO: 2717738 - RNA, 13 nt, Haemophilus influenzae Rd
auauauaaaauau

SEQ ID NO: 2717739 - RNA, 15 nt, Haemophilus influenzae Rd
auauauaaaauauau

SEQ ID NO: 2717740 - RNA, 14 nt, Haemophilus influenzae Rd
auauauaaauuuag

SEQ ID NO: 2717741 - RNA, 16 nt, Haemophilus influenzae Rd
auauauaaauuuagaa

SEQ ID NO: 2717742 - RNA, 13 nt, Haemophilus influenzae Rd
auauaucaagcag

SEQ ID NO: 2717743 - RNA, 21 nt, Haemophilus influenzae Rd
auauaucacagauuuuuaaau

SEQ ID NO: 2717744 - RNA, 21 nt, Haemophilus influenzae Rd
auauaucacagauuuuuuauu

SEQ ID NO: 2717745 - RNA, 13 nt, Haemophilus influenzae Rd
auauaucagugcu

SEQ ID NO: 2717746 - RNA, 16 nt, Haemophilus influenzae Rd
auauauccaaaugccu

SEQ ID NO: 2717747 - RNA, 14 nt, Haemophilus influenzae Rd
auauaugaaaaaua

SEQ ID NO: 2717748 - RNA, 14 nt, Haemophilus influenzae Rd
auauaugauuauaa

SEQ ID NO: 2717749 - RNA, 18 nt, Haemophilus influenzae Rd
auauaugguucauuauua

SEQ ID NO: 2717750 - RNA, 14 nt, Haemophilus influenzae Rd
auauauuaaaaaaa

SEQ ID NO: 2717751 - RNA, 16 nt, Haemophilus influenzae Rd
auauauuaauuauuuu

SEQ ID NO: 2717752 - RNA, 15 nt, Haemophilus influenzae Rd
auauauuauugugau

SEQ ID NO: 2717753 - RNA, 14 nt, Haemophilus influenzae Rd
auauauucuugguu

SEQ ID NO: 2717754 - RNA, 13 nt, Haemophilus influenzae Rd
auauauugaacau

SEQ ID NO: 2717755 - RNA, 16 nt, Haemophilus influenzae Rd
auauauugguuugcuu

SEQ ID NO: 2717756 - RNA, 23 nt, Haemophilus influenzae Rd
auauauuuguuuuuaguuuuuuu

SEQ ID NO: 2717757 - RNA, 20 nt, Haemophilus influenzae Rd
auauauuuuaucaacuaaaa

SEQ ID NO: 2717758 - RNA, 22 nt, Haemophilus influenzae Rd
auaucaaaaaguugaauuuuca

SEQ ID NO: 2717759 - RNA, 13 nt, Haemophilus influenzae Rd
auaucaaaauuau

SEQ ID NO: 2717760 - RNA, 21 nt, Haemophilus influenzae Rd
auaucaaaguuccuagaauua

SEQ ID NO: 2717761 - RNA, 20 nt, Haemophilus influenzae Rd
auaucaaucccacuuguuuu

SEQ ID NO: 2717762 - RNA, 11 nt, Haemophilus influenzae Rd
auaucaauuac

SEQ ID NO: 2717763 - RNA, 16 nt, Haemophilus influenzae Rd
auaucaauuacguaau

SEQ ID NO: 2717764 - RNA, 16 nt, Haemophilus influenzae Rd
auaucacagauuuuua

SEQ ID NO: 2717765 - RNA, 16 nt, Haemophilus influenzae Rd
auaucacgauaagcaa

SEQ ID NO: 2717766 - RNA, 22 nt, Haemophilus influenzae Rd
auaucacuucuguaagcagcua

SEQ ID NO: 2717767 - RNA, 13 nt, Haemophilus influenzae Rd
auaucagaaaaga

SEQ ID NO: 2717768 - RNA, 15 nt, Haemophilus influenzae Rd
auaucagacaaucug

SEQ ID NO: 2717769 - RNA, 17 nt, Haemophilus influenzae Rd
auaucagcccuuuguuu

SEQ ID NO: 2717770 - RNA, 19 nt, Haemophilus influenzae Rd
auaucauggcacaaaauaa

SEQ ID NO: 2717771 - RNA, 20 nt, Haemophilus influenzae Rd
auaucauggcacaaaauaau

SEQ ID NO: 2717772 - RNA, 14 nt, Haemophilus influenzae Rd
auauccaaacuuuc

SEQ ID NO: 2717773 - RNA, 15 nt, Haemophilus influenzae Rd
auauccaaagcaauu

SEQ ID NO: 2717774 - RNA, 17 nt, Haemophilus influenzae Rd
auauccaaagcaauuaa

SEQ ID NO: 2717775 - RNA, 13 nt, Haemophilus influenzae Rd
auauccaauuauu

SEQ ID NO: 2717776 - RNA, 19 nt, Haemophilus influenzae Rd
auauccacuucauuaaaac

SEQ ID NO: 2717777 - RNA, 17 nt, Haemophilus influenzae Rd
auauccugcacauccug

SEQ ID NO: 2717778 - RNA, 21 nt, Haemophilus influenzae Rd
auaucgaggcuuuuuuuauag

SEQ ID NO: 2717779 - RNA, 12 nt, Haemophilus influenzae Rd
auaucgcccauu

SEQ ID NO: 2717780 - RNA, 15 nt, Haemophilus influenzae Rd
auaucgcccauucua

SEQ ID NO: 2717781 - RNA, 18 nt, Haemophilus influenzae Rd
auaucgcccgauuuuaaa

SEQ ID NO: 2717782 - RNA, 20 nt, Haemophilus influenzae Rd
auaucgcccgauuuuaaacc

SEQ ID NO: 2717783 - RNA, 16 nt, Haemophilus influenzae Rd
auaucgccuuauccca

SEQ ID NO: 2717784 - RNA, 21 nt, Haemophilus influenzae Rd
auaucgccuuaucccauaccg

SEQ ID NO: 2717785 - RNA, 18 nt, Haemophilus influenzae Rd
auaucguuaucuuuaaag

SEQ ID NO: 2717786 - RNA, 14 nt, Haemophilus influenzae Rd
auaucuaaacuuca

SEQ ID NO: 2717787 - RNA, 15 nt, Haemophilus influenzae Rd
auaucuaaacuucaa

SEQ ID NO: 2717788 - RNA, 22 nt, Haemophilus influenzae Rd
auaucuaaacuucaauuuuuua

SEQ ID NO: 2717789 - RNA, 23 nt, Haemophilus influenzae Rd
auaucuaaggcgacaaaaugucg

SEQ ID NO: 2717790 - RNA, 18 nt, Haemophilus influenzae Rd
auaucuauaccuaucuua

SEQ ID NO: 2717791 - RNA, 23 nt, Haemophilus influenzae Rd
auaucuauugagauuuaauuuau

SEQ ID NO: 2717792 - RNA, 21 nt, Haemophilus influenzae Rd
auaucuauuggaauggcaaaa

SEQ ID NO: 2717793 - RNA, 19 nt, Haemophilus influenzae Rd
auaucuggauguuguaaaa

SEQ ID NO: 2717794 - RNA, 21 nt, Haemophilus influenzae Rd
auaucuggauguuguaaaaua

SEQ ID NO: 2717795 - RNA, 19 nt, Haemophilus influenzae Rd
auaucugucauuguaauuu

SEQ ID NO: 2717796 - RNA, 18 nt, Haemophilus influenzae Rd
auaucuuccaaagcaauc

SEQ ID NO: 2717797 - RNA, 16 nt, Haemophilus influenzae Rd
auaucuucuucuugca

SEQ ID NO: 2717798 - RNA, 17 nt, Haemophilus influenzae Rd
auaucuucuucuugcag

SEQ ID NO: 2717799 - RNA, 16 nt, Haemophilus influenzae Rd
auaucuuguuuuaaua

SEQ ID NO: 2717800 - RNA, 14 nt, Haemophilus influenzae Rd
auaucuuguuuuac

SEQ ID NO: 2717801 - RNA, 19 nt, Haemophilus influenzae Rd
auaucuuuaaauucuacgu

SEQ ID NO: 2717802 - RNA, 20 nt, Haemophilus influenzae Rd
auaucuuuaacaaaaucaau

SEQ ID NO: 2717803 - RNA, 19 nt, Haemophilus influenzae Rd
auaucuuugacuaaaucau

SEQ ID NO: 2717804 - RNA, 14 nt, Haemophilus influenzae Rd
auaugaaaaauaau

SEQ ID NO: 2717805 - RNA, 21 nt, Haemophilus influenzae Rd
auaugaaacgcgaguaaaaua

SEQ ID NO: 2717806 - RNA, 16 nt, Haemophilus influenzae Rd
auaugaaauuucuuua

SEQ ID NO: 2717807 - RNA, 19 nt, Haemophilus influenzae Rd
auaugaaccuauuagaauu

SEQ ID NO: 2717808 - RNA, 21 nt, Haemophilus influenzae Rd
auaugaccauuaaucacacuu

SEQ ID NO: 2717809 - RNA, 22 nt, Haemophilus influenzae Rd
auaugaccauuaaucacacuug

SEQ ID NO: 2717810 - RNA, 14 nt, Haemophilus influenzae Rd
auaugauaaaaaua

SEQ ID NO: 2717811 - RNA, 23 nt, Haemophilus influenzae Rd
auaugauucugugcaauauuucc

SEQ ID NO: 2717812 - RNA, 15 nt, Haemophilus influenzae Rd
auaugauuuagaaca

SEQ ID NO: 2717813 - RNA, 23 nt, Haemophilus influenzae Rd
auaugauuuagaacaauauuuau

SEQ ID NO: 2717814 - RNA, 23 nt, Haemophilus influenzae Rd
auaugauuucuucaaagcuuaag

SEQ ID NO: 2717815 - RNA, 21 nt, Haemophilus influenzae Rd
auaugcaaagguaauugccaa

SEQ ID NO: 2717816 - RNA, 14 nt, Haemophilus influenzae Rd
auaugcaaauaauc

SEQ ID NO: 2717817 - RNA, 14 nt, Haemophilus influenzae Rd
auaugccaaauaaa

SEQ ID NO: 2717818 - RNA, 23 nt, Haemophilus influenzae Rd
auaugccaagauuucgcccaugc

SEQ ID NO: 2717819 - RNA, 16 nt, Haemophilus influenzae Rd
auaugccuaaaaagaa

SEQ ID NO: 2717820 - RNA, 20 nt, Haemophilus influenzae Rd
auaugccuguggaaacuaau

SEQ ID NO: 2717821 - RNA, 15 nt, Haemophilus influenzae Rd
auaugccuuauauuu

SEQ ID NO: 2717822 - RNA, 19 nt, Haemophilus influenzae Rd
auaugccuuauauuucacu

SEQ ID NO: 2717823 - RNA, 13 nt, Haemophilus influenzae Rd
auaugcucaauag

SEQ ID NO: 2717824 - RNA, 16 nt, Haemophilus influenzae Rd
auaugguaauuagccu

SEQ ID NO: 2717825 - RNA, 17 nt, Haemophilus influenzae Rd
auaugguucauuauuaa

SEQ ID NO: 2717826 - RNA, 23 nt, Haemophilus influenzae Rd
auaugguucauuauuaauugaug

SEQ ID NO: 2717827 - RNA, 14 nt, Haemophilus influenzae Rd
auauguaaaauuuu

SEQ ID NO: 2717828 - RNA, 16 nt, Haemophilus influenzae Rd
auauguuaauaagccc

SEQ ID NO: 2717829 - RNA, 21 nt, Haemophilus influenzae Rd
auauguucaacaaguaaauca

SEQ ID NO: 2717830 - RNA, 17 nt, Haemophilus influenzae Rd
auauguucuuuguugau

SEQ ID NO: 2717831 - RNA, 16 nt, Haemophilus influenzae Rd
auauuaaagaguuaua

SEQ ID NO: 2717832 - RNA, 23 nt, Haemophilus influenzae Rd
auauuaacuugcuauuuucuaau

SEQ ID NO: 2717833 - RNA, 22 nt, Haemophilus influenzae Rd
auauuaauacuuggugcaauaa

SEQ ID NO: 2717834 - RNA, 20 nt, Haemophilus influenzae Rd
auauuacuuauaagaugacu

SEQ ID NO: 2717835 - RNA, 13 nt, Haemophilus influenzae Rd
auauuagcgaguu

SEQ ID NO: 2717836 - RNA, 16 nt, Haemophilus influenzae Rd
auauuaguuagcuaaa

SEQ ID NO: 2717837 - RNA, 19 nt, Haemophilus influenzae Rd
auauuaucuccaagaauau

SEQ ID NO: 2717838 - RNA, 16 nt, Haemophilus influenzae Rd
auauuauguucucuca

SEQ ID NO: 2717839 - RNA, 12 nt, Haemophilus influenzae Rd
auauuauuaaaa

SEQ ID NO: 2717840 - RNA, 14 nt, Haemophilus influenzae Rd
auauuauuaaguaa

SEQ ID NO: 2717841 - RNA, 14 nt, Haemophilus influenzae Rd
auauuauucagcac

SEQ ID NO: 2717842 - RNA, 17 nt, Haemophilus influenzae Rd
auauuauucagcacuuu

SEQ ID NO: 2717843 - RNA, 16 nt, Haemophilus influenzae Rd
auauuauucuuuucaa

SEQ ID NO: 2717844 - RNA, 14 nt, Haemophilus influenzae Rd
auauuauuuagauu

SEQ ID NO: 2717845 - RNA, 16 nt, Haemophilus influenzae Rd
auauuauuuauuuuga

SEQ ID NO: 2717846 - RNA, 15 nt, Haemophilus influenzae Rd
auauucaaauuucau

SEQ ID NO: 2717847 - RNA, 18 nt, Haemophilus influenzae Rd
auauucaaauuucauccu

SEQ ID NO: 2717848 - RNA, 18 nt, Haemophilus influenzae Rd
auauucaauccuauuuuu

SEQ ID NO: 2717849 - RNA, 19 nt, Haemophilus influenzae Rd
auauucaauccuauuuuua

SEQ ID NO: 2717850 - RNA, 13 nt, Haemophilus influenzae Rd
auauucaauuacu

SEQ ID NO: 2717851 - RNA, 20 nt, Haemophilus influenzae Rd
auauucaccccuucuguugc

SEQ ID NO: 2717852 - RNA, 17 nt, Haemophilus influenzae Rd
auauucacucuuauuca

SEQ ID NO: 2717853 - RNA, 14 nt, Haemophilus influenzae Rd
auauucacuuucau

SEQ ID NO: 2717854 - RNA, 19 nt, Haemophilus influenzae Rd
auauucagcaaaaucacuc

SEQ ID NO: 2717855 - RNA, 20 nt, Haemophilus influenzae Rd
auauucaucgccaaauuuac

SEQ ID NO: 2717856 - RNA, 23 nt, Haemophilus influenzae Rd
auauucaugaaucguuuuuucca

SEQ ID NO: 2717857 - RNA, 13 nt, Haemophilus influenzae Rd
auauucauuuaaa

SEQ ID NO: 2717858 - RNA, 14 nt, Haemophilus influenzae Rd
auauucauuuaaaa

SEQ ID NO: 2717859 - RNA, 17 nt, Haemophilus influenzae Rd
auauucauuuaaaacaa

SEQ ID NO: 2717860 - RNA, 18 nt, Haemophilus influenzae Rd
auauucauuuaaaacaaa

SEQ ID NO: 2717861 - RNA, 12 nt, Haemophilus influenzae Rd
auauucauuuuc

SEQ ID NO: 2717862 - RNA, 19 nt, Haemophilus influenzae Rd
auauuccaacgauuuugca

SEQ ID NO: 2717863 - RNA, 22 nt, Haemophilus influenzae Rd
auauuccagccccucagauaau

SEQ ID NO: 2717864 - RNA, 16 nt, Haemophilus influenzae Rd
auauuccauuaacuaa

SEQ ID NO: 2717865 - RNA, 17 nt, Haemophilus influenzae Rd
auauuccuuagaaagua

SEQ ID NO: 2717866 - RNA, 23 nt, Haemophilus influenzae Rd
auauuccuuagaaaguaaacaau

SEQ ID NO: 2717867 - RNA, 16 nt, Haemophilus influenzae Rd
auauuccuuauucaaa

SEQ ID NO: 2717868 - RNA, 21 nt, Haemophilus influenzae Rd
auauucgacaggaacauucac

SEQ ID NO: 2717869 - RNA, 15 nt, Haemophilus influenzae Rd
auauucgcaccuuca

SEQ ID NO: 2717870 - RNA, 18 nt, Haemophilus influenzae Rd
auauucgccuaauugcug

SEQ ID NO: 2717871 - RNA, 16 nt, Haemophilus influenzae Rd
auauucgcuucuuuua

SEQ ID NO: 2717872 - RNA, 13 nt, Haemophilus influenzae Rd
auauucuaccgca

SEQ ID NO: 2717873 - RNA, 18 nt, Haemophilus influenzae Rd
auauucuaccgcauuuuu

SEQ ID NO: 2717874 - RNA, 13 nt, Haemophilus influenzae Rd
auauucuccuugg

SEQ ID NO: 2717875 - RNA, 19 nt, Haemophilus influenzae Rd
auauucucucgcugaauua

SEQ ID NO: 2717876 - RNA, 22 nt, Haemophilus influenzae Rd
auauucugcuaacucaucaaca

SEQ ID NO: 2717877 - RNA, 23 nt, Haemophilus influenzae Rd
auauucuggcaauauuucaauaa

SEQ ID NO: 2717878 - RNA, 22 nt, Haemophilus influenzae Rd
auauucuguugaaugcuauucu

SEQ ID NO: 2717879 - RNA, 22 nt, Haemophilus influenzae Rd
auauucuucgcuuaaugguaaa

SEQ ID NO: 2717880 - RNA, 14 nt, Haemophilus influenzae Rd
auauucuucuaaaa

SEQ ID NO: 2717881 - RNA, 18 nt, Haemophilus influenzae Rd
auauucuugcguaaccaa

SEQ ID NO: 2717882 - RNA, 18 nt, Haemophilus influenzae Rd
auauucuuggagauaaua

SEQ ID NO: 2717883 - RNA, 14 nt, Haemophilus influenzae Rd
auauucuuuaaaua

SEQ ID NO: 2717884 - RNA, 20 nt, Haemophilus influenzae Rd
auauucuuuaaauauucaau

SEQ ID NO: 2717885 - RNA, 19 nt, Haemophilus influenzae Rd
auauucuuuuauuaacaaa

SEQ ID NO: 2717886 - RNA, 20 nt, Haemophilus influenzae Rd
auauucuuuuauuaacaaaa

SEQ ID NO: 2717887 - RNA, 11 nt, Haemophilus influenzae Rd
auauucuuuug

SEQ ID NO: 2717888 - RNA, 14 nt, Haemophilus influenzae Rd
auauucuuuuuaaa

SEQ ID NO: 2717889 - RNA, 23 nt, Haemophilus influenzae Rd
auauugaaaacgucgauccauug

SEQ ID NO: 2717890 - RNA, 22 nt, Haemophilus influenzae Rd
auauugaaauaagauuuuugau

SEQ ID NO: 2717891 - RNA, 22 nt, Haemophilus influenzae Rd
auauugaacaauguuuaaucca

SEQ ID NO: 2717892 - RNA, 19 nt, Haemophilus influenzae Rd
auauugaacuugagaaagu

SEQ ID NO: 2717893 - RNA, 13 nt, Haemophilus influenzae Rd
auauugaccauuu

SEQ ID NO: 2717894 - RNA, 16 nt, Haemophilus influenzae Rd
auauugaguauucccc

SEQ ID NO: 2717895 - RNA, 15 nt, Haemophilus influenzae Rd
auauugauuucucug

SEQ ID NO: 2717896 - RNA, 12 nt, Haemophilus influenzae Rd
auauugcacaau

SEQ ID NO: 2717897 - RNA, 23 nt, Haemophilus influenzae Rd
auauugcauaaucauaucuaaca

SEQ ID NO: 2717898 - RNA, 21 nt, Haemophilus influenzae Rd
auauugccuaauagaaaaaug

SEQ ID NO: 2717899 - RNA, 16 nt, Haemophilus influenzae Rd
auauugcggacaauaa

SEQ ID NO: 2717900 - RNA, 12 nt, Haemophilus influenzae Rd
auauugcucaau

SEQ ID NO: 2717901 - RNA, 15 nt, Haemophilus influenzae Rd
auauugcucaauuaa

SEQ ID NO: 2717902 - RNA, 14 nt, Haemophilus influenzae Rd
auauuggaaaccug

SEQ ID NO: 2717903 - RNA, 16 nt, Haemophilus influenzae Rd
auauuggaguuagaau

SEQ ID NO: 2717904 - RNA, 15 nt, Haemophilus influenzae Rd
auauuggauuuacuu

SEQ ID NO: 2717905 - RNA, 17 nt, Haemophilus influenzae Rd
auauuggcggauaugcu

SEQ ID NO: 2717906 - RNA, 13 nt, Haemophilus influenzae Rd
auauuguaggaag

SEQ ID NO: 2717907 - RNA, 14 nt, Haemophilus influenzae Rd
auauugucuauuuu

SEQ ID NO: 2717908 - RNA, 16 nt, Haemophilus influenzae Rd
auauugucuauuuuau

SEQ ID NO: 2717909 - RNA, 12 nt, Haemophilus influenzae Rd
auauugugcaua

SEQ ID NO: 2717910 - RNA, 17 nt, Haemophilus influenzae Rd
auauugugucacuagau

SEQ ID NO: 2717911 - RNA, 17 nt, Haemophilus influenzae Rd
auauuguuaauuaucaa

SEQ ID NO: 2717912 - RNA, 14 nt, Haemophilus influenzae Rd
auauuguugcacau

SEQ ID NO: 2717913 - RNA, 15 nt, Haemophilus influenzae Rd
auauuguugcacauu

SEQ ID NO: 2717914 - RNA, 16 nt, Haemophilus influenzae Rd
auauuguugcacauua

SEQ ID NO: 2717915 - RNA, 17 nt, Haemophilus influenzae Rd
auauuguugcacauuaa

SEQ ID NO: 2717916 - RNA, 17 nt, Haemophilus influenzae Rd
auauuguuucuucucuu

SEQ ID NO: 2717917 - RNA, 13 nt, Haemophilus influenzae Rd
auauuguuuuaau

SEQ ID NO: 2717918 - RNA, 15 nt, Haemophilus influenzae Rd
auauuuaaaaccaaa

SEQ ID NO: 2717919 - RNA, 13 nt, Haemophilus influenzae Rd
auauuuaaaauca

SEQ ID NO: 2717920 - RNA, 12 nt, Haemophilus influenzae Rd
auauuuaacuaa

SEQ ID NO: 2717921 - RNA, 14 nt, Haemophilus influenzae Rd
auauuuaauaaaau

SEQ ID NO: 2717922 - RNA, 19 nt, Haemophilus influenzae Rd
auauuuaaugauaaucuaa

SEQ ID NO: 2717923 - RNA, 23 nt, Haemophilus influenzae Rd
auauuuaauguguagauaaaaua

SEQ ID NO: 2717924 - RNA, 17 nt, Haemophilus influenzae Rd
auauuuaccgcuuucaa

SEQ ID NO: 2717925 - RNA, 20 nt, Haemophilus influenzae Rd
auauuuagauacaaaauguu

SEQ ID NO: 2717926 - RNA, 17 nt, Haemophilus influenzae Rd
auauuuaggcuauuuua

SEQ ID NO: 2717927 - RNA, 23 nt, Haemophilus influenzae Rd
auauuuauaauguggugcuguuu

SEQ ID NO: 2717928 - RNA, 11 nt, Haemophilus influenzae Rd
auauuucacua

SEQ ID NO: 2717929 - RNA, 21 nt, Haemophilus influenzae Rd
auauuucacuucuaacuaaaa

SEQ ID NO: 2717930 - RNA, 22 nt, Haemophilus influenzae Rd
auauuucacuucuaacuaaaaa

SEQ ID NO: 2717931 - RNA, 18 nt, Haemophilus influenzae Rd
auauuucgcccuuauaca

SEQ ID NO: 2717932 - RNA, 21 nt, Haemophilus influenzae Rd
auauuucgcccuuauacaaaa

SEQ ID NO: 2717933 - RNA, 20 nt, Haemophilus influenzae Rd
auauuucuuuucaaacacaa

SEQ ID NO: 2717934 - RNA, 22 nt, Haemophilus influenzae Rd
auauuugaaguugccauagaca

SEQ ID NO: 2717935 - RNA, 21 nt, Haemophilus influenzae Rd
auauuugacgaaauaaaugau

SEQ ID NO: 2717936 - RNA, 16 nt, Haemophilus influenzae Rd
auauuugaguuauuuu

SEQ ID NO: 2717937 - RNA, 20 nt, Haemophilus influenzae Rd
auauuugaguuauuuuuaau

SEQ ID NO: 2717938 - RNA, 24 nt, Haemophilus influenzae Rd
auauuuggauaacaaauugcuucu

SEQ ID NO: 2717939 - RNA, 19 nt, Haemophilus influenzae Rd
auauuuggcugauauauua

SEQ ID NO: 2717940 - RNA, 19 nt, Haemophilus influenzae Rd
auauuuuaaauaauuaaaa

SEQ ID NO: 2717941 - RNA, 15 nt, Haemophilus influenzae Rd
auauuuuaaugaaag

SEQ ID NO: 2717942 - RNA, 15 nt, Haemophilus influenzae Rd
auauuuuagcaagug

SEQ ID NO: 2717943 - RNA, 19 nt, Haemophilus influenzae Rd
auauuuuaucaacuaaaaa

SEQ ID NO: 2717944 - RNA, 14 nt, Haemophilus influenzae Rd
auauuuucaaauaa

SEQ ID NO: 2717945 - RNA, 15 nt, Haemophilus influenzae Rd
auauuuucccaguaa

SEQ ID NO: 2717946 - RNA, 19 nt, Haemophilus influenzae Rd
auauuuucccucuuuaucu

SEQ ID NO: 2717947 - RNA, 20 nt, Haemophilus influenzae Rd
auauuuuccuagcgcacaau

SEQ ID NO: 2717948 - RNA, 14 nt, Haemophilus influenzae Rd
auauuuuccuugug

SEQ ID NO: 2717949 - RNA, 13 nt, Haemophilus influenzae Rd
auauuuugaauaa

SEQ ID NO: 2717950 - RNA, 11 nt, Haemophilus influenzae Rd
auauuuuuaau

SEQ ID NO: 2717951 - RNA, 12 nt, Haemophilus influenzae Rd
auauuuuuaauu

SEQ ID NO: 2717952 - RNA, 21 nt, Haemophilus influenzae Rd
auauuuuuacuccuauuagua

SEQ ID NO: 2717953 - RNA, 12 nt, Haemophilus influenzae Rd
auauuuuuagau

SEQ ID NO: 2717954 - RNA, 19 nt, Haemophilus influenzae Rd
auauuuuuaugcuucuucu

SEQ ID NO: 2717955 - RNA, 10 nt, Haemophilus influenzae Rd
auauuuuuga

SEQ ID NO: 2717956 - RNA, 12 nt, Haemophilus influenzae Rd
auauuuuuuagu

SEQ ID NO: 2717957 - RNA, 22 nt, Haemophilus influenzae Rd
auauuuuuucagccuauuuuua

SEQ ID NO: 2717958 - RNA, 19 nt, Haemophilus influenzae Rd
auauuuuuucgugaaauua

SEQ ID NO: 2717959 - RNA, 21 nt, Haemophilus influenzae Rd
aucaaaaaacgaaauuuuuca

SEQ ID NO: 2717960 - RNA, 23 nt, Haemophilus influenzae Rd
aucaaaaaacgaaauuuuucacc

SEQ ID NO: 2717961 - RNA, 13 nt, Haemophilus influenzae Rd
aucaaaaagaaau

SEQ ID NO: 2717962 - RNA, 15 nt, Haemophilus influenzae Rd
aucaaaaagaaauau

SEQ ID NO: 2717963 - RNA, 18 nt, Haemophilus influenzae Rd
aucaaaaagaaauauuag

SEQ ID NO: 2717964 - RNA, 17 nt, Haemophilus influenzae Rd
aucaaaaauaaaaagua

SEQ ID NO: 2717965 - RNA, 20 nt, Haemophilus influenzae Rd
aucaaaaaucuuauuucaau

SEQ ID NO: 2717966 - RNA, 21 nt, Haemophilus influenzae Rd
aucaaaaaugcucgcuggcua

SEQ ID NO: 2717967 - RNA, 11 nt, Haemophilus influenzae Rd
aucaaaaccau

SEQ ID NO: 2717968 - RNA, 17 nt, Haemophilus influenzae Rd
aucaaaacgaucuaaaa

SEQ ID NO: 2717969 - RNA, 17 nt, Haemophilus influenzae Rd
aucaaaagaaaagauga

SEQ ID NO: 2717970 - RNA, 13 nt, Haemophilus influenzae Rd
aucaaaagaauua

SEQ ID NO: 2717971 - RNA, 18 nt, Haemophilus influenzae Rd
aucaaaagaauuaaaaau

SEQ ID NO: 2717972 - RNA, 19 nt, Haemophilus influenzae Rd
aucaaaauagcuuuuuaau

SEQ ID NO: 2717973 - RNA, 16 nt, Haemophilus influenzae Rd
aucaaaaucugcuagu

SEQ ID NO: 2717974 - RNA, 13 nt, Haemophilus influenzae Rd
aucaaaaugaaaa

SEQ ID NO: 2717975 - RNA, 18 nt, Haemophilus influenzae Rd
aucaaaaugaaaacuaug

SEQ ID NO: 2717976 - RNA, 15 nt, Haemophilus influenzae Rd
aucaaaauucaaaau

SEQ ID NO: 2717977 - RNA, 22 nt, Haemophilus influenzae Rd
aucaaaauuuaagccuguuaug

SEQ ID NO: 2717978 - RNA, 15 nt, Haemophilus influenzae Rd
aucaaacaaacccuc

SEQ ID NO: 2717979 - RNA, 22 nt, Haemophilus influenzae Rd
aucaaacaguucaauaaaaaua

SEQ ID NO: 2717980 - RNA, 15 nt, Haemophilus influenzae Rd
aucaaacuuuuagaa

SEQ ID NO: 2717981 - RNA, 14 nt, Haemophilus influenzae Rd
aucaaagaaacugu

SEQ ID NO: 2717982 - RNA, 13 nt, Haemophilus influenzae Rd
aucaaagaaucca

SEQ ID NO: 2717983 - RNA, 19 nt, Haemophilus influenzae Rd
aucaaagcguuuuucuaca

SEQ ID NO: 2717984 - RNA, 16 nt, Haemophilus influenzae Rd
aucaaaggcuaauucu

SEQ ID NO: 2717985 - RNA, 21 nt, Haemophilus influenzae Rd
aucaaaguagucuauuuacuu

SEQ ID NO: 2717986 - RNA, 22 nt, Haemophilus influenzae Rd
aucaaaguagucuauuuacuug

SEQ ID NO: 2717987 - RNA, 21 nt, Haemophilus influenzae Rd
aucaaagugcgguuguuuuug

SEQ ID NO: 2717988 - RNA, 13 nt, Haemophilus influenzae Rd
aucaaaguuccua

SEQ ID NO: 2717989 - RNA, 23 nt, Haemophilus influenzae Rd
aucaaaguuccuagaauuaaaag

SEQ ID NO: 2717990 - RNA, 11 nt, Haemophilus influenzae Rd
aucaaauaaaa

SEQ ID NO: 2717991 - RNA, 13 nt, Haemophilus influenzae Rd
aucaaauaaaaua

SEQ ID NO: 2717992 - RNA, 16 nt, Haemophilus influenzae Rd
aucaaaucaaauuuuc

SEQ ID NO: 2717993 - RNA, 17 nt, Haemophilus influenzae Rd
aucaaauccgccaauca

SEQ ID NO: 2717994 - RNA, 19 nt, Haemophilus influenzae Rd
aucaaauccgccaaucaua

SEQ ID NO: 2717995 - RNA, 21 nt, Haemophilus influenzae Rd
aucaaauccuuguuuuucaaa

SEQ ID NO: 2717996 - RNA, 20 nt, Haemophilus influenzae Rd
aucaaauucucuguuucuuu

SEQ ID NO: 2717997 - RNA, 16 nt, Haemophilus influenzae Rd
aucaaauugaugcucu

SEQ ID NO: 2717998 - RNA, 17 nt, Haemophilus influenzae Rd
aucaaauugaugcucug

SEQ ID NO: 2717999 - RNA, 13 nt, Haemophilus influenzae Rd
aucaacaacuaaa

SEQ ID NO: 2718000 - RNA, 17 nt, Haemophilus influenzae Rd
aucaacaauccauuucg

SEQ ID NO: 2718001 - RNA, 23 nt, Haemophilus influenzae Rd
aucaacauaacguuuaucuaaua

SEQ ID NO: 2718002 - RNA, 18 nt, Haemophilus influenzae Rd
aucaaccaaaauacaauc

SEQ ID NO: 2718003 - RNA, 18 nt, Haemophilus influenzae Rd
aucaaccauuuguuggcg

SEQ ID NO: 2718004 - RNA, 17 nt, Haemophilus influenzae Rd
aucaaccgauaaaucua

SEQ ID NO: 2718005 - RNA, 17 nt, Haemophilus influenzae Rd
aucaacuagugcuguug

SEQ ID NO: 2718006 - RNA, 19 nt, Haemophilus influenzae Rd
aucaacugcaacaauuuca

SEQ ID NO: 2718007 - RNA, 23 nt, Haemophilus influenzae Rd
aucaacuuuagucgcuuucaaca

SEQ ID NO: 2718008 - RNA, 19 nt, Haemophilus influenzae Rd
aucaagaauuccauugcau

SEQ ID NO: 2718009 - RNA, 17 nt, Haemophilus influenzae Rd
aucaagauaccaauaau

SEQ ID NO: 2718010 - RNA, 15 nt, Haemophilus influenzae Rd
aucaagauuuauucc

SEQ ID NO: 2718011 - RNA, 22 nt, Haemophilus influenzae Rd
aucaagauuuauuccugcuuuu

SEQ ID NO: 2718012 - RNA, 23 nt, Haemophilus influenzae Rd
aucaagauuuauuccugcuuuuu

SEQ ID NO: 2718013 - RNA, 19 nt, Haemophilus influenzae Rd
aucaagcugugcaaaacua

SEQ ID NO: 2718014 - RNA, 23 nt, Haemophilus influenzae Rd
aucaaggcuuuguaaugcuuuua

SEQ ID NO: 2718015 - RNA, 18 nt, Haemophilus influenzae Rd
aucaaggguacaacaaau

SEQ ID NO: 2718016 - RNA, 15 nt, Haemophilus influenzae Rd
aucaaguaauacuuu

SEQ ID NO: 2718017 - RNA, 13 nt, Haemophilus influenzae Rd
aucaaguuaaaaa

SEQ ID NO: 2718018 - RNA, 14 nt, Haemophilus influenzae Rd
aucaaguuaaaaaa

SEQ ID NO: 2718019 - RNA, 12 nt, Haemophilus influenzae Rd
aucaauaaaaag

SEQ ID NO: 2718020 - RNA, 17 nt, Haemophilus influenzae Rd
aucaauaacacucauug

SEQ ID NO: 2718021 - RNA, 14 nt, Haemophilus influenzae Rd
aucaauaccaauug

SEQ ID NO: 2718022 - RNA, 20 nt, Haemophilus influenzae Rd
aucaauacgccuaaaacaag

SEQ ID NO: 2718023 - RNA, 23 nt, Haemophilus influenzae Rd
aucaauacuugaucggcuacuau

SEQ ID NO: 2718024 - RNA, 18 nt, Haemophilus influenzae Rd
aucaauauaaccuugucc

SEQ ID NO: 2718025 - RNA, 14 nt, Haemophilus influenzae Rd
aucaaucaaauuca

SEQ ID NO: 2718026 - RNA, 16 nt, Haemophilus influenzae Rd
aucaaucaaauucaac

SEQ ID NO: 2718027 - RNA, 20 nt, Haemophilus influenzae Rd
aucaaucaagaauuccauug

SEQ ID NO: 2718028 - RNA, 21 nt, Haemophilus influenzae Rd
aucaaucaggcuuucauuuuc

SEQ ID NO: 2718029 - RNA, 15 nt, Haemophilus influenzae Rd
aucaaucauaaaaac

SEQ ID NO: 2718030 - RNA, 18 nt, Haemophilus influenzae Rd
aucaaucauaucaucaac

SEQ ID NO: 2718031 - RNA, 14 nt, Haemophilus influenzae Rd
aucaaugaauauaa

SEQ ID NO: 2718032 - RNA, 16 nt, Haemophilus influenzae Rd
aucaaugaauauaaaa

SEQ ID NO: 2718033 - RNA, 16 nt, Haemophilus influenzae Rd
aucaaugcucucuuuu

SEQ ID NO: 2718034 - RNA, 16 nt, Haemophilus influenzae Rd
aucaauggguuuaaaa

SEQ ID NO: 2718035 - RNA, 22 nt, Haemophilus influenzae Rd
aucaauggguuuaaaaaguuga

SEQ ID NO: 2718036 - RNA, 14 nt, Haemophilus influenzae Rd
aucaauguuugugc

SEQ ID NO: 2718037 - RNA, 22 nt, Haemophilus influenzae Rd
aucaauguuugugcguuuuuua

SEQ ID NO: 2718038 - RNA, 18 nt, Haemophilus influenzae Rd
aucaauuaaagaaauuuc

SEQ ID NO: 2718039 - RNA, 19 nt, Haemophilus influenzae Rd
aucaauuagaugacuggca

SEQ ID NO: 2718040 - RNA, 16 nt, Haemophilus influenzae Rd
aucaauuauuucagcu

SEQ ID NO: 2718041 - RNA, 20 nt, Haemophilus influenzae Rd
aucaauuuaaucaaaguagu

SEQ ID NO: 2718042 - RNA, 23 nt, Haemophilus influenzae Rd
aucaauuugacgcgcacauacuu

SEQ ID NO: 2718043 - RNA, 19 nt, Haemophilus influenzae Rd
aucaauuugugcauaaaca

SEQ ID NO: 2718044 - RNA, 22 nt, Haemophilus influenzae Rd
aucaauuuuacguuuuaaauua

SEQ ID NO: 2718045 - RNA, 20 nt, Haemophilus influenzae Rd
aucaauuuuauugaauacua

SEQ ID NO: 2718046 - RNA, 11 nt, Haemophilus influenzae Rd
aucaauuuuua

SEQ ID NO: 2718047 - RNA, 22 nt, Haemophilus influenzae Rd
aucacaaaacaacgaauauccg

SEQ ID NO: 2718048 - RNA, 19 nt, Haemophilus influenzae Rd
aucacaaaauggcaaacaa

SEQ ID NO: 2718049 - RNA, 20 nt, Haemophilus influenzae Rd
aucacaaaauggcaaacaaa

SEQ ID NO: 2718050 - RNA, 13 nt, Haemophilus influenzae Rd
aucacaaacaaua

SEQ ID NO: 2718051 - RNA, 14 nt, Haemophilus influenzae Rd
aucacaaacaauau

SEQ ID NO: 2718052 - RNA, 14 nt, Haemophilus influenzae Rd
aucacaaagcacua

SEQ ID NO: 2718053 - RNA, 17 nt, Haemophilus influenzae Rd
aucacaaugagacuuaa

SEQ ID NO: 2718054 - RNA, 15 nt, Haemophilus influenzae Rd
aucacaauuuuuaac

SEQ ID NO: 2718055 - RNA, 15 nt, Haemophilus influenzae Rd
aucacagauuuuuaa

SEQ ID NO: 2718056 - RNA, 16 nt, Haemophilus influenzae Rd
aucacagauuuuuaaa

SEQ ID NO: 2718057 - RNA, 21 nt, Haemophilus influenzae Rd
aucacagauuuuuuauuaauu

SEQ ID NO: 2718058 - RNA, 13 nt, Haemophilus influenzae Rd
aucacaguuuuau

SEQ ID NO: 2718059 - RNA, 19 nt, Haemophilus influenzae Rd
aucacauagauuuaagcuu

SEQ ID NO: 2718060 - RNA, 23 nt, Haemophilus influenzae Rd
aucacauuuuauugaagaguaaa

SEQ ID NO: 2718061 - RNA, 14 nt, Haemophilus influenzae Rd
aucacauuuucaaa

SEQ ID NO: 2718062 - RNA, 18 nt, Haemophilus influenzae Rd
aucaccaagaaucaaggc

SEQ ID NO: 2718063 - RNA, 14 nt, Haemophilus influenzae Rd
aucacccaucaaau

SEQ ID NO: 2718064 - RNA, 15 nt, Haemophilus influenzae Rd
aucacccaucaaauc

SEQ ID NO: 2718065 - RNA, 15 nt, Haemophilus influenzae Rd
aucacccauuaaaua

SEQ ID NO: 2718066 - RNA, 22 nt, Haemophilus influenzae Rd
aucaccccagccuuucgacaag

SEQ ID NO: 2718067 - RNA, 17 nt, Haemophilus influenzae Rd
aucacccggcacauaaa

SEQ ID NO: 2718068 - RNA, 14 nt, Haemophilus influenzae Rd
aucaccgaaauaac

SEQ ID NO: 2718069 - RNA, 22 nt, Haemophilus influenzae Rd
aucacgaauugacggugcauuu

SEQ ID NO: 2718070 - RNA, 23 nt, Haemophilus influenzae Rd
aucacgaauugacggugcauuug

SEQ ID NO: 2718071 - RNA, 20 nt, Haemophilus influenzae Rd
aucacgaucugcaacaucac

SEQ ID NO: 2718072 - RNA, 18 nt, Haemophilus influenzae Rd
aucacgcguuucuaaaau

SEQ ID NO: 2718073 - RNA, 19 nt, Haemophilus influenzae Rd
aucacgcguuucuaaaaua

SEQ ID NO: 2718074 - RNA, 23 nt, Haemophilus influenzae Rd
aucacggguuugguaagcaauag

SEQ ID NO: 2718075 - RNA, 13 nt, Haemophilus influenzae Rd
aucacguaaguaa

SEQ ID NO: 2718076 - RNA, 14 nt, Haemophilus influenzae Rd
aucacguaauacaa

SEQ ID NO: 2718077 - RNA, 18 nt, Haemophilus influenzae Rd
aucacguaauacaaaaua

SEQ ID NO: 2718078 - RNA, 18 nt, Haemophilus influenzae Rd
aucacguuaucaaagaaa

SEQ ID NO: 2718079 - RNA, 16 nt, Haemophilus influenzae Rd
aucacguucaaaaaua

SEQ ID NO: 2718080 - RNA, 22 nt, Haemophilus influenzae Rd
aucacguucaaaaauauuaugu

SEQ ID NO: 2718081 - RNA, 18 nt, Haemophilus influenzae Rd
aucacuaaauucuuguuu

SEQ ID NO: 2718082 - RNA, 17 nt, Haemophilus influenzae Rd
aucacuaauugcauuaa

SEQ ID NO: 2718083 - RNA, 19 nt, Haemophilus influenzae Rd
aucacucguugguauuuac

SEQ ID NO: 2718084 - RNA, 15 nt, Haemophilus influenzae Rd
aucacugaauuucau

SEQ ID NO: 2718085 - RNA, 16 nt, Haemophilus influenzae Rd
aucacugaauuucauu

SEQ ID NO: 2718086 - RNA, 17 nt, Haemophilus influenzae Rd
aucacugccagaaccua

SEQ ID NO: 2718087 - RNA, 21 nt, Haemophilus influenzae Rd
aucacuguaaauaauagguau

SEQ ID NO: 2718088 - RNA, 13 nt, Haemophilus influenzae Rd
aucacuuaaacca

SEQ ID NO: 2718089 - RNA, 15 nt, Haemophilus influenzae Rd
aucacuuaaaccaaa

SEQ ID NO: 2718090 - RNA, 16 nt, Haemophilus influenzae Rd
aucacuuaaaccaaau

SEQ ID NO: 2718091 - RNA, 17 nt, Haemophilus influenzae Rd
aucacuucgucuggcac

SEQ ID NO: 2718092 - RNA, 14 nt, Haemophilus influenzae Rd
aucacuucugcaua

SEQ ID NO: 2718093 - RNA, 15 nt, Haemophilus influenzae Rd
aucacuugaagucua

SEQ ID NO: 2718094 - RNA, 16 nt, Haemophilus influenzae Rd
aucacuugauaaaaau

SEQ ID NO: 2718095 - RNA, 22 nt, Haemophilus influenzae Rd
aucacuugugcgauuaacaaua

SEQ ID NO: 2718096 - RNA, 23 nt, Haemophilus influenzae Rd
aucacuugugcgauuaacaauaa

SEQ ID NO: 2718097 - RNA, 22 nt, Haemophilus influenzae Rd
aucacuugugcuacguuugcac

SEQ ID NO: 2718098 - RNA, 19 nt, Haemophilus influenzae Rd
aucacuuuuucagauacuu

SEQ ID NO: 2718099 - RNA, 16 nt, Haemophilus influenzae Rd
aucagaaauaucuuca

SEQ ID NO: 2718100 - RNA, 17 nt, Haemophilus influenzae Rd
aucagaaauaucuucaa

SEQ ID NO: 2718101 - RNA, 17 nt, Haemophilus influenzae Rd
aucagaaguuaaaacuu

SEQ ID NO: 2718102 - RNA, 22 nt, Haemophilus influenzae Rd
aucagagccucuuggauuuucu

SEQ ID NO: 2718103 - RNA, 23 nt, Haemophilus influenzae Rd
aucagagccucuuggauuuucuu

SEQ ID NO: 2718104 - RNA, 16 nt, Haemophilus influenzae Rd
aucagagcgaauacug

SEQ ID NO: 2718105 - RNA, 20 nt, Haemophilus influenzae Rd
aucagauggaauauuugcgu

SEQ ID NO: 2718106 - RNA, 13 nt, Haemophilus influenzae Rd
aucagauuuaggc

SEQ ID NO: 2718107 - RNA, 13 nt, Haemophilus influenzae Rd
aucagauuuuucg

SEQ ID NO: 2718108 - RNA, 19 nt, Haemophilus influenzae Rd
aucagauuuuucgcauuuu

SEQ ID NO: 2718109 - RNA, 21 nt, Haemophilus influenzae Rd
aucagauuuuuuucagaaaug

SEQ ID NO: 2718110 - RNA, 19 nt, Haemophilus influenzae Rd
aucagccaccuuaacaaag

SEQ ID NO: 2718111 - RNA, 19 nt, Haemophilus influenzae Rd
aucagccccuuaauuauuu

SEQ ID NO: 2718112 - RNA, 17 nt, Haemophilus influenzae Rd
aucagcccuuauuuuuu

SEQ ID NO: 2718113 - RNA, 18 nt, Haemophilus influenzae Rd
aucagcccuuauuuuuug

SEQ ID NO: 2718114 - RNA, 19 nt, Haemophilus influenzae Rd
aucagcccuuuguuuuaau

SEQ ID NO: 2718115 - RNA, 21 nt, Haemophilus influenzae Rd
aucagcgaauuaaagugcaga

SEQ ID NO: 2718116 - RNA, 22 nt, Haemophilus influenzae Rd
aucagcgcauuuuuuauuuuua

SEQ ID NO: 2718117 - RNA, 15 nt, Haemophilus influenzae Rd
aucagcuaaacgcac

SEQ ID NO: 2718118 - RNA, 21 nt, Haemophilus influenzae Rd
aucagcuacuuguaagaauaa

SEQ ID NO: 2718119 - RNA, 21 nt, Haemophilus influenzae Rd
aucagcuccuacauuaaaaga

SEQ ID NO: 2718120 - RNA, 23 nt, Haemophilus influenzae Rd
aucagcuccuacauuaaaagaua

SEQ ID NO: 2718121 - RNA, 21 nt, Haemophilus influenzae Rd
aucagcuguuuaucaauagaa

SEQ ID NO: 2718122 - RNA, 14 nt, Haemophilus influenzae Rd
aucagcuuuuguug

SEQ ID NO: 2718123 - RNA, 16 nt, Haemophilus influenzae Rd
aucaggaggaauaaug

SEQ ID NO: 2718124 - RNA, 20 nt, Haemophilus influenzae Rd
aucaggcugugcauaauccc

SEQ ID NO: 2718125 - RNA, 20 nt, Haemophilus influenzae Rd
aucaggcuuaacuuucucuc

SEQ ID NO: 2718126 - RNA, 17 nt, Haemophilus influenzae Rd
aucaggcuuucauuuuc

SEQ ID NO: 2718127 - RNA, 16 nt, Haemophilus influenzae Rd
aucagggccaguugaa

SEQ ID NO: 2718128 - RNA, 21 nt, Haemophilus influenzae Rd
aucagguaauuggugugcaau

SEQ ID NO: 2718129 - RNA, 17 nt, Haemophilus influenzae Rd
aucagguauaaagaugg

SEQ ID NO: 2718130 - RNA, 23 nt, Haemophilus influenzae Rd
aucaguaaugauucguggcaauu

SEQ ID NO: 2718131 - RNA, 13 nt, Haemophilus influenzae Rd
aucauaaaaacaa

SEQ ID NO: 2718132 - RNA, 14 nt, Haemophilus influenzae Rd
aucauaaaauuucc

SEQ ID NO: 2718133 - RNA, 12 nt, Haemophilus influenzae Rd
aucauaaauaug

SEQ ID NO: 2718134 - RNA, 23 nt, Haemophilus influenzae Rd
aucauaacuauaauuagaucaua

SEQ ID NO: 2718135 - RNA, 17 nt, Haemophilus influenzae Rd
aucauaagauaaggcaa

SEQ ID NO: 2718136 - RNA, 13 nt, Haemophilus influenzae Rd
aucauaagguaca

SEQ ID NO: 2718137 - RNA, 18 nt, Haemophilus influenzae Rd
aucauaagguacaacaga

SEQ ID NO: 2718138 - RNA, 11 nt, Haemophilus influenzae Rd
aucauaaguau

SEQ ID NO: 2718139 - RNA, 18 nt, Haemophilus influenzae Rd
aucauaaucgccaaaauc

SEQ ID NO: 2718140 - RNA, 20 nt, Haemophilus influenzae Rd
aucauaaucgccaaaaucau

SEQ ID NO: 2718141 - RNA, 16 nt, Haemophilus influenzae Rd
aucauaauuuauucaa

SEQ ID NO: 2718142 - RNA, 20 nt, Haemophilus influenzae Rd
aucauaccaauugcaacuuc

SEQ ID NO: 2718143 - RNA, 12 nt, Haemophilus influenzae Rd
aucauagaaauc

SEQ ID NO: 2718144 - RNA, 16 nt, Haemophilus influenzae Rd
aucauagccuuuucua

SEQ ID NO: 2718145 - RNA, 23 nt, Haemophilus influenzae Rd
aucauaggcuucuuguuuacauu

SEQ ID NO: 2718146 - RNA, 19 nt, Haemophilus influenzae Rd
aucauaucaucaaccaaaa

SEQ ID NO: 2718147 - RNA, 22 nt, Haemophilus influenzae Rd
aucauauuucugcaaauaaaga

SEQ ID NO: 2718148 - RNA, 14 nt, Haemophilus influenzae Rd
aucaucaaauugau

SEQ ID NO: 2718149 - RNA, 16 nt, Haemophilus influenzae Rd
aucaucaaccaaaaua

SEQ ID NO: 2718150 - RNA, 22 nt, Haemophilus influenzae Rd
aucaucaaccaaaauacaauca

SEQ ID NO: 2718151 - RNA, 15 nt, Haemophilus influenzae Rd
aucaucaagcaaacu

SEQ ID NO: 2718152 - RNA, 23 nt, Haemophilus influenzae Rd
aucaucagaauaauuaacaaaua

SEQ ID NO: 2718153 - RNA, 14 nt, Haemophilus influenzae Rd
aucaucaucauuuu

SEQ ID NO: 2718154 - RNA, 19 nt, Haemophilus influenzae Rd
aucaucauuuauuaaaagu

SEQ ID NO: 2718155 - RNA, 14 nt, Haemophilus influenzae Rd
aucaucauuuuuau

SEQ ID NO: 2718156 - RNA, 22 nt, Haemophilus influenzae Rd
aucaucccaaucuucgucauca

SEQ ID NO: 2718157 - RNA, 19 nt, Haemophilus influenzae Rd
aucaucccuguauaaagau

SEQ ID NO: 2718158 - RNA, 20 nt, Haemophilus influenzae Rd
aucaucccuguauaaagaua

SEQ ID NO: 2718159 - RNA, 21 nt, Haemophilus influenzae Rd
aucaucccuguauaaagauaa

SEQ ID NO: 2718160 - RNA, 22 nt, Haemophilus influenzae Rd
aucauccgcuucguuguaaucu

SEQ ID NO: 2718161 - RNA, 20 nt, Haemophilus influenzae Rd
aucauccgcuuguaauuuca

SEQ ID NO: 2718162 - RNA, 16 nt, Haemophilus influenzae Rd
aucaucgauaaauuca

SEQ ID NO: 2718163 - RNA, 17 nt, Haemophilus influenzae Rd
aucaucgcgaugacuaa

SEQ ID NO: 2718164 - RNA, 21 nt, Haemophilus influenzae Rd
aucaucuaguuuuaauacuaa

SEQ ID NO: 2718165 - RNA, 13 nt, Haemophilus influenzae Rd
aucaucuauacca

SEQ ID NO: 2718166 - RNA, 18 nt, Haemophilus influenzae Rd
aucaucugcugguuuuag

SEQ ID NO: 2718167 - RNA, 22 nt, Haemophilus influenzae Rd
aucaucuggcauaucugcugcu

SEQ ID NO: 2718168 - RNA, 15 nt, Haemophilus influenzae Rd
aucaucuguaaacca

SEQ ID NO: 2718169 - RNA, 23 nt, Haemophilus influenzae Rd
aucaucuuaucuagacuuucuug

SEQ ID NO: 2718170 - RNA, 21 nt, Haemophilus influenzae Rd
aucaucuucaucugcaucaca

SEQ ID NO: 2718171 - RNA, 13 nt, Haemophilus influenzae Rd
aucaugaaaugca

SEQ ID NO: 2718172 - RNA, 17 nt, Haemophilus influenzae Rd
aucaugaaaugcagauc

SEQ ID NO: 2718173 - RNA, 18 nt, Haemophilus influenzae Rd
aucaugaauaauuuuguu

SEQ ID NO: 2718174 - RNA, 18 nt, Haemophilus influenzae Rd
aucaugagguuugccauc

SEQ ID NO: 2718175 - RNA, 17 nt, Haemophilus influenzae Rd
aucauggcacaaaauaa

SEQ ID NO: 2718176 - RNA, 15 nt, Haemophilus influenzae Rd
aucaugguaauuuaa

SEQ ID NO: 2718177 - RNA, 14 nt, Haemophilus influenzae Rd
aucaugguuguaau

SEQ ID NO: 2718178 - RNA, 14 nt, Haemophilus influenzae Rd
aucauuaaauauaa

SEQ ID NO: 2718179 - RNA, 19 nt, Haemophilus influenzae Rd
aucauuaaauauaaugaau

SEQ ID NO: 2718180 - RNA, 22 nt, Haemophilus influenzae Rd
aucauuaaauuuaguuaauaua

SEQ ID NO: 2718181 - RNA, 15 nt, Haemophilus influenzae Rd
aucauuaauacacaa

SEQ ID NO: 2718182 - RNA, 17 nt, Haemophilus influenzae Rd
aucauuacuuuuuuaag

SEQ ID NO: 2718183 - RNA, 14 nt, Haemophilus influenzae Rd
aucauuagcaacuu

SEQ ID NO: 2718184 - RNA, 15 nt, Haemophilus influenzae Rd
aucauuagcaacuuc

SEQ ID NO: 2718185 - RNA, 14 nt, Haemophilus influenzae Rd
aucauuaugaaaaa

SEQ ID NO: 2718186 - RNA, 15 nt, Haemophilus influenzae Rd
aucauuauugccuuu

SEQ ID NO: 2718187 - RNA, 19 nt, Haemophilus influenzae Rd
aucauucaauauaaaaaau

SEQ ID NO: 2718188 - RNA, 20 nt, Haemophilus influenzae Rd
aucauucaaugcaacaauac

SEQ ID NO: 2718189 - RNA, 17 nt, Haemophilus influenzae Rd
aucauuccgcccauucc

SEQ ID NO: 2718190 - RNA, 18 nt, Haemophilus influenzae Rd
aucauuccgcccauucca

SEQ ID NO: 2718191 - RNA, 18 nt, Haemophilus influenzae Rd
aucauucugguaauuugc

SEQ ID NO: 2718192 - RNA, 17 nt, Haemophilus influenzae Rd
aucauugacuuuuggca

SEQ ID NO: 2718193 - RNA, 15 nt, Haemophilus influenzae Rd
aucauugcaagugca

SEQ ID NO: 2718194 - RNA, 17 nt, Haemophilus influenzae Rd
aucauuggauaauugcc

SEQ ID NO: 2718195 - RNA, 23 nt, Haemophilus influenzae Rd
aucauuuaacggggauuuuuuau

SEQ ID NO: 2718196 - RNA, 12 nt, Haemophilus influenzae Rd
aucauuuaacuu

SEQ ID NO: 2718197 - RNA, 16 nt, Haemophilus influenzae Rd
aucauuuaacuugcaa

SEQ ID NO: 2718198 - RNA, 18 nt, Haemophilus influenzae Rd
aucauuuauuaaaaguaa

SEQ ID NO: 2718199 - RNA, 16 nt, Haemophilus influenzae Rd
aucauuucaauaucaa

SEQ ID NO: 2718200 - RNA, 15 nt, Haemophilus influenzae Rd
aucauuucaauguuu

SEQ ID NO: 2718201 - RNA, 21 nt, Haemophilus influenzae Rd
aucauuugacgauuaauacca

SEQ ID NO: 2718202 - RNA, 20 nt, Haemophilus influenzae Rd
aucauuuggaucuaaaaaau

SEQ ID NO: 2718203 - RNA, 17 nt, Haemophilus influenzae Rd
aucauuuguaaguugua

SEQ ID NO: 2718204 - RNA, 22 nt, Haemophilus influenzae Rd
aucauuuguuuuccguauuuuc

SEQ ID NO: 2718205 - RNA, 22 nt, Haemophilus influenzae Rd
aucauuuucaaguaacuuucac

SEQ ID NO: 2718206 - RNA, 16 nt, Haemophilus influenzae Rd
aucauuuuucgcaaaa

SEQ ID NO: 2718207 - RNA, 13 nt, Haemophilus influenzae Rd
aucauuuuuuaac

SEQ ID NO: 2718208 - RNA, 15 nt, Haemophilus influenzae Rd
aucauuuuuugcaaa

SEQ ID NO: 2718209 - RNA, 14 nt, Haemophilus influenzae Rd
aucauuuuuuuaaa

SEQ ID NO: 2718210 - RNA, 22 nt, Haemophilus influenzae Rd
aucauuuuuuuaaauauuuuua

SEQ ID NO: 2718211 - RNA, 15 nt, Haemophilus influenzae Rd
auccaaaaauauaaa

SEQ ID NO: 2718212 - RNA, 16 nt, Haemophilus influenzae Rd
auccaaaaauauaaac

SEQ ID NO: 2718213 - RNA, 11 nt, Haemophilus influenzae Rd
auccaaaauuc

SEQ ID NO: 2718214 - RNA, 16 nt, Haemophilus influenzae Rd
auccaaacuuucugca

SEQ ID NO: 2718215 - RNA, 20 nt, Haemophilus influenzae Rd
auccaaccuaauaacggcac

SEQ ID NO: 2718216 - RNA, 22 nt, Haemophilus influenzae Rd
auccaaccuacauuaaucacca

SEQ ID NO: 2718217 - RNA, 15 nt, Haemophilus influenzae Rd
auccaacucauuaca

SEQ ID NO: 2718218 - RNA, 22 nt, Haemophilus influenzae Rd
auccaaggaauuggauuugaac

SEQ ID NO: 2718219 - RNA, 23 nt, Haemophilus influenzae Rd
auccaagugcaugagcuuugcuu

SEQ ID NO: 2718220 - RNA, 14 nt, Haemophilus influenzae Rd
auccaauguugcaa

SEQ ID NO: 2718221 - RNA, 13 nt, Haemophilus influenzae Rd
auccacaaauaau

SEQ ID NO: 2718222 - RNA, 21 nt, Haemophilus influenzae Rd
auccacaaucaaucuuuaaaa

SEQ ID NO: 2718223 - RNA, 17 nt, Haemophilus influenzae Rd
auccacacuucaucacu

SEQ ID NO: 2718224 - RNA, 23 nt, Haemophilus influenzae Rd
auccacacuuuaauaguaaacuu

SEQ ID NO: 2718225 - RNA, 16 nt, Haemophilus influenzae Rd
auccaccaaaugcaca

SEQ ID NO: 2718226 - RNA, 15 nt, Haemophilus influenzae Rd
auccacuaaaaaacu

SEQ ID NO: 2718227 - RNA, 17 nt, Haemophilus influenzae Rd
auccacuaaaaaacuaa

SEQ ID NO: 2718228 - RNA, 15 nt, Haemophilus influenzae Rd
auccacuuccguucc

SEQ ID NO: 2718229 - RNA, 22 nt, Haemophilus influenzae Rd
auccacuucgggcgaaaccuuu

SEQ ID NO: 2718230 - RNA, 18 nt, Haemophilus influenzae Rd
auccacuuuuucugccaa

SEQ ID NO: 2718231 - RNA, 13 nt, Haemophilus influenzae Rd
auccacuuuuuuc

SEQ ID NO: 2718232 - RNA, 17 nt, Haemophilus influenzae Rd
auccacuuuuuucacga

SEQ ID NO: 2718233 - RNA, 20 nt, Haemophilus influenzae Rd
auccagaaaauugcaccuuc

SEQ ID NO: 2718234 - RNA, 13 nt, Haemophilus influenzae Rd
auccagacgcauu

SEQ ID NO: 2718235 - RNA, 18 nt, Haemophilus influenzae Rd
auccagauaacaaacccu

SEQ ID NO: 2718236 - RNA, 12 nt, Haemophilus influenzae Rd
auccagugcaua

SEQ ID NO: 2718237 - RNA, 23 nt, Haemophilus influenzae Rd
auccaguuggcgugcuuccauuu

SEQ ID NO: 2718238 - RNA, 16 nt, Haemophilus influenzae Rd
auccauaacaaccauu

SEQ ID NO: 2718239 - RNA, 21 nt, Haemophilus influenzae Rd
auccauaacaaccauuguuca

SEQ ID NO: 2718240 - RNA, 19 nt, Haemophilus influenzae Rd
auccauaacggcaagcaaa

SEQ ID NO: 2718241 - RNA, 17 nt, Haemophilus influenzae Rd
auccauaauuucagcau

SEQ ID NO: 2718242 - RNA, 15 nt, Haemophilus influenzae Rd
auccauaucccauug

SEQ ID NO: 2718243 - RNA, 16 nt, Haemophilus influenzae Rd
auccauaucccauugu

SEQ ID NO: 2718244 - RNA, 12 nt, Haemophilus influenzae Rd
auccaucaaauc

SEQ ID NO: 2718245 - RNA, 13 nt, Haemophilus influenzae Rd
auccaucaagaaa

SEQ ID NO: 2718246 - RNA, 15 nt, Haemophilus influenzae Rd
auccaucauuuuucg

SEQ ID NO: 2718247 - RNA, 16 nt, Haemophilus influenzae Rd
auccaucgacauacaa

SEQ ID NO: 2718248 - RNA, 15 nt, Haemophilus influenzae Rd
auccaucgcaagaua

SEQ ID NO: 2718249 - RNA, 18 nt, Haemophilus influenzae Rd
auccaucgcaagauaaga

SEQ ID NO: 2718250 - RNA, 17 nt, Haemophilus influenzae Rd
auccaugaugaaauaau

SEQ ID NO: 2718251 - RNA, 13 nt, Haemophilus influenzae Rd
auccaugaugaug

SEQ ID NO: 2718252 - RNA, 15 nt, Haemophilus influenzae Rd
auccauuaauaacug

SEQ ID NO: 2718253 - RNA, 21 nt, Haemophilus influenzae Rd
auccauuccugcaagaaaaau

SEQ ID NO: 2718254 - RNA, 13 nt, Haemophilus influenzae Rd
auccauuguuguu

SEQ ID NO: 2718255 - RNA, 22 nt, Haemophilus influenzae Rd
auccauuucgucgcuuuucccu

SEQ ID NO: 2718256 - RNA, 20 nt, Haemophilus influenzae Rd
auccauuuugaacaagguuu

SEQ ID NO: 2718257 - RNA, 17 nt, Haemophilus influenzae Rd
auccauuuuuaaauggu

SEQ ID NO: 2718258 - RNA, 20 nt, Haemophilus influenzae Rd
aucccaaauuaaauccuuuu

SEQ ID NO: 2718259 - RNA, 13 nt, Haemophilus influenzae Rd
aucccaaucuucg

SEQ ID NO: 2718260 - RNA, 13 nt, Haemophilus influenzae Rd
aucccaauuauug

SEQ ID NO: 2718261 - RNA, 15 nt, Haemophilus influenzae Rd
aucccacuuguuuuu

SEQ ID NO: 2718262 - RNA, 15 nt, Haemophilus influenzae Rd
aucccagucaaaaau

SEQ ID NO: 2718263 - RNA, 19 nt, Haemophilus influenzae Rd
aucccauaacagauggauc

SEQ ID NO: 2718264 - RNA, 16 nt, Haemophilus influenzae Rd
aucccauugcaaaaua

SEQ ID NO: 2718265 - RNA, 22 nt, Haemophilus influenzae Rd
aucccauuuagguuagaauaaa

SEQ ID NO: 2718266 - RNA, 20 nt, Haemophilus influenzae Rd
auccccauacaaguauuuuc

SEQ ID NO: 2718267 - RNA, 16 nt, Haemophilus influenzae Rd
auccccauucuuuucg

SEQ ID NO: 2718268 - RNA, 16 nt, Haemophilus influenzae Rd
auccccuaaacuaagc

SEQ ID NO: 2718269 - RNA, 15 nt, Haemophilus influenzae Rd
aucccucaaauacac

SEQ ID NO: 2718270 - RNA, 17 nt, Haemophilus influenzae Rd
aucccugucuggcaagu

SEQ ID NO: 2718271 - RNA, 14 nt, Haemophilus influenzae Rd
aucccuucuuuuau

SEQ ID NO: 2718272 - RNA, 13 nt, Haemophilus influenzae Rd
auccgagagaaag

SEQ ID NO: 2718273 - RNA, 15 nt, Haemophilus influenzae Rd
auccgagagaaaguu

SEQ ID NO: 2718274 - RNA, 20 nt, Haemophilus influenzae Rd
auccgcaauaauuaagaaaa

SEQ ID NO: 2718275 - RNA, 16 nt, Haemophilus influenzae Rd
auccgcugcagcuuca

SEQ ID NO: 2718276 - RNA, 13 nt, Haemophilus influenzae Rd
auccgcugcuaau

SEQ ID NO: 2718277 - RNA, 18 nt, Haemophilus influenzae Rd
auccgguuggaaaagccu

SEQ ID NO: 2718278 - RNA, 19 nt, Haemophilus influenzae Rd
auccguaauauuugacgaa

SEQ ID NO: 2718279 - RNA, 15 nt, Haemophilus influenzae Rd
auccuaagaauccca

SEQ ID NO: 2718280 - RNA, 16 nt, Haemophilus influenzae Rd
auccuaguuuuuuccc

SEQ ID NO: 2718281 - RNA, 18 nt, Haemophilus influenzae Rd
auccuauuaauuuaauuc

SEQ ID NO: 2718282 - RNA, 19 nt, Haemophilus influenzae Rd
auccucagcaauuucuuca

SEQ ID NO: 2718283 - RNA, 15 nt, Haemophilus influenzae Rd
auccucucaaucugu

SEQ ID NO: 2718284 - RNA, 15 nt, Haemophilus influenzae Rd
auccucuuuaaaauu

SEQ ID NO: 2718285 - RNA, 21 nt, Haemophilus influenzae Rd
auccugaaaguagauauuucu

SEQ ID NO: 2718286 - RNA, 15 nt, Haemophilus influenzae Rd
auccugaagauuuug

SEQ ID NO: 2718287 - RNA, 20 nt, Haemophilus influenzae Rd
auccugccaguagaaaauca

SEQ ID NO: 2718288 - RNA, 18 nt, Haemophilus influenzae Rd
auccugccuugcauucgg

SEQ ID NO: 2718289 - RNA, 15 nt, Haemophilus influenzae Rd
auccugcgugaauga

SEQ ID NO: 2718290 - RNA, 22 nt, Haemophilus influenzae Rd
auccugcgugaaugacuuucac

SEQ ID NO: 2718291 - RNA, 24 nt, Haemophilus influenzae Rd
auccugguauuuacaagucucuau

SEQ ID NO: 2718292 - RNA, 18 nt, Haemophilus influenzae Rd
auccugucaucuguaaac

SEQ ID NO: 2718293 - RNA, 19 nt, Haemophilus influenzae Rd
auccuguuguuuuuuaccu

SEQ ID NO: 2718294 - RNA, 21 nt, Haemophilus influenzae Rd
auccuuaauuggggauaaaua

SEQ ID NO: 2718295 - RNA, 19 nt, Haemophilus influenzae Rd
auccuucaugguuuguucc

SEQ ID NO: 2718296 - RNA, 16 nt, Haemophilus influenzae Rd
auccuuccaaauccau

SEQ ID NO: 2718297 - RNA, 19 nt, Haemophilus influenzae Rd
auccuucgccgccauuugg

SEQ ID NO: 2718298 - RNA, 18 nt, Haemophilus influenzae Rd
auccuugaaucauuucau

SEQ ID NO: 2718299 - RNA, 21 nt, Haemophilus influenzae Rd
auccuugaaucauuucaucua

SEQ ID NO: 2718300 - RNA, 23 nt, Haemophilus influenzae Rd
auccuugcucacgggcagaauga

SEQ ID NO: 2718301 - RNA, 18 nt, Haemophilus influenzae Rd
auccuuguuuuucaaaaa

SEQ ID NO: 2718302 - RNA, 14 nt, Haemophilus influenzae Rd
aucgaaaaaguucu

SEQ ID NO: 2718303 - RNA, 17 nt, Haemophilus influenzae Rd
aucgaaaacauaauccg

SEQ ID NO: 2718304 - RNA, 17 nt, Haemophilus influenzae Rd
aucgaacacuguaaaua

SEQ ID NO: 2718305 - RNA, 20 nt, Haemophilus influenzae Rd
aucgaacacuguaaauaaac

SEQ ID NO: 2718306 - RNA, 23 nt, Haemophilus influenzae Rd
aucgaacuuagucucuuuauuuu

SEQ ID NO: 2718307 - RNA, 21 nt, Haemophilus influenzae Rd
aucgaauaagguaacugcacu

SEQ ID NO: 2718308 - RNA, 16 nt, Haemophilus influenzae Rd
aucgaaugauucaauu

SEQ ID NO: 2718309 - RNA, 18 nt, Haemophilus influenzae Rd
aucgaccauugcacgccu

SEQ ID NO: 2718310 - RNA, 15 nt, Haemophilus influenzae Rd
aucgaccuucugcau

SEQ ID NO: 2718311 - RNA, 19 nt, Haemophilus influenzae Rd
aucgagaaaauuaaaaauu

SEQ ID NO: 2718312 - RNA, 13 nt, Haemophilus influenzae Rd
aucgaguaaaaau

SEQ ID NO: 2718313 - RNA, 20 nt, Haemophilus influenzae Rd
aucgaguaaaaauaaaaugc

SEQ ID NO: 2718314 - RNA, 21 nt, Haemophilus influenzae Rd
aucgaguuuuauaagcaaauu

SEQ ID NO: 2718315 - RNA, 18 nt, Haemophilus influenzae Rd
aucgaguuuuaucuucaa

SEQ ID NO: 2718316 - RNA, 13 nt, Haemophilus influenzae Rd
aucgauaauuuaa

SEQ ID NO: 2718317 - RNA, 21 nt, Haemophilus influenzae Rd
aucgauuuuccucuuuuaugu

SEQ ID NO: 2718318 - RNA, 16 nt, Haemophilus influenzae Rd
aucgcaaggucaagau

SEQ ID NO: 2718319 - RNA, 13 nt, Haemophilus influenzae Rd
aucgcaauuuuuu

SEQ ID NO: 2718320 - RNA, 14 nt, Haemophilus influenzae Rd
aucgcacucacaau

SEQ ID NO: 2718321 - RNA, 19 nt, Haemophilus influenzae Rd
aucgcacucacaauaccaa

SEQ ID NO: 2718322 - RNA, 22 nt, Haemophilus influenzae Rd
aucgcacuguuauauaaacaau

SEQ ID NO: 2718323 - RNA, 19 nt, Haemophilus influenzae Rd
aucgcagaaauagauucuu

SEQ ID NO: 2718324 - RNA, 21 nt, Haemophilus influenzae Rd
aucgcagaaauagauucuucg

SEQ ID NO: 2718325 - RNA, 22 nt, Haemophilus influenzae Rd
aucgcaggauaagaugauaaau

SEQ ID NO: 2718326 - RNA, 22 nt, Haemophilus influenzae Rd
aucgcaucaaaggcuaauucua

SEQ ID NO: 2718327 - RNA, 21 nt, Haemophilus influenzae Rd
aucgcaucacgcguuucuaaa

SEQ ID NO: 2718328 - RNA, 18 nt, Haemophilus influenzae Rd
aucgcaucgucuuuaccu

SEQ ID NO: 2718329 - RNA, 22 nt, Haemophilus influenzae Rd
aucgcauuguuuuaucggauau

SEQ ID NO: 2718330 - RNA, 15 nt, Haemophilus influenzae Rd
aucgccaaaaucauc

SEQ ID NO: 2718331 - RNA, 12 nt, Haemophilus influenzae Rd
aucgccaauaau

SEQ ID NO: 2718332 - RNA, 16 nt, Haemophilus influenzae Rd
aucgccauccacuacu

SEQ ID NO: 2718333 - RNA, 20 nt, Haemophilus influenzae Rd
aucgccauucucacgagcau

SEQ ID NO: 2718334 - RNA, 15 nt, Haemophilus influenzae Rd
aucgcccgauuuuaa

SEQ ID NO: 2718335 - RNA, 19 nt, Haemophilus influenzae Rd
aucgccguacuguucuguu

SEQ ID NO: 2718336 - RNA, 23 nt, Haemophilus influenzae Rd
aucgcgaagcucgucuaaaucuu

SEQ ID NO: 2718337 - RNA, 14 nt, Haemophilus influenzae Rd
aucgcgcaaaauaa

SEQ ID NO: 2718338 - RNA, 19 nt, Haemophilus influenzae Rd
aucgcuaagaauaaaguga

SEQ ID NO: 2718339 - RNA, 15 nt, Haemophilus influenzae Rd
aucgcuggauaaaug

SEQ ID NO: 2718340 - RNA, 22 nt, Haemophilus influenzae Rd
aucgcugggauuuugucaccaa

SEQ ID NO: 2718341 - RNA, 23 nt, Haemophilus influenzae Rd
aucgcugggauuuugucaccaaa

SEQ ID NO: 2718342 - RNA, 15 nt, Haemophilus influenzae Rd
aucgcuugcauuucu

SEQ ID NO: 2718343 - RNA, 23 nt, Haemophilus influenzae Rd
aucgcuugccagucauuuuuuac

SEQ ID NO: 2718344 - RNA, 20 nt, Haemophilus influenzae Rd
aucggagggggauuuucucg

SEQ ID NO: 2718345 - RNA, 18 nt, Haemophilus influenzae Rd
aucggauuucuuuauucu

SEQ ID NO: 2718346 - RNA, 23 nt, Haemophilus influenzae Rd
aucggauuucuuuauucugaaac

SEQ ID NO: 2718347 - RNA, 16 nt, Haemophilus influenzae Rd
aucggcaauguuuuaa

SEQ ID NO: 2718348 - RNA, 22 nt, Haemophilus influenzae Rd
aucggcaauguuuuaaguucaa

SEQ ID NO: 2718349 - RNA, 20 nt, Haemophilus influenzae Rd
aucggcgcaccaauuaucaa

SEQ ID NO: 2718350 - RNA, 17 nt, Haemophilus influenzae Rd
aucggcuauuucagcuu

SEQ ID NO: 2718351 - RNA, 20 nt, Haemophilus influenzae Rd
aucggcuuccauuaauacuu

SEQ ID NO: 2718352 - RNA, 19 nt, Haemophilus influenzae Rd
aucgggauaacuuucaguu

SEQ ID NO: 2718353 - RNA, 16 nt, Haemophilus influenzae Rd
aucgguaaguugugag

SEQ ID NO: 2718354 - RNA, 16 nt, Haemophilus influenzae Rd
aucgguacgagaaacg

SEQ ID NO: 2718355 - RNA, 19 nt, Haemophilus influenzae Rd
aucggugcaacaauaucau

SEQ ID NO: 2718356 - RNA, 17 nt, Haemophilus influenzae Rd
aucgguuguuuuuuaau

SEQ ID NO: 2718357 - RNA, 21 nt, Haemophilus influenzae Rd
aucguaaucuuuacccauugc

SEQ ID NO: 2718358 - RNA, 16 nt, Haemophilus influenzae Rd
aucguagucuuucaau

SEQ ID NO: 2718359 - RNA, 13 nt, Haemophilus influenzae Rd
aucguauaagccc

SEQ ID NO: 2718360 - RNA, 20 nt, Haemophilus influenzae Rd
aucguauugcauaaaagcac

SEQ ID NO: 2718361 - RNA, 15 nt, Haemophilus influenzae Rd
aucgucaaauagcua

SEQ ID NO: 2718362 - RNA, 16 nt, Haemophilus influenzae Rd
aucgucaaauuuaaau

SEQ ID NO: 2718363 - RNA, 22 nt, Haemophilus influenzae Rd
aucguccaaagaaguuuuccau

SEQ ID NO: 2718364 - RNA, 15 nt, Haemophilus influenzae Rd
aucguccaauuucau

SEQ ID NO: 2718365 - RNA, 13 nt, Haemophilus influenzae Rd
aucgucuaucuaa

SEQ ID NO: 2718366 - RNA, 16 nt, Haemophilus influenzae Rd
aucgugaccaaguuca

SEQ ID NO: 2718367 - RNA, 15 nt, Haemophilus influenzae Rd
aucgugauauuucac

SEQ ID NO: 2718368 - RNA, 17 nt, Haemophilus influenzae Rd
aucgugaugauuuucau

SEQ ID NO: 2718369 - RNA, 14 nt, Haemophilus influenzae Rd
aucguguaaaaguu

SEQ ID NO: 2718370 - RNA, 18 nt, Haemophilus influenzae Rd
aucguguacuuuucgcuc

SEQ ID NO: 2718371 - RNA, 21 nt, Haemophilus influenzae Rd
aucgugucaguaacuacaacu

SEQ ID NO: 2718372 - RNA, 14 nt, Haemophilus influenzae Rd
aucguuaauaucau

SEQ ID NO: 2718373 - RNA, 19 nt, Haemophilus influenzae Rd
aucguuagcuuucauacgc

SEQ ID NO: 2718374 - RNA, 18 nt, Haemophilus influenzae Rd
aucguucuaaaauggcuu

SEQ ID NO: 2718375 - RNA, 22 nt, Haemophilus influenzae Rd
aucguuugauauaccauucuuu

SEQ ID NO: 2718376 - RNA, 11 nt, Haemophilus influenzae Rd
aucuaaaaaac

SEQ ID NO: 2718377 - RNA, 12 nt, Haemophilus influenzae Rd
aucuaaaaaacc

SEQ ID NO: 2718378 - RNA, 16 nt, Haemophilus influenzae Rd
aucuaaaaaaccuugg

SEQ ID NO: 2718379 - RNA, 19 nt, Haemophilus influenzae Rd
aucuaaaaaagaguaaaua

SEQ ID NO: 2718380 - RNA, 22 nt, Haemophilus influenzae Rd
aucuaaaauaaucgguuguuuu

SEQ ID NO: 2718381 - RNA, 22 nt, Haemophilus influenzae Rd
aucuaaaauucgacgauaacca

SEQ ID NO: 2718382 - RNA, 16 nt, Haemophilus influenzae Rd
aucuaaaccccguuuu

SEQ ID NO: 2718383 - RNA, 15 nt, Haemophilus influenzae Rd
aucuaaaccuaagca

SEQ ID NO: 2718384 - RNA, 13 nt, Haemophilus influenzae Rd
aucuaaaccuugu

SEQ ID NO: 2718385 - RNA, 20 nt, Haemophilus influenzae Rd
aucuaaacuuguuaaauaaa

SEQ ID NO: 2718386 - RNA, 14 nt, Haemophilus influenzae Rd
aucuaaagaaaaua

SEQ ID NO: 2718387 - RNA, 22 nt, Haemophilus influenzae Rd
aucuaaagcgaucaucauuaaa

SEQ ID NO: 2718388 - RNA, 18 nt, Haemophilus influenzae Rd
aucuaaaggaaucccaua

SEQ ID NO: 2718389 - RNA, 17 nt, Haemophilus influenzae Rd
aucuaaauauauuuuua

SEQ ID NO: 2718390 - RNA, 12 nt, Haemophilus influenzae Rd
aucuaaaucucu

SEQ ID NO: 2718391 - RNA, 13 nt, Haemophilus influenzae Rd
aucuaacauaaug

SEQ ID NO: 2718392 - RNA, 16 nt, Haemophilus influenzae Rd
aucuaacuaaaauagu

SEQ ID NO: 2718393 - RNA, 22 nt, Haemophilus influenzae Rd
aucuaagaaaauagaagccaaa

SEQ ID NO: 2718394 - RNA, 19 nt, Haemophilus influenzae Rd
aucuaagauacccauuucg

SEQ ID NO: 2718395 - RNA, 24 nt, Haemophilus influenzae Rd
aucuaagauacccauuucgaucau

SEQ ID NO: 2718396 - RNA, 18 nt, Haemophilus influenzae Rd
aucuaagccuaagccaaa

SEQ ID NO: 2718397 - RNA, 23 nt, Haemophilus influenzae Rd
aucuaagcucauauacaucucau

SEQ ID NO: 2718398 - RNA, 20 nt, Haemophilus influenzae Rd
aucuaagcucggaauguuuu

SEQ ID NO: 2718399 - RNA, 12 nt, Haemophilus influenzae Rd
aucuaaggucau

SEQ ID NO: 2718400 - RNA, 16 nt, Haemophilus influenzae Rd
aucuaauaauaagauu

SEQ ID NO: 2718401 - RNA, 20 nt, Haemophilus influenzae Rd
aucuaauacgucuaauuuag

SEQ ID NO: 2718402 - RNA, 17 nt, Haemophilus influenzae Rd
aucuaauccuaaaaugc

SEQ ID NO: 2718403 - RNA, 21 nt, Haemophilus influenzae Rd
aucuaaucgggcuuuaucaua

SEQ ID NO: 2718404 - RNA, 16 nt, Haemophilus influenzae Rd
aucuaaugccuuuccu

SEQ ID NO: 2718405 - RNA, 12 nt, Haemophilus influenzae Rd
aucuaauuauuu

SEQ ID NO: 2718406 - RNA, 13 nt, Haemophilus influenzae Rd
aucuaauucuucc

SEQ ID NO: 2718407 - RNA, 17 nt, Haemophilus influenzae Rd
aucuaauugauucaaau

SEQ ID NO: 2718408 - RNA, 18 nt, Haemophilus influenzae Rd
aucuaauugauucaaauc

SEQ ID NO: 2718409 - RNA, 23 nt, Haemophilus influenzae Rd
aucuaauugggucguuagcucag

SEQ ID NO: 2718410 - RNA, 20 nt, Haemophilus influenzae Rd
aucuaauuugccaaguacaa

SEQ ID NO: 2718411 - RNA, 16 nt, Haemophilus influenzae Rd
aucuacaaucaaaaaa

SEQ ID NO: 2718412 - RNA, 20 nt, Haemophilus influenzae Rd
aucuacaccgaauaauacug

SEQ ID NO: 2718413 - RNA, 22 nt, Haemophilus influenzae Rd
aucuacacggagauauuguaau

SEQ ID NO: 2718414 - RNA, 23 nt, Haemophilus influenzae Rd
aucuacacggagauauuguaauc

SEQ ID NO: 2718415 - RNA, 20 nt, Haemophilus influenzae Rd
aucuacagggcuuaguccuu

SEQ ID NO: 2718416 - RNA, 14 nt, Haemophilus influenzae Rd
aucuacauuuuuag

SEQ ID NO: 2718417 - RNA, 16 nt, Haemophilus influenzae Rd
aucuaccacaucaaau

SEQ ID NO: 2718418 - RNA, 19 nt, Haemophilus influenzae Rd
aucuaccacgauaaauccu

SEQ ID NO: 2718419 - RNA, 13 nt, Haemophilus influenzae Rd
aucuacuaaaaua

SEQ ID NO: 2718420 - RNA, 18 nt, Haemophilus influenzae Rd
aucuacuagccaaucaua

SEQ ID NO: 2718421 - RNA, 20 nt, Haemophilus influenzae Rd
aucuacuagccaaucauaau

SEQ ID NO: 2718422 - RNA, 16 nt, Haemophilus influenzae Rd
aucuacuguggcaagu

SEQ ID NO: 2718423 - RNA, 21 nt, Haemophilus influenzae Rd
aucuacuuggacauuguuguu

SEQ ID NO: 2718424 - RNA, 17 nt, Haemophilus influenzae Rd
aucuacuuguguuuuag

SEQ ID NO: 2718425 - RNA, 19 nt, Haemophilus influenzae Rd
aucuagaaaacucauccaa

SEQ ID NO: 2718426 - RNA, 14 nt, Haemophilus influenzae Rd
aucuagagauugua

SEQ ID NO: 2718427 - RNA, 22 nt, Haemophilus influenzae Rd
aucuagagauuguaugaaaaau

SEQ ID NO: 2718428 - RNA, 14 nt, Haemophilus influenzae Rd
aucuagcuuaacaa

SEQ ID NO: 2718429 - RNA, 13 nt, Haemophilus influenzae Rd
aucuauaaaaaga

SEQ ID NO: 2718430 - RNA, 15 nt, Haemophilus influenzae Rd
aucuauauuauacuu

SEQ ID NO: 2718431 - RNA, 21 nt, Haemophilus influenzae Rd
aucuauauucguuaaauaaug

SEQ ID NO: 2718432 - RNA, 15 nt, Haemophilus influenzae Rd
aucuauccaacucau

SEQ ID NO: 2718433 - RNA, 16 nt, Haemophilus influenzae Rd
aucuauccaacucauu

SEQ ID NO: 2718434 - RNA, 19 nt, Haemophilus influenzae Rd
aucuaucccaacagaaaau

SEQ ID NO: 2718435 - RNA, 15 nt, Haemophilus influenzae Rd
aucuauuccuuucuu

SEQ ID NO: 2718436 - RNA, 17 nt, Haemophilus influenzae Rd
aucuauugagauuuaau

SEQ ID NO: 2718437 - RNA, 22 nt, Haemophilus influenzae Rd
aucuauuggaauggcaaaauuu

SEQ ID NO: 2718438 - RNA, 14 nt, Haemophilus influenzae Rd
aucuauuguggcuu

SEQ ID NO: 2718439 - RNA, 14 nt, Haemophilus influenzae Rd
aucuauuucuuuga

SEQ ID NO: 2718440 - RNA, 22 nt, Haemophilus influenzae Rd
aucuauuucuuugaguaaaaaa

SEQ ID NO: 2718441 - RNA, 18 nt, Haemophilus influenzae Rd
aucucaaaaucagcaaau

SEQ ID NO: 2718442 - RNA, 23 nt, Haemophilus influenzae Rd
aucucaacaacaucuuguuuuaa

SEQ ID NO: 2718443 - RNA, 16 nt, Haemophilus influenzae Rd
aucucacguacuuuua

SEQ ID NO: 2718444 - RNA, 15 nt, Haemophilus influenzae Rd
aucucagaauuuauu

SEQ ID NO: 2718445 - RNA, 14 nt, Haemophilus influenzae Rd
aucucagcaagcug

SEQ ID NO: 2718446 - RNA, 21 nt, Haemophilus influenzae Rd
aucucauaaaguauacuuuuc

SEQ ID NO: 2718447 - RNA, 21 nt, Haemophilus influenzae Rd
aucucauccacuaaaccauuu

SEQ ID NO: 2718448 - RNA, 16 nt, Haemophilus influenzae Rd
aucuccaagaauauuu

SEQ ID NO: 2718449 - RNA, 17 nt, Haemophilus influenzae Rd
aucuccaagaauauuuc

SEQ ID NO: 2718450 - RNA, 13 nt, Haemophilus influenzae Rd
aucucccaaagaa

SEQ ID NO: 2718451 - RNA, 19 nt, Haemophilus influenzae Rd
aucucuaccacagucaaau

SEQ ID NO: 2718452 - RNA, 15 nt, Haemophilus influenzae Rd
aucucuagauuuuuu

SEQ ID NO: 2718453 - RNA, 16 nt, Haemophilus influenzae Rd
aucucuagauuuuuua

SEQ ID NO: 2718454 - RNA, 20 nt, Haemophilus influenzae Rd
aucucucaaaaaucaaccgc

SEQ ID NO: 2718455 - RNA, 14 nt, Haemophilus influenzae Rd
aucucuugaauacc

SEQ ID NO: 2718456 - RNA, 17 nt, Haemophilus influenzae Rd
aucucuuuacuguucaa

SEQ ID NO: 2718457 - RNA, 20 nt, Haemophilus influenzae Rd
aucucuuuacuguucaaaua

SEQ ID NO: 2718458 - RNA, 19 nt, Haemophilus influenzae Rd
aucucuuucuuaaaauacc

SEQ ID NO: 2718459 - RNA, 17 nt, Haemophilus influenzae Rd
aucugaacuuuguucau

SEQ ID NO: 2718460 - RNA, 16 nt, Haemophilus influenzae Rd
aucugauacuuugcuu

SEQ ID NO: 2718461 - RNA, 22 nt, Haemophilus influenzae Rd
aucugauccgugaacugaguuu

SEQ ID NO: 2718462 - RNA, 13 nt, Haemophilus influenzae Rd
aucugauugagaa

SEQ ID NO: 2718463 - RNA, 14 nt, Haemophilus influenzae Rd
aucugauuuugugg

SEQ ID NO: 2718464 - RNA, 20 nt, Haemophilus influenzae Rd
aucugcaaaugguguuuuau

SEQ ID NO: 2718465 - RNA, 21 nt, Haemophilus influenzae Rd
aucugcaccccaaaagcugga

SEQ ID NO: 2718466 - RNA, 20 nt, Haemophilus influenzae Rd
aucugcaccuuaaaggcuga

SEQ ID NO: 2718467 - RNA, 16 nt, Haemophilus influenzae Rd
aucugcacgauagcaa

SEQ ID NO: 2718468 - RNA, 18 nt, Haemophilus influenzae Rd
aucugcacgauagcaaug

SEQ ID NO: 2718469 - RNA, 16 nt, Haemophilus influenzae Rd
aucugcacguaaaguu

SEQ ID NO: 2718470 - RNA, 13 nt, Haemophilus influenzae Rd
aucugcacuuuaa

SEQ ID NO: 2718471 - RNA, 14 nt, Haemophilus influenzae Rd
aucugcaucacaaa

SEQ ID NO: 2718472 - RNA, 14 nt, Haemophilus influenzae Rd
aucugcaucuaauu

SEQ ID NO: 2718473 - RNA, 17 nt, Haemophilus influenzae Rd
aucugcauucuaaaagu

SEQ ID NO: 2718474 - RNA, 13 nt, Haemophilus influenzae Rd
aucugcauuucaa

SEQ ID NO: 2718475 - RNA, 17 nt, Haemophilus influenzae Rd
aucugcauuucaaugac

SEQ ID NO: 2718476 - RNA, 21 nt, Haemophilus influenzae Rd
aucugccacagaccaaaauuc

SEQ ID NO: 2718477 - RNA, 15 nt, Haemophilus influenzae Rd
aucugccacuucuug

SEQ ID NO: 2718478 - RNA, 22 nt, Haemophilus influenzae Rd
aucugcuaauagaacuguuauu

SEQ ID NO: 2718479 - RNA, 13 nt, Haemophilus influenzae Rd
aucugcuuuucuu

SEQ ID NO: 2718480 - RNA, 21 nt, Haemophilus influenzae Rd
aucuguaaaccuuuuggcauu

SEQ ID NO: 2718481 - RNA, 21 nt, Haemophilus influenzae Rd
aucugucacgagcuaaaaaau

SEQ ID NO: 2718482 - RNA, 14 nt, Haemophilus influenzae Rd
aucugucauauaac

SEQ ID NO: 2718483 - RNA, 21 nt, Haemophilus influenzae Rd
aucugucauauaaccacguaa

SEQ ID NO: 2718484 - RNA, 22 nt, Haemophilus influenzae Rd
aucugucaucgauguaaagugu

SEQ ID NO: 2718485 - RNA, 19 nt, Haemophilus influenzae Rd
aucugugacgccauccaaa

SEQ ID NO: 2718486 - RNA, 15 nt, Haemophilus influenzae Rd
aucugugauauauau

SEQ ID NO: 2718487 - RNA, 22 nt, Haemophilus influenzae Rd
aucugugugggcacuuguugau

SEQ ID NO: 2718488 - RNA, 23 nt, Haemophilus influenzae Rd
aucuguugaaucucagcaagcug

SEQ ID NO: 2718489 - RNA, 12 nt, Haemophilus influenzae Rd
aucuuaaaaaag

SEQ ID NO: 2718490 - RNA, 14 nt, Haemophilus influenzae Rd
aucuuaaagaauuu

SEQ ID NO: 2718491 - RNA, 15 nt, Haemophilus influenzae Rd
aucuuaccuuuuucu

SEQ ID NO: 2718492 - RNA, 20 nt, Haemophilus influenzae Rd
aucuuaccuuuuucuaccga

SEQ ID NO: 2718493 - RNA, 14 nt, Haemophilus influenzae Rd
aucuuaguauuuua

SEQ ID NO: 2718494 - RNA, 15 nt, Haemophilus influenzae Rd
aucuuaguauuuuau

SEQ ID NO: 2718495 - RNA, 23 nt, Haemophilus influenzae Rd
aucuuaguauuuuauuuaagcuu

SEQ ID NO: 2718496 - RNA, 18 nt, Haemophilus influenzae Rd
aucuuauacaacaaaaag

SEQ ID NO: 2718497 - RNA, 16 nt, Haemophilus influenzae Rd
aucuuauauuuuugau

SEQ ID NO: 2718498 - RNA, 16 nt, Haemophilus influenzae Rd
aucuuaucaaacacuu

SEQ ID NO: 2718499 - RNA, 16 nt, Haemophilus influenzae Rd
aucuuauuucaauauu

SEQ ID NO: 2718500 - RNA, 17 nt, Haemophilus influenzae Rd
aucuuauuucaauauug

SEQ ID NO: 2718501 - RNA, 21 nt, Haemophilus influenzae Rd
aucuucaaaauaguaaaaauu

SEQ ID NO: 2718502 - RNA, 13 nt, Haemophilus influenzae Rd
aucuucaaucauc

SEQ ID NO: 2718503 - RNA, 15 nt, Haemophilus influenzae Rd
aucuucaauuucuac

SEQ ID NO: 2718504 - RNA, 17 nt, Haemophilus influenzae Rd
aucuucagcauuuacca

SEQ ID NO: 2718505 - RNA, 20 nt, Haemophilus influenzae Rd
aucuucauacuuagauaaau

SEQ ID NO: 2718506 - RNA, 15 nt, Haemophilus influenzae Rd
aucuucauauccacc

SEQ ID NO: 2718507 - RNA, 14 nt, Haemophilus influenzae Rd
aucuucaugauuuu

SEQ ID NO: 2718508 - RNA, 17 nt, Haemophilus influenzae Rd
aucuucaugauuuucca

SEQ ID NO: 2718509 - RNA, 22 nt, Haemophilus influenzae Rd
aucuucaugauuuuccaaaauu

SEQ ID NO: 2718510 - RNA, 23 nt, Haemophilus influenzae Rd
aucuucaugauuuuccaaaauuu

SEQ ID NO: 2718511 - RNA, 19 nt, Haemophilus influenzae Rd
aucuucauuccauuuugca

SEQ ID NO: 2718512 - RNA, 14 nt, Haemophilus influenzae Rd
aucuuccaauaauu

SEQ ID NO: 2718513 - RNA, 17 nt, Haemophilus influenzae Rd
aucuuccaauaauucuu

SEQ ID NO: 2718514 - RNA, 18 nt, Haemophilus influenzae Rd
aucuuccaauaauucuuu

SEQ ID NO: 2718515 - RNA, 15 nt, Haemophilus influenzae Rd
aucuuccaauacaau

SEQ ID NO: 2718516 - RNA, 21 nt, Haemophilus influenzae Rd
aucuuccauaucacauuuuau

SEQ ID NO: 2718517 - RNA, 22 nt, Haemophilus influenzae Rd
aucuucccagaaugguaaugca

SEQ ID NO: 2718518 - RNA, 16 nt, Haemophilus influenzae Rd
aucuucccauuugaau

SEQ ID NO: 2718519 - RNA, 21 nt, Haemophilus influenzae Rd
aucuucccccaaaaaguuaga

SEQ ID NO: 2718520 - RNA, 18 nt, Haemophilus influenzae Rd
aucuuccguuuuuuucac

SEQ ID NO: 2718521 - RNA, 21 nt, Haemophilus influenzae Rd
aucuucgaugugcauuuuuca

SEQ ID NO: 2718522 - RNA, 23 nt, Haemophilus influenzae Rd
aucuucgcucguuguagcccaau

SEQ ID NO: 2718523 - RNA, 14 nt, Haemophilus influenzae Rd
aucuucggauuuuu

SEQ ID NO: 2718524 - RNA, 15 nt, Haemophilus influenzae Rd
aucuucgucaucauc

SEQ ID NO: 2718525 - RNA, 14 nt, Haemophilus influenzae Rd
aucuucuaaaagag

SEQ ID NO: 2718526 - RNA, 21 nt, Haemophilus influenzae Rd
aucuucuaauuugccaucacu

SEQ ID NO: 2718527 - RNA, 22 nt, Haemophilus influenzae Rd
aucuucuacuguuaauuugcca

SEQ ID NO: 2718528 - RNA, 13 nt, Haemophilus influenzae Rd
aucuucuaucuac

SEQ ID NO: 2718529 - RNA, 22 nt, Haemophilus influenzae Rd
aucuucugaucaauuuaaucaa

SEQ ID NO: 2718530 - RNA, 16 nt, Haemophilus influenzae Rd
aucuucuggguucacg

SEQ ID NO: 2718531 - RNA, 22 nt, Haemophilus influenzae Rd
aucuucuuuaccaacuaacaua

SEQ ID NO: 2718532 - RNA, 13 nt, Haemophilus influenzae Rd
aucuugacauaau

SEQ ID NO: 2718533 - RNA, 18 nt, Haemophilus influenzae Rd
aucuugacauaauuucac

SEQ ID NO: 2718534 - RNA, 15 nt, Haemophilus influenzae Rd
aucuugauccauaua

SEQ ID NO: 2718535 - RNA, 24 nt, Haemophilus influenzae Rd
aucuugauccccauacaaguauuu

SEQ ID NO: 2718536 - RNA, 23 nt, Haemophilus influenzae Rd
aucuugcacggguuuugcuaaug

SEQ ID NO: 2718537 - RNA, 22 nt, Haemophilus influenzae Rd
aucuugcauaaaccaacuauuu

SEQ ID NO: 2718538 - RNA, 20 nt, Haemophilus influenzae Rd
aucuugccaaugccaaauuu

SEQ ID NO: 2718539 - RNA, 23 nt, Haemophilus influenzae Rd
aucuugcguuaaaucaaaaccaa

SEQ ID NO: 2718540 - RNA, 16 nt, Haemophilus influenzae Rd
aucuugcuuuuuuaau

SEQ ID NO: 2718541 - RNA, 21 nt, Haemophilus influenzae Rd
aucuuggugccaauccauuuu

SEQ ID NO: 2718542 - RNA, 19 nt, Haemophilus influenzae Rd
aucuuguuggaucuuccaa

SEQ ID NO: 2718543 - RNA, 12 nt, Haemophilus influenzae Rd
aucuuguuuuaa

SEQ ID NO: 2718544 - RNA, 13 nt, Haemophilus influenzae Rd
aucuuguuuuaau

SEQ ID NO: 2718545 - RNA, 14 nt, Haemophilus influenzae Rd
aucuuguuuuaauu

SEQ ID NO: 2718546 - RNA, 12 nt, Haemophilus influenzae Rd
aucuuguuuuac

SEQ ID NO: 2718547 - RNA, 18 nt, Haemophilus influenzae Rd
aucuuuaaguguuguucc

SEQ ID NO: 2718548 - RNA, 18 nt, Haemophilus influenzae Rd
aucuuuaauuaaaauauu

SEQ ID NO: 2718549 - RNA, 13 nt, Haemophilus influenzae Rd
aucuuuaccaaaa

SEQ ID NO: 2718550 - RNA, 23 nt, Haemophilus influenzae Rd
aucuuuacguugugcgauuuucu

SEQ ID NO: 2718551 - RNA, 22 nt, Haemophilus influenzae Rd
aucuuuagcuaaugcaaaauua

SEQ ID NO: 2718552 - RNA, 14 nt, Haemophilus influenzae Rd
aucuuuauaacaua

SEQ ID NO: 2718553 - RNA, 15 nt, Haemophilus influenzae Rd
aucuuuaucauuuaa

SEQ ID NO: 2718554 - RNA, 23 nt, Haemophilus influenzae Rd
aucuuuaucuucuacaaauacac

SEQ ID NO: 2718555 - RNA, 20 nt, Haemophilus influenzae Rd
aucuuuauuugucagauuua

SEQ ID NO: 2718556 - RNA, 18 nt, Haemophilus influenzae Rd
aucuuucacugcauuuuc

SEQ ID NO: 2718557 - RNA, 17 nt, Haemophilus influenzae Rd
aucuuugacuaaaucau

SEQ ID NO: 2718558 - RNA, 12 nt, Haemophilus influenzae Rd
aucuuugauuuu

SEQ ID NO: 2718559 - RNA, 21 nt, Haemophilus influenzae Rd
aucuuugauuuucuuauuaau

SEQ ID NO: 2718560 - RNA, 18 nt, Haemophilus influenzae Rd
aucuuuggauugguguuu

SEQ ID NO: 2718561 - RNA, 18 nt, Haemophilus influenzae Rd
aucuuuuaaauaaccaua

SEQ ID NO: 2718562 - RNA, 13 nt, Haemophilus influenzae Rd
aucuuuuaacacg

SEQ ID NO: 2718563 - RNA, 15 nt, Haemophilus influenzae Rd
aucuuuuaacacgaa

SEQ ID NO: 2718564 - RNA, 19 nt, Haemophilus influenzae Rd
aucuuuuaauaagauaaua

SEQ ID NO: 2718565 - RNA, 14 nt, Haemophilus influenzae Rd
aucuuuuaauucuc

SEQ ID NO: 2718566 - RNA, 17 nt, Haemophilus influenzae Rd
aucuuuuuauaaaaaaa

SEQ ID NO: 2718567 - RNA, 12 nt, Haemophilus influenzae Rd
aucuuuuucuug

SEQ ID NO: 2718568 - RNA, 19 nt, Haemophilus influenzae Rd
aucuuuuuguaauuucuca

SEQ ID NO: 2718569 - RNA, 21 nt, Haemophilus influenzae Rd
aucuuuuuguaauuucucacc

SEQ ID NO: 2718570 - RNA, 14 nt, Haemophilus influenzae Rd
aucuuuuuguuaau

SEQ ID NO: 2718571 - RNA, 13 nt, Haemophilus influenzae Rd
aucuuuuuuaaga

SEQ ID NO: 2718572 - RNA, 14 nt, Haemophilus influenzae Rd
aucuuuuuuaagau

SEQ ID NO: 2718573 - RNA, 20 nt, Haemophilus influenzae Rd
aucuuuuuucuugcuaaaaa

SEQ ID NO: 2718574 - RNA, 23 nt, Haemophilus influenzae Rd
aucuuuuuucuugcuaaaaagaa

SEQ ID NO: 2718575 - RNA, 14 nt, Haemophilus influenzae Rd
aucuuuuuuugcuu

SEQ ID NO: 2718576 - RNA, 13 nt, Haemophilus influenzae Rd
augaaaaaaagaa

SEQ ID NO: 2718577 - RNA, 18 nt, Haemophilus influenzae Rd
augaaaaaugcuuguucu

SEQ ID NO: 2718578 - RNA, 16 nt, Haemophilus influenzae Rd
augaaaaauggguuaa

SEQ ID NO: 2718579 - RNA, 24 nt, Haemophilus influenzae Rd
augaaaacagcggucaaaauagac

SEQ ID NO: 2718580 - RNA, 13 nt, Haemophilus influenzae Rd
augaaaauuaucu

SEQ ID NO: 2718581 - RNA, 14 nt, Haemophilus influenzae Rd
augaaaauuaucug

SEQ ID NO: 2718582 - RNA, 18 nt, Haemophilus influenzae Rd
augaaaauuaucugcucu

SEQ ID NO: 2718583 - RNA, 22 nt, Haemophilus influenzae Rd
augaaaauuaucugcucucauu

SEQ ID NO: 2718584 - RNA, 19 nt, Haemophilus influenzae Rd
augaaaauucucuucaacu

SEQ ID NO: 2718585 - RNA, 15 nt, Haemophilus influenzae Rd
augaaacagcuaaaa

SEQ ID NO: 2718586 - RNA, 22 nt, Haemophilus influenzae Rd
augaaacagcuaaaaaugaauu

SEQ ID NO: 2718587 - RNA, 18 nt, Haemophilus influenzae Rd
augaaacgagauuuauuu

SEQ ID NO: 2718588 - RNA, 21 nt, Haemophilus influenzae Rd
augaaacgcgaguaaaauaaa

SEQ ID NO: 2718589 - RNA, 22 nt, Haemophilus influenzae Rd
augaaacgcgaguaaaauaaaa

SEQ ID NO: 2718590 - RNA, 20 nt, Haemophilus influenzae Rd
augaaagaagaaaaaggcag

SEQ ID NO: 2718591 - RNA, 11 nt, Haemophilus influenzae Rd
augaaagccaa

SEQ ID NO: 2718592 - RNA, 16 nt, Haemophilus influenzae Rd
augaaaguaacaaugu

SEQ ID NO: 2718593 - RNA, 21 nt, Haemophilus influenzae Rd
augaaaguaacaauguagaaa

SEQ ID NO: 2718594 - RNA, 14 nt, Haemophilus influenzae Rd
augaaauauuuuua

SEQ ID NO: 2718595 - RNA, 13 nt, Haemophilus influenzae Rd
augaaaucaaaau

SEQ ID NO: 2718596 - RNA, 21 nt, Haemophilus influenzae Rd
augaaaugccgauaauagaca

SEQ ID NO: 2718597 - RNA, 18 nt, Haemophilus influenzae Rd
augaaauuagguuauuuu

SEQ ID NO: 2718598 - RNA, 19 nt, Haemophilus influenzae Rd
augaaauucagugauuaag

SEQ ID NO: 2718599 - RNA, 18 nt, Haemophilus influenzae Rd
augaaauugcuguaaugu

SEQ ID NO: 2718600 - RNA, 22 nt, Haemophilus influenzae Rd
augaaauugcuguaaugugcua

SEQ ID NO: 2718601 - RNA, 22 nt, Haemophilus influenzae Rd
augaaauuucuugcucuaauuu

SEQ ID NO: 2718602 - RNA, 12 nt, Haemophilus influenzae Rd
augaacaaaaaa

SEQ ID NO: 2718603 - RNA, 17 nt, Haemophilus influenzae Rd
augaacaaaaaauuaac

SEQ ID NO: 2718604 - RNA, 21 nt, Haemophilus influenzae Rd
augaacgccgcaacuaauaaa

SEQ ID NO: 2718605 - RNA, 20 nt, Haemophilus influenzae Rd
augaacuuaugugcaccuuc

SEQ ID NO: 2718606 - RNA, 21 nt, Haemophilus influenzae Rd
augaacuuguucgucaccgua

SEQ ID NO: 2718607 - RNA, 16 nt, Haemophilus influenzae Rd
augaacuuuuuuauaa

SEQ ID NO: 2718608 - RNA, 17 nt, Haemophilus influenzae Rd
augaacuuuuuuauaau

SEQ ID NO: 2718609 - RNA, 16 nt, Haemophilus influenzae Rd
augaagacuaaacaga

SEQ ID NO: 2718610 - RNA, 11 nt, Haemophilus influenzae Rd
augaagaugaa

SEQ ID NO: 2718611 - RNA, 15 nt, Haemophilus influenzae Rd
augaagaugaagcua

SEQ ID NO: 2718612 - RNA, 15 nt, Haemophilus influenzae Rd
augaaguuuuacuga

SEQ ID NO: 2718613 - RNA, 12 nt, Haemophilus influenzae Rd
augaauaaaaau

SEQ ID NO: 2718614 - RNA, 16 nt, Haemophilus influenzae Rd
augaauaaaauuuuua

SEQ ID NO: 2718615 - RNA, 19 nt, Haemophilus influenzae Rd
augaauaaaauuuuuaaag

SEQ ID NO: 2718616 - RNA, 20 nt, Haemophilus influenzae Rd
augaauaagcgaaaaacaua

SEQ ID NO: 2718617 - RNA, 14 nt, Haemophilus influenzae Rd
augaauaauaaugc

SEQ ID NO: 2718618 - RNA, 14 nt, Haemophilus influenzae Rd
augaauaauuuuua

SEQ ID NO: 2718619 - RNA, 21 nt, Haemophilus influenzae Rd
augaauaucuuccacaacaac

SEQ ID NO: 2718620 - RNA, 22 nt, Haemophilus influenzae Rd
augaaucgaacacuguaaauaa

SEQ ID NO: 2718621 - RNA, 11 nt, Haemophilus influenzae Rd
augaauggguu

SEQ ID NO: 2718622 - RNA, 16 nt, Haemophilus influenzae Rd
augaauguuucaaaca

SEQ ID NO: 2718623 - RNA, 21 nt, Haemophilus influenzae Rd
augaauuaccaauuccaaagc

SEQ ID NO: 2718624 - RNA, 12 nt, Haemophilus influenzae Rd
augaauuagaaa

SEQ ID NO: 2718625 - RNA, 20 nt, Haemophilus influenzae Rd
augaauuaguuucaacuugg

SEQ ID NO: 2718626 - RNA, 16 nt, Haemophilus influenzae Rd
augacaccuuuaaaaa

SEQ ID NO: 2718627 - RNA, 20 nt, Haemophilus influenzae Rd
augacaccuuuaaaaauuac

SEQ ID NO: 2718628 - RNA, 23 nt, Haemophilus influenzae Rd
augacaguuuguaauccugcauu

SEQ ID NO: 2718629 - RNA, 14 nt, Haemophilus influenzae Rd
augacauaucaauu

SEQ ID NO: 2718630 - RNA, 19 nt, Haemophilus influenzae Rd
augacauuaaagcaauugc

SEQ ID NO: 2718631 - RNA, 15 nt, Haemophilus influenzae Rd
augaccaaauaccac

SEQ ID NO: 2718632 - RNA, 17 nt, Haemophilus influenzae Rd
augaccaaguaaaccaa

SEQ ID NO: 2718633 - RNA, 17 nt, Haemophilus influenzae Rd
augaccauuaaucacac

SEQ ID NO: 2718634 - RNA, 18 nt, Haemophilus influenzae Rd
augacgaacgugggaauu

SEQ ID NO: 2718635 - RNA, 20 nt, Haemophilus influenzae Rd
augacgagugagauaaauaa

SEQ ID NO: 2718636 - RNA, 16 nt, Haemophilus influenzae Rd
augacuaaacaaauaa

SEQ ID NO: 2718637 - RNA, 17 nt, Haemophilus influenzae Rd
augacuaauuaauuacc

SEQ ID NO: 2718638 - RNA, 14 nt, Haemophilus influenzae Rd
augacuauuuagaa

SEQ ID NO: 2718639 - RNA, 16 nt, Haemophilus influenzae Rd
augacuauuuagaaau

SEQ ID NO: 2718640 - RNA, 17 nt, Haemophilus influenzae Rd
augacuggcaaaaaugu

SEQ ID NO: 2718641 - RNA, 19 nt, Haemophilus influenzae Rd
augacuggcaaaaauguca

SEQ ID NO: 2718642 - RNA, 19 nt, Haemophilus influenzae Rd
augacuggcuugugaaaua

SEQ ID NO: 2718643 - RNA, 22 nt, Haemophilus influenzae Rd
augacuggcuugugaaauaaaa

SEQ ID NO: 2718644 - RNA, 20 nt, Haemophilus influenzae Rd
augacuuagggcucaaaucu

SEQ ID NO: 2718645 - RNA, 23 nt, Haemophilus influenzae Rd
augacuuagggcucaaaucuacu

SEQ ID NO: 2718646 - RNA, 12 nt, Haemophilus influenzae Rd
augacuuucacu

SEQ ID NO: 2718647 - RNA, 13 nt, Haemophilus influenzae Rd
augagaauuaauu

SEQ ID NO: 2718648 - RNA, 17 nt, Haemophilus influenzae Rd
augagacuuaaccaaau

SEQ ID NO: 2718649 - RNA, 19 nt, Haemophilus influenzae Rd
augagacuuaaccaaauag

SEQ ID NO: 2718650 - RNA, 13 nt, Haemophilus influenzae Rd
augagcuucaaaa

SEQ ID NO: 2718651 - RNA, 14 nt, Haemophilus influenzae Rd
augagcuuugcuuu

SEQ ID NO: 2718652 - RNA, 21 nt, Haemophilus influenzae Rd
augaggcguuuuucuuaaauu

SEQ ID NO: 2718653 - RNA, 20 nt, Haemophilus influenzae Rd
augaguaaaccgauuaauuc

SEQ ID NO: 2718654 - RNA, 15 nt, Haemophilus influenzae Rd
augaguagauuuuua

SEQ ID NO: 2718655 - RNA, 23 nt, Haemophilus influenzae Rd
augaguagauuuuuauucaauaa

SEQ ID NO: 2718656 - RNA, 14 nt, Haemophilus influenzae Rd
augagucgccugcu

SEQ ID NO: 2718657 - RNA, 16 nt, Haemophilus influenzae Rd
augagucgccugcucu

SEQ ID NO: 2718658 - RNA, 14 nt, Haemophilus influenzae Rd
augauaaaaauaaa

SEQ ID NO: 2718659 - RNA, 15 nt, Haemophilus influenzae Rd
augauaaaaauaaaa

SEQ ID NO: 2718660 - RNA, 20 nt, Haemophilus influenzae Rd
augauaaaaaucaaagagaa

SEQ ID NO: 2718661 - RNA, 15 nt, Haemophilus influenzae Rd
augauaaauucuuac

SEQ ID NO: 2718662 - RNA, 21 nt, Haemophilus influenzae Rd
augauaaauuuuauuccacca

SEQ ID NO: 2718663 - RNA, 22 nt, Haemophilus influenzae Rd
augauaaguuuugucugaaauu

SEQ ID NO: 2718664 - RNA, 23 nt, Haemophilus influenzae Rd
augauaaguuuugucugaaauuu

SEQ ID NO: 2718665 - RNA, 15 nt, Haemophilus influenzae Rd
augauaaucuuccca

SEQ ID NO: 2718666 - RNA, 16 nt, Haemophilus influenzae Rd
augauaaucuucccau

SEQ ID NO: 2718667 - RNA, 13 nt, Haemophilus influenzae Rd
augauaauuucau

SEQ ID NO: 2718668 - RNA, 13 nt, Haemophilus influenzae Rd
augauaauuuuua

SEQ ID NO: 2718669 - RNA, 19 nt, Haemophilus influenzae Rd
augaucaaaucaaauuuuc

SEQ ID NO: 2718670 - RNA, 15 nt, Haemophilus influenzae Rd
augauccaaaaauau

SEQ ID NO: 2718671 - RNA, 22 nt, Haemophilus influenzae Rd
augaucgaguaaaaauaaaaug

SEQ ID NO: 2718672 - RNA, 20 nt, Haemophilus influenzae Rd
augaucuaauggggauuuac

SEQ ID NO: 2718673 - RNA, 11 nt, Haemophilus influenzae Rd
augaucuacac

SEQ ID NO: 2718674 - RNA, 22 nt, Haemophilus influenzae Rd
augaucuacaccgaauaauacu

SEQ ID NO: 2718675 - RNA, 15 nt, Haemophilus influenzae Rd
augaucuucaaucau

SEQ ID NO: 2718676 - RNA, 22 nt, Haemophilus influenzae Rd
augaugaaacaagcuguagcaa

SEQ ID NO: 2718677 - RNA, 14 nt, Haemophilus influenzae Rd
augaugauuguuau

SEQ ID NO: 2718678 - RNA, 14 nt, Haemophilus influenzae Rd
augaugcaggaaag

SEQ ID NO: 2718679 - RNA, 22 nt, Haemophilus influenzae Rd
augaugggaugaaaucaaaaug

SEQ ID NO: 2718680 - RNA, 14 nt, Haemophilus influenzae Rd
augauguaauucug

SEQ ID NO: 2718681 - RNA, 16 nt, Haemophilus influenzae Rd
augauguaggcaaaaa

SEQ ID NO: 2718682 - RNA, 17 nt, Haemophilus influenzae Rd
augaugugcuugauguc

SEQ ID NO: 2718683 - RNA, 13 nt, Haemophilus influenzae Rd
augauuaaaaugg

SEQ ID NO: 2718684 - RNA, 18 nt, Haemophilus influenzae Rd
augauuaacuauucaaau

SEQ ID NO: 2718685 - RNA, 12 nt, Haemophilus influenzae Rd
augauuaaguua

SEQ ID NO: 2718686 - RNA, 16 nt, Haemophilus influenzae Rd
augauuaaguuaaaag

SEQ ID NO: 2718687 - RNA, 22 nt, Haemophilus influenzae Rd
augauuacgcguacgcaauuua

SEQ ID NO: 2718688 - RNA, 23 nt, Haemophilus influenzae Rd
augauuauccacuaaaaaacuaa

SEQ ID NO: 2718689 - RNA, 21 nt, Haemophilus influenzae Rd
augauuaucuagaaaacucau

SEQ ID NO: 2718690 - RNA, 23 nt, Haemophilus influenzae Rd
augauucguggcaauuuuucuaa

SEQ ID NO: 2718691 - RNA, 22 nt, Haemophilus influenzae Rd
augauuggauugggcaacacag

SEQ ID NO: 2718692 - RNA, 21 nt, Haemophilus influenzae Rd
augauuuagaacaauauuuau

SEQ ID NO: 2718693 - RNA, 13 nt, Haemophilus influenzae Rd
augauuucauuuu

SEQ ID NO: 2718694 - RNA, 18 nt, Haemophilus influenzae Rd
augauuucauuuucuaau

SEQ ID NO: 2718695 - RNA, 15 nt, Haemophilus influenzae Rd
augauuugcauaaaa

SEQ ID NO: 2718696 - RNA, 16 nt, Haemophilus influenzae Rd
augauuugcauaaaac

SEQ ID NO: 2718697 - RNA, 15 nt, Haemophilus influenzae Rd
augauuuuaaaauaa

SEQ ID NO: 2718698 - RNA, 16 nt, Haemophilus influenzae Rd
augauuuuaaaauaaa

SEQ ID NO: 2718699 - RNA, 17 nt, Haemophilus influenzae Rd
augauuuuaaaauaaau

SEQ ID NO: 2718700 - RNA, 24 nt, Haemophilus influenzae Rd
augauuuuaaagccauuuugcuca

SEQ ID NO: 2718701 - RNA, 22 nt, Haemophilus influenzae Rd
augcaaaaacaagugguggaau

SEQ ID NO: 2718702 - RNA, 17 nt, Haemophilus influenzae Rd
augcaaaaguaaauaau

SEQ ID NO: 2718703 - RNA, 13 nt, Haemophilus influenzae Rd
augcaaacaagau

SEQ ID NO: 2718704 - RNA, 22 nt, Haemophilus influenzae Rd
augcaaacaagaugucaaaugu

SEQ ID NO: 2718705 - RNA, 20 nt, Haemophilus influenzae Rd
augcaaagguaauugccaau

SEQ ID NO: 2718706 - RNA, 13 nt, Haemophilus influenzae Rd
augcaaauacaag

SEQ ID NO: 2718707 - RNA, 14 nt, Haemophilus influenzae Rd
augcaaccaaacaa

SEQ ID NO: 2718708 - RNA, 16 nt, Haemophilus influenzae Rd
augcaaccaaacaaaa

SEQ ID NO: 2718709 - RNA, 18 nt, Haemophilus influenzae Rd
augcaauuggcaauauua

SEQ ID NO: 2718710 - RNA, 13 nt, Haemophilus influenzae Rd
augcaauuucaau

SEQ ID NO: 2718711 - RNA, 14 nt, Haemophilus influenzae Rd
augcacaacaugcc

SEQ ID NO: 2718712 - RNA, 13 nt, Haemophilus influenzae Rd
augcacauuuuua

SEQ ID NO: 2718713 - RNA, 16 nt, Haemophilus influenzae Rd
augcaccaauaccaau

SEQ ID NO: 2718714 - RNA, 14 nt, Haemophilus influenzae Rd
augcagaaucagaa

SEQ ID NO: 2718715 - RNA, 15 nt, Haemophilus influenzae Rd
augcagaaucagaau

SEQ ID NO: 2718716 - RNA, 16 nt, Haemophilus influenzae Rd
augcagauccuuucac

SEQ ID NO: 2718717 - RNA, 23 nt, Haemophilus influenzae Rd
augcagauuaauuuuuuauaaaa

SEQ ID NO: 2718718 - RNA, 15 nt, Haemophilus influenzae Rd
augcagccaucaaua

SEQ ID NO: 2718719 - RNA, 21 nt, Haemophilus influenzae Rd
augcagccaucaauaaaaagc

SEQ ID NO: 2718720 - RNA, 20 nt, Haemophilus influenzae Rd
augcaguaacgcgauaaauc

SEQ ID NO: 2718721 - RNA, 14 nt, Haemophilus influenzae Rd
augcauagccaagu

SEQ ID NO: 2718722 - RNA, 13 nt, Haemophilus influenzae Rd
augcaucauuaau

SEQ ID NO: 2718723 - RNA, 15 nt, Haemophilus influenzae Rd
augcauucaaauuuc

SEQ ID NO: 2718724 - RNA, 14 nt, Haemophilus influenzae Rd
augcauugaugacu

SEQ ID NO: 2718725 - RNA, 18 nt, Haemophilus influenzae Rd
augcauugaugacugcau

SEQ ID NO: 2718726 - RNA, 20 nt, Haemophilus influenzae Rd
augcauugaugacugcauca

SEQ ID NO: 2718727 - RNA, 18 nt, Haemophilus influenzae Rd
augcauuggcugaauuua

SEQ ID NO: 2718728 - RNA, 19 nt, Haemophilus influenzae Rd
augccaaauaaaauuacaa

SEQ ID NO: 2718729 - RNA, 23 nt, Haemophilus influenzae Rd
augccaaucuaaacacacucuua

SEQ ID NO: 2718730 - RNA, 19 nt, Haemophilus influenzae Rd
augccaaugcuauuaucau

SEQ ID NO: 2718731 - RNA, 22 nt, Haemophilus influenzae Rd
augccaaugcuauuaucauaaa

SEQ ID NO: 2718732 - RNA, 23 nt, Haemophilus influenzae Rd
augccaaugcuauuaucauaaac

SEQ ID NO: 2718733 - RNA, 14 nt, Haemophilus influenzae Rd
augccaauuuuucg

SEQ ID NO: 2718734 - RNA, 19 nt, Haemophilus influenzae Rd
augccacuuggugaucacc

SEQ ID NO: 2718735 - RNA, 15 nt, Haemophilus influenzae Rd
augccaguggggaag

SEQ ID NO: 2718736 - RNA, 21 nt, Haemophilus influenzae Rd
augccaguuaaggauuuuuga

SEQ ID NO: 2718737 - RNA, 13 nt, Haemophilus influenzae Rd
augccaucaccaa

SEQ ID NO: 2718738 - RNA, 19 nt, Haemophilus influenzae Rd
augccaucaccaagaauca

SEQ ID NO: 2718739 - RNA, 17 nt, Haemophilus influenzae Rd
augccaucguggaaugg

SEQ ID NO: 2718740 - RNA, 22 nt, Haemophilus influenzae Rd
augccauuaaacuucuguaaau

SEQ ID NO: 2718741 - RNA, 14 nt, Haemophilus influenzae Rd
augccauucucccu

SEQ ID NO: 2718742 - RNA, 15 nt, Haemophilus influenzae Rd
augccauucucccug

SEQ ID NO: 2718743 - RNA, 19 nt, Haemophilus influenzae Rd
augccauugcgugaauauc

SEQ ID NO: 2718744 - RNA, 22 nt, Haemophilus influenzae Rd
augccauuugcuucgccuucag

SEQ ID NO: 2718745 - RNA, 17 nt, Haemophilus influenzae Rd
augccauuuuuuauaau

SEQ ID NO: 2718746 - RNA, 14 nt, Haemophilus influenzae Rd
augcccaauuaccu

SEQ ID NO: 2718747 - RNA, 15 nt, Haemophilus influenzae Rd
augcccacuuuuccu

SEQ ID NO: 2718748 - RNA, 21 nt, Haemophilus influenzae Rd
augcccucaguauuguuuuau

SEQ ID NO: 2718749 - RNA, 15 nt, Haemophilus influenzae Rd
augccgcaaauacuu

SEQ ID NO: 2718750 - RNA, 20 nt, Haemophilus influenzae Rd
augccgccucagcaauuuuc

SEQ ID NO: 2718751 - RNA, 20 nt, Haemophilus influenzae Rd
augccgccuuuuaauaaauu

SEQ ID NO: 2718752 - RNA, 23 nt, Haemophilus influenzae Rd
augccucaucuuuuggguuaaau

SEQ ID NO: 2718753 - RNA, 16 nt, Haemophilus influenzae Rd
augccucgauauuuau

SEQ ID NO: 2718754 - RNA, 14 nt, Haemophilus influenzae Rd
augccuucuucacu

SEQ ID NO: 2718755 - RNA, 23 nt, Haemophilus influenzae Rd
augccuugugcauaaacaaauug

SEQ ID NO: 2718756 - RNA, 20 nt, Haemophilus influenzae Rd
augccuuuccguucauaaau

SEQ ID NO: 2718757 - RNA, 13 nt, Haemophilus influenzae Rd
augcgaaaauggc

SEQ ID NO: 2718758 - RNA, 15 nt, Haemophilus influenzae Rd
augcgagcaucggua

SEQ ID NO: 2718759 - RNA, 15 nt, Haemophilus influenzae Rd
augcgauccaaaauu

SEQ ID NO: 2718760 - RNA, 19 nt, Haemophilus influenzae Rd
augcgaucuaaaucauuua

SEQ ID NO: 2718761 - RNA, 14 nt, Haemophilus influenzae Rd
augcgauuuccaag

SEQ ID NO: 2718762 - RNA, 15 nt, Haemophilus influenzae Rd
augcgcccuuuaaau

SEQ ID NO: 2718763 - RNA, 15 nt, Haemophilus influenzae Rd
augcggugaaauuuc

SEQ ID NO: 2718764 - RNA, 18 nt, Haemophilus influenzae Rd
augcgugucaaauuaauu

SEQ ID NO: 2718765 - RNA, 23 nt, Haemophilus influenzae Rd
augcguuuucgcaauaucaucau

SEQ ID NO: 2718766 - RNA, 20 nt, Haemophilus influenzae Rd
augcguuuuuaauuuuaugc

SEQ ID NO: 2718767 - RNA, 18 nt, Haemophilus influenzae Rd
augcuaaaauuaaaggca

SEQ ID NO: 2718768 - RNA, 17 nt, Haemophilus influenzae Rd
augcuaaaccaauuucu

SEQ ID NO: 2718769 - RNA, 12 nt, Haemophilus influenzae Rd
augcuaaauaua

SEQ ID NO: 2718770 - RNA, 18 nt, Haemophilus influenzae Rd
augcuaaauuccccaagg

SEQ ID NO: 2718771 - RNA, 20 nt, Haemophilus influenzae Rd
augcuaauaaucuauuucuu

SEQ ID NO: 2718772 - RNA, 21 nt, Haemophilus influenzae Rd
augcuccauugcaauuucagc

SEQ ID NO: 2718773 - RNA, 23 nt, Haemophilus influenzae Rd
augcucuaaauccccugucaauu

SEQ ID NO: 2718774 - RNA, 18 nt, Haemophilus influenzae Rd
augcugagugcaagccac

SEQ ID NO: 2718775 - RNA, 21 nt, Haemophilus influenzae Rd
augcugauuugacagaauuac

SEQ ID NO: 2718776 - RNA, 19 nt, Haemophilus influenzae Rd
augcuggggacgcaccuuu

SEQ ID NO: 2718777 - RNA, 13 nt, Haemophilus influenzae Rd
augcuguagaaau

SEQ ID NO: 2718778 - RNA, 21 nt, Haemophilus influenzae Rd
augcuguuucuaauucggcuu

SEQ ID NO: 2718779 - RNA, 20 nt, Haemophilus influenzae Rd
augcuuaaucggcacaagac

SEQ ID NO: 2718780 - RNA, 15 nt, Haemophilus influenzae Rd
augcuuauaaaacag

SEQ ID NO: 2718781 - RNA, 23 nt, Haemophilus influenzae Rd
augcuucagcguugucaucagaa

SEQ ID NO: 2718782 - RNA, 14 nt, Haemophilus influenzae Rd
augcuucuaauccc

SEQ ID NO: 2718783 - RNA, 19 nt, Haemophilus influenzae Rd
augcuucuucugcaggaaa

SEQ ID NO: 2718784 - RNA, 23 nt, Haemophilus influenzae Rd
augcuugagcugucuaauuuuuu

SEQ ID NO: 2718785 - RNA, 14 nt, Haemophilus influenzae Rd
augcuugguuuuau

SEQ ID NO: 2718786 - RNA, 20 nt, Haemophilus influenzae Rd
augcuugguuuuauauucau

SEQ ID NO: 2718787 - RNA, 23 nt, Haemophilus influenzae Rd
augcuugguuuuauauucauuua

SEQ ID NO: 2718788 - RNA, 14 nt, Haemophilus influenzae Rd
augcuuuaacacca

SEQ ID NO: 2718789 - RNA, 22 nt, Haemophilus influenzae Rd
augcuuuauuuaaauuaaaaag

SEQ ID NO: 2718790 - RNA, 16 nt, Haemophilus influenzae Rd
augcuuuauuuagaau

SEQ ID NO: 2718791 - RNA, 18 nt, Haemophilus influenzae Rd
augcuuuuauaagugaaa

SEQ ID NO: 2718792 - RNA, 22 nt, Haemophilus influenzae Rd
augcuuuuauaagugaaaugcu

SEQ ID NO: 2718793 - RNA, 21 nt, Haemophilus influenzae Rd
augcuuuugccgaaaaugguu

SEQ ID NO: 2718794 - RNA, 16 nt, Haemophilus influenzae Rd
auggaaaaagcaaaac

SEQ ID NO: 2718795 - RNA, 12 nt, Haemophilus influenzae Rd
auggaaauaaau

SEQ ID NO: 2718796 - RNA, 22 nt, Haemophilus influenzae Rd
auggaacaggcuacacccacuu

SEQ ID NO: 2718797 - RNA, 14 nt, Haemophilus influenzae Rd
auggaacguuuuuu

SEQ ID NO: 2718798 - RNA, 13 nt, Haemophilus influenzae Rd
auggaauaaaaac

SEQ ID NO: 2718799 - RNA, 13 nt, Haemophilus influenzae Rd
auggaauaaauuu

SEQ ID NO: 2718800 - RNA, 23 nt, Haemophilus influenzae Rd
auggaauguagauaaugauauua

SEQ ID NO: 2718801 - RNA, 13 nt, Haemophilus influenzae Rd
auggacguguugu

SEQ ID NO: 2718802 - RNA, 18 nt, Haemophilus influenzae Rd
auggaggauuagaaauga

SEQ ID NO: 2718803 - RNA, 14 nt, Haemophilus influenzae Rd
auggauauagaaau

SEQ ID NO: 2718804 - RNA, 18 nt, Haemophilus influenzae Rd
auggauauagaaaucaua

SEQ ID NO: 2718805 - RNA, 22 nt, Haemophilus influenzae Rd
auggaucacccauuaaauaaaa

SEQ ID NO: 2718806 - RNA, 17 nt, Haemophilus influenzae Rd
auggaugaauacaaguc

SEQ ID NO: 2718807 - RNA, 15 nt, Haemophilus influenzae Rd
auggcaacaaauauu

SEQ ID NO: 2718808 - RNA, 19 nt, Haemophilus influenzae Rd
auggcaacaaauauugguu

SEQ ID NO: 2718809 - RNA, 20 nt, Haemophilus influenzae Rd
auggcaacgccaauaaaaag

SEQ ID NO: 2718810 - RNA, 23 nt, Haemophilus influenzae Rd
auggcaagugcaagccccugaag

SEQ ID NO: 2718811 - RNA, 21 nt, Haemophilus influenzae Rd
auggcaguuuggaaagaguaa

SEQ ID NO: 2718812 - RNA, 14 nt, Haemophilus influenzae Rd
auggcaucaauauu

SEQ ID NO: 2718813 - RNA, 14 nt, Haemophilus influenzae Rd
auggcgaauuucac

SEQ ID NO: 2718814 - RNA, 18 nt, Haemophilus influenzae Rd
auggcgacggcaucaaac

SEQ ID NO: 2718815 - RNA, 23 nt, Haemophilus influenzae Rd
auggcgguaaaaaaguaacaagu

SEQ ID NO: 2718816 - RNA, 13 nt, Haemophilus influenzae Rd
auggcgugaaaua

SEQ ID NO: 2718817 - RNA, 22 nt, Haemophilus influenzae Rd
auggcguucacguaauggaaua

SEQ ID NO: 2718818 - RNA, 15 nt, Haemophilus influenzae Rd
auggcuaaauacaac

SEQ ID NO: 2718819 - RNA, 16 nt, Haemophilus influenzae Rd
auggcuauuuaagccu

SEQ ID NO: 2718820 - RNA, 23 nt, Haemophilus influenzae Rd
auggcuauuuaagccuugacgaa

SEQ ID NO: 2718821 - RNA, 16 nt, Haemophilus influenzae Rd
auggcucuaaauuaau

SEQ ID NO: 2718822 - RNA, 18 nt, Haemophilus influenzae Rd
auggcugacuagauaaac

SEQ ID NO: 2718823 - RNA, 19 nt, Haemophilus influenzae Rd
auggcugggauuucaaaca

SEQ ID NO: 2718824 - RNA, 17 nt, Haemophilus influenzae Rd
auggcuuucaauuucac

SEQ ID NO: 2718825 - RNA, 15 nt, Haemophilus influenzae Rd
auggcuuuuuccuga

SEQ ID NO: 2718826 - RNA, 15 nt, Haemophilus influenzae Rd
augggaaacaauaug

SEQ ID NO: 2718827 - RNA, 22 nt, Haemophilus influenzae Rd
augggaucaagauaccaauaau

SEQ ID NO: 2718828 - RNA, 15 nt, Haemophilus influenzae Rd
augggaugaaaucaa

SEQ ID NO: 2718829 - RNA, 15 nt, Haemophilus influenzae Rd
augggccuucaacua

SEQ ID NO: 2718830 - RNA, 18 nt, Haemophilus influenzae Rd
auggggcuuuuuuuuauu

SEQ ID NO: 2718831 - RNA, 17 nt, Haemophilus influenzae Rd
auggguuaguaaguggu

SEQ ID NO: 2718832 - RNA, 22 nt, Haemophilus influenzae Rd
augguaauagaguaccaaaauu

SEQ ID NO: 2718833 - RNA, 13 nt, Haemophilus influenzae Rd
augguauaaaaaa

SEQ ID NO: 2718834 - RNA, 15 nt, Haemophilus influenzae Rd
augguggauaaacga

SEQ ID NO: 2718835 - RNA, 15 nt, Haemophilus influenzae Rd
augguuaauuuuucg

SEQ ID NO: 2718836 - RNA, 23 nt, Haemophilus influenzae Rd
augguuaauuuuucgucaaucau

SEQ ID NO: 2718837 - RNA, 15 nt, Haemophilus influenzae Rd
augguucgauuucau

SEQ ID NO: 2718838 - RNA, 18 nt, Haemophilus influenzae Rd
augguucgauuucaucuu

SEQ ID NO: 2718839 - RNA, 16 nt, Haemophilus influenzae Rd
augguugcaaaggcag

SEQ ID NO: 2718840 - RNA, 15 nt, Haemophilus influenzae Rd
augguugcauuugcu

SEQ ID NO: 2718841 - RNA, 16 nt, Haemophilus influenzae Rd
augguuggaagaaaag

SEQ ID NO: 2718842 - RNA, 20 nt, Haemophilus influenzae Rd
augguuggaagaaaagcauu

SEQ ID NO: 2718843 - RNA, 22 nt, Haemophilus influenzae Rd
augguuggaagaaaagcauuaa

SEQ ID NO: 2718844 - RNA, 20 nt, Haemophilus influenzae Rd
augguuguaaauuuucaaua

SEQ ID NO: 2718845 - RNA, 23 nt, Haemophilus influenzae Rd
augguuuaaauaaccaauauuug

SEQ ID NO: 2718846 - RNA, 17 nt, Haemophilus influenzae Rd
augguuuuccaaaaacc

SEQ ID NO: 2718847 - RNA, 19 nt, Haemophilus influenzae Rd
augguuuuccaaaaaccaa

SEQ ID NO: 2718848 - RNA, 13 nt, Haemophilus influenzae Rd
auguaaaaauaac

SEQ ID NO: 2718849 - RNA, 16 nt, Haemophilus influenzae Rd
auguaaaaauaaccua

SEQ ID NO: 2718850 - RNA, 21 nt, Haemophilus influenzae Rd
auguaaaaauaaccuauaaua

SEQ ID NO: 2718851 - RNA, 15 nt, Haemophilus influenzae Rd
auguaaacaaaaaua

SEQ ID NO: 2718852 - RNA, 21 nt, Haemophilus influenzae Rd
auguaaacaaaaauacagcca

SEQ ID NO: 2718853 - RNA, 16 nt, Haemophilus influenzae Rd
auguaaauaguuauuu

SEQ ID NO: 2718854 - RNA, 22 nt, Haemophilus influenzae Rd
auguaaauaguuauuuauuccu

SEQ ID NO: 2718855 - RNA, 19 nt, Haemophilus influenzae Rd
auguaacuguuuguuuuuu

SEQ ID NO: 2718856 - RNA, 24 nt, Haemophilus influenzae Rd
auguaagagugaaguuauaguaua

SEQ ID NO: 2718857 - RNA, 16 nt, Haemophilus influenzae Rd
auguaauagccauuuu

SEQ ID NO: 2718858 - RNA, 22 nt, Haemophilus influenzae Rd
auguaauagccauuuuggaaug

SEQ ID NO: 2718859 - RNA, 21 nt, Haemophilus influenzae Rd
auguaauauaaguuauuuaua

SEQ ID NO: 2718860 - RNA, 21 nt, Haemophilus influenzae Rd
auguaauccaacgaagaaaca

SEQ ID NO: 2718861 - RNA, 18 nt, Haemophilus influenzae Rd
auguaauucuggcuguuu

SEQ ID NO: 2718862 - RNA, 20 nt, Haemophilus influenzae Rd
auguaauugagcguccacuu

SEQ ID NO: 2718863 - RNA, 13 nt, Haemophilus influenzae Rd
auguaccaaaaug

SEQ ID NO: 2718864 - RNA, 13 nt, Haemophilus influenzae Rd
auguagagauaau

SEQ ID NO: 2718865 - RNA, 18 nt, Haemophilus influenzae Rd
auguagagauaauaaaua

SEQ ID NO: 2718866 - RNA, 20 nt, Haemophilus influenzae Rd
auguagagauaauaaauaua

SEQ ID NO: 2718867 - RNA, 22 nt, Haemophilus influenzae Rd
auguagcaguugcuaaaucacc

SEQ ID NO: 2718868 - RNA, 17 nt, Haemophilus influenzae Rd
auguaggcaaaaacacu

SEQ ID NO: 2718869 - RNA, 20 nt, Haemophilus influenzae Rd
auguaguuucuucuuucaau

SEQ ID NO: 2718870 - RNA, 14 nt, Haemophilus influenzae Rd
auguaucugauuuu

SEQ ID NO: 2718871 - RNA, 19 nt, Haemophilus influenzae Rd
augucaggcgauuuuacgu

SEQ ID NO: 2718872 - RNA, 12 nt, Haemophilus influenzae Rd
augucagguuua

SEQ ID NO: 2718873 - RNA, 22 nt, Haemophilus influenzae Rd
auguccacuuuuggaaacuaug

SEQ ID NO: 2718874 - RNA, 21 nt, Haemophilus influenzae Rd
auguccauaacugucaaaauu

SEQ ID NO: 2718875 - RNA, 22 nt, Haemophilus influenzae Rd
auguccauaacugucaaaauua

SEQ ID NO: 2718876 - RNA, 12 nt, Haemophilus influenzae Rd
augucuuuuucu

SEQ ID NO: 2718877 - RNA, 22 nt, Haemophilus influenzae Rd
augugacagacgcugcccaaau

SEQ ID NO: 2718878 - RNA, 15 nt, Haemophilus influenzae Rd
augugacauuguaaa

SEQ ID NO: 2718879 - RNA, 15 nt, Haemophilus influenzae Rd
augugaccaaauaau

SEQ ID NO: 2718880 - RNA, 16 nt, Haemophilus influenzae Rd
augugaccaaauaauc

SEQ ID NO: 2718881 - RNA, 13 nt, Haemophilus influenzae Rd
augugauauuaaa

SEQ ID NO: 2718882 - RNA, 22 nt, Haemophilus influenzae Rd
augugauguaauauuacgcaua

SEQ ID NO: 2718883 - RNA, 17 nt, Haemophilus influenzae Rd
augugcaaucagcaaca

SEQ ID NO: 2718884 - RNA, 20 nt, Haemophilus influenzae Rd
augugcaaucagcaacauua

SEQ ID NO: 2718885 - RNA, 11 nt, Haemophilus influenzae Rd
augugcaccuu

SEQ ID NO: 2718886 - RNA, 17 nt, Haemophilus influenzae Rd
augugcaccuucaacau

SEQ ID NO: 2718887 - RNA, 18 nt, Haemophilus influenzae Rd
augugcauugaauuuuuc

SEQ ID NO: 2718888 - RNA, 20 nt, Haemophilus influenzae Rd
auguggcguacaacgugaag

SEQ ID NO: 2718889 - RNA, 18 nt, Haemophilus influenzae Rd
auguggucaaagauguuc

SEQ ID NO: 2718890 - RNA, 14 nt, Haemophilus influenzae Rd
auguguuaaauaac

SEQ ID NO: 2718891 - RNA, 13 nt, Haemophilus influenzae Rd
auguuaaguucau

SEQ ID NO: 2718892 - RNA, 13 nt, Haemophilus influenzae Rd
auguuaauugugc

SEQ ID NO: 2718893 - RNA, 15 nt, Haemophilus influenzae Rd
auguuaauuuuaaau

SEQ ID NO: 2718894 - RNA, 16 nt, Haemophilus influenzae Rd
auguucacguguuaaa

SEQ ID NO: 2718895 - RNA, 23 nt, Haemophilus influenzae Rd
auguucagccacuucuucaaaga

SEQ ID NO: 2718896 - RNA, 13 nt, Haemophilus influenzae Rd
auguucauuuucu

SEQ ID NO: 2718897 - RNA, 15 nt, Haemophilus influenzae Rd
auguucauuuucuug

SEQ ID NO: 2718898 - RNA, 16 nt, Haemophilus influenzae Rd
auguucccuauaaaua

SEQ ID NO: 2718899 - RNA, 16 nt, Haemophilus influenzae Rd
auguucgauuuuacuu

SEQ ID NO: 2718900 - RNA, 19 nt, Haemophilus influenzae Rd
auguucuaagguauaaaua

SEQ ID NO: 2718901 - RNA, 12 nt, Haemophilus influenzae Rd
auguucucucac

SEQ ID NO: 2718902 - RNA, 14 nt, Haemophilus influenzae Rd
auguugaauuuuca

SEQ ID NO: 2718903 - RNA, 17 nt, Haemophilus influenzae Rd
auguuggaaauuuaagu

SEQ ID NO: 2718904 - RNA, 14 nt, Haemophilus influenzae Rd
auguuguaaaaucu

SEQ ID NO: 2718905 - RNA, 16 nt, Haemophilus influenzae Rd
auguuguccaucaauc

SEQ ID NO: 2718906 - RNA, 19 nt, Haemophilus influenzae Rd
auguuuaaaguaagaauua

SEQ ID NO: 2718907 - RNA, 14 nt, Haemophilus influenzae Rd
auguuuaauccaaa

SEQ ID NO: 2718908 - RNA, 15 nt, Haemophilus influenzae Rd
auguuuaauuauaga

SEQ ID NO: 2718909 - RNA, 17 nt, Haemophilus influenzae Rd
auguuuaauuauagaaa

SEQ ID NO: 2718910 - RNA, 23 nt, Haemophilus influenzae Rd
auguuuaauuauagaaaagacaa

SEQ ID NO: 2718911 - RNA, 22 nt, Haemophilus influenzae Rd
auguuuaccaccgauaaacacu

SEQ ID NO: 2718912 - RNA, 20 nt, Haemophilus influenzae Rd
auguuuaccgcaaaauuauu

SEQ ID NO: 2718913 - RNA, 22 nt, Haemophilus influenzae Rd
auguuuaccgcaaaauuauuug

SEQ ID NO: 2718914 - RNA, 17 nt, Haemophilus influenzae Rd
auguuuacuuaaaucuu

SEQ ID NO: 2718915 - RNA, 22 nt, Haemophilus influenzae Rd
auguuuacuuaaaucuuuaccu

SEQ ID NO: 2718916 - RNA, 19 nt, Haemophilus influenzae Rd
auguuucucucuauucauc

SEQ ID NO: 2718917 - RNA, 22 nt, Haemophilus influenzae Rd
auguuucucucuauucaucuaa

SEQ ID NO: 2718918 - RNA, 20 nt, Haemophilus influenzae Rd
auguuugaaaauucuucuaa

SEQ ID NO: 2718919 - RNA, 16 nt, Haemophilus influenzae Rd
auguuugaaggcaaaa

SEQ ID NO: 2718920 - RNA, 19 nt, Haemophilus influenzae Rd
auguuugaggaucacacaa

SEQ ID NO: 2718921 - RNA, 15 nt, Haemophilus influenzae Rd
auguuugcaucaauc

SEQ ID NO: 2718922 - RNA, 13 nt, Haemophilus influenzae Rd
auguuuggauaau

SEQ ID NO: 2718923 - RNA, 20 nt, Haemophilus influenzae Rd
auguuugugcguuuuuuaau

SEQ ID NO: 2718924 - RNA, 16 nt, Haemophilus influenzae Rd
auguuuuaaagaauau

SEQ ID NO: 2718925 - RNA, 12 nt, Haemophilus influenzae Rd
auguuuucagcu

SEQ ID NO: 2718926 - RNA, 13 nt, Haemophilus influenzae Rd
auguuuuucauuc

SEQ ID NO: 2718927 - RNA, 19 nt, Haemophilus influenzae Rd
auguuuuugaaguaaaaaa

SEQ ID NO: 2718928 - RNA, 15 nt, Haemophilus influenzae Rd
auguuuuuuccauuu

SEQ ID NO: 2718929 - RNA, 14 nt, Haemophilus influenzae Rd
auuaaaaaaagcaa

SEQ ID NO: 2718930 - RNA, 17 nt, Haemophilus influenzae Rd
auuaaaaaaagcaauau

SEQ ID NO: 2718931 - RNA, 15 nt, Haemophilus influenzae Rd
auuaaaaaaauaguu

SEQ ID NO: 2718932 - RNA, 13 nt, Haemophilus influenzae Rd
auuaaaaaagcaa

SEQ ID NO: 2718933 - RNA, 13 nt, Haemophilus influenzae Rd
auuaaaaaauaau

SEQ ID NO: 2718934 - RNA, 13 nt, Haemophilus influenzae Rd
auuaaaaacuaaa

SEQ ID NO: 2718935 - RNA, 20 nt, Haemophilus influenzae Rd
auuaaaaagacuaaacucaa

SEQ ID NO: 2718936 - RNA, 12 nt, Haemophilus influenzae Rd
auuaaaaauaaa

SEQ ID NO: 2718937 - RNA, 19 nt, Haemophilus influenzae Rd
auuaaaaccaauuuuuuca

SEQ ID NO: 2718938 - RNA, 21 nt, Haemophilus influenzae Rd
auuaaaacccgaaccgauuuu

SEQ ID NO: 2718939 - RNA, 22 nt, Haemophilus influenzae Rd
auuaaaaggacuaaguucggua

SEQ ID NO: 2718940 - RNA, 23 nt, Haemophilus influenzae Rd
auuaaaagguggaauuuuaguuu

SEQ ID NO: 2718941 - RNA, 19 nt, Haemophilus influenzae Rd
auuaaaagucuguuuaaaa

SEQ ID NO: 2718942 - RNA, 12 nt, Haemophilus influenzae Rd
auuaaaagugcg

SEQ ID NO: 2718943 - RNA, 22 nt, Haemophilus influenzae Rd
auuaaaagugcggugauuuuuu

SEQ ID NO: 2718944 - RNA, 17 nt, Haemophilus influenzae Rd
auuaaaagugcgguuaa

SEQ ID NO: 2718945 - RNA, 14 nt, Haemophilus influenzae Rd
auuaaaauauuuuu

SEQ ID NO: 2718946 - RNA, 22 nt, Haemophilus influenzae Rd
auuaaaaucacauaaaaaauga

SEQ ID NO: 2718947 - RNA, 13 nt, Haemophilus influenzae Rd
auuaaaaugguuu

SEQ ID NO: 2718948 - RNA, 12 nt, Haemophilus influenzae Rd
auuaaacaaaaa

SEQ ID NO: 2718949 - RNA, 17 nt, Haemophilus influenzae Rd
auuaaacaaaaaccauc

SEQ ID NO: 2718950 - RNA, 13 nt, Haemophilus influenzae Rd
auuaaacagccaa

SEQ ID NO: 2718951 - RNA, 18 nt, Haemophilus influenzae Rd
auuaaacagccaaacaaa

SEQ ID NO: 2718952 - RNA, 22 nt, Haemophilus influenzae Rd
auuaaacagccaaacaaauuag

SEQ ID NO: 2718953 - RNA, 20 nt, Haemophilus influenzae Rd
auuaaacuggaugaaaucau

SEQ ID NO: 2718954 - RNA, 21 nt, Haemophilus influenzae Rd
auuaaacuggaugaaaucauu

SEQ ID NO: 2718955 - RNA, 12 nt, Haemophilus influenzae Rd
auuaaagccaca

SEQ ID NO: 2718956 - RNA, 19 nt, Haemophilus influenzae Rd
auuaaagcguuguucaucu

SEQ ID NO: 2718957 - RNA, 12 nt, Haemophilus influenzae Rd
auuaaagucaga

SEQ ID NO: 2718958 - RNA, 14 nt, Haemophilus influenzae Rd
auuaaagucccaaa

SEQ ID NO: 2718959 - RNA, 18 nt, Haemophilus influenzae Rd
auuaaagucccaaaagca

SEQ ID NO: 2718960 - RNA, 23 nt, Haemophilus influenzae Rd
auuaaagugcgguaaauuuuuuu

SEQ ID NO: 2718961 - RNA, 16 nt, Haemophilus influenzae Rd
auuaaauaaaaaugau

SEQ ID NO: 2718962 - RNA, 12 nt, Haemophilus influenzae Rd
auuaaauaacuc

SEQ ID NO: 2718963 - RNA, 13 nt, Haemophilus influenzae Rd
auuaaauaacuca

SEQ ID NO: 2718964 - RNA, 20 nt, Haemophilus influenzae Rd
auuaaauagcgaucugcacu

SEQ ID NO: 2718965 - RNA, 18 nt, Haemophilus influenzae Rd
auuaaauauaaugaaaac

SEQ ID NO: 2718966 - RNA, 20 nt, Haemophilus influenzae Rd
auuaaauauaaugaauuaug

SEQ ID NO: 2718967 - RNA, 21 nt, Haemophilus influenzae Rd
auuaaauauaggguaaauaaa

SEQ ID NO: 2718968 - RNA, 16 nt, Haemophilus influenzae Rd
auuaaauaugauaaau

SEQ ID NO: 2718969 - RNA, 15 nt, Haemophilus influenzae Rd
auuaaaucaaauuua

SEQ ID NO: 2718970 - RNA, 14 nt, Haemophilus influenzae Rd
auuaaaucacccgc

SEQ ID NO: 2718971 - RNA, 20 nt, Haemophilus influenzae Rd
auuaaauucaucagaaagug

SEQ ID NO: 2718972 - RNA, 17 nt, Haemophilus influenzae Rd
auuaaauucauuuaaaa

SEQ ID NO: 2718973 - RNA, 14 nt, Haemophilus influenzae Rd
auuaaauugaaaaa

SEQ ID NO: 2718974 - RNA, 16 nt, Haemophilus influenzae Rd
auuaaauugaaaaaau

SEQ ID NO: 2718975 - RNA, 23 nt, Haemophilus influenzae Rd
auuaacaauaaugugagaauaac

SEQ ID NO: 2718976 - RNA, 23 nt, Haemophilus influenzae Rd
auuaacaauauucgcuucuuuua

SEQ ID NO: 2718977 - RNA, 21 nt, Haemophilus influenzae Rd
auuaacaaugcggagaaaagc

SEQ ID NO: 2718978 - RNA, 15 nt, Haemophilus influenzae Rd
auuaaccaacauaaa

SEQ ID NO: 2718979 - RNA, 19 nt, Haemophilus influenzae Rd
auuaaccgcacuuuaaaua

SEQ ID NO: 2718980 - RNA, 17 nt, Haemophilus influenzae Rd
auuaaccgcacuuuaga

SEQ ID NO: 2718981 - RNA, 18 nt, Haemophilus influenzae Rd
auuaaccgcacuuuagaa

SEQ ID NO: 2718982 - RNA, 22 nt, Haemophilus influenzae Rd
auuaaccguuuuuauuuguucu

SEQ ID NO: 2718983 - RNA, 19 nt, Haemophilus influenzae Rd
auuaacggcacgguuucug

SEQ ID NO: 2718984 - RNA, 18 nt, Haemophilus influenzae Rd
auuaacgggcuuaaacuu

SEQ ID NO: 2718985 - RNA, 15 nt, Haemophilus influenzae Rd
auuaacgguuuucga

SEQ ID NO: 2718986 - RNA, 15 nt, Haemophilus influenzae Rd
auuaacuaaaccauu

SEQ ID NO: 2718987 - RNA, 16 nt, Haemophilus influenzae Rd
auuaacuaaaccauuu

SEQ ID NO: 2718988 - RNA, 19 nt, Haemophilus influenzae Rd
auuaacuauuuuuuauuua

SEQ ID NO: 2718989 - RNA, 19 nt, Haemophilus influenzae Rd
auuaacuuaucuaaaaaga

SEQ ID NO: 2718990 - RNA, 22 nt, Haemophilus influenzae Rd
auuaacuugcuauuuucuaauu

SEQ ID NO: 2718991 - RNA, 23 nt, Haemophilus influenzae Rd
auuaacuugcuauuuucuaauuu

SEQ ID NO: 2718992 - RNA, 14 nt, Haemophilus influenzae Rd
auuaagaaaauaau

SEQ ID NO: 2718993 - RNA, 17 nt, Haemophilus influenzae Rd
auuaagaaagguugguu

SEQ ID NO: 2718994 - RNA, 17 nt, Haemophilus influenzae Rd
auuaagaaauuuucuuu

SEQ ID NO: 2718995 - RNA, 14 nt, Haemophilus influenzae Rd
auuaagaaguuauu

SEQ ID NO: 2718996 - RNA, 11 nt, Haemophilus influenzae Rd
auuaagcaaua

SEQ ID NO: 2718997 - RNA, 12 nt, Haemophilus influenzae Rd
auuaagcaauag

SEQ ID NO: 2718998 - RNA, 15 nt, Haemophilus influenzae Rd
auuaagcaauagaac

SEQ ID NO: 2718999 - RNA, 17 nt, Haemophilus influenzae Rd
auuaagcacaggcguaa

SEQ ID NO: 2719000 - RNA, 13 nt, Haemophilus influenzae Rd
auuaagcagcgaa

SEQ ID NO: 2719001 - RNA, 19 nt, Haemophilus influenzae Rd
auuaagccaaaaccuagaa

SEQ ID NO: 2719002 - RNA, 15 nt, Haemophilus influenzae Rd
auuaagcgugcuuug

SEQ ID NO: 2719003 - RNA, 18 nt, Haemophilus influenzae Rd
auuaaggacuaaacuuuu

SEQ ID NO: 2719004 - RNA, 17 nt, Haemophilus influenzae Rd
auuaaggcauuuuccca

SEQ ID NO: 2719005 - RNA, 15 nt, Haemophilus influenzae Rd
auuaaggcuuuucuu

SEQ ID NO: 2719006 - RNA, 19 nt, Haemophilus influenzae Rd
auuaagguuggaauagccg

SEQ ID NO: 2719007 - RNA, 18 nt, Haemophilus influenzae Rd
auuaaguagauaacaaaa

SEQ ID NO: 2719008 - RNA, 16 nt, Haemophilus influenzae Rd
auuaaguauaacuaau

SEQ ID NO: 2719009 - RNA, 14 nt, Haemophilus influenzae Rd
auuaaguauauugc

SEQ ID NO: 2719010 - RNA, 20 nt, Haemophilus influenzae Rd
auuaagucgauaaagaaugc

SEQ ID NO: 2719011 - RNA, 21 nt, Haemophilus influenzae Rd
auuaagugcgguccguuuuca

SEQ ID NO: 2719012 - RNA, 22 nt, Haemophilus influenzae Rd
auuaagugcguguauauauuuu

SEQ ID NO: 2719013 - RNA, 15 nt, Haemophilus influenzae Rd
auuaaguuaaaagug

SEQ ID NO: 2719014 - RNA, 17 nt, Haemophilus influenzae Rd
auuaaguucaaauuucu

SEQ ID NO: 2719015 - RNA, 13 nt, Haemophilus influenzae Rd
auuaauaaaaaau

SEQ ID NO: 2719016 - RNA, 19 nt, Haemophilus influenzae Rd
auuaauaaaaaaucuguga

SEQ ID NO: 2719017 - RNA, 18 nt, Haemophilus influenzae Rd
auuaauaagaaaaucaaa

SEQ ID NO: 2719018 - RNA, 20 nt, Haemophilus influenzae Rd
auuaauaagaaaaucaaaga

SEQ ID NO: 2719019 - RNA, 16 nt, Haemophilus influenzae Rd
auuaauaagaaagaau

SEQ ID NO: 2719020 - RNA, 19 nt, Haemophilus influenzae Rd
auuaauaagaaagaaucga

SEQ ID NO: 2719021 - RNA, 12 nt, Haemophilus influenzae Rd
auuaauaagccc

SEQ ID NO: 2719022 - RNA, 16 nt, Haemophilus influenzae Rd
auuaauaccaauaaua

SEQ ID NO: 2719023 - RNA, 17 nt, Haemophilus influenzae Rd
auuaauaccaauaauaa

SEQ ID NO: 2719024 - RNA, 17 nt, Haemophilus influenzae Rd
auuaauacgccaagaua

SEQ ID NO: 2719025 - RNA, 17 nt, Haemophilus influenzae Rd
auuaauacgcucuugua

SEQ ID NO: 2719026 - RNA, 18 nt, Haemophilus influenzae Rd
auuaauacgucaauugcu

SEQ ID NO: 2719027 - RNA, 15 nt, Haemophilus influenzae Rd
auuaauagauaagaa

SEQ ID NO: 2719028 - RNA, 20 nt, Haemophilus influenzae Rd
auuaauauaaaggauuuuau

SEQ ID NO: 2719029 - RNA, 21 nt, Haemophilus influenzae Rd
auuaauauaccccaaacuaua

SEQ ID NO: 2719030 - RNA, 16 nt, Haemophilus influenzae Rd
auuaauaucuuuaaca

SEQ ID NO: 2719031 - RNA, 13 nt, Haemophilus influenzae Rd
auuaaucaauuug

SEQ ID NO: 2719032 - RNA, 14 nt, Haemophilus influenzae Rd
auuaaucaccauau

SEQ ID NO: 2719033 - RNA, 21 nt, Haemophilus influenzae Rd
auuaaucaccauaucaauuuc

SEQ ID NO: 2719034 - RNA, 22 nt, Haemophilus influenzae Rd
auuaaucaccauaucaauuuca

SEQ ID NO: 2719035 - RNA, 16 nt, Haemophilus influenzae Rd
auuaaucauaaaaaug

SEQ ID NO: 2719036 - RNA, 15 nt, Haemophilus influenzae Rd
auuaaucgaucaauu

SEQ ID NO: 2719037 - RNA, 16 nt, Haemophilus influenzae Rd
auuaaucgaucaauuu

SEQ ID NO: 2719038 - RNA, 17 nt, Haemophilus influenzae Rd
auuaaucgaucaauuug

SEQ ID NO: 2719039 - RNA, 16 nt, Haemophilus influenzae Rd
auuaaucgcaauaaca

SEQ ID NO: 2719040 - RNA, 21 nt, Haemophilus influenzae Rd
auuaaucggcaauguuuuaag

SEQ ID NO: 2719041 - RNA, 22 nt, Haemophilus influenzae Rd
auuaaucggcaauguuuuaagu

SEQ ID NO: 2719042 - RNA, 22 nt, Haemophilus influenzae Rd
auuaaucugcaccuuaaaggcu

SEQ ID NO: 2719043 - RNA, 13 nt, Haemophilus influenzae Rd
auuaaucugcauu

SEQ ID NO: 2719044 - RNA, 16 nt, Haemophilus influenzae Rd
auuaaucugcauucua

SEQ ID NO: 2719045 - RNA, 22 nt, Haemophilus influenzae Rd
auuaaucugcauucuaaaaguu

SEQ ID NO: 2719046 - RNA, 23 nt, Haemophilus influenzae Rd
auuaaucugcauucuaaaaguuu

SEQ ID NO: 2719047 - RNA, 23 nt, Haemophilus influenzae Rd
auuaaucuuuuuucuugcuaaaa

SEQ ID NO: 2719048 - RNA, 17 nt, Haemophilus influenzae Rd
auuaaugacaccuuuaa

SEQ ID NO: 2719049 - RNA, 20 nt, Haemophilus influenzae Rd
auuaaugcauugauugcuaa

SEQ ID NO: 2719050 - RNA, 12 nt, Haemophilus influenzae Rd
auuaaugccaau

SEQ ID NO: 2719051 - RNA, 22 nt, Haemophilus influenzae Rd
auuaaugcggugcuuuaaguaa

SEQ ID NO: 2719052 - RNA, 19 nt, Haemophilus influenzae Rd
auuaauggcucgauuaaac

SEQ ID NO: 2719053 - RNA, 19 nt, Haemophilus influenzae Rd
auuaaugggaucaagauac

SEQ ID NO: 2719054 - RNA, 20 nt, Haemophilus influenzae Rd
auuaauggguaaucaauauu

SEQ ID NO: 2719055 - RNA, 16 nt, Haemophilus influenzae Rd
auuaaugguauuguga

SEQ ID NO: 2719056 - RNA, 18 nt, Haemophilus influenzae Rd
auuaauguaguaaauccc

SEQ ID NO: 2719057 - RNA, 17 nt, Haemophilus influenzae Rd
auuaauguuauuaaaua

SEQ ID NO: 2719058 - RNA, 21 nt, Haemophilus influenzae Rd
auuaauuaacgcucaaaaauu

SEQ ID NO: 2719059 - RNA, 20 nt, Haemophilus influenzae Rd
auuaauuaccugccaaacca

SEQ ID NO: 2719060 - RNA, 13 nt, Haemophilus influenzae Rd
auuaauuacuuuu

SEQ ID NO: 2719061 - RNA, 21 nt, Haemophilus influenzae Rd
auuaauuacuuuuauaucuau

SEQ ID NO: 2719062 - RNA, 14 nt, Haemophilus influenzae Rd
auuaauuauauuuu

SEQ ID NO: 2719063 - RNA, 22 nt, Haemophilus influenzae Rd
auuaauucucccucaacccaua

SEQ ID NO: 2719064 - RNA, 16 nt, Haemophilus influenzae Rd
auuaauucuuuugcua

SEQ ID NO: 2719065 - RNA, 22 nt, Haemophilus influenzae Rd
auuaauuggcgcaacaucaaac

SEQ ID NO: 2719066 - RNA, 14 nt, Haemophilus influenzae Rd
auuaauuuaauucu

SEQ ID NO: 2719067 - RNA, 17 nt, Haemophilus influenzae Rd
auuaauuuaauucuaaa

SEQ ID NO: 2719068 - RNA, 12 nt, Haemophilus influenzae Rd
auuaauuugcug

SEQ ID NO: 2719069 - RNA, 14 nt, Haemophilus influenzae Rd
auuaauuugcugaa

SEQ ID NO: 2719070 - RNA, 17 nt, Haemophilus influenzae Rd
auuaauuugcugaaaua

SEQ ID NO: 2719071 - RNA, 18 nt, Haemophilus influenzae Rd
auuaauuugcugaaauau

SEQ ID NO: 2719072 - RNA, 21 nt, Haemophilus influenzae Rd
auuaauuuuaaauugagauaa

SEQ ID NO: 2719073 - RNA, 19 nt, Haemophilus influenzae Rd
auuaauuuuuuauaaaauu

SEQ ID NO: 2719074 - RNA, 18 nt, Haemophilus influenzae Rd
auuacaauuuaagaucuu

SEQ ID NO: 2719075 - RNA, 15 nt, Haemophilus influenzae Rd
auuacacaaaauauu

SEQ ID NO: 2719076 - RNA, 16 nt, Haemophilus influenzae Rd
auuacacagaugccau

SEQ ID NO: 2719077 - RNA, 15 nt, Haemophilus influenzae Rd
auuacagaaucauuu

SEQ ID NO: 2719078 - RNA, 17 nt, Haemophilus influenzae Rd
auuacagaaucauuuuc

SEQ ID NO: 2719079 - RNA, 17 nt, Haemophilus influenzae Rd
auuacagagccuagucc

SEQ ID NO: 2719080 - RNA, 17 nt, Haemophilus influenzae Rd
auuacaguacaauuaau

SEQ ID NO: 2719081 - RNA, 23 nt, Haemophilus influenzae Rd
auuacagugcgguuauuuaguuu

SEQ ID NO: 2719082 - RNA, 15 nt, Haemophilus influenzae Rd
auuacauaaaaccaa

SEQ ID NO: 2719083 - RNA, 14 nt, Haemophilus influenzae Rd
auuacauccacuuu

SEQ ID NO: 2719084 - RNA, 15 nt, Haemophilus influenzae Rd
auuacauccacuuuu

SEQ ID NO: 2719085 - RNA, 19 nt, Haemophilus influenzae Rd
auuacaucuaaugccgcaa

SEQ ID NO: 2719086 - RNA, 15 nt, Haemophilus influenzae Rd
auuacauucccaaau

SEQ ID NO: 2719087 - RNA, 15 nt, Haemophilus influenzae Rd
auuaccacaugcauu

SEQ ID NO: 2719088 - RNA, 19 nt, Haemophilus influenzae Rd
auuaccacccaaaauuuca

SEQ ID NO: 2719089 - RNA, 17 nt, Haemophilus influenzae Rd
auuaccacgaguauauu

SEQ ID NO: 2719090 - RNA, 17 nt, Haemophilus influenzae Rd
auuaccacugcauuuuc

SEQ ID NO: 2719091 - RNA, 19 nt, Haemophilus influenzae Rd
auuaccacugcauuuucuc

SEQ ID NO: 2719092 - RNA, 19 nt, Haemophilus influenzae Rd
auuacccguaccuuuaaau

SEQ ID NO: 2719093 - RNA, 20 nt, Haemophilus influenzae Rd
auuacccguaccuuuaaauu

SEQ ID NO: 2719094 - RNA, 23 nt, Haemophilus influenzae Rd
auuacccguuugaaguacauuca

SEQ ID NO: 2719095 - RNA, 22 nt, Haemophilus influenzae Rd
auuaccgcacuuuagguuuuau

SEQ ID NO: 2719096 - RNA, 17 nt, Haemophilus influenzae Rd
auuaccgcacuuuuuau

SEQ ID NO: 2719097 - RNA, 16 nt, Haemophilus influenzae Rd
auuaccgcguaaaaau

SEQ ID NO: 2719098 - RNA, 17 nt, Haemophilus influenzae Rd
auuaccgcguaaaaauu

SEQ ID NO: 2719099 - RNA, 15 nt, Haemophilus influenzae Rd
auuaccgcucuuuuc

SEQ ID NO: 2719100 - RNA, 15 nt, Haemophilus influenzae Rd
auuaccguguuuuuc

SEQ ID NO: 2719101 - RNA, 13 nt, Haemophilus influenzae Rd
auuaccuaaccaa

SEQ ID NO: 2719102 - RNA, 17 nt, Haemophilus influenzae Rd
auuaccugccaaaccau

SEQ ID NO: 2719103 - RNA, 17 nt, Haemophilus influenzae Rd
auuaccugugaaaacac

SEQ ID NO: 2719104 - RNA, 23 nt, Haemophilus influenzae Rd
auuaccuuagccaaaucaucuag

SEQ ID NO: 2719105 - RNA, 17 nt, Haemophilus influenzae Rd
auuaccuuguuuugcaa

SEQ ID NO: 2719106 - RNA, 21 nt, Haemophilus influenzae Rd
auuaccuuguuuugcaauaaa

SEQ ID NO: 2719107 - RNA, 18 nt, Haemophilus influenzae Rd
auuacgaccuuuacuuuu

SEQ ID NO: 2719108 - RNA, 23 nt, Haemophilus influenzae Rd
auuacgcaacgcuuguuugacug

SEQ ID NO: 2719109 - RNA, 16 nt, Haemophilus influenzae Rd
auuacgcauaucacga

SEQ ID NO: 2719110 - RNA, 21 nt, Haemophilus influenzae Rd
auuacgccuaaccaagccaaa

SEQ ID NO: 2719111 - RNA, 12 nt, Haemophilus influenzae Rd
auuacgcugucc

SEQ ID NO: 2719112 - RNA, 19 nt, Haemophilus influenzae Rd
auuacggccuuuacuaaag

SEQ ID NO: 2719113 - RNA, 15 nt, Haemophilus influenzae Rd
auuacgguuugcgcc

SEQ ID NO: 2719114 - RNA, 17 nt, Haemophilus influenzae Rd
auuacguagaaaacaau

SEQ ID NO: 2719115 - RNA, 15 nt, Haemophilus influenzae Rd
auuacgugcaaauaa

SEQ ID NO: 2719116 - RNA, 23 nt, Haemophilus influenzae Rd
auuacguguaguuggaucauuau

SEQ ID NO: 2719117 - RNA, 16 nt, Haemophilus influenzae Rd
auuacguguuugguuu

SEQ ID NO: 2719118 - RNA, 17 nt, Haemophilus influenzae Rd
auuacucugcuugaguu

SEQ ID NO: 2719119 - RNA, 23 nt, Haemophilus influenzae Rd
auuacucuuaauuuuugauuuaa

SEQ ID NO: 2719120 - RNA, 18 nt, Haemophilus influenzae Rd
auuacugucgaaccaagu

SEQ ID NO: 2719121 - RNA, 14 nt, Haemophilus influenzae Rd
auuacuuagauaua

SEQ ID NO: 2719122 - RNA, 21 nt, Haemophilus influenzae Rd
auuacuuggggcuaauuuuua

SEQ ID NO: 2719123 - RNA, 12 nt, Haemophilus influenzae Rd
auuagaaaugau

SEQ ID NO: 2719124 - RNA, 17 nt, Haemophilus influenzae Rd
auuagaaucaauggcuu

SEQ ID NO: 2719125 - RNA, 23 nt, Haemophilus influenzae Rd
auuagaauuuaguccuuuagaaa

SEQ ID NO: 2719126 - RNA, 13 nt, Haemophilus influenzae Rd
auuagacuuaauu

SEQ ID NO: 2719127 - RNA, 17 nt, Haemophilus influenzae Rd
auuagacuuaauuucac

SEQ ID NO: 2719128 - RNA, 20 nt, Haemophilus influenzae Rd
auuagacuuaauuucacauu

SEQ ID NO: 2719129 - RNA, 14 nt, Haemophilus influenzae Rd
auuagagacaaaca

SEQ ID NO: 2719130 - RNA, 14 nt, Haemophilus influenzae Rd
auuagagccaucaa

SEQ ID NO: 2719131 - RNA, 23 nt, Haemophilus influenzae Rd
auuagagccaucacguucaaaaa

SEQ ID NO: 2719132 - RNA, 20 nt, Haemophilus influenzae Rd
auuagauaauacagaaauau

SEQ ID NO: 2719133 - RNA, 16 nt, Haemophilus influenzae Rd
auuagaucauaaaaaa

SEQ ID NO: 2719134 - RNA, 20 nt, Haemophilus influenzae Rd
auuagaugacuggcaaaaau

SEQ ID NO: 2719135 - RNA, 15 nt, Haemophilus influenzae Rd
auuagaugauuuuaa

SEQ ID NO: 2719136 - RNA, 17 nt, Haemophilus influenzae Rd
auuagaugauuuuaaaa

SEQ ID NO: 2719137 - RNA, 20 nt, Haemophilus influenzae Rd
auuagcaaagaauuaaaaua

SEQ ID NO: 2719138 - RNA, 15 nt, Haemophilus influenzae Rd
auuagcauaaaauua

SEQ ID NO: 2719139 - RNA, 14 nt, Haemophilus influenzae Rd
auuagcauccacac

SEQ ID NO: 2719140 - RNA, 21 nt, Haemophilus influenzae Rd
auuagcgaaaauuuugccaau

SEQ ID NO: 2719141 - RNA, 14 nt, Haemophilus influenzae Rd
auuagcuaaauacu

SEQ ID NO: 2719142 - RNA, 23 nt, Haemophilus influenzae Rd
auuagcuucaagcugcauuucaa

SEQ ID NO: 2719143 - RNA, 19 nt, Haemophilus influenzae Rd
auuaggcgacgcugcaaaa

SEQ ID NO: 2719144 - RNA, 18 nt, Haemophilus influenzae Rd
auuagggauagcaucaca

SEQ ID NO: 2719145 - RNA, 17 nt, Haemophilus influenzae Rd
auuagguaaauuugguu

SEQ ID NO: 2719146 - RNA, 14 nt, Haemophilus influenzae Rd
auuaguaaaauaau

SEQ ID NO: 2719147 - RNA, 20 nt, Haemophilus influenzae Rd
auuaguaagugcuuugagug

SEQ ID NO: 2719148 - RNA, 18 nt, Haemophilus influenzae Rd
auuaguaguuagaauuuu

SEQ ID NO: 2719149 - RNA, 24 nt, Haemophilus influenzae Rd
auuaguauaaacaucagugauuuu

SEQ ID NO: 2719150 - RNA, 17 nt, Haemophilus influenzae Rd
auuagugaaugaugcca

SEQ ID NO: 2719151 - RNA, 20 nt, Haemophilus influenzae Rd
auuagugaaugaugccauuu

SEQ ID NO: 2719152 - RNA, 15 nt, Haemophilus influenzae Rd
auuagugaugauggu

SEQ ID NO: 2719153 - RNA, 14 nt, Haemophilus influenzae Rd
auuaguggauguaa

SEQ ID NO: 2719154 - RNA, 16 nt, Haemophilus influenzae Rd
auuagugugauuuuag

SEQ ID NO: 2719155 - RNA, 16 nt, Haemophilus influenzae Rd
auuaguuguuuuaguu

SEQ ID NO: 2719156 - RNA, 18 nt, Haemophilus influenzae Rd
auuaguuuuuaauuugcc

SEQ ID NO: 2719157 - RNA, 12 nt, Haemophilus influenzae Rd
auuaguuuuuua

SEQ ID NO: 2719158 - RNA, 14 nt, Haemophilus influenzae Rd
auuauacauuuaac

SEQ ID NO: 2719159 - RNA, 16 nt, Haemophilus influenzae Rd
auuauacauuuaacca

SEQ ID NO: 2719160 - RNA, 15 nt, Haemophilus influenzae Rd
auuauaccgcucaca

SEQ ID NO: 2719161 - RNA, 23 nt, Haemophilus influenzae Rd
auuauacgaucacgauuuuucuc

SEQ ID NO: 2719162 - RNA, 16 nt, Haemophilus influenzae Rd
auuauagaaaagacaa

SEQ ID NO: 2719163 - RNA, 14 nt, Haemophilus influenzae Rd
auuauagauuuagu

SEQ ID NO: 2719164 - RNA, 20 nt, Haemophilus influenzae Rd
auuauauuccuuauucaaau

SEQ ID NO: 2719165 - RNA, 22 nt, Haemophilus influenzae Rd
auuauauuuuccuguuaauucu

SEQ ID NO: 2719166 - RNA, 13 nt, Haemophilus influenzae Rd
auuauauuuucua

SEQ ID NO: 2719167 - RNA, 14 nt, Haemophilus influenzae Rd
auuauauuuuuaau

SEQ ID NO: 2719168 - RNA, 15 nt, Haemophilus influenzae Rd
auuaucaaaaagaaa

SEQ ID NO: 2719169 - RNA, 15 nt, Haemophilus influenzae Rd
auuaucaaagaauuu

SEQ ID NO: 2719170 - RNA, 14 nt, Haemophilus influenzae Rd
auuaucaaaugcca

SEQ ID NO: 2719171 - RNA, 16 nt, Haemophilus influenzae Rd
auuaucaacaguaaau

SEQ ID NO: 2719172 - RNA, 22 nt, Haemophilus influenzae Rd
auuaucaacaguaaauuuuucc

SEQ ID NO: 2719173 - RNA, 14 nt, Haemophilus influenzae Rd
auuaucaacaucaa

SEQ ID NO: 2719174 - RNA, 15 nt, Haemophilus influenzae Rd
auuaucaauaauuaa

SEQ ID NO: 2719175 - RNA, 22 nt, Haemophilus influenzae Rd
auuaucauuaaauauaaugaau

SEQ ID NO: 2719176 - RNA, 21 nt, Haemophilus influenzae Rd
auuauccaaaccaucauaggc

SEQ ID NO: 2719177 - RNA, 15 nt, Haemophilus influenzae Rd
auuauccaacauuaa

SEQ ID NO: 2719178 - RNA, 22 nt, Haemophilus influenzae Rd
auuauccguaaauucaaauacu

SEQ ID NO: 2719179 - RNA, 18 nt, Haemophilus influenzae Rd
auuaucgaauagauuuuu

SEQ ID NO: 2719180 - RNA, 19 nt, Haemophilus influenzae Rd
auuaucgccaucacgccau

SEQ ID NO: 2719181 - RNA, 19 nt, Haemophilus influenzae Rd
auuaucgccuaaaauugca

SEQ ID NO: 2719182 - RNA, 19 nt, Haemophilus influenzae Rd
auuaucgucuaucuaagau

SEQ ID NO: 2719183 - RNA, 23 nt, Haemophilus influenzae Rd
auuaucuaaaccguuuagcaaac

SEQ ID NO: 2719184 - RNA, 15 nt, Haemophilus influenzae Rd
auuaucuaaauuaca

SEQ ID NO: 2719185 - RNA, 23 nt, Haemophilus influenzae Rd
auuaucuaaauuacauuuuuucu

SEQ ID NO: 2719186 - RNA, 16 nt, Haemophilus influenzae Rd
auuaucuagaaaacuc

SEQ ID NO: 2719187 - RNA, 15 nt, Haemophilus influenzae Rd
auuaucuagcacaaa

SEQ ID NO: 2719188 - RNA, 16 nt, Haemophilus influenzae Rd
auuaucuccaagaaua

SEQ ID NO: 2719189 - RNA, 20 nt, Haemophilus influenzae Rd
auuaucuccaagaauauuuc

SEQ ID NO: 2719190 - RNA, 21 nt, Haemophilus influenzae Rd
auuaucuccaagaauauuuca

SEQ ID NO: 2719191 - RNA, 17 nt, Haemophilus influenzae Rd
auuaucugaggauuaaa

SEQ ID NO: 2719192 - RNA, 18 nt, Haemophilus influenzae Rd
auuaucuguaacaaguaa

SEQ ID NO: 2719193 - RNA, 23 nt, Haemophilus influenzae Rd
auuaucuguaacaaguaauuuau

SEQ ID NO: 2719194 - RNA, 17 nt, Haemophilus influenzae Rd
auuaucuuuauuuguca

SEQ ID NO: 2719195 - RNA, 13 nt, Haemophilus influenzae Rd
auuaugaaaaaaa

SEQ ID NO: 2719196 - RNA, 23 nt, Haemophilus influenzae Rd
auuaugaccuuuuuuuagaauua

SEQ ID NO: 2719197 - RNA, 18 nt, Haemophilus influenzae Rd
auuaugcgccuaaacgcu

SEQ ID NO: 2719198 - RNA, 22 nt, Haemophilus influenzae Rd
auuaugcuccauugcaauuuca

SEQ ID NO: 2719199 - RNA, 17 nt, Haemophilus influenzae Rd
auuauggaauggcauaa

SEQ ID NO: 2719200 - RNA, 22 nt, Haemophilus influenzae Rd
auuauggguguuuaaauuuuua

SEQ ID NO: 2719201 - RNA, 17 nt, Haemophilus influenzae Rd
auuauguauuaccauuu

SEQ ID NO: 2719202 - RNA, 21 nt, Haemophilus influenzae Rd
auuaugugcuugggcaauuaa

SEQ ID NO: 2719203 - RNA, 15 nt, Haemophilus influenzae Rd
auuauguucauuuuc

SEQ ID NO: 2719204 - RNA, 14 nt, Haemophilus influenzae Rd
auuauuaaaagcaa

SEQ ID NO: 2719205 - RNA, 14 nt, Haemophilus influenzae Rd
auuauuaaauaaac

SEQ ID NO: 2719206 - RNA, 18 nt, Haemophilus influenzae Rd
auuauuaaccguuuuuau

SEQ ID NO: 2719207 - RNA, 23 nt, Haemophilus influenzae Rd
auuauuaaguaauacauuuucau

SEQ ID NO: 2719208 - RNA, 21 nt, Haemophilus influenzae Rd
auuauuaagucuauuacuaaa

SEQ ID NO: 2719209 - RNA, 17 nt, Haemophilus influenzae Rd
auuauuacccguuugaa

SEQ ID NO: 2719210 - RNA, 19 nt, Haemophilus influenzae Rd
auuauuagcauaauaaaaa

SEQ ID NO: 2719211 - RNA, 20 nt, Haemophilus influenzae Rd
auuauuagcauaauaaaaaa

SEQ ID NO: 2719212 - RNA, 18 nt, Haemophilus influenzae Rd
auuauuccaaauaucuuc

SEQ ID NO: 2719213 - RNA, 16 nt, Haemophilus influenzae Rd
auuauucuacauaaug

SEQ ID NO: 2719214 - RNA, 22 nt, Haemophilus influenzae Rd
auuauucucuauuaauuuuaaa

SEQ ID NO: 2719215 - RNA, 11 nt, Haemophilus influenzae Rd
auuauucuuuu

SEQ ID NO: 2719216 - RNA, 21 nt, Haemophilus influenzae Rd
auuauucuuuucaacauucac

SEQ ID NO: 2719217 - RNA, 23 nt, Haemophilus influenzae Rd
auuauucuuuucaacauucacua

SEQ ID NO: 2719218 - RNA, 20 nt, Haemophilus influenzae Rd
auuauugaagcacugaaaua

SEQ ID NO: 2719219 - RNA, 19 nt, Haemophilus influenzae Rd
auuauugcacuaauaaaua

SEQ ID NO: 2719220 - RNA, 15 nt, Haemophilus influenzae Rd
auuauugcauuuuua

SEQ ID NO: 2719221 - RNA, 15 nt, Haemophilus influenzae Rd
auuauuggcuauuga

SEQ ID NO: 2719222 - RNA, 23 nt, Haemophilus influenzae Rd
auuauuuaagccagaacauauaa

SEQ ID NO: 2719223 - RNA, 16 nt, Haemophilus influenzae Rd
auuauuuaauuuuuua

SEQ ID NO: 2719224 - RNA, 17 nt, Haemophilus influenzae Rd
auuauuuaauuuuuuau

SEQ ID NO: 2719225 - RNA, 14 nt, Haemophilus influenzae Rd
auuauuuacaauug

SEQ ID NO: 2719226 - RNA, 14 nt, Haemophilus influenzae Rd
auuauuuagauaua

SEQ ID NO: 2719227 - RNA, 22 nt, Haemophilus influenzae Rd
auuauuuaggggccuuuuuuau

SEQ ID NO: 2719228 - RNA, 17 nt, Haemophilus influenzae Rd
auuauuuauuuaauuuc

SEQ ID NO: 2719229 - RNA, 19 nt, Haemophilus influenzae Rd
auuauuucguuguuuuaau

SEQ ID NO: 2719230 - RNA, 22 nt, Haemophilus influenzae Rd
auuauuucguuguuuuaauaaa

SEQ ID NO: 2719231 - RNA, 13 nt, Haemophilus influenzae Rd
auuauuucucuau

SEQ ID NO: 2719232 - RNA, 16 nt, Haemophilus influenzae Rd
auuauuugauuuuuau

SEQ ID NO: 2719233 - RNA, 19 nt, Haemophilus influenzae Rd
auuauuuuuuauccuauua

SEQ ID NO: 2719234 - RNA, 19 nt, Haemophilus influenzae Rd
auucaaaaaauguauccac

SEQ ID NO: 2719235 - RNA, 20 nt, Haemophilus influenzae Rd
auucaaaaauaaagcccugu

SEQ ID NO: 2719236 - RNA, 16 nt, Haemophilus influenzae Rd
auucaaaauaaaacca

SEQ ID NO: 2719237 - RNA, 11 nt, Haemophilus influenzae Rd
auucaaaauuu

SEQ ID NO: 2719238 - RNA, 20 nt, Haemophilus influenzae Rd
auucaaacagguguguuuuu

SEQ ID NO: 2719239 - RNA, 22 nt, Haemophilus influenzae Rd
auucaaacagguguguuuuuca

SEQ ID NO: 2719240 - RNA, 20 nt, Haemophilus influenzae Rd
auucaaacgcguuaaaucac

SEQ ID NO: 2719241 - RNA, 14 nt, Haemophilus influenzae Rd
auucaaacugaauu

SEQ ID NO: 2719242 - RNA, 15 nt, Haemophilus influenzae Rd
auucaaacugaauug

SEQ ID NO: 2719243 - RNA, 14 nt, Haemophilus influenzae Rd
auucaaagauuauu

SEQ ID NO: 2719244 - RNA, 19 nt, Haemophilus influenzae Rd
auucaaagauuuuaaaauu

SEQ ID NO: 2719245 - RNA, 11 nt, Haemophilus influenzae Rd
auucaaauaac

SEQ ID NO: 2719246 - RNA, 20 nt, Haemophilus influenzae Rd
auucaaaugaaauguuuuuu

SEQ ID NO: 2719247 - RNA, 15 nt, Haemophilus influenzae Rd
auucaacaaaaaugc

SEQ ID NO: 2719248 - RNA, 18 nt, Haemophilus influenzae Rd
auucaacaauaauuuuua

SEQ ID NO: 2719249 - RNA, 22 nt, Haemophilus influenzae Rd
auucaacaauucauaaauaauu

SEQ ID NO: 2719250 - RNA, 19 nt, Haemophilus influenzae Rd
auucaacacgccuaacaua

SEQ ID NO: 2719251 - RNA, 15 nt, Haemophilus influenzae Rd
auucaacgguaacug

SEQ ID NO: 2719252 - RNA, 23 nt, Haemophilus influenzae Rd
auucaagaugauauuuaauaaaa

SEQ ID NO: 2719253 - RNA, 19 nt, Haemophilus influenzae Rd
auucaauaauauauuuaau

SEQ ID NO: 2719254 - RNA, 19 nt, Haemophilus influenzae Rd
auucaauacuuauauuauu

SEQ ID NO: 2719255 - RNA, 20 nt, Haemophilus influenzae Rd
auucaauagguuauaaguuu

SEQ ID NO: 2719256 - RNA, 20 nt, Haemophilus influenzae Rd
auucaaugcaacaauacguu

SEQ ID NO: 2719257 - RNA, 14 nt, Haemophilus influenzae Rd
auucaaugcagaaa

SEQ ID NO: 2719258 - RNA, 19 nt, Haemophilus influenzae Rd
auucaaugcagaaauacuu

SEQ ID NO: 2719259 - RNA, 16 nt, Haemophilus influenzae Rd
auucaaugcuuccuuc

SEQ ID NO: 2719260 - RNA, 13 nt, Haemophilus influenzae Rd
auucaauuacuau

SEQ ID NO: 2719261 - RNA, 15 nt, Haemophilus influenzae Rd
auucaauuacuauua

SEQ ID NO: 2719262 - RNA, 13 nt, Haemophilus influenzae Rd
auucaauuuuccc

SEQ ID NO: 2719263 - RNA, 16 nt, Haemophilus influenzae Rd
auucaauuuuccccuc

SEQ ID NO: 2719264 - RNA, 18 nt, Haemophilus influenzae Rd
auucaccccuucuguugc

SEQ ID NO: 2719265 - RNA, 21 nt, Haemophilus influenzae Rd
auucaccccuucuguugccau

SEQ ID NO: 2719266 - RNA, 19 nt, Haemophilus influenzae Rd
auucaccgcacuuuucuuu

SEQ ID NO: 2719267 - RNA, 21 nt, Haemophilus influenzae Rd
auucaccgcacuuuuuacuuu

SEQ ID NO: 2719268 - RNA, 18 nt, Haemophilus influenzae Rd
auucaccgccuacaugau

SEQ ID NO: 2719269 - RNA, 17 nt, Haemophilus influenzae Rd
auucacgagccaauaca

SEQ ID NO: 2719270 - RNA, 21 nt, Haemophilus influenzae Rd
auucacgaucacuuguuuugu

SEQ ID NO: 2719271 - RNA, 23 nt, Haemophilus influenzae Rd
auucacgccuucgcgagauaaaa

SEQ ID NO: 2719272 - RNA, 17 nt, Haemophilus influenzae Rd
auucacgcucguuaaau

SEQ ID NO: 2719273 - RNA, 23 nt, Haemophilus influenzae Rd
auucacgguguuuuuuaauaaaa

SEQ ID NO: 2719274 - RNA, 14 nt, Haemophilus influenzae Rd
auucacuaacaaau

SEQ ID NO: 2719275 - RNA, 13 nt, Haemophilus influenzae Rd
auucacucaauuc

SEQ ID NO: 2719276 - RNA, 13 nt, Haemophilus influenzae Rd
auucacuuucaca

SEQ ID NO: 2719277 - RNA, 14 nt, Haemophilus influenzae Rd
auucacuuucacau

SEQ ID NO: 2719278 - RNA, 17 nt, Haemophilus influenzae Rd
auucacuuucacauaaa

SEQ ID NO: 2719279 - RNA, 13 nt, Haemophilus influenzae Rd
auucagauauaac

SEQ ID NO: 2719280 - RNA, 14 nt, Haemophilus influenzae Rd
auucagcaaaauca

SEQ ID NO: 2719281 - RNA, 15 nt, Haemophilus influenzae Rd
auucagcaagaaacu

SEQ ID NO: 2719282 - RNA, 23 nt, Haemophilus influenzae Rd
auucagcacuuucgcuuaaaaau

SEQ ID NO: 2719283 - RNA, 23 nt, Haemophilus influenzae Rd
auucagcgagagaauauuuagau

SEQ ID NO: 2719284 - RNA, 15 nt, Haemophilus influenzae Rd
auucagcuaaacauu

SEQ ID NO: 2719285 - RNA, 23 nt, Haemophilus influenzae Rd
auucagcuuuaaggcacagauua

SEQ ID NO: 2719286 - RNA, 18 nt, Haemophilus influenzae Rd
auucagggauuaagaaaa

SEQ ID NO: 2719287 - RNA, 19 nt, Haemophilus influenzae Rd
auucagggauuaagaaaau

SEQ ID NO: 2719288 - RNA, 19 nt, Haemophilus influenzae Rd
auucaggugggaaauaauu

SEQ ID NO: 2719289 - RNA, 17 nt, Haemophilus influenzae Rd
auucaguaucaaauaca

SEQ ID NO: 2719290 - RNA, 22 nt, Haemophilus influenzae Rd
auucaguaucaaauacacaaau

SEQ ID NO: 2719291 - RNA, 13 nt, Haemophilus influenzae Rd
auucagucuuaau

SEQ ID NO: 2719292 - RNA, 17 nt, Haemophilus influenzae Rd
auucaguuaagaaaaua

SEQ ID NO: 2719293 - RNA, 18 nt, Haemophilus influenzae Rd
auucaguuaagaaaauaa

SEQ ID NO: 2719294 - RNA, 20 nt, Haemophilus influenzae Rd
auucaguugauagacaauau

SEQ ID NO: 2719295 - RNA, 14 nt, Haemophilus influenzae Rd
auucauaaaaaugu

SEQ ID NO: 2719296 - RNA, 14 nt, Haemophilus influenzae Rd
auucauaaaaggca

SEQ ID NO: 2719297 - RNA, 23 nt, Haemophilus influenzae Rd
auucauaaaaggcaaagcaaaau

SEQ ID NO: 2719298 - RNA, 16 nt, Haemophilus influenzae Rd
auucauaauccguuaa

SEQ ID NO: 2719299 - RNA, 22 nt, Haemophilus influenzae Rd
auucauaauccguuaaauuuag

SEQ ID NO: 2719300 - RNA, 16 nt, Haemophilus influenzae Rd
auucauaccgauaaca

SEQ ID NO: 2719301 - RNA, 19 nt, Haemophilus influenzae Rd
auucauaccgauaacacga

SEQ ID NO: 2719302 - RNA, 16 nt, Haemophilus influenzae Rd
auucauauaauucauu

SEQ ID NO: 2719303 - RNA, 15 nt, Haemophilus influenzae Rd
auucaucaaaucauu

SEQ ID NO: 2719304 - RNA, 20 nt, Haemophilus influenzae Rd
auucaucaagcucaaaagua

SEQ ID NO: 2719305 - RNA, 13 nt, Haemophilus influenzae Rd
auucaucagaaag

SEQ ID NO: 2719306 - RNA, 15 nt, Haemophilus influenzae Rd
auucaucagaaagug

SEQ ID NO: 2719307 - RNA, 16 nt, Haemophilus influenzae Rd
auucaucuaaaaaacu

SEQ ID NO: 2719308 - RNA, 22 nt, Haemophilus influenzae Rd
auucaucuuagcuuuuuucuua

SEQ ID NO: 2719309 - RNA, 23 nt, Haemophilus influenzae Rd
auucaucuucugcugauaaucca

SEQ ID NO: 2719310 - RNA, 15 nt, Haemophilus influenzae Rd
auucaugaaucguuu

SEQ ID NO: 2719311 - RNA, 22 nt, Haemophilus influenzae Rd
auucaugagcugggcaaacaau

SEQ ID NO: 2719312 - RNA, 13 nt, Haemophilus influenzae Rd
auucauguuuuuu

SEQ ID NO: 2719313 - RNA, 14 nt, Haemophilus influenzae Rd
auucauguuuuuua

SEQ ID NO: 2719314 - RNA, 15 nt, Haemophilus influenzae Rd
auucauuaaguuuuc

SEQ ID NO: 2719315 - RNA, 18 nt, Haemophilus influenzae Rd
auucauuaaguuuucuac

SEQ ID NO: 2719316 - RNA, 19 nt, Haemophilus influenzae Rd
auucauuaaguuuucuaca

SEQ ID NO: 2719317 - RNA, 12 nt, Haemophilus influenzae Rd
auucauuauuug

SEQ ID NO: 2719318 - RNA, 14 nt, Haemophilus influenzae Rd
auucauucauuuug

SEQ ID NO: 2719319 - RNA, 16 nt, Haemophilus influenzae Rd
auucauucauuuuguc

SEQ ID NO: 2719320 - RNA, 24 nt, Haemophilus influenzae Rd
auucauucuugcuugaucauccau

SEQ ID NO: 2719321 - RNA, 23 nt, Haemophilus influenzae Rd
auucauugaugcccacuuuuccu

SEQ ID NO: 2719322 - RNA, 15 nt, Haemophilus influenzae Rd
auucauugcauuuuu

SEQ ID NO: 2719323 - RNA, 21 nt, Haemophilus influenzae Rd
auucauuguuucucaauaaau

SEQ ID NO: 2719324 - RNA, 15 nt, Haemophilus influenzae Rd
auucauuuaaaacaa

SEQ ID NO: 2719325 - RNA, 14 nt, Haemophilus influenzae Rd
auucauuuaaaaua

SEQ ID NO: 2719326 - RNA, 23 nt, Haemophilus influenzae Rd
auucauuuugucagauuuauaaa

SEQ ID NO: 2719327 - RNA, 17 nt, Haemophilus influenzae Rd
auucauuuuuuauuuuu

SEQ ID NO: 2719328 - RNA, 18 nt, Haemophilus influenzae Rd
auucauuuuuuauuuuuu

SEQ ID NO: 2719329 - RNA, 21 nt, Haemophilus influenzae Rd
auucauuuuuuauuuuuucua

SEQ ID NO: 2719330 - RNA, 19 nt, Haemophilus influenzae Rd
auuccaaacuggaauaaag

SEQ ID NO: 2719331 - RNA, 21 nt, Haemophilus influenzae Rd
auuccaaagcuggcucuucuu

SEQ ID NO: 2719332 - RNA, 14 nt, Haemophilus influenzae Rd
auuccaaaguuuag

SEQ ID NO: 2719333 - RNA, 22 nt, Haemophilus influenzae Rd
auuccaacaaguucuucuauug

SEQ ID NO: 2719334 - RNA, 14 nt, Haemophilus influenzae Rd
auuccaacgauuuu

SEQ ID NO: 2719335 - RNA, 17 nt, Haemophilus influenzae Rd
auuccaacgauuuugca

SEQ ID NO: 2719336 - RNA, 18 nt, Haemophilus influenzae Rd
auuccaacgauuuugcaa

SEQ ID NO: 2719337 - RNA, 23 nt, Haemophilus influenzae Rd
auuccaccacagcccaaaauuca

SEQ ID NO: 2719338 - RNA, 12 nt, Haemophilus influenzae Rd
auuccacuucag

SEQ ID NO: 2719339 - RNA, 14 nt, Haemophilus influenzae Rd
auuccacuuuuuca

SEQ ID NO: 2719340 - RNA, 21 nt, Haemophilus influenzae Rd
auuccagccccucagauaaug

SEQ ID NO: 2719341 - RNA, 16 nt, Haemophilus influenzae Rd
auuccaguucuccuuc

SEQ ID NO: 2719342 - RNA, 18 nt, Haemophilus influenzae Rd
auuccauaguucacuaaa

SEQ ID NO: 2719343 - RNA, 18 nt, Haemophilus influenzae Rd
auuccauauuacccguac

SEQ ID NO: 2719344 - RNA, 16 nt, Haemophilus influenzae Rd
auuccauauuguuuca

SEQ ID NO: 2719345 - RNA, 13 nt, Haemophilus influenzae Rd
auucccaaauuuu

SEQ ID NO: 2719346 - RNA, 16 nt, Haemophilus influenzae Rd
auucccaauuccguuu

SEQ ID NO: 2719347 - RNA, 15 nt, Haemophilus influenzae Rd
auucccauuccagua

SEQ ID NO: 2719348 - RNA, 16 nt, Haemophilus influenzae Rd
auucccauuccaguaa

SEQ ID NO: 2719349 - RNA, 20 nt, Haemophilus influenzae Rd
auucccauuucuaaugcaau

SEQ ID NO: 2719350 - RNA, 20 nt, Haemophilus influenzae Rd
auucccccauuaaaagaagc

SEQ ID NO: 2719351 - RNA, 23 nt, Haemophilus influenzae Rd
auuccccgcuuucgcuucugcuu

SEQ ID NO: 2719352 - RNA, 14 nt, Haemophilus influenzae Rd
auuccccuucaaau

SEQ ID NO: 2719353 - RNA, 16 nt, Haemophilus influenzae Rd
auucccuagccuuuuc

SEQ ID NO: 2719354 - RNA, 17 nt, Haemophilus influenzae Rd
auucccuuuacauuugg

SEQ ID NO: 2719355 - RNA, 13 nt, Haemophilus influenzae Rd
auuccgauuuuac

SEQ ID NO: 2719356 - RNA, 12 nt, Haemophilus influenzae Rd
auuccuacacca

SEQ ID NO: 2719357 - RNA, 14 nt, Haemophilus influenzae Rd
auuccuauucuaaa

SEQ ID NO: 2719358 - RNA, 19 nt, Haemophilus influenzae Rd
auuccuccgccaucaauuu

SEQ ID NO: 2719359 - RNA, 22 nt, Haemophilus influenzae Rd
auuccuccgccaucaauuuuua

SEQ ID NO: 2719360 - RNA, 16 nt, Haemophilus influenzae Rd
auuccugcuuuuuuca

SEQ ID NO: 2719361 - RNA, 14 nt, Haemophilus influenzae Rd
auuccuuacaacaa

SEQ ID NO: 2719362 - RNA, 17 nt, Haemophilus influenzae Rd
auuccuuauucaaauaa

SEQ ID NO: 2719363 - RNA, 22 nt, Haemophilus influenzae Rd
auuccuuauucaaauaacguaa

SEQ ID NO: 2719364 - RNA, 17 nt, Haemophilus influenzae Rd
auuccuucaaauucuac

SEQ ID NO: 2719365 - RNA, 23 nt, Haemophilus influenzae Rd
auuccuucaucgucuucuucgcu

SEQ ID NO: 2719366 - RNA, 23 nt, Haemophilus influenzae Rd
auuccuuccaacaauuucacuga

SEQ ID NO: 2719367 - RNA, 16 nt, Haemophilus influenzae Rd
auuccuuuguuagauu

SEQ ID NO: 2719368 - RNA, 14 nt, Haemophilus influenzae Rd
auuccuuuuucuac

SEQ ID NO: 2719369 - RNA, 19 nt, Haemophilus influenzae Rd
auucgauugcauuuuuuau

SEQ ID NO: 2719370 - RNA, 16 nt, Haemophilus influenzae Rd
auucgcaaauccuaca

SEQ ID NO: 2719371 - RNA, 16 nt, Haemophilus influenzae Rd
auucgcauauuuuugc

SEQ ID NO: 2719372 - RNA, 19 nt, Haemophilus influenzae Rd
auucgcauauuuuugcaag

SEQ ID NO: 2719373 - RNA, 20 nt, Haemophilus influenzae Rd
auucgccacgauaggaucua

SEQ ID NO: 2719374 - RNA, 21 nt, Haemophilus influenzae Rd
auucgcccgaaacucaccauu

SEQ ID NO: 2719375 - RNA, 15 nt, Haemophilus influenzae Rd
auucgccuaaugccu

SEQ ID NO: 2719376 - RNA, 12 nt, Haemophilus influenzae Rd
auucgccuucac

SEQ ID NO: 2719377 - RNA, 14 nt, Haemophilus influenzae Rd
auucgccuugcuuu

SEQ ID NO: 2719378 - RNA, 19 nt, Haemophilus influenzae Rd
auucgccuugcuuuuaaua

SEQ ID NO: 2719379 - RNA, 14 nt, Haemophilus influenzae Rd
auucgcugcaaaau

SEQ ID NO: 2719380 - RNA, 16 nt, Haemophilus influenzae Rd
auucgcugcaaaauca

SEQ ID NO: 2719381 - RNA, 16 nt, Haemophilus influenzae Rd
auucgcuuucauaaau

SEQ ID NO: 2719382 - RNA, 13 nt, Haemophilus influenzae Rd
auucgcuuuuuua

SEQ ID NO: 2719383 - RNA, 16 nt, Haemophilus influenzae Rd
auucggaauauucaac

SEQ ID NO: 2719384 - RNA, 16 nt, Haemophilus influenzae Rd
auucgguguauuuuug

SEQ ID NO: 2719385 - RNA, 20 nt, Haemophilus influenzae Rd
auucguaaugccucgauauu

SEQ ID NO: 2719386 - RNA, 23 nt, Haemophilus influenzae Rd
auucguaaugccucgauauuuau

SEQ ID NO: 2719387 - RNA, 20 nt, Haemophilus influenzae Rd
auucguacuuuugauuuauu

SEQ ID NO: 2719388 - RNA, 17 nt, Haemophilus influenzae Rd
auucgugcaaauuuuuu

SEQ ID NO: 2719389 - RNA, 20 nt, Haemophilus influenzae Rd
auucguguagaucagccccu

SEQ ID NO: 2719390 - RNA, 13 nt, Haemophilus influenzae Rd
auucguuucagua

SEQ ID NO: 2719391 - RNA, 14 nt, Haemophilus influenzae Rd
auucuaaaaaaauc

SEQ ID NO: 2719392 - RNA, 16 nt, Haemophilus influenzae Rd
auucuaaaaaaaucac

SEQ ID NO: 2719393 - RNA, 13 nt, Haemophilus influenzae Rd
auucuaaaaacuc

SEQ ID NO: 2719394 - RNA, 22 nt, Haemophilus influenzae Rd
auucuaaacggcguaucauacu

SEQ ID NO: 2719395 - RNA, 12 nt, Haemophilus influenzae Rd
auucuaaauuua

SEQ ID NO: 2719396 - RNA, 23 nt, Haemophilus influenzae Rd
auucuaagguucgauaguauuuu

SEQ ID NO: 2719397 - RNA, 23 nt, Haemophilus influenzae Rd
auucuaauuccccuucaaauaua

SEQ ID NO: 2719398 - RNA, 21 nt, Haemophilus influenzae Rd
auucuacaccauuauuuuucu

SEQ ID NO: 2719399 - RNA, 12 nt, Haemophilus influenzae Rd
auucuacauaau

SEQ ID NO: 2719400 - RNA, 17 nt, Haemophilus influenzae Rd
auucuaccgcauuuuua

SEQ ID NO: 2719401 - RNA, 15 nt, Haemophilus influenzae Rd
auucuacgccauuuu

SEQ ID NO: 2719402 - RNA, 17 nt, Haemophilus influenzae Rd
auucuacguauugaacu

SEQ ID NO: 2719403 - RNA, 20 nt, Haemophilus influenzae Rd
auucuacguauugaacuaaa

SEQ ID NO: 2719404 - RNA, 20 nt, Haemophilus influenzae Rd
auucuacgucaaagccauau

SEQ ID NO: 2719405 - RNA, 16 nt, Haemophilus influenzae Rd
auucuacugaaaucaa

SEQ ID NO: 2719406 - RNA, 21 nt, Haemophilus influenzae Rd
auucuagcuguaacagcuaga

SEQ ID NO: 2719407 - RNA, 18 nt, Haemophilus influenzae Rd
auucuaguucuuccccuc

SEQ ID NO: 2719408 - RNA, 22 nt, Haemophilus influenzae Rd
auucuauaauccgcagaauuua

SEQ ID NO: 2719409 - RNA, 14 nt, Haemophilus influenzae Rd
auucuauagaauua

SEQ ID NO: 2719410 - RNA, 19 nt, Haemophilus influenzae Rd
auucuauuuauaauccauu

SEQ ID NO: 2719411 - RNA, 14 nt, Haemophilus influenzae Rd
auucuauuuuaaaa

SEQ ID NO: 2719412 - RNA, 16 nt, Haemophilus influenzae Rd
auucucaaaugaggaa

SEQ ID NO: 2719413 - RNA, 23 nt, Haemophilus influenzae Rd
auucucaagaauauauuuuauca

SEQ ID NO: 2719414 - RNA, 19 nt, Haemophilus influenzae Rd
auucucaauugcaaaauca

SEQ ID NO: 2719415 - RNA, 17 nt, Haemophilus influenzae Rd
auucucaggaaauuuca

SEQ ID NO: 2719416 - RNA, 18 nt, Haemophilus influenzae Rd
auucucaggaaauuucaa

SEQ ID NO: 2719417 - RNA, 15 nt, Haemophilus influenzae Rd
auucucaucagccuu

SEQ ID NO: 2719418 - RNA, 16 nt, Haemophilus influenzae Rd
auucuccaaauauaaa

SEQ ID NO: 2719419 - RNA, 18 nt, Haemophilus influenzae Rd
auucuccagacugcauug

SEQ ID NO: 2719420 - RNA, 18 nt, Haemophilus influenzae Rd
auucuccccgaugauuuu

SEQ ID NO: 2719421 - RNA, 23 nt, Haemophilus influenzae Rd
auucucccugaguauguuuugau

SEQ ID NO: 2719422 - RNA, 21 nt, Haemophilus influenzae Rd
auucuccgauacauaauacug

SEQ ID NO: 2719423 - RNA, 19 nt, Haemophilus influenzae Rd
auucuccgcauuuuuuuau

SEQ ID NO: 2719424 - RNA, 22 nt, Haemophilus influenzae Rd
auucuccgccugauucgccaaa

SEQ ID NO: 2719425 - RNA, 16 nt, Haemophilus influenzae Rd
auucuccuuaauuuca

SEQ ID NO: 2719426 - RNA, 21 nt, Haemophilus influenzae Rd
auucuccuugguuuucuugcc

SEQ ID NO: 2719427 - RNA, 18 nt, Haemophilus influenzae Rd
auucucggcaaugguuca

SEQ ID NO: 2719428 - RNA, 16 nt, Haemophilus influenzae Rd
auucucgguuguuuca

SEQ ID NO: 2719429 - RNA, 15 nt, Haemophilus influenzae Rd
auucucuaacgcauu

SEQ ID NO: 2719430 - RNA, 21 nt, Haemophilus influenzae Rd
auucucuaacgcauucaaauc

SEQ ID NO: 2719431 - RNA, 24 nt, Haemophilus influenzae Rd
auucucucgcugaauuauugucuu

SEQ ID NO: 2719432 - RNA, 13 nt, Haemophilus influenzae Rd
auucucuguuucu

SEQ ID NO: 2719433 - RNA, 14 nt, Haemophilus influenzae Rd
auucucuguuucuu

SEQ ID NO: 2719434 - RNA, 20 nt, Haemophilus influenzae Rd
auucugaaaccacuaaaaac

SEQ ID NO: 2719435 - RNA, 19 nt, Haemophilus influenzae Rd
auucugauuuagguuucaa

SEQ ID NO: 2719436 - RNA, 15 nt, Haemophilus influenzae Rd
auucugcaccuuaau

SEQ ID NO: 2719437 - RNA, 15 nt, Haemophilus influenzae Rd
auucugcaguuuuuu

SEQ ID NO: 2719438 - RNA, 13 nt, Haemophilus influenzae Rd
auucugcuuguuc

SEQ ID NO: 2719439 - RNA, 18 nt, Haemophilus influenzae Rd
auucuggcaauauuucaa

SEQ ID NO: 2719440 - RNA, 18 nt, Haemophilus influenzae Rd
auucuggugcauuuaugc

SEQ ID NO: 2719441 - RNA, 14 nt, Haemophilus influenzae Rd
auucuuaaaucaua

SEQ ID NO: 2719442 - RNA, 16 nt, Haemophilus influenzae Rd
auucuuaaaucauaaa

SEQ ID NO: 2719443 - RNA, 20 nt, Haemophilus influenzae Rd
auucuucaaguguuuuugcu

SEQ ID NO: 2719444 - RNA, 18 nt, Haemophilus influenzae Rd
auucuucaauaacaacug

SEQ ID NO: 2719445 - RNA, 22 nt, Haemophilus influenzae Rd
auucuucccaaucuuguuuuaa

SEQ ID NO: 2719446 - RNA, 16 nt, Haemophilus influenzae Rd
auucuucccagcguaa

SEQ ID NO: 2719447 - RNA, 24 nt, Haemophilus influenzae Rd
auucuucccagcguaaaaaugcug

SEQ ID NO: 2719448 - RNA, 22 nt, Haemophilus influenzae Rd
auucuucgaaaauaacuucauc

SEQ ID NO: 2719449 - RNA, 17 nt, Haemophilus influenzae Rd
auucuucuaacauuucu

SEQ ID NO: 2719450 - RNA, 17 nt, Haemophilus influenzae Rd
auucuucuaauucagug

SEQ ID NO: 2719451 - RNA, 15 nt, Haemophilus influenzae Rd
auucuucuauuuuau

SEQ ID NO: 2719452 - RNA, 17 nt, Haemophilus influenzae Rd
auucuucuauuuuauca

SEQ ID NO: 2719453 - RNA, 15 nt, Haemophilus influenzae Rd
auucuugaaugucuu

SEQ ID NO: 2719454 - RNA, 17 nt, Haemophilus influenzae Rd
auucuugccagauuuuu

SEQ ID NO: 2719455 - RNA, 20 nt, Haemophilus influenzae Rd
auucuugcguaaccaaagaa

SEQ ID NO: 2719456 - RNA, 18 nt, Haemophilus influenzae Rd
auucuugcguuucaaaug

SEQ ID NO: 2719457 - RNA, 13 nt, Haemophilus influenzae Rd
auucuugucuuuu

SEQ ID NO: 2719458 - RNA, 23 nt, Haemophilus influenzae Rd
auucuuguuuaauauuuuuuuca

SEQ ID NO: 2719459 - RNA, 11 nt, Haemophilus influenzae Rd
auucuuuaaaa

SEQ ID NO: 2719460 - RNA, 15 nt, Haemophilus influenzae Rd
auucuuuaaaacauu

SEQ ID NO: 2719461 - RNA, 20 nt, Haemophilus influenzae Rd
auucuuuaaagagcaaauuu

SEQ ID NO: 2719462 - RNA, 21 nt, Haemophilus influenzae Rd
auucuuuaaagagcaaauuua

SEQ ID NO: 2719463 - RNA, 23 nt, Haemophilus influenzae Rd
auucuuuaaauauucaauuacau

SEQ ID NO: 2719464 - RNA, 17 nt, Haemophilus influenzae Rd
auucuuuaucgaucacu

SEQ ID NO: 2719465 - RNA, 19 nt, Haemophilus influenzae Rd
auucuuuaugaauuaccaa

SEQ ID NO: 2719466 - RNA, 20 nt, Haemophilus influenzae Rd
auucuuucaauaauuuuucu

SEQ ID NO: 2719467 - RNA, 13 nt, Haemophilus influenzae Rd
auucuuuucaaca

SEQ ID NO: 2719468 - RNA, 14 nt, Haemophilus influenzae Rd
auucuuuucaacau

SEQ ID NO: 2719469 - RNA, 20 nt, Haemophilus influenzae Rd
auucuuuucuucuuugacua

SEQ ID NO: 2719470 - RNA, 13 nt, Haemophilus influenzae Rd
auucuuuuuaaau

SEQ ID NO: 2719471 - RNA, 22 nt, Haemophilus influenzae Rd
auucuuuuuucuuccuaugaau

SEQ ID NO: 2719472 - RNA, 23 nt, Haemophilus influenzae Rd
auugaaaagaaaguauuaaauau

SEQ ID NO: 2719473 - RNA, 14 nt, Haemophilus influenzae Rd
auugaaaauacagu

SEQ ID NO: 2719474 - RNA, 22 nt, Haemophilus influenzae Rd
auugaaacuaaagaaucaaauu

SEQ ID NO: 2719475 - RNA, 19 nt, Haemophilus influenzae Rd
auugaaauagacuacuuaa

SEQ ID NO: 2719476 - RNA, 19 nt, Haemophilus influenzae Rd
auugaaauuggaauccagc

SEQ ID NO: 2719477 - RNA, 20 nt, Haemophilus influenzae Rd
auugaaauuuuaauuuaguu

SEQ ID NO: 2719478 - RNA, 18 nt, Haemophilus influenzae Rd
auugaaccauuuuacaau

SEQ ID NO: 2719479 - RNA, 21 nt, Haemophilus influenzae Rd
auugaacgccuagauauuguu

SEQ ID NO: 2719480 - RNA, 18 nt, Haemophilus influenzae Rd
auugaagagauugauuuu

SEQ ID NO: 2719481 - RNA, 22 nt, Haemophilus influenzae Rd
auugaagagauugauuuucuuu

SEQ ID NO: 2719482 - RNA, 22 nt, Haemophilus influenzae Rd
auugaagaguuugaucauggcu

SEQ ID NO: 2719483 - RNA, 14 nt, Haemophilus influenzae Rd
auugaauauuuagu

SEQ ID NO: 2719484 - RNA, 15 nt, Haemophilus influenzae Rd
auugaauauuuaguu

SEQ ID NO: 2719485 - RNA, 12 nt, Haemophilus influenzae Rd
auugaaucaauu

SEQ ID NO: 2719486 - RNA, 16 nt, Haemophilus influenzae Rd
auugaaucaauuuuuu

SEQ ID NO: 2719487 - RNA, 13 nt, Haemophilus influenzae Rd
auugaauuuggua

SEQ ID NO: 2719488 - RNA, 13 nt, Haemophilus influenzae Rd
auugaauuuuucu

SEQ ID NO: 2719489 - RNA, 16 nt, Haemophilus influenzae Rd
auugacaauguuuuag

SEQ ID NO: 2719490 - RNA, 23 nt, Haemophilus influenzae Rd
auugacauuuuacuuuagcaaug

SEQ ID NO: 2719491 - RNA, 14 nt, Haemophilus influenzae Rd
auugaccaaugaau

SEQ ID NO: 2719492 - RNA, 17 nt, Haemophilus influenzae Rd
auugaccauuucaucua

SEQ ID NO: 2719493 - RNA, 18 nt, Haemophilus influenzae Rd
auugaccgcuucauuaaa

SEQ ID NO: 2719494 - RNA, 19 nt, Haemophilus influenzae Rd
auugaccucguggcaaaag

SEQ ID NO: 2719495 - RNA, 14 nt, Haemophilus influenzae Rd
auugaccuuuuaau

SEQ ID NO: 2719496 - RNA, 15 nt, Haemophilus influenzae Rd
auugacguaaaaguu

SEQ ID NO: 2719497 - RNA, 19 nt, Haemophilus influenzae Rd
auugacguaaaaguuuucc

SEQ ID NO: 2719498 - RNA, 22 nt, Haemophilus influenzae Rd
auugacuaagauucgcacguuu

SEQ ID NO: 2719499 - RNA, 18 nt, Haemophilus influenzae Rd
auugacuugcacaauuac

SEQ ID NO: 2719500 - RNA, 20 nt, Haemophilus influenzae Rd
auugacuugcacaauuacuu

SEQ ID NO: 2719501 - RNA, 18 nt, Haemophilus influenzae Rd
auugacuuguuuuaaaac

SEQ ID NO: 2719502 - RNA, 20 nt, Haemophilus influenzae Rd
auugacuuguuuuaaaacua

SEQ ID NO: 2719503 - RNA, 17 nt, Haemophilus influenzae Rd
auugagauuuaauuuau

SEQ ID NO: 2719504 - RNA, 17 nt, Haemophilus influenzae Rd
auugagcgauagaaaua

SEQ ID NO: 2719505 - RNA, 18 nt, Haemophilus influenzae Rd
auugagcgauagaaauaa

SEQ ID NO: 2719506 - RNA, 15 nt, Haemophilus influenzae Rd
auugagcgauugaac

SEQ ID NO: 2719507 - RNA, 13 nt, Haemophilus influenzae Rd
auugaggaaaguu

SEQ ID NO: 2719508 - RNA, 16 nt, Haemophilus influenzae Rd
auugaggauuugccuc

SEQ ID NO: 2719509 - RNA, 17 nt, Haemophilus influenzae Rd
auugaguucucguugca

SEQ ID NO: 2719510 - RNA, 20 nt, Haemophilus influenzae Rd
auugaguucucguugcaucu

SEQ ID NO: 2719511 - RNA, 13 nt, Haemophilus influenzae Rd
auugaguuuaguc

SEQ ID NO: 2719512 - RNA, 16 nt, Haemophilus influenzae Rd
auugaguuuuucugau

SEQ ID NO: 2719513 - RNA, 13 nt, Haemophilus influenzae Rd
auugauauuugga

SEQ ID NO: 2719514 - RNA, 13 nt, Haemophilus influenzae Rd
auugaucuaaauu

SEQ ID NO: 2719515 - RNA, 13 nt, Haemophilus influenzae Rd
auugaugaaaugg

SEQ ID NO: 2719516 - RNA, 23 nt, Haemophilus influenzae Rd
auugaugcccacuuuuccuaaag

SEQ ID NO: 2719517 - RNA, 13 nt, Haemophilus influenzae Rd
auugaugcuaaau

SEQ ID NO: 2719518 - RNA, 15 nt, Haemophilus influenzae Rd
auugauggaauuuau

SEQ ID NO: 2719519 - RNA, 23 nt, Haemophilus influenzae Rd
auugauuaaaaaagcaagauacu

SEQ ID NO: 2719520 - RNA, 16 nt, Haemophilus influenzae Rd
auugauucaauucuuc

SEQ ID NO: 2719521 - RNA, 18 nt, Haemophilus influenzae Rd
auugauucaauucuucua

SEQ ID NO: 2719522 - RNA, 17 nt, Haemophilus influenzae Rd
auugauucauuugaugg

SEQ ID NO: 2719523 - RNA, 15 nt, Haemophilus influenzae Rd
auugauucuaaaaac

SEQ ID NO: 2719524 - RNA, 14 nt, Haemophilus influenzae Rd
auugauugcuaaau

SEQ ID NO: 2719525 - RNA, 17 nt, Haemophilus influenzae Rd
auugauuuacauuaauu

SEQ ID NO: 2719526 - RNA, 17 nt, Haemophilus influenzae Rd
auugauuuccaguuacu

SEQ ID NO: 2719527 - RNA, 23 nt, Haemophilus influenzae Rd
auugauuuguuacuaaaauaauu

SEQ ID NO: 2719528 - RNA, 13 nt, Haemophilus influenzae Rd
auugauuuuaaag

SEQ ID NO: 2719529 - RNA, 19 nt, Haemophilus influenzae Rd
auugauuuuaaagaauguu

SEQ ID NO: 2719530 - RNA, 13 nt, Haemophilus influenzae Rd
auugauuuucuuu

SEQ ID NO: 2719531 - RNA, 17 nt, Haemophilus influenzae Rd
auugauuuucuuucugc

SEQ ID NO: 2719532 - RNA, 22 nt, Haemophilus influenzae Rd
auugcaaaaaugcaaaguaacu

SEQ ID NO: 2719533 - RNA, 23 nt, Haemophilus influenzae Rd
auugcaacacuugcugccacaag

SEQ ID NO: 2719534 - RNA, 14 nt, Haemophilus influenzae Rd
auugcaauaaccac

SEQ ID NO: 2719535 - RNA, 17 nt, Haemophilus influenzae Rd
auugcaauaaucacagu

SEQ ID NO: 2719536 - RNA, 21 nt, Haemophilus influenzae Rd
auugcaauuucagcugcgaug

SEQ ID NO: 2719537 - RNA, 15 nt, Haemophilus influenzae Rd
auugcacaauagcuu

SEQ ID NO: 2719538 - RNA, 15 nt, Haemophilus influenzae Rd
auugcaccaaauuuc

SEQ ID NO: 2719539 - RNA, 21 nt, Haemophilus influenzae Rd
auugcacccgcagugcccaaa

SEQ ID NO: 2719540 - RNA, 23 nt, Haemophilus influenzae Rd
auugcacgagcaauaauaucaau

SEQ ID NO: 2719541 - RNA, 15 nt, Haemophilus influenzae Rd
auugcacuaauaaau

SEQ ID NO: 2719542 - RNA, 18 nt, Haemophilus influenzae Rd
auugcacuaauaaauaga

SEQ ID NO: 2719543 - RNA, 19 nt, Haemophilus influenzae Rd
auugcaggcuuagcaauaa

SEQ ID NO: 2719544 - RNA, 15 nt, Haemophilus influenzae Rd
auugcagggaauaag

SEQ ID NO: 2719545 - RNA, 14 nt, Haemophilus influenzae Rd
auugcauaaucaua

SEQ ID NO: 2719546 - RNA, 17 nt, Haemophilus influenzae Rd
auugcauaguuuuaugc

SEQ ID NO: 2719547 - RNA, 20 nt, Haemophilus influenzae Rd
auugcauccacuucauccau

SEQ ID NO: 2719548 - RNA, 18 nt, Haemophilus influenzae Rd
auugcaucuuggcauuuu

SEQ ID NO: 2719549 - RNA, 16 nt, Haemophilus influenzae Rd
auugcauuaagaaguu

SEQ ID NO: 2719550 - RNA, 16 nt, Haemophilus influenzae Rd
auugcauuuucuucca

SEQ ID NO: 2719551 - RNA, 18 nt, Haemophilus influenzae Rd
auugcauuuucuuccaau

SEQ ID NO: 2719552 - RNA, 16 nt, Haemophilus influenzae Rd
auugcauuuuuauaaa

SEQ ID NO: 2719553 - RNA, 16 nt, Haemophilus influenzae Rd
auugcauuuuuuauaa

SEQ ID NO: 2719554 - RNA, 16 nt, Haemophilus influenzae Rd
auugccaaaaaagccc

SEQ ID NO: 2719555 - RNA, 19 nt, Haemophilus influenzae Rd
auugccauaauaaucacaa

SEQ ID NO: 2719556 - RNA, 21 nt, Haemophilus influenzae Rd
auugccauauaagcaaagaaa

SEQ ID NO: 2719557 - RNA, 16 nt, Haemophilus influenzae Rd
auugccauauucgcuu

SEQ ID NO: 2719558 - RNA, 16 nt, Haemophilus influenzae Rd
auugccauuucugcau

SEQ ID NO: 2719559 - RNA, 14 nt, Haemophilus influenzae Rd
auugccauuuuuca

SEQ ID NO: 2719560 - RNA, 21 nt, Haemophilus influenzae Rd
auugcccaauaaaaguaauuu

SEQ ID NO: 2719561 - RNA, 13 nt, Haemophilus influenzae Rd
auugcccucugca

SEQ ID NO: 2719562 - RNA, 18 nt, Haemophilus influenzae Rd
auugccgacacuaaaaag

SEQ ID NO: 2719563 - RNA, 18 nt, Haemophilus influenzae Rd
auugccgaccguguuuuu

SEQ ID NO: 2719564 - RNA, 21 nt, Haemophilus influenzae Rd
auugccgccaguaagaucuuc

SEQ ID NO: 2719565 - RNA, 20 nt, Haemophilus influenzae Rd
auugccuaauaaaaaauaaa

SEQ ID NO: 2719566 - RNA, 20 nt, Haemophilus influenzae Rd
auugccuaauagaaaaaugc

SEQ ID NO: 2719567 - RNA, 15 nt, Haemophilus influenzae Rd
auugccuucauauaa

SEQ ID NO: 2719568 - RNA, 19 nt, Haemophilus influenzae Rd
auugccuucauauaauaaa

SEQ ID NO: 2719569 - RNA, 19 nt, Haemophilus influenzae Rd
auugcgagucaaauuuuua

SEQ ID NO: 2719570 - RNA, 14 nt, Haemophilus influenzae Rd
auugcgcaauacgu

SEQ ID NO: 2719571 - RNA, 13 nt, Haemophilus influenzae Rd
auugcuacagcaa

SEQ ID NO: 2719572 - RNA, 17 nt, Haemophilus influenzae Rd
auugcuauggcaaugaa

SEQ ID NO: 2719573 - RNA, 14 nt, Haemophilus influenzae Rd
auugcuccacuucu

SEQ ID NO: 2719574 - RNA, 21 nt, Haemophilus influenzae Rd
auugcucgacaaagauuuucu

SEQ ID NO: 2719575 - RNA, 16 nt, Haemophilus influenzae Rd
auugcucguuauuauu

SEQ ID NO: 2719576 - RNA, 18 nt, Haemophilus influenzae Rd
auugcugcuuuaauuuca

SEQ ID NO: 2719577 - RNA, 19 nt, Haemophilus influenzae Rd
auugcugcuuuaauuucau

SEQ ID NO: 2719578 - RNA, 20 nt, Haemophilus influenzae Rd
auugcugcuuuaauuucauu

SEQ ID NO: 2719579 - RNA, 18 nt, Haemophilus influenzae Rd
auugcuguugguuuucca

SEQ ID NO: 2719580 - RNA, 15 nt, Haemophilus influenzae Rd
auugcuuaacauuaa

SEQ ID NO: 2719581 - RNA, 18 nt, Haemophilus influenzae Rd
auugcuuaugauuuagug

SEQ ID NO: 2719582 - RNA, 22 nt, Haemophilus influenzae Rd
auugcuuugagccguuauauuu

SEQ ID NO: 2719583 - RNA, 13 nt, Haemophilus influenzae Rd
auuggaaaaguaa

SEQ ID NO: 2719584 - RNA, 21 nt, Haemophilus influenzae Rd
auuggaaaaguaagaaacuug

SEQ ID NO: 2719585 - RNA, 15 nt, Haemophilus influenzae Rd
auuggaaaauaaaau

SEQ ID NO: 2719586 - RNA, 18 nt, Haemophilus influenzae Rd
auuggaaaauaaaaugac

SEQ ID NO: 2719587 - RNA, 14 nt, Haemophilus influenzae Rd
auuggaaaaugcuu

SEQ ID NO: 2719588 - RNA, 11 nt, Haemophilus influenzae Rd
auuggaaagua

SEQ ID NO: 2719589 - RNA, 19 nt, Haemophilus influenzae Rd
auuggaaauaauauucaaa

SEQ ID NO: 2719590 - RNA, 21 nt, Haemophilus influenzae Rd
auuggaaauaauauucaaaac

SEQ ID NO: 2719591 - RNA, 18 nt, Haemophilus influenzae Rd
auuggaacgauuaaaaau

SEQ ID NO: 2719592 - RNA, 20 nt, Haemophilus influenzae Rd
auuggaacgauuaaaaaugc

SEQ ID NO: 2719593 - RNA, 13 nt, Haemophilus influenzae Rd
auuggaagauuuc

SEQ ID NO: 2719594 - RNA, 16 nt, Haemophilus influenzae Rd
auuggacggcaaaaau

SEQ ID NO: 2719595 - RNA, 19 nt, Haemophilus influenzae Rd
auuggacugcauauucaua

SEQ ID NO: 2719596 - RNA, 10 nt, Haemophilus influenzae Rd
auuggauaaa

SEQ ID NO: 2719597 - RNA, 21 nt, Haemophilus influenzae Rd
auuggauaaauuauucugcaa

SEQ ID NO: 2719598 - RNA, 15 nt, Haemophilus influenzae Rd
auuggauuaaucaau

SEQ ID NO: 2719599 - RNA, 22 nt, Haemophilus influenzae Rd
auuggcgaaccuucacuuaaau

SEQ ID NO: 2719600 - RNA, 17 nt, Haemophilus influenzae Rd
auuggcgguuuugccaa

SEQ ID NO: 2719601 - RNA, 22 nt, Haemophilus influenzae Rd
auuggcuagagcuaauucugua

SEQ ID NO: 2719602 - RNA, 14 nt, Haemophilus influenzae Rd
auugggauuauuuu

SEQ ID NO: 2719603 - RNA, 20 nt, Haemophilus influenzae Rd
auugggauuauuuuuguggc

SEQ ID NO: 2719604 - RNA, 19 nt, Haemophilus influenzae Rd
auugggccacgagcgugaa

SEQ ID NO: 2719605 - RNA, 20 nt, Haemophilus influenzae Rd
auugggcguaauguuggauc

SEQ ID NO: 2719606 - RNA, 18 nt, Haemophilus influenzae Rd
auuggguuaauagcgaaa

SEQ ID NO: 2719607 - RNA, 13 nt, Haemophilus influenzae Rd
auugguaaaauuu

SEQ ID NO: 2719608 - RNA, 15 nt, Haemophilus influenzae Rd
auugguaaaauuucu

SEQ ID NO: 2719609 - RNA, 12 nt, Haemophilus influenzae Rd
auugguaacaac

SEQ ID NO: 2719610 - RNA, 20 nt, Haemophilus influenzae Rd
auugguaacaacugcuagga

SEQ ID NO: 2719611 - RNA, 16 nt, Haemophilus influenzae Rd
auugguacgagaaaaa

SEQ ID NO: 2719612 - RNA, 18 nt, Haemophilus influenzae Rd
auuggucacgauaagauc

SEQ ID NO: 2719613 - RNA, 14 nt, Haemophilus influenzae Rd
auuggugaaaggaa

SEQ ID NO: 2719614 - RNA, 15 nt, Haemophilus influenzae Rd
auuggugaaaucaac

SEQ ID NO: 2719615 - RNA, 17 nt, Haemophilus influenzae Rd
auuggugaaaucaacaa

SEQ ID NO: 2719616 - RNA, 15 nt, Haemophilus influenzae Rd
auugguguuuaaaug

SEQ ID NO: 2719617 - RNA, 18 nt, Haemophilus influenzae Rd
auugguuaauguaaacaa

SEQ ID NO: 2719618 - RNA, 16 nt, Haemophilus influenzae Rd
auugguucuaaauauu

SEQ ID NO: 2719619 - RNA, 18 nt, Haemophilus influenzae Rd
auugguucuaaauauuuu

SEQ ID NO: 2719620 - RNA, 19 nt, Haemophilus influenzae Rd
auugguuugcuuaaaagcu

SEQ ID NO: 2719621 - RNA, 12 nt, Haemophilus influenzae Rd
auugguuuugug

SEQ ID NO: 2719622 - RNA, 13 nt, Haemophilus influenzae Rd
auuguaaaagucc

SEQ ID NO: 2719623 - RNA, 14 nt, Haemophilus influenzae Rd
auuguaauuuugug

SEQ ID NO: 2719624 - RNA, 23 nt, Haemophilus influenzae Rd
auuguacuucuuacguuuaaauu

SEQ ID NO: 2719625 - RNA, 20 nt, Haemophilus influenzae Rd
auuguccacagcaaaagaaa

SEQ ID NO: 2719626 - RNA, 23 nt, Haemophilus influenzae Rd
auuguccuuuugccauuuugcua

SEQ ID NO: 2719627 - RNA, 15 nt, Haemophilus influenzae Rd
auugugaaauuucau

SEQ ID NO: 2719628 - RNA, 19 nt, Haemophilus influenzae Rd
auugugacggugaauuuau

SEQ ID NO: 2719629 - RNA, 18 nt, Haemophilus influenzae Rd
auugugagauaugaaaua

SEQ ID NO: 2719630 - RNA, 23 nt, Haemophilus influenzae Rd
auugugaguucaacgacaauuaa

SEQ ID NO: 2719631 - RNA, 23 nt, Haemophilus influenzae Rd
auugugauggggauuuuuuuguu

SEQ ID NO: 2719632 - RNA, 16 nt, Haemophilus influenzae Rd
auugugcaauuucguu

SEQ ID NO: 2719633 - RNA, 18 nt, Haemophilus influenzae Rd
auugugcauaguuugugc

SEQ ID NO: 2719634 - RNA, 11 nt, Haemophilus influenzae Rd
auugugccaaa

SEQ ID NO: 2719635 - RNA, 21 nt, Haemophilus influenzae Rd
auuguggcuuuugucgcuaac

SEQ ID NO: 2719636 - RNA, 17 nt, Haemophilus influenzae Rd
auugugggcuuuaagcu

SEQ ID NO: 2719637 - RNA, 19 nt, Haemophilus influenzae Rd
auugugguauugauucaau

SEQ ID NO: 2719638 - RNA, 14 nt, Haemophilus influenzae Rd
auugugucacauaa

SEQ ID NO: 2719639 - RNA, 16 nt, Haemophilus influenzae Rd
auugugucacauaauc

SEQ ID NO: 2719640 - RNA, 20 nt, Haemophilus influenzae Rd
auugugucacuagauuuucu

SEQ ID NO: 2719641 - RNA, 19 nt, Haemophilus influenzae Rd
auuguguguuuuaaaccac

SEQ ID NO: 2719642 - RNA, 17 nt, Haemophilus influenzae Rd
auuguuaaauaaauccu

SEQ ID NO: 2719643 - RNA, 18 nt, Haemophilus influenzae Rd
auuguuaaauaaauccuu

SEQ ID NO: 2719644 - RNA, 17 nt, Haemophilus influenzae Rd
auuguuaauuaucaaaa

SEQ ID NO: 2719645 - RNA, 14 nt, Haemophilus influenzae Rd
auuguuauagaaaa

SEQ ID NO: 2719646 - RNA, 18 nt, Haemophilus influenzae Rd
auuguuaucuaaauaauu

SEQ ID NO: 2719647 - RNA, 22 nt, Haemophilus influenzae Rd
auuguuccaauaggaaacuacu

SEQ ID NO: 2719648 - RNA, 19 nt, Haemophilus influenzae Rd
auuguucuaggcuuucacc

SEQ ID NO: 2719649 - RNA, 18 nt, Haemophilus influenzae Rd
auuguugcaccaauaauu

SEQ ID NO: 2719650 - RNA, 17 nt, Haemophilus influenzae Rd
auuguuucucaauaaau

SEQ ID NO: 2719651 - RNA, 18 nt, Haemophilus influenzae Rd
auuguuucucaauaaaua

SEQ ID NO: 2719652 - RNA, 13 nt, Haemophilus influenzae Rd
auuguuugaaauc

SEQ ID NO: 2719653 - RNA, 12 nt, Haemophilus influenzae Rd
auuguuugcuuu

SEQ ID NO: 2719654 - RNA, 14 nt, Haemophilus influenzae Rd
auuguuuguuuuau

SEQ ID NO: 2719655 - RNA, 23 nt, Haemophilus influenzae Rd
auuguuuguuuuauuuauucugc

SEQ ID NO: 2719656 - RNA, 23 nt, Haemophilus influenzae Rd
auuguuuucuuuauuaaacaaaa

SEQ ID NO: 2719657 - RNA, 11 nt, Haemophilus influenzae Rd
auuguuuuuuc

SEQ ID NO: 2719658 - RNA, 23 nt, Haemophilus influenzae Rd
auuuaaaaaaacguuaaauuuag

SEQ ID NO: 2719659 - RNA, 13 nt, Haemophilus influenzae Rd
auuuaaaaaauca

SEQ ID NO: 2719660 - RNA, 19 nt, Haemophilus influenzae Rd
auuuaaaaauauuaagcaa

SEQ ID NO: 2719661 - RNA, 17 nt, Haemophilus influenzae Rd
auuuaaaaaucugugau

SEQ ID NO: 2719662 - RNA, 12 nt, Haemophilus influenzae Rd
auuuaaaacaag

SEQ ID NO: 2719663 - RNA, 17 nt, Haemophilus influenzae Rd
auuuaaacggauuaaca

SEQ ID NO: 2719664 - RNA, 17 nt, Haemophilus influenzae Rd
auuuaaaggacuaaauu

SEQ ID NO: 2719665 - RNA, 21 nt, Haemophilus influenzae Rd
auuuaaagugguuuuagccau

SEQ ID NO: 2719666 - RNA, 21 nt, Haemophilus influenzae Rd
auuuaaauaaaacacaguuau

SEQ ID NO: 2719667 - RNA, 24 nt, Haemophilus influenzae Rd
auuuaaauaaaacacaguuauuuu

SEQ ID NO: 2719668 - RNA, 14 nt, Haemophilus influenzae Rd
auuuaaauaaaaua

SEQ ID NO: 2719669 - RNA, 12 nt, Haemophilus influenzae Rd
auuuaaauaaag

SEQ ID NO: 2719670 - RNA, 20 nt, Haemophilus influenzae Rd
auuuaaauaaggaucuugua

SEQ ID NO: 2719671 - RNA, 16 nt, Haemophilus influenzae Rd
auuuaaauaauaaauc

SEQ ID NO: 2719672 - RNA, 21 nt, Haemophilus influenzae Rd
auuuaaauagauccgcaauau

SEQ ID NO: 2719673 - RNA, 14 nt, Haemophilus influenzae Rd
auuuaaauauaauu

SEQ ID NO: 2719674 - RNA, 21 nt, Haemophilus influenzae Rd
auuuaaauauaauuuagcauc

SEQ ID NO: 2719675 - RNA, 19 nt, Haemophilus influenzae Rd
auuuaaaucuauagauaac

SEQ ID NO: 2719676 - RNA, 12 nt, Haemophilus influenzae Rd
auuuaaauuagc

SEQ ID NO: 2719677 - RNA, 14 nt, Haemophilus influenzae Rd
auuuaaauugaaaa

SEQ ID NO: 2719678 - RNA, 12 nt, Haemophilus influenzae Rd
auuuaacaaguu

SEQ ID NO: 2719679 - RNA, 18 nt, Haemophilus influenzae Rd
auuuaacaaguuuagauu

SEQ ID NO: 2719680 - RNA, 12 nt, Haemophilus influenzae Rd
auuuaacaauaa

SEQ ID NO: 2719681 - RNA, 16 nt, Haemophilus influenzae Rd
auuuaacacuuuuucu

SEQ ID NO: 2719682 - RNA, 19 nt, Haemophilus influenzae Rd
auuuaacauaacuuuccau

SEQ ID NO: 2719683 - RNA, 13 nt, Haemophilus influenzae Rd
auuuaacauaauu

SEQ ID NO: 2719684 - RNA, 19 nt, Haemophilus influenzae Rd
auuuaacauaauuuauauu

SEQ ID NO: 2719685 - RNA, 15 nt, Haemophilus influenzae Rd
auuuaacaucaugaa

SEQ ID NO: 2719686 - RNA, 17 nt, Haemophilus influenzae Rd
auuuaaccccugaauuu

SEQ ID NO: 2719687 - RNA, 19 nt, Haemophilus influenzae Rd
auuuaaccguaauuucaaa

SEQ ID NO: 2719688 - RNA, 21 nt, Haemophilus influenzae Rd
auuuaacucggcuuuuucaau

SEQ ID NO: 2719689 - RNA, 19 nt, Haemophilus influenzae Rd
auuuaacuguaucuacuuu

SEQ ID NO: 2719690 - RNA, 15 nt, Haemophilus influenzae Rd
auuuaagcauccauc

SEQ ID NO: 2719691 - RNA, 15 nt, Haemophilus influenzae Rd
auuuaagccagaaca

SEQ ID NO: 2719692 - RNA, 21 nt, Haemophilus influenzae Rd
auuuaagcuauuguuauagaa

SEQ ID NO: 2719693 - RNA, 19 nt, Haemophilus influenzae Rd
auuuaaguaaugcuaaaua

SEQ ID NO: 2719694 - RNA, 21 nt, Haemophilus influenzae Rd
auuuaaguaaugcuaaauaua

SEQ ID NO: 2719695 - RNA, 19 nt, Haemophilus influenzae Rd
auuuaauaaaacaaaugua

SEQ ID NO: 2719696 - RNA, 13 nt, Haemophilus influenzae Rd
auuuaauaaaaug

SEQ ID NO: 2719697 - RNA, 16 nt, Haemophilus influenzae Rd
auuuaauaagaauuuu

SEQ ID NO: 2719698 - RNA, 16 nt, Haemophilus influenzae Rd
auuuaauaagauuuuu

SEQ ID NO: 2719699 - RNA, 19 nt, Haemophilus influenzae Rd
auuuaauaagauuuuuaac

SEQ ID NO: 2719700 - RNA, 19 nt, Haemophilus influenzae Rd
auuuaauaaggcaaaaccg

SEQ ID NO: 2719701 - RNA, 21 nt, Haemophilus influenzae Rd
auuuaauaauaucaaucacuu

SEQ ID NO: 2719702 - RNA, 14 nt, Haemophilus influenzae Rd
auuuaauaauuuaa

SEQ ID NO: 2719703 - RNA, 14 nt, Haemophilus influenzae Rd
auuuaauaauuuag

SEQ ID NO: 2719704 - RNA, 19 nt, Haemophilus influenzae Rd
auuuaauaccauacauaaa

SEQ ID NO: 2719705 - RNA, 12 nt, Haemophilus influenzae Rd
auuuaauagcac

SEQ ID NO: 2719706 - RNA, 13 nt, Haemophilus influenzae Rd
auuuaauaucuuc

SEQ ID NO: 2719707 - RNA, 23 nt, Haemophilus influenzae Rd
auuuaauaucuucuaauaaaaua

SEQ ID NO: 2719708 - RNA, 21 nt, Haemophilus influenzae Rd
auuuaauauuucuucauuuua

SEQ ID NO: 2719709 - RNA, 22 nt, Haemophilus influenzae Rd
auuuaauccaauccauaacaac

SEQ ID NO: 2719710 - RNA, 17 nt, Haemophilus influenzae Rd
auuuaauccugucaucu

SEQ ID NO: 2719711 - RNA, 16 nt, Haemophilus influenzae Rd
auuuaaugaugaaacu

SEQ ID NO: 2719712 - RNA, 19 nt, Haemophilus influenzae Rd
auuuaauggcugaaugcuu

SEQ ID NO: 2719713 - RNA, 20 nt, Haemophilus influenzae Rd
auuuaauuaggauguaaaaa

SEQ ID NO: 2719714 - RNA, 17 nt, Haemophilus influenzae Rd
auuuaauuauguauuuu

SEQ ID NO: 2719715 - RNA, 16 nt, Haemophilus influenzae Rd
auuuaauucacgaaug

SEQ ID NO: 2719716 - RNA, 13 nt, Haemophilus influenzae Rd
auuuaauuucaaa

SEQ ID NO: 2719717 - RNA, 16 nt, Haemophilus influenzae Rd
auuuaauuucaaaauc

SEQ ID NO: 2719718 - RNA, 20 nt, Haemophilus influenzae Rd
auuuaauuucaaaaucacau

SEQ ID NO: 2719719 - RNA, 16 nt, Haemophilus influenzae Rd
auuuaauuuuuuauag

SEQ ID NO: 2719720 - RNA, 18 nt, Haemophilus influenzae Rd
auuuaauuuuuuauagug

SEQ ID NO: 2719721 - RNA, 15 nt, Haemophilus influenzae Rd
auuuacaaacauauu

SEQ ID NO: 2719722 - RNA, 15 nt, Haemophilus influenzae Rd
auuuacacauugcca

SEQ ID NO: 2719723 - RNA, 13 nt, Haemophilus influenzae Rd
auuuacagaacaa

SEQ ID NO: 2719724 - RNA, 14 nt, Haemophilus influenzae Rd
auuuacagaacaaa

SEQ ID NO: 2719725 - RNA, 19 nt, Haemophilus influenzae Rd
auuuacauuaauuuuuccg

SEQ ID NO: 2719726 - RNA, 24 nt, Haemophilus influenzae Rd
auuuaccaauaggaagcauuucua

SEQ ID NO: 2719727 - RNA, 14 nt, Haemophilus influenzae Rd
auuuacccaaauua

SEQ ID NO: 2719728 - RNA, 16 nt, Haemophilus influenzae Rd
auuuacccacuucaua

SEQ ID NO: 2719729 - RNA, 17 nt, Haemophilus influenzae Rd
auuuaccgcacuuuaau

SEQ ID NO: 2719730 - RNA, 20 nt, Haemophilus influenzae Rd
auuuaccgcacuuugauuuu

SEQ ID NO: 2719731 - RNA, 16 nt, Haemophilus influenzae Rd
auuuaccgcacuuuuc

SEQ ID NO: 2719732 - RNA, 16 nt, Haemophilus influenzae Rd
auuuaccgcuuucaau

SEQ ID NO: 2719733 - RNA, 17 nt, Haemophilus influenzae Rd
auuuaccgcuuucaauu

SEQ ID NO: 2719734 - RNA, 23 nt, Haemophilus influenzae Rd
auuuaccgcuuucaauuaaugaa

SEQ ID NO: 2719735 - RNA, 14 nt, Haemophilus influenzae Rd
auuuacgaaaacuu

SEQ ID NO: 2719736 - RNA, 19 nt, Haemophilus influenzae Rd
auuuacgaaaacuuucauu

SEQ ID NO: 2719737 - RNA, 23 nt, Haemophilus influenzae Rd
auuuacgaaaacuuucauuccug

SEQ ID NO: 2719738 - RNA, 21 nt, Haemophilus influenzae Rd
auuuacgcaaccaucuuuaau

SEQ ID NO: 2719739 - RNA, 17 nt, Haemophilus influenzae Rd
auuuacggcuuagauaa

SEQ ID NO: 2719740 - RNA, 21 nt, Haemophilus influenzae Rd
auuuacucacaacaaagaugg

SEQ ID NO: 2719741 - RNA, 23 nt, Haemophilus influenzae Rd
auuuacucacaacaaagauggau

SEQ ID NO: 2719742 - RNA, 16 nt, Haemophilus influenzae Rd
auuuacucuuuuuuag

SEQ ID NO: 2719743 - RNA, 19 nt, Haemophilus influenzae Rd
auuuacugauuuaaaaaaa

SEQ ID NO: 2719744 - RNA, 16 nt, Haemophilus influenzae Rd
auuuacugauuuuaag

SEQ ID NO: 2719745 - RNA, 19 nt, Haemophilus influenzae Rd
auuuacuggaaauucuuca

SEQ ID NO: 2719746 - RNA, 20 nt, Haemophilus influenzae Rd
auuuacuggaaauucuucaa

SEQ ID NO: 2719747 - RNA, 23 nt, Haemophilus influenzae Rd
auuuacuggaaauucuucaauaa

SEQ ID NO: 2719748 - RNA, 14 nt, Haemophilus influenzae Rd
auuuacuuuauaaa

SEQ ID NO: 2719749 - RNA, 13 nt, Haemophilus influenzae Rd
auuuagaaaguau

SEQ ID NO: 2719750 - RNA, 16 nt, Haemophilus influenzae Rd
auuuagaacaauauuu

SEQ ID NO: 2719751 - RNA, 11 nt, Haemophilus influenzae Rd
auuuagaauuu

SEQ ID NO: 2719752 - RNA, 20 nt, Haemophilus influenzae Rd
auuuagaauuuuuauuuuua

SEQ ID NO: 2719753 - RNA, 18 nt, Haemophilus influenzae Rd
auuuagacggugaaaauu

SEQ ID NO: 2719754 - RNA, 18 nt, Haemophilus influenzae Rd
auuuagagcaagcaauau

SEQ ID NO: 2719755 - RNA, 17 nt, Haemophilus influenzae Rd
auuuagagggauaaaaa

SEQ ID NO: 2719756 - RNA, 18 nt, Haemophilus influenzae Rd
auuuagagggauaaaaau

SEQ ID NO: 2719757 - RNA, 19 nt, Haemophilus influenzae Rd
auuuagagggauaaaaauc

SEQ ID NO: 2719758 - RNA, 11 nt, Haemophilus influenzae Rd
auuuagauaaa

SEQ ID NO: 2719759 - RNA, 21 nt, Haemophilus influenzae Rd
auuuagauacaaagauuucau

SEQ ID NO: 2719760 - RNA, 16 nt, Haemophilus influenzae Rd
auuuagccaguaauuu

SEQ ID NO: 2719761 - RNA, 14 nt, Haemophilus influenzae Rd
auuuagcguauuuu

SEQ ID NO: 2719762 - RNA, 19 nt, Haemophilus influenzae Rd
auuuagcgucgguaauauc

SEQ ID NO: 2719763 - RNA, 18 nt, Haemophilus influenzae Rd
auuuaggcuauuuuauaa

SEQ ID NO: 2719764 - RNA, 17 nt, Haemophilus influenzae Rd
auuuagggaaaauuuua

SEQ ID NO: 2719765 - RNA, 16 nt, Haemophilus influenzae Rd
auuuaguccuaaaaaa

SEQ ID NO: 2719766 - RNA, 18 nt, Haemophilus influenzae Rd
auuuaguccuaaaaaauc

SEQ ID NO: 2719767 - RNA, 17 nt, Haemophilus influenzae Rd
auuuaguccuuaaacaa

SEQ ID NO: 2719768 - RNA, 14 nt, Haemophilus influenzae Rd
auuuaguccuuaau

SEQ ID NO: 2719769 - RNA, 15 nt, Haemophilus influenzae Rd
auuuaguccuuaauu

SEQ ID NO: 2719770 - RNA, 14 nt, Haemophilus influenzae Rd
auuuaguccuucug

SEQ ID NO: 2719771 - RNA, 23 nt, Haemophilus influenzae Rd
auuuaguccuucugcgauuucau

SEQ ID NO: 2719772 - RNA, 18 nt, Haemophilus influenzae Rd
auuuaguccuuuagaaaa

SEQ ID NO: 2719773 - RNA, 14 nt, Haemophilus influenzae Rd
auuuagugauuucu

SEQ ID NO: 2719774 - RNA, 16 nt, Haemophilus influenzae Rd
auuuagugauuucuau

SEQ ID NO: 2719775 - RNA, 17 nt, Haemophilus influenzae Rd
auuuaguuaauauauuc

SEQ ID NO: 2719776 - RNA, 19 nt, Haemophilus influenzae Rd
auuuaguuggguauucacu

SEQ ID NO: 2719777 - RNA, 21 nt, Haemophilus influenzae Rd
auuuaguuggguauucacuua

SEQ ID NO: 2719778 - RNA, 12 nt, Haemophilus influenzae Rd
auuuaguuuaac

SEQ ID NO: 2719779 - RNA, 14 nt, Haemophilus influenzae Rd
auuuauaaguaauc

SEQ ID NO: 2719780 - RNA, 18 nt, Haemophilus influenzae Rd
auuuauaccguuuuuuca

SEQ ID NO: 2719781 - RNA, 19 nt, Haemophilus influenzae Rd
auuuauaccguuuuuucac

SEQ ID NO: 2719782 - RNA, 18 nt, Haemophilus influenzae Rd
auuuauacgcauaauaaa

SEQ ID NO: 2719783 - RNA, 23 nt, Haemophilus influenzae Rd
auuuauacgugaaccaacccaau

SEQ ID NO: 2719784 - RNA, 16 nt, Haemophilus influenzae Rd
auuuauacuaaauuag

SEQ ID NO: 2719785 - RNA, 14 nt, Haemophilus influenzae Rd
auuuauaguuuaaa

SEQ ID NO: 2719786 - RNA, 16 nt, Haemophilus influenzae Rd
auuuauauaugauaaa

SEQ ID NO: 2719787 - RNA, 22 nt, Haemophilus influenzae Rd
auuuaucaaacaagcccacauu

SEQ ID NO: 2719788 - RNA, 17 nt, Haemophilus influenzae Rd
auuuaucauuccccagc

SEQ ID NO: 2719789 - RNA, 14 nt, Haemophilus influenzae Rd
auuuaucauuuaac

SEQ ID NO: 2719790 - RNA, 13 nt, Haemophilus influenzae Rd
auuuauccaugac

SEQ ID NO: 2719791 - RNA, 18 nt, Haemophilus influenzae Rd
auuuaucgccauagaaaa

SEQ ID NO: 2719792 - RNA, 22 nt, Haemophilus influenzae Rd
auuuaucgccauagaaaauaga

SEQ ID NO: 2719793 - RNA, 23 nt, Haemophilus influenzae Rd
auuuaucgccauagaaaauagaa

SEQ ID NO: 2719794 - RNA, 17 nt, Haemophilus influenzae Rd
auuuaucgggaauaaua

SEQ ID NO: 2719795 - RNA, 19 nt, Haemophilus influenzae Rd
auuuaucgggaauaauauc

SEQ ID NO: 2719796 - RNA, 13 nt, Haemophilus influenzae Rd
auuuaucuaaaag

SEQ ID NO: 2719797 - RNA, 15 nt, Haemophilus influenzae Rd
auuuaucuaaaagua

SEQ ID NO: 2719798 - RNA, 18 nt, Haemophilus influenzae Rd
auuuaucuaaaaguaauc

SEQ ID NO: 2719799 - RNA, 21 nt, Haemophilus influenzae Rd
auuuaucugcuuuaauucgug

SEQ ID NO: 2719800 - RNA, 13 nt, Haemophilus influenzae Rd
auuuaucuucccc

SEQ ID NO: 2719801 - RNA, 17 nt, Haemophilus influenzae Rd
auuuaugaucuucaauc

SEQ ID NO: 2719802 - RNA, 18 nt, Haemophilus influenzae Rd
auuuaugcuguuuuauag

SEQ ID NO: 2719803 - RNA, 19 nt, Haemophilus influenzae Rd
auuuauggaaauaaauccu

SEQ ID NO: 2719804 - RNA, 18 nt, Haemophilus influenzae Rd
auuuauguugaauuuuca

SEQ ID NO: 2719805 - RNA, 12 nt, Haemophilus influenzae Rd
auuuauuaaaaa

SEQ ID NO: 2719806 - RNA, 20 nt, Haemophilus influenzae Rd
auuuauuauaaaaauauuuu

SEQ ID NO: 2719807 - RNA, 23 nt, Haemophilus influenzae Rd
auuuauuauaaaaauauuuuaau

SEQ ID NO: 2719808 - RNA, 13 nt, Haemophilus influenzae Rd
auuuauuauauaa

SEQ ID NO: 2719809 - RNA, 14 nt, Haemophilus influenzae Rd
auuuauuauauaaa

SEQ ID NO: 2719810 - RNA, 16 nt, Haemophilus influenzae Rd
auuuauuauauaaaaa

SEQ ID NO: 2719811 - RNA, 17 nt, Haemophilus influenzae Rd
auuuauuauauaaaaaa

SEQ ID NO: 2719812 - RNA, 13 nt, Haemophilus influenzae Rd
auuuauucaaaau

SEQ ID NO: 2719813 - RNA, 20 nt, Haemophilus influenzae Rd
auuuauucaaaauaaaacca

SEQ ID NO: 2719814 - RNA, 16 nt, Haemophilus influenzae Rd
auuuauuccaucaaua

SEQ ID NO: 2719815 - RNA, 18 nt, Haemophilus influenzae Rd
auuuauuccaucaauacc

SEQ ID NO: 2719816 - RNA, 19 nt, Haemophilus influenzae Rd
auuuauuccaucaauaccu

SEQ ID NO: 2719817 - RNA, 18 nt, Haemophilus influenzae Rd
auuuauuccugcuuuuuu

SEQ ID NO: 2719818 - RNA, 16 nt, Haemophilus influenzae Rd
auuuauuccuucaauc

SEQ ID NO: 2719819 - RNA, 21 nt, Haemophilus influenzae Rd
auuuauuccuuuauuuugcaa

SEQ ID NO: 2719820 - RNA, 21 nt, Haemophilus influenzae Rd
auuuauuguagccuaguauuu

SEQ ID NO: 2719821 - RNA, 18 nt, Haemophilus influenzae Rd
auuuauuuaacaaugaaa

SEQ ID NO: 2719822 - RNA, 19 nt, Haemophilus influenzae Rd
auuuauuuaacaaugaaau

SEQ ID NO: 2719823 - RNA, 22 nt, Haemophilus influenzae Rd
auuuauuuacugauuuaaaaaa

SEQ ID NO: 2719824 - RNA, 16 nt, Haemophilus influenzae Rd
auuuauuuauuuuaau

SEQ ID NO: 2719825 - RNA, 19 nt, Haemophilus influenzae Rd
auuuauuucaauauaauca

SEQ ID NO: 2719826 - RNA, 14 nt, Haemophilus influenzae Rd
auuuauuucaucaa

SEQ ID NO: 2719827 - RNA, 17 nt, Haemophilus influenzae Rd
auuuauuuccauaaaug

SEQ ID NO: 2719828 - RNA, 15 nt, Haemophilus influenzae Rd
auuuauuugaaacaa

SEQ ID NO: 2719829 - RNA, 22 nt, Haemophilus influenzae Rd
auuuauuuucaccugaagaaua

SEQ ID NO: 2719830 - RNA, 12 nt, Haemophilus influenzae Rd
auuuauuuugaa

SEQ ID NO: 2719831 - RNA, 22 nt, Haemophilus influenzae Rd
auuuauuuugguauuuuugugg

SEQ ID NO: 2719832 - RNA, 17 nt, Haemophilus influenzae Rd
auuucaaaacaguuuuc

SEQ ID NO: 2719833 - RNA, 18 nt, Haemophilus influenzae Rd
auuucaaaacaguuuuca

SEQ ID NO: 2719834 - RNA, 13 nt, Haemophilus influenzae Rd
auuucaaaaucac

SEQ ID NO: 2719835 - RNA, 15 nt, Haemophilus influenzae Rd
auuucaaaaucacau

SEQ ID NO: 2719836 - RNA, 14 nt, Haemophilus influenzae Rd
auuucaacuauuuu

SEQ ID NO: 2719837 - RNA, 13 nt, Haemophilus influenzae Rd
auuucaauaaauu

SEQ ID NO: 2719838 - RNA, 23 nt, Haemophilus influenzae Rd
auuucaauaucuaagaaaauaga

SEQ ID NO: 2719839 - RNA, 12 nt, Haemophilus influenzae Rd
auuucaaucacu

SEQ ID NO: 2719840 - RNA, 20 nt, Haemophilus influenzae Rd
auuucaaucacugaauaaug

SEQ ID NO: 2719841 - RNA, 16 nt, Haemophilus influenzae Rd
auuucaauuuaagccc

SEQ ID NO: 2719842 - RNA, 19 nt, Haemophilus influenzae Rd
auuucaauuuaagcccugc

SEQ ID NO: 2719843 - RNA, 15 nt, Haemophilus influenzae Rd
auuucacaauuuuug

SEQ ID NO: 2719844 - RNA, 14 nt, Haemophilus influenzae Rd
auuucacaccauuu

SEQ ID NO: 2719845 - RNA, 15 nt, Haemophilus influenzae Rd
auuucacaccauuuu

SEQ ID NO: 2719846 - RNA, 21 nt, Haemophilus influenzae Rd
auuucacauuaugauauuuca

SEQ ID NO: 2719847 - RNA, 21 nt, Haemophilus influenzae Rd
auuucaccgcacuuuuuuaug

SEQ ID NO: 2719848 - RNA, 18 nt, Haemophilus influenzae Rd
auuucaccgcagaaguaa

SEQ ID NO: 2719849 - RNA, 22 nt, Haemophilus influenzae Rd
auuucaccguauuuuuuauuac

SEQ ID NO: 2719850 - RNA, 19 nt, Haemophilus influenzae Rd
auuucacgcccaaauacuu

SEQ ID NO: 2719851 - RNA, 21 nt, Haemophilus influenzae Rd
auuucacuggcucauuauuca

SEQ ID NO: 2719852 - RNA, 15 nt, Haemophilus influenzae Rd
auuucacuuuacauu

SEQ ID NO: 2719853 - RNA, 19 nt, Haemophilus influenzae Rd
auuucacuuuguuuuacuu

SEQ ID NO: 2719854 - RNA, 18 nt, Haemophilus influenzae Rd
auuucagacaaaacuuau

SEQ ID NO: 2719855 - RNA, 19 nt, Haemophilus influenzae Rd
auuucagcaucagaaauac

SEQ ID NO: 2719856 - RNA, 13 nt, Haemophilus influenzae Rd
auuucaguauuuu

SEQ ID NO: 2719857 - RNA, 21 nt, Haemophilus influenzae Rd
auuucaguuacguaauauuua

SEQ ID NO: 2719858 - RNA, 13 nt, Haemophilus influenzae Rd
auuucaguuuaag

SEQ ID NO: 2719859 - RNA, 21 nt, Haemophilus influenzae Rd
  misc_feature (7)..(7): n is a, c, g or u
auuucanagagguuuccuuau

SEQ ID NO: 2719860 - RNA, 13 nt, Haemophilus influenzae Rd
auuucauaaaaau

SEQ ID NO: 2719861 - RNA, 14 nt, Haemophilus influenzae Rd
auuucauaguuuuc

SEQ ID NO: 2719862 - RNA, 13 nt, Haemophilus influenzae Rd
auuucauaucuau

SEQ ID NO: 2719863 - RNA, 14 nt, Haemophilus influenzae Rd
auuucauaucuucu

SEQ ID NO: 2719864 - RNA, 14 nt, Haemophilus influenzae Rd
auuucaucacauca

SEQ ID NO: 2719865 - RNA, 17 nt, Haemophilus influenzae Rd
auuucaucccagauuuu

SEQ ID NO: 2719866 - RNA, 11 nt, Haemophilus influenzae Rd
auuucaucgcg

SEQ ID NO: 2719867 - RNA, 17 nt, Haemophilus influenzae Rd
auuucaucgcguuuuuu

SEQ ID NO: 2719868 - RNA, 16 nt, Haemophilus influenzae Rd
auuucaucuacaccaa

SEQ ID NO: 2719869 - RNA, 16 nt, Haemophilus influenzae Rd
auuucaucuguuggaa

SEQ ID NO: 2719870 - RNA, 15 nt, Haemophilus influenzae Rd
auuucaucuucagua

SEQ ID NO: 2719871 - RNA, 19 nt, Haemophilus influenzae Rd
auuucaugguuucaaccau

SEQ ID NO: 2719872 - RNA, 18 nt, Haemophilus influenzae Rd
auuucauucaaaaauaaa

SEQ ID NO: 2719873 - RNA, 21 nt, Haemophilus influenzae Rd
auuucauuggcgguuuugcca

SEQ ID NO: 2719874 - RNA, 22 nt, Haemophilus influenzae Rd
auuucauuggcgguuuugccaa

SEQ ID NO: 2719875 - RNA, 19 nt, Haemophilus influenzae Rd
auuucauuguuaaauaaau

SEQ ID NO: 2719876 - RNA, 22 nt, Haemophilus influenzae Rd
auuucauuguuaaauaaauccu

SEQ ID NO: 2719877 - RNA, 23 nt, Haemophilus influenzae Rd
auuucauuugcacccgcuuuaau

SEQ ID NO: 2719878 - RNA, 19 nt, Haemophilus influenzae Rd
auuucauuugcgccaauaa

SEQ ID NO: 2719879 - RNA, 12 nt, Haemophilus influenzae Rd
auuucauuuucu

SEQ ID NO: 2719880 - RNA, 14 nt, Haemophilus influenzae Rd
auuucauuuucuaa

SEQ ID NO: 2719881 - RNA, 17 nt, Haemophilus influenzae Rd
auuuccaacacauuauc

SEQ ID NO: 2719882 - RNA, 18 nt, Haemophilus influenzae Rd
auuuccaacacauuauca

SEQ ID NO: 2719883 - RNA, 19 nt, Haemophilus influenzae Rd
auuuccaagcguaaaagua

SEQ ID NO: 2719884 - RNA, 21 nt, Haemophilus influenzae Rd
auuuccauaugaccauuaauc

SEQ ID NO: 2719885 - RNA, 18 nt, Haemophilus influenzae Rd
auuuccaucaaaagauca

SEQ ID NO: 2719886 - RNA, 12 nt, Haemophilus influenzae Rd
auuuccauucua

SEQ ID NO: 2719887 - RNA, 18 nt, Haemophilus influenzae Rd
auuucccauaauccagca

SEQ ID NO: 2719888 - RNA, 17 nt, Haemophilus influenzae Rd
auuucccuaaaaucuuc

SEQ ID NO: 2719889 - RNA, 20 nt, Haemophilus influenzae Rd
auuuccuauacuaauuuuag

SEQ ID NO: 2719890 - RNA, 13 nt, Haemophilus influenzae Rd
auuuccuauuuac

SEQ ID NO: 2719891 - RNA, 20 nt, Haemophilus influenzae Rd
auuuccucuucuuagauaga

SEQ ID NO: 2719892 - RNA, 15 nt, Haemophilus influenzae Rd
auuuccugagaauuu

SEQ ID NO: 2719893 - RNA, 18 nt, Haemophilus influenzae Rd
auuuccuguauaauuuuu

SEQ ID NO: 2719894 - RNA, 11 nt, Haemophilus influenzae Rd
auuuccuuuuu

SEQ ID NO: 2719895 - RNA, 22 nt, Haemophilus influenzae Rd
auuucgcccuuauacaaaacua

SEQ ID NO: 2719896 - RNA, 19 nt, Haemophilus influenzae Rd
auuucgccgccuuugauuu

SEQ ID NO: 2719897 - RNA, 19 nt, Haemophilus influenzae Rd
auuucgcucaauaauuuuc

SEQ ID NO: 2719898 - RNA, 21 nt, Haemophilus influenzae Rd
auuucggaugacggaauacau

SEQ ID NO: 2719899 - RNA, 14 nt, Haemophilus influenzae Rd
auuucgucaaaaau

SEQ ID NO: 2719900 - RNA, 16 nt, Haemophilus influenzae Rd
auuucgugcaauaaca

SEQ ID NO: 2719901 - RNA, 12 nt, Haemophilus influenzae Rd
auuucuaaaaua

SEQ ID NO: 2719902 - RNA, 23 nt, Haemophilus influenzae Rd
auuucuaaaauaauaucacaacc

SEQ ID NO: 2719903 - RNA, 20 nt, Haemophilus influenzae Rd
auuucuaaaggcaauuccca

SEQ ID NO: 2719904 - RNA, 22 nt, Haemophilus influenzae Rd
auuucuaaccgcacucuuucaa

SEQ ID NO: 2719905 - RNA, 19 nt, Haemophilus influenzae Rd
auuucuaaugcaauuucaa

SEQ ID NO: 2719906 - RNA, 22 nt, Haemophilus influenzae Rd
auuucuacuaugaggauuuuca

SEQ ID NO: 2719907 - RNA, 22 nt, Haemophilus influenzae Rd
auuucuagcaacgacacacuau

SEQ ID NO: 2719908 - RNA, 20 nt, Haemophilus influenzae Rd
auuucuaggcuauauuuuua

SEQ ID NO: 2719909 - RNA, 13 nt, Haemophilus influenzae Rd
auuucuaucacga

SEQ ID NO: 2719910 - RNA, 15 nt, Haemophilus influenzae Rd
auuucuaucgcauuu

SEQ ID NO: 2719911 - RNA, 18 nt, Haemophilus influenzae Rd
auuucucgggcugaaaua

SEQ ID NO: 2719912 - RNA, 17 nt, Haemophilus influenzae Rd
auuucucucauuuuuua

SEQ ID NO: 2719913 - RNA, 20 nt, Haemophilus influenzae Rd
auuucugacgcauugcaggg

SEQ ID NO: 2719914 - RNA, 10 nt, Haemophilus influenzae Rd
auuucugcaa

SEQ ID NO: 2719915 - RNA, 20 nt, Haemophilus influenzae Rd
auuucugcugccauaaugga

SEQ ID NO: 2719916 - RNA, 14 nt, Haemophilus influenzae Rd
auuucuuagauuuc

SEQ ID NO: 2719917 - RNA, 14 nt, Haemophilus influenzae Rd
auuucuuaugaaaa

SEQ ID NO: 2719918 - RNA, 14 nt, Haemophilus influenzae Rd
auuucuucaacuaa

SEQ ID NO: 2719919 - RNA, 20 nt, Haemophilus influenzae Rd
auuucuucagcuuguuuaau

SEQ ID NO: 2719920 - RNA, 18 nt, Haemophilus influenzae Rd
auuucuucauuuuaaauu

SEQ ID NO: 2719921 - RNA, 17 nt, Haemophilus influenzae Rd
auuucuucgauuuuucu

SEQ ID NO: 2719922 - RNA, 22 nt, Haemophilus influenzae Rd
auuucuucgauuuuucuaaaau

SEQ ID NO: 2719923 - RNA, 19 nt, Haemophilus influenzae Rd
auuucuucuaguuuuccuu

SEQ ID NO: 2719924 - RNA, 13 nt, Haemophilus influenzae Rd
auuucuucugaua

SEQ ID NO: 2719925 - RNA, 22 nt, Haemophilus influenzae Rd
auuucuugaccuuucaauaauu

SEQ ID NO: 2719926 - RNA, 16 nt, Haemophilus influenzae Rd
auuucuugcuaaaaua

SEQ ID NO: 2719927 - RNA, 21 nt, Haemophilus influenzae Rd
auuucuugcuaaaauaucuug

SEQ ID NO: 2719928 - RNA, 16 nt, Haemophilus influenzae Rd
auuucuuguuuaaauu

SEQ ID NO: 2719929 - RNA, 18 nt, Haemophilus influenzae Rd
auuucuuguuuaaauuca

SEQ ID NO: 2719930 - RNA, 20 nt, Haemophilus influenzae Rd
auuucuuuaauugauuaaaa

SEQ ID NO: 2719931 - RNA, 18 nt, Haemophilus influenzae Rd
auuucuuuacaaauuucg

SEQ ID NO: 2719932 - RNA, 20 nt, Haemophilus influenzae Rd
auuucuuucgccaguuuaga

SEQ ID NO: 2719933 - RNA, 22 nt, Haemophilus influenzae Rd
auuucuuucguucaacccauuu

SEQ ID NO: 2719934 - RNA, 18 nt, Haemophilus influenzae Rd
auuucuuugaguaaaaaa

SEQ ID NO: 2719935 - RNA, 22 nt, Haemophilus influenzae Rd
auuucuuuucaaacacaaaaua

SEQ ID NO: 2719936 - RNA, 13 nt, Haemophilus influenzae Rd
auuucuuuuuuau

SEQ ID NO: 2719937 - RNA, 22 nt, Haemophilus influenzae Rd
auuugaaacaauaaaacuuuau

SEQ ID NO: 2719938 - RNA, 20 nt, Haemophilus influenzae Rd
auuugaacaaacgccauucu

SEQ ID NO: 2719939 - RNA, 22 nt, Haemophilus influenzae Rd
auuugaacaauuaacgcauugu

SEQ ID NO: 2719940 - RNA, 21 nt, Haemophilus influenzae Rd
auuugaaucaauuagaugacu

SEQ ID NO: 2719941 - RNA, 20 nt, Haemophilus influenzae Rd
auuugaaucucacguacuuu

SEQ ID NO: 2719942 - RNA, 14 nt, Haemophilus influenzae Rd
auuugaauguaaaa

SEQ ID NO: 2719943 - RNA, 15 nt, Haemophilus influenzae Rd
auuugaauguaaaaa

SEQ ID NO: 2719944 - RNA, 17 nt, Haemophilus influenzae Rd
auuugaauguaaaaaua

SEQ ID NO: 2719945 - RNA, 18 nt, Haemophilus influenzae Rd
auuugaauguaaaaauaa

SEQ ID NO: 2719946 - RNA, 15 nt, Haemophilus influenzae Rd
auuugaauuuuacuu

SEQ ID NO: 2719947 - RNA, 16 nt, Haemophilus influenzae Rd
auuugacgaaauaaau

SEQ ID NO: 2719948 - RNA, 20 nt, Haemophilus influenzae Rd
auuugacgauuaauaccaau

SEQ ID NO: 2719949 - RNA, 15 nt, Haemophilus influenzae Rd
auuugagcaagauga

SEQ ID NO: 2719950 - RNA, 21 nt, Haemophilus influenzae Rd
auuugagucucaaauuuuuca

SEQ ID NO: 2719951 - RNA, 14 nt, Haemophilus influenzae Rd
auuugaguuauuuu

SEQ ID NO: 2719952 - RNA, 18 nt, Haemophilus influenzae Rd
auuugauaagaacggcga

SEQ ID NO: 2719953 - RNA, 19 nt, Haemophilus influenzae Rd
auuugauacucuucaaguu

SEQ ID NO: 2719954 - RNA, 20 nt, Haemophilus influenzae Rd
auuugaucuucccagaaugg

SEQ ID NO: 2719955 - RNA, 15 nt, Haemophilus influenzae Rd
auuugaugcucagaa

SEQ ID NO: 2719956 - RNA, 14 nt, Haemophilus influenzae Rd
auuugauuguugcu

SEQ ID NO: 2719957 - RNA, 20 nt, Haemophilus influenzae Rd
auuugauuucagaacaugac

SEQ ID NO: 2719958 - RNA, 20 nt, Haemophilus influenzae Rd
auuugcacccgccauaaaac

SEQ ID NO: 2719959 - RNA, 23 nt, Haemophilus influenzae Rd
auuugcacccgcuuuaauagauu

SEQ ID NO: 2719960 - RNA, 11 nt, Haemophilus influenzae Rd
auuugcauauu

SEQ ID NO: 2719961 - RNA, 22 nt, Haemophilus influenzae Rd
auuugcauauuuucgugggaaa

SEQ ID NO: 2719962 - RNA, 14 nt, Haemophilus influenzae Rd
auuugcaucauuuc

SEQ ID NO: 2719963 - RNA, 14 nt, Haemophilus influenzae Rd
auuugccagcuuga

SEQ ID NO: 2719964 - RNA, 14 nt, Haemophilus influenzae Rd
auuugccaucacuc

SEQ ID NO: 2719965 - RNA, 15 nt, Haemophilus influenzae Rd
auuugccaucacuca

SEQ ID NO: 2719966 - RNA, 19 nt, Haemophilus influenzae Rd
auuugcccacauagcuuga

SEQ ID NO: 2719967 - RNA, 20 nt, Haemophilus influenzae Rd
auuugccccaauauuuuuca

SEQ ID NO: 2719968 - RNA, 18 nt, Haemophilus influenzae Rd
auuugcgauaauuugcau

SEQ ID NO: 2719969 - RNA, 15 nt, Haemophilus influenzae Rd
auuugcgaugauaaa

SEQ ID NO: 2719970 - RNA, 17 nt, Haemophilus influenzae Rd
auuugcgaugauaaagu

SEQ ID NO: 2719971 - RNA, 19 nt, Haemophilus influenzae Rd
auuugcgccaauaauaaau

SEQ ID NO: 2719972 - RNA, 15 nt, Haemophilus influenzae Rd
auuugcgucuuaaau

SEQ ID NO: 2719973 - RNA, 17 nt, Haemophilus influenzae Rd
auuugcuaaaauuaccg

SEQ ID NO: 2719974 - RNA, 18 nt, Haemophilus influenzae Rd
auuugcucaauaauuuca

SEQ ID NO: 2719975 - RNA, 23 nt, Haemophilus influenzae Rd
auuugcucgcucacggguuggaa

SEQ ID NO: 2719976 - RNA, 18 nt, Haemophilus influenzae Rd
auuugcucgcucgccaag

SEQ ID NO: 2719977 - RNA, 13 nt, Haemophilus influenzae Rd
auuugcugaaaua

SEQ ID NO: 2719978 - RNA, 23 nt, Haemophilus influenzae Rd
auuugcugcugcugucgcuucua

SEQ ID NO: 2719979 - RNA, 22 nt, Haemophilus influenzae Rd
auuugcuuacauugcuuaacau

SEQ ID NO: 2719980 - RNA, 19 nt, Haemophilus influenzae Rd
auuugcuucuaauuuuaaa

SEQ ID NO: 2719981 - RNA, 18 nt, Haemophilus influenzae Rd
auuugcuuggaauaaauu

SEQ ID NO: 2719982 - RNA, 19 nt, Haemophilus influenzae Rd
auuugcuuuuugauuuugu

SEQ ID NO: 2719983 - RNA, 16 nt, Haemophilus influenzae Rd
auuugcuuuuuguuac

SEQ ID NO: 2719984 - RNA, 16 nt, Haemophilus influenzae Rd
auuuggaaaccugcaa

SEQ ID NO: 2719985 - RNA, 14 nt, Haemophilus influenzae Rd
auuuggaauaaacu

SEQ ID NO: 2719986 - RNA, 19 nt, Haemophilus influenzae Rd
auuuggauaacaaauugcu

SEQ ID NO: 2719987 - RNA, 15 nt, Haemophilus influenzae Rd
auuuggaucuaaaaa

SEQ ID NO: 2719988 - RNA, 21 nt, Haemophilus influenzae Rd
auuuggaucuaaaaaaucaau

SEQ ID NO: 2719989 - RNA, 19 nt, Haemophilus influenzae Rd
auuuggcauuugaauuacc

SEQ ID NO: 2719990 - RNA, 15 nt, Haemophilus influenzae Rd
auuuggcauuuugua

SEQ ID NO: 2719991 - RNA, 17 nt, Haemophilus influenzae Rd
auuuggcugauauauua

SEQ ID NO: 2719992 - RNA, 16 nt, Haemophilus influenzae Rd
auuugggaauaccaca

SEQ ID NO: 2719993 - RNA, 20 nt, Haemophilus influenzae Rd
auuugggagagaggaaucua

SEQ ID NO: 2719994 - RNA, 15 nt, Haemophilus influenzae Rd
auuuggggcguggau

SEQ ID NO: 2719995 - RNA, 18 nt, Haemophilus influenzae Rd
auuugggugcagauuuuu

SEQ ID NO: 2719996 - RNA, 18 nt, Haemophilus influenzae Rd
auuuggucuaacauuuca

SEQ ID NO: 2719997 - RNA, 19 nt, Haemophilus influenzae Rd
auuuggucuguuucuucua

SEQ ID NO: 2719998 - RNA, 13 nt, Haemophilus influenzae Rd
auuuggugagaua

SEQ ID NO: 2719999 - RNA, 22 nt, Haemophilus influenzae Rd
auuugguuuugcucuuuuucca

SEQ ID NO: 2720000 - RNA, 16 nt, Haemophilus influenzae Rd
auuuguaaguuguaaa

SEQ ID NO: 2720001 - RNA, 16 nt, Haemophilus influenzae Rd
auuuguaccaccaaaa

SEQ ID NO: 2720002 - RNA, 12 nt, Haemophilus influenzae Rd
auuuguagaaag

SEQ ID NO: 2720003 - RNA, 21 nt, Haemophilus influenzae Rd
auuuguagaaaggcaauauuu

SEQ ID NO: 2720004 - RNA, 22 nt, Haemophilus influenzae Rd
auuuguccuuuaucaagcacaa

SEQ ID NO: 2720005 - RNA, 23 nt, Haemophilus influenzae Rd
auuugucgauaaaagaagcuauu

SEQ ID NO: 2720006 - RNA, 18 nt, Haemophilus influenzae Rd
auuugugagcgaucugca

SEQ ID NO: 2720007 - RNA, 15 nt, Haemophilus influenzae Rd
auuuguguggaaaaa

SEQ ID NO: 2720008 - RNA, 20 nt, Haemophilus influenzae Rd
auuuguuaagugaucuugau

SEQ ID NO: 2720009 - RNA, 13 nt, Haemophilus influenzae Rd
auuuguucaagau

SEQ ID NO: 2720010 - RNA, 17 nt, Haemophilus influenzae Rd
auuuguuuuuaguuuuu

SEQ ID NO: 2720011 - RNA, 12 nt, Haemophilus influenzae Rd
auuuguuuuuua

SEQ ID NO: 2720012 - RNA, 16 nt, Haemophilus influenzae Rd
auuuuaaaaaauaauu

SEQ ID NO: 2720013 - RNA, 13 nt, Haemophilus influenzae Rd
auuuuaaaaucau

SEQ ID NO: 2720014 - RNA, 23 nt, Haemophilus influenzae Rd
auuuuaaaccgucauuuauaaaa

SEQ ID NO: 2720015 - RNA, 20 nt, Haemophilus influenzae Rd
auuuuaaagaauguuugaaa

SEQ ID NO: 2720016 - RNA, 13 nt, Haemophilus influenzae Rd
auuuuaaaguaaa

SEQ ID NO: 2720017 - RNA, 13 nt, Haemophilus influenzae Rd
auuuuaaauaaaa

SEQ ID NO: 2720018 - RNA, 19 nt, Haemophilus influenzae Rd
auuuuaaauaaaaaauaaa

SEQ ID NO: 2720019 - RNA, 15 nt, Haemophilus influenzae Rd
auuuuaaauaaaaua

SEQ ID NO: 2720020 - RNA, 17 nt, Haemophilus influenzae Rd
auuuuaaauaaauaaua

SEQ ID NO: 2720021 - RNA, 20 nt, Haemophilus influenzae Rd
auuuuaaauaauuaaaaaua

SEQ ID NO: 2720022 - RNA, 20 nt, Haemophilus influenzae Rd
auuuuaaccaguuuguguuu

SEQ ID NO: 2720023 - RNA, 20 nt, Haemophilus influenzae Rd
auuuuaaccgcacuuuuaau

SEQ ID NO: 2720024 - RNA, 23 nt, Haemophilus influenzae Rd
auuuuaaguuggcugaaagcgaa

SEQ ID NO: 2720025 - RNA, 18 nt, Haemophilus influenzae Rd
auuuuaauaaagauaaau

SEQ ID NO: 2720026 - RNA, 13 nt, Haemophilus influenzae Rd
auuuuaaugaaag

SEQ ID NO: 2720027 - RNA, 22 nt, Haemophilus influenzae Rd
auuuuaaugcugaguaccaaaa

SEQ ID NO: 2720028 - RNA, 13 nt, Haemophilus influenzae Rd
auuuuaauguaau

SEQ ID NO: 2720029 - RNA, 15 nt, Haemophilus influenzae Rd
auuuuacagauuuug

SEQ ID NO: 2720030 - RNA, 15 nt, Haemophilus influenzae Rd
auuuuaccaagaaau

SEQ ID NO: 2720031 - RNA, 17 nt, Haemophilus influenzae Rd
auuuuaccaagaaauaa

SEQ ID NO: 2720032 - RNA, 23 nt, Haemophilus influenzae Rd
auuuuaccgcacuuuauuagaaa

SEQ ID NO: 2720033 - RNA, 23 nt, Haemophilus influenzae Rd
auuuuacgagaaagguguaauuc

SEQ ID NO: 2720034 - RNA, 18 nt, Haemophilus influenzae Rd
auuuuacguuggucugca

SEQ ID NO: 2720035 - RNA, 15 nt, Haemophilus influenzae Rd
auuuuacguuucauu

SEQ ID NO: 2720036 - RNA, 17 nt, Haemophilus influenzae Rd
auuuuacguuucauuuu

SEQ ID NO: 2720037 - RNA, 15 nt, Haemophilus influenzae Rd
auuuuacguuuuaaa

SEQ ID NO: 2720038 - RNA, 16 nt, Haemophilus influenzae Rd
auuuuacguuuuaaau

SEQ ID NO: 2720039 - RNA, 14 nt, Haemophilus influenzae Rd
auuuuacuaaacgu

SEQ ID NO: 2720040 - RNA, 15 nt, Haemophilus influenzae Rd
auuuuacuuguuuau

SEQ ID NO: 2720041 - RNA, 18 nt, Haemophilus influenzae Rd
auuuuacuuuuucuaaua

SEQ ID NO: 2720042 - RNA, 21 nt, Haemophilus influenzae Rd
auuuuagaaaaaucgaagaaa

SEQ ID NO: 2720043 - RNA, 16 nt, Haemophilus influenzae Rd
auuuuagaauccaaaa

SEQ ID NO: 2720044 - RNA, 18 nt, Haemophilus influenzae Rd
auuuuagaauccaaaauu

SEQ ID NO: 2720045 - RNA, 19 nt, Haemophilus influenzae Rd
auuuuagaauccaaaauua

SEQ ID NO: 2720046 - RNA, 20 nt, Haemophilus influenzae Rd
auuuuagaggcuaugauuuu

SEQ ID NO: 2720047 - RNA, 23 nt, Haemophilus influenzae Rd
auuuuagaggcuaugauuuuaaa

SEQ ID NO: 2720048 - RNA, 14 nt, Haemophilus influenzae Rd
auuuuaguagauuu

SEQ ID NO: 2720049 - RNA, 16 nt, Haemophilus influenzae Rd
auuuuaguauuuuuga

SEQ ID NO: 2720050 - RNA, 23 nt, Haemophilus influenzae Rd
auuuuaguauuuuugaaugauga

SEQ ID NO: 2720051 - RNA, 17 nt, Haemophilus influenzae Rd
auuuuaguuucuaauuc

SEQ ID NO: 2720052 - RNA, 13 nt, Haemophilus influenzae Rd
auuuuauauauua

SEQ ID NO: 2720053 - RNA, 21 nt, Haemophilus influenzae Rd
auuuuauaucaagcugugcaa

SEQ ID NO: 2720054 - RNA, 17 nt, Haemophilus influenzae Rd
auuuuaucaacuaaaaa

SEQ ID NO: 2720055 - RNA, 18 nt, Haemophilus influenzae Rd
auuuuaucaacuaaaaaa

SEQ ID NO: 2720056 - RNA, 23 nt, Haemophilus influenzae Rd
auuuuaucaacuaaaaaauaguu

SEQ ID NO: 2720057 - RNA, 13 nt, Haemophilus influenzae Rd
auuuuaucaagaa

SEQ ID NO: 2720058 - RNA, 21 nt, Haemophilus influenzae Rd
auuuuauccaaccuacauuaa

SEQ ID NO: 2720059 - RNA, 16 nt, Haemophilus influenzae Rd
auuuuaucuaaucauu

SEQ ID NO: 2720060 - RNA, 22 nt, Haemophilus influenzae Rd
auuuuaucuaaucauuaacaaa

SEQ ID NO: 2720061 - RNA, 15 nt, Haemophilus influenzae Rd
auuuuaugaaaucuu

SEQ ID NO: 2720062 - RNA, 20 nt, Haemophilus influenzae Rd
auuuuaugccguauuuuuca

SEQ ID NO: 2720063 - RNA, 19 nt, Haemophilus influenzae Rd
auuuuauggcugcugcaau

SEQ ID NO: 2720064 - RNA, 22 nt, Haemophilus influenzae Rd
auuuuauggcugcugcaauuca

SEQ ID NO: 2720065 - RNA, 13 nt, Haemophilus influenzae Rd
auuuuauuaucaa

SEQ ID NO: 2720066 - RNA, 14 nt, Haemophilus influenzae Rd
auuuuauugccaau

SEQ ID NO: 2720067 - RNA, 14 nt, Haemophilus influenzae Rd
auuuuauuuacuug

SEQ ID NO: 2720068 - RNA, 14 nt, Haemophilus influenzae Rd
auuuuauuuagaaa

SEQ ID NO: 2720069 - RNA, 19 nt, Haemophilus influenzae Rd
auuuuauuuuguauauugu

SEQ ID NO: 2720070 - RNA, 12 nt, Haemophilus influenzae Rd
auuuucaaauaa

SEQ ID NO: 2720071 - RNA, 18 nt, Haemophilus influenzae Rd
auuuucaaauaaguuuga

SEQ ID NO: 2720072 - RNA, 19 nt, Haemophilus influenzae Rd
auuuucaaauucauccaaa

SEQ ID NO: 2720073 - RNA, 20 nt, Haemophilus influenzae Rd
auuuucaaauugaaaagaaa

SEQ ID NO: 2720074 - RNA, 15 nt, Haemophilus influenzae Rd
auuuucaaccacuuc

SEQ ID NO: 2720075 - RNA, 18 nt, Haemophilus influenzae Rd
auuuucaagccaccagag

SEQ ID NO: 2720076 - RNA, 23 nt, Haemophilus influenzae Rd
auuuucaagcccuuccaucuuuu

SEQ ID NO: 2720077 - RNA, 20 nt, Haemophilus influenzae Rd
auuuucaauagccaauaaua

SEQ ID NO: 2720078 - RNA, 22 nt, Haemophilus influenzae Rd
auuuucaaucccuucugcucca

SEQ ID NO: 2720079 - RNA, 17 nt, Haemophilus influenzae Rd
auuuucaauggcaucaa

SEQ ID NO: 2720080 - RNA, 17 nt, Haemophilus influenzae Rd
auuuucaaugguuuaua

SEQ ID NO: 2720081 - RNA, 16 nt, Haemophilus influenzae Rd
auuuucaccguugccg

SEQ ID NO: 2720082 - RNA, 16 nt, Haemophilus influenzae Rd
auuuucaccugaagaa

SEQ ID NO: 2720083 - RNA, 20 nt, Haemophilus influenzae Rd
auuuucagaaaguguuuuac

SEQ ID NO: 2720084 - RNA, 12 nt, Haemophilus influenzae Rd
auuuucagcaaa

SEQ ID NO: 2720085 - RNA, 16 nt, Haemophilus influenzae Rd
auuuucagcaaaaugc

SEQ ID NO: 2720086 - RNA, 18 nt, Haemophilus influenzae Rd
auuuucagcaaaaugcgu

SEQ ID NO: 2720087 - RNA, 19 nt, Haemophilus influenzae Rd
auuuucaggugcuauuuua

SEQ ID NO: 2720088 - RNA, 13 nt, Haemophilus influenzae Rd
auuuucaucaauu

SEQ ID NO: 2720089 - RNA, 21 nt, Haemophilus influenzae Rd
auuuucauccauuuacggcuu

SEQ ID NO: 2720090 - RNA, 19 nt, Haemophilus influenzae Rd
auuuucaucguuaauuaau

SEQ ID NO: 2720091 - RNA, 13 nt, Haemophilus influenzae Rd
auuuuccaaaauu

SEQ ID NO: 2720092 - RNA, 15 nt, Haemophilus influenzae Rd
auuuuccaaauucca

SEQ ID NO: 2720093 - RNA, 22 nt, Haemophilus influenzae Rd
auuuuccauuggugaaaucaac

SEQ ID NO: 2720094 - RNA, 18 nt, Haemophilus influenzae Rd
auuuucccacaugucaaa

SEQ ID NO: 2720095 - RNA, 16 nt, Haemophilus influenzae Rd
auuuucccaguaaaua

SEQ ID NO: 2720096 - RNA, 21 nt, Haemophilus influenzae Rd
auuuuccccgcucuuuccauu

SEQ ID NO: 2720097 - RNA, 19 nt, Haemophilus influenzae Rd
auuuuccccuuuccacgcc

SEQ ID NO: 2720098 - RNA, 18 nt, Haemophilus influenzae Rd
auuuuccgcacuuuuuau

SEQ ID NO: 2720099 - RNA, 16 nt, Haemophilus influenzae Rd
auuuuccuucuauauc

SEQ ID NO: 2720100 - RNA, 22 nt, Haemophilus influenzae Rd
auuuucgccugccgcauaagcg

SEQ ID NO: 2720101 - RNA, 16 nt, Haemophilus influenzae Rd
auuuucguuuacccac

SEQ ID NO: 2720102 - RNA, 22 nt, Haemophilus influenzae Rd
auuuucuaaaaaacguauuaua

SEQ ID NO: 2720103 - RNA, 16 nt, Haemophilus influenzae Rd
auuuucuaauuuucac

SEQ ID NO: 2720104 - RNA, 21 nt, Haemophilus influenzae Rd
auuuucuagagcaagcguuaa

SEQ ID NO: 2720105 - RNA, 13 nt, Haemophilus influenzae Rd
auuuucucuugca

SEQ ID NO: 2720106 - RNA, 14 nt, Haemophilus influenzae Rd
auuuucuuaucuaa

SEQ ID NO: 2720107 - RNA, 11 nt, Haemophilus influenzae Rd
auuuucuuauu

SEQ ID NO: 2720108 - RNA, 18 nt, Haemophilus influenzae Rd
auuuucuucacugcaucu

SEQ ID NO: 2720109 - RNA, 12 nt, Haemophilus influenzae Rd
auuuugaacaag

SEQ ID NO: 2720110 - RNA, 15 nt, Haemophilus influenzae Rd
auuuugaacaagguu

SEQ ID NO: 2720111 - RNA, 12 nt, Haemophilus influenzae Rd
auuuugaacaau

SEQ ID NO: 2720112 - RNA, 14 nt, Haemophilus influenzae Rd
auuuugaacaaugu

SEQ ID NO: 2720113 - RNA, 17 nt, Haemophilus influenzae Rd
auuuugaauaauaaauu

SEQ ID NO: 2720114 - RNA, 19 nt, Haemophilus influenzae Rd
auuuugaaugguuguucug

SEQ ID NO: 2720115 - RNA, 15 nt, Haemophilus influenzae Rd
auuuugaccgcuguu

SEQ ID NO: 2720116 - RNA, 17 nt, Haemophilus influenzae Rd
auuuugacuuucgagua

SEQ ID NO: 2720117 - RNA, 13 nt, Haemophilus influenzae Rd
auuuugagauaga

SEQ ID NO: 2720118 - RNA, 14 nt, Haemophilus influenzae Rd
auuuugagccauuu

SEQ ID NO: 2720119 - RNA, 16 nt, Haemophilus influenzae Rd
auuuugauauuugcuc

SEQ ID NO: 2720120 - RNA, 14 nt, Haemophilus influenzae Rd
auuuugaugaaagu

SEQ ID NO: 2720121 - RNA, 15 nt, Haemophilus influenzae Rd
auuuugaugaaaguu

SEQ ID NO: 2720122 - RNA, 19 nt, Haemophilus influenzae Rd
auuuugaugaaaguugaau

SEQ ID NO: 2720123 - RNA, 21 nt, Haemophilus influenzae Rd
auuuugcaagguuuccaagaa

SEQ ID NO: 2720124 - RNA, 11 nt, Haemophilus influenzae Rd
auuuugcauau

SEQ ID NO: 2720125 - RNA, 15 nt, Haemophilus influenzae Rd
auuuugccagauuuu

SEQ ID NO: 2720126 - RNA, 17 nt, Haemophilus influenzae Rd
auuuugccagauuuuua

SEQ ID NO: 2720127 - RNA, 20 nt, Haemophilus influenzae Rd
auuuugcccaauucucugca

SEQ ID NO: 2720128 - RNA, 13 nt, Haemophilus influenzae Rd
auuuugcucaaaa

SEQ ID NO: 2720129 - RNA, 13 nt, Haemophilus influenzae Rd
auuuugcuuugcc

SEQ ID NO: 2720130 - RNA, 23 nt, Haemophilus influenzae Rd
auuuuggaaugguugcaaaggca

SEQ ID NO: 2720131 - RNA, 21 nt, Haemophilus influenzae Rd
auuuuggcacuggaaauggcu

SEQ ID NO: 2720132 - RNA, 23 nt, Haemophilus influenzae Rd
auuuugguaaauuagcaauaccu

SEQ ID NO: 2720133 - RNA, 18 nt, Haemophilus influenzae Rd
auuuuguaagcauuaaaa

SEQ ID NO: 2720134 - RNA, 15 nt, Haemophilus influenzae Rd
auuuuguauauugug

SEQ ID NO: 2720135 - RNA, 14 nt, Haemophilus influenzae Rd
auuuugucaccaaa

SEQ ID NO: 2720136 - RNA, 20 nt, Haemophilus influenzae Rd
auuuugucaccaaauacauu

SEQ ID NO: 2720137 - RNA, 19 nt, Haemophilus influenzae Rd
auuuugucagauuuauaaa

SEQ ID NO: 2720138 - RNA, 16 nt, Haemophilus influenzae Rd
auuuuguguuugaaaa

SEQ ID NO: 2720139 - RNA, 19 nt, Haemophilus influenzae Rd
auuuuguuacucgcaucaa

SEQ ID NO: 2720140 - RNA, 20 nt, Haemophilus influenzae Rd
auuuuguuacucgcaucaau

SEQ ID NO: 2720141 - RNA, 12 nt, Haemophilus influenzae Rd
auuuuguugcag

SEQ ID NO: 2720142 - RNA, 11 nt, Haemophilus influenzae Rd
auuuuuaaaac

SEQ ID NO: 2720143 - RNA, 14 nt, Haemophilus influenzae Rd
auuuuuaaagaaau

SEQ ID NO: 2720144 - RNA, 13 nt, Haemophilus influenzae Rd
auuuuuaaaucaa

SEQ ID NO: 2720145 - RNA, 14 nt, Haemophilus influenzae Rd
auuuuuaaaucaau

SEQ ID NO: 2720146 - RNA, 11 nt, Haemophilus influenzae Rd
auuuuuaaaug

SEQ ID NO: 2720147 - RNA, 15 nt, Haemophilus influenzae Rd
auuuuuaaucaaaua

SEQ ID NO: 2720148 - RNA, 22 nt, Haemophilus influenzae Rd
auuuuuaaucaaauaaaauauu

SEQ ID NO: 2720149 - RNA, 18 nt, Haemophilus influenzae Rd
auuuuuaaugcguuuuau

SEQ ID NO: 2720150 - RNA, 15 nt, Haemophilus influenzae Rd
auuuuuaauucuuca

SEQ ID NO: 2720151 - RNA, 19 nt, Haemophilus influenzae Rd
auuuuuaauucuuuuucac

SEQ ID NO: 2720152 - RNA, 20 nt, Haemophilus influenzae Rd
auuuuuaauucuuuuucacu

SEQ ID NO: 2720153 - RNA, 13 nt, Haemophilus influenzae Rd
auuuuuacaaaua

SEQ ID NO: 2720154 - RNA, 20 nt, Haemophilus influenzae Rd
auuuuuaccgcacuuuuuug

SEQ ID NO: 2720155 - RNA, 18 nt, Haemophilus influenzae Rd
auuuuuacuucaucaaaa

SEQ ID NO: 2720156 - RNA, 16 nt, Haemophilus influenzae Rd
auuuuuagauuauuuu

SEQ ID NO: 2720157 - RNA, 18 nt, Haemophilus influenzae Rd
auuuuuagauuauuuuua

SEQ ID NO: 2720158 - RNA, 21 nt, Haemophilus influenzae Rd
auuuuuagccuaagauuuuau

SEQ ID NO: 2720159 - RNA, 22 nt, Haemophilus influenzae Rd
auuuuuagugaaacuggcauuu

SEQ ID NO: 2720160 - RNA, 18 nt, Haemophilus influenzae Rd
auuuuuagugauuuuaaa

SEQ ID NO: 2720161 - RNA, 22 nt, Haemophilus influenzae Rd
auuuuuagugauuuuaaauccc

SEQ ID NO: 2720162 - RNA, 19 nt, Haemophilus influenzae Rd
auuuuuauaucuaaauaau

SEQ ID NO: 2720163 - RNA, 12 nt, Haemophilus influenzae Rd
auuuuuaucaua

SEQ ID NO: 2720164 - RNA, 14 nt, Haemophilus influenzae Rd
auuuuuaucauaua

SEQ ID NO: 2720165 - RNA, 20 nt, Haemophilus influenzae Rd
auuuuuaugauuaauuuuau

SEQ ID NO: 2720166 - RNA, 15 nt, Haemophilus influenzae Rd
auuuuuauuaguaaa

SEQ ID NO: 2720167 - RNA, 19 nt, Haemophilus influenzae Rd
auuuuuauuaucaaaaaac

SEQ ID NO: 2720168 - RNA, 17 nt, Haemophilus influenzae Rd
auuuuuauuguguuuug

SEQ ID NO: 2720169 - RNA, 15 nt, Haemophilus influenzae Rd
auuuuuauuuucuua

SEQ ID NO: 2720170 - RNA, 14 nt, Haemophilus influenzae Rd
auuuuucaaaacgu

SEQ ID NO: 2720171 - RNA, 15 nt, Haemophilus influenzae Rd
auuuuucaaaauuuu

SEQ ID NO: 2720172 - RNA, 21 nt, Haemophilus influenzae Rd
auuuuucaaggccauauuuuc

SEQ ID NO: 2720173 - RNA, 23 nt, Haemophilus influenzae Rd
auuuuucaaggccauauuuuccc

SEQ ID NO: 2720174 - RNA, 11 nt, Haemophilus influenzae Rd
auuuuucacug

SEQ ID NO: 2720175 - RNA, 13 nt, Haemophilus influenzae Rd
auuuuucagguaa

SEQ ID NO: 2720176 - RNA, 18 nt, Haemophilus influenzae Rd
auuuuucaucuuuuuaua

SEQ ID NO: 2720177 - RNA, 19 nt, Haemophilus influenzae Rd
auuuuucaucuuuuuauaa

SEQ ID NO: 2720178 - RNA, 12 nt, Haemophilus influenzae Rd
auuuuucauuuu

SEQ ID NO: 2720179 - RNA, 23 nt, Haemophilus influenzae Rd
auuuuuccagcaaaaaaauuucu

SEQ ID NO: 2720180 - RNA, 23 nt, Haemophilus influenzae Rd
auuuuuccccacuuaucuuaaaa

SEQ ID NO: 2720181 - RNA, 21 nt, Haemophilus influenzae Rd
auuuuuccgcugccuugauuu

SEQ ID NO: 2720182 - RNA, 17 nt, Haemophilus influenzae Rd
auuuuucggauuaagug

SEQ ID NO: 2720183 - RNA, 19 nt, Haemophilus influenzae Rd
auuuuucucaccaccagau

SEQ ID NO: 2720184 - RNA, 17 nt, Haemophilus influenzae Rd
auuuuucucguaugcug

SEQ ID NO: 2720185 - RNA, 23 nt, Haemophilus influenzae Rd
auuuuucuucgcgagaauuacca

SEQ ID NO: 2720186 - RNA, 17 nt, Haemophilus influenzae Rd
auuuuucuuuucuucua

SEQ ID NO: 2720187 - RNA, 23 nt, Haemophilus influenzae Rd
auuuuucuuuucuucuaauucuu

SEQ ID NO: 2720188 - RNA, 18 nt, Haemophilus influenzae Rd
auuuuugaaugaaauuca

SEQ ID NO: 2720189 - RNA, 14 nt, Haemophilus influenzae Rd
auuuuugaauuuca

SEQ ID NO: 2720190 - RNA, 15 nt, Haemophilus influenzae Rd
auuuuugaauuucac

SEQ ID NO: 2720191 - RNA, 17 nt, Haemophilus influenzae Rd
auuuuugaauuucacug

SEQ ID NO: 2720192 - RNA, 14 nt, Haemophilus influenzae Rd
auuuuugauaaaaa

SEQ ID NO: 2720193 - RNA, 18 nt, Haemophilus influenzae Rd
auuuuugauaaaaaagaa

SEQ ID NO: 2720194 - RNA, 19 nt, Haemophilus influenzae Rd
auuuuugauaaaaaagaaa

SEQ ID NO: 2720195 - RNA, 20 nt, Haemophilus influenzae Rd
auuuuugauaaaaaagaaau

SEQ ID NO: 2720196 - RNA, 23 nt, Haemophilus influenzae Rd
auuuuugauccugaucuuuugcc

SEQ ID NO: 2720197 - RNA, 22 nt, Haemophilus influenzae Rd
auuuuugauuuaauugaaauuu

SEQ ID NO: 2720198 - RNA, 15 nt, Haemophilus influenzae Rd
auuuuugauuuaguc

SEQ ID NO: 2720199 - RNA, 17 nt, Haemophilus influenzae Rd
auuuuugcaaaaaguac

SEQ ID NO: 2720200 - RNA, 15 nt, Haemophilus influenzae Rd
auuuuugcauuuuca

SEQ ID NO: 2720201 - RNA, 17 nt, Haemophilus influenzae Rd
auuuuugccaauuuuuu

SEQ ID NO: 2720202 - RNA, 18 nt, Haemophilus influenzae Rd
auuuuugccguuuucuac

SEQ ID NO: 2720203 - RNA, 19 nt, Haemophilus influenzae Rd
auuuuuguggaaugcccag

SEQ ID NO: 2720204 - RNA, 21 nt, Haemophilus influenzae Rd
auuuuuguggcgugagauccu

SEQ ID NO: 2720205 - RNA, 13 nt, Haemophilus influenzae Rd
auuuuuguuguuu

SEQ ID NO: 2720206 - RNA, 21 nt, Haemophilus influenzae Rd
auuuuuuaaccgcuuguguuu

SEQ ID NO: 2720207 - RNA, 18 nt, Haemophilus influenzae Rd
auuuuuuaauacgaaaaa

SEQ ID NO: 2720208 - RNA, 17 nt, Haemophilus influenzae Rd
auuuuuuaauuuuuucu

SEQ ID NO: 2720209 - RNA, 12 nt, Haemophilus influenzae Rd
auuuuuuacauu

SEQ ID NO: 2720210 - RNA, 14 nt, Haemophilus influenzae Rd
auuuuuuacguaau

SEQ ID NO: 2720211 - RNA, 14 nt, Haemophilus influenzae Rd
auuuuuuauaaaug

SEQ ID NO: 2720212 - RNA, 17 nt, Haemophilus influenzae Rd
auuuuuuauaugaguuu

SEQ ID NO: 2720213 - RNA, 21 nt, Haemophilus influenzae Rd
auuuuuuauaugccaagauuu

SEQ ID NO: 2720214 - RNA, 17 nt, Haemophilus influenzae Rd
auuuuuuaucaaauaac

SEQ ID NO: 2720215 - RNA, 19 nt, Haemophilus influenzae Rd
auuuuuuaugguaaauauu

SEQ ID NO: 2720216 - RNA, 12 nt, Haemophilus influenzae Rd
auuuuuuauuaa

SEQ ID NO: 2720217 - RNA, 14 nt, Haemophilus influenzae Rd
auuuuuuauuaaaa

SEQ ID NO: 2720218 - RNA, 19 nt, Haemophilus influenzae Rd
auuuuuuauuaauuauaaa

SEQ ID NO: 2720219 - RNA, 15 nt, Haemophilus influenzae Rd
auuuuuuauuacauu

SEQ ID NO: 2720220 - RNA, 22 nt, Haemophilus influenzae Rd
auuuuuuauuacauuaaaauca

SEQ ID NO: 2720221 - RNA, 18 nt, Haemophilus influenzae Rd
auuuuuuauuuauauaaa

SEQ ID NO: 2720222 - RNA, 14 nt, Haemophilus influenzae Rd
auuuuuuauuuuua

SEQ ID NO: 2720223 - RNA, 18 nt, Haemophilus influenzae Rd
auuuuuuauuuuuucuaa

SEQ ID NO: 2720224 - RNA, 12 nt, Haemophilus influenzae Rd
auuuuuucaacu

SEQ ID NO: 2720225 - RNA, 13 nt, Haemophilus influenzae Rd
auuuuuucugaau

SEQ ID NO: 2720226 - RNA, 24 nt, Haemophilus influenzae Rd
auuuuuucuguuuuuccauucacu

SEQ ID NO: 2720227 - RNA, 15 nt, Haemophilus influenzae Rd
auuuuuucuuaaauu

SEQ ID NO: 2720228 - RNA, 21 nt, Haemophilus influenzae Rd
auuuuuugcucuuuaacaaua

SEQ ID NO: 2720229 - RNA, 13 nt, Haemophilus influenzae Rd
auuuuuugcuuca

SEQ ID NO: 2720230 - RNA, 20 nt, Haemophilus influenzae Rd
auuuuuuggaguuguuuaaa

SEQ ID NO: 2720231 - RNA, 24 nt, Haemophilus influenzae Rd
auuuuuuguugagcaauccaauca

SEQ ID NO: 2720232 - RNA, 17 nt, Haemophilus influenzae Rd
auuuuuuuaaauauuuu

SEQ ID NO: 2720233 - RNA, 14 nt, Haemophilus influenzae Rd
auuuuuuuaggaug

SEQ ID NO: 2720234 - RNA, 13 nt, Haemophilus influenzae Rd
auuuuuuuauaaa

SEQ ID NO: 2720235 - RNA, 17 nt, Haemophilus influenzae Rd
auuuuuuuaugauuaaa

SEQ ID NO: 2720236 - RNA, 17 nt, Haemophilus influenzae Rd
auuuuuuucaaugaaau

SEQ ID NO: 2720237 - RNA, 13 nt, Haemophilus influenzae Rd
auuuuuuucucug

SEQ ID NO: 2720238 - RNA, 19 nt, Haemophilus influenzae Rd
auuuuuuucucuguuuuau

SEQ ID NO: 2720239 - RNA, 15 nt, Haemophilus influenzae Rd
auuuuuuugcuggaa

SEQ ID NO: 2720240 - RNA, 12 nt, Haemophilus influenzae Rd
auuuuuuuuaaa

SEQ ID NO: 2720241 - RNA, 16 nt, Haemophilus influenzae Rd
auuuuuuuuauccaaa

SEQ ID NO: 2720242 - RNA, 23 nt, Haemophilus influenzae Rd
auuuuuuuuauccaaaauuaaau

SEQ ID NO: 2720243 - RNA, 23 nt, Haemophilus influenzae Rd
auuuuuuuucuaauaauccucuu

SEQ ID NO: 2720244 - RNA, 16 nt, Haemophilus influenzae Rd
auuuuuuuugcauuua

SEQ ID NO: 2720245 - RNA, 18 nt, Haemophilus influenzae Rd
caaaaaagcguugaaaau

SEQ ID NO: 2720246 - RNA, 19 nt, Haemophilus influenzae Rd
caaaaaagcguugaaaaua

SEQ ID NO: 2720247 - RNA, 21 nt, Haemophilus influenzae Rd
caaaaaagcguugaaaauaaa

SEQ ID NO: 2720248 - RNA, 18 nt, Haemophilus influenzae Rd
caaaaaagcuaagacauu

SEQ ID NO: 2720249 - RNA, 23 nt, Haemophilus influenzae Rd
caaaaaagugcgguaaaaauuca

SEQ ID NO: 2720250 - RNA, 14 nt, Haemophilus influenzae Rd
caaaaaauacauug

SEQ ID NO: 2720251 - RNA, 13 nt, Haemophilus influenzae Rd
caaaaaauucuuu

SEQ ID NO: 2720252 - RNA, 21 nt, Haemophilus influenzae Rd
caaaaacacguuuugcaccac

SEQ ID NO: 2720253 - RNA, 13 nt, Haemophilus influenzae Rd
caaaaaccaaacu

SEQ ID NO: 2720254 - RNA, 19 nt, Haemophilus influenzae Rd
caaaaaccaacgccauuuc

SEQ ID NO: 2720255 - RNA, 15 nt, Haemophilus influenzae Rd
caaaaagucaaaaua

SEQ ID NO: 2720256 - RNA, 22 nt, Haemophilus influenzae Rd
caaaaagugcggugauuuuacc

SEQ ID NO: 2720257 - RNA, 21 nt, Haemophilus influenzae Rd
caaaaagugcgguuaaaaauu

SEQ ID NO: 2720258 - RNA, 22 nt, Haemophilus influenzae Rd
caaaaagugcgguuaaaauuca

SEQ ID NO: 2720259 - RNA, 16 nt, Haemophilus influenzae Rd
caaaaauaaagcccug

SEQ ID NO: 2720260 - RNA, 17 nt, Haemophilus influenzae Rd
caaaaauaaagcccugu

SEQ ID NO: 2720261 - RNA, 18 nt, Haemophilus influenzae Rd
caaaaauacagccacuau

SEQ ID NO: 2720262 - RNA, 19 nt, Haemophilus influenzae Rd
caaaaauacagccacuauu

SEQ ID NO: 2720263 - RNA, 21 nt, Haemophilus influenzae Rd
caaaaauacguuguuuuucua

SEQ ID NO: 2720264 - RNA, 17 nt, Haemophilus influenzae Rd
caaaaauacuaacugga

SEQ ID NO: 2720265 - RNA, 18 nt, Haemophilus influenzae Rd
caaaaauagccuucauca

SEQ ID NO: 2720266 - RNA, 22 nt, Haemophilus influenzae Rd
caaaaauagccuucaucacaaa

SEQ ID NO: 2720267 - RNA, 11 nt, Haemophilus influenzae Rd
caaaaaucaac

SEQ ID NO: 2720268 - RNA, 15 nt, Haemophilus influenzae Rd
caaaaaugaaaggga

SEQ ID NO: 2720269 - RNA, 15 nt, Haemophilus influenzae Rd
caaaaaugcacccgc

SEQ ID NO: 2720270 - RNA, 17 nt, Haemophilus influenzae Rd
caaaaaugccuacuaaa

SEQ ID NO: 2720271 - RNA, 18 nt, Haemophilus influenzae Rd
caaaaaugccuacuaaac

SEQ ID NO: 2720272 - RNA, 19 nt, Haemophilus influenzae Rd
caaaaauuugaauguaaaa

SEQ ID NO: 2720273 - RNA, 22 nt, Haemophilus influenzae Rd
caaaaauuugaauguaaaaaua

SEQ ID NO: 2720274 - RNA, 17 nt, Haemophilus influenzae Rd
caaaaauuuuugcaaaa

SEQ ID NO: 2720275 - RNA, 13 nt, Haemophilus influenzae Rd
caaaacaguaaug

SEQ ID NO: 2720276 - RNA, 15 nt, Haemophilus influenzae Rd
caaaacaguaaugaa

SEQ ID NO: 2720277 - RNA, 14 nt, Haemophilus influenzae Rd
caaaacauaagaaa

SEQ ID NO: 2720278 - RNA, 14 nt, Haemophilus influenzae Rd
caaaacauaauaaa

SEQ ID NO: 2720279 - RNA, 13 nt, Haemophilus influenzae Rd
caaaacauuaauu

SEQ ID NO: 2720280 - RNA, 21 nt, Haemophilus influenzae Rd
caaaaccaaucauaaaauuuc

SEQ ID NO: 2720281 - RNA, 17 nt, Haemophilus influenzae Rd
caaaaccaaucauugga

SEQ ID NO: 2720282 - RNA, 21 nt, Haemophilus influenzae Rd
caaaaccauccaagcaaagaa

SEQ ID NO: 2720283 - RNA, 22 nt, Haemophilus influenzae Rd
caaaaccauccaagcaaagaaa

SEQ ID NO: 2720284 - RNA, 18 nt, Haemophilus influenzae Rd
caaaaccaucuaauacgu

SEQ ID NO: 2720285 - RNA, 18 nt, Haemophilus influenzae Rd
caaaaccauucaguaaua

SEQ ID NO: 2720286 - RNA, 15 nt, Haemophilus influenzae Rd
caaaaccuaacauaa

SEQ ID NO: 2720287 - RNA, 20 nt, Haemophilus influenzae Rd
caaaaccuaacauaaugccu

SEQ ID NO: 2720288 - RNA, 13 nt, Haemophilus influenzae Rd
caaaacuaaaaaa

SEQ ID NO: 2720289 - RNA, 20 nt, Haemophilus influenzae Rd
caaaacuagucauauugauu

SEQ ID NO: 2720290 - RNA, 14 nt, Haemophilus influenzae Rd
caaaacuaucaaaa

SEQ ID NO: 2720291 - RNA, 15 nt, Haemophilus influenzae Rd
caaaacuaucaaaau

SEQ ID NO: 2720292 - RNA, 21 nt, Haemophilus influenzae Rd
caaaacuaucaaaaucaaagu

SEQ ID NO: 2720293 - RNA, 17 nt, Haemophilus influenzae Rd
caaaacuuaucauuaau

SEQ ID NO: 2720294 - RNA, 21 nt, Haemophilus influenzae Rd
caaaacuuuuuccuucugcca

SEQ ID NO: 2720295 - RNA, 11 nt, Haemophilus influenzae Rd
caaaagaaaag

SEQ ID NO: 2720296 - RNA, 14 nt, Haemophilus influenzae Rd
caaaagaaaagaug

SEQ ID NO: 2720297 - RNA, 15 nt, Haemophilus influenzae Rd
caaaagaaaagauga

SEQ ID NO: 2720298 - RNA, 14 nt, Haemophilus influenzae Rd
caaaagaaagacuu

SEQ ID NO: 2720299 - RNA, 15 nt, Haemophilus influenzae Rd
caaaagaaagacuuu

SEQ ID NO: 2720300 - RNA, 21 nt, Haemophilus influenzae Rd
caaaagaaugacguaauuugu

SEQ ID NO: 2720301 - RNA, 16 nt, Haemophilus influenzae Rd
caaaagacgaagaaac

SEQ ID NO: 2720302 - RNA, 17 nt, Haemophilus influenzae Rd
caaaagagcgguugaaa

SEQ ID NO: 2720303 - RNA, 19 nt, Haemophilus influenzae Rd
caaaagagcgguugaaaau

SEQ ID NO: 2720304 - RNA, 20 nt, Haemophilus influenzae Rd
caaaagaucaggaucaaaaa

SEQ ID NO: 2720305 - RNA, 22 nt, Haemophilus influenzae Rd
caaaagaucaggaucaaaaaua

SEQ ID NO: 2720306 - RNA, 20 nt, Haemophilus influenzae Rd
caaaagcaagaucuaaaaac

SEQ ID NO: 2720307 - RNA, 16 nt, Haemophilus influenzae Rd
caaaagccaauaagag

SEQ ID NO: 2720308 - RNA, 13 nt, Haemophilus influenzae Rd
caaaagccaccau

SEQ ID NO: 2720309 - RNA, 20 nt, Haemophilus influenzae Rd
caaaagcuacaccgauuucu

SEQ ID NO: 2720310 - RNA, 19 nt, Haemophilus influenzae Rd
caaaagcuggauuaaauaa

SEQ ID NO: 2720311 - RNA, 21 nt, Haemophilus influenzae Rd
caaaagcuggauuaaauaacc

SEQ ID NO: 2720312 - RNA, 16 nt, Haemophilus influenzae Rd
caaaaggcaagcuagg

SEQ ID NO: 2720313 - RNA, 15 nt, Haemophilus influenzae Rd
caaaagguaaaaauu

SEQ ID NO: 2720314 - RNA, 19 nt, Haemophilus influenzae Rd
caaaaggucuuaauagcau

SEQ ID NO: 2720315 - RNA, 13 nt, Haemophilus influenzae Rd
caaaaguaaauaa

SEQ ID NO: 2720316 - RNA, 15 nt, Haemophilus influenzae Rd
caaaaguaagcaaau

SEQ ID NO: 2720317 - RNA, 14 nt, Haemophilus influenzae Rd
caaaaguauaaacu

SEQ ID NO: 2720318 - RNA, 22 nt, Haemophilus influenzae Rd
caaaagugcgguaaauuuuuac

SEQ ID NO: 2720319 - RNA, 20 nt, Haemophilus influenzae Rd
caaaagugcuuaaaugcaaa

SEQ ID NO: 2720320 - RNA, 22 nt, Haemophilus influenzae Rd
caaaaguuguggaaguugcucu

SEQ ID NO: 2720321 - RNA, 23 nt, Haemophilus influenzae Rd
caaaaguuguggaaguugcucua

SEQ ID NO: 2720322 - RNA, 15 nt, Haemophilus influenzae Rd
caaaaguuugcaaca

SEQ ID NO: 2720323 - RNA, 16 nt, Haemophilus influenzae Rd
caaaaguuugcaacau

SEQ ID NO: 2720324 - RNA, 15 nt, Haemophilus influenzae Rd
caaaauaaacucauu

SEQ ID NO: 2720325 - RNA, 17 nt, Haemophilus influenzae Rd
caaaauaaauaaaauau

SEQ ID NO: 2720326 - RNA, 22 nt, Haemophilus influenzae Rd
caaaauaaauaaaauauuuggc

SEQ ID NO: 2720327 - RNA, 21 nt, Haemophilus influenzae Rd
caaaauaaaugauuauccacu

SEQ ID NO: 2720328 - RNA, 20 nt, Haemophilus influenzae Rd
caaaauaaucaggauauuuu

SEQ ID NO: 2720329 - RNA, 21 nt, Haemophilus influenzae Rd
caaaauaaugagguauaaaau

SEQ ID NO: 2720330 - RNA, 21 nt, Haemophilus influenzae Rd
caaaauagaccgcuauuuuua

SEQ ID NO: 2720331 - RNA, 21 nt, Haemophilus influenzae Rd
caaaauagcugugcaaaaucu

SEQ ID NO: 2720332 - RNA, 15 nt, Haemophilus influenzae Rd
caaaauaguaaaaau

SEQ ID NO: 2720333 - RNA, 21 nt, Haemophilus influenzae Rd
caaaauaguaaaaauuguuga

SEQ ID NO: 2720334 - RNA, 22 nt, Haemophilus influenzae Rd
caaaauauuaguuagcuaaaaa

SEQ ID NO: 2720335 - RNA, 16 nt, Haemophilus influenzae Rd
caaaauauuuucaaau

SEQ ID NO: 2720336 - RNA, 10 nt, Haemophilus influenzae Rd
caaaaucaag

SEQ ID NO: 2720337 - RNA, 14 nt, Haemophilus influenzae Rd
caaaaucagcaaau

SEQ ID NO: 2720338 - RNA, 18 nt, Haemophilus influenzae Rd
caaaaucagcuaauaaca

SEQ ID NO: 2720339 - RNA, 15 nt, Haemophilus influenzae Rd
caaaaucauucguau

SEQ ID NO: 2720340 - RNA, 15 nt, Haemophilus influenzae Rd
caaaaucgcccgaca

SEQ ID NO: 2720341 - RNA, 21 nt, Haemophilus influenzae Rd
caaaaucuaaauuucuacuau

SEQ ID NO: 2720342 - RNA, 22 nt, Haemophilus influenzae Rd
caaaaucucuggagaaaauugc

SEQ ID NO: 2720343 - RNA, 23 nt, Haemophilus influenzae Rd
caaaaucuuuacgaauuguaccu

SEQ ID NO: 2720344 - RNA, 11 nt, Haemophilus influenzae Rd
caaaaugaaca

SEQ ID NO: 2720345 - RNA, 14 nt, Haemophilus influenzae Rd
caaaaugagcuuuu

SEQ ID NO: 2720346 - RNA, 22 nt, Haemophilus influenzae Rd
caaaaugcuugaauaaaugacc

SEQ ID NO: 2720347 - RNA, 21 nt, Haemophilus influenzae Rd
caaaauggcuuuuuugccuuu

SEQ ID NO: 2720348 - RNA, 22 nt, Haemophilus influenzae Rd
caaaaugucgccauuuaagccu

SEQ ID NO: 2720349 - RNA, 17 nt, Haemophilus influenzae Rd
caaaaugucgcuuucuu

SEQ ID NO: 2720350 - RNA, 20 nt, Haemophilus influenzae Rd
caaaauuaaauugaaaaaau

SEQ ID NO: 2720351 - RNA, 21 nt, Haemophilus influenzae Rd
caaaauuauaaaccaguuaaa

SEQ ID NO: 2720352 - RNA, 21 nt, Haemophilus influenzae Rd
caaaauuaugcugauuugaca

SEQ ID NO: 2720353 - RNA, 21 nt, Haemophilus influenzae Rd
caaaauucuacgccauuuucu

SEQ ID NO: 2720354 - RNA, 22 nt, Haemophilus influenzae Rd
caaaauucuacgccauuuucua

SEQ ID NO: 2720355 - RNA, 12 nt, Haemophilus influenzae Rd
caaaauugaagc

SEQ ID NO: 2720356 - RNA, 12 nt, Haemophilus influenzae Rd
caaaauugcuuu

SEQ ID NO: 2720357 - RNA, 12 nt, Haemophilus influenzae Rd
caaaauuuaaaa

SEQ ID NO: 2720358 - RNA, 14 nt, Haemophilus influenzae Rd
caaaauuuaaaauc

SEQ ID NO: 2720359 - RNA, 14 nt, Haemophilus influenzae Rd
caaaauuuaagccu

SEQ ID NO: 2720360 - RNA, 12 nt, Haemophilus influenzae Rd
caaaauuucagc

SEQ ID NO: 2720361 - RNA, 15 nt, Haemophilus influenzae Rd
caaaauuucagcuag

SEQ ID NO: 2720362 - RNA, 19 nt, Haemophilus influenzae Rd
caaaauuuguuaagugauc

SEQ ID NO: 2720363 - RNA, 20 nt, Haemophilus influenzae Rd
caaaauuuguuaagugaucu

SEQ ID NO: 2720364 - RNA, 12 nt, Haemophilus influenzae Rd
caaaauuuuacc

SEQ ID NO: 2720365 - RNA, 11 nt, Haemophilus influenzae Rd
caaacaaaaag

SEQ ID NO: 2720366 - RNA, 14 nt, Haemophilus influenzae Rd
caaacaaaauaaau

SEQ ID NO: 2720367 - RNA, 20 nt, Haemophilus influenzae Rd
caaacaaaauuuuaaauaaa

SEQ ID NO: 2720368 - RNA, 21 nt, Haemophilus influenzae Rd
caaacaaaauuuuaaauaaaa

SEQ ID NO: 2720369 - RNA, 15 nt, Haemophilus influenzae Rd
caaacaaauuuuuac

SEQ ID NO: 2720370 - RNA, 17 nt, Haemophilus influenzae Rd
caaacaaauuuuuacag

SEQ ID NO: 2720371 - RNA, 21 nt, Haemophilus influenzae Rd
caaacaacaagucaaugcacc

SEQ ID NO: 2720372 - RNA, 15 nt, Haemophilus influenzae Rd
caaacagcaauaaau

SEQ ID NO: 2720373 - RNA, 16 nt, Haemophilus influenzae Rd
caaacagcaauaaaua

SEQ ID NO: 2720374 - RNA, 16 nt, Haemophilus influenzae Rd
caaacaggaauacuca

SEQ ID NO: 2720375 - RNA, 22 nt, Haemophilus influenzae Rd
caaacaggcuuauuaaaaacua

SEQ ID NO: 2720376 - RNA, 23 nt, Haemophilus influenzae Rd
caaacauaccacuucagaauuca

SEQ ID NO: 2720377 - RNA, 16 nt, Haemophilus influenzae Rd
caaacauaccuaaaaa

SEQ ID NO: 2720378 - RNA, 17 nt, Haemophilus influenzae Rd
caaacauaccuaaaaau

SEQ ID NO: 2720379 - RNA, 20 nt, Haemophilus influenzae Rd
caaacauaccuaaaaaugcc

SEQ ID NO: 2720380 - RNA, 21 nt, Haemophilus influenzae Rd
caaacauuaaucgaucaauuu

SEQ ID NO: 2720381 - RNA, 18 nt, Haemophilus influenzae Rd
caaacauuugaccugcgu

SEQ ID NO: 2720382 - RNA, 12 nt, Haemophilus influenzae Rd
caaaccaauaaa

SEQ ID NO: 2720383 - RNA, 20 nt, Haemophilus influenzae Rd
caaaccaccgcgacucaccg

SEQ ID NO: 2720384 - RNA, 16 nt, Haemophilus influenzae Rd
caaaccagccugaaaa

SEQ ID NO: 2720385 - RNA, 18 nt, Haemophilus influenzae Rd
caaaccgucagugcuuuc

SEQ ID NO: 2720386 - RNA, 21 nt, Haemophilus influenzae Rd
caaacgaaaaaaauaaaaaau

SEQ ID NO: 2720387 - RNA, 17 nt, Haemophilus influenzae Rd
caaacgagaaaauuucu

SEQ ID NO: 2720388 - RNA, 17 nt, Haemophilus influenzae Rd
caaacgagacauuauuu

SEQ ID NO: 2720389 - RNA, 15 nt, Haemophilus influenzae Rd
caaacgcguuaaauc

SEQ ID NO: 2720390 - RNA, 16 nt, Haemophilus influenzae Rd
caaacgcucuuuaauu

SEQ ID NO: 2720391 - RNA, 17 nt, Haemophilus influenzae Rd
caaacgcucuuuaauug

SEQ ID NO: 2720392 - RNA, 20 nt, Haemophilus influenzae Rd
caaacgcucuuuaauuguuu

SEQ ID NO: 2720393 - RNA, 12 nt, Haemophilus influenzae Rd
caaacggaaaau

SEQ ID NO: 2720394 - RNA, 14 nt, Haemophilus influenzae Rd
caaacuauuaccua

SEQ ID NO: 2720395 - RNA, 20 nt, Haemophilus influenzae Rd
caaacucgguuuauuuucag

SEQ ID NO: 2720396 - RNA, 18 nt, Haemophilus influenzae Rd
caaacucuaauuccaccg

SEQ ID NO: 2720397 - RNA, 14 nt, Haemophilus influenzae Rd
caaacucuugugcc

SEQ ID NO: 2720398 - RNA, 15 nt, Haemophilus influenzae Rd
caaacugaucauaau

SEQ ID NO: 2720399 - RNA, 15 nt, Haemophilus influenzae Rd
caaacugccaaacaa

SEQ ID NO: 2720400 - RNA, 22 nt, Haemophilus influenzae Rd
caaacuggaauaaagcaaccaa

SEQ ID NO: 2720401 - RNA, 15 nt, Haemophilus influenzae Rd
caaacuuggaucaua

SEQ ID NO: 2720402 - RNA, 14 nt, Haemophilus influenzae Rd
caaacuuucugcaa

SEQ ID NO: 2720403 - RNA, 20 nt, Haemophilus influenzae Rd
caaagaauacaccccaaaau

SEQ ID NO: 2720404 - RNA, 20 nt, Haemophilus influenzae Rd
caaagaauuaaaauaugauu

SEQ ID NO: 2720405 - RNA, 18 nt, Haemophilus influenzae Rd
caaagaauugaucaaaau

SEQ ID NO: 2720406 - RNA, 13 nt, Haemophilus influenzae Rd
caaagaauuugcc

SEQ ID NO: 2720407 - RNA, 16 nt, Haemophilus influenzae Rd
caaagaauuuuuucac

SEQ ID NO: 2720408 - RNA, 21 nt, Haemophilus influenzae Rd
caaagacagcuauuaaaaaaa

SEQ ID NO: 2720409 - RNA, 15 nt, Haemophilus influenzae Rd
caaagacuaaaacca

SEQ ID NO: 2720410 - RNA, 16 nt, Haemophilus influenzae Rd
caaagacuaaaaccac

SEQ ID NO: 2720411 - RNA, 18 nt, Haemophilus influenzae Rd
caaagacuaaaaccacau

SEQ ID NO: 2720412 - RNA, 21 nt, Haemophilus influenzae Rd
caaagacuaaaaccacaucau

SEQ ID NO: 2720413 - RNA, 16 nt, Haemophilus influenzae Rd
caaagagaagcugaau

SEQ ID NO: 2720414 - RNA, 19 nt, Haemophilus influenzae Rd
caaagaggagguagaaaau

SEQ ID NO: 2720415 - RNA, 13 nt, Haemophilus influenzae Rd
caaagaggccucu

SEQ ID NO: 2720416 - RNA, 22 nt, Haemophilus influenzae Rd
caaagauauaaacugauuuuga

SEQ ID NO: 2720417 - RNA, 13 nt, Haemophilus influenzae Rd
caaagauggauau

SEQ ID NO: 2720418 - RNA, 16 nt, Haemophilus influenzae Rd
caaagauggauauuuc

SEQ ID NO: 2720419 - RNA, 20 nt, Haemophilus influenzae Rd
caaagauguuccuacagaac

SEQ ID NO: 2720420 - RNA, 21 nt, Haemophilus influenzae Rd
caaagauuuuaaaauuuauuu

SEQ ID NO: 2720421 - RNA, 21 nt, Haemophilus influenzae Rd
caaagcauuuagagcaagcaa

SEQ ID NO: 2720422 - RNA, 17 nt, Haemophilus influenzae Rd
caaagccugcuacauuu

SEQ ID NO: 2720423 - RNA, 18 nt, Haemophilus influenzae Rd
caaagcguccaagcaagc

SEQ ID NO: 2720424 - RNA, 16 nt, Haemophilus influenzae Rd
caaagcguucauuuug

SEQ ID NO: 2720425 - RNA, 18 nt, Haemophilus influenzae Rd
caaagcguucauuuugau

SEQ ID NO: 2720426 - RNA, 18 nt, Haemophilus influenzae Rd
caaagcguuuuaaaaucu

SEQ ID NO: 2720427 - RNA, 23 nt, Haemophilus influenzae Rd
caaaggcucuaccuaaaauaaau

SEQ ID NO: 2720428 - RNA, 16 nt, Haemophilus influenzae Rd
caaagggcacuuugca

SEQ ID NO: 2720429 - RNA, 17 nt, Haemophilus influenzae Rd
caaagguaauugccaau

SEQ ID NO: 2720430 - RNA, 21 nt, Haemophilus influenzae Rd
caaagguuaaaccuaaauccc

SEQ ID NO: 2720431 - RNA, 18 nt, Haemophilus influenzae Rd
caaagguuuuauuuugaa

SEQ ID NO: 2720432 - RNA, 22 nt, Haemophilus influenzae Rd
caaagguuuuauuuugaacaau

SEQ ID NO: 2720433 - RNA, 12 nt, Haemophilus influenzae Rd
caaaguaacuuu

SEQ ID NO: 2720434 - RNA, 18 nt, Haemophilus influenzae Rd
caaaguagucuauuuacu

SEQ ID NO: 2720435 - RNA, 20 nt, Haemophilus influenzae Rd
caaaguagucuauuuacuug

SEQ ID NO: 2720436 - RNA, 13 nt, Haemophilus influenzae Rd
caaagucuuuacc

SEQ ID NO: 2720437 - RNA, 18 nt, Haemophilus influenzae Rd
caaagugcggcaaaaaau

SEQ ID NO: 2720438 - RNA, 19 nt, Haemophilus influenzae Rd
caaagugcgguuaaauauu

SEQ ID NO: 2720439 - RNA, 13 nt, Haemophilus influenzae Rd
caaaguuaccauu

SEQ ID NO: 2720440 - RNA, 22 nt, Haemophilus influenzae Rd
caaaguuuccuucgccauuuuu

SEQ ID NO: 2720441 - RNA, 16 nt, Haemophilus influenzae Rd
caaauaaaaagugggu

SEQ ID NO: 2720442 - RNA, 23 nt, Haemophilus influenzae Rd
caaauaaaauagacaauauugaa

SEQ ID NO: 2720443 - RNA, 15 nt, Haemophilus influenzae Rd
caaauaaaauuacaa

SEQ ID NO: 2720444 - RNA, 17 nt, Haemophilus influenzae Rd
caaauaaacaaacuuuc

SEQ ID NO: 2720445 - RNA, 18 nt, Haemophilus influenzae Rd
caaauaaacaaacuuuca

SEQ ID NO: 2720446 - RNA, 17 nt, Haemophilus influenzae Rd
caaauaaagaagaaaau

SEQ ID NO: 2720447 - RNA, 11 nt, Haemophilus influenzae Rd
caaauaaauuu

SEQ ID NO: 2720448 - RNA, 20 nt, Haemophilus influenzae Rd
caaauaaauuugguacaugu

SEQ ID NO: 2720449 - RNA, 19 nt, Haemophilus influenzae Rd
caaauaacacagaaaccaa

SEQ ID NO: 2720450 - RNA, 19 nt, Haemophilus influenzae Rd
caaauaacuauuggcauca

SEQ ID NO: 2720451 - RNA, 23 nt, Haemophilus influenzae Rd
caaauaacugauaugccaaggcu

SEQ ID NO: 2720452 - RNA, 14 nt, Haemophilus influenzae Rd
caaauaauacaucu

SEQ ID NO: 2720453 - RNA, 20 nt, Haemophilus influenzae Rd
caaauaauacuugaccaaaa

SEQ ID NO: 2720454 - RNA, 13 nt, Haemophilus influenzae Rd
caaauaauuauua

SEQ ID NO: 2720455 - RNA, 19 nt, Haemophilus influenzae Rd
caaauaauuauuauccuau

SEQ ID NO: 2720456 - RNA, 23 nt, Haemophilus influenzae Rd
caaauacaauuuucuuuucaaac

SEQ ID NO: 2720457 - RNA, 17 nt, Haemophilus influenzae Rd
caaauacaccaagcauu

SEQ ID NO: 2720458 - RNA, 20 nt, Haemophilus influenzae Rd
caaauacagugacaaauuuu

SEQ ID NO: 2720459 - RNA, 17 nt, Haemophilus influenzae Rd
caaauacauauuuuuag

SEQ ID NO: 2720460 - RNA, 17 nt, Haemophilus influenzae Rd
caaauacaucuucacaa

SEQ ID NO: 2720461 - RNA, 18 nt, Haemophilus influenzae Rd
caaauacaucuucacaaa

SEQ ID NO: 2720462 - RNA, 20 nt, Haemophilus influenzae Rd
caaauacugaccuuuaggau

SEQ ID NO: 2720463 - RNA, 14 nt, Haemophilus influenzae Rd
caaauagaugaaau

SEQ ID NO: 2720464 - RNA, 19 nt, Haemophilus influenzae Rd
caaauagaugaaauuuauu

SEQ ID NO: 2720465 - RNA, 16 nt, Haemophilus influenzae Rd
caaauagcaaaaccga

SEQ ID NO: 2720466 - RNA, 22 nt, Haemophilus influenzae Rd
caaauaggcacauaaguaaaau

SEQ ID NO: 2720467 - RNA, 17 nt, Haemophilus influenzae Rd
caaauauaaaauaaaau

SEQ ID NO: 2720468 - RNA, 21 nt, Haemophilus influenzae Rd
caaauauaaauaguuaaagcc

SEQ ID NO: 2720469 - RNA, 22 nt, Haemophilus influenzae Rd
caaauauaaauaguuaaagccu

SEQ ID NO: 2720470 - RNA, 15 nt, Haemophilus influenzae Rd
caaauaucaaaaaaa

SEQ ID NO: 2720471 - RNA, 16 nt, Haemophilus influenzae Rd
caaauaucaaaaaaau

SEQ ID NO: 2720472 - RNA, 19 nt, Haemophilus influenzae Rd
caaauaugguaauuagccu

SEQ ID NO: 2720473 - RNA, 15 nt, Haemophilus influenzae Rd
caaauauucuucuaa

SEQ ID NO: 2720474 - RNA, 17 nt, Haemophilus influenzae Rd
caaauauucuucuaaaa

SEQ ID NO: 2720475 - RNA, 21 nt, Haemophilus influenzae Rd
caaauauucuucuaaaagauc

SEQ ID NO: 2720476 - RNA, 19 nt, Haemophilus influenzae Rd
caaauauugguuauuuaaa

SEQ ID NO: 2720477 - RNA, 23 nt, Haemophilus influenzae Rd
caaauauuuuccucgacauaaaa

SEQ ID NO: 2720478 - RNA, 15 nt, Haemophilus influenzae Rd
caaaucaaaaagcua

SEQ ID NO: 2720479 - RNA, 19 nt, Haemophilus influenzae Rd
caaaucaaaaccuuucugu

SEQ ID NO: 2720480 - RNA, 18 nt, Haemophilus influenzae Rd
caaaucauaccaauugca

SEQ ID NO: 2720481 - RNA, 22 nt, Haemophilus influenzae Rd
caaaucauaccaauugcaacuu

SEQ ID NO: 2720482 - RNA, 12 nt, Haemophilus influenzae Rd
caaaucauuuuu

SEQ ID NO: 2720483 - RNA, 22 nt, Haemophilus influenzae Rd
caaauccacccucguuaauauu

SEQ ID NO: 2720484 - RNA, 14 nt, Haemophilus influenzae Rd
caaaucgagguuuu

SEQ ID NO: 2720485 - RNA, 15 nt, Haemophilus influenzae Rd
caaaucgaucacuua

SEQ ID NO: 2720486 - RNA, 23 nt, Haemophilus influenzae Rd
caaaucgaucacuuaauaaaaau

SEQ ID NO: 2720487 - RNA, 17 nt, Haemophilus influenzae Rd
caaaucguaauuaaaau

SEQ ID NO: 2720488 - RNA, 19 nt, Haemophilus influenzae Rd
caaaucguuugucguaaua

SEQ ID NO: 2720489 - RNA, 13 nt, Haemophilus influenzae Rd
caaaucuaaaaau

SEQ ID NO: 2720490 - RNA, 18 nt, Haemophilus influenzae Rd
caaaucuaaaaauaugua

SEQ ID NO: 2720491 - RNA, 13 nt, Haemophilus influenzae Rd
caaaucuaacauu

SEQ ID NO: 2720492 - RNA, 17 nt, Haemophilus influenzae Rd
caaaucuacuaaaauaa

SEQ ID NO: 2720493 - RNA, 18 nt, Haemophilus influenzae Rd
caaaucuacuaaaauaag

SEQ ID NO: 2720494 - RNA, 22 nt, Haemophilus influenzae Rd
caaaucuggcaccuaaugaggu

SEQ ID NO: 2720495 - RNA, 21 nt, Haemophilus influenzae Rd
caaaucuucauuuucaaccac

SEQ ID NO: 2720496 - RNA, 20 nt, Haemophilus influenzae Rd
caaaucuugacauaauuuca

SEQ ID NO: 2720497 - RNA, 14 nt, Haemophilus influenzae Rd
caaaugaaauguuu

SEQ ID NO: 2720498 - RNA, 21 nt, Haemophilus influenzae Rd
caaaugaagugcgguugaaau

SEQ ID NO: 2720499 - RNA, 18 nt, Haemophilus influenzae Rd
caaaugaggaaaauaaag

SEQ ID NO: 2720500 - RNA, 13 nt, Haemophilus influenzae Rd
caaaugcaacaau

SEQ ID NO: 2720501 - RNA, 18 nt, Haemophilus influenzae Rd
caaaugcacauaacaaaa

SEQ ID NO: 2720502 - RNA, 19 nt, Haemophilus influenzae Rd
caaaugcacauaacaaaau

SEQ ID NO: 2720503 - RNA, 15 nt, Haemophilus influenzae Rd
caaaugccuaacaca

SEQ ID NO: 2720504 - RNA, 14 nt, Haemophilus influenzae Rd
caaaugcuaaauuc

SEQ ID NO: 2720505 - RNA, 11 nt, Haemophilus influenzae Rd
caaaugcuuug

SEQ ID NO: 2720506 - RNA, 14 nt, Haemophilus influenzae Rd
caaauggcaucaau

SEQ ID NO: 2720507 - RNA, 20 nt, Haemophilus influenzae Rd
caaaugggugcuuguucaug

SEQ ID NO: 2720508 - RNA, 14 nt, Haemophilus influenzae Rd
caaaugguguuuua

SEQ ID NO: 2720509 - RNA, 14 nt, Haemophilus influenzae Rd
caaauguaaaacag

SEQ ID NO: 2720510 - RNA, 18 nt, Haemophilus influenzae Rd
caaaugucauugauggcu

SEQ ID NO: 2720511 - RNA, 12 nt, Haemophilus influenzae Rd
caaaugucgaaa

SEQ ID NO: 2720512 - RNA, 20 nt, Haemophilus influenzae Rd
caaaugugaccgcuuguuua

SEQ ID NO: 2720513 - RNA, 14 nt, Haemophilus influenzae Rd
caaauuaaaaauau

SEQ ID NO: 2720514 - RNA, 14 nt, Haemophilus influenzae Rd
caaauuaaccgcac

SEQ ID NO: 2720515 - RNA, 13 nt, Haemophilus influenzae Rd
caaauuaauaaga

SEQ ID NO: 2720516 - RNA, 17 nt, Haemophilus influenzae Rd
caaauuacccaaaugau

SEQ ID NO: 2720517 - RNA, 17 nt, Haemophilus influenzae Rd
caaauuaucaaagaauu

SEQ ID NO: 2720518 - RNA, 19 nt, Haemophilus influenzae Rd
caaauuaucaaagaauuuu

SEQ ID NO: 2720519 - RNA, 14 nt, Haemophilus influenzae Rd
caaauucaacacgc

SEQ ID NO: 2720520 - RNA, 23 nt, Haemophilus influenzae Rd
caaauucaacacgccuaacauaa

SEQ ID NO: 2720521 - RNA, 20 nt, Haemophilus influenzae Rd
caaauucagcuaauucagcu

SEQ ID NO: 2720522 - RNA, 15 nt, Haemophilus influenzae Rd
caaauucauucuugc

SEQ ID NO: 2720523 - RNA, 19 nt, Haemophilus influenzae Rd
caaauuccauucacuuuca

SEQ ID NO: 2720524 - RNA, 15 nt, Haemophilus influenzae Rd
caaauuccgcaauau

SEQ ID NO: 2720525 - RNA, 19 nt, Haemophilus influenzae Rd
caaauucgccauauauaaa

SEQ ID NO: 2720526 - RNA, 14 nt, Haemophilus influenzae Rd
caaauucuaauucu

SEQ ID NO: 2720527 - RNA, 13 nt, Haemophilus influenzae Rd
caaauugauuaag

SEQ ID NO: 2720528 - RNA, 17 nt, Haemophilus influenzae Rd
caaauugauucauuuga

SEQ ID NO: 2720529 - RNA, 16 nt, Haemophilus influenzae Rd
caaauugcaaaaaacu

SEQ ID NO: 2720530 - RNA, 19 nt, Haemophilus influenzae Rd
caaauugcaaaaaacuuug

SEQ ID NO: 2720531 - RNA, 22 nt, Haemophilus influenzae Rd
caaauugcccuguugaaacagg

SEQ ID NO: 2720532 - RNA, 19 nt, Haemophilus influenzae Rd
caaauugcuaaugaugugc

SEQ ID NO: 2720533 - RNA, 23 nt, Haemophilus influenzae Rd
caaauuggagcgggaaacgaggc

SEQ ID NO: 2720534 - RNA, 21 nt, Haemophilus influenzae Rd
caaauuggguucgcaaauaac

SEQ ID NO: 2720535 - RNA, 23 nt, Haemophilus influenzae Rd
caaauuggguucgcaaauaacga

SEQ ID NO: 2720536 - RNA, 17 nt, Haemophilus influenzae Rd
caaauuguacuuuuuga

SEQ ID NO: 2720537 - RNA, 19 nt, Haemophilus influenzae Rd
caaauuguccuuugccuuu

SEQ ID NO: 2720538 - RNA, 16 nt, Haemophilus influenzae Rd
caaauuuaaauaauaa

SEQ ID NO: 2720539 - RNA, 17 nt, Haemophilus influenzae Rd
caaauuuaaauaauaaa

SEQ ID NO: 2720540 - RNA, 15 nt, Haemophilus influenzae Rd
caaauuuaaaugaug

SEQ ID NO: 2720541 - RNA, 18 nt, Haemophilus influenzae Rd
caaauuuaauauuucuuc

SEQ ID NO: 2720542 - RNA, 17 nt, Haemophilus influenzae Rd
caaauuuagauaacaau

SEQ ID NO: 2720543 - RNA, 14 nt, Haemophilus influenzae Rd
caaauuuaggauuu

SEQ ID NO: 2720544 - RNA, 23 nt, Haemophilus influenzae Rd
caaauuucuguugaaaucaaaug

SEQ ID NO: 2720545 - RNA, 15 nt, Haemophilus influenzae Rd
caaauuucuugcuau

SEQ ID NO: 2720546 - RNA, 20 nt, Haemophilus influenzae Rd
caaauuuguugaucugcaaa

SEQ ID NO: 2720547 - RNA, 20 nt, Haemophilus influenzae Rd
caaauuuguugcauuucuaa

SEQ ID NO: 2720548 - RNA, 21 nt, Haemophilus influenzae Rd
caaauuuuccgcauaaauaau

SEQ ID NO: 2720549 - RNA, 12 nt, Haemophilus influenzae Rd
caaauuuuccuu

SEQ ID NO: 2720550 - RNA, 13 nt, Haemophilus influenzae Rd
caaauuuuccuuc

SEQ ID NO: 2720551 - RNA, 17 nt, Haemophilus influenzae Rd
caaauuuugaugaaagu

SEQ ID NO: 2720552 - RNA, 14 nt, Haemophilus influenzae Rd
caaauuuuucacag

SEQ ID NO: 2720553 - RNA, 16 nt, Haemophilus influenzae Rd
caaauuuuucuuuucu

SEQ ID NO: 2720554 - RNA, 13 nt, Haemophilus influenzae Rd
caaauuuuuucaa

SEQ ID NO: 2720555 - RNA, 15 nt, Haemophilus influenzae Rd
caaauuuuuucaaaa

SEQ ID NO: 2720556 - RNA, 12 nt, Haemophilus influenzae Rd
caacaaaaaggc

SEQ ID NO: 2720557 - RNA, 18 nt, Haemophilus influenzae Rd
caacaaacauuaaucgau

SEQ ID NO: 2720558 - RNA, 19 nt, Haemophilus influenzae Rd
caacaaagucaauacacau

SEQ ID NO: 2720559 - RNA, 19 nt, Haemophilus influenzae Rd
caacaaagugcggcaaaaa

SEQ ID NO: 2720560 - RNA, 21 nt, Haemophilus influenzae Rd
caacaaagugcggcaaaaaau

SEQ ID NO: 2720561 - RNA, 14 nt, Haemophilus influenzae Rd
caacaaauaaauca

SEQ ID NO: 2720562 - RNA, 17 nt, Haemophilus influenzae Rd
caacaaauuuaaaugau

SEQ ID NO: 2720563 - RNA, 19 nt, Haemophilus influenzae Rd
caacaacgcccucgccuug

SEQ ID NO: 2720564 - RNA, 24 nt, Haemophilus influenzae Rd
caacaacgcccucgccuugcaaau

SEQ ID NO: 2720565 - RNA, 13 nt, Haemophilus influenzae Rd
caacaacuuuucu

SEQ ID NO: 2720566 - RNA, 22 nt, Haemophilus influenzae Rd
caacaaguaagucgugaucugc

SEQ ID NO: 2720567 - RNA, 21 nt, Haemophilus influenzae Rd
caacaagucaucgaguuuuau

SEQ ID NO: 2720568 - RNA, 22 nt, Haemophilus influenzae Rd
caacaauaacugccacaucauc

SEQ ID NO: 2720569 - RNA, 16 nt, Haemophilus influenzae Rd
caacaauaauuuuuaa

SEQ ID NO: 2720570 - RNA, 18 nt, Haemophilus influenzae Rd
caacaauacguugaacuu

SEQ ID NO: 2720571 - RNA, 12 nt, Haemophilus influenzae Rd
caacaauaucac

SEQ ID NO: 2720572 - RNA, 16 nt, Haemophilus influenzae Rd
caacaauccauuucgu

SEQ ID NO: 2720573 - RNA, 19 nt, Haemophilus influenzae Rd
caacaaugcuauaaaaccu

SEQ ID NO: 2720574 - RNA, 14 nt, Haemophilus influenzae Rd
caacaauucauaaa

SEQ ID NO: 2720575 - RNA, 20 nt, Haemophilus influenzae Rd
caacaauuucacugaaagua

SEQ ID NO: 2720576 - RNA, 16 nt, Haemophilus influenzae Rd
caacaauuucugcaua

SEQ ID NO: 2720577 - RNA, 21 nt, Haemophilus influenzae Rd
caacacaacaucagcuucaau

SEQ ID NO: 2720578 - RNA, 17 nt, Haemophilus influenzae Rd
caacacagcagcuaaaa

SEQ ID NO: 2720579 - RNA, 16 nt, Haemophilus influenzae Rd
caacaccgcaaaaaua

SEQ ID NO: 2720580 - RNA, 14 nt, Haemophilus influenzae Rd
caacaccuaagaac

SEQ ID NO: 2720581 - RNA, 23 nt, Haemophilus influenzae Rd
caacaccuaauaucaagucaaaa

SEQ ID NO: 2720582 - RNA, 19 nt, Haemophilus influenzae Rd
caacacuugcagcccaaca

SEQ ID NO: 2720583 - RNA, 19 nt, Haemophilus influenzae Rd
caacacuugcuguuuuucc

SEQ ID NO: 2720584 - RNA, 21 nt, Haemophilus influenzae Rd
caacacuugcuguuuuuccgc

SEQ ID NO: 2720585 - RNA, 16 nt, Haemophilus influenzae Rd
caacacuuuauuacuu

SEQ ID NO: 2720586 - RNA, 20 nt, Haemophilus influenzae Rd
caacacuuuauuacuuuuau

SEQ ID NO: 2720587 - RNA, 22 nt, Haemophilus influenzae Rd
caacagauucacggccgucaau

SEQ ID NO: 2720588 - RNA, 12 nt, Haemophilus influenzae Rd
caacagcgaaau

SEQ ID NO: 2720589 - RNA, 17 nt, Haemophilus influenzae Rd
caacaguaaauuuuucc

SEQ ID NO: 2720590 - RNA, 18 nt, Haemophilus influenzae Rd
caacaguaaauuuuucca

SEQ ID NO: 2720591 - RNA, 19 nt, Haemophilus influenzae Rd
caacaguaaauuuuuccac

SEQ ID NO: 2720592 - RNA, 18 nt, Haemophilus influenzae Rd
caacauaaagauuaaaau

SEQ ID NO: 2720593 - RNA, 16 nt, Haemophilus influenzae Rd
caacauaaauagagaa

SEQ ID NO: 2720594 - RNA, 14 nt, Haemophilus influenzae Rd
caacauaagcugca

SEQ ID NO: 2720595 - RNA, 17 nt, Haemophilus influenzae Rd
caacauaagcugcauca

SEQ ID NO: 2720596 - RNA, 23 nt, Haemophilus influenzae Rd
caacauagucgcuggaacuucua

SEQ ID NO: 2720597 - RNA, 23 nt, Haemophilus influenzae Rd
caacauauggauagaugaaaugc

SEQ ID NO: 2720598 - RNA, 14 nt, Haemophilus influenzae Rd
caacauauugcgaa

SEQ ID NO: 2720599 - RNA, 13 nt, Haemophilus influenzae Rd
caacauauuuucu

SEQ ID NO: 2720600 - RNA, 14 nt, Haemophilus influenzae Rd
caacauauuuucua

SEQ ID NO: 2720601 - RNA, 16 nt, Haemophilus influenzae Rd
caacauauuuucuaag

SEQ ID NO: 2720602 - RNA, 20 nt, Haemophilus influenzae Rd
caacauauuuucuaaggcuu

SEQ ID NO: 2720603 - RNA, 22 nt, Haemophilus influenzae Rd
caacaucaacuaauuuauuaaa

SEQ ID NO: 2720604 - RNA, 12 nt, Haemophilus influenzae Rd
caacaucuucua

SEQ ID NO: 2720605 - RNA, 15 nt, Haemophilus influenzae Rd
caacauuaauaacgu

SEQ ID NO: 2720606 - RNA, 16 nt, Haemophilus influenzae Rd
caacauuaauaacgug

SEQ ID NO: 2720607 - RNA, 14 nt, Haemophilus influenzae Rd
caaccaaacaaaaa

SEQ ID NO: 2720608 - RNA, 16 nt, Haemophilus influenzae Rd
caaccacuucaaauac

SEQ ID NO: 2720609 - RNA, 20 nt, Haemophilus influenzae Rd
caaccacuucgccaagugca

SEQ ID NO: 2720610 - RNA, 16 nt, Haemophilus influenzae Rd
caaccagcgcaccaca

SEQ ID NO: 2720611 - RNA, 15 nt, Haemophilus influenzae Rd
caaccauaacaagaa

SEQ ID NO: 2720612 - RNA, 23 nt, Haemophilus influenzae Rd
caaccauauuaaucgcaauaaca

SEQ ID NO: 2720613 - RNA, 15 nt, Haemophilus influenzae Rd
caaccaucuucaacg

SEQ ID NO: 2720614 - RNA, 17 nt, Haemophilus influenzae Rd
caaccaucuuuaauucc

SEQ ID NO: 2720615 - RNA, 15 nt, Haemophilus influenzae Rd
caaccauuacguaau

SEQ ID NO: 2720616 - RNA, 14 nt, Haemophilus influenzae Rd
caaccauucgccua

SEQ ID NO: 2720617 - RNA, 15 nt, Haemophilus influenzae Rd
caacccaauuuaccu

SEQ ID NO: 2720618 - RNA, 11 nt, Haemophilus influenzae Rd
caacccauaau

SEQ ID NO: 2720619 - RNA, 16 nt, Haemophilus influenzae Rd
caaccgcacuuaauaa

SEQ ID NO: 2720620 - RNA, 17 nt, Haemophilus influenzae Rd
caaccgcacuuaauaaa

SEQ ID NO: 2720621 - RNA, 21 nt, Haemophilus influenzae Rd
caaccgccugcauagaaugca

SEQ ID NO: 2720622 - RNA, 15 nt, Haemophilus influenzae Rd
caaccguaauaauug

SEQ ID NO: 2720623 - RNA, 22 nt, Haemophilus influenzae Rd
caaccguacacgcgcaaauuuu

SEQ ID NO: 2720624 - RNA, 21 nt, Haemophilus influenzae Rd
caaccguagucacaacaauua

SEQ ID NO: 2720625 - RNA, 11 nt, Haemophilus influenzae Rd
caaccuugagc

SEQ ID NO: 2720626 - RNA, 17 nt, Haemophilus influenzae Rd
caaccuuggucggaaug

SEQ ID NO: 2720627 - RNA, 18 nt, Haemophilus influenzae Rd
caaccuuugguaaaagaa

SEQ ID NO: 2720628 - RNA, 14 nt, Haemophilus influenzae Rd
caacgacuaaaauu

SEQ ID NO: 2720629 - RNA, 24 nt, Haemophilus influenzae Rd
caacgacuuuaccauugcguucac

SEQ ID NO: 2720630 - RNA, 14 nt, Haemophilus influenzae Rd
caacgcaucuauug

SEQ ID NO: 2720631 - RNA, 18 nt, Haemophilus influenzae Rd
caacgcaucuuuauaaca

SEQ ID NO: 2720632 - RNA, 13 nt, Haemophilus influenzae Rd
caacgcauuagca

SEQ ID NO: 2720633 - RNA, 13 nt, Haemophilus influenzae Rd
caacgcuuaauga

SEQ ID NO: 2720634 - RNA, 16 nt, Haemophilus influenzae Rd
caacgcuuaaugaacu

SEQ ID NO: 2720635 - RNA, 14 nt, Haemophilus influenzae Rd
caacggggcaaggc

SEQ ID NO: 2720636 - RNA, 18 nt, Haemophilus influenzae Rd
caacgguaacugauuuug

SEQ ID NO: 2720637 - RNA, 18 nt, Haemophilus influenzae Rd
caacguaagcaccaaugu

SEQ ID NO: 2720638 - RNA, 16 nt, Haemophilus influenzae Rd
caacguauuuauacca

SEQ ID NO: 2720639 - RNA, 17 nt, Haemophilus influenzae Rd
caacuaaaaaauaguua

SEQ ID NO: 2720640 - RNA, 18 nt, Haemophilus influenzae Rd
caacuaaaaagacaaaac

SEQ ID NO: 2720641 - RNA, 18 nt, Haemophilus influenzae Rd
caacuaaaaaucccauuu

SEQ ID NO: 2720642 - RNA, 12 nt, Haemophilus influenzae Rd
caacuaaauaag

SEQ ID NO: 2720643 - RNA, 13 nt, Haemophilus influenzae Rd
caacuaacacgcg

SEQ ID NO: 2720644 - RNA, 15 nt, Haemophilus influenzae Rd
caacuaauaaaccaa

SEQ ID NO: 2720645 - RNA, 24 nt, Haemophilus influenzae Rd
caacuaauaaaccaauaagauaga

SEQ ID NO: 2720646 - RNA, 21 nt, Haemophilus influenzae Rd
caacuaauagcgugaaaagcu

SEQ ID NO: 2720647 - RNA, 18 nt, Haemophilus influenzae Rd
caacuaauuuauuaaaaa

SEQ ID NO: 2720648 - RNA, 17 nt, Haemophilus influenzae Rd
caacucauuacacaaaa

SEQ ID NO: 2720649 - RNA, 18 nt, Haemophilus influenzae Rd
caacucauuacacaaaau

SEQ ID NO: 2720650 - RNA, 22 nt, Haemophilus influenzae Rd
caacucguucuuuguuaccuuu

SEQ ID NO: 2720651 - RNA, 19 nt, Haemophilus influenzae Rd
caacuguuuauagcgucuu

SEQ ID NO: 2720652 - RNA, 23 nt, Haemophilus influenzae Rd
caacuguuuauagcgucuuuuug

SEQ ID NO: 2720653 - RNA, 15 nt, Haemophilus influenzae Rd
caacuuaaguugggc

SEQ ID NO: 2720654 - RNA, 21 nt, Haemophilus influenzae Rd
caacuuaaguugggcuuauuu

SEQ ID NO: 2720655 - RNA, 13 nt, Haemophilus influenzae Rd
caacuucagcagc

SEQ ID NO: 2720656 - RNA, 15 nt, Haemophilus influenzae Rd
caacuuccgcuaaua

SEQ ID NO: 2720657 - RNA, 17 nt, Haemophilus influenzae Rd
caacuuccgcuaauacu

SEQ ID NO: 2720658 - RNA, 15 nt, Haemophilus influenzae Rd
caacuugaauaccug

SEQ ID NO: 2720659 - RNA, 13 nt, Haemophilus influenzae Rd
caacuugagcaaa

SEQ ID NO: 2720660 - RNA, 16 nt, Haemophilus influenzae Rd
caacuugccagcagaa

SEQ ID NO: 2720661 - RNA, 14 nt, Haemophilus influenzae Rd
caacuuggaaugca

SEQ ID NO: 2720662 - RNA, 23 nt, Haemophilus influenzae Rd
caacuuuauguccauaacuguca

SEQ ID NO: 2720663 - RNA, 13 nt, Haemophilus influenzae Rd
caacuuugaccau

SEQ ID NO: 2720664 - RNA, 18 nt, Haemophilus influenzae Rd
caacuuuugagucaauuu

SEQ ID NO: 2720665 - RNA, 20 nt, Haemophilus influenzae Rd
caacuuuuuauuuucugcag

SEQ ID NO: 2720666 - RNA, 17 nt, Haemophilus influenzae Rd
caacuuuuucaucuuua

SEQ ID NO: 2720667 - RNA, 13 nt, Haemophilus influenzae Rd
caacuuuuuuagg

SEQ ID NO: 2720668 - RNA, 17 nt, Haemophilus influenzae Rd
caagaaaccaaaauagc

SEQ ID NO: 2720669 - RNA, 22 nt, Haemophilus influenzae Rd
caagaaagaaauauaauaaaua

SEQ ID NO: 2720670 - RNA, 18 nt, Haemophilus influenzae Rd
caagaaagcguucaucaa

SEQ ID NO: 2720671 - RNA, 20 nt, Haemophilus influenzae Rd
caagaaaguuuaugacgaac

SEQ ID NO: 2720672 - RNA, 17 nt, Haemophilus influenzae Rd
caagaaauaauaaaaua

SEQ ID NO: 2720673 - RNA, 16 nt, Haemophilus influenzae Rd
caagaaauuuuguuuu

SEQ ID NO: 2720674 - RNA, 16 nt, Haemophilus influenzae Rd
caagaacaauuaauac

SEQ ID NO: 2720675 - RNA, 13 nt, Haemophilus influenzae Rd
caagaacagccag

SEQ ID NO: 2720676 - RNA, 13 nt, Haemophilus influenzae Rd
caagaauaaaaug

SEQ ID NO: 2720677 - RNA, 21 nt, Haemophilus influenzae Rd
caagaaugacuggcuugugaa

SEQ ID NO: 2720678 - RNA, 13 nt, Haemophilus influenzae Rd
caagacaaaauaa

SEQ ID NO: 2720679 - RNA, 18 nt, Haemophilus influenzae Rd
caagaccugcuucuuuua

SEQ ID NO: 2720680 - RNA, 20 nt, Haemophilus influenzae Rd
caagaccugcuucuuuuaau

SEQ ID NO: 2720681 - RNA, 16 nt, Haemophilus influenzae Rd
caagacugaauuuuac

SEQ ID NO: 2720682 - RNA, 23 nt, Haemophilus influenzae Rd
caagagccaguuggguuaaauau

SEQ ID NO: 2720683 - RNA, 23 nt, Haemophilus influenzae Rd
caagauaacugauuguccaaaga

SEQ ID NO: 2720684 - RNA, 14 nt, Haemophilus influenzae Rd
caagauaauaaagu

SEQ ID NO: 2720685 - RNA, 12 nt, Haemophilus influenzae Rd
caagauacuuuu

SEQ ID NO: 2720686 - RNA, 15 nt, Haemophilus influenzae Rd
caagaucaagcacuu

SEQ ID NO: 2720687 - RNA, 22 nt, Haemophilus influenzae Rd
caagaucaagcacuuuuccuuu

SEQ ID NO: 2720688 - RNA, 14 nt, Haemophilus influenzae Rd
caagaucaauauaa

SEQ ID NO: 2720689 - RNA, 16 nt, Haemophilus influenzae Rd
caagaugacugcaauu

SEQ ID NO: 2720690 - RNA, 12 nt, Haemophilus influenzae Rd
caagauucuaaa

SEQ ID NO: 2720691 - RNA, 13 nt, Haemophilus influenzae Rd
caagauucuaaau

SEQ ID NO: 2720692 - RNA, 18 nt, Haemophilus influenzae Rd
caagauuugccaaaauca

SEQ ID NO: 2720693 - RNA, 14 nt, Haemophilus influenzae Rd
caagauuuuuugaa

SEQ ID NO: 2720694 - RNA, 13 nt, Haemophilus influenzae Rd
caagcaaacagca

SEQ ID NO: 2720695 - RNA, 11 nt, Haemophilus influenzae Rd
caagcaaauau

SEQ ID NO: 2720696 - RNA, 14 nt, Haemophilus influenzae Rd
caagcaacaaguca

SEQ ID NO: 2720697 - RNA, 16 nt, Haemophilus influenzae Rd
caagcaaccuguggca

SEQ ID NO: 2720698 - RNA, 13 nt, Haemophilus influenzae Rd
caagcaagcaaaa

SEQ ID NO: 2720699 - RNA, 21 nt, Haemophilus influenzae Rd
caagcacaucauaacuacgaa

SEQ ID NO: 2720700 - RNA, 22 nt, Haemophilus influenzae Rd
caagcacauuaaucauuucaau

SEQ ID NO: 2720701 - RNA, 18 nt, Haemophilus influenzae Rd
caagcaccagucaagguu

SEQ ID NO: 2720702 - RNA, 21 nt, Haemophilus influenzae Rd
caagcagccauccccaaaaca

SEQ ID NO: 2720703 - RNA, 23 nt, Haemophilus influenzae Rd
caagcaguuuacgguuaagucau

SEQ ID NO: 2720704 - RNA, 14 nt, Haemophilus influenzae Rd
caagcauuaaauau

SEQ ID NO: 2720705 - RNA, 15 nt, Haemophilus influenzae Rd
caagcauuucaagcu

SEQ ID NO: 2720706 - RNA, 21 nt, Haemophilus influenzae Rd
caagcauuuuucauacaaucu

SEQ ID NO: 2720707 - RNA, 16 nt, Haemophilus influenzae Rd
caagccaaguuguaaa

SEQ ID NO: 2720708 - RNA, 13 nt, Haemophilus influenzae Rd
caagccaauuauu

SEQ ID NO: 2720709 - RNA, 17 nt, Haemophilus influenzae Rd
caagccuucuaaaauaa

SEQ ID NO: 2720710 - RNA, 20 nt, Haemophilus influenzae Rd
caagcgcgugugaaauuccu

SEQ ID NO: 2720711 - RNA, 23 nt, Haemophilus influenzae Rd
caagcggcugacauuacauaaau

SEQ ID NO: 2720712 - RNA, 16 nt, Haemophilus influenzae Rd
caagcuaagauugaca

SEQ ID NO: 2720713 - RNA, 22 nt, Haemophilus influenzae Rd
caagcuaccuuguggcaguaaa

SEQ ID NO: 2720714 - RNA, 14 nt, Haemophilus influenzae Rd
caagcucaaaaacg

SEQ ID NO: 2720715 - RNA, 19 nt, Haemophilus influenzae Rd
caagcugaccacuuucaau

SEQ ID NO: 2720716 - RNA, 23 nt, Haemophilus influenzae Rd
caagcugauuuaucauuccccag

SEQ ID NO: 2720717 - RNA, 16 nt, Haemophilus influenzae Rd
caagcuggcuaacaaa

SEQ ID NO: 2720718 - RNA, 21 nt, Haemophilus influenzae Rd
caagcuggcuaacaaauaaug

SEQ ID NO: 2720719 - RNA, 14 nt, Haemophilus influenzae Rd
caaggacaauaaua

SEQ ID NO: 2720720 - RNA, 18 nt, Haemophilus influenzae Rd
caaggacaauaauaagca

SEQ ID NO: 2720721 - RNA, 18 nt, Haemophilus influenzae Rd
caaggacuaggcucugua

SEQ ID NO: 2720722 - RNA, 20 nt, Haemophilus influenzae Rd
caaggcgaaucgaaagauuc

SEQ ID NO: 2720723 - RNA, 17 nt, Haemophilus influenzae Rd
caaggcuaacuggcaau

SEQ ID NO: 2720724 - RNA, 18 nt, Haemophilus influenzae Rd
caaggcuccaguuguaaa

SEQ ID NO: 2720725 - RNA, 22 nt, Haemophilus influenzae Rd
caaggcuuuaauuuuaucuaau

SEQ ID NO: 2720726 - RNA, 15 nt, Haemophilus influenzae Rd
caagggauuugaaaa

SEQ ID NO: 2720727 - RNA, 19 nt, Haemophilus influenzae Rd
caaggguacaacaaauuuc

SEQ ID NO: 2720728 - RNA, 20 nt, Haemophilus influenzae Rd
caaggguacaacaaauuuca

SEQ ID NO: 2720729 - RNA, 17 nt, Haemophilus influenzae Rd
caaggguuccugcauca

SEQ ID NO: 2720730 - RNA, 13 nt, Haemophilus influenzae Rd
caagguacuugaa

SEQ ID NO: 2720731 - RNA, 15 nt, Haemophilus influenzae Rd
caagguacuugaacu

SEQ ID NO: 2720732 - RNA, 19 nt, Haemophilus influenzae Rd
caagguugcaacaucaaua

SEQ ID NO: 2720733 - RNA, 18 nt, Haemophilus influenzae Rd
caagguugcccacaaaau

SEQ ID NO: 2720734 - RNA, 16 nt, Haemophilus influenzae Rd
caagguuguaagccca

SEQ ID NO: 2720735 - RNA, 23 nt, Haemophilus influenzae Rd
caagguuuuuugcuauguggauc

SEQ ID NO: 2720736 - RNA, 12 nt, Haemophilus influenzae Rd
caaguaaaucaa

SEQ ID NO: 2720737 - RNA, 23 nt, Haemophilus influenzae Rd
caaguaacgccgcacucgcugua

SEQ ID NO: 2720738 - RNA, 20 nt, Haemophilus influenzae Rd
caaguaauacaccaauaauu

SEQ ID NO: 2720739 - RNA, 21 nt, Haemophilus influenzae Rd
caaguaauacaccaauaauua

SEQ ID NO: 2720740 - RNA, 17 nt, Haemophilus influenzae Rd
caaguaaugcuuuaaau

SEQ ID NO: 2720741 - RNA, 17 nt, Haemophilus influenzae Rd
caaguacucuugucaau

SEQ ID NO: 2720742 - RNA, 16 nt, Haemophilus influenzae Rd
caaguauaaaaaagug

SEQ ID NO: 2720743 - RNA, 14 nt, Haemophilus influenzae Rd
caaguauaaaaaau

SEQ ID NO: 2720744 - RNA, 15 nt, Haemophilus influenzae Rd
caaguauaaaaaauc

SEQ ID NO: 2720745 - RNA, 18 nt, Haemophilus influenzae Rd
caaguaucaauguaauga

SEQ ID NO: 2720746 - RNA, 19 nt, Haemophilus influenzae Rd
caaguauuuuguggaauau

SEQ ID NO: 2720747 - RNA, 15 nt, Haemophilus influenzae Rd
caagucagcucaagc

SEQ ID NO: 2720748 - RNA, 20 nt, Haemophilus influenzae Rd
caagucagcucaagcaacau

SEQ ID NO: 2720749 - RNA, 14 nt, Haemophilus influenzae Rd
caaguccaaguuuu

SEQ ID NO: 2720750 - RNA, 21 nt, Haemophilus influenzae Rd
caagucucuaugauuuuuuug

SEQ ID NO: 2720751 - RNA, 22 nt, Haemophilus influenzae Rd
caagugaaauucuaccugcugu

SEQ ID NO: 2720752 - RNA, 13 nt, Haemophilus influenzae Rd
caagugauuauuu

SEQ ID NO: 2720753 - RNA, 20 nt, Haemophilus influenzae Rd
caagugcgaucgcuccacca

SEQ ID NO: 2720754 - RNA, 19 nt, Haemophilus influenzae Rd
caagugcggguucuuuuuu

SEQ ID NO: 2720755 - RNA, 16 nt, Haemophilus influenzae Rd
caagugcgguaaaauu

SEQ ID NO: 2720756 - RNA, 18 nt, Haemophilus influenzae Rd
caagugcgguaaaauuuu

SEQ ID NO: 2720757 - RNA, 22 nt, Haemophilus influenzae Rd
caagugcgguaaaauuuuucuc

SEQ ID NO: 2720758 - RNA, 18 nt, Haemophilus influenzae Rd
caaguggcgguaaaaaug

SEQ ID NO: 2720759 - RNA, 20 nt, Haemophilus influenzae Rd
caagugguggaauaaaaguc

SEQ ID NO: 2720760 - RNA, 24 nt, Haemophilus influenzae Rd
caagugugugaaaggcaagcucua

SEQ ID NO: 2720761 - RNA, 14 nt, Haemophilus influenzae Rd
caaguuaaaaaaug

SEQ ID NO: 2720762 - RNA, 19 nt, Haemophilus influenzae Rd
caaguuaaaaaaugauuaa

SEQ ID NO: 2720763 - RNA, 20 nt, Haemophilus influenzae Rd
caaguuaaaaaaugauuaag

SEQ ID NO: 2720764 - RNA, 22 nt, Haemophilus influenzae Rd
caaguuaaaaaaugauuaaguu

SEQ ID NO: 2720765 - RNA, 21 nt, Haemophilus influenzae Rd
caaguucacaaaucuaaaaau

SEQ ID NO: 2720766 - RNA, 19 nt, Haemophilus influenzae Rd
caaguugaagagaauuuuc

SEQ ID NO: 2720767 - RNA, 21 nt, Haemophilus influenzae Rd
caaguugaagagaauuuucau

SEQ ID NO: 2720768 - RNA, 19 nt, Haemophilus influenzae Rd
caaguugggauuuaucuuc

SEQ ID NO: 2720769 - RNA, 15 nt, Haemophilus influenzae Rd
caaguuguaaaagug

SEQ ID NO: 2720770 - RNA, 14 nt, Haemophilus influenzae Rd
caaguuguuugaua

SEQ ID NO: 2720771 - RNA, 19 nt, Haemophilus influenzae Rd
caaguuucuaaaaucacuu

SEQ ID NO: 2720772 - RNA, 21 nt, Haemophilus influenzae Rd
caaguuuuauuugagaaaaau

SEQ ID NO: 2720773 - RNA, 13 nt, Haemophilus influenzae Rd
caauaaaaaaaca

SEQ ID NO: 2720774 - RNA, 13 nt, Haemophilus influenzae Rd
caauaaaaaaacu

SEQ ID NO: 2720775 - RNA, 13 nt, Haemophilus influenzae Rd
caauaaaaagaua

SEQ ID NO: 2720776 - RNA, 13 nt, Haemophilus influenzae Rd
caauaaaagcaau

SEQ ID NO: 2720777 - RNA, 13 nt, Haemophilus influenzae Rd
caauaaacagaaa

SEQ ID NO: 2720778 - RNA, 19 nt, Haemophilus influenzae Rd
caauaaacagaaauauugu

SEQ ID NO: 2720779 - RNA, 21 nt, Haemophilus influenzae Rd
caauaaacagaaauauugucu

SEQ ID NO: 2720780 - RNA, 11 nt, Haemophilus influenzae Rd
caauaaacauu

SEQ ID NO: 2720781 - RNA, 19 nt, Haemophilus influenzae Rd
caauaaacccgaaauauaa

SEQ ID NO: 2720782 - RNA, 23 nt, Haemophilus influenzae Rd
caauaaagagaaagugcaacuau

SEQ ID NO: 2720783 - RNA, 19 nt, Haemophilus influenzae Rd
caauaaaguugagaauuuu

SEQ ID NO: 2720784 - RNA, 14 nt, Haemophilus influenzae Rd
caauaaauaucuaa

SEQ ID NO: 2720785 - RNA, 20 nt, Haemophilus influenzae Rd
caauaaauaucuaaacuuca

SEQ ID NO: 2720786 - RNA, 16 nt, Haemophilus influenzae Rd
caauaaauucaccacu

SEQ ID NO: 2720787 - RNA, 21 nt, Haemophilus influenzae Rd
caauaaauucguacaaaugaa

SEQ ID NO: 2720788 - RNA, 22 nt, Haemophilus influenzae Rd
caauaaauucguacaaaugaaa

SEQ ID NO: 2720789 - RNA, 18 nt, Haemophilus influenzae Rd
caauaacaagcucagguu

SEQ ID NO: 2720790 - RNA, 14 nt, Haemophilus influenzae Rd
caauaaccaauaac

SEQ ID NO: 2720791 - RNA, 23 nt, Haemophilus influenzae Rd
caauaaccacgccuucgaaugcu

SEQ ID NO: 2720792 - RNA, 22 nt, Haemophilus influenzae Rd
caauaacgagguuggcaauaaa

SEQ ID NO: 2720793 - RNA, 18 nt, Haemophilus influenzae Rd
caauaacgauauucuugc

SEQ ID NO: 2720794 - RNA, 19 nt, Haemophilus influenzae Rd
caauaacguuacuaaaauc

SEQ ID NO: 2720795 - RNA, 15 nt, Haemophilus influenzae Rd
caauaacuaaaaaua

SEQ ID NO: 2720796 - RNA, 16 nt, Haemophilus influenzae Rd
caauaacuaaaaauac

SEQ ID NO: 2720797 - RNA, 13 nt, Haemophilus influenzae Rd
caauaagcaagua

SEQ ID NO: 2720798 - RNA, 23 nt, Haemophilus influenzae Rd
caauaagcucgccuuuuucaaag

SEQ ID NO: 2720799 - RNA, 20 nt, Haemophilus influenzae Rd
caauaagugcgguaaaaaaa

SEQ ID NO: 2720800 - RNA, 22 nt, Haemophilus influenzae Rd
caauaagugcgguaaaaaaaug

SEQ ID NO: 2720801 - RNA, 20 nt, Haemophilus influenzae Rd
caauaauauuugguguauuu

SEQ ID NO: 2720802 - RNA, 16 nt, Haemophilus influenzae Rd
caauaaucaauacucc

SEQ ID NO: 2720803 - RNA, 15 nt, Haemophilus influenzae Rd
caauaaucacaguac

SEQ ID NO: 2720804 - RNA, 14 nt, Haemophilus influenzae Rd
caauaauguugcug

SEQ ID NO: 2720805 - RNA, 17 nt, Haemophilus influenzae Rd
caauaauuaaacagcca

SEQ ID NO: 2720806 - RNA, 23 nt, Haemophilus influenzae Rd
caauaauuaaacagccaaacaaa

SEQ ID NO: 2720807 - RNA, 15 nt, Haemophilus influenzae Rd
caauaauucuuuaau

SEQ ID NO: 2720808 - RNA, 23 nt, Haemophilus influenzae Rd
caauaauucuuuaaucguuacca

SEQ ID NO: 2720809 - RNA, 14 nt, Haemophilus influenzae Rd
caauaauugaugcu

SEQ ID NO: 2720810 - RNA, 17 nt, Haemophilus influenzae Rd
caauaauugaugcuaaa

SEQ ID NO: 2720811 - RNA, 13 nt, Haemophilus influenzae Rd
caauaauuucaau

SEQ ID NO: 2720812 - RNA, 21 nt, Haemophilus influenzae Rd
caauaauuucauuguuaaaua

SEQ ID NO: 2720813 - RNA, 15 nt, Haemophilus influenzae Rd
caauaauuuucaaua

SEQ ID NO: 2720814 - RNA, 14 nt, Haemophilus influenzae Rd
caauacaaauacug

SEQ ID NO: 2720815 - RNA, 18 nt, Haemophilus influenzae Rd
caauacccgcuucaaucg

SEQ ID NO: 2720816 - RNA, 15 nt, Haemophilus influenzae Rd
caauaccuaacguua

SEQ ID NO: 2720817 - RNA, 22 nt, Haemophilus influenzae Rd
caauacgauucguuucaguacg

SEQ ID NO: 2720818 - RNA, 20 nt, Haemophilus influenzae Rd
caauacguaaucccauuuca

SEQ ID NO: 2720819 - RNA, 16 nt, Haemophilus influenzae Rd
caauacuggcugaaca

SEQ ID NO: 2720820 - RNA, 20 nt, Haemophilus influenzae Rd
caauacuguuuggcaaauag

SEQ ID NO: 2720821 - RNA, 11 nt, Haemophilus influenzae Rd
caauacuuagc

SEQ ID NO: 2720822 - RNA, 20 nt, Haemophilus influenzae Rd
caauagaacgcacacaacaa

SEQ ID NO: 2720823 - RNA, 13 nt, Haemophilus influenzae Rd
caauagaacguaa

SEQ ID NO: 2720824 - RNA, 16 nt, Haemophilus influenzae Rd
caauagauguuaauug

SEQ ID NO: 2720825 - RNA, 24 nt, Haemophilus influenzae Rd
caauagauucuaagguugcucgaa

SEQ ID NO: 2720826 - RNA, 20 nt, Haemophilus influenzae Rd
caauagauugugaaauuuca

SEQ ID NO: 2720827 - RNA, 21 nt, Haemophilus influenzae Rd
caauagauugugaaauuucau

SEQ ID NO: 2720828 - RNA, 13 nt, Haemophilus influenzae Rd
caauagauuuaau

SEQ ID NO: 2720829 - RNA, 20 nt, Haemophilus influenzae Rd
caauagcauuaaagucuaau

SEQ ID NO: 2720830 - RNA, 14 nt, Haemophilus influenzae Rd
caauagccaauaau

SEQ ID NO: 2720831 - RNA, 16 nt, Haemophilus influenzae Rd
caauagccuguaaauu

SEQ ID NO: 2720832 - RNA, 22 nt, Haemophilus influenzae Rd
caauagcgaccaacaguuaagc

SEQ ID NO: 2720833 - RNA, 19 nt, Haemophilus influenzae Rd
caauagcuuccgcuuuuuu

SEQ ID NO: 2720834 - RNA, 20 nt, Haemophilus influenzae Rd
caauaggaagcauuucuaaa

SEQ ID NO: 2720835 - RNA, 21 nt, Haemophilus influenzae Rd
caauaggaagcauuucuaaag

SEQ ID NO: 2720836 - RNA, 23 nt, Haemophilus influenzae Rd
caauagguugaagaacguaaauu

SEQ ID NO: 2720837 - RNA, 13 nt, Haemophilus influenzae Rd
caauauaaaaaau

SEQ ID NO: 2720838 - RNA, 22 nt, Haemophilus influenzae Rd
caauauaaugguggcguuuuau

SEQ ID NO: 2720839 - RNA, 20 nt, Haemophilus influenzae Rd
caauauaauuuacuguuuaa

SEQ ID NO: 2720840 - RNA, 15 nt, Haemophilus influenzae Rd
caauauaggcuauau

SEQ ID NO: 2720841 - RNA, 21 nt, Haemophilus influenzae Rd
caauauaggcuauauuuucca

SEQ ID NO: 2720842 - RNA, 13 nt, Haemophilus influenzae Rd
caauauagucaaa

SEQ ID NO: 2720843 - RNA, 17 nt, Haemophilus influenzae Rd
caauauagucaaauaac

SEQ ID NO: 2720844 - RNA, 23 nt, Haemophilus influenzae Rd
caauauauaaauccguaaaauac

SEQ ID NO: 2720845 - RNA, 16 nt, Haemophilus influenzae Rd
caauauaucagacaau

SEQ ID NO: 2720846 - RNA, 15 nt, Haemophilus influenzae Rd
caauauauucggaaa

SEQ ID NO: 2720847 - RNA, 18 nt, Haemophilus influenzae Rd
caauauauucggaaaaaa

SEQ ID NO: 2720848 - RNA, 22 nt, Haemophilus influenzae Rd
caauauauucggaaaaaauuug

SEQ ID NO: 2720849 - RNA, 16 nt, Haemophilus influenzae Rd
caauaucauugacuuu

SEQ ID NO: 2720850 - RNA, 15 nt, Haemophilus influenzae Rd
caauaucuaagaaaa

SEQ ID NO: 2720851 - RNA, 21 nt, Haemophilus influenzae Rd
caauaucuaagaaaauagaag

SEQ ID NO: 2720852 - RNA, 20 nt, Haemophilus influenzae Rd
caauaucuagcacagcaauu

SEQ ID NO: 2720853 - RNA, 20 nt, Haemophilus influenzae Rd
caauaucucgugaugcagaa

SEQ ID NO: 2720854 - RNA, 15 nt, Haemophilus influenzae Rd
caauaugaacauuau

SEQ ID NO: 2720855 - RNA, 19 nt, Haemophilus influenzae Rd
caauaugcgcuucaucaaa

SEQ ID NO: 2720856 - RNA, 23 nt, Haemophilus influenzae Rd
caauauggguucaauauaacuca

SEQ ID NO: 2720857 - RNA, 17 nt, Haemophilus influenzae Rd
caauauguauaauuccu

SEQ ID NO: 2720858 - RNA, 20 nt, Haemophilus influenzae Rd
caauauguauaauuccuaaa

SEQ ID NO: 2720859 - RNA, 15 nt, Haemophilus influenzae Rd
caauauguuuaccac

SEQ ID NO: 2720860 - RNA, 15 nt, Haemophilus influenzae Rd
caauauucuuuaaaa

SEQ ID NO: 2720861 - RNA, 20 nt, Haemophilus influenzae Rd
caauauucuuuaaaacauuc

SEQ ID NO: 2720862 - RNA, 12 nt, Haemophilus influenzae Rd
caauauugaaaa

SEQ ID NO: 2720863 - RNA, 12 nt, Haemophilus influenzae Rd
caauauugaaau

SEQ ID NO: 2720864 - RNA, 14 nt, Haemophilus influenzae Rd
caauauugaaauaa

SEQ ID NO: 2720865 - RNA, 12 nt, Haemophilus influenzae Rd
caauauuuaaau

SEQ ID NO: 2720866 - RNA, 18 nt, Haemophilus influenzae Rd
caauauuuaaauacacuu

SEQ ID NO: 2720867 - RNA, 21 nt, Haemophilus influenzae Rd
caauauuuaaauacacuucua

SEQ ID NO: 2720868 - RNA, 23 nt, Haemophilus influenzae Rd
caauauuuaauaugccaaauaaa

SEQ ID NO: 2720869 - RNA, 13 nt, Haemophilus influenzae Rd
caauauuucaaua

SEQ ID NO: 2720870 - RNA, 13 nt, Haemophilus influenzae Rd
caauauuuccucu

SEQ ID NO: 2720871 - RNA, 18 nt, Haemophilus influenzae Rd
caauauuuccucuaaaua

SEQ ID NO: 2720872 - RNA, 21 nt, Haemophilus influenzae Rd
caauauuugguugaacuucua

SEQ ID NO: 2720873 - RNA, 13 nt, Haemophilus influenzae Rd
caaucaaaaaauc

SEQ ID NO: 2720874 - RNA, 15 nt, Haemophilus influenzae Rd
caaucaaauucaaca

SEQ ID NO: 2720875 - RNA, 16 nt, Haemophilus influenzae Rd
caaucaaauucaacac

SEQ ID NO: 2720876 - RNA, 22 nt, Haemophilus influenzae Rd
caaucacaaaauggcaaacaaa

SEQ ID NO: 2720877 - RNA, 15 nt, Haemophilus influenzae Rd
caaucacaacacaau

SEQ ID NO: 2720878 - RNA, 19 nt, Haemophilus influenzae Rd
caaucacgaucugcaacau

SEQ ID NO: 2720879 - RNA, 22 nt, Haemophilus influenzae Rd
caaucacgaucugcaacaucac

SEQ ID NO: 2720880 - RNA, 16 nt, Haemophilus influenzae Rd
caaucacuguaucuuu

SEQ ID NO: 2720881 - RNA, 20 nt, Haemophilus influenzae Rd
caaucacuguaucuuuuugu

SEQ ID NO: 2720882 - RNA, 20 nt, Haemophilus influenzae Rd
caaucacuucucugacuaau

SEQ ID NO: 2720883 - RNA, 14 nt, Haemophilus influenzae Rd
caaucagcaaaacu

SEQ ID NO: 2720884 - RNA, 13 nt, Haemophilus influenzae Rd
caaucagcaacau

SEQ ID NO: 2720885 - RNA, 18 nt, Haemophilus influenzae Rd
caaucaggcgauccaucg

SEQ ID NO: 2720886 - RNA, 18 nt, Haemophilus influenzae Rd
caaucaggcuuucauuuu

SEQ ID NO: 2720887 - RNA, 13 nt, Haemophilus influenzae Rd
caaucaguuuuac

SEQ ID NO: 2720888 - RNA, 16 nt, Haemophilus influenzae Rd
caaucaguuuuacgcu

SEQ ID NO: 2720889 - RNA, 16 nt, Haemophilus influenzae Rd
caaucauaaaaacaau

SEQ ID NO: 2720890 - RNA, 13 nt, Haemophilus influenzae Rd
caaucauaaaauu

SEQ ID NO: 2720891 - RNA, 18 nt, Haemophilus influenzae Rd
caaucauacuaaauacau

SEQ ID NO: 2720892 - RNA, 20 nt, Haemophilus influenzae Rd
caaucauacuaaauacauuu

SEQ ID NO: 2720893 - RNA, 12 nt, Haemophilus influenzae Rd
caaucauaucau

SEQ ID NO: 2720894 - RNA, 16 nt, Haemophilus influenzae Rd
caaucauaucaucaac

SEQ ID NO: 2720895 - RNA, 17 nt, Haemophilus influenzae Rd
caaucaucaucccaauc

SEQ ID NO: 2720896 - RNA, 15 nt, Haemophilus influenzae Rd
caaucaucauuuauu

SEQ ID NO: 2720897 - RNA, 19 nt, Haemophilus influenzae Rd
caaucaucccuucuuuuau

SEQ ID NO: 2720898 - RNA, 15 nt, Haemophilus influenzae Rd
caauccaaguauuuu

SEQ ID NO: 2720899 - RNA, 10 nt, Haemophilus influenzae Rd
caauccauaa

SEQ ID NO: 2720900 - RNA, 17 nt, Haemophilus influenzae Rd
caauccauaaaauacag

SEQ ID NO: 2720901 - RNA, 22 nt, Haemophilus influenzae Rd
caauccauuucgucgcuuuucc

SEQ ID NO: 2720902 - RNA, 17 nt, Haemophilus influenzae Rd
caauccauuuuuaaaug

SEQ ID NO: 2720903 - RNA, 16 nt, Haemophilus influenzae Rd
caauccgcuuguuaau

SEQ ID NO: 2720904 - RNA, 16 nt, Haemophilus influenzae Rd
caauccuaacuuuucu

SEQ ID NO: 2720905 - RNA, 21 nt, Haemophilus influenzae Rd
caauccuaacuuuucuucaau

SEQ ID NO: 2720906 - RNA, 17 nt, Haemophilus influenzae Rd
caauccuuuacgggauu

SEQ ID NO: 2720907 - RNA, 20 nt, Haemophilus influenzae Rd
caaucgacuuuguccaaaaa

SEQ ID NO: 2720908 - RNA, 15 nt, Haemophilus influenzae Rd
caaucgcaucauuca

SEQ ID NO: 2720909 - RNA, 15 nt, Haemophilus influenzae Rd
caaucgccaauguuu

SEQ ID NO: 2720910 - RNA, 11 nt, Haemophilus influenzae Rd
caaucuaauuc

SEQ ID NO: 2720911 - RNA, 23 nt, Haemophilus influenzae Rd
caaucucuagauuuuuuacucaa

SEQ ID NO: 2720912 - RNA, 16 nt, Haemophilus influenzae Rd
caaucucuuuacuguu

SEQ ID NO: 2720913 - RNA, 21 nt, Haemophilus influenzae Rd
caaucucuuuacuguucaaau

SEQ ID NO: 2720914 - RNA, 15 nt, Haemophilus influenzae Rd
caaucuggauuggau

SEQ ID NO: 2720915 - RNA, 18 nt, Haemophilus influenzae Rd
caaucuguccaucuuuua

SEQ ID NO: 2720916 - RNA, 18 nt, Haemophilus influenzae Rd
caaucuguggcguauuua

SEQ ID NO: 2720917 - RNA, 13 nt, Haemophilus influenzae Rd
caaucuuguuuua

SEQ ID NO: 2720918 - RNA, 22 nt, Haemophilus influenzae Rd
caaucuuuaaaacuauaaaaau

SEQ ID NO: 2720919 - RNA, 17 nt, Haemophilus influenzae Rd
caaucuuuggcaaaaaa

SEQ ID NO: 2720920 - RNA, 22 nt, Haemophilus influenzae Rd
caaucuuuggcaaaaaauacau

SEQ ID NO: 2720921 - RNA, 18 nt, Haemophilus influenzae Rd
caaucuuuuuguuaauaa

SEQ ID NO: 2720922 - RNA, 14 nt, Haemophilus influenzae Rd
caaugaaauauuac

SEQ ID NO: 2720923 - RNA, 21 nt, Haemophilus influenzae Rd
caaugaaaucgcaguuucuuu

SEQ ID NO: 2720924 - RNA, 12 nt, Haemophilus influenzae Rd
caaugaaauuuu

SEQ ID NO: 2720925 - RNA, 15 nt, Haemophilus influenzae Rd
caaugaauauaaaau

SEQ ID NO: 2720926 - RNA, 16 nt, Haemophilus influenzae Rd
caaugaauuaaaaguu

SEQ ID NO: 2720927 - RNA, 22 nt, Haemophilus influenzae Rd
caaugacacgacgagcuguugc

SEQ ID NO: 2720928 - RNA, 12 nt, Haemophilus influenzae Rd
caaugacugaua

SEQ ID NO: 2720929 - RNA, 23 nt, Haemophilus influenzae Rd
caaugagccaacucgaacaugaa

SEQ ID NO: 2720930 - RNA, 23 nt, Haemophilus influenzae Rd
caaugaguguuauugaugaagau

SEQ ID NO: 2720931 - RNA, 22 nt, Haemophilus influenzae Rd
caaugauugagcgauagaaaua

SEQ ID NO: 2720932 - RNA, 16 nt, Haemophilus influenzae Rd
caaugcaaaaguaaau

SEQ ID NO: 2720933 - RNA, 19 nt, Haemophilus influenzae Rd
caaugcaaauuaacgguuu

SEQ ID NO: 2720934 - RNA, 14 nt, Haemophilus influenzae Rd
caaugcaacaauac

SEQ ID NO: 2720935 - RNA, 21 nt, Haemophilus influenzae Rd
caaugcaauuggcaauauuaa

SEQ ID NO: 2720936 - RNA, 15 nt, Haemophilus influenzae Rd
caaugcacuuguggc

SEQ ID NO: 2720937 - RNA, 23 nt, Haemophilus influenzae Rd
caaugccagcgcuugcaccaaug

SEQ ID NO: 2720938 - RNA, 16 nt, Haemophilus influenzae Rd
caaugccauuuuuuau

SEQ ID NO: 2720939 - RNA, 15 nt, Haemophilus influenzae Rd
caaugccuuuuguau

SEQ ID NO: 2720940 - RNA, 21 nt, Haemophilus influenzae Rd
caaugccuuuuguauccaauc

SEQ ID NO: 2720941 - RNA, 17 nt, Haemophilus influenzae Rd
caaugcuuccuucaaac

SEQ ID NO: 2720942 - RNA, 15 nt, Haemophilus influenzae Rd
caaugcuuuuaauuu

SEQ ID NO: 2720943 - RNA, 16 nt, Haemophilus influenzae Rd
caauggaaauaccaug

SEQ ID NO: 2720944 - RNA, 13 nt, Haemophilus influenzae Rd
caauggaauacca

SEQ ID NO: 2720945 - RNA, 21 nt, Haemophilus influenzae Rd
caauggcaaucacaguuuuau

SEQ ID NO: 2720946 - RNA, 23 nt, Haemophilus influenzae Rd
caauggcugaaaaauucaaagaa

SEQ ID NO: 2720947 - RNA, 19 nt, Haemophilus influenzae Rd
caauggcuuuuaauccaag

SEQ ID NO: 2720948 - RNA, 22 nt, Haemophilus influenzae Rd
caauggggguuagguaaaaauc

SEQ ID NO: 2720949 - RNA, 17 nt, Haemophilus influenzae Rd
caaugguucgagaaacu

SEQ ID NO: 2720950 - RNA, 18 nt, Haemophilus influenzae Rd
caaugguucgagaaacuu

SEQ ID NO: 2720951 - RNA, 14 nt, Haemophilus influenzae Rd
caaugguuggacaa

SEQ ID NO: 2720952 - RNA, 12 nt, Haemophilus influenzae Rd
caaugguuuuac

SEQ ID NO: 2720953 - RNA, 16 nt, Haemophilus influenzae Rd
caaugguuuuacugug

SEQ ID NO: 2720954 - RNA, 13 nt, Haemophilus influenzae Rd
caaugucuuuuuc

SEQ ID NO: 2720955 - RNA, 17 nt, Haemophilus influenzae Rd
caauguuaaguucauca

SEQ ID NO: 2720956 - RNA, 18 nt, Haemophilus influenzae Rd
caauguuaaguucaucau

SEQ ID NO: 2720957 - RNA, 20 nt, Haemophilus influenzae Rd
caauguuauugccuaauaaa

SEQ ID NO: 2720958 - RNA, 14 nt, Haemophilus influenzae Rd
caauguuccaccac

SEQ ID NO: 2720959 - RNA, 17 nt, Haemophilus influenzae Rd
caauguucgauuuuacu

SEQ ID NO: 2720960 - RNA, 12 nt, Haemophilus influenzae Rd
caauguuuggau

SEQ ID NO: 2720961 - RNA, 20 nt, Haemophilus influenzae Rd
caauguuuuaaguucaacac

SEQ ID NO: 2720962 - RNA, 17 nt, Haemophilus influenzae Rd
caauguuuuagagaaau

SEQ ID NO: 2720963 - RNA, 22 nt, Haemophilus influenzae Rd
caauguuuucgccccauuauuu

SEQ ID NO: 2720964 - RNA, 13 nt, Haemophilus influenzae Rd
caauuaaaucaaa

SEQ ID NO: 2720965 - RNA, 21 nt, Haemophilus influenzae Rd
caauuaaaucaaaaauuaaga

SEQ ID NO: 2720966 - RNA, 16 nt, Haemophilus influenzae Rd
caauuaaccauaaaaa

SEQ ID NO: 2720967 - RNA, 21 nt, Haemophilus influenzae Rd
caauuaagccugcaaagccuu

SEQ ID NO: 2720968 - RNA, 18 nt, Haemophilus influenzae Rd
caauuaaggcauuuuccc

SEQ ID NO: 2720969 - RNA, 16 nt, Haemophilus influenzae Rd
caauuaauacgucaau

SEQ ID NO: 2720970 - RNA, 19 nt, Haemophilus influenzae Rd
caauuaauacgucaauugc

SEQ ID NO: 2720971 - RNA, 20 nt, Haemophilus influenzae Rd
caauuaauacgucaauugcu

SEQ ID NO: 2720972 - RNA, 23 nt, Haemophilus influenzae Rd
caauuaauacgucaauugcuaaa

SEQ ID NO: 2720973 - RNA, 18 nt, Haemophilus influenzae Rd
caauuaauauaaaggauu

SEQ ID NO: 2720974 - RNA, 21 nt, Haemophilus influenzae Rd
caauuaauggcaauucgugaa

SEQ ID NO: 2720975 - RNA, 13 nt, Haemophilus influenzae Rd
caauuaauucgau

SEQ ID NO: 2720976 - RNA, 23 nt, Haemophilus influenzae Rd
caauuaccuuagccaaaucaucu

SEQ ID NO: 2720977 - RNA, 17 nt, Haemophilus influenzae Rd
caauuacgacauucuuu

SEQ ID NO: 2720978 - RNA, 20 nt, Haemophilus influenzae Rd
caauuacguaaucauccacu

SEQ ID NO: 2720979 - RNA, 16 nt, Haemophilus influenzae Rd
caauuacguagauaau

SEQ ID NO: 2720980 - RNA, 19 nt, Haemophilus influenzae Rd
caauuacuucuuacaacaa

SEQ ID NO: 2720981 - RNA, 20 nt, Haemophilus influenzae Rd
caauuacuucuuacaacaaa

SEQ ID NO: 2720982 - RNA, 16 nt, Haemophilus influenzae Rd
caauuagaugauuuua

SEQ ID NO: 2720983 - RNA, 18 nt, Haemophilus influenzae Rd
caauuagaugauuuuaaa

SEQ ID NO: 2720984 - RNA, 19 nt, Haemophilus influenzae Rd
caauuagaugauuuuaaaa

SEQ ID NO: 2720985 - RNA, 19 nt, Haemophilus influenzae Rd
caauuagaugauuuuaaag

SEQ ID NO: 2720986 - RNA, 17 nt, Haemophilus influenzae Rd
caauuaggcgaauuugu

SEQ ID NO: 2720987 - RNA, 17 nt, Haemophilus influenzae Rd
caauuauccgagagaaa

SEQ ID NO: 2720988 - RNA, 14 nt, Haemophilus influenzae Rd
caauuauuggauug

SEQ ID NO: 2720989 - RNA, 23 nt, Haemophilus influenzae Rd
caauuauuggauugaaucaauuu

SEQ ID NO: 2720990 - RNA, 12 nt, Haemophilus influenzae Rd
caauuauuuaua

SEQ ID NO: 2720991 - RNA, 15 nt, Haemophilus influenzae Rd
caauucaaaaaccaa

SEQ ID NO: 2720992 - RNA, 22 nt, Haemophilus influenzae Rd
caauucaaagaaguagccgccu

SEQ ID NO: 2720993 - RNA, 18 nt, Haemophilus influenzae Rd
caauucacgagccaauac

SEQ ID NO: 2720994 - RNA, 24 nt, Haemophilus influenzae Rd
caauucagcuaacggcaaauaacu

SEQ ID NO: 2720995 - RNA, 16 nt, Haemophilus influenzae Rd
caauucccaguaaucu

SEQ ID NO: 2720996 - RNA, 22 nt, Haemophilus influenzae Rd
caauucccaguaaucuuuuaau

SEQ ID NO: 2720997 - RNA, 18 nt, Haemophilus influenzae Rd
caauucgcccgaaacuca

SEQ ID NO: 2720998 - RNA, 21 nt, Haemophilus influenzae Rd
caauucuaguucuuccccuca

SEQ ID NO: 2720999 - RNA, 23 nt, Haemophilus influenzae Rd
caauucuauauuauuuaagccag

SEQ ID NO: 2721000 - RNA, 21 nt, Haemophilus influenzae Rd
caauucucugacgcugaccac

SEQ ID NO: 2721001 - RNA, 14 nt, Haemophilus influenzae Rd
caauucuuuuaaau

SEQ ID NO: 2721002 - RNA, 14 nt, Haemophilus influenzae Rd
caauugaugcacaa

SEQ ID NO: 2721003 - RNA, 17 nt, Haemophilus influenzae Rd
caauugauguaaaagau

SEQ ID NO: 2721004 - RNA, 18 nt, Haemophilus influenzae Rd
caauugcccagauugguu

SEQ ID NO: 2721005 - RNA, 20 nt, Haemophilus influenzae Rd
caauugccgacacuaaaaag

SEQ ID NO: 2721006 - RNA, 21 nt, Haemophilus influenzae Rd
caauugccgacacuaaaaagc

SEQ ID NO: 2721007 - RNA, 19 nt, Haemophilus influenzae Rd
caauugggauuauuuuugu

SEQ ID NO: 2721008 - RNA, 21 nt, Haemophilus influenzae Rd
caauugguaaaauuucuucua

SEQ ID NO: 2721009 - RNA, 19 nt, Haemophilus influenzae Rd
caauugugccguauuuuuu

SEQ ID NO: 2721010 - RNA, 22 nt, Haemophilus influenzae Rd
caauugugccguauuuuuuaca

SEQ ID NO: 2721011 - RNA, 17 nt, Haemophilus influenzae Rd
caauugugucauucgca

SEQ ID NO: 2721012 - RNA, 17 nt, Haemophilus influenzae Rd
caauuuagauacaaaga

SEQ ID NO: 2721013 - RNA, 14 nt, Haemophilus influenzae Rd
caauuucaauugcc

SEQ ID NO: 2721014 - RNA, 13 nt, Haemophilus influenzae Rd
caauuucacugcc

SEQ ID NO: 2721015 - RNA, 15 nt, Haemophilus influenzae Rd
caauuucacugccaa

SEQ ID NO: 2721016 - RNA, 20 nt, Haemophilus influenzae Rd
caauuucagcacccacauca

SEQ ID NO: 2721017 - RNA, 14 nt, Haemophilus influenzae Rd
caauuucaucacau

SEQ ID NO: 2721018 - RNA, 16 nt, Haemophilus influenzae Rd
caauuucauuugcacc

SEQ ID NO: 2721019 - RNA, 16 nt, Haemophilus influenzae Rd
caauuuccauaaaaga

SEQ ID NO: 2721020 - RNA, 16 nt, Haemophilus influenzae Rd
caauuucccguuuaau

SEQ ID NO: 2721021 - RNA, 17 nt, Haemophilus influenzae Rd
caauuucuaaaaaucug

SEQ ID NO: 2721022 - RNA, 21 nt, Haemophilus influenzae Rd
caauuucuaaaaaucugucau

SEQ ID NO: 2721023 - RNA, 20 nt, Haemophilus influenzae Rd
caauuucuaccgcacuuuca

SEQ ID NO: 2721024 - RNA, 21 nt, Haemophilus influenzae Rd
caauuucucgaguaggcaauu

SEQ ID NO: 2721025 - RNA, 14 nt, Haemophilus influenzae Rd
caauuucucuggcu

SEQ ID NO: 2721026 - RNA, 15 nt, Haemophilus influenzae Rd
caauuugaaaagaau

SEQ ID NO: 2721027 - RNA, 16 nt, Haemophilus influenzae Rd
caauuugaaaagaauu

SEQ ID NO: 2721028 - RNA, 16 nt, Haemophilus influenzae Rd
caauuugagucucaaa

SEQ ID NO: 2721029 - RNA, 20 nt, Haemophilus influenzae Rd
caauuugagucucaaauuuu

SEQ ID NO: 2721030 - RNA, 19 nt, Haemophilus influenzae Rd
caauuuggcaaaaguaagc

SEQ ID NO: 2721031 - RNA, 22 nt, Haemophilus influenzae Rd
caauuuggcgcauuaaacucac

SEQ ID NO: 2721032 - RNA, 19 nt, Haemophilus influenzae Rd
caauuuggucgccgacuuu

SEQ ID NO: 2721033 - RNA, 14 nt, Haemophilus influenzae Rd
caauuuguccuuua

SEQ ID NO: 2721034 - RNA, 13 nt, Haemophilus influenzae Rd
caauuuuaaaauu

SEQ ID NO: 2721035 - RNA, 16 nt, Haemophilus influenzae Rd
caauuuuagcuaaugg

SEQ ID NO: 2721036 - RNA, 15 nt, Haemophilus influenzae Rd
caauuuucugcagaa

SEQ ID NO: 2721037 - RNA, 14 nt, Haemophilus influenzae Rd
caauuuucugugag

SEQ ID NO: 2721038 - RNA, 20 nt, Haemophilus influenzae Rd
caauuuucuucacugcaucu

SEQ ID NO: 2721039 - RNA, 13 nt, Haemophilus influenzae Rd
caauuuuuaauuc

SEQ ID NO: 2721040 - RNA, 19 nt, Haemophilus influenzae Rd
caauuuuucaguauuuuuu

SEQ ID NO: 2721041 - RNA, 18 nt, Haemophilus influenzae Rd
caauuuuugcauuuucag

SEQ ID NO: 2721042 - RNA, 18 nt, Haemophilus influenzae Rd
caauuuuuucaaauaaau

SEQ ID NO: 2721043 - RNA, 19 nt, Haemophilus influenzae Rd
caauuuuuucuccacaaac

SEQ ID NO: 2721044 - RNA, 14 nt, Haemophilus influenzae Rd
caauuuuuucugaa

SEQ ID NO: 2721045 - RNA, 20 nt, Haemophilus influenzae Rd
caauuuuuucugaauaaauu

SEQ ID NO: 2721046 - RNA, 23 nt, Haemophilus influenzae Rd
caauuuuuucugaauaaauuuuu

SEQ ID NO: 2721047 - RNA, 16 nt, Haemophilus influenzae Rd
caauuuuuugucugaa

SEQ ID NO: 2721048 - RNA, 21 nt, Haemophilus influenzae Rd
caauuuuuugucugaaauuuu

SEQ ID NO: 2721049 - RNA, 20 nt, Haemophilus influenzae Rd
cacaaaaaauucuuugccuu

SEQ ID NO: 2721050 - RNA, 23 nt, Haemophilus influenzae Rd
cacaaaaucuugaacgcaaauac

SEQ ID NO: 2721051 - RNA, 19 nt, Haemophilus influenzae Rd
cacaaaauggcaaacaaaa

SEQ ID NO: 2721052 - RNA, 20 nt, Haemophilus influenzae Rd
cacaaaauggcaaacaaaau

SEQ ID NO: 2721053 - RNA, 17 nt, Haemophilus influenzae Rd
cacaaaauuccgcugcu

SEQ ID NO: 2721054 - RNA, 12 nt, Haemophilus influenzae Rd
cacaaacaauau

SEQ ID NO: 2721055 - RNA, 18 nt, Haemophilus influenzae Rd
cacaaacuccguccaauc

SEQ ID NO: 2721056 - RNA, 19 nt, Haemophilus influenzae Rd
cacaaacugguuaaaaucc

SEQ ID NO: 2721057 - RNA, 20 nt, Haemophilus influenzae Rd
cacaaacugguuaaaaucca

SEQ ID NO: 2721058 - RNA, 14 nt, Haemophilus influenzae Rd
cacaaagaaaaacu

SEQ ID NO: 2721059 - RNA, 16 nt, Haemophilus influenzae Rd
cacaaagaaaaacuaa

SEQ ID NO: 2721060 - RNA, 14 nt, Haemophilus influenzae Rd
cacaaagacuaaua

SEQ ID NO: 2721061 - RNA, 23 nt, Haemophilus influenzae Rd
cacaaaguguuuuauuuaucagc

SEQ ID NO: 2721062 - RNA, 20 nt, Haemophilus influenzae Rd
cacaaaguugauaaucaucc

SEQ ID NO: 2721063 - RNA, 14 nt, Haemophilus influenzae Rd
cacaaauauuaucu

SEQ ID NO: 2721064 - RNA, 13 nt, Haemophilus influenzae Rd
cacaaaucuaaaa

SEQ ID NO: 2721065 - RNA, 15 nt, Haemophilus influenzae Rd
cacaaaucuaaaaau

SEQ ID NO: 2721066 - RNA, 16 nt, Haemophilus influenzae Rd
cacaaaucuaaaaaua

SEQ ID NO: 2721067 - RNA, 15 nt, Haemophilus influenzae Rd
cacaaauuuccauau

SEQ ID NO: 2721068 - RNA, 16 nt, Haemophilus influenzae Rd
cacaacaaccacauuc

SEQ ID NO: 2721069 - RNA, 20 nt, Haemophilus influenzae Rd
cacaacagcuaccaauucaa

SEQ ID NO: 2721070 - RNA, 15 nt, Haemophilus influenzae Rd
cacaacauauaaauc

SEQ ID NO: 2721071 - RNA, 20 nt, Haemophilus influenzae Rd
cacaacgacgcacuguugug

SEQ ID NO: 2721072 - RNA, 23 nt, Haemophilus influenzae Rd
cacaacggaagauuuacccaaca

SEQ ID NO: 2721073 - RNA, 15 nt, Haemophilus influenzae Rd
cacaacgguugaaau

SEQ ID NO: 2721074 - RNA, 21 nt, Haemophilus influenzae Rd
cacaacuucggaagaaaaaga

SEQ ID NO: 2721075 - RNA, 18 nt, Haemophilus influenzae Rd
cacaagaugguaauuuug

SEQ ID NO: 2721076 - RNA, 12 nt, Haemophilus influenzae Rd
cacaagcaacaa

SEQ ID NO: 2721077 - RNA, 16 nt, Haemophilus influenzae Rd
cacaagcaccacuucc

SEQ ID NO: 2721078 - RNA, 13 nt, Haemophilus influenzae Rd
cacaagcaccagu

SEQ ID NO: 2721079 - RNA, 15 nt, Haemophilus influenzae Rd
cacaagccacaucac

SEQ ID NO: 2721080 - RNA, 21 nt, Haemophilus influenzae Rd
cacaagcugaccacuuucaau

SEQ ID NO: 2721081 - RNA, 22 nt, Haemophilus influenzae Rd
cacaagcuuguccaugaaaaac

SEQ ID NO: 2721082 - RNA, 15 nt, Haemophilus influenzae Rd
cacaagggauuuaaa

SEQ ID NO: 2721083 - RNA, 18 nt, Haemophilus influenzae Rd
cacaaguagauuacacau

SEQ ID NO: 2721084 - RNA, 14 nt, Haemophilus influenzae Rd
cacaaguuacaagu

SEQ ID NO: 2721085 - RNA, 17 nt, Haemophilus influenzae Rd
cacaaguucuugcgcau

SEQ ID NO: 2721086 - RNA, 18 nt, Haemophilus influenzae Rd
cacaaguucuugcgcauu

SEQ ID NO: 2721087 - RNA, 18 nt, Haemophilus influenzae Rd
cacaauaagcaauccuaa

SEQ ID NO: 2721088 - RNA, 21 nt, Haemophilus influenzae Rd
cacaauaauaggcgaaucaaa

SEQ ID NO: 2721089 - RNA, 17 nt, Haemophilus influenzae Rd
cacaauaauauauuucu

SEQ ID NO: 2721090 - RNA, 16 nt, Haemophilus influenzae Rd
cacaauacuuaucacu

SEQ ID NO: 2721091 - RNA, 14 nt, Haemophilus influenzae Rd
cacaauauuuaaua

SEQ ID NO: 2721092 - RNA, 16 nt, Haemophilus influenzae Rd
cacaauauuuaauaug

SEQ ID NO: 2721093 - RNA, 22 nt, Haemophilus influenzae Rd
cacaauauuugguugaacuucu

SEQ ID NO: 2721094 - RNA, 18 nt, Haemophilus influenzae Rd
cacaaucaaaccaauaaa

SEQ ID NO: 2721095 - RNA, 16 nt, Haemophilus influenzae Rd
cacaaucaaucuuuaa

SEQ ID NO: 2721096 - RNA, 16 nt, Haemophilus influenzae Rd
cacaaucgcaucgucu

SEQ ID NO: 2721097 - RNA, 22 nt, Haemophilus influenzae Rd
cacaaugagacuuaaccaaaua

SEQ ID NO: 2721098 - RNA, 13 nt, Haemophilus influenzae Rd
cacaaugauuaau

SEQ ID NO: 2721099 - RNA, 16 nt, Haemophilus influenzae Rd
cacaaugauuaauauc

SEQ ID NO: 2721100 - RNA, 16 nt, Haemophilus influenzae Rd
cacaauugauguaaaa

SEQ ID NO: 2721101 - RNA, 21 nt, Haemophilus influenzae Rd
cacacaaacuaauuucauuuu

SEQ ID NO: 2721102 - RNA, 16 nt, Haemophilus influenzae Rd
cacacaguuauacaca

SEQ ID NO: 2721103 - RNA, 21 nt, Haemophilus influenzae Rd
cacaccagagugaccaccaau

SEQ ID NO: 2721104 - RNA, 21 nt, Haemophilus influenzae Rd
cacacccaugaaucgaacacu

SEQ ID NO: 2721105 - RNA, 17 nt, Haemophilus influenzae Rd
cacaccgucuaaaaauc

SEQ ID NO: 2721106 - RNA, 18 nt, Haemophilus influenzae Rd
cacaccuauuuuuuccug

SEQ ID NO: 2721107 - RNA, 21 nt, Haemophilus influenzae Rd
cacacuauuaauuacuuuuau

SEQ ID NO: 2721108 - RNA, 15 nt, Haemophilus influenzae Rd
cacacuuuaaaaguu

SEQ ID NO: 2721109 - RNA, 17 nt, Haemophilus influenzae Rd
cacacuuuguauggcaa

SEQ ID NO: 2721110 - RNA, 16 nt, Haemophilus influenzae Rd
cacagaccaaaauucu

SEQ ID NO: 2721111 - RNA, 17 nt, Haemophilus influenzae Rd
cacagaccaaaauucua

SEQ ID NO: 2721112 - RNA, 16 nt, Haemophilus influenzae Rd
cacagacuaaauucag

SEQ ID NO: 2721113 - RNA, 18 nt, Haemophilus influenzae Rd
cacagagccuuuuucuaa

SEQ ID NO: 2721114 - RNA, 13 nt, Haemophilus influenzae Rd
cacagauuuuacc

SEQ ID NO: 2721115 - RNA, 13 nt, Haemophilus influenzae Rd
cacagauuuuuaa

SEQ ID NO: 2721116 - RNA, 19 nt, Haemophilus influenzae Rd
cacagauuuuuacuucauc

SEQ ID NO: 2721117 - RNA, 15 nt, Haemophilus influenzae Rd
cacagccaagaucaa

SEQ ID NO: 2721118 - RNA, 15 nt, Haemophilus influenzae Rd
cacagcccaaaauuc

SEQ ID NO: 2721119 - RNA, 20 nt, Haemophilus influenzae Rd
cacaggaugcaccaauacca

SEQ ID NO: 2721120 - RNA, 17 nt, Haemophilus influenzae Rd
cacaggcuucaauuuga

SEQ ID NO: 2721121 - RNA, 17 nt, Haemophilus influenzae Rd
cacagggcugauaaauu

SEQ ID NO: 2721122 - RNA, 22 nt, Haemophilus influenzae Rd
cacagggcugauaaauuucuaa

SEQ ID NO: 2721123 - RNA, 13 nt, Haemophilus influenzae Rd
cacaguaaagauu

SEQ ID NO: 2721124 - RNA, 13 nt, Haemophilus influenzae Rd
cacaguaccuaca

SEQ ID NO: 2721125 - RNA, 12 nt, Haemophilus influenzae Rd
cacaguauuuau

SEQ ID NO: 2721126 - RNA, 18 nt, Haemophilus influenzae Rd
cacagucaaauugugauu

SEQ ID NO: 2721127 - RNA, 17 nt, Haemophilus influenzae Rd
cacagucuuuuaacaca

SEQ ID NO: 2721128 - RNA, 13 nt, Haemophilus influenzae Rd
cacaguuauuuuu

SEQ ID NO: 2721129 - RNA, 22 nt, Haemophilus influenzae Rd
cacaguuuuauuuuccaucauc

SEQ ID NO: 2721130 - RNA, 15 nt, Haemophilus influenzae Rd
cacauaaaaaacuaa

SEQ ID NO: 2721131 - RNA, 23 nt, Haemophilus influenzae Rd
cacauaaguuaccgcuucuuccu

SEQ ID NO: 2721132 - RNA, 14 nt, Haemophilus influenzae Rd
cacauaauaagaaa

SEQ ID NO: 2721133 - RNA, 13 nt, Haemophilus influenzae Rd
cacauacuucuuc

SEQ ID NO: 2721134 - RNA, 21 nt, Haemophilus influenzae Rd
cacauauggagaaucuuuauc

SEQ ID NO: 2721135 - RNA, 23 nt, Haemophilus influenzae Rd
cacauauuuuugauauuaagcca

SEQ ID NO: 2721136 - RNA, 14 nt, Haemophilus influenzae Rd
cacaucaaagcguu

SEQ ID NO: 2721137 - RNA, 16 nt, Haemophilus influenzae Rd
cacaucagaaaaucaa

SEQ ID NO: 2721138 - RNA, 20 nt, Haemophilus influenzae Rd
cacaucagcaaucauuugcc

SEQ ID NO: 2721139 - RNA, 13 nt, Haemophilus influenzae Rd
cacaucauuuuuu

SEQ ID NO: 2721140 - RNA, 13 nt, Haemophilus influenzae Rd
cacauccacaaaa

SEQ ID NO: 2721141 - RNA, 15 nt, Haemophilus influenzae Rd
cacauccauuccugc

SEQ ID NO: 2721142 - RNA, 20 nt, Haemophilus influenzae Rd
cacauccauuccugcaagaa

SEQ ID NO: 2721143 - RNA, 16 nt, Haemophilus influenzae Rd
cacaugaauuucuaau

SEQ ID NO: 2721144 - RNA, 23 nt, Haemophilus influenzae Rd
cacaugauaaaaaccgcugucau

SEQ ID NO: 2721145 - RNA, 22 nt, Haemophilus influenzae Rd
cacaugggcaucauagccuuuu

SEQ ID NO: 2721146 - RNA, 12 nt, Haemophilus influenzae Rd
cacauuaaacug

SEQ ID NO: 2721147 - RNA, 15 nt, Haemophilus influenzae Rd
cacauucaaauccaa

SEQ ID NO: 2721148 - RNA, 21 nt, Haemophilus influenzae Rd
cacauuccauaccguuacgaa

SEQ ID NO: 2721149 - RNA, 14 nt, Haemophilus influenzae Rd
cacauucuaauccu

SEQ ID NO: 2721150 - RNA, 21 nt, Haemophilus influenzae Rd
cacauuucccuuagauuuaag

SEQ ID NO: 2721151 - RNA, 20 nt, Haemophilus influenzae Rd
caccaaaaauccucaucuga

SEQ ID NO: 2721152 - RNA, 18 nt, Haemophilus influenzae Rd
caccaaaaccaauaccau

SEQ ID NO: 2721153 - RNA, 13 nt, Haemophilus influenzae Rd
caccaaauuacug

SEQ ID NO: 2721154 - RNA, 18 nt, Haemophilus influenzae Rd
caccaacacuugcagccc

SEQ ID NO: 2721155 - RNA, 21 nt, Haemophilus influenzae Rd
caccaagcaauuucaucacau

SEQ ID NO: 2721156 - RNA, 12 nt, Haemophilus influenzae Rd
caccaauaauug

SEQ ID NO: 2721157 - RNA, 12 nt, Haemophilus influenzae Rd
caccaauaccaa

SEQ ID NO: 2721158 - RNA, 15 nt, Haemophilus influenzae Rd
caccaaucaaauaaa

SEQ ID NO: 2721159 - RNA, 22 nt, Haemophilus influenzae Rd
caccaaucacagccgcauuuuu

SEQ ID NO: 2721160 - RNA, 22 nt, Haemophilus influenzae Rd
caccaaugccaguuaaggauuu

SEQ ID NO: 2721161 - RNA, 14 nt, Haemophilus influenzae Rd
caccaauuaauucu

SEQ ID NO: 2721162 - RNA, 22 nt, Haemophilus influenzae Rd
caccaauuaucaauguuugugc

SEQ ID NO: 2721163 - RNA, 20 nt, Haemophilus influenzae Rd
caccaauuccgucagaauuu

SEQ ID NO: 2721164 - RNA, 13 nt, Haemophilus influenzae Rd
caccacaaaauaa

SEQ ID NO: 2721165 - RNA, 18 nt, Haemophilus influenzae Rd
caccacaaaauaaaugau

SEQ ID NO: 2721166 - RNA, 13 nt, Haemophilus influenzae Rd
caccacaagcuga

SEQ ID NO: 2721167 - RNA, 19 nt, Haemophilus influenzae Rd
caccacaagcugaccacuu

SEQ ID NO: 2721168 - RNA, 19 nt, Haemophilus influenzae Rd
caccacagcccaaaauuca

SEQ ID NO: 2721169 - RNA, 16 nt, Haemophilus influenzae Rd
caccacgaccuaagaa

SEQ ID NO: 2721170 - RNA, 18 nt, Haemophilus influenzae Rd
caccacgaccuaagaaaa

SEQ ID NO: 2721171 - RNA, 15 nt, Haemophilus influenzae Rd
caccacguucauaaa

SEQ ID NO: 2721172 - RNA, 16 nt, Haemophilus influenzae Rd
caccacuaaaguugaa

SEQ ID NO: 2721173 - RNA, 15 nt, Haemophilus influenzae Rd
caccacucacuggcu

SEQ ID NO: 2721174 - RNA, 22 nt, Haemophilus influenzae Rd
caccacucgcgccgauuggaug

SEQ ID NO: 2721175 - RNA, 17 nt, Haemophilus influenzae Rd
caccacugguaaauauc

SEQ ID NO: 2721176 - RNA, 15 nt, Haemophilus influenzae Rd
caccacuuaaaaaua

SEQ ID NO: 2721177 - RNA, 15 nt, Haemophilus influenzae Rd
caccacuucauccaa

SEQ ID NO: 2721178 - RNA, 17 nt, Haemophilus influenzae Rd
caccacuucauccaauc

SEQ ID NO: 2721179 - RNA, 18 nt, Haemophilus influenzae Rd
caccacuuggugcaacca

SEQ ID NO: 2721180 - RNA, 23 nt, Haemophilus influenzae Rd
caccagaaacauagauaacuucu

SEQ ID NO: 2721181 - RNA, 20 nt, Haemophilus influenzae Rd
caccagccgcuuguaaugcu

SEQ ID NO: 2721182 - RNA, 15 nt, Haemophilus influenzae Rd
caccagcuugcuccg

SEQ ID NO: 2721183 - RNA, 13 nt, Haemophilus influenzae Rd
caccauaacuuau

SEQ ID NO: 2721184 - RNA, 12 nt, Haemophilus influenzae Rd
caccauacgcaa

SEQ ID NO: 2721185 - RNA, 21 nt, Haemophilus influenzae Rd
caccaucacguaauacaaaau

SEQ ID NO: 2721186 - RNA, 21 nt, Haemophilus influenzae Rd
caccauccaucaaauccgcca

SEQ ID NO: 2721187 - RNA, 13 nt, Haemophilus influenzae Rd
caccaucuacacg

SEQ ID NO: 2721188 - RNA, 16 nt, Haemophilus influenzae Rd
caccauugauuuuuac

SEQ ID NO: 2721189 - RNA, 10 nt, Haemophilus influenzae Rd
caccauuucc

SEQ ID NO: 2721190 - RNA, 22 nt, Haemophilus influenzae Rd
caccauuugguggcuuuuuuau

SEQ ID NO: 2721191 - RNA, 16 nt, Haemophilus influenzae Rd
cacccaaaauuucagc

SEQ ID NO: 2721192 - RNA, 14 nt, Haemophilus influenzae Rd
cacccacuaaugcg

SEQ ID NO: 2721193 - RNA, 19 nt, Haemophilus influenzae Rd
cacccauacuuuaacuucu

SEQ ID NO: 2721194 - RNA, 21 nt, Haemophilus influenzae Rd
cacccauuucaccacuucauc

SEQ ID NO: 2721195 - RNA, 16 nt, Haemophilus influenzae Rd
cacccggcacauaaau

SEQ ID NO: 2721196 - RNA, 20 nt, Haemophilus influenzae Rd
cacccuacgauacuuuuaau

SEQ ID NO: 2721197 - RNA, 16 nt, Haemophilus influenzae Rd
cacccucaguuaccau

SEQ ID NO: 2721198 - RNA, 19 nt, Haemophilus influenzae Rd
caccgaaagguguuuuuuu

SEQ ID NO: 2721199 - RNA, 14 nt, Haemophilus influenzae Rd
caccgaauguggca

SEQ ID NO: 2721200 - RNA, 13 nt, Haemophilus influenzae Rd
caccgauuaauaa

SEQ ID NO: 2721201 - RNA, 20 nt, Haemophilus influenzae Rd
caccgauugauguuaugcuu

SEQ ID NO: 2721202 - RNA, 13 nt, Haemophilus influenzae Rd
caccgcaaaagcc

SEQ ID NO: 2721203 - RNA, 14 nt, Haemophilus influenzae Rd
caccgcacuuucuu

SEQ ID NO: 2721204 - RNA, 21 nt, Haemophilus influenzae Rd
caccgcacuuugugcuccccc

SEQ ID NO: 2721205 - RNA, 22 nt, Haemophilus influenzae Rd
caccgcacuuuuaucuauaaaa

SEQ ID NO: 2721206 - RNA, 15 nt, Haemophilus influenzae Rd
caccgcacuuuuuac

SEQ ID NO: 2721207 - RNA, 18 nt, Haemophilus influenzae Rd
caccgcacuuuuuacuuu

SEQ ID NO: 2721208 - RNA, 16 nt, Haemophilus influenzae Rd
caccgcagaaguaaaa

SEQ ID NO: 2721209 - RNA, 12 nt, Haemophilus influenzae Rd
caccgcauucuu

SEQ ID NO: 2721210 - RNA, 15 nt, Haemophilus influenzae Rd
caccgcauucuucuu

SEQ ID NO: 2721211 - RNA, 15 nt, Haemophilus influenzae Rd
caccgcccuuuuuau

SEQ ID NO: 2721212 - RNA, 23 nt, Haemophilus influenzae Rd
caccgcuaaaccuugcacuaauu

SEQ ID NO: 2721213 - RNA, 19 nt, Haemophilus influenzae Rd
caccgguacagaugccaau

SEQ ID NO: 2721214 - RNA, 19 nt, Haemophilus influenzae Rd
caccguaaccgcccagcau

SEQ ID NO: 2721215 - RNA, 23 nt, Haemophilus influenzae Rd
caccguauuuuuuaguuaaauaa

SEQ ID NO: 2721216 - RNA, 19 nt, Haemophilus influenzae Rd
caccgucauuuucaagcca

SEQ ID NO: 2721217 - RNA, 17 nt, Haemophilus influenzae Rd
caccguuaagcaaauuu

SEQ ID NO: 2721218 - RNA, 22 nt, Haemophilus influenzae Rd
caccuaacagggcauaaaucau

SEQ ID NO: 2721219 - RNA, 22 nt, Haemophilus influenzae Rd
caccuaagucaggaauaaaaga

SEQ ID NO: 2721220 - RNA, 12 nt, Haemophilus influenzae Rd
caccuauuuuuu

SEQ ID NO: 2721221 - RNA, 16 nt, Haemophilus influenzae Rd
caccuauuuuuuccug

SEQ ID NO: 2721222 - RNA, 17 nt, Haemophilus influenzae Rd
caccuccagcaaaagca

SEQ ID NO: 2721223 - RNA, 17 nt, Haemophilus influenzae Rd
caccugaagaauacaag

SEQ ID NO: 2721224 - RNA, 14 nt, Haemophilus influenzae Rd
caccugaugcuuua

SEQ ID NO: 2721225 - RNA, 16 nt, Haemophilus influenzae Rd
caccugaugcuuuaac

SEQ ID NO: 2721226 - RNA, 17 nt, Haemophilus influenzae Rd
caccugcaagugcggua

SEQ ID NO: 2721227 - RNA, 15 nt, Haemophilus influenzae Rd
caccugcaucaauuu

SEQ ID NO: 2721228 - RNA, 21 nt, Haemophilus influenzae Rd
caccugcaucaauuuuacguu

SEQ ID NO: 2721229 - RNA, 22 nt, Haemophilus influenzae Rd
caccugugauaaguugggauaa

SEQ ID NO: 2721230 - RNA, 16 nt, Haemophilus influenzae Rd
caccuuaaaggcugaa

SEQ ID NO: 2721231 - RNA, 14 nt, Haemophilus influenzae Rd
caccuucaacauuu

SEQ ID NO: 2721232 - RNA, 22 nt, Haemophilus influenzae Rd
caccuucuuuuggauacacaaa

SEQ ID NO: 2721233 - RNA, 20 nt, Haemophilus influenzae Rd
caccuugaauugcauuuucu

SEQ ID NO: 2721234 - RNA, 19 nt, Haemophilus influenzae Rd
caccuugauugagaugcca

SEQ ID NO: 2721235 - RNA, 14 nt, Haemophilus influenzae Rd
caccuuuaaaaauu

SEQ ID NO: 2721236 - RNA, 15 nt, Haemophilus influenzae Rd
caccuuuacguuuaa

SEQ ID NO: 2721237 - RNA, 20 nt, Haemophilus influenzae Rd
caccuuuacguuuaacugcg

SEQ ID NO: 2721238 - RNA, 16 nt, Haemophilus influenzae Rd
caccuuuccagccuaa

SEQ ID NO: 2721239 - RNA, 17 nt, Haemophilus influenzae Rd
caccuuuugcaagcauu

SEQ ID NO: 2721240 - RNA, 12 nt, Haemophilus influenzae Rd
caccuuuuuccu

SEQ ID NO: 2721241 - RNA, 21 nt, Haemophilus influenzae Rd
cacgaaaccaacgaaaauagc

SEQ ID NO: 2721242 - RNA, 16 nt, Haemophilus influenzae Rd
cacgaagugaauuucc

SEQ ID NO: 2721243 - RNA, 21 nt, Haemophilus influenzae Rd
cacgacgagcuuuccaaacaa

SEQ ID NO: 2721244 - RNA, 17 nt, Haemophilus influenzae Rd
cacgagcaggaaaacca

SEQ ID NO: 2721245 - RNA, 15 nt, Haemophilus influenzae Rd
cacgagcuaaaaaau

SEQ ID NO: 2721246 - RNA, 23 nt, Haemophilus influenzae Rd
cacgauagcaaugccaaucuaaa

SEQ ID NO: 2721247 - RNA, 12 nt, Haemophilus influenzae Rd
cacgaucacuug

SEQ ID NO: 2721248 - RNA, 15 nt, Haemophilus influenzae Rd
cacgaucacuuguuu

SEQ ID NO: 2721249 - RNA, 23 nt, Haemophilus influenzae Rd
cacgaucagggccaguugaaaga

SEQ ID NO: 2721250 - RNA, 21 nt, Haemophilus influenzae Rd
cacgaucugcaacaucaccga

SEQ ID NO: 2721251 - RNA, 21 nt, Haemophilus influenzae Rd
cacgauucuuccaauuacuaa

SEQ ID NO: 2721252 - RNA, 23 nt, Haemophilus influenzae Rd
cacgauuuucaauacaucaguaa

SEQ ID NO: 2721253 - RNA, 16 nt, Haemophilus influenzae Rd
cacgauuuuuuuauaa

SEQ ID NO: 2721254 - RNA, 13 nt, Haemophilus influenzae Rd
cacgcauuuaaau

SEQ ID NO: 2721255 - RNA, 17 nt, Haemophilus influenzae Rd
cacgcauuuaaauaaaa

SEQ ID NO: 2721256 - RNA, 14 nt, Haemophilus influenzae Rd
cacgccagauaaaa

SEQ ID NO: 2721257 - RNA, 14 nt, Haemophilus influenzae Rd
cacgcccaaaggcu

SEQ ID NO: 2721258 - RNA, 23 nt, Haemophilus influenzae Rd
cacgcccaagguuauauaacaua

SEQ ID NO: 2721259 - RNA, 13 nt, Haemophilus influenzae Rd
cacgcccuuguga

SEQ ID NO: 2721260 - RNA, 13 nt, Haemophilus influenzae Rd
cacgcgcugcucu

SEQ ID NO: 2721261 - RNA, 20 nt, Haemophilus influenzae Rd
cacgcgugguauucuuucca

SEQ ID NO: 2721262 - RNA, 18 nt, Haemophilus influenzae Rd
cacgcuaaaaucuugcac

SEQ ID NO: 2721263 - RNA, 22 nt, Haemophilus influenzae Rd
cacgcuguaaacaagauucuga

SEQ ID NO: 2721264 - RNA, 15 nt, Haemophilus influenzae Rd
cacggcaauaauuua

SEQ ID NO: 2721265 - RNA, 16 nt, Haemophilus influenzae Rd
cacgguaguaaauaac

SEQ ID NO: 2721266 - RNA, 19 nt, Haemophilus influenzae Rd
cacgguuuuccacuucuuc

SEQ ID NO: 2721267 - RNA, 22 nt, Haemophilus influenzae Rd
cacguaaaguuggcaacauauu

SEQ ID NO: 2721268 - RNA, 14 nt, Haemophilus influenzae Rd
cacguagauacaua

SEQ ID NO: 2721269 - RNA, 22 nt, Haemophilus influenzae Rd
cacgucaagugguuuauuuuuu

SEQ ID NO: 2721270 - RNA, 23 nt, Haemophilus influenzae Rd
cacgucaagugguuuauuuuuua

SEQ ID NO: 2721271 - RNA, 15 nt, Haemophilus influenzae Rd
cacguccgcaaccag

SEQ ID NO: 2721272 - RNA, 20 nt, Haemophilus influenzae Rd
cacguuaauuaccacaugca

SEQ ID NO: 2721273 - RNA, 19 nt, Haemophilus influenzae Rd
cacguuagaugacauauca

SEQ ID NO: 2721274 - RNA, 17 nt, Haemophilus influenzae Rd
cacguucuuuuaaugcu

SEQ ID NO: 2721275 - RNA, 23 nt, Haemophilus influenzae Rd
cacguucuuuuaaugcuucugcc

SEQ ID NO: 2721276 - RNA, 19 nt, Haemophilus influenzae Rd
cacguuguacgccacauac

SEQ ID NO: 2721277 - RNA, 20 nt, Haemophilus influenzae Rd
cacguuugccagaaagcauu

SEQ ID NO: 2721278 - RNA, 13 nt, Haemophilus influenzae Rd
cacguuuugcacc

SEQ ID NO: 2721279 - RNA, 17 nt, Haemophilus influenzae Rd
cacuaaaaacaagugcu

SEQ ID NO: 2721280 - RNA, 21 nt, Haemophilus influenzae Rd
cacuaaaaagcccaaaugcaa

SEQ ID NO: 2721281 - RNA, 13 nt, Haemophilus influenzae Rd
cacuaaaauuugu

SEQ ID NO: 2721282 - RNA, 18 nt, Haemophilus influenzae Rd
cacuaaaccugcuucuuu

SEQ ID NO: 2721283 - RNA, 18 nt, Haemophilus influenzae Rd
cacuaaagagaaacauug

SEQ ID NO: 2721284 - RNA, 13 nt, Haemophilus influenzae Rd
cacuaaauaaaug

SEQ ID NO: 2721285 - RNA, 14 nt, Haemophilus influenzae Rd
cacuaacuuuccua

SEQ ID NO: 2721286 - RNA, 18 nt, Haemophilus influenzae Rd
cacuaaggguuaagacaa

SEQ ID NO: 2721287 - RNA, 13 nt, Haemophilus influenzae Rd
cacuaauauaaag

SEQ ID NO: 2721288 - RNA, 20 nt, Haemophilus influenzae Rd
cacuaauauaaagauaauua

SEQ ID NO: 2721289 - RNA, 16 nt, Haemophilus influenzae Rd
cacuaauugugguaaa

SEQ ID NO: 2721290 - RNA, 18 nt, Haemophilus influenzae Rd
cacuacgauuuaauguau

SEQ ID NO: 2721291 - RNA, 22 nt, Haemophilus influenzae Rd
cacuacgauuuaauguauaaaa

SEQ ID NO: 2721292 - RNA, 21 nt, Haemophilus influenzae Rd
cacuacuaacguuucuaauac

SEQ ID NO: 2721293 - RNA, 14 nt, Haemophilus influenzae Rd
cacuagauuuucuu

SEQ ID NO: 2721294 - RNA, 19 nt, Haemophilus influenzae Rd
cacuagauuuucuucauca

SEQ ID NO: 2721295 - RNA, 18 nt, Haemophilus influenzae Rd
cacuagccauaaauaaau

SEQ ID NO: 2721296 - RNA, 22 nt, Haemophilus influenzae Rd
cacuagccauaaauaaaucaau

SEQ ID NO: 2721297 - RNA, 22 nt, Haemophilus influenzae Rd
cacuagucugcacgggaaaucc

SEQ ID NO: 2721298 - RNA, 13 nt, Haemophilus influenzae Rd
cacuauaaaauac

SEQ ID NO: 2721299 - RNA, 12 nt, Haemophilus influenzae Rd
cacuauuaauua

SEQ ID NO: 2721300 - RNA, 13 nt, Haemophilus influenzae Rd
cacucaauucaaa

SEQ ID NO: 2721301 - RNA, 18 nt, Haemophilus influenzae Rd
cacucacuuuaaucgaaa

SEQ ID NO: 2721302 - RNA, 14 nt, Haemophilus influenzae Rd
cacucacuuuuccu

SEQ ID NO: 2721303 - RNA, 21 nt, Haemophilus influenzae Rd
cacuccaaaaguuggauuaaa

SEQ ID NO: 2721304 - RNA, 15 nt, Haemophilus influenzae Rd
cacuccaacaccagu

SEQ ID NO: 2721305 - RNA, 22 nt, Haemophilus influenzae Rd
cacucgcaccaucacguaauac

SEQ ID NO: 2721306 - RNA, 23 nt, Haemophilus influenzae Rd
cacucgcuguauuagaaguaaau

SEQ ID NO: 2721307 - RNA, 20 nt, Haemophilus influenzae Rd
cacucguggaauuucauaaa

SEQ ID NO: 2721308 - RNA, 16 nt, Haemophilus influenzae Rd
cacucuaauaagugag

SEQ ID NO: 2721309 - RNA, 14 nt, Haemophilus influenzae Rd
cacugaaaaaugga

SEQ ID NO: 2721310 - RNA, 13 nt, Haemophilus influenzae Rd
cacugauuucacg

SEQ ID NO: 2721311 - RNA, 15 nt, Haemophilus influenzae Rd
cacugauuucacgcu

SEQ ID NO: 2721312 - RNA, 17 nt, Haemophilus influenzae Rd
cacugauuuuuuuauaa

SEQ ID NO: 2721313 - RNA, 16 nt, Haemophilus influenzae Rd
cacugcaaugauaaga

SEQ ID NO: 2721314 - RNA, 22 nt, Haemophilus influenzae Rd
cacugcaccguugaaugcuucu

SEQ ID NO: 2721315 - RNA, 20 nt, Haemophilus influenzae Rd
cacugcaguaaaaucuucac

SEQ ID NO: 2721316 - RNA, 19 nt, Haemophilus influenzae Rd
cacugcgccuaauuggaaa

SEQ ID NO: 2721317 - RNA, 23 nt, Haemophilus influenzae Rd
cacuggguuucggauaauaauuu

SEQ ID NO: 2721318 - RNA, 14 nt, Haemophilus influenzae Rd
cacuguauuggaaa

SEQ ID NO: 2721319 - RNA, 18 nt, Haemophilus influenzae Rd
cacugugcauuaaaucaa

SEQ ID NO: 2721320 - RNA, 20 nt, Haemophilus influenzae Rd
cacugugcauuaaaucaaau

SEQ ID NO: 2721321 - RNA, 18 nt, Haemophilus influenzae Rd
cacugugccaacuucuac

SEQ ID NO: 2721322 - RNA, 22 nt, Haemophilus influenzae Rd
cacuguugugaaguuuuuuaag

SEQ ID NO: 2721323 - RNA, 14 nt, Haemophilus influenzae Rd
cacuuaaaaauaaa

SEQ ID NO: 2721324 - RNA, 22 nt, Haemophilus influenzae Rd
cacuuaaauuacgaccuuuacu

SEQ ID NO: 2721325 - RNA, 21 nt, Haemophilus influenzae Rd
cacuuaaauuauauuuuccug

SEQ ID NO: 2721326 - RNA, 15 nt, Haemophilus influenzae Rd
cacuuaauaaaaauu

SEQ ID NO: 2721327 - RNA, 14 nt, Haemophilus influenzae Rd
cacuuaauaaauau

SEQ ID NO: 2721328 - RNA, 18 nt, Haemophilus influenzae Rd
cacuuaauguuaauaauu

SEQ ID NO: 2721329 - RNA, 19 nt, Haemophilus influenzae Rd
cacuuaauguuaauaauuu

SEQ ID NO: 2721330 - RNA, 21 nt, Haemophilus influenzae Rd
cacuuaauuucuuaauuaaga

SEQ ID NO: 2721331 - RNA, 21 nt, Haemophilus influenzae Rd
cacuuacgccagcuaaagaaa

SEQ ID NO: 2721332 - RNA, 15 nt, Haemophilus influenzae Rd
cacuuaucuuaaaaa

SEQ ID NO: 2721333 - RNA, 16 nt, Haemophilus influenzae Rd
cacuucaauagauaaa

SEQ ID NO: 2721334 - RNA, 18 nt, Haemophilus influenzae Rd
cacuucaauuucaccgcc

SEQ ID NO: 2721335 - RNA, 16 nt, Haemophilus influenzae Rd
cacuucacaacuuuuu

SEQ ID NO: 2721336 - RNA, 12 nt, Haemophilus influenzae Rd
cacuucagcaga

SEQ ID NO: 2721337 - RNA, 23 nt, Haemophilus influenzae Rd
cacuucagcagauacaucuucug

SEQ ID NO: 2721338 - RNA, 18 nt, Haemophilus influenzae Rd
cacuucaggguuuucauc

SEQ ID NO: 2721339 - RNA, 20 nt, Haemophilus influenzae Rd
cacuucaggguuuucaucau

SEQ ID NO: 2721340 - RNA, 23 nt, Haemophilus influenzae Rd
cacuucauaaauccaauccaacu

SEQ ID NO: 2721341 - RNA, 14 nt, Haemophilus influenzae Rd
cacuucauaaauug

SEQ ID NO: 2721342 - RNA, 13 nt, Haemophilus influenzae Rd
cacuucauauaaa

SEQ ID NO: 2721343 - RNA, 14 nt, Haemophilus influenzae Rd
cacuucauauaaau

SEQ ID NO: 2721344 - RNA, 15 nt, Haemophilus influenzae Rd
cacuucauauaaauu

SEQ ID NO: 2721345 - RNA, 12 nt, Haemophilus influenzae Rd
cacuucaucacc

SEQ ID NO: 2721346 - RNA, 13 nt, Haemophilus influenzae Rd
cacuucauuaaaa

SEQ ID NO: 2721347 - RNA, 20 nt, Haemophilus influenzae Rd
cacuucgccacguaacgaau

SEQ ID NO: 2721348 - RNA, 22 nt, Haemophilus influenzae Rd
cacuucuaaaaccaauaauccu

SEQ ID NO: 2721349 - RNA, 18 nt, Haemophilus influenzae Rd
cacuucucgcccaacaga

SEQ ID NO: 2721350 - RNA, 23 nt, Haemophilus influenzae Rd
cacuucugccagauguuggaaau

SEQ ID NO: 2721351 - RNA, 14 nt, Haemophilus influenzae Rd
cacuucuucaaaga

SEQ ID NO: 2721352 - RNA, 20 nt, Haemophilus influenzae Rd
cacuucuucaaagauugcau

SEQ ID NO: 2721353 - RNA, 18 nt, Haemophilus influenzae Rd
cacuugaagucuauaaaa

SEQ ID NO: 2721354 - RNA, 20 nt, Haemophilus influenzae Rd
cacuugaagucuauaaaaga

SEQ ID NO: 2721355 - RNA, 22 nt, Haemophilus influenzae Rd
cacuugauuugcuuggaauaaa

SEQ ID NO: 2721356 - RNA, 23 nt, Haemophilus influenzae Rd
cacuugauuugcuuggaauaaau

SEQ ID NO: 2721357 - RNA, 23 nt, Haemophilus influenzae Rd
cacuugcauauccgcugcaaauu

SEQ ID NO: 2721358 - RNA, 20 nt, Haemophilus influenzae Rd
cacuugcaucuaaaaauaau

SEQ ID NO: 2721359 - RNA, 22 nt, Haemophilus influenzae Rd
cacuugcaucuaaaaauaauuu

SEQ ID NO: 2721360 - RNA, 21 nt, Haemophilus influenzae Rd
cacuuggcgaaaaucaucaua

SEQ ID NO: 2721361 - RNA, 23 nt, Haemophilus influenzae Rd
cacuugggcugcaugaagaacuu

SEQ ID NO: 2721362 - RNA, 22 nt, Haemophilus influenzae Rd
cacuuggugaucaccgaaauaa

SEQ ID NO: 2721363 - RNA, 18 nt, Haemophilus influenzae Rd
cacuugucauuaaaaaau

SEQ ID NO: 2721364 - RNA, 20 nt, Haemophilus influenzae Rd
cacuugucauuaaaaaauaa

SEQ ID NO: 2721365 - RNA, 23 nt, Haemophilus influenzae Rd
cacuugugauugcgcauuuaaua

SEQ ID NO: 2721366 - RNA, 20 nt, Haemophilus influenzae Rd
cacuugugcaucaaagcguu

SEQ ID NO: 2721367 - RNA, 22 nt, Haemophilus influenzae Rd
cacuugugcgauuaacaauaau

SEQ ID NO: 2721368 - RNA, 20 nt, Haemophilus influenzae Rd
cacuuguucaggugucauca

SEQ ID NO: 2721369 - RNA, 13 nt, Haemophilus influenzae Rd
cacuuguuuuuuc

SEQ ID NO: 2721370 - RNA, 15 nt, Haemophilus influenzae Rd
cacuuguuuuuucaa

SEQ ID NO: 2721371 - RNA, 14 nt, Haemophilus influenzae Rd
cacuuuaaaaauaa

SEQ ID NO: 2721372 - RNA, 23 nt, Haemophilus influenzae Rd
cacuuuaaaaauaaacauugcgc

SEQ ID NO: 2721373 - RNA, 13 nt, Haemophilus influenzae Rd
cacuuuaaaagug

SEQ ID NO: 2721374 - RNA, 12 nt, Haemophilus influenzae Rd
cacuuuaaauau

SEQ ID NO: 2721375 - RNA, 18 nt, Haemophilus influenzae Rd
cacuuuaaauauuuaaaa

SEQ ID NO: 2721376 - RNA, 16 nt, Haemophilus influenzae Rd
cacuuuaaauuuuccu

SEQ ID NO: 2721377 - RNA, 22 nt, Haemophilus influenzae Rd
cacuuuaaucgaaaucacaccu

SEQ ID NO: 2721378 - RNA, 13 nt, Haemophilus influenzae Rd
cacuuuagaaaau

SEQ ID NO: 2721379 - RNA, 23 nt, Haemophilus influenzae Rd
cacuuuagaaaauauaauuaauc

SEQ ID NO: 2721380 - RNA, 18 nt, Haemophilus influenzae Rd
cacuuuaucuagacaaaa

SEQ ID NO: 2721381 - RNA, 15 nt, Haemophilus influenzae Rd
cacuuuauuagaaau

SEQ ID NO: 2721382 - RNA, 13 nt, Haemophilus influenzae Rd
cacuuucaacugu

SEQ ID NO: 2721383 - RNA, 15 nt, Haemophilus influenzae Rd
cacuuucacauaaau

SEQ ID NO: 2721384 - RNA, 21 nt, Haemophilus influenzae Rd
cacuuucauuccauucuaaaa

SEQ ID NO: 2721385 - RNA, 15 nt, Haemophilus influenzae Rd
cacuuuccaucauug

SEQ ID NO: 2721386 - RNA, 13 nt, Haemophilus influenzae Rd
cacuuugauuuug

SEQ ID NO: 2721387 - RNA, 18 nt, Haemophilus influenzae Rd
cacuuugcacuuuaaaga

SEQ ID NO: 2721388 - RNA, 12 nt, Haemophilus influenzae Rd
cacuuuuaaagu

SEQ ID NO: 2721389 - RNA, 12 nt, Haemophilus influenzae Rd
cacuuuuaacca

SEQ ID NO: 2721390 - RNA, 20 nt, Haemophilus influenzae Rd
cacuuuuaccuuuaagcauu

SEQ ID NO: 2721391 - RNA, 17 nt, Haemophilus influenzae Rd
cacuuuuaucuauaaaa

SEQ ID NO: 2721392 - RNA, 22 nt, Haemophilus influenzae Rd
cacuuuuaucuauaaaaagaac

SEQ ID NO: 2721393 - RNA, 23 nt, Haemophilus influenzae Rd
cacuuuucaacaaaaaacaccua

SEQ ID NO: 2721394 - RNA, 13 nt, Haemophilus influenzae Rd
cacuuuuccuuuu

SEQ ID NO: 2721395 - RNA, 17 nt, Haemophilus influenzae Rd
cacuuuuggauaaagua

SEQ ID NO: 2721396 - RNA, 19 nt, Haemophilus influenzae Rd
cacuuuuggauaaaguauu

SEQ ID NO: 2721397 - RNA, 16 nt, Haemophilus influenzae Rd
cacuuuuguuguuauu

SEQ ID NO: 2721398 - RNA, 17 nt, Haemophilus influenzae Rd
cacuuuuuauauuuuuu

SEQ ID NO: 2721399 - RNA, 19 nt, Haemophilus influenzae Rd
cacuuuuuauuuuuccuuu

SEQ ID NO: 2721400 - RNA, 11 nt, Haemophilus influenzae Rd
cacuuuuucua

SEQ ID NO: 2721401 - RNA, 13 nt, Haemophilus influenzae Rd
cacuuuuugaaag

SEQ ID NO: 2721402 - RNA, 21 nt, Haemophilus influenzae Rd
cacuuuuuguuuguaauaaau

SEQ ID NO: 2721403 - RNA, 23 nt, Haemophilus influenzae Rd
cacuuuuuguuuguaauaaauuu

SEQ ID NO: 2721404 - RNA, 17 nt, Haemophilus influenzae Rd
cacuuuuuuguuuucag

SEQ ID NO: 2721405 - RNA, 17 nt, Haemophilus influenzae Rd
cacuuuuuuuauaucuu

SEQ ID NO: 2721406 - RNA, 13 nt, Haemophilus influenzae Rd
cacuuuuuuucuu

SEQ ID NO: 2721407 - RNA, 22 nt, Haemophilus influenzae Rd
cagaaaacggcuuaguuaaaua

SEQ ID NO: 2721408 - RNA, 12 nt, Haemophilus influenzae Rd
cagaaaauaacg

SEQ ID NO: 2721409 - RNA, 14 nt, Haemophilus influenzae Rd
cagaaagauuacau

SEQ ID NO: 2721410 - RNA, 19 nt, Haemophilus influenzae Rd
cagaaagcagguuuuucuu

SEQ ID NO: 2721411 - RNA, 16 nt, Haemophilus influenzae Rd
cagaaaggacagccag

SEQ ID NO: 2721412 - RNA, 20 nt, Haemophilus influenzae Rd
cagaaaguucuaauucauuu

SEQ ID NO: 2721413 - RNA, 12 nt, Haemophilus influenzae Rd
cagaaauacuuu

SEQ ID NO: 2721414 - RNA, 19 nt, Haemophilus influenzae Rd
cagaaauacuuuuagcucc

SEQ ID NO: 2721415 - RNA, 20 nt, Haemophilus influenzae Rd
cagaaauauaaucaauuucu

SEQ ID NO: 2721416 - RNA, 16 nt, Haemophilus influenzae Rd
cagaaauauguuuuac

SEQ ID NO: 2721417 - RNA, 20 nt, Haemophilus influenzae Rd
cagaaaugcuuacaggaaag

SEQ ID NO: 2721418 - RNA, 11 nt, Haemophilus influenzae Rd
cagaacaaaau

SEQ ID NO: 2721419 - RNA, 22 nt, Haemophilus influenzae Rd
cagaacauugugacauuggauu

SEQ ID NO: 2721420 - RNA, 16 nt, Haemophilus influenzae Rd
cagaacccgcuaaagu

SEQ ID NO: 2721421 - RNA, 18 nt, Haemophilus influenzae Rd
cagaaccgccguauugaa

SEQ ID NO: 2721422 - RNA, 19 nt, Haemophilus influenzae Rd
cagaacguugaucauugaa

SEQ ID NO: 2721423 - RNA, 20 nt, Haemophilus influenzae Rd
cagaacguugaucauugaag

SEQ ID NO: 2721424 - RNA, 19 nt, Haemophilus influenzae Rd
cagaacugcuuucuuccaa

SEQ ID NO: 2721425 - RNA, 19 nt, Haemophilus influenzae Rd
cagaagaaguaaaaagaaa

SEQ ID NO: 2721426 - RNA, 20 nt, Haemophilus influenzae Rd
cagaagauaaaagugcgguu

SEQ ID NO: 2721427 - RNA, 17 nt, Haemophilus influenzae Rd
cagaagcccguugcuaa

SEQ ID NO: 2721428 - RNA, 15 nt, Haemophilus influenzae Rd
cagaaguaaaauagc

SEQ ID NO: 2721429 - RNA, 15 nt, Haemophilus influenzae Rd
cagaaguaaaccgug

SEQ ID NO: 2721430 - RNA, 14 nt, Haemophilus influenzae Rd
cagaaguauuuacu

SEQ ID NO: 2721431 - RNA, 15 nt, Haemophilus influenzae Rd
cagaagucagcaaua

SEQ ID NO: 2721432 - RNA, 21 nt, Haemophilus influenzae Rd
cagaagugcguucauauuuga

SEQ ID NO: 2721433 - RNA, 16 nt, Haemophilus influenzae Rd
cagaaguuguuuuucu

SEQ ID NO: 2721434 - RNA, 14 nt, Haemophilus influenzae Rd
cagaauaccacucc

SEQ ID NO: 2721435 - RNA, 17 nt, Haemophilus influenzae Rd
cagaaucauuuucacca

SEQ ID NO: 2721436 - RNA, 17 nt, Haemophilus influenzae Rd
cagaaucuaaagaaaau

SEQ ID NO: 2721437 - RNA, 21 nt, Haemophilus influenzae Rd
cagaaugaaucguuuguucug

SEQ ID NO: 2721438 - RNA, 12 nt, Haemophilus influenzae Rd
cagaauuacguu

SEQ ID NO: 2721439 - RNA, 17 nt, Haemophilus influenzae Rd
cagaauuuacgaaaacu

SEQ ID NO: 2721440 - RNA, 20 nt, Haemophilus influenzae Rd
cagaauuuaguccuuuuacu

SEQ ID NO: 2721441 - RNA, 22 nt, Haemophilus influenzae Rd
cagaauuuauucccccauuaaa

SEQ ID NO: 2721442 - RNA, 20 nt, Haemophilus influenzae Rd
cagaauuucaucuguuggaa

SEQ ID NO: 2721443 - RNA, 22 nt, Haemophilus influenzae Rd
cagaauuucaucuguuggaaug

SEQ ID NO: 2721444 - RNA, 18 nt, Haemophilus influenzae Rd
cagaauuucgucaaaaau

SEQ ID NO: 2721445 - RNA, 21 nt, Haemophilus influenzae Rd
cagaauuucgucaaaaauguc

SEQ ID NO: 2721446 - RNA, 13 nt, Haemophilus influenzae Rd
cagacaaguuuaa

SEQ ID NO: 2721447 - RNA, 13 nt, Haemophilus influenzae Rd
cagacgcuuggug

SEQ ID NO: 2721448 - RNA, 20 nt, Haemophilus influenzae Rd
cagacuagcaucaaaauaaa

SEQ ID NO: 2721449 - RNA, 18 nt, Haemophilus influenzae Rd
cagacuagugaaauauuu

SEQ ID NO: 2721450 - RNA, 21 nt, Haemophilus influenzae Rd
cagacuagugaaauauuuacu

SEQ ID NO: 2721451 - RNA, 19 nt, Haemophilus influenzae Rd
cagacuauuucuguauuuu

SEQ ID NO: 2721452 - RNA, 22 nt, Haemophilus influenzae Rd
cagacuauuucuguauuuuuua

SEQ ID NO: 2721453 - RNA, 15 nt, Haemophilus influenzae Rd
cagacuugaacuggc

SEQ ID NO: 2721454 - RNA, 12 nt, Haemophilus influenzae Rd
cagagaaaaaaa

SEQ ID NO: 2721455 - RNA, 13 nt, Haemophilus influenzae Rd
cagagaagaaaua

SEQ ID NO: 2721456 - RNA, 14 nt, Haemophilus influenzae Rd
cagagaagaaauac

SEQ ID NO: 2721457 - RNA, 16 nt, Haemophilus influenzae Rd
cagagaagaaauacaa

SEQ ID NO: 2721458 - RNA, 19 nt, Haemophilus influenzae Rd
cagagauuuagauaauaaa

SEQ ID NO: 2721459 - RNA, 14 nt, Haemophilus influenzae Rd
cagagcaagauuua

SEQ ID NO: 2721460 - RNA, 23 nt, Haemophilus influenzae Rd
cagagcaagauuuaaacuuucga

SEQ ID NO: 2721461 - RNA, 20 nt, Haemophilus influenzae Rd
cagagcaccaaauuaaaaau

SEQ ID NO: 2721462 - RNA, 15 nt, Haemophilus influenzae Rd
cagagccaaauacaa

SEQ ID NO: 2721463 - RNA, 18 nt, Haemophilus influenzae Rd
cagagccaaauacaaucg

SEQ ID NO: 2721464 - RNA, 18 nt, Haemophilus influenzae Rd
cagagccguuugcuguau

SEQ ID NO: 2721465 - RNA, 15 nt, Haemophilus influenzae Rd
cagaggcugaacuuu

SEQ ID NO: 2721466 - RNA, 19 nt, Haemophilus influenzae Rd
cagaggggauaaaauaaac

SEQ ID NO: 2721467 - RNA, 22 nt, Haemophilus influenzae Rd
cagaguaguggugguggaauaa

SEQ ID NO: 2721468 - RNA, 14 nt, Haemophilus influenzae Rd
cagaguuaaaaguc

SEQ ID NO: 2721469 - RNA, 20 nt, Haemophilus influenzae Rd
cagauaaaauuggugcaaaa

SEQ ID NO: 2721470 - RNA, 18 nt, Haemophilus influenzae Rd
cagauaaaucagcgaguu

SEQ ID NO: 2721471 - RNA, 16 nt, Haemophilus influenzae Rd
cagaucgugauauuuc

SEQ ID NO: 2721472 - RNA, 21 nt, Haemophilus influenzae Rd
cagaugaaaauccccucuuaa

SEQ ID NO: 2721473 - RNA, 20 nt, Haemophilus influenzae Rd
cagaugcacgagcaggaaaa

SEQ ID NO: 2721474 - RNA, 22 nt, Haemophilus influenzae Rd
cagauuaauuuuuuauaaaauu

SEQ ID NO: 2721475 - RNA, 22 nt, Haemophilus influenzae Rd
cagauucauuguuucucaauaa

SEQ ID NO: 2721476 - RNA, 23 nt, Haemophilus influenzae Rd
cagauugcugacaaauuuguuga

SEQ ID NO: 2721477 - RNA, 21 nt, Haemophilus influenzae Rd
cagauuuaauaccauacauaa

SEQ ID NO: 2721478 - RNA, 14 nt, Haemophilus influenzae Rd
cagauuucaauuaa

SEQ ID NO: 2721479 - RNA, 16 nt, Haemophilus influenzae Rd
cagauuuuauaucaag

SEQ ID NO: 2721480 - RNA, 17 nt, Haemophilus influenzae Rd
cagauuuuauaucaagc

SEQ ID NO: 2721481 - RNA, 13 nt, Haemophilus influenzae Rd
cagauuuuuaaau

SEQ ID NO: 2721482 - RNA, 17 nt, Haemophilus influenzae Rd
cagauuuuuaaaucaau

SEQ ID NO: 2721483 - RNA, 23 nt, Haemophilus influenzae Rd
cagauuuuuaaaucaauuaacua

SEQ ID NO: 2721484 - RNA, 20 nt, Haemophilus influenzae Rd
cagauuuuuacuucaucaaa

SEQ ID NO: 2721485 - RNA, 13 nt, Haemophilus influenzae Rd
cagauuuuuauau

SEQ ID NO: 2721486 - RNA, 18 nt, Haemophilus influenzae Rd
cagauuuuuuaugaccaa

SEQ ID NO: 2721487 - RNA, 21 nt, Haemophilus influenzae Rd
cagauuuuuuuauugauuucc

SEQ ID NO: 2721488 - RNA, 17 nt, Haemophilus influenzae Rd
cagauuuuuuucaauga

SEQ ID NO: 2721489 - RNA, 21 nt, Haemophilus influenzae Rd
cagauuuuuuucagaaaugac

SEQ ID NO: 2721490 - RNA, 16 nt, Haemophilus influenzae Rd
cagauuuuuuuuauau

SEQ ID NO: 2721491 - RNA, 20 nt, Haemophilus influenzae Rd
cagauuuuuuuuauaucuuc

SEQ ID NO: 2721492 - RNA, 12 nt, Haemophilus influenzae Rd
cagcaaaaaaau

SEQ ID NO: 2721493 - RNA, 16 nt, Haemophilus influenzae Rd
cagcaaaaaaauuucu

SEQ ID NO: 2721494 - RNA, 12 nt, Haemophilus influenzae Rd
cagcaaaagaaa

SEQ ID NO: 2721495 - RNA, 14 nt, Haemophilus influenzae Rd
cagcaaaagaaaua

SEQ ID NO: 2721496 - RNA, 15 nt, Haemophilus influenzae Rd
cagcaaaagaaauaa

SEQ ID NO: 2721497 - RNA, 16 nt, Haemophilus influenzae Rd
cagcaaaaugcgugcu

SEQ ID NO: 2721498 - RNA, 21 nt, Haemophilus influenzae Rd
cagcaaaaugcgugcugugau

SEQ ID NO: 2721499 - RNA, 15 nt, Haemophilus influenzae Rd
cagcaaaccaaggaa

SEQ ID NO: 2721500 - RNA, 22 nt, Haemophilus influenzae Rd
cagcaacgcuugugcauugcuc

SEQ ID NO: 2721501 - RNA, 23 nt, Haemophilus influenzae Rd
cagcaacgguguggaaagaucca

SEQ ID NO: 2721502 - RNA, 17 nt, Haemophilus influenzae Rd
cagcaacuguuauauug

SEQ ID NO: 2721503 - RNA, 16 nt, Haemophilus influenzae Rd
cagcaagaaacucaag

SEQ ID NO: 2721504 - RNA, 17 nt, Haemophilus influenzae Rd
cagcaagauaagcugcg

SEQ ID NO: 2721505 - RNA, 24 nt, Haemophilus influenzae Rd
cagcaagggcuuuuucugcuggcu

SEQ ID NO: 2721506 - RNA, 14 nt, Haemophilus influenzae Rd
cagcaauaaauaau

SEQ ID NO: 2721507 - RNA, 15 nt, Haemophilus influenzae Rd
cagcaauaaauaaua

SEQ ID NO: 2721508 - RNA, 18 nt, Haemophilus influenzae Rd
cagcaauacccgcuucaa

SEQ ID NO: 2721509 - RNA, 14 nt, Haemophilus influenzae Rd
cagcaaucaacaca

SEQ ID NO: 2721510 - RNA, 14 nt, Haemophilus influenzae Rd
cagcaauuaauaau

SEQ ID NO: 2721511 - RNA, 12 nt, Haemophilus influenzae Rd
cagcaauuaauu

SEQ ID NO: 2721512 - RNA, 14 nt, Haemophilus influenzae Rd
cagcaccaaagaaa

SEQ ID NO: 2721513 - RNA, 14 nt, Haemophilus influenzae Rd
cagcacuaaaagca

SEQ ID NO: 2721514 - RNA, 15 nt, Haemophilus influenzae Rd
cagcacuaaaagcau

SEQ ID NO: 2721515 - RNA, 19 nt, Haemophilus influenzae Rd
cagcacuacugcgugacaa

SEQ ID NO: 2721516 - RNA, 16 nt, Haemophilus influenzae Rd
cagcacuuaauacgac

SEQ ID NO: 2721517 - RNA, 14 nt, Haemophilus influenzae Rd
cagcagaaaauaac

SEQ ID NO: 2721518 - RNA, 15 nt, Haemophilus influenzae Rd
cagcagaguuaauua

SEQ ID NO: 2721519 - RNA, 14 nt, Haemophilus influenzae Rd
cagcagcaccuaaa

SEQ ID NO: 2721520 - RNA, 17 nt, Haemophilus influenzae Rd
cagcagggauuuuaagu

SEQ ID NO: 2721521 - RNA, 22 nt, Haemophilus influenzae Rd
cagcaguuuggcaagucuuaau

SEQ ID NO: 2721522 - RNA, 20 nt, Haemophilus influenzae Rd
cagcauaaagagaauauuuc

SEQ ID NO: 2721523 - RNA, 15 nt, Haemophilus influenzae Rd
cagcauaaauaaaua

SEQ ID NO: 2721524 - RNA, 19 nt, Haemophilus influenzae Rd
cagcauauugaaauuggaa

SEQ ID NO: 2721525 - RNA, 21 nt, Haemophilus influenzae Rd
cagcauauugaaauuggaauc

SEQ ID NO: 2721526 - RNA, 20 nt, Haemophilus influenzae Rd
cagcaucugccacuucuugc

SEQ ID NO: 2721527 - RNA, 22 nt, Haemophilus influenzae Rd
cagcaucugccacuucuugcgu

SEQ ID NO: 2721528 - RNA, 13 nt, Haemophilus influenzae Rd
cagcauuuaaaga

SEQ ID NO: 2721529 - RNA, 16 nt, Haemophilus influenzae Rd
cagccaaauuuuucuu

SEQ ID NO: 2721530 - RNA, 22 nt, Haemophilus influenzae Rd
cagccacuaauuucacaccauu

SEQ ID NO: 2721531 - RNA, 13 nt, Haemophilus influenzae Rd
cagccacuucuuc

SEQ ID NO: 2721532 - RNA, 14 nt, Haemophilus influenzae Rd
cagccagguuuugu

SEQ ID NO: 2721533 - RNA, 16 nt, Haemophilus influenzae Rd
cagccauaaaugcuac

SEQ ID NO: 2721534 - RNA, 19 nt, Haemophilus influenzae Rd
cagccauccccaaaacagu

SEQ ID NO: 2721535 - RNA, 15 nt, Haemophilus influenzae Rd
cagccaucgcugaaa

SEQ ID NO: 2721536 - RNA, 17 nt, Haemophilus influenzae Rd
cagccauggcuuuuucc

SEQ ID NO: 2721537 - RNA, 15 nt, Haemophilus influenzae Rd
cagcccaaauaaaga

SEQ ID NO: 2721538 - RNA, 23 nt, Haemophilus influenzae Rd
cagcccguuguguuucaacaaaa

SEQ ID NO: 2721539 - RNA, 21 nt, Haemophilus influenzae Rd
cagcccuuuuaguuuccccug

SEQ ID NO: 2721540 - RNA, 21 nt, Haemophilus influenzae Rd
cagcccuuuuuuaaugggauu

SEQ ID NO: 2721541 - RNA, 20 nt, Haemophilus influenzae Rd
cagccugaaaaagcuaaaaa

SEQ ID NO: 2721542 - RNA, 23 nt, Haemophilus influenzae Rd
cagccugaauggcgaauuucacg

SEQ ID NO: 2721543 - RNA, 16 nt, Haemophilus influenzae Rd
cagcgaacauuuuugg

SEQ ID NO: 2721544 - RNA, 14 nt, Haemophilus influenzae Rd
cagcgaaguuaaac

SEQ ID NO: 2721545 - RNA, 13 nt, Haemophilus influenzae Rd
cagcgaccaccaa

SEQ ID NO: 2721546 - RNA, 15 nt, Haemophilus influenzae Rd
cagcgaccaccaaug

SEQ ID NO: 2721547 - RNA, 17 nt, Haemophilus influenzae Rd
cagcgcaccacacaaua

SEQ ID NO: 2721548 - RNA, 17 nt, Haemophilus influenzae Rd
cagcggcauuugcauca

SEQ ID NO: 2721549 - RNA, 16 nt, Haemophilus influenzae Rd
cagcgguuggcuucca

SEQ ID NO: 2721550 - RNA, 12 nt, Haemophilus influenzae Rd
cagcguuuucaa

SEQ ID NO: 2721551 - RNA, 16 nt, Haemophilus influenzae Rd
cagcuaaagaaagcaa

SEQ ID NO: 2721552 - RNA, 17 nt, Haemophilus influenzae Rd
cagcuaacggcaaauaa

SEQ ID NO: 2721553 - RNA, 17 nt, Haemophilus influenzae Rd
cagcuaagccaauaauu

SEQ ID NO: 2721554 - RNA, 15 nt, Haemophilus influenzae Rd
cagcuaauaggcuua

SEQ ID NO: 2721555 - RNA, 16 nt, Haemophilus influenzae Rd
cagcuacauucaucaa

SEQ ID NO: 2721556 - RNA, 19 nt, Haemophilus influenzae Rd
cagcuacuucccaaauuuu

SEQ ID NO: 2721557 - RNA, 12 nt, Haemophilus influenzae Rd
cagcuagaauaa

SEQ ID NO: 2721558 - RNA, 20 nt, Haemophilus influenzae Rd
cagcuccuacauuaaaagau

SEQ ID NO: 2721559 - RNA, 19 nt, Haemophilus influenzae Rd
cagcugauaaguucauaaa

SEQ ID NO: 2721560 - RNA, 22 nt, Haemophilus influenzae Rd
cagcugcaauaucaaucccacu

SEQ ID NO: 2721561 - RNA, 12 nt, Haemophilus influenzae Rd
cagcuguugcaa

SEQ ID NO: 2721562 - RNA, 14 nt, Haemophilus influenzae Rd
cagcuuaagcuggc

SEQ ID NO: 2721563 - RNA, 18 nt, Haemophilus influenzae Rd
cagcuucaaugacacgac

SEQ ID NO: 2721564 - RNA, 17 nt, Haemophilus influenzae Rd
cagcuucacgguuauac

SEQ ID NO: 2721565 - RNA, 23 nt, Haemophilus influenzae Rd
cagcuugaguugucacaacagau

SEQ ID NO: 2721566 - RNA, 19 nt, Haemophilus influenzae Rd
cagcuuuaaggcacagauu

SEQ ID NO: 2721567 - RNA, 13 nt, Haemophilus influenzae Rd
cagcuuuacucau

SEQ ID NO: 2721568 - RNA, 23 nt, Haemophilus influenzae Rd
cagcuuuacucauaucuaaagca

SEQ ID NO: 2721569 - RNA, 14 nt, Haemophilus influenzae Rd
caggaaaaauaaau

SEQ ID NO: 2721570 - RNA, 14 nt, Haemophilus influenzae Rd
caggaaaaccacaa

SEQ ID NO: 2721571 - RNA, 16 nt, Haemophilus influenzae Rd
caggaaaauuuuauaa

SEQ ID NO: 2721572 - RNA, 21 nt, Haemophilus influenzae Rd
caggaagcucgguaaaaauca

SEQ ID NO: 2721573 - RNA, 12 nt, Haemophilus influenzae Rd
caggaauuugcu

SEQ ID NO: 2721574 - RNA, 21 nt, Haemophilus influenzae Rd
caggaggagccaaauuuaaaa

SEQ ID NO: 2721575 - RNA, 14 nt, Haemophilus influenzae Rd
caggaucgguaagu

SEQ ID NO: 2721576 - RNA, 15 nt, Haemophilus influenzae Rd
caggcgacucauaau

SEQ ID NO: 2721577 - RNA, 20 nt, Haemophilus influenzae Rd
caggcuaucaucaucauuuu

SEQ ID NO: 2721578 - RNA, 16 nt, Haemophilus influenzae Rd
caggcuuucacuauuu

SEQ ID NO: 2721579 - RNA, 16 nt, Haemophilus influenzae Rd
caggcuuucauuuucc

SEQ ID NO: 2721580 - RNA, 19 nt, Haemophilus influenzae Rd
cagggauuucaauaaauuc

SEQ ID NO: 2721581 - RNA, 18 nt, Haemophilus influenzae Rd
cagggccaguugaaagaa

SEQ ID NO: 2721582 - RNA, 14 nt, Haemophilus influenzae Rd
cagggcuuuauuuu

SEQ ID NO: 2721583 - RNA, 14 nt, Haemophilus influenzae Rd
caggggauugaaaa

SEQ ID NO: 2721584 - RNA, 17 nt, Haemophilus influenzae Rd
cagggugucguagaaau

SEQ ID NO: 2721585 - RNA, 23 nt, Haemophilus influenzae Rd
cagguaaggauugaccgcccaac

SEQ ID NO: 2721586 - RNA, 18 nt, Haemophilus influenzae Rd
cagguaauguuucauaaa

SEQ ID NO: 2721587 - RNA, 15 nt, Haemophilus influenzae Rd
cagguaauuucucug

SEQ ID NO: 2721588 - RNA, 19 nt, Haemophilus influenzae Rd
caggucgagggucaaaaga

SEQ ID NO: 2721589 - RNA, 18 nt, Haemophilus influenzae Rd
caggugggaaauaauuuu

SEQ ID NO: 2721590 - RNA, 14 nt, Haemophilus influenzae Rd
caggugucacagca

SEQ ID NO: 2721591 - RNA, 22 nt, Haemophilus influenzae Rd
cagguucaaaacgcucaacaua

SEQ ID NO: 2721592 - RNA, 20 nt, Haemophilus influenzae Rd
cagguucgccacuggugcug

SEQ ID NO: 2721593 - RNA, 17 nt, Haemophilus influenzae Rd
cagguugcugauaaaga

SEQ ID NO: 2721594 - RNA, 23 nt, Haemophilus influenzae Rd
cagguuuaauaaucgaaaaaguu

SEQ ID NO: 2721595 - RNA, 19 nt, Haemophilus influenzae Rd
cagguuuacccauauugaa

SEQ ID NO: 2721596 - RNA, 20 nt, Haemophilus influenzae Rd
cagguuuuucuuuuaauuuu

SEQ ID NO: 2721597 - RNA, 19 nt, Haemophilus influenzae Rd
caguaaacaaguauaaaaa

SEQ ID NO: 2721598 - RNA, 22 nt, Haemophilus influenzae Rd
caguaaacaaguauaaaaaauc

SEQ ID NO: 2721599 - RNA, 20 nt, Haemophilus influenzae Rd
caguaaauugguuaauguaa

SEQ ID NO: 2721600 - RNA, 20 nt, Haemophilus influenzae Rd
caguaacuacaacuucauca

SEQ ID NO: 2721601 - RNA, 14 nt, Haemophilus influenzae Rd
caguaacuucugcu

SEQ ID NO: 2721602 - RNA, 17 nt, Haemophilus influenzae Rd
caguaacuucugcugca

SEQ ID NO: 2721603 - RNA, 18 nt, Haemophilus influenzae Rd
caguaacuuucuucaaua

SEQ ID NO: 2721604 - RNA, 18 nt, Haemophilus influenzae Rd
caguaaugguuacuuuau

SEQ ID NO: 2721605 - RNA, 12 nt, Haemophilus influenzae Rd
caguacaauuaa

SEQ ID NO: 2721606 - RNA, 12 nt, Haemophilus influenzae Rd
caguaccuacau

SEQ ID NO: 2721607 - RNA, 16 nt, Haemophilus influenzae Rd
caguaccuauauacuu

SEQ ID NO: 2721608 - RNA, 19 nt, Haemophilus influenzae Rd
caguacucgaaaaggcaaa

SEQ ID NO: 2721609 - RNA, 22 nt, Haemophilus influenzae Rd
caguauaaaccgcauuacuuuu

SEQ ID NO: 2721610 - RNA, 20 nt, Haemophilus influenzae Rd
caguauccgccaaugcuuuu

SEQ ID NO: 2721611 - RNA, 18 nt, Haemophilus influenzae Rd
cagucacuucuucaauac

SEQ ID NO: 2721612 - RNA, 17 nt, Haemophilus influenzae Rd
caguccccauaucucug

SEQ ID NO: 2721613 - RNA, 20 nt, Haemophilus influenzae Rd
cagucgauacaaguuuuacc

SEQ ID NO: 2721614 - RNA, 19 nt, Haemophilus influenzae Rd
cagucugcgccuaaaauau

SEQ ID NO: 2721615 - RNA, 22 nt, Haemophilus influenzae Rd
cagucugcgccuaaaauauuuu

SEQ ID NO: 2721616 - RNA, 15 nt, Haemophilus influenzae Rd
cagucuuuuaacaca

SEQ ID NO: 2721617 - RNA, 17 nt, Haemophilus influenzae Rd
cagucuuuuaacacaua

SEQ ID NO: 2721618 - RNA, 13 nt, Haemophilus influenzae Rd
cagugaaaccaaa

SEQ ID NO: 2721619 - RNA, 13 nt, Haemophilus influenzae Rd
cagugaguucaua

SEQ ID NO: 2721620 - RNA, 15 nt, Haemophilus influenzae Rd
cagugauguaaauuu

SEQ ID NO: 2721621 - RNA, 15 nt, Haemophilus influenzae Rd
cagugauuauauuuu

SEQ ID NO: 2721622 - RNA, 15 nt, Haemophilus influenzae Rd
cagugcauuaaugcc

SEQ ID NO: 2721623 - RNA, 18 nt, Haemophilus influenzae Rd
cagugcuuucauagauga

SEQ ID NO: 2721624 - RNA, 13 nt, Haemophilus influenzae Rd
cagugcuuuuuca

SEQ ID NO: 2721625 - RNA, 20 nt, Haemophilus influenzae Rd
cagugggagaacuuuuaaaa

SEQ ID NO: 2721626 - RNA, 18 nt, Haemophilus influenzae Rd
caguggggaauaaaauaa

SEQ ID NO: 2721627 - RNA, 13 nt, Haemophilus influenzae Rd
caguuaagaaaau

SEQ ID NO: 2721628 - RNA, 15 nt, Haemophilus influenzae Rd
caguuaagaaaauaa

SEQ ID NO: 2721629 - RNA, 17 nt, Haemophilus influenzae Rd
caguuaaggauuuuuga

SEQ ID NO: 2721630 - RNA, 19 nt, Haemophilus influenzae Rd
caguuaauuagaauaacaa

SEQ ID NO: 2721631 - RNA, 20 nt, Haemophilus influenzae Rd
caguuaauuagaauaacaac

SEQ ID NO: 2721632 - RNA, 12 nt, Haemophilus influenzae Rd
caguuaccauac

SEQ ID NO: 2721633 - RNA, 13 nt, Haemophilus influenzae Rd
caguuaccauaca

SEQ ID NO: 2721634 - RNA, 16 nt, Haemophilus influenzae Rd
caguuacuuauuuagc

SEQ ID NO: 2721635 - RNA, 20 nt, Haemophilus influenzae Rd
caguuacuuauuuagcaagc

SEQ ID NO: 2721636 - RNA, 22 nt, Haemophilus influenzae Rd
caguuaugcaaauacauauuuu

SEQ ID NO: 2721637 - RNA, 15 nt, Haemophilus influenzae Rd
caguuauucuucaga

SEQ ID NO: 2721638 - RNA, 18 nt, Haemophilus influenzae Rd
caguuauucuucagaacu

SEQ ID NO: 2721639 - RNA, 13 nt, Haemophilus influenzae Rd
caguuauuuuuua

SEQ ID NO: 2721640 - RNA, 19 nt, Haemophilus influenzae Rd
caguucuccuucuccauuu

SEQ ID NO: 2721641 - RNA, 22 nt, Haemophilus influenzae Rd
caguucuccuucuccauuugcc

SEQ ID NO: 2721642 - RNA, 20 nt, Haemophilus influenzae Rd
caguugcuaaaucaccuaaa

SEQ ID NO: 2721643 - RNA, 22 nt, Haemophilus influenzae Rd
caguugcuguguugauauucaa

SEQ ID NO: 2721644 - RNA, 19 nt, Haemophilus influenzae Rd
caguugcuucgccagcagu

SEQ ID NO: 2721645 - RNA, 13 nt, Haemophilus influenzae Rd
caguuguaaagau

SEQ ID NO: 2721646 - RNA, 22 nt, Haemophilus influenzae Rd
caguuuaaaacuggguuuuuuu

SEQ ID NO: 2721647 - RNA, 19 nt, Haemophilus influenzae Rd
caguuuagaaagcacuuca

SEQ ID NO: 2721648 - RNA, 13 nt, Haemophilus influenzae Rd
caguuucaagcac

SEQ ID NO: 2721649 - RNA, 17 nt, Haemophilus influenzae Rd
caguuugaauaucuacg

SEQ ID NO: 2721650 - RNA, 14 nt, Haemophilus influenzae Rd
caguuuucaaauua

SEQ ID NO: 2721651 - RNA, 15 nt, Haemophilus influenzae Rd
caguuuucauuuuuu

SEQ ID NO: 2721652 - RNA, 16 nt, Haemophilus influenzae Rd
caguuuucauuuuuug

SEQ ID NO: 2721653 - RNA, 12 nt, Haemophilus influenzae Rd
cauaaaaaaauc

SEQ ID NO: 2721654 - RNA, 11 nt, Haemophilus influenzae Rd
cauaaaaccag

SEQ ID NO: 2721655 - RNA, 17 nt, Haemophilus influenzae Rd
cauaaaaggcaaagcaa

SEQ ID NO: 2721656 - RNA, 21 nt, Haemophilus influenzae Rd
cauaaaagugcgguaaaaaaa

SEQ ID NO: 2721657 - RNA, 13 nt, Haemophilus influenzae Rd
cauaaaauaauuu

SEQ ID NO: 2721658 - RNA, 12 nt, Haemophilus influenzae Rd
cauaaacaaauu

SEQ ID NO: 2721659 - RNA, 15 nt, Haemophilus influenzae Rd
cauaaacaauuucau

SEQ ID NO: 2721660 - RNA, 17 nt, Haemophilus influenzae Rd
cauaaacaauuucauua

SEQ ID NO: 2721661 - RNA, 19 nt, Haemophilus influenzae Rd
cauaaaccgccaaaaauua

SEQ ID NO: 2721662 - RNA, 17 nt, Haemophilus influenzae Rd
cauaaacgguauuuucu

SEQ ID NO: 2721663 - RNA, 16 nt, Haemophilus influenzae Rd
cauaaacuaaaauauc

SEQ ID NO: 2721664 - RNA, 15 nt, Haemophilus influenzae Rd
cauaaagaauaauuu

SEQ ID NO: 2721665 - RNA, 19 nt, Haemophilus influenzae Rd
cauaaagaauaauuuucaa

SEQ ID NO: 2721666 - RNA, 17 nt, Haemophilus influenzae Rd
cauaaagcucagccaaa

SEQ ID NO: 2721667 - RNA, 16 nt, Haemophilus influenzae Rd
cauaaaguauacuuuu

SEQ ID NO: 2721668 - RNA, 16 nt, Haemophilus influenzae Rd
cauaaauaauaaagug

SEQ ID NO: 2721669 - RNA, 23 nt, Haemophilus influenzae Rd
cauaaauaggaaaggcauuuuuu

SEQ ID NO: 2721670 - RNA, 19 nt, Haemophilus influenzae Rd
cauaaauaucaacagcuuc

SEQ ID NO: 2721671 - RNA, 21 nt, Haemophilus influenzae Rd
cauaaaucaucccuguauaaa

SEQ ID NO: 2721672 - RNA, 18 nt, Haemophilus influenzae Rd
cauaaaucgccuucacau

SEQ ID NO: 2721673 - RNA, 20 nt, Haemophilus influenzae Rd
cauaaaucggcguauuuuac

SEQ ID NO: 2721674 - RNA, 18 nt, Haemophilus influenzae Rd
cauaaauuacaauguaag

SEQ ID NO: 2721675 - RNA, 23 nt, Haemophilus influenzae Rd
cauaaauucucgccauaauaaaa

SEQ ID NO: 2721676 - RNA, 20 nt, Haemophilus influenzae Rd
cauaaauuuggauaguuuau

SEQ ID NO: 2721677 - RNA, 22 nt, Haemophilus influenzae Rd
cauaaauuuggauaguuuauua

SEQ ID NO: 2721678 - RNA, 18 nt, Haemophilus influenzae Rd
cauaacaagaaucaucgc

SEQ ID NO: 2721679 - RNA, 13 nt, Haemophilus influenzae Rd
cauaacaagugcu

SEQ ID NO: 2721680 - RNA, 16 nt, Haemophilus influenzae Rd
cauaaccaaagggcac

SEQ ID NO: 2721681 - RNA, 24 nt, Haemophilus influenzae Rd
cauaaccauucccauuccaguaau

SEQ ID NO: 2721682 - RNA, 13 nt, Haemophilus influenzae Rd
cauaacgauaacu

SEQ ID NO: 2721683 - RNA, 16 nt, Haemophilus influenzae Rd
cauaacgccaagguua

SEQ ID NO: 2721684 - RNA, 20 nt, Haemophilus influenzae Rd
cauaacgccaagguuauuua

SEQ ID NO: 2721685 - RNA, 17 nt, Haemophilus influenzae Rd
cauaacgcuaucuuuug

SEQ ID NO: 2721686 - RNA, 22 nt, Haemophilus influenzae Rd
cauaacgcuaucuuuugguaaa

SEQ ID NO: 2721687 - RNA, 22 nt, Haemophilus influenzae Rd
cauaacgcugcuuaaagcaauc

SEQ ID NO: 2721688 - RNA, 16 nt, Haemophilus influenzae Rd
cauaacggcaagcaaa

SEQ ID NO: 2721689 - RNA, 19 nt, Haemophilus influenzae Rd
cauaacguuuacgauacau

SEQ ID NO: 2721690 - RNA, 18 nt, Haemophilus influenzae Rd
cauaacuaucacuaauau

SEQ ID NO: 2721691 - RNA, 23 nt, Haemophilus influenzae Rd
cauaacugaucggauuucuuuau

SEQ ID NO: 2721692 - RNA, 13 nt, Haemophilus influenzae Rd
cauaacuuaaauu

SEQ ID NO: 2721693 - RNA, 12 nt, Haemophilus influenzae Rd
cauaacuuuuug

SEQ ID NO: 2721694 - RNA, 19 nt, Haemophilus influenzae Rd
cauaagcauuuugauaauu

SEQ ID NO: 2721695 - RNA, 20 nt, Haemophilus influenzae Rd
cauaagcugcaucaauauug

SEQ ID NO: 2721696 - RNA, 14 nt, Haemophilus influenzae Rd
cauaaguaaaauag

SEQ ID NO: 2721697 - RNA, 23 nt, Haemophilus influenzae Rd
cauaaguaugugauguaauauua

SEQ ID NO: 2721698 - RNA, 13 nt, Haemophilus influenzae Rd
cauaaguccaagu

SEQ ID NO: 2721699 - RNA, 15 nt, Haemophilus influenzae Rd
cauaagugagaaaau

SEQ ID NO: 2721700 - RNA, 21 nt, Haemophilus influenzae Rd
cauaaguuaccgcuucuuccu

SEQ ID NO: 2721701 - RNA, 14 nt, Haemophilus influenzae Rd
cauaauaaaaaaac

SEQ ID NO: 2721702 - RNA, 12 nt, Haemophilus influenzae Rd
cauaauaaaaau

SEQ ID NO: 2721703 - RNA, 14 nt, Haemophilus influenzae Rd
cauaauaaaauuua

SEQ ID NO: 2721704 - RNA, 16 nt, Haemophilus influenzae Rd
cauaauagaaaacauu

SEQ ID NO: 2721705 - RNA, 19 nt, Haemophilus influenzae Rd
cauaauagaaacuaaacuu

SEQ ID NO: 2721706 - RNA, 18 nt, Haemophilus influenzae Rd
cauaauaggcgcguaaua

SEQ ID NO: 2721707 - RNA, 21 nt, Haemophilus influenzae Rd
cauaauaggcgcguaauaaau

SEQ ID NO: 2721708 - RNA, 18 nt, Haemophilus influenzae Rd
cauaauaucuuucuucga

SEQ ID NO: 2721709 - RNA, 18 nt, Haemophilus influenzae Rd
cauaauauuuuccccuug

SEQ ID NO: 2721710 - RNA, 16 nt, Haemophilus influenzae Rd
cauaauauuuuuacuc

SEQ ID NO: 2721711 - RNA, 18 nt, Haemophilus influenzae Rd
cauaaucaggcugugcau

SEQ ID NO: 2721712 - RNA, 21 nt, Haemophilus influenzae Rd
cauaaucaggcugugcauaau

SEQ ID NO: 2721713 - RNA, 15 nt, Haemophilus influenzae Rd
cauaauccacuaaaa

SEQ ID NO: 2721714 - RNA, 17 nt, Haemophilus influenzae Rd
cauaauccacuaaaaac

SEQ ID NO: 2721715 - RNA, 17 nt, Haemophilus influenzae Rd
cauaauccgcugcagcu

SEQ ID NO: 2721716 - RNA, 15 nt, Haemophilus influenzae Rd
cauaaucgccaaaau

SEQ ID NO: 2721717 - RNA, 15 nt, Haemophilus influenzae Rd
cauaaugauuucuaa

SEQ ID NO: 2721718 - RNA, 14 nt, Haemophilus influenzae Rd
cauaauggcuuaau

SEQ ID NO: 2721719 - RNA, 20 nt, Haemophilus influenzae Rd
cauaauguucccuauaaaua

SEQ ID NO: 2721720 - RNA, 22 nt, Haemophilus influenzae Rd
cauaauguucccuauaaauaaa

SEQ ID NO: 2721721 - RNA, 21 nt, Haemophilus influenzae Rd
cauaauuaccugugaaaacac

SEQ ID NO: 2721722 - RNA, 13 nt, Haemophilus influenzae Rd
cauaauuccuuuu

SEQ ID NO: 2721723 - RNA, 20 nt, Haemophilus influenzae Rd
cauacaacgcucugcaccuu

SEQ ID NO: 2721724 - RNA, 15 nt, Haemophilus influenzae Rd
cauacaaguauuuuc

SEQ ID NO: 2721725 - RNA, 18 nt, Haemophilus influenzae Rd
cauacaaucgcucgaaau

SEQ ID NO: 2721726 - RNA, 21 nt, Haemophilus influenzae Rd
cauacaaucucuagauuuuuu

SEQ ID NO: 2721727 - RNA, 14 nt, Haemophilus influenzae Rd
cauacaguaaaaau

SEQ ID NO: 2721728 - RNA, 22 nt, Haemophilus influenzae Rd
cauaccauuuaaaaguaaaaau

SEQ ID NO: 2721729 - RNA, 12 nt, Haemophilus influenzae Rd
cauaccccaaac

SEQ ID NO: 2721730 - RNA, 15 nt, Haemophilus influenzae Rd
cauaccgcucauugc

SEQ ID NO: 2721731 - RNA, 23 nt, Haemophilus influenzae Rd
cauaccuaaaaaugccccagcaa

SEQ ID NO: 2721732 - RNA, 14 nt, Haemophilus influenzae Rd
cauacgaucuacau

SEQ ID NO: 2721733 - RNA, 22 nt, Haemophilus influenzae Rd
cauacggauauuaguaauauau

SEQ ID NO: 2721734 - RNA, 21 nt, Haemophilus influenzae Rd
cauacuaaaaaauuaaauugu

SEQ ID NO: 2721735 - RNA, 12 nt, Haemophilus influenzae Rd
cauacuaaauac

SEQ ID NO: 2721736 - RNA, 17 nt, Haemophilus influenzae Rd
cauacuaaauacauuuu

SEQ ID NO: 2721737 - RNA, 20 nt, Haemophilus influenzae Rd
cauacuaaauacauuuuuau

SEQ ID NO: 2721738 - RNA, 20 nt, Haemophilus influenzae Rd
cauacuaugacguuuauuua

SEQ ID NO: 2721739 - RNA, 21 nt, Haemophilus influenzae Rd
cauacuuagauaaauucggau

SEQ ID NO: 2721740 - RNA, 16 nt, Haemophilus influenzae Rd
cauacuuuguugaaug

SEQ ID NO: 2721741 - RNA, 18 nt, Haemophilus influenzae Rd
cauacuuuguugaaugcc

SEQ ID NO: 2721742 - RNA, 13 nt, Haemophilus influenzae Rd
cauagaaaagccc

SEQ ID NO: 2721743 - RNA, 22 nt, Haemophilus influenzae Rd
cauagaaacaacgcguacuuuu

SEQ ID NO: 2721744 - RNA, 13 nt, Haemophilus influenzae Rd
cauagaaagcauu

SEQ ID NO: 2721745 - RNA, 16 nt, Haemophilus influenzae Rd
cauagaaaguuuaacu

SEQ ID NO: 2721746 - RNA, 20 nt, Haemophilus influenzae Rd
cauagaaaucacuaaauuuc

SEQ ID NO: 2721747 - RNA, 21 nt, Haemophilus influenzae Rd
cauagaaggcuaguucuuccu

SEQ ID NO: 2721748 - RNA, 22 nt, Haemophilus influenzae Rd
cauagaaggcuaguucuuccuu

SEQ ID NO: 2721749 - RNA, 23 nt, Haemophilus influenzae Rd
cauagaaggcuaguucuuccuug

SEQ ID NO: 2721750 - RNA, 16 nt, Haemophilus influenzae Rd
cauagaauaacgccau

SEQ ID NO: 2721751 - RNA, 19 nt, Haemophilus influenzae Rd
cauagaaugcaacaaguac

SEQ ID NO: 2721752 - RNA, 15 nt, Haemophilus influenzae Rd
cauagauaaauauau

SEQ ID NO: 2721753 - RNA, 16 nt, Haemophilus influenzae Rd
cauagauaacuucuuc

SEQ ID NO: 2721754 - RNA, 17 nt, Haemophilus influenzae Rd
cauagauaacuucuuca

SEQ ID NO: 2721755 - RNA, 18 nt, Haemophilus influenzae Rd
cauagauugaaaaguaaa

SEQ ID NO: 2721756 - RNA, 14 nt, Haemophilus influenzae Rd
cauagauuuaagcu

SEQ ID NO: 2721757 - RNA, 23 nt, Haemophilus influenzae Rd
cauagcaaaaaaccuuggaauau

SEQ ID NO: 2721758 - RNA, 17 nt, Haemophilus influenzae Rd
cauagcacguaaugcaa

SEQ ID NO: 2721759 - RNA, 16 nt, Haemophilus influenzae Rd
cauagccguucuuauc

SEQ ID NO: 2721760 - RNA, 13 nt, Haemophilus influenzae Rd
cauagcuauuagc

SEQ ID NO: 2721761 - RNA, 16 nt, Haemophilus influenzae Rd
cauagcugaaaaauaa

SEQ ID NO: 2721762 - RNA, 23 nt, Haemophilus influenzae Rd
cauagcugaaaaauaaaaaauau

SEQ ID NO: 2721763 - RNA, 21 nt, Haemophilus influenzae Rd
cauagcuucuaauuuuugcaa

SEQ ID NO: 2721764 - RNA, 23 nt, Haemophilus influenzae Rd
cauagcuucuaauuuuugcaaug

SEQ ID NO: 2721765 - RNA, 22 nt, Haemophilus influenzae Rd
cauagcuugaauugcuccuccu

SEQ ID NO: 2721766 - RNA, 14 nt, Haemophilus influenzae Rd
cauaggacaggcua

SEQ ID NO: 2721767 - RNA, 21 nt, Haemophilus influenzae Rd
cauaggacaggcuaucaucau

SEQ ID NO: 2721768 - RNA, 14 nt, Haemophilus influenzae Rd
cauaggcuucuugu

SEQ ID NO: 2721769 - RNA, 22 nt, Haemophilus influenzae Rd
cauaguuauccauccagaaaau

SEQ ID NO: 2721770 - RNA, 17 nt, Haemophilus influenzae Rd
cauaguucacuaaaaau

SEQ ID NO: 2721771 - RNA, 22 nt, Haemophilus influenzae Rd
cauaguugaugaaccauaaaca

SEQ ID NO: 2721772 - RNA, 15 nt, Haemophilus influenzae Rd
cauaguuuggcucuu

SEQ ID NO: 2721773 - RNA, 19 nt, Haemophilus influenzae Rd
cauaguuuuccauuuuuga

SEQ ID NO: 2721774 - RNA, 12 nt, Haemophilus influenzae Rd
cauauaaaagug

SEQ ID NO: 2721775 - RNA, 15 nt, Haemophilus influenzae Rd
cauauaaauaagaau

SEQ ID NO: 2721776 - RNA, 17 nt, Haemophilus influenzae Rd
cauauaaaucucccgcu

SEQ ID NO: 2721777 - RNA, 13 nt, Haemophilus influenzae Rd
cauauaacaacaa

SEQ ID NO: 2721778 - RNA, 16 nt, Haemophilus influenzae Rd
cauauaccaauaauuc

SEQ ID NO: 2721779 - RNA, 14 nt, Haemophilus influenzae Rd
cauauagacaacua

SEQ ID NO: 2721780 - RNA, 20 nt, Haemophilus influenzae Rd
cauauagggcucaaauuuuc

SEQ ID NO: 2721781 - RNA, 19 nt, Haemophilus influenzae Rd
cauauaguaagcaccaaaa

SEQ ID NO: 2721782 - RNA, 17 nt, Haemophilus influenzae Rd
cauauauucaacuaaag

SEQ ID NO: 2721783 - RNA, 23 nt, Haemophilus influenzae Rd
cauauauucaacuaaaggcacaa

SEQ ID NO: 2721784 - RNA, 21 nt, Haemophilus influenzae Rd
cauaucaaaaaguugaauuuu

SEQ ID NO: 2721785 - RNA, 14 nt, Haemophilus influenzae Rd
cauaucaauuucau

SEQ ID NO: 2721786 - RNA, 15 nt, Haemophilus influenzae Rd
cauaucaauuugcca

SEQ ID NO: 2721787 - RNA, 22 nt, Haemophilus influenzae Rd
cauaucaauuugccauuuacag

SEQ ID NO: 2721788 - RNA, 22 nt, Haemophilus influenzae Rd
cauaucaauuuggcucacaaga

SEQ ID NO: 2721789 - RNA, 11 nt, Haemophilus influenzae Rd
cauauccaaau

SEQ ID NO: 2721790 - RNA, 22 nt, Haemophilus influenzae Rd
cauaucgacaaccguugcauug

SEQ ID NO: 2721791 - RNA, 22 nt, Haemophilus influenzae Rd
cauaucgagcagacaaaauugg

SEQ ID NO: 2721792 - RNA, 19 nt, Haemophilus influenzae Rd
cauaucggcaaucaauuca

SEQ ID NO: 2721793 - RNA, 15 nt, Haemophilus influenzae Rd
cauaucuaaagcauu

SEQ ID NO: 2721794 - RNA, 15 nt, Haemophilus influenzae Rd
cauaucuauugagau

SEQ ID NO: 2721795 - RNA, 20 nt, Haemophilus influenzae Rd
cauaucuauugagauuuaau

SEQ ID NO: 2721796 - RNA, 18 nt, Haemophilus influenzae Rd
cauaucucacaauaauuu

SEQ ID NO: 2721797 - RNA, 13 nt, Haemophilus influenzae Rd
cauaucugaaaau

SEQ ID NO: 2721798 - RNA, 19 nt, Haemophilus influenzae Rd
cauaucugucauauaacca

SEQ ID NO: 2721799 - RNA, 13 nt, Haemophilus influenzae Rd
cauaucuucuucu

SEQ ID NO: 2721800 - RNA, 18 nt, Haemophilus influenzae Rd
cauaucuucuucuugcag

SEQ ID NO: 2721801 - RNA, 22 nt, Haemophilus influenzae Rd
cauauuacccguaccuuuaaau

SEQ ID NO: 2721802 - RNA, 15 nt, Haemophilus influenzae Rd
cauauuagaaucaau

SEQ ID NO: 2721803 - RNA, 19 nt, Haemophilus influenzae Rd
cauauuaguuaguuuuuua

SEQ ID NO: 2721804 - RNA, 13 nt, Haemophilus influenzae Rd
cauauuaucugcu

SEQ ID NO: 2721805 - RNA, 17 nt, Haemophilus influenzae Rd
cauauuaucugcuggau

SEQ ID NO: 2721806 - RNA, 19 nt, Haemophilus influenzae Rd
cauauucgacaauuucugc

SEQ ID NO: 2721807 - RNA, 19 nt, Haemophilus influenzae Rd
cauauucuaccgcauuuuu

SEQ ID NO: 2721808 - RNA, 16 nt, Haemophilus influenzae Rd
cauauugaugauuaac

SEQ ID NO: 2721809 - RNA, 22 nt, Haemophilus influenzae Rd
cauauugcuugcauucacaaaa

SEQ ID NO: 2721810 - RNA, 22 nt, Haemophilus influenzae Rd
cauauuggcggauaugcucaau

SEQ ID NO: 2721811 - RNA, 20 nt, Haemophilus influenzae Rd
cauauuuagccgcaccuuga

SEQ ID NO: 2721812 - RNA, 18 nt, Haemophilus influenzae Rd
cauauuugaaguugccau

SEQ ID NO: 2721813 - RNA, 17 nt, Haemophilus influenzae Rd
cauauuuuaaauaauua

SEQ ID NO: 2721814 - RNA, 22 nt, Haemophilus influenzae Rd
cauauuuuaaauaauuaaaaau

SEQ ID NO: 2721815 - RNA, 21 nt, Haemophilus influenzae Rd
cauauuuuaggauacaaauaa

SEQ ID NO: 2721816 - RNA, 11 nt, Haemophilus influenzae Rd
cauauuuucca

SEQ ID NO: 2721817 - RNA, 14 nt, Haemophilus influenzae Rd
cauauuuuguucua

SEQ ID NO: 2721818 - RNA, 22 nt, Haemophilus influenzae Rd
caucaaaagaucauuuuuuuaa

SEQ ID NO: 2721819 - RNA, 14 nt, Haemophilus influenzae Rd
caucaaaauaaaua

SEQ ID NO: 2721820 - RNA, 14 nt, Haemophilus influenzae Rd
caucaaaaugaaaa

SEQ ID NO: 2721821 - RNA, 12 nt, Haemophilus influenzae Rd
caucaaaauuga

SEQ ID NO: 2721822 - RNA, 20 nt, Haemophilus influenzae Rd
caucaaaccugcuucaucca

SEQ ID NO: 2721823 - RNA, 21 nt, Haemophilus influenzae Rd
caucaaagcguucauuuugau

SEQ ID NO: 2721824 - RNA, 17 nt, Haemophilus influenzae Rd
caucaaagcucaccugc

SEQ ID NO: 2721825 - RNA, 23 nt, Haemophilus influenzae Rd
caucaaagcucaccugcccugaa

SEQ ID NO: 2721826 - RNA, 21 nt, Haemophilus influenzae Rd
caucaaauccgccaaucauac

SEQ ID NO: 2721827 - RNA, 15 nt, Haemophilus influenzae Rd
caucaaauccuuguu

SEQ ID NO: 2721828 - RNA, 20 nt, Haemophilus influenzae Rd
caucaaauccuuguuuuuca

SEQ ID NO: 2721829 - RNA, 19 nt, Haemophilus influenzae Rd
caucaacgguuuucauugc

SEQ ID NO: 2721830 - RNA, 19 nt, Haemophilus influenzae Rd
caucaacuaauuuauuaaa

SEQ ID NO: 2721831 - RNA, 12 nt, Haemophilus influenzae Rd
caucaagauuua

SEQ ID NO: 2721832 - RNA, 15 nt, Haemophilus influenzae Rd
caucaauaaaaagcu

SEQ ID NO: 2721833 - RNA, 12 nt, Haemophilus influenzae Rd
caucaauaauac

SEQ ID NO: 2721834 - RNA, 18 nt, Haemophilus influenzae Rd
caucaauaccuaacguua

SEQ ID NO: 2721835 - RNA, 13 nt, Haemophilus influenzae Rd
caucaauaucugc

SEQ ID NO: 2721836 - RNA, 16 nt, Haemophilus influenzae Rd
caucaauauuaugugc

SEQ ID NO: 2721837 - RNA, 18 nt, Haemophilus influenzae Rd
caucaauauuaugugcuu

SEQ ID NO: 2721838 - RNA, 14 nt, Haemophilus influenzae Rd
caucaaucacagca

SEQ ID NO: 2721839 - RNA, 17 nt, Haemophilus influenzae Rd
caucaaucauaaaaaca

SEQ ID NO: 2721840 - RNA, 17 nt, Haemophilus influenzae Rd
caucaaugccauuuuuu

SEQ ID NO: 2721841 - RNA, 23 nt, Haemophilus influenzae Rd
caucaauggcaucgcuggcuaaa

SEQ ID NO: 2721842 - RNA, 15 nt, Haemophilus influenzae Rd
caucaauucuuccca

SEQ ID NO: 2721843 - RNA, 16 nt, Haemophilus influenzae Rd
caucaauucuucccaa

SEQ ID NO: 2721844 - RNA, 19 nt, Haemophilus influenzae Rd
caucacaaacacguucuaa

SEQ ID NO: 2721845 - RNA, 12 nt, Haemophilus influenzae Rd
caucacauccac

SEQ ID NO: 2721846 - RNA, 18 nt, Haemophilus influenzae Rd
caucacauccacaaaaaa

SEQ ID NO: 2721847 - RNA, 14 nt, Haemophilus influenzae Rd
caucacauuuucaa

SEQ ID NO: 2721848 - RNA, 15 nt, Haemophilus influenzae Rd
caucaccaagaauca

SEQ ID NO: 2721849 - RNA, 13 nt, Haemophilus influenzae Rd
caucaccacaaaa

SEQ ID NO: 2721850 - RNA, 19 nt, Haemophilus influenzae Rd
caucaccgauaauaugcau

SEQ ID NO: 2721851 - RNA, 20 nt, Haemophilus influenzae Rd
caucaccgauaauaugcauc

SEQ ID NO: 2721852 - RNA, 15 nt, Haemophilus influenzae Rd
caucacgacaucaau

SEQ ID NO: 2721853 - RNA, 22 nt, Haemophilus influenzae Rd
caucacgccaucgccauucuca

SEQ ID NO: 2721854 - RNA, 23 nt, Haemophilus influenzae Rd
caucacggguuugguaagcaaua

SEQ ID NO: 2721855 - RNA, 18 nt, Haemophilus influenzae Rd
caucacguaauacaaaau

SEQ ID NO: 2721856 - RNA, 17 nt, Haemophilus influenzae Rd
caucacguucaaaaaua

SEQ ID NO: 2721857 - RNA, 20 nt, Haemophilus influenzae Rd
caucacucguugguauuuac

SEQ ID NO: 2721858 - RNA, 13 nt, Haemophilus influenzae Rd
caucacuucuugu

SEQ ID NO: 2721859 - RNA, 14 nt, Haemophilus influenzae Rd
caucacuugugcua

SEQ ID NO: 2721860 - RNA, 19 nt, Haemophilus influenzae Rd
caucagaaauaucuucaau

SEQ ID NO: 2721861 - RNA, 23 nt, Haemophilus influenzae Rd
caucagaaauaucuucaauuucu

SEQ ID NO: 2721862 - RNA, 18 nt, Haemophilus influenzae Rd
caucagauggaauauuug

SEQ ID NO: 2721863 - RNA, 23 nt, Haemophilus influenzae Rd
caucagcuccuacauuaaaagau

SEQ ID NO: 2721864 - RNA, 22 nt, Haemophilus influenzae Rd
caucagguuuaauaaucgaaaa

SEQ ID NO: 2721865 - RNA, 14 nt, Haemophilus influenzae Rd
caucaguaccuuua

SEQ ID NO: 2721866 - RNA, 16 nt, Haemophilus influenzae Rd
caucaucagacauauc

SEQ ID NO: 2721867 - RNA, 23 nt, Haemophilus influenzae Rd
caucaucaucgauaaauucaauc

SEQ ID NO: 2721868 - RNA, 12 nt, Haemophilus influenzae Rd
caucaucaucgc

SEQ ID NO: 2721869 - RNA, 23 nt, Haemophilus influenzae Rd
caucaucgauaaauucaaucgcu

SEQ ID NO: 2721870 - RNA, 13 nt, Haemophilus influenzae Rd
caucaucugcugg

SEQ ID NO: 2721871 - RNA, 23 nt, Haemophilus influenzae Rd
caucaucuggcauaucugcugcu

SEQ ID NO: 2721872 - RNA, 15 nt, Haemophilus influenzae Rd
caucauuaaacgauc

SEQ ID NO: 2721873 - RNA, 15 nt, Haemophilus influenzae Rd
caucauuaauacaca

SEQ ID NO: 2721874 - RNA, 22 nt, Haemophilus influenzae Rd
caucauuaauacacaaaaucca

SEQ ID NO: 2721875 - RNA, 15 nt, Haemophilus influenzae Rd
caucauuacuuuuuu

SEQ ID NO: 2721876 - RNA, 17 nt, Haemophilus influenzae Rd
caucauuacuuuuuuaa

SEQ ID NO: 2721877 - RNA, 15 nt, Haemophilus influenzae Rd
caucauuaugaaaaa

SEQ ID NO: 2721878 - RNA, 16 nt, Haemophilus influenzae Rd
caucauuaugaaaaaa

SEQ ID NO: 2721879 - RNA, 23 nt, Haemophilus influenzae Rd
caucauuaugaaaaaaagaaaac

SEQ ID NO: 2721880 - RNA, 15 nt, Haemophilus influenzae Rd
caucauuauugccuu

SEQ ID NO: 2721881 - RNA, 20 nt, Haemophilus influenzae Rd
caucauucaauauaaaaaau

SEQ ID NO: 2721882 - RNA, 19 nt, Haemophilus influenzae Rd
caucauucaaugcaacaau

SEQ ID NO: 2721883 - RNA, 17 nt, Haemophilus influenzae Rd
caucauuucucgggcug

SEQ ID NO: 2721884 - RNA, 14 nt, Haemophilus influenzae Rd
caucauuugcucua

SEQ ID NO: 2721885 - RNA, 12 nt, Haemophilus influenzae Rd
caucauuuuuau

SEQ ID NO: 2721886 - RNA, 19 nt, Haemophilus influenzae Rd
caucauuuuucgcaaaauc

SEQ ID NO: 2721887 - RNA, 18 nt, Haemophilus influenzae Rd
cauccaaaacuaauaaaa

SEQ ID NO: 2721888 - RNA, 16 nt, Haemophilus influenzae Rd
cauccaauguugcaau

SEQ ID NO: 2721889 - RNA, 15 nt, Haemophilus influenzae Rd
cauccacuaaaccau

SEQ ID NO: 2721890 - RNA, 16 nt, Haemophilus influenzae Rd
cauccacuaaaccauu

SEQ ID NO: 2721891 - RNA, 13 nt, Haemophilus influenzae Rd
cauccacuaauuc

SEQ ID NO: 2721892 - RNA, 15 nt, Haemophilus influenzae Rd
cauccacuucaucca

SEQ ID NO: 2721893 - RNA, 16 nt, Haemophilus influenzae Rd
cauccacuucauccau

SEQ ID NO: 2721894 - RNA, 20 nt, Haemophilus influenzae Rd
cauccagaaaauugcaccuu

SEQ ID NO: 2721895 - RNA, 16 nt, Haemophilus influenzae Rd
cauccaugacagaauu

SEQ ID NO: 2721896 - RNA, 22 nt, Haemophilus influenzae Rd
cauccauuccugcaagaaaaau

SEQ ID NO: 2721897 - RNA, 14 nt, Haemophilus influenzae Rd
caucccaauuauug

SEQ ID NO: 2721898 - RNA, 14 nt, Haemophilus influenzae Rd
caucccuucuuuua

SEQ ID NO: 2721899 - RNA, 15 nt, Haemophilus influenzae Rd
cauccgaaauuaauu

SEQ ID NO: 2721900 - RNA, 18 nt, Haemophilus influenzae Rd
cauccgcuguucgcaaac

SEQ ID NO: 2721901 - RNA, 20 nt, Haemophilus influenzae Rd
cauccgcuuguaauuucauu

SEQ ID NO: 2721902 - RNA, 12 nt, Haemophilus influenzae Rd
caucgagaaaua

SEQ ID NO: 2721903 - RNA, 19 nt, Haemophilus influenzae Rd
caucgaggccucuugcuuc

SEQ ID NO: 2721904 - RNA, 13 nt, Haemophilus influenzae Rd
caucgcagugauc

SEQ ID NO: 2721905 - RNA, 16 nt, Haemophilus influenzae Rd
caucgcaucaaaggcu

SEQ ID NO: 2721906 - RNA, 15 nt, Haemophilus influenzae Rd
caucgcaucuguauc

SEQ ID NO: 2721907 - RNA, 16 nt, Haemophilus influenzae Rd
caucgcgccaacgaaa

SEQ ID NO: 2721908 - RNA, 18 nt, Haemophilus influenzae Rd
caucgcguuuauuuuuau

SEQ ID NO: 2721909 - RNA, 14 nt, Haemophilus influenzae Rd
caucgcugccuaau

SEQ ID NO: 2721910 - RNA, 14 nt, Haemophilus influenzae Rd
caucgcuucaucau

SEQ ID NO: 2721911 - RNA, 15 nt, Haemophilus influenzae Rd
caucgcuucaucauc

SEQ ID NO: 2721912 - RNA, 13 nt, Haemophilus influenzae Rd
caucguauuaaaa

SEQ ID NO: 2721913 - RNA, 21 nt, Haemophilus influenzae Rd
caucguauuaaaagugcggug

SEQ ID NO: 2721914 - RNA, 15 nt, Haemophilus influenzae Rd
caucgucuuuaccug

SEQ ID NO: 2721915 - RNA, 15 nt, Haemophilus influenzae Rd
caucgugaugauuuu

SEQ ID NO: 2721916 - RNA, 19 nt, Haemophilus influenzae Rd
caucguuaaaccaaauaau

SEQ ID NO: 2721917 - RNA, 15 nt, Haemophilus influenzae Rd
caucuaaaaauaauu

SEQ ID NO: 2721918 - RNA, 21 nt, Haemophilus influenzae Rd
caucuaaaaauaauuuuacuu

SEQ ID NO: 2721919 - RNA, 19 nt, Haemophilus influenzae Rd
caucuaaaccgauagcuuu

SEQ ID NO: 2721920 - RNA, 17 nt, Haemophilus influenzae Rd
caucuaaacuuauauua

SEQ ID NO: 2721921 - RNA, 12 nt, Haemophilus influenzae Rd
caucuaacaaua

SEQ ID NO: 2721922 - RNA, 11 nt, Haemophilus influenzae Rd
caucuaacaca

SEQ ID NO: 2721923 - RNA, 13 nt, Haemophilus influenzae Rd
caucuaacacaau

SEQ ID NO: 2721924 - RNA, 20 nt, Haemophilus influenzae Rd
caucuaaugcaggcaacuca

SEQ ID NO: 2721925 - RNA, 17 nt, Haemophilus influenzae Rd
caucuaauugugcuaaa

SEQ ID NO: 2721926 - RNA, 22 nt, Haemophilus influenzae Rd
caucuaauugugcuaaauaauu

SEQ ID NO: 2721927 - RNA, 22 nt, Haemophilus influenzae Rd
caucuacacggagauauuguaa

SEQ ID NO: 2721928 - RNA, 19 nt, Haemophilus influenzae Rd
caucuagauuucuauccau

SEQ ID NO: 2721929 - RNA, 15 nt, Haemophilus influenzae Rd
caucuagcuuaacaa

SEQ ID NO: 2721930 - RNA, 18 nt, Haemophilus influenzae Rd
caucuaguaccugauuug

SEQ ID NO: 2721931 - RNA, 15 nt, Haemophilus influenzae Rd
caucuaguuuuaaua

SEQ ID NO: 2721932 - RNA, 17 nt, Haemophilus influenzae Rd
caucucuaaccuaaaau

SEQ ID NO: 2721933 - RNA, 18 nt, Haemophilus influenzae Rd
caucucuaaccuaaaaua

SEQ ID NO: 2721934 - RNA, 17 nt, Haemophilus influenzae Rd
caucucuuguuuuucca

SEQ ID NO: 2721935 - RNA, 13 nt, Haemophilus influenzae Rd
caucugaauuuaa

SEQ ID NO: 2721936 - RNA, 16 nt, Haemophilus influenzae Rd
caucugaauuuaaacu

SEQ ID NO: 2721937 - RNA, 13 nt, Haemophilus influenzae Rd
caucugauuuugu

SEQ ID NO: 2721938 - RNA, 19 nt, Haemophilus influenzae Rd
caucugccacuucuugcgu

SEQ ID NO: 2721939 - RNA, 16 nt, Haemophilus influenzae Rd
caucugcugguuuuag

SEQ ID NO: 2721940 - RNA, 20 nt, Haemophilus influenzae Rd
caucuggcauaucugcugcu

SEQ ID NO: 2721941 - RNA, 14 nt, Haemophilus influenzae Rd
caucugguuuugug

SEQ ID NO: 2721942 - RNA, 22 nt, Haemophilus influenzae Rd
caucugguuuugugaguaaaau

SEQ ID NO: 2721943 - RNA, 23 nt, Haemophilus influenzae Rd
caucugguuuugugaguaaaaua

SEQ ID NO: 2721944 - RNA, 19 nt, Haemophilus influenzae Rd
caucuguaaaccauuccac

SEQ ID NO: 2721945 - RNA, 13 nt, Haemophilus influenzae Rd
caucuguaaaccu

SEQ ID NO: 2721946 - RNA, 14 nt, Haemophilus influenzae Rd
caucuguuggaaug

SEQ ID NO: 2721947 - RNA, 19 nt, Haemophilus influenzae Rd
caucuguugugaaugcaau

SEQ ID NO: 2721948 - RNA, 21 nt, Haemophilus influenzae Rd
caucuguugugaaugcaauau

SEQ ID NO: 2721949 - RNA, 20 nt, Haemophilus influenzae Rd
caucuuaaauuauagauaaa

SEQ ID NO: 2721950 - RNA, 21 nt, Haemophilus influenzae Rd
caucuuaucuagacuuucuug

SEQ ID NO: 2721951 - RNA, 13 nt, Haemophilus influenzae Rd
caucuucaguacg

SEQ ID NO: 2721952 - RNA, 13 nt, Haemophilus influenzae Rd
caucuucauuaaa

SEQ ID NO: 2721953 - RNA, 19 nt, Haemophilus influenzae Rd
caucuuccgugacaucauc

SEQ ID NO: 2721954 - RNA, 13 nt, Haemophilus influenzae Rd
caucuucuacggu

SEQ ID NO: 2721955 - RNA, 21 nt, Haemophilus influenzae Rd
caucuugccaaugccaaauuu

SEQ ID NO: 2721956 - RNA, 20 nt, Haemophilus influenzae Rd
caucuugcguuaaaucaaaa

SEQ ID NO: 2721957 - RNA, 14 nt, Haemophilus influenzae Rd
caucuuguuuaucg

SEQ ID NO: 2721958 - RNA, 15 nt, Haemophilus influenzae Rd
caucuuuaaaguguu

SEQ ID NO: 2721959 - RNA, 18 nt, Haemophilus influenzae Rd
caucuuuaagaguaaauu

SEQ ID NO: 2721960 - RNA, 12 nt, Haemophilus influenzae Rd
caucuuuaauuc

SEQ ID NO: 2721961 - RNA, 17 nt, Haemophilus influenzae Rd
caucuuuauaacauaau

SEQ ID NO: 2721962 - RNA, 19 nt, Haemophilus influenzae Rd
caucuuuggcuaugucaau

SEQ ID NO: 2721963 - RNA, 14 nt, Haemophilus influenzae Rd
caucuuuuaaauaa

SEQ ID NO: 2721964 - RNA, 18 nt, Haemophilus influenzae Rd
caucuuuuggguuaaaua

SEQ ID NO: 2721965 - RNA, 14 nt, Haemophilus influenzae Rd
caugaauaaaaaug

SEQ ID NO: 2721966 - RNA, 16 nt, Haemophilus influenzae Rd
caugaauuucuaauuu

SEQ ID NO: 2721967 - RNA, 16 nt, Haemophilus influenzae Rd
caugacuauuacaauu

SEQ ID NO: 2721968 - RNA, 18 nt, Haemophilus influenzae Rd
caugagcugggcaaacaa

SEQ ID NO: 2721969 - RNA, 18 nt, Haemophilus influenzae Rd
caugagcuucaaaaucac

SEQ ID NO: 2721970 - RNA, 21 nt, Haemophilus influenzae Rd
caugaguuguuuuuucaguug

SEQ ID NO: 2721971 - RNA, 14 nt, Haemophilus influenzae Rd
caugauccacauag

SEQ ID NO: 2721972 - RNA, 18 nt, Haemophilus influenzae Rd
caugauguaauucugcuu

SEQ ID NO: 2721973 - RNA, 20 nt, Haemophilus influenzae Rd
caugauguuuuucagcaaaa

SEQ ID NO: 2721974 - RNA, 21 nt, Haemophilus influenzae Rd
caugcaaaauauucuauuuau

SEQ ID NO: 2721975 - RNA, 15 nt, Haemophilus influenzae Rd
caugcauuaaaaaac

SEQ ID NO: 2721976 - RNA, 15 nt, Haemophilus influenzae Rd
caugccaagcuaauu

SEQ ID NO: 2721977 - RNA, 14 nt, Haemophilus influenzae Rd
caugccauuuccua

SEQ ID NO: 2721978 - RNA, 22 nt, Haemophilus influenzae Rd
caugcgaagcguaacgcccaaa

SEQ ID NO: 2721979 - RNA, 15 nt, Haemophilus influenzae Rd
cauggaacguuuuuu

SEQ ID NO: 2721980 - RNA, 16 nt, Haemophilus influenzae Rd
cauggcacaaaauaau

SEQ ID NO: 2721981 - RNA, 18 nt, Haemophilus influenzae Rd
cauggccaauuucaucgc

SEQ ID NO: 2721982 - RNA, 15 nt, Haemophilus influenzae Rd
caugggauaaacauu

SEQ ID NO: 2721983 - RNA, 18 nt, Haemophilus influenzae Rd
caugggauaaacauuucu

SEQ ID NO: 2721984 - RNA, 18 nt, Haemophilus influenzae Rd
caugggugugaaaguacu

SEQ ID NO: 2721985 - RNA, 23 nt, Haemophilus influenzae Rd
cauguaaacccacaacuuuuuca

SEQ ID NO: 2721986 - RNA, 19 nt, Haemophilus influenzae Rd
cauguaaauaguuauuuau

SEQ ID NO: 2721987 - RNA, 12 nt, Haemophilus influenzae Rd
cauguacauuaa

SEQ ID NO: 2721988 - RNA, 15 nt, Haemophilus influenzae Rd
cauguugauguaaaa

SEQ ID NO: 2721989 - RNA, 19 nt, Haemophilus influenzae Rd
cauuaaaaauuuaaaagca

SEQ ID NO: 2721990 - RNA, 13 nt, Haemophilus influenzae Rd
cauuaaaaggacu

SEQ ID NO: 2721991 - RNA, 21 nt, Haemophilus influenzae Rd
cauuaaaagucuguuuaaaaa

SEQ ID NO: 2721992 - RNA, 17 nt, Haemophilus influenzae Rd
cauuaaacgaucuauuc

SEQ ID NO: 2721993 - RNA, 18 nt, Haemophilus influenzae Rd
cauuaaacucacuaaauu

SEQ ID NO: 2721994 - RNA, 12 nt, Haemophilus influenzae Rd
cauuaaacugau

SEQ ID NO: 2721995 - RNA, 16 nt, Haemophilus influenzae Rd
cauuaaagcaauugcu

SEQ ID NO: 2721996 - RNA, 19 nt, Haemophilus influenzae Rd
cauuaaagcaauugcuaaa

SEQ ID NO: 2721997 - RNA, 12 nt, Haemophilus influenzae Rd
cauuaaauaaaa

SEQ ID NO: 2721998 - RNA, 13 nt, Haemophilus influenzae Rd
cauuaaauaaaaa

SEQ ID NO: 2721999 - RNA, 14 nt, Haemophilus influenzae Rd
cauuaaauaaaaau

SEQ ID NO: 2722000 - RNA, 19 nt, Haemophilus influenzae Rd
cauuaaauaccgcuugaau

SEQ ID NO: 2722001 - RNA, 10 nt, Haemophilus influenzae Rd
cauuaaauau

SEQ ID NO: 2722002 - RNA, 22 nt, Haemophilus influenzae Rd
cauuaacagcacuaaauucuaa

SEQ ID NO: 2722003 - RNA, 15 nt, Haemophilus influenzae Rd
cauuaaggcuuuucu

SEQ ID NO: 2722004 - RNA, 22 nt, Haemophilus influenzae Rd
cauuaauaaaccaacauacauu

SEQ ID NO: 2722005 - RNA, 13 nt, Haemophilus influenzae Rd
cauuaauaaauuu

SEQ ID NO: 2722006 - RNA, 19 nt, Haemophilus influenzae Rd
cauuaauaacguguaaauu

SEQ ID NO: 2722007 - RNA, 11 nt, Haemophilus influenzae Rd
cauuaauaacu

SEQ ID NO: 2722008 - RNA, 21 nt, Haemophilus influenzae Rd
cauuaauaaucuaauccaaau

SEQ ID NO: 2722009 - RNA, 19 nt, Haemophilus influenzae Rd
cauuaauacacaaaaucca

SEQ ID NO: 2722010 - RNA, 13 nt, Haemophilus influenzae Rd
cauuaauacuuuu

SEQ ID NO: 2722011 - RNA, 19 nt, Haemophilus influenzae Rd
cauuaauacuuuugcacug

SEQ ID NO: 2722012 - RNA, 19 nt, Haemophilus influenzae Rd
cauuaauaggaauaacaca

SEQ ID NO: 2722013 - RNA, 23 nt, Haemophilus influenzae Rd
cauuaaucuuauacaacaaaaag

SEQ ID NO: 2722014 - RNA, 15 nt, Haemophilus influenzae Rd
cauuaaugcauugau

SEQ ID NO: 2722015 - RNA, 22 nt, Haemophilus influenzae Rd
cauuaaugcauugauugcuaaa

SEQ ID NO: 2722016 - RNA, 23 nt, Haemophilus influenzae Rd
cauuaauggguaaucaauauuua

SEQ ID NO: 2722017 - RNA, 20 nt, Haemophilus influenzae Rd
cauuaauuggcgcaacauca

SEQ ID NO: 2722018 - RNA, 19 nt, Haemophilus influenzae Rd
cauuaauuuuauuuuuugc

SEQ ID NO: 2722019 - RNA, 15 nt, Haemophilus influenzae Rd
cauuaauuuuuucac

SEQ ID NO: 2722020 - RNA, 17 nt, Haemophilus influenzae Rd
cauuaauuuuuucacaa

SEQ ID NO: 2722021 - RNA, 20 nt, Haemophilus influenzae Rd
cauuacaagcauuaaauacc

SEQ ID NO: 2722022 - RNA, 17 nt, Haemophilus influenzae Rd
cauuacaaguauaaaga

SEQ ID NO: 2722023 - RNA, 13 nt, Haemophilus influenzae Rd
cauuacagcaagc

SEQ ID NO: 2722024 - RNA, 16 nt, Haemophilus influenzae Rd
cauuacauaaaaccaa

SEQ ID NO: 2722025 - RNA, 13 nt, Haemophilus influenzae Rd
cauuacauaauac

SEQ ID NO: 2722026 - RNA, 15 nt, Haemophilus influenzae Rd
cauuacauccacuuu

SEQ ID NO: 2722027 - RNA, 18 nt, Haemophilus influenzae Rd
cauuaccgccagugauuu

SEQ ID NO: 2722028 - RNA, 17 nt, Haemophilus influenzae Rd
cauuaccguaugcaaac

SEQ ID NO: 2722029 - RNA, 19 nt, Haemophilus influenzae Rd
cauuacggcaggaaugaaa

SEQ ID NO: 2722030 - RNA, 16 nt, Haemophilus influenzae Rd
cauuacgugcaaauaa

SEQ ID NO: 2722031 - RNA, 18 nt, Haemophilus influenzae Rd
cauuacgugcaaauaaau

SEQ ID NO: 2722032 - RNA, 18 nt, Haemophilus influenzae Rd
cauuacguucauauaaau

SEQ ID NO: 2722033 - RNA, 18 nt, Haemophilus influenzae Rd
cauuacuuagauauauua

SEQ ID NO: 2722034 - RNA, 19 nt, Haemophilus influenzae Rd
cauuagaaaguuguuucau

SEQ ID NO: 2722035 - RNA, 17 nt, Haemophilus influenzae Rd
cauuaggaauaucuuug

SEQ ID NO: 2722036 - RNA, 18 nt, Haemophilus influenzae Rd
cauuaggaauaucuuuga

SEQ ID NO: 2722037 - RNA, 19 nt, Haemophilus influenzae Rd
cauuaggaauaucuuugac

SEQ ID NO: 2722038 - RNA, 21 nt, Haemophilus influenzae Rd
cauuaggguacauuugacgaa

SEQ ID NO: 2722039 - RNA, 17 nt, Haemophilus influenzae Rd
cauuaguaucuuccauu

SEQ ID NO: 2722040 - RNA, 19 nt, Haemophilus influenzae Rd
cauuagucgucuauuuauu

SEQ ID NO: 2722041 - RNA, 13 nt, Haemophilus influenzae Rd
cauuaguuguuuu

SEQ ID NO: 2722042 - RNA, 21 nt, Haemophilus influenzae Rd
cauuauauuccuuauucaaau

SEQ ID NO: 2722043 - RNA, 20 nt, Haemophilus influenzae Rd
cauuauauuuaauacuuucu

SEQ ID NO: 2722044 - RNA, 15 nt, Haemophilus influenzae Rd
cauuaucaaaugcca

SEQ ID NO: 2722045 - RNA, 14 nt, Haemophilus influenzae Rd
cauuaugaaaaaaa

SEQ ID NO: 2722046 - RNA, 18 nt, Haemophilus influenzae Rd
cauuaugaaaaaaacugu

SEQ ID NO: 2722047 - RNA, 18 nt, Haemophilus influenzae Rd
cauuaugccuacuuuuua

SEQ ID NO: 2722048 - RNA, 14 nt, Haemophilus influenzae Rd
cauuaugugcaauu

SEQ ID NO: 2722049 - RNA, 13 nt, Haemophilus influenzae Rd
cauuauuaaaagc

SEQ ID NO: 2722050 - RNA, 14 nt, Haemophilus influenzae Rd
cauuauugccuuuc

SEQ ID NO: 2722051 - RNA, 23 nt, Haemophilus influenzae Rd
cauuauugugauggggauuuuuu

SEQ ID NO: 2722052 - RNA, 20 nt, Haemophilus influenzae Rd
cauuauuuggcauagaaaag

SEQ ID NO: 2722053 - RNA, 16 nt, Haemophilus influenzae Rd
cauuauuuuuaucgac

SEQ ID NO: 2722054 - RNA, 18 nt, Haemophilus influenzae Rd
cauucaaaaauaaagccc

SEQ ID NO: 2722055 - RNA, 21 nt, Haemophilus influenzae Rd
cauucaaaaauaaagcccugu

SEQ ID NO: 2722056 - RNA, 23 nt, Haemophilus influenzae Rd
cauucaagccuucuaaaauaaga

SEQ ID NO: 2722057 - RNA, 23 nt, Haemophilus influenzae Rd
cauucaaucuuuuuguuaauaaa

SEQ ID NO: 2722058 - RNA, 15 nt, Haemophilus influenzae Rd
cauucacaggguuca

SEQ ID NO: 2722059 - RNA, 16 nt, Haemophilus influenzae Rd
cauucacauucuuuua

SEQ ID NO: 2722060 - RNA, 16 nt, Haemophilus influenzae Rd
cauucacuaacaaaua

SEQ ID NO: 2722061 - RNA, 17 nt, Haemophilus influenzae Rd
cauucacucggaaugcc

SEQ ID NO: 2722062 - RNA, 18 nt, Haemophilus influenzae Rd
cauucacuuucacauaaa

SEQ ID NO: 2722063 - RNA, 15 nt, Haemophilus influenzae Rd
cauucagcacuaauu

SEQ ID NO: 2722064 - RNA, 13 nt, Haemophilus influenzae Rd
cauucaucaaaac

SEQ ID NO: 2722065 - RNA, 20 nt, Haemophilus influenzae Rd
cauucaucaaaucauuuuuu

SEQ ID NO: 2722066 - RNA, 12 nt, Haemophilus influenzae Rd
cauucauuuugu

SEQ ID NO: 2722067 - RNA, 13 nt, Haemophilus influenzae Rd
cauucauuuuguc

SEQ ID NO: 2722068 - RNA, 20 nt, Haemophilus influenzae Rd
cauuccacgcuaaaaucuug

SEQ ID NO: 2722069 - RNA, 23 nt, Haemophilus influenzae Rd
cauuccacgcuaaaaucuugcac

SEQ ID NO: 2722070 - RNA, 15 nt, Haemophilus influenzae Rd
cauucccaaauaaua

SEQ ID NO: 2722071 - RNA, 13 nt, Haemophilus influenzae Rd
cauucgcauauuu

SEQ ID NO: 2722072 - RNA, 14 nt, Haemophilus influenzae Rd
cauucgcauauuuu

SEQ ID NO: 2722073 - RNA, 23 nt, Haemophilus influenzae Rd
cauucgccguuaguuuguauuug

SEQ ID NO: 2722074 - RNA, 14 nt, Haemophilus influenzae Rd
cauucgccuaaugc

SEQ ID NO: 2722075 - RNA, 16 nt, Haemophilus influenzae Rd
cauucgccuaaugccu

SEQ ID NO: 2722076 - RNA, 23 nt, Haemophilus influenzae Rd
cauucgguguucguuuguuugaa

SEQ ID NO: 2722077 - RNA, 17 nt, Haemophilus influenzae Rd
cauucguauaaauauuu

SEQ ID NO: 2722078 - RNA, 15 nt, Haemophilus influenzae Rd
cauucguucccaaau

SEQ ID NO: 2722079 - RNA, 15 nt, Haemophilus influenzae Rd
cauucuaauggcuuc

SEQ ID NO: 2722080 - RNA, 17 nt, Haemophilus influenzae Rd
cauucuauuuuaaaaau

SEQ ID NO: 2722081 - RNA, 18 nt, Haemophilus influenzae Rd
cauucuauuuuaaaaauu

SEQ ID NO: 2722082 - RNA, 22 nt, Haemophilus influenzae Rd
cauucucaaaugaggaauacuc

SEQ ID NO: 2722083 - RNA, 18 nt, Haemophilus influenzae Rd
cauucucaauugcaaaau

SEQ ID NO: 2722084 - RNA, 21 nt, Haemophilus influenzae Rd
cauucucuaacgcauucaaau

SEQ ID NO: 2722085 - RNA, 12 nt, Haemophilus influenzae Rd
cauucucuucug

SEQ ID NO: 2722086 - RNA, 21 nt, Haemophilus influenzae Rd
cauucugaaugaucgaguaaa

SEQ ID NO: 2722087 - RNA, 14 nt, Haemophilus influenzae Rd
cauucuuuuaaaua

SEQ ID NO: 2722088 - RNA, 15 nt, Haemophilus influenzae Rd
cauucuuuuaaauac

SEQ ID NO: 2722089 - RNA, 23 nt, Haemophilus influenzae Rd
cauucuuuucgcaauucuuuuuc

SEQ ID NO: 2722090 - RNA, 15 nt, Haemophilus influenzae Rd
cauugaaaauacagu

SEQ ID NO: 2722091 - RNA, 21 nt, Haemophilus influenzae Rd
cauugaauccaacguauuuau

SEQ ID NO: 2722092 - RNA, 14 nt, Haemophilus influenzae Rd
cauugaauuaaaaa

SEQ ID NO: 2722093 - RNA, 16 nt, Haemophilus influenzae Rd
cauugaauuaaaaaug

SEQ ID NO: 2722094 - RNA, 14 nt, Haemophilus influenzae Rd
cauugacuucugua

SEQ ID NO: 2722095 - RNA, 13 nt, Haemophilus influenzae Rd
cauugagcauuuu

SEQ ID NO: 2722096 - RNA, 17 nt, Haemophilus influenzae Rd
cauugaguuuagucuuu

SEQ ID NO: 2722097 - RNA, 19 nt, Haemophilus influenzae Rd
cauugaugacugcaucaau

SEQ ID NO: 2722098 - RNA, 22 nt, Haemophilus influenzae Rd
cauugauugcgagucaaauuuu

SEQ ID NO: 2722099 - RNA, 19 nt, Haemophilus influenzae Rd
cauugauugcuaaauaaau

SEQ ID NO: 2722100 - RNA, 17 nt, Haemophilus influenzae Rd
cauugauugcuuuaacu

SEQ ID NO: 2722101 - RNA, 20 nt, Haemophilus influenzae Rd
cauugauugcuuuaacugaa

SEQ ID NO: 2722102 - RNA, 23 nt, Haemophilus influenzae Rd
cauugauuuguuacuaaaauaau

SEQ ID NO: 2722103 - RNA, 15 nt, Haemophilus influenzae Rd
cauugcaagugcagu

SEQ ID NO: 2722104 - RNA, 16 nt, Haemophilus influenzae Rd
cauugcaucagccacc

SEQ ID NO: 2722105 - RNA, 15 nt, Haemophilus influenzae Rd
cauugcauccacuuc

SEQ ID NO: 2722106 - RNA, 19 nt, Haemophilus influenzae Rd
cauugcauccacuucaucc

SEQ ID NO: 2722107 - RNA, 14 nt, Haemophilus influenzae Rd
cauugcauuuuuau

SEQ ID NO: 2722108 - RNA, 16 nt, Haemophilus influenzae Rd
cauugccauuucugca

SEQ ID NO: 2722109 - RNA, 21 nt, Haemophilus influenzae Rd
cauugcgccuuuuuggaaacg

SEQ ID NO: 2722110 - RNA, 13 nt, Haemophilus influenzae Rd
cauugcguuuuac

SEQ ID NO: 2722111 - RNA, 12 nt, Haemophilus influenzae Rd
cauugcuaaauu

SEQ ID NO: 2722112 - RNA, 15 nt, Haemophilus influenzae Rd
cauugcuaaauuuau

SEQ ID NO: 2722113 - RNA, 18 nt, Haemophilus influenzae Rd
cauugcuaagggcaacaa

SEQ ID NO: 2722114 - RNA, 15 nt, Haemophilus influenzae Rd
cauugcuauggcaau

SEQ ID NO: 2722115 - RNA, 21 nt, Haemophilus influenzae Rd
cauugcuauggcaaugaauaa

SEQ ID NO: 2722116 - RNA, 23 nt, Haemophilus influenzae Rd
cauugcucgauaaguaaugaaaa

SEQ ID NO: 2722117 - RNA, 19 nt, Haemophilus influenzae Rd
cauugcuuaacauuaauaa

SEQ ID NO: 2722118 - RNA, 21 nt, Haemophilus influenzae Rd
cauuggaaaaugcuuauaaaa

SEQ ID NO: 2722119 - RNA, 14 nt, Haemophilus influenzae Rd
cauuggaaugcuaa

SEQ ID NO: 2722120 - RNA, 18 nt, Haemophilus influenzae Rd
cauuggauaauugccacu

SEQ ID NO: 2722121 - RNA, 17 nt, Haemophilus influenzae Rd
cauuggauuaaucaauu

SEQ ID NO: 2722122 - RNA, 18 nt, Haemophilus influenzae Rd
cauuggauuaaucaauuu

SEQ ID NO: 2722123 - RNA, 19 nt, Haemophilus influenzae Rd
cauuggcugaauuuaauuc

SEQ ID NO: 2722124 - RNA, 19 nt, Haemophilus influenzae Rd
cauuggugaaaggaaacgc

SEQ ID NO: 2722125 - RNA, 24 nt, Haemophilus influenzae Rd
cauuguaaaccaaauuucuugcua

SEQ ID NO: 2722126 - RNA, 16 nt, Haemophilus influenzae Rd
cauuguaguuuuucac

SEQ ID NO: 2722127 - RNA, 18 nt, Haemophilus influenzae Rd
cauugucauaccccaaac

SEQ ID NO: 2722128 - RNA, 19 nt, Haemophilus influenzae Rd
cauugucauaccccaaacu

SEQ ID NO: 2722129 - RNA, 14 nt, Haemophilus influenzae Rd
cauugucuuuuacg

SEQ ID NO: 2722130 - RNA, 21 nt, Haemophilus influenzae Rd
cauugugaucggacuuuuuuc

SEQ ID NO: 2722131 - RNA, 19 nt, Haemophilus influenzae Rd
cauugugauguucuaaauc

SEQ ID NO: 2722132 - RNA, 13 nt, Haemophilus influenzae Rd
cauuguggaaacg

SEQ ID NO: 2722133 - RNA, 21 nt, Haemophilus influenzae Rd
cauuguggaaacgugcaauua

SEQ ID NO: 2722134 - RNA, 16 nt, Haemophilus influenzae Rd
cauugugggcuuuaag

SEQ ID NO: 2722135 - RNA, 20 nt, Haemophilus influenzae Rd
cauuguuaaauaaauccuua

SEQ ID NO: 2722136 - RNA, 15 nt, Haemophilus influenzae Rd
cauuguuaaauguua

SEQ ID NO: 2722137 - RNA, 16 nt, Haemophilus influenzae Rd
cauuguuaccuaauuc

SEQ ID NO: 2722138 - RNA, 20 nt, Haemophilus influenzae Rd
cauuguuucaaucacuuuau

SEQ ID NO: 2722139 - RNA, 18 nt, Haemophilus influenzae Rd
cauuguuugauccuuuau

SEQ ID NO: 2722140 - RNA, 14 nt, Haemophilus influenzae Rd
cauuuaaaacaaaa

SEQ ID NO: 2722141 - RNA, 15 nt, Haemophilus influenzae Rd
cauuuaaaaguaaaa

SEQ ID NO: 2722142 - RNA, 18 nt, Haemophilus influenzae Rd
cauuuaaaaguaaaaaua

SEQ ID NO: 2722143 - RNA, 20 nt, Haemophilus influenzae Rd
cauuuaaaaguaaaaauaaa

SEQ ID NO: 2722144 - RNA, 14 nt, Haemophilus influenzae Rd
cauuuaaaauauau

SEQ ID NO: 2722145 - RNA, 14 nt, Haemophilus influenzae Rd
cauuuaaacaccaa

SEQ ID NO: 2722146 - RNA, 16 nt, Haemophilus influenzae Rd
cauuuaaacaccaauu

SEQ ID NO: 2722147 - RNA, 11 nt, Haemophilus influenzae Rd
cauuuaaauaa

SEQ ID NO: 2722148 - RNA, 17 nt, Haemophilus influenzae Rd
cauuuaaauaaaauaac

SEQ ID NO: 2722149 - RNA, 22 nt, Haemophilus influenzae Rd
cauuuaaauaaaauaacaaaaa

SEQ ID NO: 2722150 - RNA, 22 nt, Haemophilus influenzae Rd
cauuuaacaauggcaacaaaua

SEQ ID NO: 2722151 - RNA, 22 nt, Haemophilus influenzae Rd
cauuuaaccguaauuucaaauc

SEQ ID NO: 2722152 - RNA, 23 nt, Haemophilus influenzae Rd
cauuuaacggggauuuuuuauaa

SEQ ID NO: 2722153 - RNA, 23 nt, Haemophilus influenzae Rd
cauuuaacuaacugcucuugcgc

SEQ ID NO: 2722154 - RNA, 19 nt, Haemophilus influenzae Rd
cauuuaacuuaaucuccaa

SEQ ID NO: 2722155 - RNA, 16 nt, Haemophilus influenzae Rd
cauuuaauaaaacaaa

SEQ ID NO: 2722156 - RNA, 16 nt, Haemophilus influenzae Rd
cauuuaauccugucau

SEQ ID NO: 2722157 - RNA, 19 nt, Haemophilus influenzae Rd
cauuuacggcuuagauaau

SEQ ID NO: 2722158 - RNA, 23 nt, Haemophilus influenzae Rd
cauuuacggcuuagauaauaaaa

SEQ ID NO: 2722159 - RNA, 16 nt, Haemophilus influenzae Rd
cauuuagagggauaaa

SEQ ID NO: 2722160 - RNA, 19 nt, Haemophilus influenzae Rd
cauuuagagggauaaaaau

SEQ ID NO: 2722161 - RNA, 23 nt, Haemophilus influenzae Rd
cauuuagagggauaaaaaucauc

SEQ ID NO: 2722162 - RNA, 18 nt, Haemophilus influenzae Rd
cauuuagguuagaauaaa

SEQ ID NO: 2722163 - RNA, 14 nt, Haemophilus influenzae Rd
cauuuagucaauuu

SEQ ID NO: 2722164 - RNA, 13 nt, Haemophilus influenzae Rd
cauuuauaaaaug

SEQ ID NO: 2722165 - RNA, 12 nt, Haemophilus influenzae Rd
cauuuaucuucc

SEQ ID NO: 2722166 - RNA, 16 nt, Haemophilus influenzae Rd
cauuuauggaaauaaa

SEQ ID NO: 2722167 - RNA, 17 nt, Haemophilus influenzae Rd
cauuuauggaaauaaau

SEQ ID NO: 2722168 - RNA, 19 nt, Haemophilus influenzae Rd
cauuucaagcuuugcaaca

SEQ ID NO: 2722169 - RNA, 16 nt, Haemophilus influenzae Rd
cauuucaauaucaauc

SEQ ID NO: 2722170 - RNA, 15 nt, Haemophilus influenzae Rd
cauuucaauuucacu

SEQ ID NO: 2722171 - RNA, 16 nt, Haemophilus influenzae Rd
cauuucacuaaauaaa

SEQ ID NO: 2722172 - RNA, 17 nt, Haemophilus influenzae Rd
cauuucaucuacaccaa

SEQ ID NO: 2722173 - RNA, 15 nt, Haemophilus influenzae Rd
cauuucaucugcugg

SEQ ID NO: 2722174 - RNA, 13 nt, Haemophilus influenzae Rd
cauuucauuugag

SEQ ID NO: 2722175 - RNA, 13 nt, Haemophilus influenzae Rd
cauuucccauaau

SEQ ID NO: 2722176 - RNA, 21 nt, Haemophilus influenzae Rd
cauuucccucaagacaaauuu

SEQ ID NO: 2722177 - RNA, 13 nt, Haemophilus influenzae Rd
cauuucuaaaaua

SEQ ID NO: 2722178 - RNA, 16 nt, Haemophilus influenzae Rd
cauuucuaaaauaaua

SEQ ID NO: 2722179 - RNA, 13 nt, Haemophilus influenzae Rd
cauuucuaaagga

SEQ ID NO: 2722180 - RNA, 21 nt, Haemophilus influenzae Rd
cauuucuaaaggcaauuccca

SEQ ID NO: 2722181 - RNA, 15 nt, Haemophilus influenzae Rd
cauuucuaaauaaaa

SEQ ID NO: 2722182 - RNA, 17 nt, Haemophilus influenzae Rd
cauuucuaaauaaaauu

SEQ ID NO: 2722183 - RNA, 16 nt, Haemophilus influenzae Rd
cauuucuaaugcaauu

SEQ ID NO: 2722184 - RNA, 23 nt, Haemophilus influenzae Rd
cauuucucgggcugaaauaccuu

SEQ ID NO: 2722185 - RNA, 13 nt, Haemophilus influenzae Rd
cauuucuggagaa

SEQ ID NO: 2722186 - RNA, 15 nt, Haemophilus influenzae Rd
cauuucuuauguuuu

SEQ ID NO: 2722187 - RNA, 16 nt, Haemophilus influenzae Rd
cauuucuuauguuuug

SEQ ID NO: 2722188 - RNA, 18 nt, Haemophilus influenzae Rd
cauuugaagaauuuguug

SEQ ID NO: 2722189 - RNA, 14 nt, Haemophilus influenzae Rd
cauuugaagauuaa

SEQ ID NO: 2722190 - RNA, 20 nt, Haemophilus influenzae Rd
cauuugaagauuaaauguau

SEQ ID NO: 2722191 - RNA, 19 nt, Haemophilus influenzae Rd
cauuugaauuuuacuucuu

SEQ ID NO: 2722192 - RNA, 23 nt, Haemophilus influenzae Rd
cauuugaauuuuacuucuucagg

SEQ ID NO: 2722193 - RNA, 15 nt, Haemophilus influenzae Rd
cauuugagaugaaaa

SEQ ID NO: 2722194 - RNA, 15 nt, Haemophilus influenzae Rd
cauuugauacagcca

SEQ ID NO: 2722195 - RNA, 12 nt, Haemophilus influenzae Rd
cauuugauucac

SEQ ID NO: 2722196 - RNA, 13 nt, Haemophilus influenzae Rd
cauuugcacccgc

SEQ ID NO: 2722197 - RNA, 13 nt, Haemophilus influenzae Rd
cauuugcauaaag

SEQ ID NO: 2722198 - RNA, 16 nt, Haemophilus influenzae Rd
cauuugcauaaagcau

SEQ ID NO: 2722199 - RNA, 14 nt, Haemophilus influenzae Rd
cauuugcauauuuu

SEQ ID NO: 2722200 - RNA, 15 nt, Haemophilus influenzae Rd
cauuugcaucauuua

SEQ ID NO: 2722201 - RNA, 16 nt, Haemophilus influenzae Rd
cauuugcgccaauaau

SEQ ID NO: 2722202 - RNA, 18 nt, Haemophilus influenzae Rd
cauuugcgccaauaauaa

SEQ ID NO: 2722203 - RNA, 14 nt, Haemophilus influenzae Rd
cauuugcucaauac

SEQ ID NO: 2722204 - RNA, 23 nt, Haemophilus influenzae Rd
cauuugcuucgccuucagcaauu

SEQ ID NO: 2722205 - RNA, 20 nt, Haemophilus influenzae Rd
cauuugcuucuaauuuuaaa

SEQ ID NO: 2722206 - RNA, 21 nt, Haemophilus influenzae Rd
cauuugcuucuaauuuuaaaa

SEQ ID NO: 2722207 - RNA, 18 nt, Haemophilus influenzae Rd
cauuuggaucuaaaaaau

SEQ ID NO: 2722208 - RNA, 14 nt, Haemophilus influenzae Rd
cauuuggcaaaaua

SEQ ID NO: 2722209 - RNA, 20 nt, Haemophilus influenzae Rd
cauuuggcauuuuguaagca

SEQ ID NO: 2722210 - RNA, 17 nt, Haemophilus influenzae Rd
cauuugguggcuuuuuu

SEQ ID NO: 2722211 - RNA, 19 nt, Haemophilus influenzae Rd
cauuugguuagaucagaaa

SEQ ID NO: 2722212 - RNA, 21 nt, Haemophilus influenzae Rd
cauuuguuagaaauacauuau

SEQ ID NO: 2722213 - RNA, 21 nt, Haemophilus influenzae Rd
cauuuguuagaucaguuuuac

SEQ ID NO: 2722214 - RNA, 22 nt, Haemophilus influenzae Rd
cauuuguuggcggaauuaugua

SEQ ID NO: 2722215 - RNA, 17 nt, Haemophilus influenzae Rd
cauuuguugguaaaucu

SEQ ID NO: 2722216 - RNA, 19 nt, Haemophilus influenzae Rd
cauuuguugguaaaucuaa

SEQ ID NO: 2722217 - RNA, 21 nt, Haemophilus influenzae Rd
cauuuguugguaaaucuaaca

SEQ ID NO: 2722218 - RNA, 20 nt, Haemophilus influenzae Rd
cauuuguuuuccguauuuuc

SEQ ID NO: 2722219 - RNA, 15 nt, Haemophilus influenzae Rd
cauuuuaaauuauuu

SEQ ID NO: 2722220 - RNA, 16 nt, Haemophilus influenzae Rd
cauuuuaaauuauuuu

SEQ ID NO: 2722221 - RNA, 22 nt, Haemophilus influenzae Rd
cauuuuaacucagggaaaugua

SEQ ID NO: 2722222 - RNA, 17 nt, Haemophilus influenzae Rd
cauuuuaaucauaaaaa

SEQ ID NO: 2722223 - RNA, 15 nt, Haemophilus influenzae Rd
cauuuuaucacaagu

SEQ ID NO: 2722224 - RNA, 22 nt, Haemophilus influenzae Rd
cauuuucaaauuguccuuugcc

SEQ ID NO: 2722225 - RNA, 15 nt, Haemophilus influenzae Rd
cauuuucaagccacc

SEQ ID NO: 2722226 - RNA, 22 nt, Haemophilus influenzae Rd
cauuuucaagcccuuccaucuu

SEQ ID NO: 2722227 - RNA, 16 nt, Haemophilus influenzae Rd
cauuuucacugauaua

SEQ ID NO: 2722228 - RNA, 19 nt, Haemophilus influenzae Rd
cauuuuccauuggugaaau

SEQ ID NO: 2722229 - RNA, 22 nt, Haemophilus influenzae Rd
cauuuucgcauagcgaucugcu

SEQ ID NO: 2722230 - RNA, 16 nt, Haemophilus influenzae Rd
cauuuucucugcgauu

SEQ ID NO: 2722231 - RNA, 15 nt, Haemophilus influenzae Rd
cauuuucuugaacug

SEQ ID NO: 2722232 - RNA, 16 nt, Haemophilus influenzae Rd
cauuuugaacaagguu

SEQ ID NO: 2722233 - RNA, 20 nt, Haemophilus influenzae Rd
cauuuugaaugguuguucug

SEQ ID NO: 2722234 - RNA, 18 nt, Haemophilus influenzae Rd
cauuuugagauaaauuuu

SEQ ID NO: 2722235 - RNA, 18 nt, Haemophilus influenzae Rd
cauuuugaggaauaaauu

SEQ ID NO: 2722236 - RNA, 20 nt, Haemophilus influenzae Rd
cauuuugauugcuacagcaa

SEQ ID NO: 2722237 - RNA, 12 nt, Haemophilus influenzae Rd
cauuuuggaaug

SEQ ID NO: 2722238 - RNA, 21 nt, Haemophilus influenzae Rd
cauuuuggaaugguugcaaag

SEQ ID NO: 2722239 - RNA, 20 nt, Haemophilus influenzae Rd
cauuuuggauacguuuuguu

SEQ ID NO: 2722240 - RNA, 14 nt, Haemophilus influenzae Rd
cauuuuuaaaaaua

SEQ ID NO: 2722241 - RNA, 19 nt, Haemophilus influenzae Rd
cauuuuuaaaaauaacaua

SEQ ID NO: 2722242 - RNA, 18 nt, Haemophilus influenzae Rd
cauuuuuaauuuuuagaa

SEQ ID NO: 2722243 - RNA, 14 nt, Haemophilus influenzae Rd
cauuuuuauuagua

SEQ ID NO: 2722244 - RNA, 19 nt, Haemophilus influenzae Rd
cauuuuuauuaguaaaaua

SEQ ID NO: 2722245 - RNA, 16 nt, Haemophilus influenzae Rd
cauuuuucaaaauuuu

SEQ ID NO: 2722246 - RNA, 23 nt, Haemophilus influenzae Rd
cauuuuucagcaagcauuuugaa

SEQ ID NO: 2722247 - RNA, 20 nt, Haemophilus influenzae Rd
cauuuuucauacaaucucua

SEQ ID NO: 2722248 - RNA, 15 nt, Haemophilus influenzae Rd
cauuuuucauuuucg

SEQ ID NO: 2722249 - RNA, 21 nt, Haemophilus influenzae Rd
cauuuuucgugaggucugcaa

SEQ ID NO: 2722250 - RNA, 21 nt, Haemophilus influenzae Rd
cauuuuugcuggcguuuuuua

SEQ ID NO: 2722251 - RNA, 18 nt, Haemophilus influenzae Rd
cauuuuuuauaaauggcu

SEQ ID NO: 2722252 - RNA, 18 nt, Haemophilus influenzae Rd
cauuuuuuauaaugucau

SEQ ID NO: 2722253 - RNA, 15 nt, Haemophilus influenzae Rd
cauuuuuuauuuuuu

SEQ ID NO: 2722254 - RNA, 21 nt, Haemophilus influenzae Rd
cauuuuuuauuuuuucuaaaa

SEQ ID NO: 2722255 - RNA, 22 nt, Haemophilus influenzae Rd
cauuuuuucuacgguuuuaaua

SEQ ID NO: 2722256 - RNA, 22 nt, Haemophilus influenzae Rd
cauuuuuuggaguuguuuaaaa

SEQ ID NO: 2722257 - RNA, 13 nt, Haemophilus influenzae Rd
cauuuuuuuaaau

SEQ ID NO: 2722258 - RNA, 17 nt, Haemophilus influenzae Rd
cauuuuuuuaaauauuu

SEQ ID NO: 2722259 - RNA, 12 nt, Haemophilus influenzae Rd
cauuuuuuucua

SEQ ID NO: 2722260 - RNA, 23 nt, Haemophilus influenzae Rd
ccaaaaaagcguugaaaauaaau

SEQ ID NO: 2722261 - RNA, 16 nt, Haemophilus influenzae Rd
ccaaaaauccucaucu

SEQ ID NO: 2722262 - RNA, 21 nt, Haemophilus influenzae Rd
ccaaaacaguaaugaaagaaa

SEQ ID NO: 2722263 - RNA, 22 nt, Haemophilus influenzae Rd
ccaaaaccuagaaauuuuggcu

SEQ ID NO: 2722264 - RNA, 16 nt, Haemophilus influenzae Rd
ccaaaacgaauagaaa

SEQ ID NO: 2722265 - RNA, 17 nt, Haemophilus influenzae Rd
ccaaaacgaauagaaau

SEQ ID NO: 2722266 - RNA, 14 nt, Haemophilus influenzae Rd
ccaaaagauucaac

SEQ ID NO: 2722267 - RNA, 23 nt, Haemophilus influenzae Rd
ccaaaaguuggauuaaacaacca

SEQ ID NO: 2722268 - RNA, 14 nt, Haemophilus influenzae Rd
ccaaaauauuucau

SEQ ID NO: 2722269 - RNA, 17 nt, Haemophilus influenzae Rd
ccaaaauauuucauuug

SEQ ID NO: 2722270 - RNA, 13 nt, Haemophilus influenzae Rd
ccaaaauauuuuc

SEQ ID NO: 2722271 - RNA, 22 nt, Haemophilus influenzae Rd
ccaaaaucacgccagauaaaau

SEQ ID NO: 2722272 - RNA, 23 nt, Haemophilus influenzae Rd
ccaaaaucucuaccacagucaaa

SEQ ID NO: 2722273 - RNA, 17 nt, Haemophilus influenzae Rd
ccaaaaugcuugaauaa

SEQ ID NO: 2722274 - RNA, 19 nt, Haemophilus influenzae Rd
ccaaaaugcuugaauaaau

SEQ ID NO: 2722275 - RNA, 13 nt, Haemophilus influenzae Rd
ccaaaauuaaauu

SEQ ID NO: 2722276 - RNA, 23 nt, Haemophilus influenzae Rd
ccaaaauuaaauugaaaaaaucu

SEQ ID NO: 2722277 - RNA, 19 nt, Haemophilus influenzae Rd
ccaaaauuacuuuucgaua

SEQ ID NO: 2722278 - RNA, 16 nt, Haemophilus influenzae Rd
ccaaaauucuguguuu

SEQ ID NO: 2722279 - RNA, 23 nt, Haemophilus influenzae Rd
ccaaacaaauugccgaagccauc

SEQ ID NO: 2722280 - RNA, 16 nt, Haemophilus influenzae Rd
ccaaacauuaccaagc

SEQ ID NO: 2722281 - RNA, 19 nt, Haemophilus influenzae Rd
ccaaacauuaccaagccca

SEQ ID NO: 2722282 - RNA, 13 nt, Haemophilus influenzae Rd
ccaaacauuuuua

SEQ ID NO: 2722283 - RNA, 18 nt, Haemophilus influenzae Rd
ccaaacgguauuucaauu

SEQ ID NO: 2722284 - RNA, 18 nt, Haemophilus influenzae Rd
ccaaacuccccuuaacua

SEQ ID NO: 2722285 - RNA, 16 nt, Haemophilus influenzae Rd
ccaaacuuggaucaua

SEQ ID NO: 2722286 - RNA, 17 nt, Haemophilus influenzae Rd
ccaaagaagcuuuccau

SEQ ID NO: 2722287 - RNA, 20 nt, Haemophilus influenzae Rd
ccaaagaaucaucuucaucu

SEQ ID NO: 2722288 - RNA, 15 nt, Haemophilus influenzae Rd
ccaaagacuaaaacc

SEQ ID NO: 2722289 - RNA, 22 nt, Haemophilus influenzae Rd
ccaaagaguuugaauaauugau

SEQ ID NO: 2722290 - RNA, 21 nt, Haemophilus influenzae Rd
ccaaagcaauccaagggaaau

SEQ ID NO: 2722291 - RNA, 22 nt, Haemophilus influenzae Rd
ccaaagcauuuagagcaagcaa

SEQ ID NO: 2722292 - RNA, 22 nt, Haemophilus influenzae Rd
ccaaagccaaugccaaaaccau

SEQ ID NO: 2722293 - RNA, 13 nt, Haemophilus influenzae Rd
ccaaagcuauuca

SEQ ID NO: 2722294 - RNA, 16 nt, Haemophilus influenzae Rd
ccaaaggcuuucgcaa

SEQ ID NO: 2722295 - RNA, 13 nt, Haemophilus influenzae Rd
ccaaauaauacau

SEQ ID NO: 2722296 - RNA, 21 nt, Haemophilus influenzae Rd
ccaaauaauacuugaccaaaa

SEQ ID NO: 2722297 - RNA, 22 nt, Haemophilus influenzae Rd
ccaaauaauacuugaccaaaau

SEQ ID NO: 2722298 - RNA, 13 nt, Haemophilus influenzae Rd
ccaaauaaugcau

SEQ ID NO: 2722299 - RNA, 15 nt, Haemophilus influenzae Rd
ccaaaucucaaaauc

SEQ ID NO: 2722300 - RNA, 17 nt, Haemophilus influenzae Rd
ccaaaugaugaaacaag

SEQ ID NO: 2722301 - RNA, 22 nt, Haemophilus influenzae Rd
ccaaaugcacauaacaaaaugg

SEQ ID NO: 2722302 - RNA, 13 nt, Haemophilus influenzae Rd
ccaaauuaaaaau

SEQ ID NO: 2722303 - RNA, 20 nt, Haemophilus influenzae Rd
ccaaauuacuuggggcuaau

SEQ ID NO: 2722304 - RNA, 15 nt, Haemophilus influenzae Rd
ccaaauucauuuuuu

SEQ ID NO: 2722305 - RNA, 22 nt, Haemophilus influenzae Rd
ccaaauuccgcaauauuuaaau

SEQ ID NO: 2722306 - RNA, 23 nt, Haemophilus influenzae Rd
ccaaauucuuuaaauucaauaaa

SEQ ID NO: 2722307 - RNA, 12 nt, Haemophilus influenzae Rd
ccaaauuuuucu

SEQ ID NO: 2722308 - RNA, 16 nt, Haemophilus influenzae Rd
ccaacaaaauaaacac

SEQ ID NO: 2722309 - RNA, 15 nt, Haemophilus influenzae Rd
ccaacaaauuuaaau

SEQ ID NO: 2722310 - RNA, 17 nt, Haemophilus influenzae Rd
ccaacaaauuuaaauga

SEQ ID NO: 2722311 - RNA, 11 nt, Haemophilus influenzae Rd
ccaacaacugc

SEQ ID NO: 2722312 - RNA, 14 nt, Haemophilus influenzae Rd
ccaacaacugcaca

SEQ ID NO: 2722313 - RNA, 20 nt, Haemophilus influenzae Rd
ccaacaacuuauuuggaaca

SEQ ID NO: 2722314 - RNA, 11 nt, Haemophilus influenzae Rd
ccaacaauauc

SEQ ID NO: 2722315 - RNA, 12 nt, Haemophilus influenzae Rd
ccaacagaaaau

SEQ ID NO: 2722316 - RNA, 13 nt, Haemophilus influenzae Rd
ccaacagaaaauu

SEQ ID NO: 2722317 - RNA, 20 nt, Haemophilus influenzae Rd
ccaacagaaaauuugagccc

SEQ ID NO: 2722318 - RNA, 17 nt, Haemophilus influenzae Rd
ccaacagaaaucauuuc

SEQ ID NO: 2722319 - RNA, 15 nt, Haemophilus influenzae Rd
ccaacagagcgagau

SEQ ID NO: 2722320 - RNA, 21 nt, Haemophilus influenzae Rd
ccaacauuucacuaaauaaau

SEQ ID NO: 2722321 - RNA, 11 nt, Haemophilus influenzae Rd
ccaaccaauca

SEQ ID NO: 2722322 - RNA, 19 nt, Haemophilus influenzae Rd
ccaaccgccugcauagaau

SEQ ID NO: 2722323 - RNA, 15 nt, Haemophilus influenzae Rd
ccaaccuacauuaau

SEQ ID NO: 2722324 - RNA, 15 nt, Haemophilus influenzae Rd
ccaacgcaucuauug

SEQ ID NO: 2722325 - RNA, 18 nt, Haemophilus influenzae Rd
ccaacgggccaguuugaa

SEQ ID NO: 2722326 - RNA, 17 nt, Haemophilus influenzae Rd
ccaacguauuuauacca

SEQ ID NO: 2722327 - RNA, 17 nt, Haemophilus influenzae Rd
ccaacuaacauacccau

SEQ ID NO: 2722328 - RNA, 23 nt, Haemophilus influenzae Rd
ccaacuaaggugcagauuuuuua

SEQ ID NO: 2722329 - RNA, 19 nt, Haemophilus influenzae Rd
ccaacugcaacagcugcac

SEQ ID NO: 2722330 - RNA, 17 nt, Haemophilus influenzae Rd
ccaacuugaauaccuga

SEQ ID NO: 2722331 - RNA, 20 nt, Haemophilus influenzae Rd
ccaagaaaagugcgaugaca

SEQ ID NO: 2722332 - RNA, 21 nt, Haemophilus influenzae Rd
ccaagaaagucauuaaugcau

SEQ ID NO: 2722333 - RNA, 15 nt, Haemophilus influenzae Rd
ccaagaauaaaaugu

SEQ ID NO: 2722334 - RNA, 23 nt, Haemophilus influenzae Rd
ccaagaggcucugaucacaauga

SEQ ID NO: 2722335 - RNA, 13 nt, Haemophilus influenzae Rd
ccaagauucuaaa

SEQ ID NO: 2722336 - RNA, 23 nt, Haemophilus influenzae Rd
ccaagcagccaaugcaacuugca

SEQ ID NO: 2722337 - RNA, 15 nt, Haemophilus influenzae Rd
ccaagccaauuauuu

SEQ ID NO: 2722338 - RNA, 15 nt, Haemophilus influenzae Rd
ccaagcguaaaagua

SEQ ID NO: 2722339 - RNA, 18 nt, Haemophilus influenzae Rd
ccaagcguuaauccaagg

SEQ ID NO: 2722340 - RNA, 15 nt, Haemophilus influenzae Rd
ccaagcuguaccagc

SEQ ID NO: 2722341 - RNA, 23 nt, Haemophilus influenzae Rd
ccaagcuuuuucuuguucugccg

SEQ ID NO: 2722342 - RNA, 16 nt, Haemophilus influenzae Rd
ccaagguuauuuagcc

SEQ ID NO: 2722343 - RNA, 19 nt, Haemophilus influenzae Rd
ccaagguugcucaauccaa

SEQ ID NO: 2722344 - RNA, 12 nt, Haemophilus influenzae Rd
ccaagugcauga

SEQ ID NO: 2722345 - RNA, 12 nt, Haemophilus influenzae Rd
ccaagugcuuua

SEQ ID NO: 2722346 - RNA, 14 nt, Haemophilus influenzae Rd
ccaagugcuuuacc

SEQ ID NO: 2722347 - RNA, 19 nt, Haemophilus influenzae Rd
ccaaguuuguuuuuuacga

SEQ ID NO: 2722348 - RNA, 23 nt, Haemophilus influenzae Rd
ccaaguuuucacuucguuguggc

SEQ ID NO: 2722349 - RNA, 20 nt, Haemophilus influenzae Rd
ccaaguuuuuuaucuuuuuc

SEQ ID NO: 2722350 - RNA, 17 nt, Haemophilus influenzae Rd
ccaauaaaaagauaacu

SEQ ID NO: 2722351 - RNA, 15 nt, Haemophilus influenzae Rd
ccaauaaaacaguua

SEQ ID NO: 2722352 - RNA, 20 nt, Haemophilus influenzae Rd
ccaauaauccuuuuuuugaa

SEQ ID NO: 2722353 - RNA, 22 nt, Haemophilus influenzae Rd
ccaauaaucuccccguccaaag

SEQ ID NO: 2722354 - RNA, 18 nt, Haemophilus influenzae Rd
ccaauaauuaaacuuuca

SEQ ID NO: 2722355 - RNA, 14 nt, Haemophilus influenzae Rd
ccaauaauucuuua

SEQ ID NO: 2722356 - RNA, 14 nt, Haemophilus influenzae Rd
ccaauacagccgcu

SEQ ID NO: 2722357 - RNA, 14 nt, Haemophilus influenzae Rd
ccaauaccaauaau

SEQ ID NO: 2722358 - RNA, 12 nt, Haemophilus influenzae Rd
ccaauagauuac

SEQ ID NO: 2722359 - RNA, 17 nt, Haemophilus influenzae Rd
ccaauauagcgagauac

SEQ ID NO: 2722360 - RNA, 20 nt, Haemophilus influenzae Rd
ccaauaugaacauuaugugc

SEQ ID NO: 2722361 - RNA, 21 nt, Haemophilus influenzae Rd
ccaauauucuuuaaaacauuc

SEQ ID NO: 2722362 - RNA, 16 nt, Haemophilus influenzae Rd
ccaauauugaaaagua

SEQ ID NO: 2722363 - RNA, 13 nt, Haemophilus influenzae Rd
ccaauauuuuuca

SEQ ID NO: 2722364 - RNA, 14 nt, Haemophilus influenzae Rd
ccaauauuuuucau

SEQ ID NO: 2722365 - RNA, 15 nt, Haemophilus influenzae Rd
ccaaucaagauaacu

SEQ ID NO: 2722366 - RNA, 21 nt, Haemophilus influenzae Rd
ccaaucacuagccauaaauaa

SEQ ID NO: 2722367 - RNA, 23 nt, Haemophilus influenzae Rd
ccaaucacuagccauaaauaaau

SEQ ID NO: 2722368 - RNA, 13 nt, Haemophilus influenzae Rd
ccaaucauaaaau

SEQ ID NO: 2722369 - RNA, 14 nt, Haemophilus influenzae Rd
ccaaucaucagaau

SEQ ID NO: 2722370 - RNA, 19 nt, Haemophilus influenzae Rd
ccaaucaucagaauaauua

SEQ ID NO: 2722371 - RNA, 12 nt, Haemophilus influenzae Rd
ccaaucaucauc

SEQ ID NO: 2722372 - RNA, 15 nt, Haemophilus influenzae Rd
ccaauccauuuuuaa

SEQ ID NO: 2722373 - RNA, 18 nt, Haemophilus influenzae Rd
ccaaucccucaaauacac

SEQ ID NO: 2722374 - RNA, 19 nt, Haemophilus influenzae Rd
ccaauccgcuuguuaauac

SEQ ID NO: 2722375 - RNA, 18 nt, Haemophilus influenzae Rd
ccaaucuaaacacacucu

SEQ ID NO: 2722376 - RNA, 16 nt, Haemophilus influenzae Rd
ccaaucuaauucuucc

SEQ ID NO: 2722377 - RNA, 23 nt, Haemophilus influenzae Rd
ccaaucuccguugggauuuuuua

SEQ ID NO: 2722378 - RNA, 16 nt, Haemophilus influenzae Rd
ccaaugcaacaggaau

SEQ ID NO: 2722379 - RNA, 15 nt, Haemophilus influenzae Rd
ccaaugcaacuugca

SEQ ID NO: 2722380 - RNA, 20 nt, Haemophilus influenzae Rd
ccaaugcaauuggcaauauu

SEQ ID NO: 2722381 - RNA, 23 nt, Haemophilus influenzae Rd
ccaaugccuugugcauaaacaaa

SEQ ID NO: 2722382 - RNA, 21 nt, Haemophilus influenzae Rd
ccaauguuugguauaaauaau

SEQ ID NO: 2722383 - RNA, 17 nt, Haemophilus influenzae Rd
ccaauuaaggauuuauu

SEQ ID NO: 2722384 - RNA, 19 nt, Haemophilus influenzae Rd
ccaauuaauucucccucaa

SEQ ID NO: 2722385 - RNA, 17 nt, Haemophilus influenzae Rd
ccaauuaccugaugaaa

SEQ ID NO: 2722386 - RNA, 20 nt, Haemophilus influenzae Rd
ccaauuagaugauuuuaaaa

SEQ ID NO: 2722387 - RNA, 20 nt, Haemophilus influenzae Rd
ccaauuagaugauuuuaaag

SEQ ID NO: 2722388 - RNA, 21 nt, Haemophilus influenzae Rd
ccaauuagaugauuuuaaagu

SEQ ID NO: 2722389 - RNA, 18 nt, Haemophilus influenzae Rd
ccaauuagauuacgcuuu

SEQ ID NO: 2722390 - RNA, 22 nt, Haemophilus influenzae Rd
ccaauuagcugguuuauuuauu

SEQ ID NO: 2722391 - RNA, 22 nt, Haemophilus influenzae Rd
ccaauuauccgagagaaaguua

SEQ ID NO: 2722392 - RNA, 12 nt, Haemophilus influenzae Rd
ccaauuauugga

SEQ ID NO: 2722393 - RNA, 19 nt, Haemophilus influenzae Rd
ccaauuauuggcaauuucc

SEQ ID NO: 2722394 - RNA, 22 nt, Haemophilus influenzae Rd
ccaauucaaagauuuuaaaauu

SEQ ID NO: 2722395 - RNA, 20 nt, Haemophilus influenzae Rd
ccaauucuaguucuuccccu

SEQ ID NO: 2722396 - RNA, 15 nt, Haemophilus influenzae Rd
ccaauucucugcauc

SEQ ID NO: 2722397 - RNA, 16 nt, Haemophilus influenzae Rd
ccaauucucugcaucg

SEQ ID NO: 2722398 - RNA, 16 nt, Haemophilus influenzae Rd
ccaauucuucagauuu

SEQ ID NO: 2722399 - RNA, 17 nt, Haemophilus influenzae Rd
ccaauucuuuuaaaugu

SEQ ID NO: 2722400 - RNA, 13 nt, Haemophilus influenzae Rd
ccaauugcaacuu

SEQ ID NO: 2722401 - RNA, 18 nt, Haemophilus influenzae Rd
ccaauugguaaaauuucu

SEQ ID NO: 2722402 - RNA, 20 nt, Haemophilus influenzae Rd
ccaauuucaucccaauuauu

SEQ ID NO: 2722403 - RNA, 13 nt, Haemophilus influenzae Rd
ccaauuuguacca

SEQ ID NO: 2722404 - RNA, 15 nt, Haemophilus influenzae Rd
ccaauuuuggaucgg

SEQ ID NO: 2722405 - RNA, 15 nt, Haemophilus influenzae Rd
ccaauuuuucaaaac

SEQ ID NO: 2722406 - RNA, 18 nt, Haemophilus influenzae Rd
ccaauuuuucaaaacguu

SEQ ID NO: 2722407 - RNA, 21 nt, Haemophilus influenzae Rd
ccaauuuuuucugaauaaauu

SEQ ID NO: 2722408 - RNA, 9 nt, Haemophilus influenzae Rd
ccacaaaca

SEQ ID NO: 2722409 - RNA, 21 nt, Haemophilus influenzae Rd
ccacaaacuuaccgaucauuu

SEQ ID NO: 2722410 - RNA, 20 nt, Haemophilus influenzae Rd
ccacaacugaagcuucuuca

SEQ ID NO: 2722411 - RNA, 15 nt, Haemophilus influenzae Rd
ccacaacuuuuucau

SEQ ID NO: 2722412 - RNA, 15 nt, Haemophilus influenzae Rd
ccacaagauuacgug

SEQ ID NO: 2722413 - RNA, 15 nt, Haemophilus influenzae Rd
ccacaagcaacaaua

SEQ ID NO: 2722414 - RNA, 21 nt, Haemophilus influenzae Rd
ccacaagcaacaauauuagga

SEQ ID NO: 2722415 - RNA, 16 nt, Haemophilus influenzae Rd
ccacaauaaaauaaua

SEQ ID NO: 2722416 - RNA, 17 nt, Haemophilus influenzae Rd
ccacacgguauaaucag

SEQ ID NO: 2722417 - RNA, 18 nt, Haemophilus influenzae Rd
ccacacuucaucacuaaa

SEQ ID NO: 2722418 - RNA, 15 nt, Haemophilus influenzae Rd
ccacagcaaaagaaa

SEQ ID NO: 2722419 - RNA, 20 nt, Haemophilus influenzae Rd
ccacagguaaagaaccacaa

SEQ ID NO: 2722420 - RNA, 18 nt, Haemophilus influenzae Rd
ccacagguuucucuagcc

SEQ ID NO: 2722421 - RNA, 18 nt, Haemophilus influenzae Rd
ccacagucaaauugugau

SEQ ID NO: 2722422 - RNA, 15 nt, Haemophilus influenzae Rd
ccacauaaccaaagg

SEQ ID NO: 2722423 - RNA, 23 nt, Haemophilus influenzae Rd
ccacauaauaagaaaguaauugc

SEQ ID NO: 2722424 - RNA, 15 nt, Haemophilus influenzae Rd
ccacauagcuugaau

SEQ ID NO: 2722425 - RNA, 21 nt, Haemophilus influenzae Rd
ccacauauagugaaaaaauaa

SEQ ID NO: 2722426 - RNA, 14 nt, Haemophilus influenzae Rd
ccacaugaauuucu

SEQ ID NO: 2722427 - RNA, 14 nt, Haemophilus influenzae Rd
ccacaugauauauu

SEQ ID NO: 2722428 - RNA, 15 nt, Haemophilus influenzae Rd
ccacaugauauauuu

SEQ ID NO: 2722429 - RNA, 19 nt, Haemophilus influenzae Rd
ccacauuucccuuagauuu

SEQ ID NO: 2722430 - RNA, 18 nt, Haemophilus influenzae Rd
ccacauuuggaaauguuu

SEQ ID NO: 2722431 - RNA, 19 nt, Haemophilus influenzae Rd
ccacauuuuuuguaauucg

SEQ ID NO: 2722432 - RNA, 12 nt, Haemophilus influenzae Rd
ccaccaaaacca

SEQ ID NO: 2722433 - RNA, 22 nt, Haemophilus influenzae Rd
ccaccaaaugcacauaacaaaa

SEQ ID NO: 2722434 - RNA, 15 nt, Haemophilus influenzae Rd
ccaccacccuucuuu

SEQ ID NO: 2722435 - RNA, 23 nt, Haemophilus influenzae Rd
ccacccauuucaccacuucaucc

SEQ ID NO: 2722436 - RNA, 20 nt, Haemophilus influenzae Rd
ccaccccauuucuugaccuu

SEQ ID NO: 2722437 - RNA, 22 nt, Haemophilus influenzae Rd
ccacccuucuuucaaauucccu

SEQ ID NO: 2722438 - RNA, 14 nt, Haemophilus influenzae Rd
ccaccgauaaacac

SEQ ID NO: 2722439 - RNA, 16 nt, Haemophilus influenzae Rd
ccaccguucuauauuu

SEQ ID NO: 2722440 - RNA, 15 nt, Haemophilus influenzae Rd
ccaccugaugcuuua

SEQ ID NO: 2722441 - RNA, 18 nt, Haemophilus influenzae Rd
ccaccuugauugagaugc

SEQ ID NO: 2722442 - RNA, 17 nt, Haemophilus influenzae Rd
ccacgaggucaaucuuu

SEQ ID NO: 2722443 - RNA, 21 nt, Haemophilus influenzae Rd
ccacgauacggcaaauuaaau

SEQ ID NO: 2722444 - RNA, 23 nt, Haemophilus influenzae Rd
ccacgccuguggcaaaaucucug

SEQ ID NO: 2722445 - RNA, 16 nt, Haemophilus influenzae Rd
ccacggcuugccaauu

SEQ ID NO: 2722446 - RNA, 13 nt, Haemophilus influenzae Rd
ccacguucauuuc

SEQ ID NO: 2722447 - RNA, 16 nt, Haemophilus influenzae Rd
ccacuaaaaacaagug

SEQ ID NO: 2722448 - RNA, 15 nt, Haemophilus influenzae Rd
ccacuaaaccauuuu

SEQ ID NO: 2722449 - RNA, 15 nt, Haemophilus influenzae Rd
ccacuacguguagaa

SEQ ID NO: 2722450 - RNA, 19 nt, Haemophilus influenzae Rd
ccacuacugcaucugcauu

SEQ ID NO: 2722451 - RNA, 15 nt, Haemophilus influenzae Rd
ccacuccccaaaaac

SEQ ID NO: 2722452 - RNA, 18 nt, Haemophilus influenzae Rd
ccacugugcauuaaauca

SEQ ID NO: 2722453 - RNA, 23 nt, Haemophilus influenzae Rd
ccacuguugugaaguuuuuuaag

SEQ ID NO: 2722454 - RNA, 23 nt, Haemophilus influenzae Rd
ccacuuaacgaaccaucagcucc

SEQ ID NO: 2722455 - RNA, 20 nt, Haemophilus influenzae Rd
ccacuucugaauccaaugca

SEQ ID NO: 2722456 - RNA, 13 nt, Haemophilus influenzae Rd
ccacuucugcacc

SEQ ID NO: 2722457 - RNA, 19 nt, Haemophilus influenzae Rd
ccacuucuuccgcugucca

SEQ ID NO: 2722458 - RNA, 20 nt, Haemophilus influenzae Rd
ccacuucuucuuuaaacacc

SEQ ID NO: 2722459 - RNA, 19 nt, Haemophilus influenzae Rd
ccacuucuugcgugcgaau

SEQ ID NO: 2722460 - RNA, 18 nt, Haemophilus influenzae Rd
ccacuuggugaucaccga

SEQ ID NO: 2722461 - RNA, 14 nt, Haemophilus influenzae Rd
ccacuugugcauca

SEQ ID NO: 2722462 - RNA, 20 nt, Haemophilus influenzae Rd
ccacuugugcaucaaagcgu

SEQ ID NO: 2722463 - RNA, 22 nt, Haemophilus influenzae Rd
ccacuuuugguggauuauaaac

SEQ ID NO: 2722464 - RNA, 12 nt, Haemophilus influenzae Rd
ccacuuuuucau

SEQ ID NO: 2722465 - RNA, 14 nt, Haemophilus influenzae Rd
ccacuuuuuucacg

SEQ ID NO: 2722466 - RNA, 17 nt, Haemophilus influenzae Rd
ccagaaaauugcaccuu

SEQ ID NO: 2722467 - RNA, 21 nt, Haemophilus influenzae Rd
ccagaaaauugcaccuucuuu

SEQ ID NO: 2722468 - RNA, 17 nt, Haemophilus influenzae Rd
ccagaaauagaguuaag

SEQ ID NO: 2722469 - RNA, 13 nt, Haemophilus influenzae Rd
ccagaaaugcuua

SEQ ID NO: 2722470 - RNA, 19 nt, Haemophilus influenzae Rd
ccagaacauauaacccaua

SEQ ID NO: 2722471 - RNA, 15 nt, Haemophilus influenzae Rd
ccagaagcccguugc

SEQ ID NO: 2722472 - RNA, 24 nt, Haemophilus influenzae Rd
ccagaccuaagguuaauuuuugau

SEQ ID NO: 2722473 - RNA, 19 nt, Haemophilus influenzae Rd
ccagacgguggauuaauug

SEQ ID NO: 2722474 - RNA, 16 nt, Haemophilus influenzae Rd
ccagagaaaucaucaa

SEQ ID NO: 2722475 - RNA, 17 nt, Haemophilus influenzae Rd
ccagagccaaauacaau

SEQ ID NO: 2722476 - RNA, 19 nt, Haemophilus influenzae Rd
ccagauaagguauguacca

SEQ ID NO: 2722477 - RNA, 12 nt, Haemophilus influenzae Rd
ccagcaaguuca

SEQ ID NO: 2722478 - RNA, 18 nt, Haemophilus influenzae Rd
ccagcaaguucauauaaa

SEQ ID NO: 2722479 - RNA, 15 nt, Haemophilus influenzae Rd
ccagcaauaccacag

SEQ ID NO: 2722480 - RNA, 16 nt, Haemophilus influenzae Rd
ccagcaccacguucau

SEQ ID NO: 2722481 - RNA, 16 nt, Haemophilus influenzae Rd
ccagcagaaaauaacg

SEQ ID NO: 2722482 - RNA, 19 nt, Haemophilus influenzae Rd
ccagcagugacguuuauuu

SEQ ID NO: 2722483 - RNA, 22 nt, Haemophilus influenzae Rd
ccagcagugacguuuauuuuua

SEQ ID NO: 2722484 - RNA, 13 nt, Haemophilus influenzae Rd
ccagcgcaccaca

SEQ ID NO: 2722485 - RNA, 17 nt, Haemophilus influenzae Rd
ccagcgcuugcaccaau

SEQ ID NO: 2722486 - RNA, 18 nt, Haemophilus influenzae Rd
ccagcguaaaaaugcugu

SEQ ID NO: 2722487 - RNA, 20 nt, Haemophilus influenzae Rd
ccagcuacauucaucaaaac

SEQ ID NO: 2722488 - RNA, 19 nt, Haemophilus influenzae Rd
ccagcuggaaauuccacuu

SEQ ID NO: 2722489 - RNA, 14 nt, Haemophilus influenzae Rd
ccagcuuuccaaug

SEQ ID NO: 2722490 - RNA, 15 nt, Haemophilus influenzae Rd
ccaggaaaauuuuau

SEQ ID NO: 2722491 - RNA, 22 nt, Haemophilus influenzae Rd
ccaggagaaaguuguacuauuu

SEQ ID NO: 2722492 - RNA, 17 nt, Haemophilus influenzae Rd
ccaggcgaaaccgccuu

SEQ ID NO: 2722493 - RNA, 17 nt, Haemophilus influenzae Rd
ccaguaacuuucuucaa

SEQ ID NO: 2722494 - RNA, 18 nt, Haemophilus influenzae Rd
ccaguagaaaaucagauu

SEQ ID NO: 2722495 - RNA, 15 nt, Haemophilus influenzae Rd
ccaguaucaaucaua

SEQ ID NO: 2722496 - RNA, 22 nt, Haemophilus influenzae Rd
ccaguaucaaucauaucaucaa

SEQ ID NO: 2722497 - RNA, 19 nt, Haemophilus influenzae Rd
ccaguauuaaucugauaaa

SEQ ID NO: 2722498 - RNA, 14 nt, Haemophilus influenzae Rd
ccagucacuucuuc

SEQ ID NO: 2722499 - RNA, 15 nt, Haemophilus influenzae Rd
ccagucacuucuuca

SEQ ID NO: 2722500 - RNA, 23 nt, Haemophilus influenzae Rd
ccagucaucauagucaggugcac

SEQ ID NO: 2722501 - RNA, 17 nt, Haemophilus influenzae Rd
ccagucauuuuuuacau

SEQ ID NO: 2722502 - RNA, 15 nt, Haemophilus influenzae Rd
ccagucgauugugac

SEQ ID NO: 2722503 - RNA, 13 nt, Haemophilus influenzae Rd
ccagugaauuucu

SEQ ID NO: 2722504 - RNA, 14 nt, Haemophilus influenzae Rd
ccagugaauuucuu

SEQ ID NO: 2722505 - RNA, 22 nt, Haemophilus influenzae Rd
ccaguuacuuauuuagcaagcg

SEQ ID NO: 2722506 - RNA, 19 nt, Haemophilus influenzae Rd
ccaguuauucuucagaacu

SEQ ID NO: 2722507 - RNA, 15 nt, Haemophilus influenzae Rd
ccaguucuccuucuc

SEQ ID NO: 2722508 - RNA, 18 nt, Haemophilus influenzae Rd
ccaguuggguuaaauaua

SEQ ID NO: 2722509 - RNA, 15 nt, Haemophilus influenzae Rd
ccaguuuagaaagca

SEQ ID NO: 2722510 - RNA, 15 nt, Haemophilus influenzae Rd
ccaguuuucuagcuu

SEQ ID NO: 2722511 - RNA, 13 nt, Haemophilus influenzae Rd
ccauaaaaaaugg

SEQ ID NO: 2722512 - RNA, 12 nt, Haemophilus influenzae Rd
ccauaaaacguu

SEQ ID NO: 2722513 - RNA, 22 nt, Haemophilus influenzae Rd
ccauaaaagaccucucuaggcu

SEQ ID NO: 2722514 - RNA, 12 nt, Haemophilus influenzae Rd
ccauaaacauug

SEQ ID NO: 2722515 - RNA, 21 nt, Haemophilus influenzae Rd
ccauaaaccgccaaaaauuaa

SEQ ID NO: 2722516 - RNA, 12 nt, Haemophilus influenzae Rd
ccauaaauuugg

SEQ ID NO: 2722517 - RNA, 20 nt, Haemophilus influenzae Rd
ccauaacggcaagcaaacag

SEQ ID NO: 2722518 - RNA, 14 nt, Haemophilus influenzae Rd
ccauaagugagaaa

SEQ ID NO: 2722519 - RNA, 13 nt, Haemophilus influenzae Rd
ccauaauaaucac

SEQ ID NO: 2722520 - RNA, 18 nt, Haemophilus influenzae Rd
ccauaauggcaauuuuau

SEQ ID NO: 2722521 - RNA, 15 nt, Haemophilus influenzae Rd
ccauaccgcccauuc

SEQ ID NO: 2722522 - RNA, 15 nt, Haemophilus influenzae Rd
ccauacuugccacag

SEQ ID NO: 2722523 - RNA, 17 nt, Haemophilus influenzae Rd
ccauacuugccacaggu

SEQ ID NO: 2722524 - RNA, 23 nt, Haemophilus influenzae Rd
ccauagcgaagcguaaaaguagc

SEQ ID NO: 2722525 - RNA, 22 nt, Haemophilus influenzae Rd
ccauagcggauaaccaaaauau

SEQ ID NO: 2722526 - RNA, 19 nt, Haemophilus influenzae Rd
ccauaggauuauucacccc

SEQ ID NO: 2722527 - RNA, 21 nt, Haemophilus influenzae Rd
ccauaguccgcaccaugggca

SEQ ID NO: 2722528 - RNA, 23 nt, Haemophilus influenzae Rd
ccauaguuuggcugaaauucuaa

SEQ ID NO: 2722529 - RNA, 23 nt, Haemophilus influenzae Rd
ccauauccgagcucuuucauuaa

SEQ ID NO: 2722530 - RNA, 19 nt, Haemophilus influenzae Rd
ccauauuaaucgcaauaac

SEQ ID NO: 2722531 - RNA, 15 nt, Haemophilus influenzae Rd
ccauauuauuccuuu

SEQ ID NO: 2722532 - RNA, 12 nt, Haemophilus influenzae Rd
ccauauucuuuc

SEQ ID NO: 2722533 - RNA, 20 nt, Haemophilus influenzae Rd
ccauauucuuucgccaacca

SEQ ID NO: 2722534 - RNA, 11 nt, Haemophilus influenzae Rd
ccauauuuucc

SEQ ID NO: 2722535 - RNA, 12 nt, Haemophilus influenzae Rd
ccauauuuuccc

SEQ ID NO: 2722536 - RNA, 22 nt, Haemophilus influenzae Rd
ccauauuuucccaguaaauauc

SEQ ID NO: 2722537 - RNA, 22 nt, Haemophilus influenzae Rd
ccaucaaauccgccaaucauac

SEQ ID NO: 2722538 - RNA, 17 nt, Haemophilus influenzae Rd
ccaucaaccauaacaag

SEQ ID NO: 2722539 - RNA, 17 nt, Haemophilus influenzae Rd
ccaucaaucauaaaaac

SEQ ID NO: 2722540 - RNA, 17 nt, Haemophilus influenzae Rd
ccaucacaaaggaaagu

SEQ ID NO: 2722541 - RNA, 17 nt, Haemophilus influenzae Rd
ccaucacauuuucaaau

SEQ ID NO: 2722542 - RNA, 19 nt, Haemophilus influenzae Rd
ccaucacgaccuuuuucag

SEQ ID NO: 2722543 - RNA, 23 nt, Haemophilus influenzae Rd
ccaucacgccauaaacgcaccac

SEQ ID NO: 2722544 - RNA, 19 nt, Haemophilus influenzae Rd
ccaucacguaaguaaguca

SEQ ID NO: 2722545 - RNA, 21 nt, Haemophilus influenzae Rd
ccaucacguaauacaaaauau

SEQ ID NO: 2722546 - RNA, 13 nt, Haemophilus influenzae Rd
ccaucacguucaa

SEQ ID NO: 2722547 - RNA, 12 nt, Haemophilus influenzae Rd
ccaucacucaau

SEQ ID NO: 2722548 - RNA, 20 nt, Haemophilus influenzae Rd
ccaucacuuuuaauucuuua

SEQ ID NO: 2722549 - RNA, 14 nt, Haemophilus influenzae Rd
ccaucauaaauaug

SEQ ID NO: 2722550 - RNA, 22 nt, Haemophilus influenzae Rd
ccaucauuuuagguucaauaau

SEQ ID NO: 2722551 - RNA, 19 nt, Haemophilus influenzae Rd
ccauccauaacggcaagca

SEQ ID NO: 2722552 - RNA, 17 nt, Haemophilus influenzae Rd
ccaucgcugaaauuaau

SEQ ID NO: 2722553 - RNA, 18 nt, Haemophilus influenzae Rd
ccaucugauuuuguggca

SEQ ID NO: 2722554 - RNA, 14 nt, Haemophilus influenzae Rd
ccaucuucuucugg

SEQ ID NO: 2722555 - RNA, 23 nt, Haemophilus influenzae Rd
ccaucuucuucuggauuaucugu

SEQ ID NO: 2722556 - RNA, 23 nt, Haemophilus influenzae Rd
ccaugaugaaauaauucauguuu

SEQ ID NO: 2722557 - RNA, 23 nt, Haemophilus influenzae Rd
ccaugaugaugggaugaaaucaa

SEQ ID NO: 2722558 - RNA, 16 nt, Haemophilus influenzae Rd
ccauggcuuuuuccug

SEQ ID NO: 2722559 - RNA, 17 nt, Haemophilus influenzae Rd
ccauggcuuuuuccuga

SEQ ID NO: 2722560 - RNA, 20 nt, Haemophilus influenzae Rd
ccauggcuuuuuccugauca

SEQ ID NO: 2722561 - RNA, 19 nt, Haemophilus influenzae Rd
ccauuaaauaaaaaugaug

SEQ ID NO: 2722562 - RNA, 18 nt, Haemophilus influenzae Rd
ccauuaauacuuuugcac

SEQ ID NO: 2722563 - RNA, 11 nt, Haemophilus influenzae Rd
ccauuacaagc

SEQ ID NO: 2722564 - RNA, 18 nt, Haemophilus influenzae Rd
ccauuacaagcauuaaau

SEQ ID NO: 2722565 - RNA, 13 nt, Haemophilus influenzae Rd
ccauuacagcaag

SEQ ID NO: 2722566 - RNA, 20 nt, Haemophilus influenzae Rd
ccauuaccacugcauuuucu

SEQ ID NO: 2722567 - RNA, 19 nt, Haemophilus influenzae Rd
ccauuaguuguuuuaguuc

SEQ ID NO: 2722568 - RNA, 16 nt, Haemophilus influenzae Rd
ccauuauuuaucaucc

SEQ ID NO: 2722569 - RNA, 14 nt, Haemophilus influenzae Rd
ccauucacuacaca

SEQ ID NO: 2722570 - RNA, 14 nt, Haemophilus influenzae Rd
ccauucacuuucac

SEQ ID NO: 2722571 - RNA, 22 nt, Haemophilus influenzae Rd
ccauucaguaauaaggcuugca

SEQ ID NO: 2722572 - RNA, 16 nt, Haemophilus influenzae Rd
ccauuccugcaagaaa

SEQ ID NO: 2722573 - RNA, 19 nt, Haemophilus influenzae Rd
ccauucguucccaaauauc

SEQ ID NO: 2722574 - RNA, 23 nt, Haemophilus influenzae Rd
ccauucuaaaaaaauccuaaaua

SEQ ID NO: 2722575 - RNA, 22 nt, Haemophilus influenzae Rd
ccauucuaaugagcguuuaacu

SEQ ID NO: 2722576 - RNA, 14 nt, Haemophilus influenzae Rd
ccauucucaaauga

SEQ ID NO: 2722577 - RNA, 17 nt, Haemophilus influenzae Rd
ccauucuguaaacuaaa

SEQ ID NO: 2722578 - RNA, 17 nt, Haemophilus influenzae Rd
ccauucuuucaauaauu

SEQ ID NO: 2722579 - RNA, 15 nt, Haemophilus influenzae Rd
ccauugaaaauacag

SEQ ID NO: 2722580 - RNA, 23 nt, Haemophilus influenzae Rd
ccauugaaaccugaguaaauaaa

SEQ ID NO: 2722581 - RNA, 14 nt, Haemophilus influenzae Rd
ccauugaugaaaug

SEQ ID NO: 2722582 - RNA, 16 nt, Haemophilus influenzae Rd
ccauugcaauuucagc

SEQ ID NO: 2722583 - RNA, 17 nt, Haemophilus influenzae Rd
ccauugcauccacuuca

SEQ ID NO: 2722584 - RNA, 16 nt, Haemophilus influenzae Rd
ccauugcuaaauuuau

SEQ ID NO: 2722585 - RNA, 22 nt, Haemophilus influenzae Rd
ccauugguggguucaucuaaua

SEQ ID NO: 2722586 - RNA, 11 nt, Haemophilus influenzae Rd
ccauugugaug

SEQ ID NO: 2722587 - RNA, 16 nt, Haemophilus influenzae Rd
ccauuguuaaauguua

SEQ ID NO: 2722588 - RNA, 19 nt, Haemophilus influenzae Rd
ccauuguuguuuauuggca

SEQ ID NO: 2722589 - RNA, 21 nt, Haemophilus influenzae Rd
ccauuuaaaaguaaaaauaaa

SEQ ID NO: 2722590 - RNA, 21 nt, Haemophilus influenzae Rd
ccauuuaauguucccacaaag

SEQ ID NO: 2722591 - RNA, 20 nt, Haemophilus influenzae Rd
ccauuuacagguuugacauu

SEQ ID NO: 2722592 - RNA, 19 nt, Haemophilus influenzae Rd
ccauuuagguuagaauaaa

SEQ ID NO: 2722593 - RNA, 18 nt, Haemophilus influenzae Rd
ccauuucaucuucaguac

SEQ ID NO: 2722594 - RNA, 20 nt, Haemophilus influenzae Rd
ccauuucuaaugcaauuuca

SEQ ID NO: 2722595 - RNA, 21 nt, Haemophilus influenzae Rd
ccauuucuaaugcaauuucaa

SEQ ID NO: 2722596 - RNA, 19 nt, Haemophilus influenzae Rd
ccauuucuugaccuuucaa

SEQ ID NO: 2722597 - RNA, 19 nt, Haemophilus influenzae Rd
ccauuugcccacauagcuu

SEQ ID NO: 2722598 - RNA, 20 nt, Haemophilus influenzae Rd
ccauuugcccacauagcuug

SEQ ID NO: 2722599 - RNA, 17 nt, Haemophilus influenzae Rd
ccauuuggucuaacauu

SEQ ID NO: 2722600 - RNA, 20 nt, Haemophilus influenzae Rd
ccauuuguuuagauuuuacu

SEQ ID NO: 2722601 - RNA, 19 nt, Haemophilus influenzae Rd
ccauuuuaaucauaaaaaa

SEQ ID NO: 2722602 - RNA, 23 nt, Haemophilus influenzae Rd
ccauuuuagaggcuaugauuuua

SEQ ID NO: 2722603 - RNA, 19 nt, Haemophilus influenzae Rd
ccauuuucggacucgcugu

SEQ ID NO: 2722604 - RNA, 19 nt, Haemophilus influenzae Rd
ccauuuucuuguucuccau

SEQ ID NO: 2722605 - RNA, 18 nt, Haemophilus influenzae Rd
ccauuuugaggaauaaau

SEQ ID NO: 2722606 - RNA, 22 nt, Haemophilus influenzae Rd
ccauuuugcucaaaacgaguua

SEQ ID NO: 2722607 - RNA, 21 nt, Haemophilus influenzae Rd
ccauuuuuaaauggucuucau

SEQ ID NO: 2722608 - RNA, 20 nt, Haemophilus influenzae Rd
ccauuuuuaaccgcacuugc

SEQ ID NO: 2722609 - RNA, 19 nt, Haemophilus influenzae Rd
ccauuuuuaauuaaacguu

SEQ ID NO: 2722610 - RNA, 13 nt, Haemophilus influenzae Rd
ccauuuuucaaaa

SEQ ID NO: 2722611 - RNA, 19 nt, Haemophilus influenzae Rd
ccauuuuucagcaagcauu

SEQ ID NO: 2722612 - RNA, 11 nt, Haemophilus influenzae Rd
ccauuuuucca

SEQ ID NO: 2722613 - RNA, 15 nt, Haemophilus influenzae Rd
ccauuuuuccagcaa

SEQ ID NO: 2722614 - RNA, 23 nt, Haemophilus influenzae Rd
ccauuuuugagguguuuaugcuu

SEQ ID NO: 2722615 - RNA, 22 nt, Haemophilus influenzae Rd
ccauuuuuuggaguuguuuaaa

SEQ ID NO: 2722616 - RNA, 13 nt, Haemophilus influenzae Rd
ccauuuuuuucua

SEQ ID NO: 2722617 - RNA, 22 nt, Haemophilus influenzae Rd
cccaaaauauuuucaaauaagu

SEQ ID NO: 2722618 - RNA, 14 nt, Haemophilus influenzae Rd
cccaaaauuucagc

SEQ ID NO: 2722619 - RNA, 11 nt, Haemophilus influenzae Rd
cccaacaaauu

SEQ ID NO: 2722620 - RNA, 21 nt, Haemophilus influenzae Rd
cccaacaaauuuaaaugauga

SEQ ID NO: 2722621 - RNA, 20 nt, Haemophilus influenzae Rd
cccaacagaaaucauuucaa

SEQ ID NO: 2722622 - RNA, 21 nt, Haemophilus influenzae Rd
cccaacagaaaucauuucaau

SEQ ID NO: 2722623 - RNA, 17 nt, Haemophilus influenzae Rd
cccaacagauuuaauac

SEQ ID NO: 2722624 - RNA, 20 nt, Haemophilus influenzae Rd
cccaaccgauauacucuccc

SEQ ID NO: 2722625 - RNA, 17 nt, Haemophilus influenzae Rd
cccaagagucuugccaa

SEQ ID NO: 2722626 - RNA, 14 nt, Haemophilus influenzae Rd
cccaagcaauucuu

SEQ ID NO: 2722627 - RNA, 16 nt, Haemophilus influenzae Rd
cccaagccaauuauuu

SEQ ID NO: 2722628 - RNA, 15 nt, Haemophilus influenzae Rd
cccaauauuuuucau

SEQ ID NO: 2722629 - RNA, 18 nt, Haemophilus influenzae Rd
cccaauauuuuucauaaa

SEQ ID NO: 2722630 - RNA, 19 nt, Haemophilus influenzae Rd
cccaaucuccguugggauu

SEQ ID NO: 2722631 - RNA, 20 nt, Haemophilus influenzae Rd
cccaaucuucgucaucauca

SEQ ID NO: 2722632 - RNA, 23 nt, Haemophilus influenzae Rd
cccaauuaccugaugaaaucauu

SEQ ID NO: 2722633 - RNA, 21 nt, Haemophilus influenzae Rd
cccaauuacgaaguggcguuu

SEQ ID NO: 2722634 - RNA, 15 nt, Haemophilus influenzae Rd
cccaauuauuggcaa

SEQ ID NO: 2722635 - RNA, 18 nt, Haemophilus influenzae Rd
cccaauuuaccugauuca

SEQ ID NO: 2722636 - RNA, 17 nt, Haemophilus influenzae Rd
cccaauuuggcaaaagu

SEQ ID NO: 2722637 - RNA, 21 nt, Haemophilus influenzae Rd
cccaauuuggcaaaaguaagc

SEQ ID NO: 2722638 - RNA, 17 nt, Haemophilus influenzae Rd
cccacaacccaagagcc

SEQ ID NO: 2722639 - RNA, 13 nt, Haemophilus influenzae Rd
cccacaugggcau

SEQ ID NO: 2722640 - RNA, 13 nt, Haemophilus influenzae Rd
cccacaugucaaa

SEQ ID NO: 2722641 - RNA, 18 nt, Haemophilus influenzae Rd
cccaccauacgcaacuaa

SEQ ID NO: 2722642 - RNA, 24 nt, Haemophilus influenzae Rd
cccaccgcuggcauagcuucuaau

SEQ ID NO: 2722643 - RNA, 15 nt, Haemophilus influenzae Rd
cccacguccacuuca

SEQ ID NO: 2722644 - RNA, 22 nt, Haemophilus influenzae Rd
cccacugauuuuucuuuuucag

SEQ ID NO: 2722645 - RNA, 19 nt, Haemophilus influenzae Rd
cccacuucgauauuuuccg

SEQ ID NO: 2722646 - RNA, 15 nt, Haemophilus influenzae Rd
cccacuucugcacca

SEQ ID NO: 2722647 - RNA, 19 nt, Haemophilus influenzae Rd
cccaggaguaaccacaaaa

SEQ ID NO: 2722648 - RNA, 20 nt, Haemophilus influenzae Rd
cccaguaaauauccacgaau

SEQ ID NO: 2722649 - RNA, 15 nt, Haemophilus influenzae Rd
cccagugcugaaaua

SEQ ID NO: 2722650 - RNA, 13 nt, Haemophilus influenzae Rd
cccaguuuaccgc

SEQ ID NO: 2722651 - RNA, 18 nt, Haemophilus influenzae Rd
cccaguuuaccgccaagu

SEQ ID NO: 2722652 - RNA, 21 nt, Haemophilus influenzae Rd
cccauaaaucggcguauuuua

SEQ ID NO: 2722653 - RNA, 19 nt, Haemophilus influenzae Rd
cccauaagugagaaaauac

SEQ ID NO: 2722654 - RNA, 15 nt, Haemophilus influenzae Rd
cccauauuauuccuu

SEQ ID NO: 2722655 - RNA, 23 nt, Haemophilus influenzae Rd
cccauauuuaaaaccaaaagauu

SEQ ID NO: 2722656 - RNA, 18 nt, Haemophilus influenzae Rd
cccaucauuuuagguuca

SEQ ID NO: 2722657 - RNA, 20 nt, Haemophilus influenzae Rd
cccaugcgaacagguucauu

SEQ ID NO: 2722658 - RNA, 23 nt, Haemophilus influenzae Rd
cccauugaaauaacacaaccauc

SEQ ID NO: 2722659 - RNA, 16 nt, Haemophilus influenzae Rd
cccauuucuaaugcaa

SEQ ID NO: 2722660 - RNA, 19 nt, Haemophilus influenzae Rd
ccccaaaagcugccaucug

SEQ ID NO: 2722661 - RNA, 20 nt, Haemophilus influenzae Rd
ccccaaucccucaaauacac

SEQ ID NO: 2722662 - RNA, 15 nt, Haemophilus influenzae Rd
ccccaauuagauuac

SEQ ID NO: 2722663 - RNA, 17 nt, Haemophilus influenzae Rd
ccccauuauugugaugg

SEQ ID NO: 2722664 - RNA, 13 nt, Haemophilus influenzae Rd
ccccccuaccgga

SEQ ID NO: 2722665 - RNA, 15 nt, Haemophilus influenzae Rd
ccccgaugauuuuua

SEQ ID NO: 2722666 - RNA, 12 nt, Haemophilus influenzae Rd
ccccucauguuu

SEQ ID NO: 2722667 - RNA, 20 nt, Haemophilus influenzae Rd
ccccugguguuauuggaaaa

SEQ ID NO: 2722668 - RNA, 16 nt, Haemophilus influenzae Rd
ccccuuaauuauuuua

SEQ ID NO: 2722669 - RNA, 19 nt, Haemophilus influenzae Rd
ccccuucaaauauaacgac

SEQ ID NO: 2722670 - RNA, 19 nt, Haemophilus influenzae Rd
ccccuuguucuucauagaa

SEQ ID NO: 2722671 - RNA, 12 nt, Haemophilus influenzae Rd
cccgaagccaga

SEQ ID NO: 2722672 - RNA, 16 nt, Haemophilus influenzae Rd
cccgaucauugugauc

SEQ ID NO: 2722673 - RNA, 21 nt, Haemophilus influenzae Rd
cccgauuaagaauacugcacc

SEQ ID NO: 2722674 - RNA, 16 nt, Haemophilus influenzae Rd
cccgcacuuuuaacca

SEQ ID NO: 2722675 - RNA, 18 nt, Haemophilus influenzae Rd
cccgcuuucgcuucugcu

SEQ ID NO: 2722676 - RNA, 13 nt, Haemophilus influenzae Rd
cccgguaaaucua

SEQ ID NO: 2722677 - RNA, 16 nt, Haemophilus influenzae Rd
cccguaauuaaaaaua

SEQ ID NO: 2722678 - RNA, 14 nt, Haemophilus influenzae Rd
cccguauuaaauac

SEQ ID NO: 2722679 - RNA, 20 nt, Haemophilus influenzae Rd
cccgucaauuccauaauauc

SEQ ID NO: 2722680 - RNA, 12 nt, Haemophilus influenzae Rd
cccuaauuauuu

SEQ ID NO: 2722681 - RNA, 15 nt, Haemophilus influenzae Rd
cccuacgccuaauuc

SEQ ID NO: 2722682 - RNA, 22 nt, Haemophilus influenzae Rd
cccuacgccuaauucaucuucu

SEQ ID NO: 2722683 - RNA, 17 nt, Haemophilus influenzae Rd
cccuagccuuuucuagc

SEQ ID NO: 2722684 - RNA, 12 nt, Haemophilus influenzae Rd
cccuauagcuua

SEQ ID NO: 2722685 - RNA, 15 nt, Haemophilus influenzae Rd
cccuauuaaaacagc

SEQ ID NO: 2722686 - RNA, 14 nt, Haemophilus influenzae Rd
cccucaagauagcg

SEQ ID NO: 2722687 - RNA, 15 nt, Haemophilus influenzae Rd
cccugaaagucgauu

SEQ ID NO: 2722688 - RNA, 16 nt, Haemophilus influenzae Rd
cccugaagcaacaauc

SEQ ID NO: 2722689 - RNA, 17 nt, Haemophilus influenzae Rd
cccuuaauacugcugaa

SEQ ID NO: 2722690 - RNA, 16 nt, Haemophilus influenzae Rd
cccuuacuuuauacua

SEQ ID NO: 2722691 - RNA, 12 nt, Haemophilus influenzae Rd
cccuuauggugg

SEQ ID NO: 2722692 - RNA, 11 nt, Haemophilus influenzae Rd
cccuucauaag

SEQ ID NO: 2722693 - RNA, 18 nt, Haemophilus influenzae Rd
cccuucauaagcccccac

SEQ ID NO: 2722694 - RNA, 13 nt, Haemophilus influenzae Rd
cccuuguucuuca

SEQ ID NO: 2722695 - RNA, 15 nt, Haemophilus influenzae Rd
cccuuguucuucaua

SEQ ID NO: 2722696 - RNA, 21 nt, Haemophilus influenzae Rd
cccuuuaaauuacauucccaa

SEQ ID NO: 2722697 - RNA, 22 nt, Haemophilus influenzae Rd
cccuuuaaauuacauucccaaa

SEQ ID NO: 2722698 - RNA, 13 nt, Haemophilus influenzae Rd
cccuuuucaaaca

SEQ ID NO: 2722699 - RNA, 16 nt, Haemophilus influenzae Rd
cccuuuugccuaaaac

SEQ ID NO: 2722700 - RNA, 22 nt, Haemophilus influenzae Rd
cccuuuuuacauuauugaagca

SEQ ID NO: 2722701 - RNA, 17 nt, Haemophilus influenzae Rd
cccuuuuucaauuauua

SEQ ID NO: 2722702 - RNA, 13 nt, Haemophilus influenzae Rd
ccgaaaaaacaag

SEQ ID NO: 2722703 - RNA, 18 nt, Haemophilus influenzae Rd
ccgaaaaccgaaaaaaua

SEQ ID NO: 2722704 - RNA, 20 nt, Haemophilus influenzae Rd
ccgaaauaaccuagaacaaa

SEQ ID NO: 2722705 - RNA, 16 nt, Haemophilus influenzae Rd
ccgaagugaauaaugu

SEQ ID NO: 2722706 - RNA, 20 nt, Haemophilus influenzae Rd
ccgaauauccacuucauuaa

SEQ ID NO: 2722707 - RNA, 22 nt, Haemophilus influenzae Rd
ccgaaugaagaaauggcgacca

SEQ ID NO: 2722708 - RNA, 23 nt, Haemophilus influenzae Rd
ccgaaugacgcguuaauuuuuaa

SEQ ID NO: 2722709 - RNA, 15 nt, Haemophilus influenzae Rd
ccgaauguggcagca

SEQ ID NO: 2722710 - RNA, 15 nt, Haemophilus influenzae Rd
ccgacaacacuugcu

SEQ ID NO: 2722711 - RNA, 23 nt, Haemophilus influenzae Rd
ccgacuuuauauugacaaagucg

SEQ ID NO: 2722712 - RNA, 19 nt, Haemophilus influenzae Rd
ccgagcucuuucauuaaau

SEQ ID NO: 2722713 - RNA, 18 nt, Haemophilus influenzae Rd
ccgauaaaaccuaaaauu

SEQ ID NO: 2722714 - RNA, 19 nt, Haemophilus influenzae Rd
ccgauaaaugcacauuuuu

SEQ ID NO: 2722715 - RNA, 21 nt, Haemophilus influenzae Rd
ccgauaaaugcacauuuuuac

SEQ ID NO: 2722716 - RNA, 16 nt, Haemophilus influenzae Rd
ccgauaaguccaucac

SEQ ID NO: 2722717 - RNA, 22 nt, Haemophilus influenzae Rd
ccgauagcuuuuguugcuugaa

SEQ ID NO: 2722718 - RNA, 21 nt, Haemophilus influenzae Rd
ccgauauguuuuuuacgaagu

SEQ ID NO: 2722719 - RNA, 12 nt, Haemophilus influenzae Rd
ccgauauuuucc

SEQ ID NO: 2722720 - RNA, 17 nt, Haemophilus influenzae Rd
ccgauuucuuuacaaau

SEQ ID NO: 2722721 - RNA, 12 nt, Haemophilus influenzae Rd
ccgauuuuaaac

SEQ ID NO: 2722722 - RNA, 21 nt, Haemophilus influenzae Rd
ccgauuuuaauugugcaauuu

SEQ ID NO: 2722723 - RNA, 17 nt, Haemophilus influenzae Rd
ccgauuuuacgauuucu

SEQ ID NO: 2722724 - RNA, 18 nt, Haemophilus influenzae Rd
ccgcaaccguggcaaccg

SEQ ID NO: 2722725 - RNA, 22 nt, Haemophilus influenzae Rd
ccgcaagaggaauuucgacaua

SEQ ID NO: 2722726 - RNA, 19 nt, Haemophilus influenzae Rd
ccgcaauauuuaaauacac

SEQ ID NO: 2722727 - RNA, 13 nt, Haemophilus influenzae Rd
ccgcaaucaagca

SEQ ID NO: 2722728 - RNA, 15 nt, Haemophilus influenzae Rd
ccgcaaucacaaaau

SEQ ID NO: 2722729 - RNA, 18 nt, Haemophilus influenzae Rd
ccgcaaucuucacaaaua

SEQ ID NO: 2722730 - RNA, 13 nt, Haemophilus influenzae Rd
ccgcaauuucugc

SEQ ID NO: 2722731 - RNA, 15 nt, Haemophilus influenzae Rd
ccgcaccaauaacag

SEQ ID NO: 2722732 - RNA, 17 nt, Haemophilus influenzae Rd
ccgcacuuuauuagaaa

SEQ ID NO: 2722733 - RNA, 23 nt, Haemophilus influenzae Rd
ccgcacuuucgccgaguaaauuc

SEQ ID NO: 2722734 - RNA, 21 nt, Haemophilus influenzae Rd
ccgcacuuugugcuccccccc

SEQ ID NO: 2722735 - RNA, 17 nt, Haemophilus influenzae Rd
ccgcacuuuuauuauuu

SEQ ID NO: 2722736 - RNA, 14 nt, Haemophilus influenzae Rd
ccgcacuuuuuagc

SEQ ID NO: 2722737 - RNA, 20 nt, Haemophilus influenzae Rd
ccgcacuuuuuauauuuuuu

SEQ ID NO: 2722738 - RNA, 17 nt, Haemophilus influenzae Rd
ccgcacuuuuuauuuuu

SEQ ID NO: 2722739 - RNA, 13 nt, Haemophilus influenzae Rd
ccgcacuuuuucu

SEQ ID NO: 2722740 - RNA, 12 nt, Haemophilus influenzae Rd
ccgcacuuuuug

SEQ ID NO: 2722741 - RNA, 14 nt, Haemophilus influenzae Rd
ccgcacuuuuuucu

SEQ ID NO: 2722742 - RNA, 22 nt, Haemophilus influenzae Rd
ccgcacuuuuuuguauaaaaau

SEQ ID NO: 2722743 - RNA, 12 nt, Haemophilus influenzae Rd
ccgcagcaauua

SEQ ID NO: 2722744 - RNA, 21 nt, Haemophilus influenzae Rd
ccgcagcuaauccaaaucaag

SEQ ID NO: 2722745 - RNA, 23 nt, Haemophilus influenzae Rd
ccgcagcuaauccaaaucaagcu

SEQ ID NO: 2722746 - RNA, 19 nt, Haemophilus influenzae Rd
ccgcaguuaaaacugugcc

SEQ ID NO: 2722747 - RNA, 12 nt, Haemophilus influenzae Rd
ccgcauauaaaa

SEQ ID NO: 2722748 - RNA, 13 nt, Haemophilus influenzae Rd
ccgcauauaaaau

SEQ ID NO: 2722749 - RNA, 15 nt, Haemophilus influenzae Rd
ccgcauuacuuuuug

SEQ ID NO: 2722750 - RNA, 20 nt, Haemophilus influenzae Rd
ccgccaagugcgguugaaaa

SEQ ID NO: 2722751 - RNA, 22 nt, Haemophilus influenzae Rd
ccgccacgauggcaauucgccc

SEQ ID NO: 2722752 - RNA, 12 nt, Haemophilus influenzae Rd
ccgccaguaaga

SEQ ID NO: 2722753 - RNA, 18 nt, Haemophilus influenzae Rd
ccgcccauuccacccaua

SEQ ID NO: 2722754 - RNA, 15 nt, Haemophilus influenzae Rd
ccgccccacagccaa

SEQ ID NO: 2722755 - RNA, 14 nt, Haemophilus influenzae Rd
ccgccgauaguuaa

SEQ ID NO: 2722756 - RNA, 13 nt, Haemophilus influenzae Rd
ccgccuuuguuuu

SEQ ID NO: 2722757 - RNA, 23 nt, Haemophilus influenzae Rd
ccgcgaaaugcggacuuuuucau

SEQ ID NO: 2722758 - RNA, 20 nt, Haemophilus influenzae Rd
ccgcuaauaaucgcaaugcc

SEQ ID NO: 2722759 - RNA, 11 nt, Haemophilus influenzae Rd
ccgcuaauggu

SEQ ID NO: 2722760 - RNA, 17 nt, Haemophilus influenzae Rd
ccgcucuuuaacaaauu

SEQ ID NO: 2722761 - RNA, 14 nt, Haemophilus influenzae Rd
ccgcucuuuucggu

SEQ ID NO: 2722762 - RNA, 15 nt, Haemophilus influenzae Rd
ccgcugcucuaccga

SEQ ID NO: 2722763 - RNA, 21 nt, Haemophilus influenzae Rd
ccgcuguugugaguaagucuu

SEQ ID NO: 2722764 - RNA, 18 nt, Haemophilus influenzae Rd
ccgcuucguuguaaucuu

SEQ ID NO: 2722765 - RNA, 23 nt, Haemophilus influenzae Rd
ccgcuugaacauaagcaacauau

SEQ ID NO: 2722766 - RNA, 22 nt, Haemophilus influenzae Rd
ccgcuuuugcauugagcacuuc

SEQ ID NO: 2722767 - RNA, 15 nt, Haemophilus influenzae Rd
ccgguaaaucuacuu

SEQ ID NO: 2722768 - RNA, 16 nt, Haemophilus influenzae Rd
ccguauugaauaauua

SEQ ID NO: 2722769 - RNA, 15 nt, Haemophilus influenzae Rd
ccguauuggcgaccg

SEQ ID NO: 2722770 - RNA, 21 nt, Haemophilus influenzae Rd
ccguauugucaaaaucagcuu

SEQ ID NO: 2722771 - RNA, 23 nt, Haemophilus influenzae Rd
ccgucagccaaauuuuucuuuuc

SEQ ID NO: 2722772 - RNA, 18 nt, Haemophilus influenzae Rd
ccgucaugggauaaacau

SEQ ID NO: 2722773 - RNA, 14 nt, Haemophilus influenzae Rd
ccgucauuuauaaa

SEQ ID NO: 2722774 - RNA, 16 nt, Haemophilus influenzae Rd
ccgucauuuauaaaau

SEQ ID NO: 2722775 - RNA, 18 nt, Haemophilus influenzae Rd
ccgucauuuucaagccac

SEQ ID NO: 2722776 - RNA, 21 nt, Haemophilus influenzae Rd
ccguccaaucuaauucuuccg

SEQ ID NO: 2722777 - RNA, 23 nt, Haemophilus influenzae Rd
ccgucgcgauagccucuucuuuu

SEQ ID NO: 2722778 - RNA, 22 nt, Haemophilus influenzae Rd
ccgucguuguuccuaaugugca

SEQ ID NO: 2722779 - RNA, 22 nt, Haemophilus influenzae Rd
ccgucuaaaaauccugaagauu

SEQ ID NO: 2722780 - RNA, 13 nt, Haemophilus influenzae Rd
ccgugagcauuua

SEQ ID NO: 2722781 - RNA, 16 nt, Haemophilus influenzae Rd
ccgugauaacaacuca

SEQ ID NO: 2722782 - RNA, 23 nt, Haemophilus influenzae Rd
ccgugauaacaacucacaauaau

SEQ ID NO: 2722783 - RNA, 18 nt, Haemophilus influenzae Rd
ccguguucuagugcaaca

SEQ ID NO: 2722784 - RNA, 17 nt, Haemophilus influenzae Rd
ccguuaaauuuagauuu

SEQ ID NO: 2722785 - RNA, 16 nt, Haemophilus influenzae Rd
ccguuagguuuaaaag

SEQ ID NO: 2722786 - RNA, 21 nt, Haemophilus influenzae Rd
ccguuccacuuccugcuaccu

SEQ ID NO: 2722787 - RNA, 11 nt, Haemophilus influenzae Rd
ccguuuaccau

SEQ ID NO: 2722788 - RNA, 16 nt, Haemophilus influenzae Rd
ccguuugaccauucau

SEQ ID NO: 2722789 - RNA, 13 nt, Haemophilus influenzae Rd
ccguuuucaaugc

SEQ ID NO: 2722790 - RNA, 17 nt, Haemophilus influenzae Rd
ccguuuucaaugcaaau

SEQ ID NO: 2722791 - RNA, 18 nt, Haemophilus influenzae Rd
ccguuuuuauuuguucua

SEQ ID NO: 2722792 - RNA, 21 nt, Haemophilus influenzae Rd
ccguuuuuauuuguucuacuu

SEQ ID NO: 2722793 - RNA, 11 nt, Haemophilus influenzae Rd
ccguuuuucac

SEQ ID NO: 2722794 - RNA, 17 nt, Haemophilus influenzae Rd
ccguuuuuucauucacu

SEQ ID NO: 2722795 - RNA, 13 nt, Haemophilus influenzae Rd
ccuaaaaaacccg

SEQ ID NO: 2722796 - RNA, 19 nt, Haemophilus influenzae Rd
ccuaaaaaugccccagcaa

SEQ ID NO: 2722797 - RNA, 13 nt, Haemophilus influenzae Rd
ccuaaaauacaaa

SEQ ID NO: 2722798 - RNA, 22 nt, Haemophilus influenzae Rd
ccuaaaauagagcaaauauaaa

SEQ ID NO: 2722799 - RNA, 11 nt, Haemophilus influenzae Rd
ccuaaaauauu

SEQ ID NO: 2722800 - RNA, 18 nt, Haemophilus influenzae Rd
ccuaaacccgcaauuaau

SEQ ID NO: 2722801 - RNA, 19 nt, Haemophilus influenzae Rd
ccuaaacgaacuggcugag

SEQ ID NO: 2722802 - RNA, 19 nt, Haemophilus influenzae Rd
ccuaaacuacaacagcgaa

SEQ ID NO: 2722803 - RNA, 23 nt, Haemophilus influenzae Rd
ccuaaauacaucacuaauacgcg

SEQ ID NO: 2722804 - RNA, 14 nt, Haemophilus influenzae Rd
ccuaaauauuuaua

SEQ ID NO: 2722805 - RNA, 19 nt, Haemophilus influenzae Rd
ccuaaaugagaaaaauccu

SEQ ID NO: 2722806 - RNA, 14 nt, Haemophilus influenzae Rd
ccuaacaauaauuu

SEQ ID NO: 2722807 - RNA, 12 nt, Haemophilus influenzae Rd
ccuaacauaaug

SEQ ID NO: 2722808 - RNA, 21 nt, Haemophilus influenzae Rd
ccuaacauacugcuuucuaga

SEQ ID NO: 2722809 - RNA, 13 nt, Haemophilus influenzae Rd
ccuaaccaaagcg

SEQ ID NO: 2722810 - RNA, 22 nt, Haemophilus influenzae Rd
ccuaagauuuuaucuaacucuu

SEQ ID NO: 2722811 - RNA, 16 nt, Haemophilus influenzae Rd
ccuaagcacaaagaaa

SEQ ID NO: 2722812 - RNA, 16 nt, Haemophilus influenzae Rd
ccuaagccaaauccaa

SEQ ID NO: 2722813 - RNA, 16 nt, Haemophilus influenzae Rd
ccuaaguuuuggucaa

SEQ ID NO: 2722814 - RNA, 19 nt, Haemophilus influenzae Rd
ccuaauaugauuucuucaa

SEQ ID NO: 2722815 - RNA, 23 nt, Haemophilus influenzae Rd
ccuaaugcauugaugacugcauc

SEQ ID NO: 2722816 - RNA, 17 nt, Haemophilus influenzae Rd
ccuaauggauauagaaa

SEQ ID NO: 2722817 - RNA, 22 nt, Haemophilus influenzae Rd
ccuaauggauauagaaaucaua

SEQ ID NO: 2722818 - RNA, 22 nt, Haemophilus influenzae Rd
ccuaauuaauuuagauaaaaau

SEQ ID NO: 2722819 - RNA, 11 nt, Haemophilus influenzae Rd
ccuaauuauuu

SEQ ID NO: 2722820 - RNA, 14 nt, Haemophilus influenzae Rd
ccuaauucaauauc

SEQ ID NO: 2722821 - RNA, 13 nt, Haemophilus influenzae Rd
ccuaauucacuau

SEQ ID NO: 2722822 - RNA, 14 nt, Haemophilus influenzae Rd
ccuaauucuuucac

SEQ ID NO: 2722823 - RNA, 23 nt, Haemophilus influenzae Rd
ccuaauugcugggcaauauaaac

SEQ ID NO: 2722824 - RNA, 12 nt, Haemophilus influenzae Rd
ccuacaacuaau

SEQ ID NO: 2722825 - RNA, 20 nt, Haemophilus influenzae Rd
ccuacaccacccgauaaaug

SEQ ID NO: 2722826 - RNA, 13 nt, Haemophilus influenzae Rd
ccuacagauacag

SEQ ID NO: 2722827 - RNA, 16 nt, Haemophilus influenzae Rd
ccuacagauacagaag

SEQ ID NO: 2722828 - RNA, 14 nt, Haemophilus influenzae Rd
ccuacauuaaaaga

SEQ ID NO: 2722829 - RNA, 19 nt, Haemophilus influenzae Rd
ccuacauuaaucaccauau

SEQ ID NO: 2722830 - RNA, 22 nt, Haemophilus influenzae Rd
ccuacgauacuuuuaauuaaau

SEQ ID NO: 2722831 - RNA, 16 nt, Haemophilus influenzae Rd
ccuacgccguuagaua

SEQ ID NO: 2722832 - RNA, 21 nt, Haemophilus influenzae Rd
ccuacgccguuagauacuuua

SEQ ID NO: 2722833 - RNA, 18 nt, Haemophilus influenzae Rd
ccuacuauaggaauauca

SEQ ID NO: 2722834 - RNA, 20 nt, Haemophilus influenzae Rd
ccuacuuuuuauuuuugauu

SEQ ID NO: 2722835 - RNA, 13 nt, Haemophilus influenzae Rd
ccuagaacaaaag

SEQ ID NO: 2722836 - RNA, 15 nt, Haemophilus influenzae Rd
ccuagaacaaaaggc

SEQ ID NO: 2722837 - RNA, 23 nt, Haemophilus influenzae Rd
ccuagcgcuguuacuucuuucac

SEQ ID NO: 2722838 - RNA, 13 nt, Haemophilus influenzae Rd
ccuauaaaacaaa

SEQ ID NO: 2722839 - RNA, 16 nt, Haemophilus influenzae Rd
ccuauaauuaaaguua

SEQ ID NO: 2722840 - RNA, 22 nt, Haemophilus influenzae Rd
ccuaucucauccacuaaaccau

SEQ ID NO: 2722841 - RNA, 22 nt, Haemophilus influenzae Rd
ccuauuaguauuuaagcugaaa

SEQ ID NO: 2722842 - RNA, 17 nt, Haemophilus influenzae Rd
ccuauucgcugauaaac

SEQ ID NO: 2722843 - RNA, 12 nt, Haemophilus influenzae Rd
ccuauucuaaau

SEQ ID NO: 2722844 - RNA, 12 nt, Haemophilus influenzae Rd
ccuauuuuuaga

SEQ ID NO: 2722845 - RNA, 12 nt, Haemophilus influenzae Rd
ccuauuuuuucc

SEQ ID NO: 2722846 - RNA, 15 nt, Haemophilus influenzae Rd
ccuauuuuuuccugc

SEQ ID NO: 2722847 - RNA, 23 nt, Haemophilus influenzae Rd
ccucaaguuuguggaguaauucu

SEQ ID NO: 2722848 - RNA, 22 nt, Haemophilus influenzae Rd
ccucagauaaucuacaaaacau

SEQ ID NO: 2722849 - RNA, 23 nt, Haemophilus influenzae Rd
ccucagauaaugauagaugaauu

SEQ ID NO: 2722850 - RNA, 15 nt, Haemophilus influenzae Rd
ccucagcaauuucuu

SEQ ID NO: 2722851 - RNA, 22 nt, Haemophilus influenzae Rd
ccucagcaauuucuucagcuug

SEQ ID NO: 2722852 - RNA, 15 nt, Haemophilus influenzae Rd
ccucagcaauuuucu

SEQ ID NO: 2722853 - RNA, 17 nt, Haemophilus influenzae Rd
ccucagguucaaacauc

SEQ ID NO: 2722854 - RNA, 19 nt, Haemophilus influenzae Rd
ccucagguucaaacaucac

SEQ ID NO: 2722855 - RNA, 12 nt, Haemophilus influenzae Rd
ccucaucuuuuu

SEQ ID NO: 2722856 - RNA, 15 nt, Haemophilus influenzae Rd
ccuccaaauucuuua

SEQ ID NO: 2722857 - RNA, 18 nt, Haemophilus influenzae Rd
ccuccaaauucuuuaaau

SEQ ID NO: 2722858 - RNA, 17 nt, Haemophilus influenzae Rd
ccuccauuaguuguuuu

SEQ ID NO: 2722859 - RNA, 19 nt, Haemophilus influenzae Rd
ccuccauuaguuguuuuag

SEQ ID NO: 2722860 - RNA, 20 nt, Haemophilus influenzae Rd
ccucccuaaugauuaauuaa

SEQ ID NO: 2722861 - RNA, 23 nt, Haemophilus influenzae Rd
ccuccuaaugcagcagcuucuuc

SEQ ID NO: 2722862 - RNA, 19 nt, Haemophilus influenzae Rd
ccucucgccaaaucucaaa

SEQ ID NO: 2722863 - RNA, 13 nt, Haemophilus influenzae Rd
ccucuguauuuuu

SEQ ID NO: 2722864 - RNA, 14 nt, Haemophilus influenzae Rd
ccucuguauuuuuc

SEQ ID NO: 2722865 - RNA, 15 nt, Haemophilus influenzae Rd
ccucuucauugugga

SEQ ID NO: 2722866 - RNA, 16 nt, Haemophilus influenzae Rd
ccucuucauuguggaa

SEQ ID NO: 2722867 - RNA, 21 nt, Haemophilus influenzae Rd
ccucuucuuuugcaaaaauga

SEQ ID NO: 2722868 - RNA, 17 nt, Haemophilus influenzae Rd
ccucuugcacaauuugg

SEQ ID NO: 2722869 - RNA, 22 nt, Haemophilus influenzae Rd
ccucuuuaauuucgccagaacu

SEQ ID NO: 2722870 - RNA, 12 nt, Haemophilus influenzae Rd
ccucuuuuucag

SEQ ID NO: 2722871 - RNA, 19 nt, Haemophilus influenzae Rd
ccucuuuuucagaagucac

SEQ ID NO: 2722872 - RNA, 16 nt, Haemophilus influenzae Rd
ccugaagcaacaauca

SEQ ID NO: 2722873 - RNA, 15 nt, Haemophilus influenzae Rd
ccugacccacaucau

SEQ ID NO: 2722874 - RNA, 15 nt, Haemophilus influenzae Rd
ccugaucauaaguau

SEQ ID NO: 2722875 - RNA, 15 nt, Haemophilus influenzae Rd
ccugaugaaaucauu

SEQ ID NO: 2722876 - RNA, 17 nt, Haemophilus influenzae Rd
ccugaugcgauccaaaa

SEQ ID NO: 2722877 - RNA, 13 nt, Haemophilus influenzae Rd
ccugauguuugag

SEQ ID NO: 2722878 - RNA, 16 nt, Haemophilus influenzae Rd
ccugauuaaucaaaaa

SEQ ID NO: 2722879 - RNA, 20 nt, Haemophilus influenzae Rd
ccugauucauugcauuuuua

SEQ ID NO: 2722880 - RNA, 22 nt, Haemophilus influenzae Rd
ccugauucauugcauuuuuaua

SEQ ID NO: 2722881 - RNA, 14 nt, Haemophilus influenzae Rd
ccugcaaauaagau

SEQ ID NO: 2722882 - RNA, 23 nt, Haemophilus influenzae Rd
ccugcaauugugucauucgcauc

SEQ ID NO: 2722883 - RNA, 18 nt, Haemophilus influenzae Rd
ccugcauuuucuuucguc

SEQ ID NO: 2722884 - RNA, 15 nt, Haemophilus influenzae Rd
ccugcccugaagcaa

SEQ ID NO: 2722885 - RNA, 21 nt, Haemophilus influenzae Rd
ccugcccuugauauucaauua

SEQ ID NO: 2722886 - RNA, 23 nt, Haemophilus influenzae Rd
ccugcgggucuuguuccaacaga

SEQ ID NO: 2722887 - RNA, 19 nt, Haemophilus influenzae Rd
ccugcgugaaugacuuuca

SEQ ID NO: 2722888 - RNA, 16 nt, Haemophilus influenzae Rd
ccugcuacauauucaa

SEQ ID NO: 2722889 - RNA, 21 nt, Haemophilus influenzae Rd
ccugcuucguuuucugcuuca

SEQ ID NO: 2722890 - RNA, 23 nt, Haemophilus influenzae Rd
ccuggucgggcugaguacacaaa

SEQ ID NO: 2722891 - RNA, 16 nt, Haemophilus influenzae Rd
ccuguauaauuuuuca

SEQ ID NO: 2722892 - RNA, 16 nt, Haemophilus influenzae Rd
ccugucaauuuuucua

SEQ ID NO: 2722893 - RNA, 22 nt, Haemophilus influenzae Rd
ccugucaguuugcuuugauaaa

SEQ ID NO: 2722894 - RNA, 14 nt, Haemophilus influenzae Rd
ccugucauauaaag

SEQ ID NO: 2722895 - RNA, 14 nt, Haemophilus influenzae Rd
ccugugcauugcua

SEQ ID NO: 2722896 - RNA, 17 nt, Haemophilus influenzae Rd
ccuguugauguuuuaac

SEQ ID NO: 2722897 - RNA, 17 nt, Haemophilus influenzae Rd
ccuguugcgacagauac

SEQ ID NO: 2722898 - RNA, 22 nt, Haemophilus influenzae Rd
ccuguuggaauuucaaaaucca

SEQ ID NO: 2722899 - RNA, 12 nt, Haemophilus influenzae Rd
ccuguuucacaa

SEQ ID NO: 2722900 - RNA, 14 nt, Haemophilus influenzae Rd
ccuguuucacaagu

SEQ ID NO: 2722901 - RNA, 18 nt, Haemophilus influenzae Rd
ccuguuugagcaagaacu

SEQ ID NO: 2722902 - RNA, 18 nt, Haemophilus influenzae Rd
ccuguuugugcacagauu

SEQ ID NO: 2722903 - RNA, 19 nt, Haemophilus influenzae Rd
ccuuaaacaaauguaucug

SEQ ID NO: 2722904 - RNA, 22 nt, Haemophilus influenzae Rd
ccuuaaccaucuuuuuuugcaa

SEQ ID NO: 2722905 - RNA, 19 nt, Haemophilus influenzae Rd
ccuuaaucauugcaagugc

SEQ ID NO: 2722906 - RNA, 21 nt, Haemophilus influenzae Rd
ccuuaauggggcaauuuuuug

SEQ ID NO: 2722907 - RNA, 17 nt, Haemophilus influenzae Rd
ccuuaccgcauuuuuaa

SEQ ID NO: 2722908 - RNA, 16 nt, Haemophilus influenzae Rd
ccuuacugccuuuuuc

SEQ ID NO: 2722909 - RNA, 18 nt, Haemophilus influenzae Rd
ccuuagccaaaucaucua

SEQ ID NO: 2722910 - RNA, 22 nt, Haemophilus influenzae Rd
ccuuauauucagacugaauuug

SEQ ID NO: 2722911 - RNA, 15 nt, Haemophilus influenzae Rd
ccuuaucuucacgau

SEQ ID NO: 2722912 - RNA, 13 nt, Haemophilus influenzae Rd
ccuuauuuuaaau

SEQ ID NO: 2722913 - RNA, 17 nt, Haemophilus influenzae Rd
ccuuauuuuaaauaaaa

SEQ ID NO: 2722914 - RNA, 20 nt, Haemophilus influenzae Rd
ccuuauuuuaaauaaaaaau

SEQ ID NO: 2722915 - RNA, 14 nt, Haemophilus influenzae Rd
ccuuauuuuguguu

SEQ ID NO: 2722916 - RNA, 15 nt, Haemophilus influenzae Rd
ccuucaacauuuuuu

SEQ ID NO: 2722917 - RNA, 13 nt, Haemophilus influenzae Rd
ccuucaagccuug

SEQ ID NO: 2722918 - RNA, 17 nt, Haemophilus influenzae Rd
ccuucaauauagguuaa

SEQ ID NO: 2722919 - RNA, 17 nt, Haemophilus influenzae Rd
ccuucaaugggcaucca

SEQ ID NO: 2722920 - RNA, 17 nt, Haemophilus influenzae Rd
ccuucacaaacccauuu

SEQ ID NO: 2722921 - RNA, 19 nt, Haemophilus influenzae Rd
ccuucacagauuucaauua

SEQ ID NO: 2722922 - RNA, 22 nt, Haemophilus influenzae Rd
ccuucacagauuucaauuaaau

SEQ ID NO: 2722923 - RNA, 16 nt, Haemophilus influenzae Rd
ccuucaccuaauccua

SEQ ID NO: 2722924 - RNA, 22 nt, Haemophilus influenzae Rd
ccuucagccugcucacgaguua

SEQ ID NO: 2722925 - RNA, 14 nt, Haemophilus influenzae Rd
ccuucauauaauaa

SEQ ID NO: 2722926 - RNA, 16 nt, Haemophilus influenzae Rd
ccuucaucgucuucuu

SEQ ID NO: 2722927 - RNA, 22 nt, Haemophilus influenzae Rd
ccuucauugauggaauaaauuu

SEQ ID NO: 2722928 - RNA, 18 nt, Haemophilus influenzae Rd
ccuucgccuucggcuccc

SEQ ID NO: 2722929 - RNA, 16 nt, Haemophilus influenzae Rd
ccuucgcuauuuuucg

SEQ ID NO: 2722930 - RNA, 22 nt, Haemophilus influenzae Rd
ccuucggcauauaagauuuuug

SEQ ID NO: 2722931 - RNA, 17 nt, Haemophilus influenzae Rd
ccuucuaugccaaucac

SEQ ID NO: 2722932 - RNA, 14 nt, Haemophilus influenzae Rd
ccuucuguuuucaa

SEQ ID NO: 2722933 - RNA, 14 nt, Haemophilus influenzae Rd
ccuucuucacuacu

SEQ ID NO: 2722934 - RNA, 21 nt, Haemophilus influenzae Rd
ccuucuucaguaccagucacu

SEQ ID NO: 2722935 - RNA, 20 nt, Haemophilus influenzae Rd
ccuucuuuuauagacuucaa

SEQ ID NO: 2722936 - RNA, 20 nt, Haemophilus influenzae Rd
ccuugaaguuugauuccguu

SEQ ID NO: 2722937 - RNA, 22 nt, Haemophilus influenzae Rd
ccuugaaucauuucaucuacac

SEQ ID NO: 2722938 - RNA, 23 nt, Haemophilus influenzae Rd
ccuugaauugcuuuaauuucuuu

SEQ ID NO: 2722939 - RNA, 21 nt, Haemophilus influenzae Rd
ccuugacauacuuuguugaau

SEQ ID NO: 2722940 - RNA, 15 nt, Haemophilus influenzae Rd
ccuugacauauucug

SEQ ID NO: 2722941 - RNA, 19 nt, Haemophilus influenzae Rd
ccuugagaaauaauauaac

SEQ ID NO: 2722942 - RNA, 13 nt, Haemophilus influenzae Rd
ccuugcaagcagu

SEQ ID NO: 2722943 - RNA, 20 nt, Haemophilus influenzae Rd
ccuugcauaauuccuuuuuc

SEQ ID NO: 2722944 - RNA, 19 nt, Haemophilus influenzae Rd
ccuugcccagcaagggauu

SEQ ID NO: 2722945 - RNA, 13 nt, Haemophilus influenzae Rd
ccuugcgcugcuu

SEQ ID NO: 2722946 - RNA, 15 nt, Haemophilus influenzae Rd
ccuugcgcugcuuua

SEQ ID NO: 2722947 - RNA, 16 nt, Haemophilus influenzae Rd
ccuugcugauaaauuc

SEQ ID NO: 2722948 - RNA, 19 nt, Haemophilus influenzae Rd
ccuugguuuucuugccaaa

SEQ ID NO: 2722949 - RNA, 21 nt, Haemophilus influenzae Rd
ccuuguaaccaagcuguacca

SEQ ID NO: 2722950 - RNA, 18 nt, Haemophilus influenzae Rd
ccuugugcauaaacaaau

SEQ ID NO: 2722951 - RNA, 14 nt, Haemophilus influenzae Rd
ccuuguuacaccuu

SEQ ID NO: 2722952 - RNA, 21 nt, Haemophilus influenzae Rd
ccuuguuccaggaaaauuuua

SEQ ID NO: 2722953 - RNA, 13 nt, Haemophilus influenzae Rd
ccuuguucuucau

SEQ ID NO: 2722954 - RNA, 21 nt, Haemophilus influenzae Rd
ccuuguuuccaaguauuuucu

SEQ ID NO: 2722955 - RNA, 19 nt, Haemophilus influenzae Rd
ccuuuaaggugcagauuaa

SEQ ID NO: 2722956 - RNA, 23 nt, Haemophilus influenzae Rd
ccuuuaaucugucacgagcuaaa

SEQ ID NO: 2722957 - RNA, 17 nt, Haemophilus influenzae Rd
ccuuuacauuuggcaaa

SEQ ID NO: 2722958 - RNA, 22 nt, Haemophilus influenzae Rd
ccuuuacauuuggcaaaauaau

SEQ ID NO: 2722959 - RNA, 20 nt, Haemophilus influenzae Rd
ccuuuacugacuuucuaacu

SEQ ID NO: 2722960 - RNA, 23 nt, Haemophilus influenzae Rd
ccuuuacuuauucguucuuuugg

SEQ ID NO: 2722961 - RNA, 23 nt, Haemophilus influenzae Rd
ccuuuacuuuuuaauaaaucaag

SEQ ID NO: 2722962 - RNA, 20 nt, Haemophilus influenzae Rd
ccuuuagacaacaacuuuuc

SEQ ID NO: 2722963 - RNA, 18 nt, Haemophilus influenzae Rd
ccuuuaugacuauuuuuu

SEQ ID NO: 2722964 - RNA, 24 nt, Haemophilus influenzae Rd
ccuuuauugauccuagauguaacu

SEQ ID NO: 2722965 - RNA, 15 nt, Haemophilus influenzae Rd
ccuuuauuuugcaac

SEQ ID NO: 2722966 - RNA, 15 nt, Haemophilus influenzae Rd
ccuuucaucauugcu

SEQ ID NO: 2722967 - RNA, 13 nt, Haemophilus influenzae Rd
ccuuuccacgccu

SEQ ID NO: 2722968 - RNA, 23 nt, Haemophilus influenzae Rd
ccuuucguaguuaugaugugcuu

SEQ ID NO: 2722969 - RNA, 18 nt, Haemophilus influenzae Rd
ccuuucuggcucugcuga

SEQ ID NO: 2722970 - RNA, 17 nt, Haemophilus influenzae Rd
ccuuugguaaaagaaau

SEQ ID NO: 2722971 - RNA, 20 nt, Haemophilus influenzae Rd
ccuuuguagccauuuucaga

SEQ ID NO: 2722972 - RNA, 17 nt, Haemophilus influenzae Rd
ccuuuguagcgacguuc

SEQ ID NO: 2722973 - RNA, 21 nt, Haemophilus influenzae Rd
ccuuuguugucguuauuauga

SEQ ID NO: 2722974 - RNA, 20 nt, Haemophilus influenzae Rd
ccuuuuaaugcuccauggac

SEQ ID NO: 2722975 - RNA, 21 nt, Haemophilus influenzae Rd
ccuuuuaccaauugauuuuuc

SEQ ID NO: 2722976 - RNA, 23 nt, Haemophilus influenzae Rd
ccuuuuaccaauugauuuuucaa

SEQ ID NO: 2722977 - RNA, 17 nt, Haemophilus influenzae Rd
ccuuuuaguuuccccug

SEQ ID NO: 2722978 - RNA, 15 nt, Haemophilus influenzae Rd
ccuuuuaugaauaug

SEQ ID NO: 2722979 - RNA, 22 nt, Haemophilus influenzae Rd
ccuuuuauuucuuagauuucua

SEQ ID NO: 2722980 - RNA, 16 nt, Haemophilus influenzae Rd
ccuuuucauaaaaauu

SEQ ID NO: 2722981 - RNA, 22 nt, Haemophilus influenzae Rd
ccuuuuguuuuaucagaaugau

SEQ ID NO: 2722982 - RNA, 18 nt, Haemophilus influenzae Rd
ccuuuuuacauuauugaa

SEQ ID NO: 2722983 - RNA, 15 nt, Haemophilus influenzae Rd
ccuuuuuaucuauuu

SEQ ID NO: 2722984 - RNA, 21 nt, Haemophilus influenzae Rd
ccuuuuucagcuaaugcuuua

SEQ ID NO: 2722985 - RNA, 19 nt, Haemophilus influenzae Rd
ccuuuuucuaacacaacuu

SEQ ID NO: 2722986 - RNA, 17 nt, Haemophilus influenzae Rd
ccuuuuucuacuucuuc

SEQ ID NO: 2722987 - RNA, 20 nt, Haemophilus influenzae Rd
ccuuuuuuauaggauuaacg

SEQ ID NO: 2722988 - RNA, 13 nt, Haemophilus influenzae Rd
cgaaaaaaauaaa

SEQ ID NO: 2722989 - RNA, 17 nt, Haemophilus influenzae Rd
cgaaaaaaauaaaaaau

SEQ ID NO: 2722990 - RNA, 13 nt, Haemophilus influenzae Rd
cgaaaacuuucau

SEQ ID NO: 2722991 - RNA, 13 nt, Haemophilus influenzae Rd
cgaaaaggcaaac

SEQ ID NO: 2722992 - RNA, 21 nt, Haemophilus influenzae Rd
cgaaaaucaucauauucacuu

SEQ ID NO: 2722993 - RNA, 18 nt, Haemophilus influenzae Rd
cgaaaauggcuaaauuca

SEQ ID NO: 2722994 - RNA, 17 nt, Haemophilus influenzae Rd
cgaaaauuaagaaaaua

SEQ ID NO: 2722995 - RNA, 21 nt, Haemophilus influenzae Rd
cgaaaauuuaccgcacuuuga

SEQ ID NO: 2722996 - RNA, 17 nt, Haemophilus influenzae Rd
cgaaaauuuugccaauu

SEQ ID NO: 2722997 - RNA, 18 nt, Haemophilus influenzae Rd
cgaaacauaaaaagagag

SEQ ID NO: 2722998 - RNA, 18 nt, Haemophilus influenzae Rd
cgaaaccuuuuucuucca

SEQ ID NO: 2722999 - RNA, 21 nt, Haemophilus influenzae Rd
cgaaaccuuuuucuuccauuu

SEQ ID NO: 2723000 - RNA, 17 nt, Haemophilus influenzae Rd
cgaaaggcgagggauuu

SEQ ID NO: 2723001 - RNA, 20 nt, Haemophilus influenzae Rd
cgaaaggcgagggauuuuaa

SEQ ID NO: 2723002 - RNA, 23 nt, Haemophilus influenzae Rd
cgaaagguguuuuuuuauuaucu

SEQ ID NO: 2723003 - RNA, 14 nt, Haemophilus influenzae Rd
cgaaauaaaucuaa

SEQ ID NO: 2723004 - RNA, 20 nt, Haemophilus influenzae Rd
cgaaauaaccuagaacaaaa

SEQ ID NO: 2723005 - RNA, 19 nt, Haemophilus influenzae Rd
cgaaaucaucgaaaucuaa

SEQ ID NO: 2723006 - RNA, 17 nt, Haemophilus influenzae Rd
cgaaaucgcacucacaa

SEQ ID NO: 2723007 - RNA, 23 nt, Haemophilus influenzae Rd
cgaaaucgcacucacaauaccaa

SEQ ID NO: 2723008 - RNA, 18 nt, Haemophilus influenzae Rd
cgaaaugcggacuuuuuc

SEQ ID NO: 2723009 - RNA, 13 nt, Haemophilus influenzae Rd
cgaaauuaaaaua

SEQ ID NO: 2723010 - RNA, 15 nt, Haemophilus influenzae Rd
cgaaauuaaaauaau

SEQ ID NO: 2723011 - RNA, 23 nt, Haemophilus influenzae Rd
cgaaauuaaaugggacaaagcag

SEQ ID NO: 2723012 - RNA, 21 nt, Haemophilus influenzae Rd
cgaaauuaauuugggugguuu

SEQ ID NO: 2723013 - RNA, 17 nt, Haemophilus influenzae Rd
cgaacaauuucuuuacc

SEQ ID NO: 2723014 - RNA, 16 nt, Haemophilus influenzae Rd
cgaacacgccaccauu

SEQ ID NO: 2723015 - RNA, 17 nt, Haemophilus influenzae Rd
cgaacacuguaaauaaa

SEQ ID NO: 2723016 - RNA, 17 nt, Haemophilus influenzae Rd
cgaacauucccuuucca

SEQ ID NO: 2723017 - RNA, 18 nt, Haemophilus influenzae Rd
cgaaccuuucauauaaau

SEQ ID NO: 2723018 - RNA, 20 nt, Haemophilus influenzae Rd
cgaaccuuucauauaaauaa

SEQ ID NO: 2723019 - RNA, 23 nt, Haemophilus influenzae Rd
cgaacgugggaauuuucccauuu

SEQ ID NO: 2723020 - RNA, 19 nt, Haemophilus influenzae Rd
cgaacguuucaucacuuca

SEQ ID NO: 2723021 - RNA, 18 nt, Haemophilus influenzae Rd
cgaacuggcugagagaag

SEQ ID NO: 2723022 - RNA, 13 nt, Haemophilus influenzae Rd
cgaagauuacuuu

SEQ ID NO: 2723023 - RNA, 19 nt, Haemophilus influenzae Rd
cgaagauuacuuucauaaa

SEQ ID NO: 2723024 - RNA, 22 nt, Haemophilus influenzae Rd
cgaaguugcauaacuucaccaa

SEQ ID NO: 2723025 - RNA, 14 nt, Haemophilus influenzae Rd
cgaauaauacugcu

SEQ ID NO: 2723026 - RNA, 15 nt, Haemophilus influenzae Rd
cgaauaauccuucuu

SEQ ID NO: 2723027 - RNA, 21 nt, Haemophilus influenzae Rd
cgaauacugcgacuuucccug

SEQ ID NO: 2723028 - RNA, 17 nt, Haemophilus influenzae Rd
cgaauagccaaaacgaa

SEQ ID NO: 2723029 - RNA, 16 nt, Haemophilus influenzae Rd
cgaauagcuucugcca

SEQ ID NO: 2723030 - RNA, 23 nt, Haemophilus influenzae Rd
cgaauauaagguaguuuuccuuu

SEQ ID NO: 2723031 - RNA, 17 nt, Haemophilus influenzae Rd
cgaaucgcaaauggaau

SEQ ID NO: 2723032 - RNA, 22 nt, Haemophilus influenzae Rd
cgaauuaaacgugauuuaccaa

SEQ ID NO: 2723033 - RNA, 18 nt, Haemophilus influenzae Rd
cgaauuaaagugcagauu

SEQ ID NO: 2723034 - RNA, 19 nt, Haemophilus influenzae Rd
cgaauuaaagugcagauuu

SEQ ID NO: 2723035 - RNA, 23 nt, Haemophilus influenzae Rd
cgaauuaaagugcagauuuuuuu

SEQ ID NO: 2723036 - RNA, 18 nt, Haemophilus influenzae Rd
cgaauuaguauaaacauc

SEQ ID NO: 2723037 - RNA, 21 nt, Haemophilus influenzae Rd
cgaauugacggugcauuugca

SEQ ID NO: 2723038 - RNA, 13 nt, Haemophilus influenzae Rd
cgaauugcaaugc

SEQ ID NO: 2723039 - RNA, 17 nt, Haemophilus influenzae Rd
cgaauugguucuaaaua

SEQ ID NO: 2723040 - RNA, 23 nt, Haemophilus influenzae Rd
cgaauugguucuaaauauuuuuc

SEQ ID NO: 2723041 - RNA, 23 nt, Haemophilus influenzae Rd
cgacaaguuugauccacaaauaa

SEQ ID NO: 2723042 - RNA, 21 nt, Haemophilus influenzae Rd
cgacacacuauuaauuacuuu

SEQ ID NO: 2723043 - RNA, 24 nt, Haemophilus influenzae Rd
cgacacuaaaaagcccaaaugcaa

SEQ ID NO: 2723044 - RNA, 23 nt, Haemophilus influenzae Rd
cgacaucaaucaaauucaacacg

SEQ ID NO: 2723045 - RNA, 19 nt, Haemophilus influenzae Rd
cgacauuaagugcaucaac

SEQ ID NO: 2723046 - RNA, 12 nt, Haemophilus influenzae Rd
cgaccaccaaug

SEQ ID NO: 2723047 - RNA, 14 nt, Haemophilus influenzae Rd
cgaccauuaaaucc

SEQ ID NO: 2723048 - RNA, 18 nt, Haemophilus influenzae Rd
cgaccauuacagcaagca

SEQ ID NO: 2723049 - RNA, 20 nt, Haemophilus influenzae Rd
cgaccguauugucugcaacg

SEQ ID NO: 2723050 - RNA, 22 nt, Haemophilus influenzae Rd
cgaccguuuuuucuuuuuccug

SEQ ID NO: 2723051 - RNA, 11 nt, Haemophilus influenzae Rd
cgaccugaaga

SEQ ID NO: 2723052 - RNA, 14 nt, Haemophilus influenzae Rd
cgaccuugcaaauu

SEQ ID NO: 2723053 - RNA, 18 nt, Haemophilus influenzae Rd
cgacgcaagguauuuuuu

SEQ ID NO: 2723054 - RNA, 18 nt, Haemophilus influenzae Rd
cgacgcugcaaaaugaac

SEQ ID NO: 2723055 - RNA, 20 nt, Haemophilus influenzae Rd
cgacguggacgaccuguuac

SEQ ID NO: 2723056 - RNA, 23 nt, Haemophilus influenzae Rd
cgacuaauuuuuuaauuuuuucu

SEQ ID NO: 2723057 - RNA, 19 nt, Haemophilus influenzae Rd
cgacucaccgcaauaauac

SEQ ID NO: 2723058 - RNA, 20 nt, Haemophilus influenzae Rd
cgacuuuguuucuaaaaaug

SEQ ID NO: 2723059 - RNA, 19 nt, Haemophilus influenzae Rd
cgagaaaauuaaaaauuua

SEQ ID NO: 2723060 - RNA, 17 nt, Haemophilus influenzae Rd
cgagaaacuuucaaaau

SEQ ID NO: 2723061 - RNA, 18 nt, Haemophilus influenzae Rd
cgagaaagguguaauucc

SEQ ID NO: 2723062 - RNA, 17 nt, Haemophilus influenzae Rd
cgagaaccaaaacgcaa

SEQ ID NO: 2723063 - RNA, 23 nt, Haemophilus influenzae Rd
cgagaacgagccucaucuaaggu

SEQ ID NO: 2723064 - RNA, 22 nt, Haemophilus influenzae Rd
cgagaaguuaaaccugccaacg

SEQ ID NO: 2723065 - RNA, 18 nt, Haemophilus influenzae Rd
cgagaauuaccacaagau

SEQ ID NO: 2723066 - RNA, 16 nt, Haemophilus influenzae Rd
cgagacauuauuuuua

SEQ ID NO: 2723067 - RNA, 12 nt, Haemophilus influenzae Rd
cgagauaaaauu

SEQ ID NO: 2723068 - RNA, 15 nt, Haemophilus influenzae Rd
cgagauaaaauuuuu

SEQ ID NO: 2723069 - RNA, 17 nt, Haemophilus influenzae Rd
cgagcaacuuggaaugc

SEQ ID NO: 2723070 - RNA, 20 nt, Haemophilus influenzae Rd
cgagcauagaucgcaagggc

SEQ ID NO: 2723071 - RNA, 17 nt, Haemophilus influenzae Rd
cgagcgacugauucuuc

SEQ ID NO: 2723072 - RNA, 16 nt, Haemophilus influenzae Rd
cgagcgagaccacuuu

SEQ ID NO: 2723073 - RNA, 16 nt, Haemophilus influenzae Rd
cgagcuacauggauuu

SEQ ID NO: 2723074 - RNA, 20 nt, Haemophilus influenzae Rd
cgagcucuuucauuaaauua

SEQ ID NO: 2723075 - RNA, 22 nt, Haemophilus influenzae Rd
cgagcuggcaucaucauuuuuu

SEQ ID NO: 2723076 - RNA, 18 nt, Haemophilus influenzae Rd
cgagcuuagauaagaaaa

SEQ ID NO: 2723077 - RNA, 23 nt, Haemophilus influenzae Rd
cgaggcuuuuuuuauaguuuuau

SEQ ID NO: 2723078 - RNA, 20 nt, Haemophilus influenzae Rd
cgaggguucgaaucccucuc

SEQ ID NO: 2723079 - RNA, 16 nt, Haemophilus influenzae Rd
cgagguaagcugaagu

SEQ ID NO: 2723080 - RNA, 14 nt, Haemophilus influenzae Rd
cgagguuuucguau

SEQ ID NO: 2723081 - RNA, 21 nt, Haemophilus influenzae Rd
cgaguaaaaaaucuaucccaa

SEQ ID NO: 2723082 - RNA, 17 nt, Haemophilus influenzae Rd
cgaguaaaaauaaaaug

SEQ ID NO: 2723083 - RNA, 17 nt, Haemophilus influenzae Rd
cgaguaaaauaaaaagg

SEQ ID NO: 2723084 - RNA, 19 nt, Haemophilus influenzae Rd
cgaguaaauuaauuuagag

SEQ ID NO: 2723085 - RNA, 16 nt, Haemophilus influenzae Rd
cgaguaaauucaccaa

SEQ ID NO: 2723086 - RNA, 15 nt, Haemophilus influenzae Rd
cgaguaaauuuagag

SEQ ID NO: 2723087 - RNA, 22 nt, Haemophilus influenzae Rd
cgaguaagggcaaaaaaucuuu

SEQ ID NO: 2723088 - RNA, 17 nt, Haemophilus influenzae Rd
cgaguacgaaauacgca

SEQ ID NO: 2723089 - RNA, 18 nt, Haemophilus influenzae Rd
cgaguagugauugcgccg

SEQ ID NO: 2723090 - RNA, 16 nt, Haemophilus influenzae Rd
cgaguggcggacgggu

SEQ ID NO: 2723091 - RNA, 13 nt, Haemophilus influenzae Rd
cgaguuaaguaag

SEQ ID NO: 2723092 - RNA, 13 nt, Haemophilus influenzae Rd
cgaguugauuaau

SEQ ID NO: 2723093 - RNA, 18 nt, Haemophilus influenzae Rd
cgaguuugucaugacuau

SEQ ID NO: 2723094 - RNA, 17 nt, Haemophilus influenzae Rd
cgauaaaaaagccacca

SEQ ID NO: 2723095 - RNA, 15 nt, Haemophilus influenzae Rd
cgauaaaaucuugcu

SEQ ID NO: 2723096 - RNA, 10 nt, Haemophilus influenzae Rd
cgauaaacau

SEQ ID NO: 2723097 - RNA, 11 nt, Haemophilus influenzae Rd
cgauaaacauu

SEQ ID NO: 2723098 - RNA, 17 nt, Haemophilus influenzae Rd
cgauaaacauuuuuuca

SEQ ID NO: 2723099 - RNA, 17 nt, Haemophilus influenzae Rd
cgauaaauucaaucgcu

SEQ ID NO: 2723100 - RNA, 22 nt, Haemophilus influenzae Rd
cgauaacaauuuuugcauuuuc

SEQ ID NO: 2723101 - RNA, 12 nt, Haemophilus influenzae Rd
cgauaacacccu

SEQ ID NO: 2723102 - RNA, 16 nt, Haemophilus influenzae Rd
cgauaagcgguuguac

SEQ ID NO: 2723103 - RNA, 18 nt, Haemophilus influenzae Rd
cgauaaguccaucacuuu

SEQ ID NO: 2723104 - RNA, 23 nt, Haemophilus influenzae Rd
cgauaauagacauagaaaguuua

SEQ ID NO: 2723105 - RNA, 14 nt, Haemophilus influenzae Rd
cgauaccacauucc

SEQ ID NO: 2723106 - RNA, 15 nt, Haemophilus influenzae Rd
cgauaccacauucca

SEQ ID NO: 2723107 - RNA, 18 nt, Haemophilus influenzae Rd
cgauacggcaaauuaaau

SEQ ID NO: 2723108 - RNA, 14 nt, Haemophilus influenzae Rd
cgauagaaauaaag

SEQ ID NO: 2723109 - RNA, 19 nt, Haemophilus influenzae Rd
cgauagcggcgaauguggc

SEQ ID NO: 2723110 - RNA, 15 nt, Haemophilus influenzae Rd
cgauaguaaaaaauc

SEQ ID NO: 2723111 - RNA, 20 nt, Haemophilus influenzae Rd
cgauaguaaaaaaucaagcc

SEQ ID NO: 2723112 - RNA, 22 nt, Haemophilus influenzae Rd
cgauaguggcaccgaauguggc

SEQ ID NO: 2723113 - RNA, 23 nt, Haemophilus influenzae Rd
cgauaguggcaccgaauguggca

SEQ ID NO: 2723114 - RNA, 20 nt, Haemophilus influenzae Rd
cgauauauuguaguaauaaa

SEQ ID NO: 2723115 - RNA, 16 nt, Haemophilus influenzae Rd
cgauauuuaagucuaa

SEQ ID NO: 2723116 - RNA, 17 nt, Haemophilus influenzae Rd
cgauauuucgcacgugc

SEQ ID NO: 2723117 - RNA, 19 nt, Haemophilus influenzae Rd
cgauauuuguguaacagcu

SEQ ID NO: 2723118 - RNA, 19 nt, Haemophilus influenzae Rd
cgauauuuuuaucaauaac

SEQ ID NO: 2723119 - RNA, 20 nt, Haemophilus influenzae Rd
cgauauuuuuaucaauaacu

SEQ ID NO: 2723120 - RNA, 14 nt, Haemophilus influenzae Rd
cgauauuuuuucag

SEQ ID NO: 2723121 - RNA, 14 nt, Haemophilus influenzae Rd
cgaucaaauuguca

SEQ ID NO: 2723122 - RNA, 17 nt, Haemophilus influenzae Rd
cgaucacgauuuuucuc

SEQ ID NO: 2723123 - RNA, 14 nt, Haemophilus influenzae Rd
cgaucaucauuaaa

SEQ ID NO: 2723124 - RNA, 13 nt, Haemophilus influenzae Rd
cgauccuaaaaaa

SEQ ID NO: 2723125 - RNA, 19 nt, Haemophilus influenzae Rd
cgaucuauaagaaaauuau

SEQ ID NO: 2723126 - RNA, 22 nt, Haemophilus influenzae Rd
cgaucuauauucguuaaauaau

SEQ ID NO: 2723127 - RNA, 14 nt, Haemophilus influenzae Rd
cgaucugcacuuua

SEQ ID NO: 2723128 - RNA, 20 nt, Haemophilus influenzae Rd
cgaucuggguuuacaucuug

SEQ ID NO: 2723129 - RNA, 21 nt, Haemophilus influenzae Rd
cgaucuuuagcuaaugcaaaa

SEQ ID NO: 2723130 - RNA, 13 nt, Haemophilus influenzae Rd
cgaugaagaaaau

SEQ ID NO: 2723131 - RNA, 12 nt, Haemophilus influenzae Rd
cgaugaauaauu

SEQ ID NO: 2723132 - RNA, 16 nt, Haemophilus influenzae Rd
cgaugacuaaacaaau

SEQ ID NO: 2723133 - RNA, 16 nt, Haemophilus influenzae Rd
cgaugaugcaggaaag

SEQ ID NO: 2723134 - RNA, 22 nt, Haemophilus influenzae Rd
cgaugcauugauugcuuuaacu

SEQ ID NO: 2723135 - RNA, 17 nt, Haemophilus influenzae Rd
cgaugccgaaugaagaa

SEQ ID NO: 2723136 - RNA, 19 nt, Haemophilus influenzae Rd
cgaugcggucggcgaguug

SEQ ID NO: 2723137 - RNA, 22 nt, Haemophilus influenzae Rd
cgauggaaaugaguaaaccgau

SEQ ID NO: 2723138 - RNA, 23 nt, Haemophilus influenzae Rd
cgauggaaaugaguaaaccgauu

SEQ ID NO: 2723139 - RNA, 19 nt, Haemophilus influenzae Rd
cgaugucuaaaugugccca

SEQ ID NO: 2723140 - RNA, 14 nt, Haemophilus influenzae Rd
cgaugugcauugaa

SEQ ID NO: 2723141 - RNA, 14 nt, Haemophilus influenzae Rd
cgauguugcaaccu

SEQ ID NO: 2723142 - RNA, 19 nt, Haemophilus influenzae Rd
cgauuaauaccaauaauaa

SEQ ID NO: 2723143 - RNA, 11 nt, Haemophilus influenzae Rd
cgauuaauaua

SEQ ID NO: 2723144 - RNA, 22 nt, Haemophilus influenzae Rd
cgauuaaucgaaguaugaaaac

SEQ ID NO: 2723145 - RNA, 13 nt, Haemophilus influenzae Rd
cgauuacaaaaac

SEQ ID NO: 2723146 - RNA, 14 nt, Haemophilus influenzae Rd
cgauuacaaaaaca

SEQ ID NO: 2723147 - RNA, 15 nt, Haemophilus influenzae Rd
cgauugcauuuuuua

SEQ ID NO: 2723148 - RNA, 19 nt, Haemophilus influenzae Rd
cgauugcauuuuuuauaaa

SEQ ID NO: 2723149 - RNA, 23 nt, Haemophilus influenzae Rd
cgauugcucguuauuauuaagug

SEQ ID NO: 2723150 - RNA, 17 nt, Haemophilus influenzae Rd
cgauuguugcaucguga

SEQ ID NO: 2723151 - RNA, 20 nt, Haemophilus influenzae Rd
cgauuuacgccaagacagua

SEQ ID NO: 2723152 - RNA, 17 nt, Haemophilus influenzae Rd
cgauuucgugcaauaac

SEQ ID NO: 2723153 - RNA, 18 nt, Haemophilus influenzae Rd
cgauuugcuauccaaccu

SEQ ID NO: 2723154 - RNA, 12 nt, Haemophilus influenzae Rd
cgauuuggauuu

SEQ ID NO: 2723155 - RNA, 11 nt, Haemophilus influenzae Rd
cgauuuuaaau

SEQ ID NO: 2723156 - RNA, 17 nt, Haemophilus influenzae Rd
cgauuuuaaauucuccc

SEQ ID NO: 2723157 - RNA, 17 nt, Haemophilus influenzae Rd
cgauuuugacuuuugcc

SEQ ID NO: 2723158 - RNA, 13 nt, Haemophilus influenzae Rd
cgauuuuucucua

SEQ ID NO: 2723159 - RNA, 14 nt, Haemophilus influenzae Rd
cgauuuuucucuag

SEQ ID NO: 2723160 - RNA, 20 nt, Haemophilus influenzae Rd
cgauuuuuuuauaaaaaaac

SEQ ID NO: 2723161 - RNA, 14 nt, Haemophilus influenzae Rd
cgcaaaaauacuaa

SEQ ID NO: 2723162 - RNA, 23 nt, Haemophilus influenzae Rd
cgcaaaagugcggucaauuuuuc

SEQ ID NO: 2723163 - RNA, 14 nt, Haemophilus influenzae Rd
cgcaaauacuucac

SEQ ID NO: 2723164 - RNA, 17 nt, Haemophilus influenzae Rd
cgcaaccagcagaaaau

SEQ ID NO: 2723165 - RNA, 16 nt, Haemophilus influenzae Rd
cgcaaccguaauaauu

SEQ ID NO: 2723166 - RNA, 17 nt, Haemophilus influenzae Rd
cgcaacuaaauucaauu

SEQ ID NO: 2723167 - RNA, 23 nt, Haemophilus influenzae Rd
cgcaacuguuuuuuguccgccac

SEQ ID NO: 2723168 - RNA, 15 nt, Haemophilus influenzae Rd
cgcaagcaccaaagc

SEQ ID NO: 2723169 - RNA, 20 nt, Haemophilus influenzae Rd
cgcaagguauuuuuuuuaaa

SEQ ID NO: 2723170 - RNA, 13 nt, Haemophilus influenzae Rd
cgcaaguucuuca

SEQ ID NO: 2723171 - RNA, 20 nt, Haemophilus influenzae Rd
cgcaauauaggcuauauuuu

SEQ ID NO: 2723172 - RNA, 15 nt, Haemophilus influenzae Rd
cgcaaugaagauuaa

SEQ ID NO: 2723173 - RNA, 20 nt, Haemophilus influenzae Rd
cgcaaugaagauuaacucag

SEQ ID NO: 2723174 - RNA, 21 nt, Haemophilus influenzae Rd
cgcacaccaccugaugcuuua

SEQ ID NO: 2723175 - RNA, 14 nt, Haemophilus influenzae Rd
cgcaccaauaacag

SEQ ID NO: 2723176 - RNA, 12 nt, Haemophilus influenzae Rd
cgcaccacacaa

SEQ ID NO: 2723177 - RNA, 12 nt, Haemophilus influenzae Rd
cgcaccgcuucu

SEQ ID NO: 2723178 - RNA, 22 nt, Haemophilus influenzae Rd
cgcacgcauauuaguuaguuuu

SEQ ID NO: 2723179 - RNA, 20 nt, Haemophilus influenzae Rd
cgcacggaugaguucauuuu

SEQ ID NO: 2723180 - RNA, 13 nt, Haemophilus influenzae Rd
cgcacuuuauuau

SEQ ID NO: 2723181 - RNA, 21 nt, Haemophilus influenzae Rd
cgcacuuucagagaaaacuca

SEQ ID NO: 2723182 - RNA, 14 nt, Haemophilus influenzae Rd
cgcacuuucgccuu

SEQ ID NO: 2723183 - RNA, 20 nt, Haemophilus influenzae Rd
cgcacuuucgccuucauaag

SEQ ID NO: 2723184 - RNA, 16 nt, Haemophilus influenzae Rd
cgcacuuucuucuuuu

SEQ ID NO: 2723185 - RNA, 20 nt, Haemophilus influenzae Rd
cgcacuuuuaucuauaaaaa

SEQ ID NO: 2723186 - RNA, 14 nt, Haemophilus influenzae Rd
cgcacuuuuauugc

SEQ ID NO: 2723187 - RNA, 17 nt, Haemophilus influenzae Rd
cgcacuuuuguauuuua

SEQ ID NO: 2723188 - RNA, 17 nt, Haemophilus influenzae Rd
cgcacuuuuuauuuuuc

SEQ ID NO: 2723189 - RNA, 23 nt, Haemophilus influenzae Rd
cgcacuuuuuuguuuucaggaua

SEQ ID NO: 2723190 - RNA, 14 nt, Haemophilus influenzae Rd
cgcacuuuuuuucu

SEQ ID NO: 2723191 - RNA, 14 nt, Haemophilus influenzae Rd
cgcagacugcauau

SEQ ID NO: 2723192 - RNA, 16 nt, Haemophilus influenzae Rd
cgcagcaccaaagaaa

SEQ ID NO: 2723193 - RNA, 14 nt, Haemophilus influenzae Rd
cgcagccacuugcg

SEQ ID NO: 2723194 - RNA, 22 nt, Haemophilus influenzae Rd
cgcaggauaagaugauaaauuc

SEQ ID NO: 2723195 - RNA, 16 nt, Haemophilus influenzae Rd
cgcagguucgaguccc

SEQ ID NO: 2723196 - RNA, 20 nt, Haemophilus influenzae Rd
cgcaguauucgggcuucuca

SEQ ID NO: 2723197 - RNA, 20 nt, Haemophilus influenzae Rd
cgcagugaucccagcauaaa

SEQ ID NO: 2723198 - RNA, 14 nt, Haemophilus influenzae Rd
cgcauaaccauucc

SEQ ID NO: 2723199 - RNA, 16 nt, Haemophilus influenzae Rd
cgcauaauacuugaca

SEQ ID NO: 2723200 - RNA, 13 nt, Haemophilus influenzae Rd
cgcauaggccuca

SEQ ID NO: 2723201 - RNA, 21 nt, Haemophilus influenzae Rd
cgcauaucacgauaagcaacc

SEQ ID NO: 2723202 - RNA, 23 nt, Haemophilus influenzae Rd
cgcauauuaguuaguuuuuuacc

SEQ ID NO: 2723203 - RNA, 18 nt, Haemophilus influenzae Rd
cgcauauuuuguucuaca

SEQ ID NO: 2723204 - RNA, 22 nt, Haemophilus influenzae Rd
cgcauauuuuugcaagauuuuu

SEQ ID NO: 2723205 - RNA, 20 nt, Haemophilus influenzae Rd
cgcaucaacaacuaaauaag

SEQ ID NO: 2723206 - RNA, 17 nt, Haemophilus influenzae Rd
cgcaucaaucacagcac

SEQ ID NO: 2723207 - RNA, 15 nt, Haemophilus influenzae Rd
cgcaucaccacaaaa

SEQ ID NO: 2723208 - RNA, 16 nt, Haemophilus influenzae Rd
cgcaucauucaaugca

SEQ ID NO: 2723209 - RNA, 21 nt, Haemophilus influenzae Rd
cgcaucgcccaauuuggcaaa

SEQ ID NO: 2723210 - RNA, 14 nt, Haemophilus influenzae Rd
cgcaucuuuuucug

SEQ ID NO: 2723211 - RNA, 20 nt, Haemophilus influenzae Rd
cgcaugcggaauaauuuucc

SEQ ID NO: 2723212 - RNA, 15 nt, Haemophilus influenzae Rd
cgcauugcguaaaug

SEQ ID NO: 2723213 - RNA, 18 nt, Haemophilus influenzae Rd
cgcauuguuaucuaaaua

SEQ ID NO: 2723214 - RNA, 14 nt, Haemophilus influenzae Rd
cgcauuuuuauuag

SEQ ID NO: 2723215 - RNA, 14 nt, Haemophilus influenzae Rd
cgcauuuuuuuauu

SEQ ID NO: 2723216 - RNA, 17 nt, Haemophilus influenzae Rd
cgccaacguaagcacca

SEQ ID NO: 2723217 - RNA, 17 nt, Haemophilus influenzae Rd
cgccaagaauaaaaugu

SEQ ID NO: 2723218 - RNA, 17 nt, Haemophilus influenzae Rd
cgccaagcgcugcagua

SEQ ID NO: 2723219 - RNA, 21 nt, Haemophilus influenzae Rd
cgccaaguccccauuuguaga

SEQ ID NO: 2723220 - RNA, 20 nt, Haemophilus influenzae Rd
cgccaauacaaaguguagca

SEQ ID NO: 2723221 - RNA, 22 nt, Haemophilus influenzae Rd
cgccaaucauacuaaauacauu

SEQ ID NO: 2723222 - RNA, 19 nt, Haemophilus influenzae Rd
cgccaaucuaagccuaagc

SEQ ID NO: 2723223 - RNA, 22 nt, Haemophilus influenzae Rd
cgccaauguuugguauaaauaa

SEQ ID NO: 2723224 - RNA, 19 nt, Haemophilus influenzae Rd
cgccacgguaaaucugauu

SEQ ID NO: 2723225 - RNA, 18 nt, Haemophilus influenzae Rd
cgccacguagauacauaa

SEQ ID NO: 2723226 - RNA, 14 nt, Haemophilus influenzae Rd
cgccagcagugcca

SEQ ID NO: 2723227 - RNA, 16 nt, Haemophilus influenzae Rd
cgccagucacuucuuc

SEQ ID NO: 2723228 - RNA, 18 nt, Haemophilus influenzae Rd
cgccauaaacgcaccaca

SEQ ID NO: 2723229 - RNA, 14 nt, Haemophilus influenzae Rd
cgccauaauaaaaa

SEQ ID NO: 2723230 - RNA, 14 nt, Haemophilus influenzae Rd
cgccaucaauuuuu

SEQ ID NO: 2723231 - RNA, 22 nt, Haemophilus influenzae Rd
cgccauuaaaauucacgggcaa

SEQ ID NO: 2723232 - RNA, 16 nt, Haemophilus influenzae Rd
cgccauucuuuauucg

SEQ ID NO: 2723233 - RNA, 16 nt, Haemophilus influenzae Rd
cgccauugaaaggguu

SEQ ID NO: 2723234 - RNA, 16 nt, Haemophilus influenzae Rd
cgccauuuuuaaaaau

SEQ ID NO: 2723235 - RNA, 20 nt, Haemophilus influenzae Rd
cgcccaacagauuuaauacc

SEQ ID NO: 2723236 - RNA, 14 nt, Haemophilus influenzae Rd
cgcccucgccuugc

SEQ ID NO: 2723237 - RNA, 16 nt, Haemophilus influenzae Rd
cgcccucgccuugcaa

SEQ ID NO: 2723238 - RNA, 22 nt, Haemophilus influenzae Rd
cgcccuuucgggcguuauuuuu

SEQ ID NO: 2723239 - RNA, 21 nt, Haemophilus influenzae Rd
cgccguauugaauaauuacuu

SEQ ID NO: 2723240 - RNA, 14 nt, Haemophilus influenzae Rd
cgccuaaccaagcc

SEQ ID NO: 2723241 - RNA, 16 nt, Haemophilus influenzae Rd
cgccuaauucuugcca

SEQ ID NO: 2723242 - RNA, 15 nt, Haemophilus influenzae Rd
cgccuacaugaucac

SEQ ID NO: 2723243 - RNA, 14 nt, Haemophilus influenzae Rd
cgccuagcacuuca

SEQ ID NO: 2723244 - RNA, 15 nt, Haemophilus influenzae Rd
cgccucagcaauuuu

SEQ ID NO: 2723245 - RNA, 15 nt, Haemophilus influenzae Rd
cgccucaucuuuuuu

SEQ ID NO: 2723246 - RNA, 18 nt, Haemophilus influenzae Rd
cgccugaucguacacuuc

SEQ ID NO: 2723247 - RNA, 15 nt, Haemophilus influenzae Rd
cgccugguucguuug

SEQ ID NO: 2723248 - RNA, 12 nt, Haemophilus influenzae Rd
cgccuucuucca

SEQ ID NO: 2723249 - RNA, 20 nt, Haemophilus influenzae Rd
cgccuuggaucguuuucucg

SEQ ID NO: 2723250 - RNA, 11 nt, Haemophilus influenzae Rd
cgccuuuauug

SEQ ID NO: 2723251 - RNA, 15 nt, Haemophilus influenzae Rd
cgccuuuuaauaaau

SEQ ID NO: 2723252 - RNA, 20 nt, Haemophilus influenzae Rd
cgcgaauaucuggauguugu

SEQ ID NO: 2723253 - RNA, 15 nt, Haemophilus influenzae Rd
cgcgacuaaaucuua

SEQ ID NO: 2723254 - RNA, 16 nt, Haemophilus influenzae Rd
cgcgagauacuauauu

SEQ ID NO: 2723255 - RNA, 14 nt, Haemophilus influenzae Rd
cgcgaguaaaauaa

SEQ ID NO: 2723256 - RNA, 12 nt, Haemophilus influenzae Rd
cgcgauaaagag

SEQ ID NO: 2723257 - RNA, 14 nt, Haemophilus influenzae Rd
cgcgaugcauugau

SEQ ID NO: 2723258 - RNA, 14 nt, Haemophilus influenzae Rd
cgcgcacauacuuc

SEQ ID NO: 2723259 - RNA, 15 nt, Haemophilus influenzae Rd
cgcguaaaguuuuaa

SEQ ID NO: 2723260 - RNA, 14 nt, Haemophilus influenzae Rd
cgcgugaugaaaca

SEQ ID NO: 2723261 - RNA, 13 nt, Haemophilus influenzae Rd
cgcuaauuugcgg

SEQ ID NO: 2723262 - RNA, 22 nt, Haemophilus influenzae Rd
cgcuaucuuuugguaaauacug

SEQ ID NO: 2723263 - RNA, 12 nt, Haemophilus influenzae Rd
cgcuauuucacu

SEQ ID NO: 2723264 - RNA, 17 nt, Haemophilus influenzae Rd
cgcuauuuucuaaugaa

SEQ ID NO: 2723265 - RNA, 23 nt, Haemophilus influenzae Rd
cgcucaaauaaauugcccucugc

SEQ ID NO: 2723266 - RNA, 19 nt, Haemophilus influenzae Rd
cgcucaacuuaaacaagcu

SEQ ID NO: 2723267 - RNA, 23 nt, Haemophilus influenzae Rd
cgcucaauaaggugcuaauuaaa

SEQ ID NO: 2723268 - RNA, 19 nt, Haemophilus influenzae Rd
cgcucaggaaaacguucau

SEQ ID NO: 2723269 - RNA, 15 nt, Haemophilus influenzae Rd
cgcucaucguaucaa

SEQ ID NO: 2723270 - RNA, 15 nt, Haemophilus influenzae Rd
cgcucugcaccuuca

SEQ ID NO: 2723271 - RNA, 15 nt, Haemophilus influenzae Rd
cgcucuucagcuucu

SEQ ID NO: 2723272 - RNA, 21 nt, Haemophilus influenzae Rd
cgcugaaaugaaguaauaauc

SEQ ID NO: 2723273 - RNA, 18 nt, Haemophilus influenzae Rd
cgcugacuuaaugcaaaa

SEQ ID NO: 2723274 - RNA, 20 nt, Haemophilus influenzae Rd
cgcugauucuaaugccauug

SEQ ID NO: 2723275 - RNA, 14 nt, Haemophilus influenzae Rd
cgcugcaaaaugaa

SEQ ID NO: 2723276 - RNA, 17 nt, Haemophilus influenzae Rd
cgcugcaaaaugaacag

SEQ ID NO: 2723277 - RNA, 20 nt, Haemophilus influenzae Rd
cgcugcaacaaauaaaucau

SEQ ID NO: 2723278 - RNA, 16 nt, Haemophilus influenzae Rd
cgcugcagcugcugcu

SEQ ID NO: 2723279 - RNA, 16 nt, Haemophilus influenzae Rd
cgcuggaacuucuaaa

SEQ ID NO: 2723280 - RNA, 19 nt, Haemophilus influenzae Rd
cgcugggauuuugucacca

SEQ ID NO: 2723281 - RNA, 13 nt, Haemophilus influenzae Rd
cgcuguaacauca

SEQ ID NO: 2723282 - RNA, 14 nt, Haemophilus influenzae Rd
cgcuguauugggac

SEQ ID NO: 2723283 - RNA, 20 nt, Haemophilus influenzae Rd
cgcuguccaauaauuaaacu

SEQ ID NO: 2723284 - RNA, 20 nt, Haemophilus influenzae Rd
cgcuguccaauauaaacguu

SEQ ID NO: 2723285 - RNA, 14 nt, Haemophilus influenzae Rd
cgcuguuacuucuu

SEQ ID NO: 2723286 - RNA, 19 nt, Haemophilus influenzae Rd
cgcuuaggcguucuaaagc

SEQ ID NO: 2723287 - RNA, 13 nt, Haemophilus influenzae Rd
cgcuucagcaagg

SEQ ID NO: 2723288 - RNA, 22 nt, Haemophilus influenzae Rd
cgcuuccauagcacguaaugca

SEQ ID NO: 2723289 - RNA, 19 nt, Haemophilus influenzae Rd
cgcuucuuuaacuugcucu

SEQ ID NO: 2723290 - RNA, 16 nt, Haemophilus influenzae Rd
cgcuugaauaaauccc

SEQ ID NO: 2723291 - RNA, 18 nt, Haemophilus influenzae Rd
cgcuugacgcauuaauug

SEQ ID NO: 2723292 - RNA, 20 nt, Haemophilus influenzae Rd
cgcuugccagucauuuuuua

SEQ ID NO: 2723293 - RNA, 17 nt, Haemophilus influenzae Rd
cgcuugggcuuuuucaa

SEQ ID NO: 2723294 - RNA, 18 nt, Haemophilus influenzae Rd
cgcuuguaauuucauuuu

SEQ ID NO: 2723295 - RNA, 21 nt, Haemophilus influenzae Rd
cgcuuguuaauacacuuuuac

SEQ ID NO: 2723296 - RNA, 12 nt, Haemophilus influenzae Rd
cgcuuuaauaau

SEQ ID NO: 2723297 - RNA, 16 nt, Haemophilus influenzae Rd
cgcuuucaauuuucug

SEQ ID NO: 2723298 - RNA, 17 nt, Haemophilus influenzae Rd
cgcuuucaauuuucugu

SEQ ID NO: 2723299 - RNA, 23 nt, Haemophilus influenzae Rd
cgcuuucauaaauucaucuucug

SEQ ID NO: 2723300 - RNA, 15 nt, Haemophilus influenzae Rd
cgcuuugagaaagaa

SEQ ID NO: 2723301 - RNA, 15 nt, Haemophilus influenzae Rd
cgcuuuugcauugag

SEQ ID NO: 2723302 - RNA, 12 nt, Haemophilus influenzae Rd
cgcuuuuuccuc

SEQ ID NO: 2723303 - RNA, 14 nt, Haemophilus influenzae Rd
cgcuuuuuccucag

SEQ ID NO: 2723304 - RNA, 16 nt, Haemophilus influenzae Rd
cgcuuuuuccucagca

SEQ ID NO: 2723305 - RNA, 19 nt, Haemophilus influenzae Rd
cgcuuuuuucgcaccaaug

SEQ ID NO: 2723306 - RNA, 12 nt, Haemophilus influenzae Rd
cggaaaaauucg

SEQ ID NO: 2723307 - RNA, 11 nt, Haemophilus influenzae Rd
cggaaaauaau

SEQ ID NO: 2723308 - RNA, 14 nt, Haemophilus influenzae Rd
cggaaaccagcuuu

SEQ ID NO: 2723309 - RNA, 18 nt, Haemophilus influenzae Rd
cggaaauauuuuaauaga

SEQ ID NO: 2723310 - RNA, 19 nt, Haemophilus influenzae Rd
cggaauuauguauuuuacg

SEQ ID NO: 2723311 - RNA, 23 nt, Haemophilus influenzae Rd
cggauacccauugaggaaaguuc

SEQ ID NO: 2723312 - RNA, 13 nt, Haemophilus influenzae Rd
cggauuaacacau

SEQ ID NO: 2723313 - RNA, 14 nt, Haemophilus influenzae Rd
cggauuaacacauc

SEQ ID NO: 2723314 - RNA, 16 nt, Haemophilus influenzae Rd
cggauuaagugcgguc

SEQ ID NO: 2723315 - RNA, 15 nt, Haemophilus influenzae Rd
cggauuaauuucucg

SEQ ID NO: 2723316 - RNA, 13 nt, Haemophilus influenzae Rd
cggauugcagaac

SEQ ID NO: 2723317 - RNA, 15 nt, Haemophilus influenzae Rd
cggauuuauuauuua

SEQ ID NO: 2723318 - RNA, 15 nt, Haemophilus influenzae Rd
cggauuuguuaagua

SEQ ID NO: 2723319 - RNA, 16 nt, Haemophilus influenzae Rd
cggcaaccaaguauca

SEQ ID NO: 2723320 - RNA, 19 nt, Haemophilus influenzae Rd
cggcaagcaaacagcaaua

SEQ ID NO: 2723321 - RNA, 21 nt, Haemophilus influenzae Rd
cggcaagcaaacagcaauaaa

SEQ ID NO: 2723322 - RNA, 19 nt, Haemophilus influenzae Rd
cggcaagccacauacgcaa

SEQ ID NO: 2723323 - RNA, 24 nt, Haemophilus influenzae Rd
cggcaauccacgccccaacauagc

SEQ ID NO: 2723324 - RNA, 19 nt, Haemophilus influenzae Rd
cggcaaugguuaauacaaa

SEQ ID NO: 2723325 - RNA, 14 nt, Haemophilus influenzae Rd
cggcacauaaauca

SEQ ID NO: 2723326 - RNA, 19 nt, Haemophilus influenzae Rd
cggcacgguuucugccgcg

SEQ ID NO: 2723327 - RNA, 23 nt, Haemophilus influenzae Rd
cggcaguacucgaaaaggcaaac

SEQ ID NO: 2723328 - RNA, 18 nt, Haemophilus influenzae Rd
cggccaauacuggcugaa

SEQ ID NO: 2723329 - RNA, 15 nt, Haemophilus influenzae Rd
cggccacuaauaagg

SEQ ID NO: 2723330 - RNA, 17 nt, Haemophilus influenzae Rd
cggcguagaaugcaaac

SEQ ID NO: 2723331 - RNA, 15 nt, Haemophilus influenzae Rd
cggcuuagauaauaa

SEQ ID NO: 2723332 - RNA, 16 nt, Haemophilus influenzae Rd
cggcuuguuguugcuc

SEQ ID NO: 2723333 - RNA, 15 nt, Haemophilus influenzae Rd
cgggaaaauuuggaa

SEQ ID NO: 2723334 - RNA, 18 nt, Haemophilus influenzae Rd
cgggaaaauuuggaauaa

SEQ ID NO: 2723335 - RNA, 19 nt, Haemophilus influenzae Rd
cgggaauacacgaugcucu

SEQ ID NO: 2723336 - RNA, 16 nt, Haemophilus influenzae Rd
cgggauaccagccuga

SEQ ID NO: 2723337 - RNA, 21 nt, Haemophilus influenzae Rd
cgggcugaaauaccuucuuga

SEQ ID NO: 2723338 - RNA, 14 nt, Haemophilus influenzae Rd
cgggcuuuaucaua

SEQ ID NO: 2723339 - RNA, 16 nt, Haemophilus influenzae Rd
cgggugucgugaaaau

SEQ ID NO: 2723340 - RNA, 21 nt, Haemophilus influenzae Rd
cggguuuugcuaauggagaaa

SEQ ID NO: 2723341 - RNA, 17 nt, Haemophilus influenzae Rd
cgguaaaaauuucucuc

SEQ ID NO: 2723342 - RNA, 17 nt, Haemophilus influenzae Rd
cgguaaaauucuauuaa

SEQ ID NO: 2723343 - RNA, 14 nt, Haemophilus influenzae Rd
cgguaaauuuuaaa

SEQ ID NO: 2723344 - RNA, 17 nt, Haemophilus influenzae Rd
cgguaaauuuuaaaaua

SEQ ID NO: 2723345 - RNA, 14 nt, Haemophilus influenzae Rd
cgguaaauuuuuac

SEQ ID NO: 2723346 - RNA, 15 nt, Haemophilus influenzae Rd
cgguaagaaaaucaa

SEQ ID NO: 2723347 - RNA, 21 nt, Haemophilus influenzae Rd
cgguaaguacgauaaacacug

SEQ ID NO: 2723348 - RNA, 22 nt, Haemophilus influenzae Rd
cgguaauuugaucuaauuugcc

SEQ ID NO: 2723349 - RNA, 23 nt, Haemophilus influenzae Rd
cgguagacacaagggauuuaaaa

SEQ ID NO: 2723350 - RNA, 23 nt, Haemophilus influenzae Rd
cgguagauuuucaucguuaauua

SEQ ID NO: 2723351 - RNA, 15 nt, Haemophilus influenzae Rd
cgguauuuuuauuua

SEQ ID NO: 2723352 - RNA, 18 nt, Haemophilus influenzae Rd
cgguauuuuuauuuauag

SEQ ID NO: 2723353 - RNA, 23 nt, Haemophilus influenzae Rd
cgguauuuuuuauugaaauuuua

SEQ ID NO: 2723354 - RNA, 14 nt, Haemophilus influenzae Rd
cggucaauuuuuuc

SEQ ID NO: 2723355 - RNA, 18 nt, Haemophilus influenzae Rd
cggucagcauaaagagaa

SEQ ID NO: 2723356 - RNA, 14 nt, Haemophilus influenzae Rd
cggucauccaaugu

SEQ ID NO: 2723357 - RNA, 20 nt, Haemophilus influenzae Rd
cggucaucuacccacacacc

SEQ ID NO: 2723358 - RNA, 19 nt, Haemophilus influenzae Rd
cggucauugugugcagaau

SEQ ID NO: 2723359 - RNA, 14 nt, Haemophilus influenzae Rd
cggucgcaccaccu

SEQ ID NO: 2723360 - RNA, 16 nt, Haemophilus influenzae Rd
cggucgcaccaccuuu

SEQ ID NO: 2723361 - RNA, 20 nt, Haemophilus influenzae Rd
cggucugaaaaucaaaagaa

SEQ ID NO: 2723362 - RNA, 18 nt, Haemophilus influenzae Rd
cggugauuuuaccgcacu

SEQ ID NO: 2723363 - RNA, 14 nt, Haemophilus influenzae Rd
cggugcuuuaagua

SEQ ID NO: 2723364 - RNA, 18 nt, Haemophilus influenzae Rd
cggugggcugaagcccac

SEQ ID NO: 2723365 - RNA, 15 nt, Haemophilus influenzae Rd
cggugguucgauucc

SEQ ID NO: 2723366 - RNA, 17 nt, Haemophilus influenzae Rd
cgguguuuucuuuugcc

SEQ ID NO: 2723367 - RNA, 20 nt, Haemophilus influenzae Rd
cgguguuuuuuuucuuuaaa

SEQ ID NO: 2723368 - RNA, 18 nt, Haemophilus influenzae Rd
cgguuaaaaaagaaauau

SEQ ID NO: 2723369 - RNA, 22 nt, Haemophilus influenzae Rd
cgguuaaaaaagaaauauuuuu

SEQ ID NO: 2723370 - RNA, 23 nt, Haemophilus influenzae Rd
cgguuaaaaaucauaguguuuuu

SEQ ID NO: 2723371 - RNA, 17 nt, Haemophilus influenzae Rd
cgguuaagucauuugag

SEQ ID NO: 2723372 - RNA, 15 nt, Haemophilus influenzae Rd
cgguuaauuuugagc

SEQ ID NO: 2723373 - RNA, 20 nt, Haemophilus influenzae Rd
cgguuaugcaacgagcaaua

SEQ ID NO: 2723374 - RNA, 13 nt, Haemophilus influenzae Rd
cgguuauuuuuuu

SEQ ID NO: 2723375 - RNA, 16 nt, Haemophilus influenzae Rd
cgguucgccugauuuc

SEQ ID NO: 2723376 - RNA, 14 nt, Haemophilus influenzae Rd
cgguugauuuuccu

SEQ ID NO: 2723377 - RNA, 16 nt, Haemophilus influenzae Rd
cgguugauuuuugacg

SEQ ID NO: 2723378 - RNA, 15 nt, Haemophilus influenzae Rd
cgguuguaauuguug

SEQ ID NO: 2723379 - RNA, 22 nt, Haemophilus influenzae Rd
cgguuguuuuugccaaaauucu

SEQ ID NO: 2723380 - RNA, 20 nt, Haemophilus influenzae Rd
cgguuuauuuuuauuauuua

SEQ ID NO: 2723381 - RNA, 16 nt, Haemophilus influenzae Rd
cgguuugaaauuuaug

SEQ ID NO: 2723382 - RNA, 12 nt, Haemophilus influenzae Rd
cgguuuuauuau

SEQ ID NO: 2723383 - RNA, 23 nt, Haemophilus influenzae Rd
cgguuuuucgaccguuuuuucuu

SEQ ID NO: 2723384 - RNA, 19 nt, Haemophilus influenzae Rd
cguaaaaaugcuguuucua

SEQ ID NO: 2723385 - RNA, 20 nt, Haemophilus influenzae Rd
cguaaagugcggaaauauuu

SEQ ID NO: 2723386 - RNA, 23 nt, Haemophilus influenzae Rd
cguaaaguuggcaacauauuuuc

SEQ ID NO: 2723387 - RNA, 10 nt, Haemophilus influenzae Rd
cguaaaguuu

SEQ ID NO: 2723388 - RNA, 22 nt, Haemophilus influenzae Rd
cguaacgaauuaguauaaacau

SEQ ID NO: 2723389 - RNA, 16 nt, Haemophilus influenzae Rd
cguaacuaaaaaaguu

SEQ ID NO: 2723390 - RNA, 24 nt, Haemophilus influenzae Rd
cguaacuuaaugcaguaauaaauc

SEQ ID NO: 2723391 - RNA, 22 nt, Haemophilus influenzae Rd
cguaagaucagauuuuuuucag

SEQ ID NO: 2723392 - RNA, 20 nt, Haemophilus influenzae Rd
cguaaguuugcuaauuuauc

SEQ ID NO: 2723393 - RNA, 14 nt, Haemophilus influenzae Rd
cguaauaaauaaaa

SEQ ID NO: 2723394 - RNA, 22 nt, Haemophilus influenzae Rd
cguaauaacauucaguuuuuaa

SEQ ID NO: 2723395 - RNA, 13 nt, Haemophilus influenzae Rd
cguaauacaaaau

SEQ ID NO: 2723396 - RNA, 17 nt, Haemophilus influenzae Rd
cguaauaccaaaauugc

SEQ ID NO: 2723397 - RNA, 16 nt, Haemophilus influenzae Rd
cguaauauuuaccgcu

SEQ ID NO: 2723398 - RNA, 22 nt, Haemophilus influenzae Rd
cguaaucgugccugccaccaug

SEQ ID NO: 2723399 - RNA, 15 nt, Haemophilus influenzae Rd
cguaaucugauggga

SEQ ID NO: 2723400 - RNA, 16 nt, Haemophilus influenzae Rd
cguaaugcuuuauuua

SEQ ID NO: 2723401 - RNA, 15 nt, Haemophilus influenzae Rd
cguaaugcuuuugcu

SEQ ID NO: 2723402 - RNA, 16 nt, Haemophilus influenzae Rd
cguaaugcuuuugcuu

SEQ ID NO: 2723403 - RNA, 20 nt, Haemophilus influenzae Rd
cguaauggaauauggcggcu

SEQ ID NO: 2723404 - RNA, 16 nt, Haemophilus influenzae Rd
cguaauguuuaaagua

SEQ ID NO: 2723405 - RNA, 17 nt, Haemophilus influenzae Rd
cguaauuaaaaauaacc

SEQ ID NO: 2723406 - RNA, 22 nt, Haemophilus influenzae Rd
cguaauucuugaccgauuaauu

SEQ ID NO: 2723407 - RNA, 13 nt, Haemophilus influenzae Rd
cguaauuucaaau

SEQ ID NO: 2723408 - RNA, 23 nt, Haemophilus influenzae Rd
cguaauuuuaaaaccacaauaaa

SEQ ID NO: 2723409 - RNA, 15 nt, Haemophilus influenzae Rd
cguacagaccauuga

SEQ ID NO: 2723410 - RNA, 16 nt, Haemophilus influenzae Rd
cguaccaaauuccauu

SEQ ID NO: 2723411 - RNA, 15 nt, Haemophilus influenzae Rd
cguagaaaucaaaaa

SEQ ID NO: 2723412 - RNA, 16 nt, Haemophilus influenzae Rd
cguagaaaucaaaaau

SEQ ID NO: 2723413 - RNA, 22 nt, Haemophilus influenzae Rd
cguagaaaucaaaaaugcuuuu

SEQ ID NO: 2723414 - RNA, 19 nt, Haemophilus influenzae Rd
cguagauacauaacgccaa

SEQ ID NO: 2723415 - RNA, 13 nt, Haemophilus influenzae Rd
cguagauauugau

SEQ ID NO: 2723416 - RNA, 21 nt, Haemophilus influenzae Rd
cguagccuggcacuaagaaag

SEQ ID NO: 2723417 - RNA, 14 nt, Haemophilus influenzae Rd
cguaguauggcaag

SEQ ID NO: 2723418 - RNA, 15 nt, Haemophilus influenzae Rd
cguagucacaacaau

SEQ ID NO: 2723419 - RNA, 18 nt, Haemophilus influenzae Rd
cguagucggcgauuuauu

SEQ ID NO: 2723420 - RNA, 14 nt, Haemophilus influenzae Rd
cguaguuauuuauu

SEQ ID NO: 2723421 - RNA, 17 nt, Haemophilus influenzae Rd
cguauaagcuaaagcaa

SEQ ID NO: 2723422 - RNA, 21 nt, Haemophilus influenzae Rd
cguaucaacuaaaucaucuac

SEQ ID NO: 2723423 - RNA, 24 nt, Haemophilus influenzae Rd
cguaucaacuaaaucaucuaccac

SEQ ID NO: 2723424 - RNA, 15 nt, Haemophilus influenzae Rd
cguauccguuccacu

SEQ ID NO: 2723425 - RNA, 22 nt, Haemophilus influenzae Rd
cguaugcgaaugguaacauuca

SEQ ID NO: 2723426 - RNA, 12 nt, Haemophilus influenzae Rd
cguauuaaauac

SEQ ID NO: 2723427 - RNA, 18 nt, Haemophilus influenzae Rd
cguauuaucggaagauga

SEQ ID NO: 2723428 - RNA, 13 nt, Haemophilus influenzae Rd
cguauucuuuaca

SEQ ID NO: 2723429 - RNA, 16 nt, Haemophilus influenzae Rd
cguauucuuuacaaau

SEQ ID NO: 2723430 - RNA, 18 nt, Haemophilus influenzae Rd
cguauugcauaaaagcac

SEQ ID NO: 2723431 - RNA, 22 nt, Haemophilus influenzae Rd
cguauuuucucaucauuauuuu

SEQ ID NO: 2723432 - RNA, 19 nt, Haemophilus influenzae Rd
cguauuuuuuaguuaaaua

SEQ ID NO: 2723433 - RNA, 15 nt, Haemophilus influenzae Rd
cgucaaaggaacaga

SEQ ID NO: 2723434 - RNA, 21 nt, Haemophilus influenzae Rd
cgucaauaucccaacuuuaug

SEQ ID NO: 2723435 - RNA, 14 nt, Haemophilus influenzae Rd
cgucaauugcuaaa

SEQ ID NO: 2723436 - RNA, 21 nt, Haemophilus influenzae Rd
cgucaccuacugguguagaug

SEQ ID NO: 2723437 - RNA, 19 nt, Haemophilus influenzae Rd
cgucaugggauaaacauuu

SEQ ID NO: 2723438 - RNA, 19 nt, Haemophilus influenzae Rd
cguccaaagaaguuuucca

SEQ ID NO: 2723439 - RNA, 19 nt, Haemophilus influenzae Rd
cguccaaaggcuucuuuuc

SEQ ID NO: 2723440 - RNA, 12 nt, Haemophilus influenzae Rd
cguccaagguuu

SEQ ID NO: 2723441 - RNA, 20 nt, Haemophilus influenzae Rd
cguccaagguuuuaauuuug

SEQ ID NO: 2723442 - RNA, 14 nt, Haemophilus influenzae Rd
cguccauucuguaa

SEQ ID NO: 2723443 - RNA, 15 nt, Haemophilus influenzae Rd
cguccgaccauuaaa

SEQ ID NO: 2723444 - RNA, 17 nt, Haemophilus influenzae Rd
cgucgcagccuuguucu

SEQ ID NO: 2723445 - RNA, 18 nt, Haemophilus influenzae Rd
cgucgcagccuuguucug

SEQ ID NO: 2723446 - RNA, 22 nt, Haemophilus influenzae Rd
cgucgcagccuuguucugcagc

SEQ ID NO: 2723447 - RNA, 22 nt, Haemophilus influenzae Rd
cgucgcuaccgccaauauguuu

SEQ ID NO: 2723448 - RNA, 18 nt, Haemophilus influenzae Rd
cgucuaaucgccaaucua

SEQ ID NO: 2723449 - RNA, 21 nt, Haemophilus influenzae Rd
cgucuaaugccgccuuaucua

SEQ ID NO: 2723450 - RNA, 10 nt, Haemophilus influenzae Rd
cgucuugcca

SEQ ID NO: 2723451 - RNA, 16 nt, Haemophilus influenzae Rd
cgucuuugaagccuga

SEQ ID NO: 2723452 - RNA, 14 nt, Haemophilus influenzae Rd
cgucuuuuaacauu

SEQ ID NO: 2723453 - RNA, 15 nt, Haemophilus influenzae Rd
cgucuuuuaacauua

SEQ ID NO: 2723454 - RNA, 18 nt, Haemophilus influenzae Rd
cgugaaauuagacaaaaa

SEQ ID NO: 2723455 - RNA, 20 nt, Haemophilus influenzae Rd
cgugaaauuagacaaaaaug

SEQ ID NO: 2723456 - RNA, 17 nt, Haemophilus influenzae Rd
cgugaauacgaucugca

SEQ ID NO: 2723457 - RNA, 17 nt, Haemophilus influenzae Rd
cgugaaucguuuguaaa

SEQ ID NO: 2723458 - RNA, 15 nt, Haemophilus influenzae Rd
cgugaauguccauuu

SEQ ID NO: 2723459 - RNA, 20 nt, Haemophilus influenzae Rd
cgugaccuaauaugauuucu

SEQ ID NO: 2723460 - RNA, 17 nt, Haemophilus influenzae Rd
cgugagauccuuuaucg

SEQ ID NO: 2723461 - RNA, 21 nt, Haemophilus influenzae Rd
cgugauaauaucgcccgcuuu

SEQ ID NO: 2723462 - RNA, 21 nt, Haemophilus influenzae Rd
cgugauaaugccucuuuaaca

SEQ ID NO: 2723463 - RNA, 17 nt, Haemophilus influenzae Rd
cgugaugaccugcagag

SEQ ID NO: 2723464 - RNA, 15 nt, Haemophilus influenzae Rd
cgugauuaucuaaau

SEQ ID NO: 2723465 - RNA, 13 nt, Haemophilus influenzae Rd
cgugcaaauaaau

SEQ ID NO: 2723466 - RNA, 20 nt, Haemophilus influenzae Rd
cgugccaucacauccacaaa

SEQ ID NO: 2723467 - RNA, 14 nt, Haemophilus influenzae Rd
cgugcugcagcuug

SEQ ID NO: 2723468 - RNA, 13 nt, Haemophilus influenzae Rd
cgugcuuccauuu

SEQ ID NO: 2723469 - RNA, 15 nt, Haemophilus influenzae Rd
cgugguucaaaacca

SEQ ID NO: 2723470 - RNA, 21 nt, Haemophilus influenzae Rd
cguguaaaucuaaaauaaucg

SEQ ID NO: 2723471 - RNA, 17 nt, Haemophilus influenzae Rd
cguguagaucagccccu

SEQ ID NO: 2723472 - RNA, 21 nt, Haemophilus influenzae Rd
cguguaguuggaucauuaucc

SEQ ID NO: 2723473 - RNA, 16 nt, Haemophilus influenzae Rd
cguguauauauuuucc

SEQ ID NO: 2723474 - RNA, 23 nt, Haemophilus influenzae Rd
cgugucccggagucgaaccgagc

SEQ ID NO: 2723475 - RNA, 14 nt, Haemophilus influenzae Rd
cgugugaaauuccu

SEQ ID NO: 2723476 - RNA, 15 nt, Haemophilus influenzae Rd
cguguguuuguaaac

SEQ ID NO: 2723477 - RNA, 13 nt, Haemophilus influenzae Rd
cguguucaaccac

SEQ ID NO: 2723478 - RNA, 12 nt, Haemophilus influenzae Rd
cguguucaucau

SEQ ID NO: 2723479 - RNA, 22 nt, Haemophilus influenzae Rd
cguguucuagugcaacaacaaa

SEQ ID NO: 2723480 - RNA, 21 nt, Haemophilus influenzae Rd
cguguuuuucacgauauugca

SEQ ID NO: 2723481 - RNA, 13 nt, Haemophilus influenzae Rd
cguguuuuuucac

SEQ ID NO: 2723482 - RNA, 16 nt, Haemophilus influenzae Rd
cguuaaaccaaauaau

SEQ ID NO: 2723483 - RNA, 19 nt, Haemophilus influenzae Rd
cguuaaacccuguuuuaag

SEQ ID NO: 2723484 - RNA, 17 nt, Haemophilus influenzae Rd
cguuaaaucaaaaccaa

SEQ ID NO: 2723485 - RNA, 20 nt, Haemophilus influenzae Rd
cguuaaaucaaaaccaauca

SEQ ID NO: 2723486 - RNA, 17 nt, Haemophilus influenzae Rd
cguuaagaaagaaacug

SEQ ID NO: 2723487 - RNA, 18 nt, Haemophilus influenzae Rd
cguuaagaaagaaacuga

SEQ ID NO: 2723488 - RNA, 15 nt, Haemophilus influenzae Rd
cguuaaguucagaaa

SEQ ID NO: 2723489 - RNA, 14 nt, Haemophilus influenzae Rd
cguuacuaaaaucc

SEQ ID NO: 2723490 - RNA, 14 nt, Haemophilus influenzae Rd
cguuagauacuuua

SEQ ID NO: 2723491 - RNA, 15 nt, Haemophilus influenzae Rd
cguuagauacuuuac

SEQ ID NO: 2723492 - RNA, 15 nt, Haemophilus influenzae Rd
cguuagccgauuuac

SEQ ID NO: 2723493 - RNA, 20 nt, Haemophilus influenzae Rd
cguuaggcgugcguuuuuuu

SEQ ID NO: 2723494 - RNA, 19 nt, Haemophilus influenzae Rd
cguuagugcugcuguuuua

SEQ ID NO: 2723495 - RNA, 15 nt, Haemophilus influenzae Rd
cguuaguuuguauuu

SEQ ID NO: 2723496 - RNA, 18 nt, Haemophilus influenzae Rd
cguuauuaugaaauuugu

SEQ ID NO: 2723497 - RNA, 22 nt, Haemophilus influenzae Rd
cguuauucaucacaacuugcaa

SEQ ID NO: 2723498 - RNA, 16 nt, Haemophilus influenzae Rd
cguucacguuuuucau

SEQ ID NO: 2723499 - RNA, 13 nt, Haemophilus influenzae Rd
cguucagaauuug

SEQ ID NO: 2723500 - RNA, 21 nt, Haemophilus influenzae Rd
cguucauauuguuucaacaua

SEQ ID NO: 2723501 - RNA, 12 nt, Haemophilus influenzae Rd
cguucauauuug

SEQ ID NO: 2723502 - RNA, 19 nt, Haemophilus influenzae Rd
cguucaugguuguaauaau

SEQ ID NO: 2723503 - RNA, 13 nt, Haemophilus influenzae Rd
cguucauuuugau

SEQ ID NO: 2723504 - RNA, 17 nt, Haemophilus influenzae Rd
cguucgauacaagguac

SEQ ID NO: 2723505 - RNA, 13 nt, Haemophilus influenzae Rd
cguucuaaagauu

SEQ ID NO: 2723506 - RNA, 18 nt, Haemophilus influenzae Rd
cguucuaaagauuuaugu

SEQ ID NO: 2723507 - RNA, 17 nt, Haemophilus influenzae Rd
cguucuaagaauuuuuu

SEQ ID NO: 2723508 - RNA, 23 nt, Haemophilus influenzae Rd
cguucuauauuuugaauaauaaa

SEQ ID NO: 2723509 - RNA, 16 nt, Haemophilus influenzae Rd
cguucuugaugauaau

SEQ ID NO: 2723510 - RNA, 21 nt, Haemophilus influenzae Rd
cguucuugaugauaaucuucc

SEQ ID NO: 2723511 - RNA, 17 nt, Haemophilus influenzae Rd
cguugaacuuaauuaaa

SEQ ID NO: 2723512 - RNA, 15 nt, Haemophilus influenzae Rd
cguugagccaauuuu

SEQ ID NO: 2723513 - RNA, 16 nt, Haemophilus influenzae Rd
cguugagccaauuuuc

SEQ ID NO: 2723514 - RNA, 14 nt, Haemophilus influenzae Rd
cguugcaacgcugc

SEQ ID NO: 2723515 - RNA, 22 nt, Haemophilus influenzae Rd
cguugguaaagccaacuuuuuc

SEQ ID NO: 2723516 - RNA, 19 nt, Haemophilus influenzae Rd
cguuggucugcccaugcuu

SEQ ID NO: 2723517 - RNA, 21 nt, Haemophilus influenzae Rd
cguuggucugcccaugcuuug

SEQ ID NO: 2723518 - RNA, 23 nt, Haemophilus influenzae Rd
cguuguaauugauucgauaaauu

SEQ ID NO: 2723519 - RNA, 17 nt, Haemophilus influenzae Rd
cguuguacgccacauac

SEQ ID NO: 2723520 - RNA, 19 nt, Haemophilus influenzae Rd
cguuguucuucuguuaaac

SEQ ID NO: 2723521 - RNA, 21 nt, Haemophilus influenzae Rd
cguuuaaccacguauuuuuua

SEQ ID NO: 2723522 - RNA, 12 nt, Haemophilus influenzae Rd
cguuuaucaucu

SEQ ID NO: 2723523 - RNA, 14 nt, Haemophilus influenzae Rd
cguuuaucaucugc

SEQ ID NO: 2723524 - RNA, 23 nt, Haemophilus influenzae Rd
cguuuauccuguuguuuuuuacc

SEQ ID NO: 2723525 - RNA, 17 nt, Haemophilus influenzae Rd
cguuuaucuaauagauu

SEQ ID NO: 2723526 - RNA, 17 nt, Haemophilus influenzae Rd
cguuuauggcuuucaau

SEQ ID NO: 2723527 - RNA, 13 nt, Haemophilus influenzae Rd
cguuuauucgcac

SEQ ID NO: 2723528 - RNA, 16 nt, Haemophilus influenzae Rd
cguuuauuuaacaaua

SEQ ID NO: 2723529 - RNA, 13 nt, Haemophilus influenzae Rd
cguuucaaaugcu

SEQ ID NO: 2723530 - RNA, 16 nt, Haemophilus influenzae Rd
cguuucaaaugcuuug

SEQ ID NO: 2723531 - RNA, 22 nt, Haemophilus influenzae Rd
cguuucacccaagauucuaaau

SEQ ID NO: 2723532 - RNA, 14 nt, Haemophilus influenzae Rd
cguuucauaugcca

SEQ ID NO: 2723533 - RNA, 11 nt, Haemophilus influenzae Rd
cguuucaucac

SEQ ID NO: 2723534 - RNA, 11 nt, Haemophilus influenzae Rd
cguuucauuuu

SEQ ID NO: 2723535 - RNA, 13 nt, Haemophilus influenzae Rd
cguuucauuuuug

SEQ ID NO: 2723536 - RNA, 14 nt, Haemophilus influenzae Rd
cguuucauuuuugc

SEQ ID NO: 2723537 - RNA, 16 nt, Haemophilus influenzae Rd
cguuucccgcuccaau

SEQ ID NO: 2723538 - RNA, 13 nt, Haemophilus influenzae Rd
cguuugacagcaa

SEQ ID NO: 2723539 - RNA, 17 nt, Haemophilus influenzae Rd
cguuugacguauccaua

SEQ ID NO: 2723540 - RNA, 22 nt, Haemophilus influenzae Rd
cguuugccgaagccuaaaucuu

SEQ ID NO: 2723541 - RNA, 20 nt, Haemophilus influenzae Rd
cguuugguaaacgaacuuca

SEQ ID NO: 2723542 - RNA, 20 nt, Haemophilus influenzae Rd
cguuugguucgauaaacauu

SEQ ID NO: 2723543 - RNA, 14 nt, Haemophilus influenzae Rd
cguuugugcuaaau

SEQ ID NO: 2723544 - RNA, 14 nt, Haemophilus influenzae Rd
cguuuuaauaaaaa

SEQ ID NO: 2723545 - RNA, 13 nt, Haemophilus influenzae Rd
cguuuuaauaguu

SEQ ID NO: 2723546 - RNA, 22 nt, Haemophilus influenzae Rd
cguuuuaauccuuccaaaucca

SEQ ID NO: 2723547 - RNA, 19 nt, Haemophilus influenzae Rd
cguuuucgcaauaucauca

SEQ ID NO: 2723548 - RNA, 13 nt, Haemophilus influenzae Rd
cguuuucuacuuc

SEQ ID NO: 2723549 - RNA, 19 nt, Haemophilus influenzae Rd
cguuuuuacgugcgaauuu

SEQ ID NO: 2723550 - RNA, 13 nt, Haemophilus influenzae Rd
cguuuuucuuaaa

SEQ ID NO: 2723551 - RNA, 22 nt, Haemophilus influenzae Rd
cguuuuugucguucuuuuucca

SEQ ID NO: 2723552 - RNA, 12 nt, Haemophilus influenzae Rd
cguuuuuuacuu

SEQ ID NO: 2723553 - RNA, 18 nt, Haemophilus influenzae Rd
cguuuuuuagaaagggcg

SEQ ID NO: 2723554 - RNA, 12 nt, Haemophilus influenzae Rd
cguuuuuuauaa

SEQ ID NO: 2723555 - RNA, 16 nt, Haemophilus influenzae Rd
cguuuuuuauuuugug

SEQ ID NO: 2723556 - RNA, 16 nt, Haemophilus influenzae Rd
cguuuuuucuuuuucc

SEQ ID NO: 2723557 - RNA, 21 nt, Haemophilus influenzae Rd
cguuuuuuucacggcauagua

SEQ ID NO: 2723558 - RNA, 12 nt, Haemophilus influenzae Rd
cuaaaaaaacua

SEQ ID NO: 2723559 - RNA, 23 nt, Haemophilus influenzae Rd
cuaaaaaacccgcuuuuaacaaa

SEQ ID NO: 2723560 - RNA, 22 nt, Haemophilus influenzae Rd
cuaaaaaacccguaauuaaaaa

SEQ ID NO: 2723561 - RNA, 16 nt, Haemophilus influenzae Rd
cuaaaaaaccuuggga

SEQ ID NO: 2723562 - RNA, 12 nt, Haemophilus influenzae Rd
cuaaaaaacuaa

SEQ ID NO: 2723563 - RNA, 19 nt, Haemophilus influenzae Rd
cuaaaaaagaguaaauauu

SEQ ID NO: 2723564 - RNA, 18 nt, Haemophilus influenzae Rd
cuaaaaaauaguuaauaa

SEQ ID NO: 2723565 - RNA, 16 nt, Haemophilus influenzae Rd
cuaaaaagaaauaaaa

SEQ ID NO: 2723566 - RNA, 21 nt, Haemophilus influenzae Rd
cuaaaaagauuugauuuuuau

SEQ ID NO: 2723567 - RNA, 19 nt, Haemophilus influenzae Rd
cuaaaaaucccauuuaggu

SEQ ID NO: 2723568 - RNA, 14 nt, Haemophilus influenzae Rd
cuaaaaauccugaa

SEQ ID NO: 2723569 - RNA, 20 nt, Haemophilus influenzae Rd
cuaaaaauccugaagauuuu

SEQ ID NO: 2723570 - RNA, 21 nt, Haemophilus influenzae Rd
cuaaaaauugcugcaacuaac

SEQ ID NO: 2723571 - RNA, 20 nt, Haemophilus influenzae Rd
cuaaaaccacaucauuuuuu

SEQ ID NO: 2723572 - RNA, 19 nt, Haemophilus influenzae Rd
cuaaaagcggcgcaucaau

SEQ ID NO: 2723573 - RNA, 13 nt, Haemophilus influenzae Rd
cuaaaaggacuaa

SEQ ID NO: 2723574 - RNA, 20 nt, Haemophilus influenzae Rd
cuaaaagugcggcuucauuu

SEQ ID NO: 2723575 - RNA, 22 nt, Haemophilus influenzae Rd
cuaaaaguuggcuuacagcaaa

SEQ ID NO: 2723576 - RNA, 14 nt, Haemophilus influenzae Rd
cuaaaauacaaaua

SEQ ID NO: 2723577 - RNA, 22 nt, Haemophilus influenzae Rd
cuaaaauacaaauacauuuugu

SEQ ID NO: 2723578 - RNA, 19 nt, Haemophilus influenzae Rd
cuaaaauaguugaaauuug

SEQ ID NO: 2723579 - RNA, 19 nt, Haemophilus influenzae Rd
cuaaaauauaacauuuauu

SEQ ID NO: 2723580 - RNA, 13 nt, Haemophilus influenzae Rd
cuaaaauauuuac

SEQ ID NO: 2723581 - RNA, 16 nt, Haemophilus influenzae Rd
cuaaaaucugugcaaa

SEQ ID NO: 2723582 - RNA, 21 nt, Haemophilus influenzae Rd
cuaaaauggugcuuuuuacaa

SEQ ID NO: 2723583 - RNA, 18 nt, Haemophilus influenzae Rd
cuaaaauucgacgauaac

SEQ ID NO: 2723584 - RNA, 19 nt, Haemophilus influenzae Rd
cuaaaauugauuucauaua

SEQ ID NO: 2723585 - RNA, 15 nt, Haemophilus influenzae Rd
cuaaaauuuguacca

SEQ ID NO: 2723586 - RNA, 15 nt, Haemophilus influenzae Rd
cuaaacaaauaaaaa

SEQ ID NO: 2723587 - RNA, 12 nt, Haemophilus influenzae Rd
cuaaacacauaa

SEQ ID NO: 2723588 - RNA, 17 nt, Haemophilus influenzae Rd
cuaaacacauaauauuu

SEQ ID NO: 2723589 - RNA, 16 nt, Haemophilus influenzae Rd
cuaaacagaauuuacg

SEQ ID NO: 2723590 - RNA, 23 nt, Haemophilus influenzae Rd
cuaaaccagaaguagcaacacca

SEQ ID NO: 2723591 - RNA, 13 nt, Haemophilus influenzae Rd
cuaaaccagcaag

SEQ ID NO: 2723592 - RNA, 14 nt, Haemophilus influenzae Rd
cuaaaccauuuugg

SEQ ID NO: 2723593 - RNA, 12 nt, Haemophilus influenzae Rd
cuaaacccauuu

SEQ ID NO: 2723594 - RNA, 16 nt, Haemophilus influenzae Rd
cuaaacccgcaauuaa

SEQ ID NO: 2723595 - RNA, 23 nt, Haemophilus influenzae Rd
cuaaaccuuauuuuaaauaaaaa

SEQ ID NO: 2723596 - RNA, 14 nt, Haemophilus influenzae Rd
cuaaacgaaugaag

SEQ ID NO: 2723597 - RNA, 15 nt, Haemophilus influenzae Rd
cuaaacgaucuaaua

SEQ ID NO: 2723598 - RNA, 15 nt, Haemophilus influenzae Rd
cuaaacgcucaaaua

SEQ ID NO: 2723599 - RNA, 17 nt, Haemophilus influenzae Rd
cuaaacgcucaaauaaa

SEQ ID NO: 2723600 - RNA, 18 nt, Haemophilus influenzae Rd
cuaaacgcucaaauaaau

SEQ ID NO: 2723601 - RNA, 16 nt, Haemophilus influenzae Rd
cuaaacgcucuuuaau

SEQ ID NO: 2723602 - RNA, 15 nt, Haemophilus influenzae Rd
cuaaacguaacuaaa

SEQ ID NO: 2723603 - RNA, 15 nt, Haemophilus influenzae Rd
cuaaacguucuugga

SEQ ID NO: 2723604 - RNA, 12 nt, Haemophilus influenzae Rd
cuaaacuaagcu

SEQ ID NO: 2723605 - RNA, 22 nt, Haemophilus influenzae Rd
cuaaacuaagcucauccauaaa

SEQ ID NO: 2723606 - RNA, 16 nt, Haemophilus influenzae Rd
cuaaacucggaauuuu

SEQ ID NO: 2723607 - RNA, 23 nt, Haemophilus influenzae Rd
cuaaacucggaauuuuuuucaac

SEQ ID NO: 2723608 - RNA, 19 nt, Haemophilus influenzae Rd
cuaaacuuaccuaaaaauu

SEQ ID NO: 2723609 - RNA, 14 nt, Haemophilus influenzae Rd
cuaaacuuauauua

SEQ ID NO: 2723610 - RNA, 14 nt, Haemophilus influenzae Rd
cuaaacuugauaua

SEQ ID NO: 2723611 - RNA, 19 nt, Haemophilus influenzae Rd
cuaaacuuguuaaauaaac

SEQ ID NO: 2723612 - RNA, 17 nt, Haemophilus influenzae Rd
cuaaacuuuagagauuu

SEQ ID NO: 2723613 - RNA, 21 nt, Haemophilus influenzae Rd
cuaaacuuuagagauuuuauu

SEQ ID NO: 2723614 - RNA, 14 nt, Haemophilus influenzae Rd
cuaaacuuuuaauu

SEQ ID NO: 2723615 - RNA, 16 nt, Haemophilus influenzae Rd
cuaaagaaaauacaau

SEQ ID NO: 2723616 - RNA, 16 nt, Haemophilus influenzae Rd
cuaaagaaagcaaugu

SEQ ID NO: 2723617 - RNA, 16 nt, Haemophilus influenzae Rd
cuaaagagaaacauug

SEQ ID NO: 2723618 - RNA, 12 nt, Haemophilus influenzae Rd
cuaaagagauuu

SEQ ID NO: 2723619 - RNA, 20 nt, Haemophilus influenzae Rd
cuaaagagauuuagcggcuu

SEQ ID NO: 2723620 - RNA, 21 nt, Haemophilus influenzae Rd
cuaaaggaguaaguuuuacac

SEQ ID NO: 2723621 - RNA, 17 nt, Haemophilus influenzae Rd
cuaaaggcaauucccag

SEQ ID NO: 2723622 - RNA, 20 nt, Haemophilus influenzae Rd
cuaaaggcacaaaaaauucu

SEQ ID NO: 2723623 - RNA, 17 nt, Haemophilus influenzae Rd
cuaaagugcgguuaauu

SEQ ID NO: 2723624 - RNA, 16 nt, Haemophilus influenzae Rd
cuaaaguuucuuuuac

SEQ ID NO: 2723625 - RNA, 21 nt, Haemophilus influenzae Rd
cuaaauaaacuacuucuaaag

SEQ ID NO: 2723626 - RNA, 14 nt, Haemophilus influenzae Rd
cuaaauaaagauua

SEQ ID NO: 2723627 - RNA, 13 nt, Haemophilus influenzae Rd
cuaaauaaaucac

SEQ ID NO: 2723628 - RNA, 24 nt, Haemophilus influenzae Rd
cuaaauaauccaacuaugaagacu

SEQ ID NO: 2723629 - RNA, 15 nt, Haemophilus influenzae Rd
cuaaauaauuuccuu

SEQ ID NO: 2723630 - RNA, 20 nt, Haemophilus influenzae Rd
cuaaauaauuuccuuuccuu

SEQ ID NO: 2723631 - RNA, 15 nt, Haemophilus influenzae Rd
cuaaauacauuuuua

SEQ ID NO: 2723632 - RNA, 16 nt, Haemophilus influenzae Rd
cuaaauacauuuuuau

SEQ ID NO: 2723633 - RNA, 23 nt, Haemophilus influenzae Rd
cuaaauacuugcuuaugcaaagu

SEQ ID NO: 2723634 - RNA, 16 nt, Haemophilus influenzae Rd
cuaaauauauuuuuau

SEQ ID NO: 2723635 - RNA, 15 nt, Haemophilus influenzae Rd
cuaaauauuuuucaa

SEQ ID NO: 2723636 - RNA, 23 nt, Haemophilus influenzae Rd
cuaaauauuuuucaaggccauau

SEQ ID NO: 2723637 - RNA, 15 nt, Haemophilus influenzae Rd
cuaaaucaaaaauaa

SEQ ID NO: 2723638 - RNA, 19 nt, Haemophilus influenzae Rd
cuaaaucaccuaaaucuuu

SEQ ID NO: 2723639 - RNA, 19 nt, Haemophilus influenzae Rd
cuaaauccuuacgcugaau

SEQ ID NO: 2723640 - RNA, 15 nt, Haemophilus influenzae Rd
cuaaaucuaauuuug

SEQ ID NO: 2723641 - RNA, 16 nt, Haemophilus influenzae Rd
cuaaaucugccaaugc

SEQ ID NO: 2723642 - RNA, 22 nt, Haemophilus influenzae Rd
cuaaaucugguggagaaauguc

SEQ ID NO: 2723643 - RNA, 19 nt, Haemophilus influenzae Rd
cuaaaucuguuucauuugu

SEQ ID NO: 2723644 - RNA, 18 nt, Haemophilus influenzae Rd
cuaaaucuucuuuaccaa

SEQ ID NO: 2723645 - RNA, 19 nt, Haemophilus influenzae Rd
cuaaaucuucuuuaccaac

SEQ ID NO: 2723646 - RNA, 22 nt, Haemophilus influenzae Rd
cuaaaucuucuuuaccaacuaa

SEQ ID NO: 2723647 - RNA, 16 nt, Haemophilus influenzae Rd
cuaaaugaauaaaacu

SEQ ID NO: 2723648 - RNA, 21 nt, Haemophilus influenzae Rd
cuaaaugcuguagaaauuaau

SEQ ID NO: 2723649 - RNA, 14 nt, Haemophilus influenzae Rd
cuaaaugugauuuc

SEQ ID NO: 2723650 - RNA, 20 nt, Haemophilus influenzae Rd
cuaaaugugcccagcgauau

SEQ ID NO: 2723651 - RNA, 23 nt, Haemophilus influenzae Rd
cuaaauuaauuaggacaauauuu

SEQ ID NO: 2723652 - RNA, 15 nt, Haemophilus influenzae Rd
cuaaauuaauuuacu

SEQ ID NO: 2723653 - RNA, 18 nt, Haemophilus influenzae Rd
cuaaauuacauuuuuucu

SEQ ID NO: 2723654 - RNA, 16 nt, Haemophilus influenzae Rd
cuaaauuagaauuuag

SEQ ID NO: 2723655 - RNA, 18 nt, Haemophilus influenzae Rd
cuaaauuaucguuuacuu

SEQ ID NO: 2723656 - RNA, 19 nt, Haemophilus influenzae Rd
cuaaauuauggguguuuaa

SEQ ID NO: 2723657 - RNA, 16 nt, Haemophilus influenzae Rd
cuaaauuauuugauuu

SEQ ID NO: 2723658 - RNA, 13 nt, Haemophilus influenzae Rd
cuaaauucaauuu

SEQ ID NO: 2723659 - RNA, 14 nt, Haemophilus influenzae Rd
cuaaauucuuuugc

SEQ ID NO: 2723660 - RNA, 19 nt, Haemophilus influenzae Rd
cuaaauucuuuugccauau

SEQ ID NO: 2723661 - RNA, 22 nt, Haemophilus influenzae Rd
cuaaauuugacuucuuguacaa

SEQ ID NO: 2723662 - RNA, 21 nt, Haemophilus influenzae Rd
cuaaauuugcugcgugagcuu

SEQ ID NO: 2723663 - RNA, 11 nt, Haemophilus influenzae Rd
cuaaauuuuag

SEQ ID NO: 2723664 - RNA, 20 nt, Haemophilus influenzae Rd
cuaaauuuuuggcugcugca

SEQ ID NO: 2723665 - RNA, 15 nt, Haemophilus influenzae Rd
cuaacaaauuuaaua

SEQ ID NO: 2723666 - RNA, 17 nt, Haemophilus influenzae Rd
cuaacaaauuuaauauu

SEQ ID NO: 2723667 - RNA, 21 nt, Haemophilus influenzae Rd
cuaacaaauuuaauauuucuu

SEQ ID NO: 2723668 - RNA, 15 nt, Haemophilus influenzae Rd
cuaacaauauuucac

SEQ ID NO: 2723669 - RNA, 13 nt, Haemophilus influenzae Rd
cuaacacaauaac

SEQ ID NO: 2723670 - RNA, 14 nt, Haemophilus influenzae Rd
cuaacacagucaua

SEQ ID NO: 2723671 - RNA, 20 nt, Haemophilus influenzae Rd
cuaacaccauugagcauuuu

SEQ ID NO: 2723672 - RNA, 18 nt, Haemophilus influenzae Rd
cuaacacgcgcugcucug

SEQ ID NO: 2723673 - RNA, 15 nt, Haemophilus influenzae Rd
cuaacacugccaaug

SEQ ID NO: 2723674 - RNA, 20 nt, Haemophilus influenzae Rd
cuaacauugcaucagccacc

SEQ ID NO: 2723675 - RNA, 17 nt, Haemophilus influenzae Rd
cuaacauuuccugugca

SEQ ID NO: 2723676 - RNA, 16 nt, Haemophilus influenzae Rd
cuaacauuuuuuuuau

SEQ ID NO: 2723677 - RNA, 15 nt, Haemophilus influenzae Rd
cuaaccccuuuucug

SEQ ID NO: 2723678 - RNA, 20 nt, Haemophilus influenzae Rd
cuaacccgauaacuaauuuc

SEQ ID NO: 2723679 - RNA, 21 nt, Haemophilus influenzae Rd
cuaaccgcacucuuucaaaaa

SEQ ID NO: 2723680 - RNA, 16 nt, Haemophilus influenzae Rd
cuaaccgcacuuuuua

SEQ ID NO: 2723681 - RNA, 14 nt, Haemophilus influenzae Rd
cuaacgcauucaaa

SEQ ID NO: 2723682 - RNA, 15 nt, Haemophilus influenzae Rd
cuaacgcuuuuaaac

SEQ ID NO: 2723683 - RNA, 18 nt, Haemophilus influenzae Rd
cuaacggaucaacauaac

SEQ ID NO: 2723684 - RNA, 18 nt, Haemophilus influenzae Rd
cuaacuaaggugcagauu

SEQ ID NO: 2723685 - RNA, 19 nt, Haemophilus influenzae Rd
cuaacuaaggugcagauuu

SEQ ID NO: 2723686 - RNA, 23 nt, Haemophilus influenzae Rd
cuaacuaaggugcagauuuuuuu

SEQ ID NO: 2723687 - RNA, 18 nt, Haemophilus influenzae Rd
cuaacucacauugccauu

SEQ ID NO: 2723688 - RNA, 19 nt, Haemophilus influenzae Rd
cuaacucugguucaaaaug

SEQ ID NO: 2723689 - RNA, 15 nt, Haemophilus influenzae Rd
cuaacucuuggcuaa

SEQ ID NO: 2723690 - RNA, 17 nt, Haemophilus influenzae Rd
cuaacugaucuaaaugu

SEQ ID NO: 2723691 - RNA, 13 nt, Haemophilus influenzae Rd
cuaacuuuuaauu

SEQ ID NO: 2723692 - RNA, 16 nt, Haemophilus influenzae Rd
cuaacuuuucuucaau

SEQ ID NO: 2723693 - RNA, 13 nt, Haemophilus influenzae Rd
cuaagaaaauaga

SEQ ID NO: 2723694 - RNA, 14 nt, Haemophilus influenzae Rd
cuaagaaaauccaa

SEQ ID NO: 2723695 - RNA, 17 nt, Haemophilus influenzae Rd
cuaagacaucacggguu

SEQ ID NO: 2723696 - RNA, 12 nt, Haemophilus influenzae Rd
cuaagauaaauu

SEQ ID NO: 2723697 - RNA, 15 nt, Haemophilus influenzae Rd
cuaagauacccauuu

SEQ ID NO: 2723698 - RNA, 17 nt, Haemophilus influenzae Rd
cuaagauacccauuucg

SEQ ID NO: 2723699 - RNA, 21 nt, Haemophilus influenzae Rd
cuaagauucgcacguuuuuac

SEQ ID NO: 2723700 - RNA, 19 nt, Haemophilus influenzae Rd
cuaagauugcaagugagcu

SEQ ID NO: 2723701 - RNA, 14 nt, Haemophilus influenzae Rd
cuaagcauuucagu

SEQ ID NO: 2723702 - RNA, 14 nt, Haemophilus influenzae Rd
cuaagccaaaucca

SEQ ID NO: 2723703 - RNA, 15 nt, Haemophilus influenzae Rd
cuaagccgcuauugu

SEQ ID NO: 2723704 - RNA, 11 nt, Haemophilus influenzae Rd
cuaagccuugu

SEQ ID NO: 2723705 - RNA, 14 nt, Haemophilus influenzae Rd
cuaaggcaaaaaaa

SEQ ID NO: 2723706 - RNA, 20 nt, Haemophilus influenzae Rd
cuaagguauccacuuuucca

SEQ ID NO: 2723707 - RNA, 15 nt, Haemophilus influenzae Rd
cuaagguuaauuuuu

SEQ ID NO: 2723708 - RNA, 18 nt, Haemophilus influenzae Rd
cuaagguugguaugguuu

SEQ ID NO: 2723709 - RNA, 15 nt, Haemophilus influenzae Rd
cuaagguuuaacuga

SEQ ID NO: 2723710 - RNA, 13 nt, Haemophilus influenzae Rd
cuaagguuuccau

SEQ ID NO: 2723711 - RNA, 15 nt, Haemophilus influenzae Rd
cuaagucaggaauaa

SEQ ID NO: 2723712 - RNA, 22 nt, Haemophilus influenzae Rd
cuaaguguuuccgugauuucuu

SEQ ID NO: 2723713 - RNA, 13 nt, Haemophilus influenzae Rd
cuaaguucuaaaa

SEQ ID NO: 2723714 - RNA, 16 nt, Haemophilus influenzae Rd
cuaaguucuauaauuu

SEQ ID NO: 2723715 - RNA, 19 nt, Haemophilus influenzae Rd
cuaaguucuauaauuuuag

SEQ ID NO: 2723716 - RNA, 21 nt, Haemophilus influenzae Rd
cuaaguuuaagugguuucaac

SEQ ID NO: 2723717 - RNA, 15 nt, Haemophilus influenzae Rd
cuaaguuuuggucaa

SEQ ID NO: 2723718 - RNA, 18 nt, Haemophilus influenzae Rd
cuaauaagaagcugcuuu

SEQ ID NO: 2723719 - RNA, 22 nt, Haemophilus influenzae Rd
cuaauaagaagcugcuuuuaau

SEQ ID NO: 2723720 - RNA, 22 nt, Haemophilus influenzae Rd
cuaauaagccgccugauguuug

SEQ ID NO: 2723721 - RNA, 23 nt, Haemophilus influenzae Rd
cuaauaagccgccugauguuuga

SEQ ID NO: 2723722 - RNA, 16 nt, Haemophilus influenzae Rd
cuaauaagcuuggcuu

SEQ ID NO: 2723723 - RNA, 21 nt, Haemophilus influenzae Rd
cuaauaagcuuggcuuauuua

SEQ ID NO: 2723724 - RNA, 17 nt, Haemophilus influenzae Rd
cuaauaauaaaaagugc

SEQ ID NO: 2723725 - RNA, 18 nt, Haemophilus influenzae Rd
cuaauaccgcguauuauc

SEQ ID NO: 2723726 - RNA, 18 nt, Haemophilus influenzae Rd
cuaauacgucuaauuuag

SEQ ID NO: 2723727 - RNA, 16 nt, Haemophilus influenzae Rd
cuaauagaaaaaugcc

SEQ ID NO: 2723728 - RNA, 15 nt, Haemophilus influenzae Rd
cuaauagaacuguua

SEQ ID NO: 2723729 - RNA, 17 nt, Haemophilus influenzae Rd
cuaauagcgugaaaagc

SEQ ID NO: 2723730 - RNA, 19 nt, Haemophilus influenzae Rd
cuaauaggaguaaaaauau

SEQ ID NO: 2723731 - RNA, 21 nt, Haemophilus influenzae Rd
cuaauaggaguaaaaauauua

SEQ ID NO: 2723732 - RNA, 15 nt, Haemophilus influenzae Rd
cuaauauaauaaauu

SEQ ID NO: 2723733 - RNA, 16 nt, Haemophilus influenzae Rd
cuaauauaauaaauuc

SEQ ID NO: 2723734 - RNA, 19 nt, Haemophilus influenzae Rd
cuaauaugauuucuucaaa

SEQ ID NO: 2723735 - RNA, 21 nt, Haemophilus influenzae Rd
cuaauauuucuugaguauauc

SEQ ID NO: 2723736 - RNA, 17 nt, Haemophilus influenzae Rd
cuaauccagauugguau

SEQ ID NO: 2723737 - RNA, 15 nt, Haemophilus influenzae Rd
cuaaucgguuuugac

SEQ ID NO: 2723738 - RNA, 17 nt, Haemophilus influenzae Rd
cuaaucguccaauuuca

SEQ ID NO: 2723739 - RNA, 15 nt, Haemophilus influenzae Rd
cuaaucuuaaaaaau

SEQ ID NO: 2723740 - RNA, 14 nt, Haemophilus influenzae Rd
cuaaucuuaugaau

SEQ ID NO: 2723741 - RNA, 22 nt, Haemophilus influenzae Rd
cuaaugagcguuuaacugcuuu

SEQ ID NO: 2723742 - RNA, 15 nt, Haemophilus influenzae Rd
cuaaugaugcuucag

SEQ ID NO: 2723743 - RNA, 17 nt, Haemophilus influenzae Rd
cuaaugaugcuucagcg

SEQ ID NO: 2723744 - RNA, 20 nt, Haemophilus influenzae Rd
cuaaugauuaauuaaauuac

SEQ ID NO: 2723745 - RNA, 15 nt, Haemophilus influenzae Rd
cuaaugcaaaauuag

SEQ ID NO: 2723746 - RNA, 22 nt, Haemophilus influenzae Rd
cuaaugcaggcaacucaguuuu

SEQ ID NO: 2723747 - RNA, 21 nt, Haemophilus influenzae Rd
cuaaugcccacguccacuuca

SEQ ID NO: 2723748 - RNA, 23 nt, Haemophilus influenzae Rd
cuaaugccgcaaaaccuaacaua

SEQ ID NO: 2723749 - RNA, 13 nt, Haemophilus influenzae Rd
cuaaugcuuuaau

SEQ ID NO: 2723750 - RNA, 14 nt, Haemophilus influenzae Rd
cuaaugcuuuaauu

SEQ ID NO: 2723751 - RNA, 16 nt, Haemophilus influenzae Rd
cuaaugcuuuaauuug

SEQ ID NO: 2723752 - RNA, 20 nt, Haemophilus influenzae Rd
cuaauggauauagaaaucau

SEQ ID NO: 2723753 - RNA, 22 nt, Haemophilus influenzae Rd
cuaauggcccguguuucaauuc

SEQ ID NO: 2723754 - RNA, 20 nt, Haemophilus influenzae Rd
cuaaugguuguaaauuuuca

SEQ ID NO: 2723755 - RNA, 15 nt, Haemophilus influenzae Rd
cuaaugugcaaucag

SEQ ID NO: 2723756 - RNA, 13 nt, Haemophilus influenzae Rd
cuaauguuaauuu

SEQ ID NO: 2723757 - RNA, 16 nt, Haemophilus influenzae Rd
cuaauguuaauuuuaa

SEQ ID NO: 2723758 - RNA, 13 nt, Haemophilus influenzae Rd
cuaauuaaaagga

SEQ ID NO: 2723759 - RNA, 13 nt, Haemophilus influenzae Rd
cuaauuaaacuaa

SEQ ID NO: 2723760 - RNA, 14 nt, Haemophilus influenzae Rd
cuaauucugcacga

SEQ ID NO: 2723761 - RNA, 23 nt, Haemophilus influenzae Rd
cuaauucugcacgacgugcuuca

SEQ ID NO: 2723762 - RNA, 17 nt, Haemophilus influenzae Rd
cuaauucugcuaaaucu

SEQ ID NO: 2723763 - RNA, 19 nt, Haemophilus influenzae Rd
cuaauucugcuuuuccaua

SEQ ID NO: 2723764 - RNA, 21 nt, Haemophilus influenzae Rd
cuaauucuguaauuucacuuc

SEQ ID NO: 2723765 - RNA, 12 nt, Haemophilus influenzae Rd
cuaauucuucca

SEQ ID NO: 2723766 - RNA, 18 nt, Haemophilus influenzae Rd
cuaauucuugccagauuu

SEQ ID NO: 2723767 - RNA, 14 nt, Haemophilus influenzae Rd
cuaauucuuucacg

SEQ ID NO: 2723768 - RNA, 15 nt, Haemophilus influenzae Rd
cuaauugaaauagac

SEQ ID NO: 2723769 - RNA, 19 nt, Haemophilus influenzae Rd
cuaauugcauuaaaagucu

SEQ ID NO: 2723770 - RNA, 14 nt, Haemophilus influenzae Rd
cuaauuggaaaagu

SEQ ID NO: 2723771 - RNA, 16 nt, Haemophilus influenzae Rd
cuaauuggaaaaguaa

SEQ ID NO: 2723772 - RNA, 23 nt, Haemophilus influenzae Rd
cuaauuggggugcagauuuuuuu

SEQ ID NO: 2723773 - RNA, 19 nt, Haemophilus influenzae Rd
cuaauugugcauuguuacc

SEQ ID NO: 2723774 - RNA, 18 nt, Haemophilus influenzae Rd
cuaauugugcuaaauaau

SEQ ID NO: 2723775 - RNA, 16 nt, Haemophilus influenzae Rd
cuaauugugguaaagc

SEQ ID NO: 2723776 - RNA, 23 nt, Haemophilus influenzae Rd
cuaauuguucuucuguuaauaaa

SEQ ID NO: 2723777 - RNA, 15 nt, Haemophilus influenzae Rd
cuaauuguuuuaaaa

SEQ ID NO: 2723778 - RNA, 19 nt, Haemophilus influenzae Rd
cuaauuguuuuaaaaugga

SEQ ID NO: 2723779 - RNA, 14 nt, Haemophilus influenzae Rd
cuaauuuaagaaaa

SEQ ID NO: 2723780 - RNA, 15 nt, Haemophilus influenzae Rd
cuaauuuaagaaaaa

SEQ ID NO: 2723781 - RNA, 17 nt, Haemophilus influenzae Rd
cuaauuuauuucaucaa

SEQ ID NO: 2723782 - RNA, 21 nt, Haemophilus influenzae Rd
cuaauuucacaccauuuuuaa

SEQ ID NO: 2723783 - RNA, 13 nt, Haemophilus influenzae Rd
cuaauuucauaaa

SEQ ID NO: 2723784 - RNA, 17 nt, Haemophilus influenzae Rd
cuaauuucauaaaaauu

SEQ ID NO: 2723785 - RNA, 13 nt, Haemophilus influenzae Rd
cuaauuucauuuu

SEQ ID NO: 2723786 - RNA, 19 nt, Haemophilus influenzae Rd
cuaauuugccaaguacaau

SEQ ID NO: 2723787 - RNA, 17 nt, Haemophilus influenzae Rd
cuaauuuuaguuguuug

SEQ ID NO: 2723788 - RNA, 13 nt, Haemophilus influenzae Rd
cuaauuuucacau

SEQ ID NO: 2723789 - RNA, 13 nt, Haemophilus influenzae Rd
cuaauuuugccau

SEQ ID NO: 2723790 - RNA, 17 nt, Haemophilus influenzae Rd
cuaauuuuguaagcauu

SEQ ID NO: 2723791 - RNA, 19 nt, Haemophilus influenzae Rd
cuaauuuuguaagcauuaa

SEQ ID NO: 2723792 - RNA, 14 nt, Haemophilus influenzae Rd
cuaauuuuguugug

SEQ ID NO: 2723793 - RNA, 19 nt, Haemophilus influenzae Rd
cuaauuuuuguuguuuaua

SEQ ID NO: 2723794 - RNA, 22 nt, Haemophilus influenzae Rd
cuaauuuuuuaauuaguuugau

SEQ ID NO: 2723795 - RNA, 21 nt, Haemophilus influenzae Rd
cuaauuuuuuaauuuuuucug

SEQ ID NO: 2723796 - RNA, 15 nt, Haemophilus influenzae Rd
cuaauuuuuuuccaa

SEQ ID NO: 2723797 - RNA, 22 nt, Haemophilus influenzae Rd
cuaauuuuuuuccaauuaauuc

SEQ ID NO: 2723798 - RNA, 14 nt, Haemophilus influenzae Rd
cuaauuuuuuuucu

SEQ ID NO: 2723799 - RNA, 16 nt, Haemophilus influenzae Rd
cuacaaaacauaauaa

SEQ ID NO: 2723800 - RNA, 18 nt, Haemophilus influenzae Rd
cuacaaaacauaauaaaa

SEQ ID NO: 2723801 - RNA, 18 nt, Haemophilus influenzae Rd
cuacaacaaaggguaaau

SEQ ID NO: 2723802 - RNA, 20 nt, Haemophilus influenzae Rd
cuacaacaaaggguaaauaa

SEQ ID NO: 2723803 - RNA, 15 nt, Haemophilus influenzae Rd
cuacaacuucaucaa

SEQ ID NO: 2723804 - RNA, 21 nt, Haemophilus influenzae Rd
cuacaacuuuuuauuuucugc

SEQ ID NO: 2723805 - RNA, 16 nt, Haemophilus influenzae Rd
cuacaaggguaucuaa

SEQ ID NO: 2723806 - RNA, 19 nt, Haemophilus influenzae Rd
cuacaaggguaucuaaauu

SEQ ID NO: 2723807 - RNA, 22 nt, Haemophilus influenzae Rd
cuacaaggguaucuaaauuugc

SEQ ID NO: 2723808 - RNA, 18 nt, Haemophilus influenzae Rd
cuacaaguacuacuggca

SEQ ID NO: 2723809 - RNA, 18 nt, Haemophilus influenzae Rd
cuacaagugaaccaauau

SEQ ID NO: 2723810 - RNA, 13 nt, Haemophilus influenzae Rd
cuacaaucaaaaa

SEQ ID NO: 2723811 - RNA, 17 nt, Haemophilus influenzae Rd
cuacaccgauuucuuua

SEQ ID NO: 2723812 - RNA, 14 nt, Haemophilus influenzae Rd
cuacaccuucuuua

SEQ ID NO: 2723813 - RNA, 16 nt, Haemophilus influenzae Rd
cuacagauacagaagg

SEQ ID NO: 2723814 - RNA, 19 nt, Haemophilus influenzae Rd
cuacagcuuguuucaucau

SEQ ID NO: 2723815 - RNA, 22 nt, Haemophilus influenzae Rd
cuacagugacuaaaacaacagu

SEQ ID NO: 2723816 - RNA, 14 nt, Haemophilus influenzae Rd
cuacaucaacaaau

SEQ ID NO: 2723817 - RNA, 23 nt, Haemophilus influenzae Rd
cuacaucuaaaccgauagcuuuu

SEQ ID NO: 2723818 - RNA, 15 nt, Haemophilus influenzae Rd
cuacauucaucaaaa

SEQ ID NO: 2723819 - RNA, 21 nt, Haemophilus influenzae Rd
cuacauuuaagcguuuaauau

SEQ ID NO: 2723820 - RNA, 20 nt, Haemophilus influenzae Rd
cuacauuugccccaacaaca

SEQ ID NO: 2723821 - RNA, 21 nt, Haemophilus influenzae Rd
cuacauuugccccaacaacau

SEQ ID NO: 2723822 - RNA, 12 nt, Haemophilus influenzae Rd
cuacauuuuuag

SEQ ID NO: 2723823 - RNA, 15 nt, Haemophilus influenzae Rd
cuaccacgauaaauc

SEQ ID NO: 2723824 - RNA, 18 nt, Haemophilus influenzae Rd
cuaccacgauacggcaaa

SEQ ID NO: 2723825 - RNA, 14 nt, Haemophilus influenzae Rd
cuaccaucuaaagu

SEQ ID NO: 2723826 - RNA, 22 nt, Haemophilus influenzae Rd
cuaccauggugccuucgccaac

SEQ ID NO: 2723827 - RNA, 12 nt, Haemophilus influenzae Rd
cuacccaaauuu

SEQ ID NO: 2723828 - RNA, 14 nt, Haemophilus influenzae Rd
cuacccacacaccu

SEQ ID NO: 2723829 - RNA, 14 nt, Haemophilus influenzae Rd
cuaccuaauaaagc

SEQ ID NO: 2723830 - RNA, 22 nt, Haemophilus influenzae Rd
cuacgaauugguucuaaauauu

SEQ ID NO: 2723831 - RNA, 18 nt, Haemophilus influenzae Rd
cuacgacauuuuuaacua

SEQ ID NO: 2723832 - RNA, 14 nt, Haemophilus influenzae Rd
cuacgccauuuucu

SEQ ID NO: 2723833 - RNA, 20 nt, Haemophilus influenzae Rd
cuacgccuaauucaucuucu

SEQ ID NO: 2723834 - RNA, 16 nt, Haemophilus influenzae Rd
cuacggacuaaauaaa

SEQ ID NO: 2723835 - RNA, 21 nt, Haemophilus influenzae Rd
cuacguauugaacuaaaauau

SEQ ID NO: 2723836 - RNA, 14 nt, Haemophilus influenzae Rd
cuacuaaaaauugc

SEQ ID NO: 2723837 - RNA, 13 nt, Haemophilus influenzae Rd
cuacuaaaauaag

SEQ ID NO: 2723838 - RNA, 18 nt, Haemophilus influenzae Rd
cuacuaaacgcacuuuuu

SEQ ID NO: 2723839 - RNA, 17 nt, Haemophilus influenzae Rd
cuacuagccaaucauaa

SEQ ID NO: 2723840 - RNA, 19 nt, Haemophilus influenzae Rd
cuacucgagcauaaacuaa

SEQ ID NO: 2723841 - RNA, 18 nt, Haemophilus influenzae Rd
cuacugcaucugcauuuc

SEQ ID NO: 2723842 - RNA, 14 nt, Haemophilus influenzae Rd
cuacuucuaaacga

SEQ ID NO: 2723843 - RNA, 14 nt, Haemophilus influenzae Rd
cuacuugacgguuu

SEQ ID NO: 2723844 - RNA, 14 nt, Haemophilus influenzae Rd
cuacuugagcuuca

SEQ ID NO: 2723845 - RNA, 16 nt, Haemophilus influenzae Rd
cuacuugaguugcggc

SEQ ID NO: 2723846 - RNA, 16 nt, Haemophilus influenzae Rd
cuacuuguaagaauaa

SEQ ID NO: 2723847 - RNA, 16 nt, Haemophilus influenzae Rd
cuacuuguguuuuaga

SEQ ID NO: 2723848 - RNA, 16 nt, Haemophilus influenzae Rd
cuacuuuaaagaauau

SEQ ID NO: 2723849 - RNA, 12 nt, Haemophilus influenzae Rd
cuacuuucagga

SEQ ID NO: 2723850 - RNA, 12 nt, Haemophilus influenzae Rd
cuacuuucuauu

SEQ ID NO: 2723851 - RNA, 22 nt, Haemophilus influenzae Rd
cuacuuuggauuggauuuugaa

SEQ ID NO: 2723852 - RNA, 20 nt, Haemophilus influenzae Rd
cuacuuuugacgcagcaucu

SEQ ID NO: 2723853 - RNA, 18 nt, Haemophilus influenzae Rd
cuacuuuugugccagcug

SEQ ID NO: 2723854 - RNA, 23 nt, Haemophilus influenzae Rd
cuacuuuugugccagcuggaaau

SEQ ID NO: 2723855 - RNA, 16 nt, Haemophilus influenzae Rd
cuacuuuuuauuuuug

SEQ ID NO: 2723856 - RNA, 14 nt, Haemophilus influenzae Rd
cuagaaagcaaugu

SEQ ID NO: 2723857 - RNA, 21 nt, Haemophilus influenzae Rd
cuagaaauaucuaggcuaauu

SEQ ID NO: 2723858 - RNA, 15 nt, Haemophilus influenzae Rd
cuagaacaaaaggcu

SEQ ID NO: 2723859 - RNA, 13 nt, Haemophilus influenzae Rd
cuagaagaucaac

SEQ ID NO: 2723860 - RNA, 23 nt, Haemophilus influenzae Rd
cuagacuuucuuguauugccacu

SEQ ID NO: 2723861 - RNA, 21 nt, Haemophilus influenzae Rd
cuagaggcugaagccauuuua

SEQ ID NO: 2723862 - RNA, 23 nt, Haemophilus influenzae Rd
cuagauaaacgcuguuuugcuuc

SEQ ID NO: 2723863 - RNA, 19 nt, Haemophilus influenzae Rd
cuagauaaugaugaaugcu

SEQ ID NO: 2723864 - RNA, 15 nt, Haemophilus influenzae Rd
cuagauauaaaaacu

SEQ ID NO: 2723865 - RNA, 17 nt, Haemophilus influenzae Rd
cuagauauaaaaacuau

SEQ ID NO: 2723866 - RNA, 21 nt, Haemophilus influenzae Rd
cuagauauuguucuacugguu

SEQ ID NO: 2723867 - RNA, 19 nt, Haemophilus influenzae Rd
cuagauauuucuaggcuau

SEQ ID NO: 2723868 - RNA, 22 nt, Haemophilus influenzae Rd
cuagaucacaguugugaaaaaa

SEQ ID NO: 2723869 - RNA, 15 nt, Haemophilus influenzae Rd
cuagauuuuuuacuc

SEQ ID NO: 2723870 - RNA, 16 nt, Haemophilus influenzae Rd
cuagauuuuuuacuca

SEQ ID NO: 2723871 - RNA, 19 nt, Haemophilus influenzae Rd
cuagauuuuuuacucaaag

SEQ ID NO: 2723872 - RNA, 22 nt, Haemophilus influenzae Rd
cuagcaacgacacacuauuaau

SEQ ID NO: 2723873 - RNA, 18 nt, Haemophilus influenzae Rd
cuagcaaucuuuggcaaa

SEQ ID NO: 2723874 - RNA, 19 nt, Haemophilus influenzae Rd
cuagcaucaaaauaaauaa

SEQ ID NO: 2723875 - RNA, 20 nt, Haemophilus influenzae Rd
cuagcaucaaaauaaauaaa

SEQ ID NO: 2723876 - RNA, 15 nt, Haemophilus influenzae Rd
cuagcaucgcauaac

SEQ ID NO: 2723877 - RNA, 20 nt, Haemophilus influenzae Rd
cuagccaguuaauuagugug

SEQ ID NO: 2723878 - RNA, 16 nt, Haemophilus influenzae Rd
cuagccuuauuuuguc

SEQ ID NO: 2723879 - RNA, 20 nt, Haemophilus influenzae Rd
cuagcgcuguuacuucuuuc

SEQ ID NO: 2723880 - RNA, 20 nt, Haemophilus influenzae Rd
cuagcucucguuguucuuua

SEQ ID NO: 2723881 - RNA, 18 nt, Haemophilus influenzae Rd
cuaggaaugaucugcacc

SEQ ID NO: 2723882 - RNA, 18 nt, Haemophilus influenzae Rd
cuaggcuauauuuuuaug

SEQ ID NO: 2723883 - RNA, 17 nt, Haemophilus influenzae Rd
cuaguacuuguaacuug

SEQ ID NO: 2723884 - RNA, 13 nt, Haemophilus influenzae Rd
cuaguauuuuugu

SEQ ID NO: 2723885 - RNA, 19 nt, Haemophilus influenzae Rd
cuagucccgcuuuugccau

SEQ ID NO: 2723886 - RNA, 23 nt, Haemophilus influenzae Rd
cuaguccugcagccgccauggaa

SEQ ID NO: 2723887 - RNA, 16 nt, Haemophilus influenzae Rd
cuagucuuguaacuau

SEQ ID NO: 2723888 - RNA, 12 nt, Haemophilus influenzae Rd
cuaguucaucau

SEQ ID NO: 2723889 - RNA, 15 nt, Haemophilus influenzae Rd
cuaguucuuccccuc

SEQ ID NO: 2723890 - RNA, 13 nt, Haemophilus influenzae Rd
cuaguuuuccuuu

SEQ ID NO: 2723891 - RNA, 20 nt, Haemophilus influenzae Rd
cuaguuuuuucccuaaugcu

SEQ ID NO: 2723892 - RNA, 19 nt, Haemophilus influenzae Rd
cuauaaaacaaauaagccc

SEQ ID NO: 2723893 - RNA, 12 nt, Haemophilus influenzae Rd
cuauaaaagaag

SEQ ID NO: 2723894 - RNA, 17 nt, Haemophilus influenzae Rd
cuauaaaucguauaagc

SEQ ID NO: 2723895 - RNA, 23 nt, Haemophilus influenzae Rd
cuauaacuaggcaucaaaauuca

SEQ ID NO: 2723896 - RNA, 12 nt, Haemophilus influenzae Rd
cuauaauuaaac

SEQ ID NO: 2723897 - RNA, 15 nt, Haemophilus influenzae Rd
cuauaauuaaacauu

SEQ ID NO: 2723898 - RNA, 20 nt, Haemophilus influenzae Rd
cuauaauuucgccauuuuuu

SEQ ID NO: 2723899 - RNA, 13 nt, Haemophilus influenzae Rd
cuauacaaaauug

SEQ ID NO: 2723900 - RNA, 18 nt, Haemophilus influenzae Rd
cuauaccuaucuuauuaa

SEQ ID NO: 2723901 - RNA, 19 nt, Haemophilus influenzae Rd
cuauagaauuauuuaaacu

SEQ ID NO: 2723902 - RNA, 18 nt, Haemophilus influenzae Rd
cuauagauuuauuuacug

SEQ ID NO: 2723903 - RNA, 18 nt, Haemophilus influenzae Rd
cuauauacauuaacaaug

SEQ ID NO: 2723904 - RNA, 12 nt, Haemophilus influenzae Rd
cuauauacuuuu

SEQ ID NO: 2723905 - RNA, 13 nt, Haemophilus influenzae Rd
cuauauauuucuc

SEQ ID NO: 2723906 - RNA, 22 nt, Haemophilus influenzae Rd
cuauaugauauauaaaaccccg

SEQ ID NO: 2723907 - RNA, 15 nt, Haemophilus influenzae Rd
cuauauucguuaaau

SEQ ID NO: 2723908 - RNA, 17 nt, Haemophilus influenzae Rd
cuauauucguuaaauaa

SEQ ID NO: 2723909 - RNA, 20 nt, Haemophilus influenzae Rd
cuauauucguuaaauaaugc

SEQ ID NO: 2723910 - RNA, 21 nt, Haemophilus influenzae Rd
cuauauuuugaauaauaaauu

SEQ ID NO: 2723911 - RNA, 18 nt, Haemophilus influenzae Rd
cuaucaaaaucaaagugc

SEQ ID NO: 2723912 - RNA, 22 nt, Haemophilus influenzae Rd
cuaucauccgcuuguaauuuca

SEQ ID NO: 2723913 - RNA, 14 nt, Haemophilus influenzae Rd
cuauccaacucauu

SEQ ID NO: 2723914 - RNA, 17 nt, Haemophilus influenzae Rd
cuaucggugaagacauc

SEQ ID NO: 2723915 - RNA, 16 nt, Haemophilus influenzae Rd
cuaucuaaauggcaaa

SEQ ID NO: 2723916 - RNA, 20 nt, Haemophilus influenzae Rd
cuaucuacuacgcuaacacu

SEQ ID NO: 2723917 - RNA, 13 nt, Haemophilus influenzae Rd
cuaucucauccac

SEQ ID NO: 2723918 - RNA, 16 nt, Haemophilus influenzae Rd
cuaucugcuuuucuuc

SEQ ID NO: 2723919 - RNA, 20 nt, Haemophilus influenzae Rd
cuaucuuguaauuuuuucuc

SEQ ID NO: 2723920 - RNA, 14 nt, Haemophilus influenzae Rd
cuaucuuuugguaa

SEQ ID NO: 2723921 - RNA, 16 nt, Haemophilus influenzae Rd
cuaugaaaucaaggac

SEQ ID NO: 2723922 - RNA, 23 nt, Haemophilus influenzae Rd
cuaugaauaagcgaaaaacauau

SEQ ID NO: 2723923 - RNA, 20 nt, Haemophilus influenzae Rd
cuaugacguuuauuuacagu

SEQ ID NO: 2723924 - RNA, 12 nt, Haemophilus influenzae Rd
cuaugcccaagc

SEQ ID NO: 2723925 - RNA, 23 nt, Haemophilus influenzae Rd
cuaugccuucuucacuacuugaa

SEQ ID NO: 2723926 - RNA, 14 nt, Haemophilus influenzae Rd
cuaugcugaaugug

SEQ ID NO: 2723927 - RNA, 17 nt, Haemophilus influenzae Rd
cuauggcaaugaauaaa

SEQ ID NO: 2723928 - RNA, 19 nt, Haemophilus influenzae Rd
cuauggcccgauauuuugg

SEQ ID NO: 2723929 - RNA, 17 nt, Haemophilus influenzae Rd
cuauguuauuaaaauua

SEQ ID NO: 2723930 - RNA, 12 nt, Haemophilus influenzae Rd
cuauuaaaaaau

SEQ ID NO: 2723931 - RNA, 13 nt, Haemophilus influenzae Rd
cuauuaaaaaauc

SEQ ID NO: 2723932 - RNA, 15 nt, Haemophilus influenzae Rd
cuauuaaaaaaucau

SEQ ID NO: 2723933 - RNA, 17 nt, Haemophilus influenzae Rd
  misc_feature (8)..(8): n is a, c, g or u
cuauuaanacaauaaau

SEQ ID NO: 2723934 - RNA, 17 nt, Haemophilus influenzae Rd
cuauuaauuacuuuuau

SEQ ID NO: 2723935 - RNA, 18 nt, Haemophilus influenzae Rd
cuauuaauuuaauucuaa

SEQ ID NO: 2723936 - RNA, 19 nt, Haemophilus influenzae Rd
cuauuaauuuaauucuaaa

SEQ ID NO: 2723937 - RNA, 15 nt, Haemophilus influenzae Rd
cuauuaauuuuaaau

SEQ ID NO: 2723938 - RNA, 18 nt, Haemophilus influenzae Rd
cuauuacaagauaaucag

SEQ ID NO: 2723939 - RNA, 15 nt, Haemophilus influenzae Rd
cuauuacaauuggug

SEQ ID NO: 2723940 - RNA, 16 nt, Haemophilus influenzae Rd
cuauuacccacuucac

SEQ ID NO: 2723941 - RNA, 19 nt, Haemophilus influenzae Rd
cuauuacccacuucacaca

SEQ ID NO: 2723942 - RNA, 20 nt, Haemophilus influenzae Rd
cuauuacgcuguccaauaau

SEQ ID NO: 2723943 - RNA, 17 nt, Haemophilus influenzae Rd
cuauuagacuuaauuuc

SEQ ID NO: 2723944 - RNA, 20 nt, Haemophilus influenzae Rd
cuauuagacuuaauuucaca

SEQ ID NO: 2723945 - RNA, 21 nt, Haemophilus influenzae Rd
cuauuaucauaaacaauuuca

SEQ ID NO: 2723946 - RNA, 23 nt, Haemophilus influenzae Rd
cuauucaaugcaccuaagucagg

SEQ ID NO: 2723947 - RNA, 17 nt, Haemophilus influenzae Rd
cuauucauaccgauaac

SEQ ID NO: 2723948 - RNA, 20 nt, Haemophilus influenzae Rd
cuauuccuuucuuuauuuca

SEQ ID NO: 2723949 - RNA, 12 nt, Haemophilus influenzae Rd
cuauucuucaau

SEQ ID NO: 2723950 - RNA, 15 nt, Haemophilus influenzae Rd
cuauugaaaauuaaa

SEQ ID NO: 2723951 - RNA, 14 nt, Haemophilus influenzae Rd
cuauuggauaaauu

SEQ ID NO: 2723952 - RNA, 14 nt, Haemophilus influenzae Rd
cuauuggcaucaaa

SEQ ID NO: 2723953 - RNA, 16 nt, Haemophilus influenzae Rd
cuauuguuuuuuucua

SEQ ID NO: 2723954 - RNA, 16 nt, Haemophilus influenzae Rd
cuauuuacguaaaaaa

SEQ ID NO: 2723955 - RNA, 18 nt, Haemophilus influenzae Rd
cuauuuauaauccauuca

SEQ ID NO: 2723956 - RNA, 19 nt, Haemophilus influenzae Rd
cuauuugucggaaaauaau

SEQ ID NO: 2723957 - RNA, 11 nt, Haemophilus influenzae Rd
cuauuuuaaaa

SEQ ID NO: 2723958 - RNA, 17 nt, Haemophilus influenzae Rd
cuauuuuauaauuaaua

SEQ ID NO: 2723959 - RNA, 19 nt, Haemophilus influenzae Rd
cuauuuuauaauuaauaaa

SEQ ID NO: 2723960 - RNA, 23 nt, Haemophilus influenzae Rd
cuauuuuauaauuaauaaaaaau

SEQ ID NO: 2723961 - RNA, 14 nt, Haemophilus influenzae Rd
cuauuuuauuuaga

SEQ ID NO: 2723962 - RNA, 14 nt, Haemophilus influenzae Rd
cuauuuuauuugcc

SEQ ID NO: 2723963 - RNA, 19 nt, Haemophilus influenzae Rd
cuauuuuuaauuuacugga

SEQ ID NO: 2723964 - RNA, 15 nt, Haemophilus influenzae Rd
cuauuuuuagaaaau

SEQ ID NO: 2723965 - RNA, 22 nt, Haemophilus influenzae Rd
cuauuuuuuccugccuugcaaa

SEQ ID NO: 2723966 - RNA, 17 nt, Haemophilus influenzae Rd
cucaaaaacggauuuau

SEQ ID NO: 2723967 - RNA, 20 nt, Haemophilus influenzae Rd
cucaaaaaguuaaauaagcu

SEQ ID NO: 2723968 - RNA, 13 nt, Haemophilus influenzae Rd
cucaaaaucaagu

SEQ ID NO: 2723969 - RNA, 21 nt, Haemophilus influenzae Rd
cucaaaaucaaguuaaaaaau

SEQ ID NO: 2723970 - RNA, 22 nt, Haemophilus influenzae Rd
cucaaaauccgccgcacuuaau

SEQ ID NO: 2723971 - RNA, 18 nt, Haemophilus influenzae Rd
cucaacaccuaauaucaa

SEQ ID NO: 2723972 - RNA, 18 nt, Haemophilus influenzae Rd
cucaacaucaaaaccauu

SEQ ID NO: 2723973 - RNA, 11 nt, Haemophilus influenzae Rd
cucaagaaacu

SEQ ID NO: 2723974 - RNA, 19 nt, Haemophilus influenzae Rd
cucaauaaauaucuaaacu

SEQ ID NO: 2723975 - RNA, 17 nt, Haemophilus influenzae Rd
cucaauagauuuaauau

SEQ ID NO: 2723976 - RNA, 14 nt, Haemophilus influenzae Rd
cucaaugaauuaaa

SEQ ID NO: 2723977 - RNA, 15 nt, Haemophilus influenzae Rd
cucaaugaauuaaaa

SEQ ID NO: 2723978 - RNA, 17 nt, Haemophilus influenzae Rd
cucaauuauuuauacua

SEQ ID NO: 2723979 - RNA, 23 nt, Haemophilus influenzae Rd
cucaauuccuucaucgucuucuu

SEQ ID NO: 2723980 - RNA, 11 nt, Haemophilus influenzae Rd
cucacaagacg

SEQ ID NO: 2723981 - RNA, 14 nt, Haemophilus influenzae Rd
cucacauaaagugc

SEQ ID NO: 2723982 - RNA, 12 nt, Haemophilus influenzae Rd
cucacauccauu

SEQ ID NO: 2723983 - RNA, 16 nt, Haemophilus influenzae Rd
cucacauccauuccug

SEQ ID NO: 2723984 - RNA, 14 nt, Haemophilus influenzae Rd
cucacauugccauu

SEQ ID NO: 2723985 - RNA, 17 nt, Haemophilus influenzae Rd
cucacauugccauuuuu

SEQ ID NO: 2723986 - RNA, 14 nt, Haemophilus influenzae Rd
cucaccaaauuguu

SEQ ID NO: 2723987 - RNA, 22 nt, Haemophilus influenzae Rd
cucacgagcauagaucgcaagg

SEQ ID NO: 2723988 - RNA, 13 nt, Haemophilus influenzae Rd
cucacgccgugau

SEQ ID NO: 2723989 - RNA, 14 nt, Haemophilus influenzae Rd
cucacggcaauaau

SEQ ID NO: 2723990 - RNA, 13 nt, Haemophilus influenzae Rd
cucacgggcagaa

SEQ ID NO: 2723991 - RNA, 15 nt, Haemophilus influenzae Rd
cucacuaacuuuccu

SEQ ID NO: 2723992 - RNA, 12 nt, Haemophilus influenzae Rd
cucacuucuuua

SEQ ID NO: 2723993 - RNA, 13 nt, Haemophilus influenzae Rd
cucagauaaugau

SEQ ID NO: 2723994 - RNA, 20 nt, Haemophilus influenzae Rd
cucagauaaugauagaugaa

SEQ ID NO: 2723995 - RNA, 11 nt, Haemophilus influenzae Rd
cucagcaagcu

SEQ ID NO: 2723996 - RNA, 19 nt, Haemophilus influenzae Rd
cucagcgugaauauaagaa

SEQ ID NO: 2723997 - RNA, 21 nt, Haemophilus influenzae Rd
cucagcgugaauauaagaaau

SEQ ID NO: 2723998 - RNA, 15 nt, Haemophilus influenzae Rd
cucaggaacaucacc

SEQ ID NO: 2723999 - RNA, 14 nt, Haemophilus influenzae Rd
cucagguauuucuu

SEQ ID NO: 2724000 - RNA, 18 nt, Haemophilus influenzae Rd
cucagguauuucuucaau

SEQ ID NO: 2724001 - RNA, 20 nt, Haemophilus influenzae Rd
cucagucgguagagcagcgg

SEQ ID NO: 2724002 - RNA, 17 nt, Haemophilus influenzae Rd
cucaguugguagagcac

SEQ ID NO: 2724003 - RNA, 19 nt, Haemophilus influenzae Rd
cucaguugguagagcacga

SEQ ID NO: 2724004 - RNA, 21 nt, Haemophilus influenzae Rd
cucaguuuauuagaauauaac

SEQ ID NO: 2724005 - RNA, 19 nt, Haemophilus influenzae Rd
cucaguuuuugaggaaagu

SEQ ID NO: 2724006 - RNA, 13 nt, Haemophilus influenzae Rd
cucauacaaaaag

SEQ ID NO: 2724007 - RNA, 19 nt, Haemophilus influenzae Rd
cucauaccaaggcauuuuu

SEQ ID NO: 2724008 - RNA, 21 nt, Haemophilus influenzae Rd
cucauaccaaggcauuuuuuc

SEQ ID NO: 2724009 - RNA, 22 nt, Haemophilus influenzae Rd
cucauaccaaggcauuuuuucu

SEQ ID NO: 2724010 - RNA, 23 nt, Haemophilus influenzae Rd
cucaucaaaauaaggucagcaaa

SEQ ID NO: 2724011 - RNA, 18 nt, Haemophilus influenzae Rd
cucaucauuaugaaaaaa

SEQ ID NO: 2724012 - RNA, 19 nt, Haemophilus influenzae Rd
cucaucauuaugaaaaaaa

SEQ ID NO: 2724013 - RNA, 15 nt, Haemophilus influenzae Rd
cucaucauuauuuuu

SEQ ID NO: 2724014 - RNA, 16 nt, Haemophilus influenzae Rd
cucauccacuaaacca

SEQ ID NO: 2724015 - RNA, 21 nt, Haemophilus influenzae Rd
cucaucguaucaauuuuauug

SEQ ID NO: 2724016 - RNA, 15 nt, Haemophilus influenzae Rd
cucauuacacaaaau

SEQ ID NO: 2724017 - RNA, 22 nt, Haemophilus influenzae Rd
cucauucgaauauugaucaucu

SEQ ID NO: 2724018 - RNA, 17 nt, Haemophilus influenzae Rd
cucauugcugcuuuaau

SEQ ID NO: 2724019 - RNA, 12 nt, Haemophilus influenzae Rd
cucauugugauc

SEQ ID NO: 2724020 - RNA, 17 nt, Haemophilus influenzae Rd
cuccaagaauauuucac

SEQ ID NO: 2724021 - RNA, 20 nt, Haemophilus influenzae Rd
cuccaagaauauuucacacc

SEQ ID NO: 2724022 - RNA, 20 nt, Haemophilus influenzae Rd
cuccaccuugaauugcauuu

SEQ ID NO: 2724023 - RNA, 18 nt, Haemophilus influenzae Rd
cuccagcaaaagcaagau

SEQ ID NO: 2724024 - RNA, 15 nt, Haemophilus influenzae Rd
cuccauaauauugug

SEQ ID NO: 2724025 - RNA, 16 nt, Haemophilus influenzae Rd
cuccauugcaauuuca

SEQ ID NO: 2724026 - RNA, 17 nt, Haemophilus influenzae Rd
cuccauugcaauuucag

SEQ ID NO: 2724027 - RNA, 18 nt, Haemophilus influenzae Rd
cucccauucuuaaaucau

SEQ ID NO: 2724028 - RNA, 13 nt, Haemophilus influenzae Rd
cucccccauugaa

SEQ ID NO: 2724029 - RNA, 17 nt, Haemophilus influenzae Rd
cucccccccaauaaaaa

SEQ ID NO: 2724030 - RNA, 14 nt, Haemophilus influenzae Rd
cuccccguccaaag

SEQ ID NO: 2724031 - RNA, 15 nt, Haemophilus influenzae Rd
cuccgauacauaaua

SEQ ID NO: 2724032 - RNA, 20 nt, Haemophilus influenzae Rd
cuccgcaaccguggcaaccg

SEQ ID NO: 2724033 - RNA, 14 nt, Haemophilus influenzae Rd
cuccgcauuuuuuu

SEQ ID NO: 2724034 - RNA, 14 nt, Haemophilus influenzae Rd
cuccgccaagugcg

SEQ ID NO: 2724035 - RNA, 14 nt, Haemophilus influenzae Rd
cuccuccuaaugca

SEQ ID NO: 2724036 - RNA, 16 nt, Haemophilus influenzae Rd
cuccugauauaguggc

SEQ ID NO: 2724037 - RNA, 13 nt, Haemophilus influenzae Rd
cucgaaaguuacc

SEQ ID NO: 2724038 - RNA, 16 nt, Haemophilus influenzae Rd
cucgaaaguuaccgcu

SEQ ID NO: 2724039 - RNA, 22 nt, Haemophilus influenzae Rd
cucgaacaauaugauuacgguu

SEQ ID NO: 2724040 - RNA, 19 nt, Haemophilus influenzae Rd
cucgaauaucgacuaauau

SEQ ID NO: 2724041 - RNA, 16 nt, Haemophilus influenzae Rd
cucgacauaaaaacau

SEQ ID NO: 2724042 - RNA, 20 nt, Haemophilus influenzae Rd
cucgagcauaaacuaaaaua

SEQ ID NO: 2724043 - RNA, 15 nt, Haemophilus influenzae Rd
cucgaguaucaaaac

SEQ ID NO: 2724044 - RNA, 13 nt, Haemophilus influenzae Rd
cucgaucauuuuu

SEQ ID NO: 2724045 - RNA, 14 nt, Haemophilus influenzae Rd
cucgaucauuuuua

SEQ ID NO: 2724046 - RNA, 17 nt, Haemophilus influenzae Rd
cucgcaaaagugcgguc

SEQ ID NO: 2724047 - RNA, 17 nt, Haemophilus influenzae Rd
cucgcauugauucuuua

SEQ ID NO: 2724048 - RNA, 14 nt, Haemophilus influenzae Rd
cucgccaaaucuca

SEQ ID NO: 2724049 - RNA, 17 nt, Haemophilus influenzae Rd
cucgccaaaucucaaaa

SEQ ID NO: 2724050 - RNA, 16 nt, Haemophilus influenzae Rd
cucgccauuuugagga

SEQ ID NO: 2724051 - RNA, 13 nt, Haemophilus influenzae Rd
cucgccauuuuuc

SEQ ID NO: 2724052 - RNA, 14 nt, Haemophilus influenzae Rd
cucgccuugcaaau

SEQ ID NO: 2724053 - RNA, 15 nt, Haemophilus influenzae Rd
cucgcucgccaagaa

SEQ ID NO: 2724054 - RNA, 17 nt, Haemophilus influenzae Rd
cucggaaagcaaaauag

SEQ ID NO: 2724055 - RNA, 22 nt, Haemophilus influenzae Rd
cucgguaaaaaucauuaaauaa

SEQ ID NO: 2724056 - RNA, 21 nt, Haemophilus influenzae Rd
cucggucgauggcugggauuu

SEQ ID NO: 2724057 - RNA, 15 nt, Haemophilus influenzae Rd
cucguaaaauauuaa

SEQ ID NO: 2724058 - RNA, 23 nt, Haemophilus influenzae Rd
cucguccgaccauuaaauccuga

SEQ ID NO: 2724059 - RNA, 19 nt, Haemophilus influenzae Rd
cucgugauuaucuaaauuu

SEQ ID NO: 2724060 - RNA, 17 nt, Haemophilus influenzae Rd
cucguugccauaaaaaa

SEQ ID NO: 2724061 - RNA, 18 nt, Haemophilus influenzae Rd
cucguugccauaaaaaau

SEQ ID NO: 2724062 - RNA, 19 nt, Haemophilus influenzae Rd
cucguugccauaaaaaauu

SEQ ID NO: 2724063 - RNA, 20 nt, Haemophilus influenzae Rd
cucguuguucuuuauaagaa

SEQ ID NO: 2724064 - RNA, 15 nt, Haemophilus influenzae Rd
cucuaaaucuaauuu

SEQ ID NO: 2724065 - RNA, 19 nt, Haemophilus influenzae Rd
cucuaaaugugauuuccau

SEQ ID NO: 2724066 - RNA, 20 nt, Haemophilus influenzae Rd
cucuaaccuaaaauagagca

SEQ ID NO: 2724067 - RNA, 15 nt, Haemophilus influenzae Rd
cucuaacgcauucaa

SEQ ID NO: 2724068 - RNA, 21 nt, Haemophilus influenzae Rd
cucuaauucagcaaaaagugc

SEQ ID NO: 2724069 - RNA, 13 nt, Haemophilus influenzae Rd
cucuaccaacuga

SEQ ID NO: 2724070 - RNA, 16 nt, Haemophilus influenzae Rd
cucuaccaacugagcu

SEQ ID NO: 2724071 - RNA, 16 nt, Haemophilus influenzae Rd
cucuaccgacugagcu

SEQ ID NO: 2724072 - RNA, 22 nt, Haemophilus influenzae Rd
cucuauuugucggaaaauaaua

SEQ ID NO: 2724073 - RNA, 15 nt, Haemophilus influenzae Rd
cucucaaaaaucaac

SEQ ID NO: 2724074 - RNA, 22 nt, Haemophilus influenzae Rd
cucucacgugaaucacaacaua

SEQ ID NO: 2724075 - RNA, 13 nt, Haemophilus influenzae Rd
cucucauuuuuua

SEQ ID NO: 2724076 - RNA, 20 nt, Haemophilus influenzae Rd
cucucccgaaaauuguucag

SEQ ID NO: 2724077 - RNA, 17 nt, Haemophilus influenzae Rd
cucucgcugaauuauug

SEQ ID NO: 2724078 - RNA, 19 nt, Haemophilus influenzae Rd
cucucggcgguucuuguuu

SEQ ID NO: 2724079 - RNA, 22 nt, Haemophilus influenzae Rd
cucucgggugcgccauuuuuaa

SEQ ID NO: 2724080 - RNA, 21 nt, Haemophilus influenzae Rd
cucucgucaauacaacaagaa

SEQ ID NO: 2724081 - RNA, 22 nt, Haemophilus influenzae Rd
cucucucaccgccauuguuugu

SEQ ID NO: 2724082 - RNA, 17 nt, Haemophilus influenzae Rd
cucugccacggcuugug

SEQ ID NO: 2724083 - RNA, 12 nt, Haemophilus influenzae Rd
cucugcuugagu

SEQ ID NO: 2724084 - RNA, 19 nt, Haemophilus influenzae Rd
cucuggcucgcucuucagc

SEQ ID NO: 2724085 - RNA, 22 nt, Haemophilus influenzae Rd
cucuuauuuguguggaaaaaug

SEQ ID NO: 2724086 - RNA, 15 nt, Haemophilus influenzae Rd
cucuucagcuucuuc

SEQ ID NO: 2724087 - RNA, 18 nt, Haemophilus influenzae Rd
cucuucagcuucuucauc

SEQ ID NO: 2724088 - RNA, 23 nt, Haemophilus influenzae Rd
cucuucagcuucuucaucgcuca

SEQ ID NO: 2724089 - RNA, 12 nt, Haemophilus influenzae Rd
cucuucaucaaa

SEQ ID NO: 2724090 - RNA, 15 nt, Haemophilus influenzae Rd
cucuucaucaaaaug

SEQ ID NO: 2724091 - RNA, 17 nt, Haemophilus influenzae Rd
cucuucuuguucaaaua

SEQ ID NO: 2724092 - RNA, 16 nt, Haemophilus influenzae Rd
cucuugcuucuaauac

SEQ ID NO: 2724093 - RNA, 20 nt, Haemophilus influenzae Rd
cucuuggauuuucuuagcuu

SEQ ID NO: 2724094 - RNA, 15 nt, Haemophilus influenzae Rd
cucuuggauuuuuuc

SEQ ID NO: 2724095 - RNA, 19 nt, Haemophilus influenzae Rd
cucuuggcuaacuucuucc

SEQ ID NO: 2724096 - RNA, 18 nt, Haemophilus influenzae Rd
cucuugucaauaaauccc

SEQ ID NO: 2724097 - RNA, 19 nt, Haemophilus influenzae Rd
cucuuuacuguucaaauaa

SEQ ID NO: 2724098 - RNA, 22 nt, Haemophilus influenzae Rd
cucuuuauagccuauaauuaaa

SEQ ID NO: 2724099 - RNA, 12 nt, Haemophilus influenzae Rd
cucuuucaaaua

SEQ ID NO: 2724100 - RNA, 12 nt, Haemophilus influenzae Rd
cucuuucaauuu

SEQ ID NO: 2724101 - RNA, 14 nt, Haemophilus influenzae Rd
cucuuucaccauua

SEQ ID NO: 2724102 - RNA, 22 nt, Haemophilus influenzae Rd
cucuuuuaucucggcuaaaauc

SEQ ID NO: 2724103 - RNA, 21 nt, Haemophilus influenzae Rd
cucuuuuuauuuuacuaauua

SEQ ID NO: 2724104 - RNA, 13 nt, Haemophilus influenzae Rd
cugaaaaagcuaa

SEQ ID NO: 2724105 - RNA, 19 nt, Haemophilus influenzae Rd
cugaaaaagcuaaaaaaac

SEQ ID NO: 2724106 - RNA, 21 nt, Haemophilus influenzae Rd
cugaaaaagcuaaaaaaacag

SEQ ID NO: 2724107 - RNA, 12 nt, Haemophilus influenzae Rd
cugaaaaauaaa

SEQ ID NO: 2724108 - RNA, 20 nt, Haemophilus influenzae Rd
cugaaaaauaaaaaauauug

SEQ ID NO: 2724109 - RNA, 20 nt, Haemophilus influenzae Rd
cugaaaauauucuucauaaa

SEQ ID NO: 2724110 - RNA, 17 nt, Haemophilus influenzae Rd
cugaaaccacuaaaaac

SEQ ID NO: 2724111 - RNA, 18 nt, Haemophilus influenzae Rd
cugaaaccacuaaaaaca

SEQ ID NO: 2724112 - RNA, 23 nt, Haemophilus influenzae Rd
cugaaagacccaccgcaaaagcc

SEQ ID NO: 2724113 - RNA, 19 nt, Haemophilus influenzae Rd
cugaaaguagauauuucuc

SEQ ID NO: 2724114 - RNA, 18 nt, Haemophilus influenzae Rd
cugaaaguauuaaauuuu

SEQ ID NO: 2724115 - RNA, 20 nt, Haemophilus influenzae Rd
cugaaagucgauucaaauaa

SEQ ID NO: 2724116 - RNA, 17 nt, Haemophilus influenzae Rd
cugaaauaccuucuuga

SEQ ID NO: 2724117 - RNA, 19 nt, Haemophilus influenzae Rd
cugaaauucauucaacaaa

SEQ ID NO: 2724118 - RNA, 14 nt, Haemophilus influenzae Rd
cugaaauucuaaaa

SEQ ID NO: 2724119 - RNA, 20 nt, Haemophilus influenzae Rd
cugaaauucuaaaaaaauca

SEQ ID NO: 2724120 - RNA, 13 nt, Haemophilus influenzae Rd
cugaaauuuugau

SEQ ID NO: 2724121 - RNA, 13 nt, Haemophilus influenzae Rd
cugaaauuuuuau

SEQ ID NO: 2724122 - RNA, 21 nt, Haemophilus influenzae Rd
cugaacaugucuuguggguuu

SEQ ID NO: 2724123 - RNA, 15 nt, Haemophilus influenzae Rd
cugaacuaaaauaac

SEQ ID NO: 2724124 - RNA, 15 nt, Haemophilus influenzae Rd
cugaagcaacaauca

SEQ ID NO: 2724125 - RNA, 21 nt, Haemophilus influenzae Rd
cugaaguuguaauaaagcuga

SEQ ID NO: 2724126 - RNA, 13 nt, Haemophilus influenzae Rd
cugaauaaaaaaa

SEQ ID NO: 2724127 - RNA, 16 nt, Haemophilus influenzae Rd
cugaauaaauuuuuua

SEQ ID NO: 2724128 - RNA, 14 nt, Haemophilus influenzae Rd
cugaauaaugugca

SEQ ID NO: 2724129 - RNA, 21 nt, Haemophilus influenzae Rd
cugaauaauuuccaacacauu

SEQ ID NO: 2724130 - RNA, 23 nt, Haemophilus influenzae Rd
cugaauacacuuuaaauuuuccu

SEQ ID NO: 2724131 - RNA, 14 nt, Haemophilus influenzae Rd
cugaauaucagaag

SEQ ID NO: 2724132 - RNA, 19 nt, Haemophilus influenzae Rd
cugaaugaucgaguaaaaa

SEQ ID NO: 2724133 - RNA, 22 nt, Haemophilus influenzae Rd
cugaaugaucgaguaaaaauaa

SEQ ID NO: 2724134 - RNA, 12 nt, Haemophilus influenzae Rd
cugaaugcguuc

SEQ ID NO: 2724135 - RNA, 15 nt, Haemophilus influenzae Rd
cugaauuaaaaaccg

SEQ ID NO: 2724136 - RNA, 15 nt, Haemophilus influenzae Rd
cugaauuauugucuu

SEQ ID NO: 2724137 - RNA, 23 nt, Haemophilus influenzae Rd
cugaauuggacggcaaaaauauc

SEQ ID NO: 2724138 - RNA, 13 nt, Haemophilus influenzae Rd
cugaauuuaaacu

SEQ ID NO: 2724139 - RNA, 13 nt, Haemophilus influenzae Rd
cugaauuuaauuc

SEQ ID NO: 2724140 - RNA, 14 nt, Haemophilus influenzae Rd
cugaauuuaauuca

SEQ ID NO: 2724141 - RNA, 21 nt, Haemophilus influenzae Rd
cugaauuucauucaaaaauaa

SEQ ID NO: 2724142 - RNA, 12 nt, Haemophilus influenzae Rd
cugaauuuugua

SEQ ID NO: 2724143 - RNA, 13 nt, Haemophilus influenzae Rd
cugacaaauuugu

SEQ ID NO: 2724144 - RNA, 14 nt, Haemophilus influenzae Rd
cugacaaauuuguu

SEQ ID NO: 2724145 - RNA, 16 nt, Haemophilus influenzae Rd
cugacacccaaauuaa

SEQ ID NO: 2724146 - RNA, 17 nt, Haemophilus influenzae Rd
cugacacccaaauuaaa

SEQ ID NO: 2724147 - RNA, 20 nt, Haemophilus influenzae Rd
cugacacccaaauuaaaaaa

SEQ ID NO: 2724148 - RNA, 15 nt, Haemophilus influenzae Rd
cugacacuuccccug

SEQ ID NO: 2724149 - RNA, 17 nt, Haemophilus influenzae Rd
cugacaguuuaucucuu

SEQ ID NO: 2724150 - RNA, 13 nt, Haemophilus influenzae Rd
cugacaucaagca

SEQ ID NO: 2724151 - RNA, 14 nt, Haemophilus influenzae Rd
cugacauuacauaa

SEQ ID NO: 2724152 - RNA, 22 nt, Haemophilus influenzae Rd
cugacauuucgggcaaaagaaa

SEQ ID NO: 2724153 - RNA, 15 nt, Haemophilus influenzae Rd
cugaccacuuucaau

SEQ ID NO: 2724154 - RNA, 14 nt, Haemophilus influenzae Rd
cugaccauuuuguu

SEQ ID NO: 2724155 - RNA, 17 nt, Haemophilus influenzae Rd
cugacccacaucaucaa

SEQ ID NO: 2724156 - RNA, 15 nt, Haemophilus influenzae Rd
cugacguaauuguuc

SEQ ID NO: 2724157 - RNA, 19 nt, Haemophilus influenzae Rd
cugacguaauuguuccaau

SEQ ID NO: 2724158 - RNA, 17 nt, Haemophilus influenzae Rd
cugacguacaauuucaa

SEQ ID NO: 2724159 - RNA, 15 nt, Haemophilus influenzae Rd
cugacuagauaaacg

SEQ ID NO: 2724160 - RNA, 18 nt, Haemophilus influenzae Rd
cugacuugucuauacaaa

SEQ ID NO: 2724161 - RNA, 21 nt, Haemophilus influenzae Rd
cugagaaagggauuuuaauua

SEQ ID NO: 2724162 - RNA, 21 nt, Haemophilus influenzae Rd
cugagcaaauuacccaaauga

SEQ ID NO: 2724163 - RNA, 14 nt, Haemophilus influenzae Rd
cugagcguuaaauc

SEQ ID NO: 2724164 - RNA, 16 nt, Haemophilus influenzae Rd
cugagcuaagggggga

SEQ ID NO: 2724165 - RNA, 19 nt, Haemophilus influenzae Rd
cugagcuuuucuuguaaug

SEQ ID NO: 2724166 - RNA, 22 nt, Haemophilus influenzae Rd
cugaggauuaaagggcugcuac

SEQ ID NO: 2724167 - RNA, 23 nt, Haemophilus influenzae Rd
cugaggcuaauaauaaaaagugc

SEQ ID NO: 2724168 - RNA, 17 nt, Haemophilus influenzae Rd
cugagguucaaaacuau

SEQ ID NO: 2724169 - RNA, 21 nt, Haemophilus influenzae Rd
cugagguuccccuaaaaaaua

SEQ ID NO: 2724170 - RNA, 13 nt, Haemophilus influenzae Rd
cugaguaaauaaa

SEQ ID NO: 2724171 - RNA, 12 nt, Haemophilus influenzae Rd
cugaguaaugua

SEQ ID NO: 2724172 - RNA, 16 nt, Haemophilus influenzae Rd
cugaguauguuuugau

SEQ ID NO: 2724173 - RNA, 16 nt, Haemophilus influenzae Rd
cugagugcaagccacg

SEQ ID NO: 2724174 - RNA, 20 nt, Haemophilus influenzae Rd
cugauaaacgccuuuuaaac

SEQ ID NO: 2724175 - RNA, 13 nt, Haemophilus influenzae Rd
cugauaaagauaa

SEQ ID NO: 2724176 - RNA, 21 nt, Haemophilus influenzae Rd
cugauaaagauaacuaagaug

SEQ ID NO: 2724177 - RNA, 15 nt, Haemophilus influenzae Rd
cugauaacucuaaag

SEQ ID NO: 2724178 - RNA, 16 nt, Haemophilus influenzae Rd
cugauaaguagaaaaa

SEQ ID NO: 2724179 - RNA, 17 nt, Haemophilus influenzae Rd
cugauaaguagaaaaau

SEQ ID NO: 2724180 - RNA, 21 nt, Haemophilus influenzae Rd
cugauaaguagaaaaauuggu

SEQ ID NO: 2724181 - RNA, 16 nt, Haemophilus influenzae Rd
cugauaaguucauaaa

SEQ ID NO: 2724182 - RNA, 21 nt, Haemophilus influenzae Rd
cugauaaguucauaaaagggg

SEQ ID NO: 2724183 - RNA, 15 nt, Haemophilus influenzae Rd
cugauaauuuuucac

SEQ ID NO: 2724184 - RNA, 18 nt, Haemophilus influenzae Rd
cugauaucccaucacuac

SEQ ID NO: 2724185 - RNA, 17 nt, Haemophilus influenzae Rd
cugauaugccaaggcuc

SEQ ID NO: 2724186 - RNA, 18 nt, Haemophilus influenzae Rd
cugauaugccaaggcucc

SEQ ID NO: 2724187 - RNA, 12 nt, Haemophilus influenzae Rd
cugauauuuaaa

SEQ ID NO: 2724188 - RNA, 18 nt, Haemophilus influenzae Rd
cugauauuuaacaucaug

SEQ ID NO: 2724189 - RNA, 20 nt, Haemophilus influenzae Rd
cugauccacgguauuuucuu

SEQ ID NO: 2724190 - RNA, 18 nt, Haemophilus influenzae Rd
cugaucuugguagaaaau

SEQ ID NO: 2724191 - RNA, 13 nt, Haemophilus influenzae Rd
cugaugaauuuag

SEQ ID NO: 2724192 - RNA, 20 nt, Haemophilus influenzae Rd
cugaugaauuuaguacuucc

SEQ ID NO: 2724193 - RNA, 20 nt, Haemophilus influenzae Rd
cugaugauggccaugacaag

SEQ ID NO: 2724194 - RNA, 14 nt, Haemophilus influenzae Rd
cugaugcuuuaaca

SEQ ID NO: 2724195 - RNA, 17 nt, Haemophilus influenzae Rd
cugauguuuaccgcaaa

SEQ ID NO: 2724196 - RNA, 15 nt, Haemophilus influenzae Rd
cugauuaaucaaaaa

SEQ ID NO: 2724197 - RNA, 16 nt, Haemophilus influenzae Rd
cugauuaaucaaaaau

SEQ ID NO: 2724198 - RNA, 17 nt, Haemophilus influenzae Rd
cugauuacuuaaaguua

SEQ ID NO: 2724199 - RNA, 21 nt, Haemophilus influenzae Rd
cugauuacuuaaaguuaucaa

SEQ ID NO: 2724200 - RNA, 23 nt, Haemophilus influenzae Rd
cugauuagggugcagauuuuuuu

SEQ ID NO: 2724201 - RNA, 15 nt, Haemophilus influenzae Rd
cugauuauauuguug

SEQ ID NO: 2724202 - RNA, 18 nt, Haemophilus influenzae Rd
cugauuauauuguugcac

SEQ ID NO: 2724203 - RNA, 15 nt, Haemophilus influenzae Rd
cugauucuaaugcca

SEQ ID NO: 2724204 - RNA, 13 nt, Haemophilus influenzae Rd
cugauuuaaaaaa

SEQ ID NO: 2724205 - RNA, 15 nt, Haemophilus influenzae Rd
cugauuuaaaaaaac

SEQ ID NO: 2724206 - RNA, 21 nt, Haemophilus influenzae Rd
cugauuuaccugaacguucac

SEQ ID NO: 2724207 - RNA, 14 nt, Haemophilus influenzae Rd
cugauuuaucauuc

SEQ ID NO: 2724208 - RNA, 18 nt, Haemophilus influenzae Rd
cugauuuccuguaaaaaa

SEQ ID NO: 2724209 - RNA, 13 nt, Haemophilus influenzae Rd
cugauuugacaga

SEQ ID NO: 2724210 - RNA, 14 nt, Haemophilus influenzae Rd
cugauuuuaaauau

SEQ ID NO: 2724211 - RNA, 12 nt, Haemophilus influenzae Rd
cugauuuugcua

SEQ ID NO: 2724212 - RNA, 12 nt, Haemophilus influenzae Rd
cugauuuuucac

SEQ ID NO: 2724213 - RNA, 16 nt, Haemophilus influenzae Rd
cugauuuuucuuuuuc

SEQ ID NO: 2724214 - RNA, 18 nt, Haemophilus influenzae Rd
cugauuuuuuuauaauua

SEQ ID NO: 2724215 - RNA, 17 nt, Haemophilus influenzae Rd
cugcaaagucuuuaccu

SEQ ID NO: 2724216 - RNA, 22 nt, Haemophilus influenzae Rd
cugcaaauaaagaagaaaaucu

SEQ ID NO: 2724217 - RNA, 18 nt, Haemophilus influenzae Rd
cugcaaaugguguuuuau

SEQ ID NO: 2724218 - RNA, 14 nt, Haemophilus influenzae Rd
cugcaacaaauaaa

SEQ ID NO: 2724219 - RNA, 20 nt, Haemophilus influenzae Rd
cugcaacaaauaaaucauag

SEQ ID NO: 2724220 - RNA, 20 nt, Haemophilus influenzae Rd
cugcaaggauauuuccauag

SEQ ID NO: 2724221 - RNA, 22 nt, Haemophilus influenzae Rd
cugcaagugcgguaaaauuuuu

SEQ ID NO: 2724222 - RNA, 23 nt, Haemophilus influenzae Rd
cugcaagugcgguaaaauuuuuc

SEQ ID NO: 2724223 - RNA, 22 nt, Haemophilus influenzae Rd
cugcaauaauaucugcuuuuuc

SEQ ID NO: 2724224 - RNA, 22 nt, Haemophilus influenzae Rd
cugcaaugauaagauguuucac

SEQ ID NO: 2724225 - RNA, 18 nt, Haemophilus influenzae Rd
cugcaauuuuacgagaaa

SEQ ID NO: 2724226 - RNA, 18 nt, Haemophilus influenzae Rd
cugcacaaaguugauaau

SEQ ID NO: 2724227 - RNA, 19 nt, Haemophilus influenzae Rd
cugcacaaaguugauaauc

SEQ ID NO: 2724228 - RNA, 16 nt, Haemophilus influenzae Rd
cugcacaagcaccacu

SEQ ID NO: 2724229 - RNA, 18 nt, Haemophilus influenzae Rd
cugcaccaaucaaauaaa

SEQ ID NO: 2724230 - RNA, 19 nt, Haemophilus influenzae Rd
cugcacccuaauucauuaa

SEQ ID NO: 2724231 - RNA, 14 nt, Haemophilus influenzae Rd
cugcaccuuaauua

SEQ ID NO: 2724232 - RNA, 16 nt, Haemophilus influenzae Rd
cugcacgggaaaucca

SEQ ID NO: 2724233 - RNA, 17 nt, Haemophilus influenzae Rd
cugcacgggaaauccag

SEQ ID NO: 2724234 - RNA, 22 nt, Haemophilus influenzae Rd
cugcacuauauacauuaacaau

SEQ ID NO: 2724235 - RNA, 13 nt, Haemophilus influenzae Rd
cugcacuuuaaca

SEQ ID NO: 2724236 - RNA, 21 nt, Haemophilus influenzae Rd
cugcagagaagaaauacaauc

SEQ ID NO: 2724237 - RNA, 15 nt, Haemophilus influenzae Rd
cugcagcauuuaaag

SEQ ID NO: 2724238 - RNA, 16 nt, Haemophilus influenzae Rd
cugcagccauaauauu

SEQ ID NO: 2724239 - RNA, 20 nt, Haemophilus influenzae Rd
cugcagccauaauauuuaaa

SEQ ID NO: 2724240 - RNA, 21 nt, Haemophilus influenzae Rd
cugcagccauaauauuuaaaa

SEQ ID NO: 2724241 - RNA, 17 nt, Haemophilus influenzae Rd
cugcagcugcugcuuua

SEQ ID NO: 2724242 - RNA, 20 nt, Haemophilus influenzae Rd
cugcagcuugcgccauugaa

SEQ ID NO: 2724243 - RNA, 14 nt, Haemophilus influenzae Rd
cugcaggaaaaaua

SEQ ID NO: 2724244 - RNA, 18 nt, Haemophilus influenzae Rd
cugcaggcauuuucaacu

SEQ ID NO: 2724245 - RNA, 21 nt, Haemophilus influenzae Rd
cugcaguuuuuuguuuuuccg

SEQ ID NO: 2724246 - RNA, 15 nt, Haemophilus influenzae Rd
cugcauagaaugcaa

SEQ ID NO: 2724247 - RNA, 13 nt, Haemophilus influenzae Rd
cugcaucaauaau

SEQ ID NO: 2724248 - RNA, 15 nt, Haemophilus influenzae Rd
cugcaucacaaacac

SEQ ID NO: 2724249 - RNA, 23 nt, Haemophilus influenzae Rd
cugcaucguugcuaccacuugau

SEQ ID NO: 2724250 - RNA, 15 nt, Haemophilus influenzae Rd
cugcaucugcauuuc

SEQ ID NO: 2724251 - RNA, 20 nt, Haemophilus influenzae Rd
cugcauuacugcggcuaguc

SEQ ID NO: 2724252 - RNA, 20 nt, Haemophilus influenzae Rd
cugcauuauaaccaaaguuu

SEQ ID NO: 2724253 - RNA, 12 nt, Haemophilus influenzae Rd
cugcauuuaaug

SEQ ID NO: 2724254 - RNA, 15 nt, Haemophilus influenzae Rd
cugcauuucaauuuc

SEQ ID NO: 2724255 - RNA, 23 nt, Haemophilus influenzae Rd
cugcauuucaauuucacugccaa

SEQ ID NO: 2724256 - RNA, 16 nt, Haemophilus influenzae Rd
cugccaaaccaucucg

SEQ ID NO: 2724257 - RNA, 14 nt, Haemophilus influenzae Rd
cugccaaugcuucu

SEQ ID NO: 2724258 - RNA, 13 nt, Haemophilus influenzae Rd
cugccacaucauc

SEQ ID NO: 2724259 - RNA, 15 nt, Haemophilus influenzae Rd
cugccacuaauaagc

SEQ ID NO: 2724260 - RNA, 20 nt, Haemophilus influenzae Rd
cugccacuucagcuaauaaa

SEQ ID NO: 2724261 - RNA, 14 nt, Haemophilus influenzae Rd
cugccacuucuugc

SEQ ID NO: 2724262 - RNA, 20 nt, Haemophilus influenzae Rd
cugccauaauaacgccaccc

SEQ ID NO: 2724263 - RNA, 17 nt, Haemophilus influenzae Rd
cugcccaaguugugcca

SEQ ID NO: 2724264 - RNA, 19 nt, Haemophilus influenzae Rd
cugcccauaagugagaaaa

SEQ ID NO: 2724265 - RNA, 13 nt, Haemophilus influenzae Rd
cugccgaauagau

SEQ ID NO: 2724266 - RNA, 13 nt, Haemophilus influenzae Rd
cugccuaauaagc

SEQ ID NO: 2724267 - RNA, 15 nt, Haemophilus influenzae Rd
cugccucuguauuuu

SEQ ID NO: 2724268 - RNA, 16 nt, Haemophilus influenzae Rd
cugccucuguauuuuu

SEQ ID NO: 2724269 - RNA, 12 nt, Haemophilus influenzae Rd
cugccugauuuu

SEQ ID NO: 2724270 - RNA, 13 nt, Haemophilus influenzae Rd
cugccuuuuucuu

SEQ ID NO: 2724271 - RNA, 17 nt, Haemophilus influenzae Rd
cugcgacuuucccugca

SEQ ID NO: 2724272 - RNA, 22 nt, Haemophilus influenzae Rd
cugcgagcaguuuucgugauuu

SEQ ID NO: 2724273 - RNA, 19 nt, Haemophilus influenzae Rd
cugcgauacguuucauauc

SEQ ID NO: 2724274 - RNA, 15 nt, Haemophilus influenzae Rd
cugcgauuucuuuug

SEQ ID NO: 2724275 - RNA, 18 nt, Haemophilus influenzae Rd
cugcgccuaauuggaaaa

SEQ ID NO: 2724276 - RNA, 23 nt, Haemophilus influenzae Rd
cugcgccuaauuggaaaaguaag

SEQ ID NO: 2724277 - RNA, 22 nt, Haemophilus influenzae Rd
cugcguuuggcacaacaucaga

SEQ ID NO: 2724278 - RNA, 19 nt, Haemophilus influenzae Rd
cugcuaacucaucaacaaa

SEQ ID NO: 2724279 - RNA, 16 nt, Haemophilus influenzae Rd
cugcuaauacugucac

SEQ ID NO: 2724280 - RNA, 17 nt, Haemophilus influenzae Rd
cugcuaauuccacuuca

SEQ ID NO: 2724281 - RNA, 14 nt, Haemophilus influenzae Rd
cugcuacaauuuca

SEQ ID NO: 2724282 - RNA, 18 nt, Haemophilus influenzae Rd
cugcuacaauuucauuaa

SEQ ID NO: 2724283 - RNA, 17 nt, Haemophilus influenzae Rd
cugcuacauuugcccca

SEQ ID NO: 2724284 - RNA, 15 nt, Haemophilus influenzae Rd
cugcuaguucuucaa

SEQ ID NO: 2724285 - RNA, 19 nt, Haemophilus influenzae Rd
cugcugacgguucaguuuc

SEQ ID NO: 2724286 - RNA, 20 nt, Haemophilus influenzae Rd
cugcugcaagauuugcugcu

SEQ ID NO: 2724287 - RNA, 23 nt, Haemophilus influenzae Rd
cugcugcaagauuugcugcugcu

SEQ ID NO: 2724288 - RNA, 16 nt, Haemophilus influenzae Rd
cugcugcaguuacugc

SEQ ID NO: 2724289 - RNA, 20 nt, Haemophilus influenzae Rd
cugcugcaguuacugccucu

SEQ ID NO: 2724290 - RNA, 15 nt, Haemophilus influenzae Rd
cugcugcaguuucug

SEQ ID NO: 2724291 - RNA, 15 nt, Haemophilus influenzae Rd
cugcuggcucuacgc

SEQ ID NO: 2724292 - RNA, 23 nt, Haemophilus influenzae Rd
cugcuggcucuacgcaagcgguu

SEQ ID NO: 2724293 - RNA, 15 nt, Haemophilus influenzae Rd
cugcuguaacguuaa

SEQ ID NO: 2724294 - RNA, 11 nt, Haemophilus influenzae Rd
cugcuucauaa

SEQ ID NO: 2724295 - RNA, 16 nt, Haemophilus influenzae Rd
cugcuucuuuuaauaa

SEQ ID NO: 2724296 - RNA, 15 nt, Haemophilus influenzae Rd
cugcuugaaugcgag

SEQ ID NO: 2724297 - RNA, 16 nt, Haemophilus influenzae Rd
cugcuugauacauuuc

SEQ ID NO: 2724298 - RNA, 18 nt, Haemophilus influenzae Rd
cugcuugguaauaaucaa

SEQ ID NO: 2724299 - RNA, 13 nt, Haemophilus influenzae Rd
cugcuuguaacca

SEQ ID NO: 2724300 - RNA, 18 nt, Haemophilus influenzae Rd
cugcuuguaaccaauaaa

SEQ ID NO: 2724301 - RNA, 21 nt, Haemophilus influenzae Rd
cugcuuguaaccaauaaaggg

SEQ ID NO: 2724302 - RNA, 22 nt, Haemophilus influenzae Rd
cugcuuguucacguguuuuuuc

SEQ ID NO: 2724303 - RNA, 18 nt, Haemophilus influenzae Rd
cugcuuuaacaauuacug

SEQ ID NO: 2724304 - RNA, 19 nt, Haemophilus influenzae Rd
cugcuuuaacaauuacugc

SEQ ID NO: 2724305 - RNA, 18 nt, Haemophilus influenzae Rd
cugcuuuagcuugauuga

SEQ ID NO: 2724306 - RNA, 19 nt, Haemophilus influenzae Rd
cugcuuuauuuggcauuug

SEQ ID NO: 2724307 - RNA, 19 nt, Haemophilus influenzae Rd
cugcuuucuagaugaugaa

SEQ ID NO: 2724308 - RNA, 15 nt, Haemophilus influenzae Rd
cugcuuuuucuugcu

SEQ ID NO: 2724309 - RNA, 13 nt, Haemophilus influenzae Rd
cugcuuuuuucca

SEQ ID NO: 2724310 - RNA, 19 nt, Haemophilus influenzae Rd
cuggaaauuccacuuuuuc

SEQ ID NO: 2724311 - RNA, 21 nt, Haemophilus influenzae Rd
cuggaaauuccacuuuuucau

SEQ ID NO: 2724312 - RNA, 16 nt, Haemophilus influenzae Rd
cuggaaauucuucaau

SEQ ID NO: 2724313 - RNA, 20 nt, Haemophilus influenzae Rd
cuggaagcgaauuuaagaaa

SEQ ID NO: 2724314 - RNA, 21 nt, Haemophilus influenzae Rd
cuggaaucaaugaguggucgu

SEQ ID NO: 2724315 - RNA, 16 nt, Haemophilus influenzae Rd
cuggauaaaugccgcc

SEQ ID NO: 2724316 - RNA, 18 nt, Haemophilus influenzae Rd
cuggauaaaugccgccac

SEQ ID NO: 2724317 - RNA, 19 nt, Haemophilus influenzae Rd
cuggauauugcucaauuaa

SEQ ID NO: 2724318 - RNA, 19 nt, Haemophilus influenzae Rd
cuggauuaaauaaccaacu

SEQ ID NO: 2724319 - RNA, 18 nt, Haemophilus influenzae Rd
cuggauuagagccaucaa

SEQ ID NO: 2724320 - RNA, 22 nt, Haemophilus influenzae Rd
cuggauuucccgugcagacuag

SEQ ID NO: 2724321 - RNA, 23 nt, Haemophilus influenzae Rd
cuggcaaaaaugucaggcgauuu

SEQ ID NO: 2724322 - RNA, 20 nt, Haemophilus influenzae Rd
cuggcaauauuucaauaagc

SEQ ID NO: 2724323 - RNA, 16 nt, Haemophilus influenzae Rd
cuggcaaucgccaaug

SEQ ID NO: 2724324 - RNA, 18 nt, Haemophilus influenzae Rd
cuggcacacguugcaccu

SEQ ID NO: 2724325 - RNA, 17 nt, Haemophilus influenzae Rd
cuggcacaucaaauucu

SEQ ID NO: 2724326 - RNA, 17 nt, Haemophilus influenzae Rd
cuggcauaucugcugcu

SEQ ID NO: 2724327 - RNA, 21 nt, Haemophilus influenzae Rd
cuggcuaacaaauaaugccuc

SEQ ID NO: 2724328 - RNA, 14 nt, Haemophilus influenzae Rd
cuggcucugcugau

SEQ ID NO: 2724329 - RNA, 12 nt, Haemophilus influenzae Rd
cuggcucuucuu

SEQ ID NO: 2724330 - RNA, 23 nt, Haemophilus influenzae Rd
cuggcucuucuuucgguggugcg

SEQ ID NO: 2724331 - RNA, 16 nt, Haemophilus influenzae Rd
cuggcuuaaaugaucu

SEQ ID NO: 2724332 - RNA, 15 nt, Haemophilus influenzae Rd
cuggcuugccaauuc

SEQ ID NO: 2724333 - RNA, 18 nt, Haemophilus influenzae Rd
cuggcuugugaaauaaaa

SEQ ID NO: 2724334 - RNA, 24 nt, Haemophilus influenzae Rd
cugggaauucgaagguauauaagc

SEQ ID NO: 2724335 - RNA, 21 nt, Haemophilus influenzae Rd
cugggcaaaaucaucaaacac

SEQ ID NO: 2724336 - RNA, 23 nt, Haemophilus influenzae Rd
cugggcaaaaucaucaaacaccc

SEQ ID NO: 2724337 - RNA, 22 nt, Haemophilus influenzae Rd
cuggggacgcaccuuuugaaaa

SEQ ID NO: 2724338 - RNA, 20 nt, Haemophilus influenzae Rd
cuggguaaaauaaugcaaaa

SEQ ID NO: 2724339 - RNA, 22 nt, Haemophilus influenzae Rd
cuggguauugauucaauucuuc

SEQ ID NO: 2724340 - RNA, 22 nt, Haemophilus influenzae Rd
cuggguuucggauaauaauuuu

SEQ ID NO: 2724341 - RNA, 15 nt, Haemophilus influenzae Rd
cugguacaaauuuag

SEQ ID NO: 2724342 - RNA, 14 nt, Haemophilus influenzae Rd
cuggugagugagca

SEQ ID NO: 2724343 - RNA, 22 nt, Haemophilus influenzae Rd
cuggugagugagcauuucguau

SEQ ID NO: 2724344 - RNA, 18 nt, Haemophilus influenzae Rd
cugguucguuugguucga

SEQ ID NO: 2724345 - RNA, 22 nt, Haemophilus influenzae Rd
cugguuuaucgucugcacgaau

SEQ ID NO: 2724346 - RNA, 15 nt, Haemophilus influenzae Rd
cugguuuauuuauuc

SEQ ID NO: 2724347 - RNA, 21 nt, Haemophilus influenzae Rd
cuguaaauaugccuuauauuu

SEQ ID NO: 2724348 - RNA, 20 nt, Haemophilus influenzae Rd
cuguaauauaugaaaaauaa

SEQ ID NO: 2724349 - RNA, 17 nt, Haemophilus influenzae Rd
cuguaguagauaacaac

SEQ ID NO: 2724350 - RNA, 13 nt, Haemophilus influenzae Rd
cuguauaccaacc

SEQ ID NO: 2724351 - RNA, 16 nt, Haemophilus influenzae Rd
cuguauaccaaccauu

SEQ ID NO: 2724352 - RNA, 13 nt, Haemophilus influenzae Rd
cuguaucuacuuu

SEQ ID NO: 2724353 - RNA, 18 nt, Haemophilus influenzae Rd
cuguaucuacuuuauuca

SEQ ID NO: 2724354 - RNA, 14 nt, Haemophilus influenzae Rd
cuguaucuuuagcu

SEQ ID NO: 2724355 - RNA, 13 nt, Haemophilus influenzae Rd
cuguauuaucuaa

SEQ ID NO: 2724356 - RNA, 15 nt, Haemophilus influenzae Rd
cuguauuggaaaagu

SEQ ID NO: 2724357 - RNA, 19 nt, Haemophilus influenzae Rd
cuguauuuuuuauuuaauu

SEQ ID NO: 2724358 - RNA, 13 nt, Haemophilus influenzae Rd
cugucacaauauu

SEQ ID NO: 2724359 - RNA, 14 nt, Haemophilus influenzae Rd
cugucacaauauuu

SEQ ID NO: 2724360 - RNA, 16 nt, Haemophilus influenzae Rd
cugucauauaaagugg

SEQ ID NO: 2724361 - RNA, 18 nt, Haemophilus influenzae Rd
cugucaucgguucuuuua

SEQ ID NO: 2724362 - RNA, 16 nt, Haemophilus influenzae Rd
cugucgcuucuaauuc

SEQ ID NO: 2724363 - RNA, 15 nt, Haemophilus influenzae Rd
cugucuaauuuuuua

SEQ ID NO: 2724364 - RNA, 13 nt, Haemophilus influenzae Rd
cugucucauuuug

SEQ ID NO: 2724365 - RNA, 20 nt, Haemophilus influenzae Rd
cugucuggcaaguagaacca

SEQ ID NO: 2724366 - RNA, 14 nt, Haemophilus influenzae Rd
cugucuuccacaac

SEQ ID NO: 2724367 - RNA, 16 nt, Haemophilus influenzae Rd
cugugagucuugcuuu

SEQ ID NO: 2724368 - RNA, 17 nt, Haemophilus influenzae Rd
cugugagucuugcuuuu

SEQ ID NO: 2724369 - RNA, 17 nt, Haemophilus influenzae Rd
cugugauaccgauaaaa

SEQ ID NO: 2724370 - RNA, 19 nt, Haemophilus influenzae Rd
cugugauauauaucacaga

SEQ ID NO: 2724371 - RNA, 19 nt, Haemophilus influenzae Rd
cugugccaagcauacgacg

SEQ ID NO: 2724372 - RNA, 15 nt, Haemophilus influenzae Rd
cugugccuagggcaa

SEQ ID NO: 2724373 - RNA, 13 nt, Haemophilus influenzae Rd
cuguggcuaauuc

SEQ ID NO: 2724374 - RNA, 13 nt, Haemophilus influenzae Rd
cugugguaaaaau

SEQ ID NO: 2724375 - RNA, 15 nt, Haemophilus influenzae Rd
cuguguaaaacauug

SEQ ID NO: 2724376 - RNA, 20 nt, Haemophilus influenzae Rd
cuguuaaacgcauauuuugu

SEQ ID NO: 2724377 - RNA, 20 nt, Haemophilus influenzae Rd
cuguuacuaaaucgcccaac

SEQ ID NO: 2724378 - RNA, 23 nt, Haemophilus influenzae Rd
cuguuauauaaacaauuccccuu

SEQ ID NO: 2724379 - RNA, 19 nt, Haemophilus influenzae Rd
cuguuauuaagcgugcuuu

SEQ ID NO: 2724380 - RNA, 16 nt, Haemophilus influenzae Rd
cuguucaaauucugcu

SEQ ID NO: 2724381 - RNA, 16 nt, Haemophilus influenzae Rd
cuguuccgccacaagu

SEQ ID NO: 2724382 - RNA, 19 nt, Haemophilus influenzae Rd
cuguucggacuuacaucug

SEQ ID NO: 2724383 - RNA, 16 nt, Haemophilus influenzae Rd
cuguucuucugggauu

SEQ ID NO: 2724384 - RNA, 16 nt, Haemophilus influenzae Rd
cuguugaaugcuauuc

SEQ ID NO: 2724385 - RNA, 15 nt, Haemophilus influenzae Rd
cuguugagcaucuac

SEQ ID NO: 2724386 - RNA, 16 nt, Haemophilus influenzae Rd
cuguugcaccaagcaa

SEQ ID NO: 2724387 - RNA, 21 nt, Haemophilus influenzae Rd
cuguugcauuagaaaucaaca

SEQ ID NO: 2724388 - RNA, 23 nt, Haemophilus influenzae Rd
cuguugcgauuuccacuuuuuca

SEQ ID NO: 2724389 - RNA, 18 nt, Haemophilus influenzae Rd
cuguugcuucaauuguug

SEQ ID NO: 2724390 - RNA, 17 nt, Haemophilus influenzae Rd
cuguuggaauuucaaaa

SEQ ID NO: 2724391 - RNA, 20 nt, Haemophilus influenzae Rd
cuguuggagcaagcucaaaa

SEQ ID NO: 2724392 - RNA, 15 nt, Haemophilus influenzae Rd
cuguugggaauaauu

SEQ ID NO: 2724393 - RNA, 18 nt, Haemophilus influenzae Rd
cuguuuaaaucuaagccu

SEQ ID NO: 2724394 - RNA, 22 nt, Haemophilus influenzae Rd
cuguuuauagcgucuuuuugca

SEQ ID NO: 2724395 - RNA, 21 nt, Haemophilus influenzae Rd
cuguuuauuuuuuauaugcca

SEQ ID NO: 2724396 - RNA, 22 nt, Haemophilus influenzae Rd
cuguuucacgaucauaaauuuu

SEQ ID NO: 2724397 - RNA, 21 nt, Haemophilus influenzae Rd
cuguuucgcaguguuaaaugc

SEQ ID NO: 2724398 - RNA, 17 nt, Haemophilus influenzae Rd
cuguuucuaauucggcu

SEQ ID NO: 2724399 - RNA, 15 nt, Haemophilus influenzae Rd
cuguuucuucuacuu

SEQ ID NO: 2724400 - RNA, 20 nt, Haemophilus influenzae Rd
cuguuugauaacuuuaagua

SEQ ID NO: 2724401 - RNA, 10 nt, Haemophilus influenzae Rd
cuguuuuaag

SEQ ID NO: 2724402 - RNA, 20 nt, Haemophilus influenzae Rd
cuguuuuaagguuuuuuccg

SEQ ID NO: 2724403 - RNA, 18 nt, Haemophilus influenzae Rd
cuguuuucaauuuuaaaa

SEQ ID NO: 2724404 - RNA, 16 nt, Haemophilus influenzae Rd
cuguuuugccugcuuc

SEQ ID NO: 2724405 - RNA, 17 nt, Haemophilus influenzae Rd
cuguuuugccugcuucg

SEQ ID NO: 2724406 - RNA, 17 nt, Haemophilus influenzae Rd
cuguuuuggcauuuuca

SEQ ID NO: 2724407 - RNA, 17 nt, Haemophilus influenzae Rd
cuguuuuuccauucacu

SEQ ID NO: 2724408 - RNA, 20 nt, Haemophilus influenzae Rd
cuguuuuugguaauuuacuc

SEQ ID NO: 2724409 - RNA, 12 nt, Haemophilus influenzae Rd
cuuaaaaacccc

SEQ ID NO: 2724410 - RNA, 14 nt, Haemophilus influenzae Rd
cuuaaaaagagcgg

SEQ ID NO: 2724411 - RNA, 22 nt, Haemophilus influenzae Rd
cuuaaaagaaauucgcuuuuuu

SEQ ID NO: 2724412 - RNA, 16 nt, Haemophilus influenzae Rd
cuuaaaagauuaaaac

SEQ ID NO: 2724413 - RNA, 20 nt, Haemophilus influenzae Rd
cuuaaaauacccauaaaauu

SEQ ID NO: 2724414 - RNA, 19 nt, Haemophilus influenzae Rd
cuuaaaaucuugguuuaaa

SEQ ID NO: 2724415 - RNA, 22 nt, Haemophilus influenzae Rd
cuuaaaauucaaagauuauuua

SEQ ID NO: 2724416 - RNA, 14 nt, Haemophilus influenzae Rd
cuuaaacaagcucu

SEQ ID NO: 2724417 - RNA, 17 nt, Haemophilus influenzae Rd
cuuaaacucgaaggaaa

SEQ ID NO: 2724418 - RNA, 18 nt, Haemophilus influenzae Rd
cuuaaagcugaauaaaua

SEQ ID NO: 2724419 - RNA, 11 nt, Haemophilus influenzae Rd
cuuaaauauau

SEQ ID NO: 2724420 - RNA, 18 nt, Haemophilus influenzae Rd
cuuaaauauaucaagcag

SEQ ID NO: 2724421 - RNA, 16 nt, Haemophilus influenzae Rd
cuuaaaugaucuaaug

SEQ ID NO: 2724422 - RNA, 18 nt, Haemophilus influenzae Rd
cuuaaaugaucuaauggg

SEQ ID NO: 2724423 - RNA, 18 nt, Haemophilus influenzae Rd
cuuaaauuagcguaaaca

SEQ ID NO: 2724424 - RNA, 21 nt, Haemophilus influenzae Rd
cuuaaauuagcguaaacauuu

SEQ ID NO: 2724425 - RNA, 23 nt, Haemophilus influenzae Rd
cuuaaauuagcguaaacauuuug

SEQ ID NO: 2724426 - RNA, 18 nt, Haemophilus influenzae Rd
cuuaaauuuuuauaaagu

SEQ ID NO: 2724427 - RNA, 13 nt, Haemophilus influenzae Rd
cuuaacaaagccu

SEQ ID NO: 2724428 - RNA, 17 nt, Haemophilus influenzae Rd
cuuaacauuaauaaacc

SEQ ID NO: 2724429 - RNA, 16 nt, Haemophilus influenzae Rd
cuuaacugaaaauuca

SEQ ID NO: 2724430 - RNA, 18 nt, Haemophilus influenzae Rd
cuuaagucagcauaaaca

SEQ ID NO: 2724431 - RNA, 20 nt, Haemophilus influenzae Rd
cuuaagugcgguauuuuuau

SEQ ID NO: 2724432 - RNA, 19 nt, Haemophilus influenzae Rd
cuuaauaauggauuaauuc

SEQ ID NO: 2724433 - RNA, 15 nt, Haemophilus influenzae Rd
cuuaauacgacggca

SEQ ID NO: 2724434 - RNA, 21 nt, Haemophilus influenzae Rd
cuuaauauugccauaauaauc

SEQ ID NO: 2724435 - RNA, 16 nt, Haemophilus influenzae Rd
cuuaaucauuuuuuaa

SEQ ID NO: 2724436 - RNA, 15 nt, Haemophilus influenzae Rd
cuuaauccuuucacu

SEQ ID NO: 2724437 - RNA, 16 nt, Haemophilus influenzae Rd
cuuaaucggcacaaga

SEQ ID NO: 2724438 - RNA, 18 nt, Haemophilus influenzae Rd
cuuaaucggcacaagacu

SEQ ID NO: 2724439 - RNA, 16 nt, Haemophilus influenzae Rd
cuuaaugaacuuucua

SEQ ID NO: 2724440 - RNA, 15 nt, Haemophilus influenzae Rd
cuuaaugcaaaaucu

SEQ ID NO: 2724441 - RNA, 22 nt, Haemophilus influenzae Rd
cuuaauggcuugcucuguauuu

SEQ ID NO: 2724442 - RNA, 16 nt, Haemophilus influenzae Rd
cuuaauguuaauaauu

SEQ ID NO: 2724443 - RNA, 16 nt, Haemophilus influenzae Rd
cuuaauuaagauaauu

SEQ ID NO: 2724444 - RNA, 14 nt, Haemophilus influenzae Rd
cuuaauuaaucuuu

SEQ ID NO: 2724445 - RNA, 16 nt, Haemophilus influenzae Rd
cuuaauuagauuuauu

SEQ ID NO: 2724446 - RNA, 20 nt, Haemophilus influenzae Rd
cuuaauuagauuuauuuucu

SEQ ID NO: 2724447 - RNA, 18 nt, Haemophilus influenzae Rd
cuuaauuaguuauacuua

SEQ ID NO: 2724448 - RNA, 17 nt, Haemophilus influenzae Rd
cuuaauugauuuuaaag

SEQ ID NO: 2724449 - RNA, 17 nt, Haemophilus influenzae Rd
cuuaauugugugcguuu

SEQ ID NO: 2724450 - RNA, 15 nt, Haemophilus influenzae Rd
cuuaauuuaauuaug

SEQ ID NO: 2724451 - RNA, 19 nt, Haemophilus influenzae Rd
cuuaauuucauuaauaacc

SEQ ID NO: 2724452 - RNA, 14 nt, Haemophilus influenzae Rd
cuuaauuuuauuaa

SEQ ID NO: 2724453 - RNA, 13 nt, Haemophilus influenzae Rd
cuuaauuuuuuaa

SEQ ID NO: 2724454 - RNA, 13 nt, Haemophilus influenzae Rd
cuuacaacaaauu

SEQ ID NO: 2724455 - RNA, 23 nt, Haemophilus influenzae Rd
cuuacagauucauuguuucucaa

SEQ ID NO: 2724456 - RNA, 16 nt, Haemophilus influenzae Rd
cuuacagcaaaagcaa

SEQ ID NO: 2724457 - RNA, 13 nt, Haemophilus influenzae Rd
cuuacaggaaagu

SEQ ID NO: 2724458 - RNA, 19 nt, Haemophilus influenzae Rd
cuuacagggcuuuauuuuu

SEQ ID NO: 2724459 - RNA, 17 nt, Haemophilus influenzae Rd
cuuacauugcuuaacau

SEQ ID NO: 2724460 - RNA, 19 nt, Haemophilus influenzae Rd
cuuaccaaccgaauauaug

SEQ ID NO: 2724461 - RNA, 15 nt, Haemophilus influenzae Rd
cuuaccccaacaaac

SEQ ID NO: 2724462 - RNA, 14 nt, Haemophilus influenzae Rd
cuuaccgaucauuu

SEQ ID NO: 2724463 - RNA, 13 nt, Haemophilus influenzae Rd
cuuaccuuccacu

SEQ ID NO: 2724464 - RNA, 23 nt, Haemophilus influenzae Rd
cuuacgaagaauccacauuuuuu

SEQ ID NO: 2724465 - RNA, 22 nt, Haemophilus influenzae Rd
cuuacgccagcuaaagaaagca

SEQ ID NO: 2724466 - RNA, 21 nt, Haemophilus influenzae Rd
cuuacgcugaauagcaaauac

SEQ ID NO: 2724467 - RNA, 18 nt, Haemophilus influenzae Rd
cuuacuacguguucauca

SEQ ID NO: 2724468 - RNA, 19 nt, Haemophilus influenzae Rd
cuuacuacguguucaucau

SEQ ID NO: 2724469 - RNA, 22 nt, Haemophilus influenzae Rd
cuuacucauuuaucaaacaagc

SEQ ID NO: 2724470 - RNA, 16 nt, Haemophilus influenzae Rd
cuuacugccuuuuucu

SEQ ID NO: 2724471 - RNA, 14 nt, Haemophilus influenzae Rd
cuuacuucuacuuc

SEQ ID NO: 2724472 - RNA, 19 nt, Haemophilus influenzae Rd
cuuacuucuacuucuugug

SEQ ID NO: 2724473 - RNA, 16 nt, Haemophilus influenzae Rd
cuuacuuuauuuuuaa

SEQ ID NO: 2724474 - RNA, 17 nt, Haemophilus influenzae Rd
cuuagacucguuuuuua

SEQ ID NO: 2724475 - RNA, 12 nt, Haemophilus influenzae Rd
cuuagauaaauu

SEQ ID NO: 2724476 - RNA, 13 nt, Haemophilus influenzae Rd
cuuagauaaauuc

SEQ ID NO: 2724477 - RNA, 16 nt, Haemophilus influenzae Rd
cuuagauaacguucau

SEQ ID NO: 2724478 - RNA, 14 nt, Haemophilus influenzae Rd
cuuagauuuucuua

SEQ ID NO: 2724479 - RNA, 21 nt, Haemophilus influenzae Rd
cuuagauuuucuuauuauaca

SEQ ID NO: 2724480 - RNA, 14 nt, Haemophilus influenzae Rd
cuuagccuuuuugu

SEQ ID NO: 2724481 - RNA, 21 nt, Haemophilus influenzae Rd
cuuagcgcauuuuucuuuaaa

SEQ ID NO: 2724482 - RNA, 17 nt, Haemophilus influenzae Rd
cuuagcgugcuaauucc

SEQ ID NO: 2724483 - RNA, 17 nt, Haemophilus influenzae Rd
cuuaggaugauacaauc

SEQ ID NO: 2724484 - RNA, 23 nt, Haemophilus influenzae Rd
cuuaggguaauuuuuucgguuuu

SEQ ID NO: 2724485 - RNA, 15 nt, Haemophilus influenzae Rd
cuuaguaauauagca

SEQ ID NO: 2724486 - RNA, 13 nt, Haemophilus influenzae Rd
cuuagugaaaaga

SEQ ID NO: 2724487 - RNA, 14 nt, Haemophilus influenzae Rd
cuuagugaaaagaa

SEQ ID NO: 2724488 - RNA, 15 nt, Haemophilus influenzae Rd
cuuagugaaaagaaa

SEQ ID NO: 2724489 - RNA, 23 nt, Haemophilus influenzae Rd
cuuauaauaugaaucguugauca

SEQ ID NO: 2724490 - RNA, 15 nt, Haemophilus influenzae Rd
cuuauacaaaacuaa

SEQ ID NO: 2724491 - RNA, 16 nt, Haemophilus influenzae Rd
cuuauacaacaaaaag

SEQ ID NO: 2724492 - RNA, 17 nt, Haemophilus influenzae Rd
cuuauacgaguaaaaaa

SEQ ID NO: 2724493 - RNA, 18 nt, Haemophilus influenzae Rd
cuuauacgaguaaaaaau

SEQ ID NO: 2724494 - RNA, 21 nt, Haemophilus influenzae Rd
cuuauacgaguaaaaaaucua

SEQ ID NO: 2724495 - RNA, 18 nt, Haemophilus influenzae Rd
cuuauauuauuuagauua

SEQ ID NO: 2724496 - RNA, 17 nt, Haemophilus influenzae Rd
cuuauauucaaauuuca

SEQ ID NO: 2724497 - RNA, 12 nt, Haemophilus influenzae Rd
cuuaucaaacac

SEQ ID NO: 2724498 - RNA, 23 nt, Haemophilus influenzae Rd
cuuauccguuacauuauuuaauu

SEQ ID NO: 2724499 - RNA, 17 nt, Haemophilus influenzae Rd
cuuauccuauaaaacaa

SEQ ID NO: 2724500 - RNA, 16 nt, Haemophilus influenzae Rd
cuuaucgguuggauuu

SEQ ID NO: 2724501 - RNA, 15 nt, Haemophilus influenzae Rd
cuuaucuaaaaagau

SEQ ID NO: 2724502 - RNA, 16 nt, Haemophilus influenzae Rd
cuuaucuaaacuuuca

SEQ ID NO: 2724503 - RNA, 16 nt, Haemophilus influenzae Rd
cuuaucuaacuaaaau

SEQ ID NO: 2724504 - RNA, 12 nt, Haemophilus influenzae Rd
cuuaucuacaau

SEQ ID NO: 2724505 - RNA, 18 nt, Haemophilus influenzae Rd
cuuaugaaaaaaaauuua

SEQ ID NO: 2724506 - RNA, 14 nt, Haemophilus influenzae Rd
cuuaugaaacagcu

SEQ ID NO: 2724507 - RNA, 21 nt, Haemophilus influenzae Rd
cuuaugaacuuuuuuauaauc

SEQ ID NO: 2724508 - RNA, 15 nt, Haemophilus influenzae Rd
cuuaugugcaccuuc

SEQ ID NO: 2724509 - RNA, 16 nt, Haemophilus influenzae Rd
cuuaugugcaccuuca

SEQ ID NO: 2724510 - RNA, 23 nt, Haemophilus influenzae Rd
cuuauguuuugguuuucuuuuuu

SEQ ID NO: 2724511 - RNA, 23 nt, Haemophilus influenzae Rd
cuuauuaagguaauauguaauau

SEQ ID NO: 2724512 - RNA, 23 nt, Haemophilus influenzae Rd
cuuauuaccuacuaauuagguuc

SEQ ID NO: 2724513 - RNA, 18 nt, Haemophilus influenzae Rd
cuuauuauacauuuaacc

SEQ ID NO: 2724514 - RNA, 20 nt, Haemophilus influenzae Rd
cuuauucauuaaggcuuuuc

SEQ ID NO: 2724515 - RNA, 18 nt, Haemophilus influenzae Rd
cuuauucgcugcaaaauc

SEQ ID NO: 2724516 - RNA, 23 nt, Haemophilus influenzae Rd
cuuauucgguguucugcaucaau

SEQ ID NO: 2724517 - RNA, 16 nt, Haemophilus influenzae Rd
cuuauugaagaaagag

SEQ ID NO: 2724518 - RNA, 12 nt, Haemophilus influenzae Rd
cuuauuucaaua

SEQ ID NO: 2724519 - RNA, 15 nt, Haemophilus influenzae Rd
cuuauuucuguuacu

SEQ ID NO: 2724520 - RNA, 13 nt, Haemophilus influenzae Rd
cuuauuugauuaa

SEQ ID NO: 2724521 - RNA, 14 nt, Haemophilus influenzae Rd
cuuauuuguuuuau

SEQ ID NO: 2724522 - RNA, 12 nt, Haemophilus influenzae Rd
cuuauuuuaaau

SEQ ID NO: 2724523 - RNA, 19 nt, Haemophilus influenzae Rd
cuuauuuuaaauaaaaaau

SEQ ID NO: 2724524 - RNA, 22 nt, Haemophilus influenzae Rd
cuuauuuuacuucaacaacgau

SEQ ID NO: 2724525 - RNA, 14 nt, Haemophilus influenzae Rd
cuuauuuugggauu

SEQ ID NO: 2724526 - RNA, 11 nt, Haemophilus influenzae Rd
cuuauuuuguu

SEQ ID NO: 2724527 - RNA, 17 nt, Haemophilus influenzae Rd
cuuauuuuguugcagcu

SEQ ID NO: 2724528 - RNA, 22 nt, Haemophilus influenzae Rd
cuuauuuuguugcagcuuucau

SEQ ID NO: 2724529 - RNA, 14 nt, Haemophilus influenzae Rd
cuuauuuuuaaaca

SEQ ID NO: 2724530 - RNA, 21 nt, Haemophilus influenzae Rd
cuuauuuuuauuaucaaaaaa

SEQ ID NO: 2724531 - RNA, 20 nt, Haemophilus influenzae Rd
cuuauuuuuuggaauauuau

SEQ ID NO: 2724532 - RNA, 17 nt, Haemophilus influenzae Rd
cuucaaaaagugcgguu

SEQ ID NO: 2724533 - RNA, 16 nt, Haemophilus influenzae Rd
cuucaaaauuuggccc

SEQ ID NO: 2724534 - RNA, 21 nt, Haemophilus influenzae Rd
cuucaaacgccguucaaaauc

SEQ ID NO: 2724535 - RNA, 14 nt, Haemophilus influenzae Rd
cuucaacauuuuuu

SEQ ID NO: 2724536 - RNA, 21 nt, Haemophilus influenzae Rd
cuucaaccacccauacuuuaa

SEQ ID NO: 2724537 - RNA, 17 nt, Haemophilus influenzae Rd
cuucaaccacuucaaau

SEQ ID NO: 2724538 - RNA, 16 nt, Haemophilus influenzae Rd
cuucaacuaacuggcu

SEQ ID NO: 2724539 - RNA, 19 nt, Haemophilus influenzae Rd
cuucaacuugccacaguag

SEQ ID NO: 2724540 - RNA, 14 nt, Haemophilus influenzae Rd
cuucaaguuuaucg

SEQ ID NO: 2724541 - RNA, 21 nt, Haemophilus influenzae Rd
cuucaauagauaaaucaaaac

SEQ ID NO: 2724542 - RNA, 16 nt, Haemophilus influenzae Rd
cuucaaucaucauuua

SEQ ID NO: 2724543 - RNA, 21 nt, Haemophilus influenzae Rd
cuucaaucaucauuuauuaaa

SEQ ID NO: 2724544 - RNA, 17 nt, Haemophilus influenzae Rd
cuucaaucgcaacacgu

SEQ ID NO: 2724545 - RNA, 15 nt, Haemophilus influenzae Rd
cuucaaugguuuuac

SEQ ID NO: 2724546 - RNA, 17 nt, Haemophilus influenzae Rd
cuucaauuuuuuaucaa

SEQ ID NO: 2724547 - RNA, 13 nt, Haemophilus influenzae Rd
cuucacaaauaau

SEQ ID NO: 2724548 - RNA, 20 nt, Haemophilus influenzae Rd
cuucacacaccaacacgcca

SEQ ID NO: 2724549 - RNA, 16 nt, Haemophilus influenzae Rd
cuucacaguaaagauu

SEQ ID NO: 2724550 - RNA, 17 nt, Haemophilus influenzae Rd
cuucaccaaucacagcc

SEQ ID NO: 2724551 - RNA, 16 nt, Haemophilus influenzae Rd
cuucaccagugaauuu

SEQ ID NO: 2724552 - RNA, 23 nt, Haemophilus influenzae Rd
cuucacuacuugaacuaauauca

SEQ ID NO: 2724553 - RNA, 13 nt, Haemophilus influenzae Rd
cuucacugugcca

SEQ ID NO: 2724554 - RNA, 18 nt, Haemophilus influenzae Rd
cuucacuuggcgaaaauc

SEQ ID NO: 2724555 - RNA, 13 nt, Haemophilus influenzae Rd
cuucagaaaauaa

SEQ ID NO: 2724556 - RNA, 14 nt, Haemophilus influenzae Rd
cuucagaaaauaaa

SEQ ID NO: 2724557 - RNA, 11 nt, Haemophilus influenzae Rd
cuucagaaaga

SEQ ID NO: 2724558 - RNA, 20 nt, Haemophilus influenzae Rd
cuucagaaagauuacauucu

SEQ ID NO: 2724559 - RNA, 11 nt, Haemophilus influenzae Rd
cuucagauuuu

SEQ ID NO: 2724560 - RNA, 19 nt, Haemophilus influenzae Rd
cuucagcaaguucugcacg

SEQ ID NO: 2724561 - RNA, 22 nt, Haemophilus influenzae Rd
cuucagcagauacaucuucugg

SEQ ID NO: 2724562 - RNA, 16 nt, Haemophilus influenzae Rd
cuucagcauaauguuu

SEQ ID NO: 2724563 - RNA, 14 nt, Haemophilus influenzae Rd
cuucagcauuuaaa

SEQ ID NO: 2724564 - RNA, 14 nt, Haemophilus influenzae Rd
cuucagcguuguca

SEQ ID NO: 2724565 - RNA, 19 nt, Haemophilus influenzae Rd
cuucagcguugucaucaga

SEQ ID NO: 2724566 - RNA, 14 nt, Haemophilus influenzae Rd
cuucagcuucuuca

SEQ ID NO: 2724567 - RNA, 17 nt, Haemophilus influenzae Rd
cuucagcuucuucaucg

SEQ ID NO: 2724568 - RNA, 18 nt, Haemophilus influenzae Rd
cuucagcuugaguuguca

SEQ ID NO: 2724569 - RNA, 21 nt, Haemophilus influenzae Rd
cuucaguccgccuuuuugcuu

SEQ ID NO: 2724570 - RNA, 22 nt, Haemophilus influenzae Rd
cuucaguccgccuuuuugcuua

SEQ ID NO: 2724571 - RNA, 14 nt, Haemophilus influenzae Rd
cuucaguuuucauu

SEQ ID NO: 2724572 - RNA, 13 nt, Haemophilus influenzae Rd
cuucauaaaaaaa

SEQ ID NO: 2724573 - RNA, 17 nt, Haemophilus influenzae Rd
cuucauaaguccaaguu

SEQ ID NO: 2724574 - RNA, 18 nt, Haemophilus influenzae Rd
cuucauagaaaccaauaa

SEQ ID NO: 2724575 - RNA, 23 nt, Haemophilus influenzae Rd
cuucauauaaauuagccaucgca

SEQ ID NO: 2724576 - RNA, 12 nt, Haemophilus influenzae Rd
cuucaucaaaac

SEQ ID NO: 2724577 - RNA, 17 nt, Haemophilus influenzae Rd
cuucaucaaaaugaaaa

SEQ ID NO: 2724578 - RNA, 14 nt, Haemophilus influenzae Rd
cuucaucaccugcu

SEQ ID NO: 2724579 - RNA, 14 nt, Haemophilus influenzae Rd
cuucauccauuuuc

SEQ ID NO: 2724580 - RNA, 16 nt, Haemophilus influenzae Rd
cuucaucgaaaauuaa

SEQ ID NO: 2724581 - RNA, 15 nt, Haemophilus influenzae Rd
cuucaucgucuucuu

SEQ ID NO: 2724582 - RNA, 16 nt, Haemophilus influenzae Rd
cuucaucgucuucuuc

SEQ ID NO: 2724583 - RNA, 23 nt, Haemophilus influenzae Rd
cuucaucgucuucuucgcuccaa

SEQ ID NO: 2724584 - RNA, 16 nt, Haemophilus influenzae Rd
cuucaucugcaucaca

SEQ ID NO: 2724585 - RNA, 17 nt, Haemophilus influenzae Rd
cuucaucugcaucacaa

SEQ ID NO: 2724586 - RNA, 14 nt, Haemophilus influenzae Rd
cuucaucuucuuuu

SEQ ID NO: 2724587 - RNA, 20 nt, Haemophilus influenzae Rd
cuucaucuuuaaacaucgcu

SEQ ID NO: 2724588 - RNA, 11 nt, Haemophilus influenzae Rd
cuucaugauuu

SEQ ID NO: 2724589 - RNA, 14 nt, Haemophilus influenzae Rd
cuucaugauuuucc

SEQ ID NO: 2724590 - RNA, 16 nt, Haemophilus influenzae Rd
cuucaugauuuuccaa

SEQ ID NO: 2724591 - RNA, 20 nt, Haemophilus influenzae Rd
cuucauuaaaaccaauuuuu

SEQ ID NO: 2724592 - RNA, 14 nt, Haemophilus influenzae Rd
cuucauuauauucc

SEQ ID NO: 2724593 - RNA, 16 nt, Haemophilus influenzae Rd
cuucauuauauuccuu

SEQ ID NO: 2724594 - RNA, 15 nt, Haemophilus influenzae Rd
cuucauucucuucug

SEQ ID NO: 2724595 - RNA, 13 nt, Haemophilus influenzae Rd
cuucauuguggaa

SEQ ID NO: 2724596 - RNA, 23 nt, Haemophilus influenzae Rd
cuucauuguggaaacgugcaauu

SEQ ID NO: 2724597 - RNA, 16 nt, Haemophilus influenzae Rd
cuucauuugcuucuau

SEQ ID NO: 2724598 - RNA, 14 nt, Haemophilus influenzae Rd
cuucauuugcuuua

SEQ ID NO: 2724599 - RNA, 15 nt, Haemophilus influenzae Rd
cuucauuuuaaauua

SEQ ID NO: 2724600 - RNA, 21 nt, Haemophilus influenzae Rd
cuucauuuugagauaaauuuu

SEQ ID NO: 2724601 - RNA, 22 nt, Haemophilus influenzae Rd
cuucauuuugagauaaauuuuu

SEQ ID NO: 2724602 - RNA, 18 nt, Haemophilus influenzae Rd
cuuccaaauccaucauuu

SEQ ID NO: 2724603 - RNA, 15 nt, Haemophilus influenzae Rd
cuuccaauaauucuu

SEQ ID NO: 2724604 - RNA, 17 nt, Haemophilus influenzae Rd
cuuccaauaauucuuua

SEQ ID NO: 2724605 - RNA, 22 nt, Haemophilus influenzae Rd
cuuccaaugugaccaaauaauc

SEQ ID NO: 2724606 - RNA, 20 nt, Haemophilus influenzae Rd
cuuccacaacggaagauuua

SEQ ID NO: 2724607 - RNA, 12 nt, Haemophilus influenzae Rd
cuuccacuuuug

SEQ ID NO: 2724608 - RNA, 13 nt, Haemophilus influenzae Rd
cuuccacuuuuug

SEQ ID NO: 2724609 - RNA, 18 nt, Haemophilus influenzae Rd
cuuccauaucacauuuua

SEQ ID NO: 2724610 - RNA, 17 nt, Haemophilus influenzae Rd
cuuccaucuuuuugagc

SEQ ID NO: 2724611 - RNA, 23 nt, Haemophilus influenzae Rd
cuuccauuucaauaucuaagaaa

SEQ ID NO: 2724612 - RNA, 13 nt, Haemophilus influenzae Rd
cuuccauuuuuua

SEQ ID NO: 2724613 - RNA, 20 nt, Haemophilus influenzae Rd
cuucccaaucuuguuuuaau

SEQ ID NO: 2724614 - RNA, 15 nt, Haemophilus influenzae Rd
cuuccgcgucauuua

SEQ ID NO: 2724615 - RNA, 20 nt, Haemophilus influenzae Rd
cuuccgcuggugggaauaau

SEQ ID NO: 2724616 - RNA, 21 nt, Haemophilus influenzae Rd
cuuccgcuggugggaauaauu

SEQ ID NO: 2724617 - RNA, 21 nt, Haemophilus influenzae Rd
cuuccgcuuuuuucgcaccaa

SEQ ID NO: 2724618 - RNA, 23 nt, Haemophilus influenzae Rd
cuuccgucaauaucccaacuuua

SEQ ID NO: 2724619 - RNA, 12 nt, Haemophilus influenzae Rd
cuuccuaugaau

SEQ ID NO: 2724620 - RNA, 22 nt, Haemophilus influenzae Rd
cuuccugcaaacauaccacuuc

SEQ ID NO: 2724621 - RNA, 20 nt, Haemophilus influenzae Rd
cuuccuuauugccuaauuca

SEQ ID NO: 2724622 - RNA, 19 nt, Haemophilus influenzae Rd
cuucgaaaauaacuucauc

SEQ ID NO: 2724623 - RNA, 23 nt, Haemophilus influenzae Rd
cuucgaccaacggauuaaaaguc

SEQ ID NO: 2724624 - RNA, 18 nt, Haemophilus influenzae Rd
cuucgauaaaaucuugcu

SEQ ID NO: 2724625 - RNA, 13 nt, Haemophilus influenzae Rd
cuucgaugcuuuu

SEQ ID NO: 2724626 - RNA, 18 nt, Haemophilus influenzae Rd
cuucgaugugcauuuuuc

SEQ ID NO: 2724627 - RNA, 20 nt, Haemophilus influenzae Rd
cuucgaugugcauuuuucau

SEQ ID NO: 2724628 - RNA, 20 nt, Haemophilus influenzae Rd
cuucgauuuuucuaaaauca

SEQ ID NO: 2724629 - RNA, 17 nt, Haemophilus influenzae Rd
cuucgccauuuuuaaaa

SEQ ID NO: 2724630 - RNA, 20 nt, Haemophilus influenzae Rd
cuucgcgagaauuaccacaa

SEQ ID NO: 2724631 - RNA, 16 nt, Haemophilus influenzae Rd
cuucgcuaauuuuuuu

SEQ ID NO: 2724632 - RNA, 22 nt, Haemophilus influenzae Rd
cuucgcuccaaucaucauccca

SEQ ID NO: 2724633 - RNA, 15 nt, Haemophilus influenzae Rd
cuucggauuuuucaa

SEQ ID NO: 2724634 - RNA, 22 nt, Haemophilus influenzae Rd
cuucgggcgaaaccuuuuucuu

SEQ ID NO: 2724635 - RNA, 15 nt, Haemophilus influenzae Rd
cuucgucaucaucaa

SEQ ID NO: 2724636 - RNA, 22 nt, Haemophilus influenzae Rd
cuucgugaauacgaucugcauc

SEQ ID NO: 2724637 - RNA, 23 nt, Haemophilus influenzae Rd
cuucgugaauacgaucugcaucu

SEQ ID NO: 2724638 - RNA, 14 nt, Haemophilus influenzae Rd
cuucgugcugaaga

SEQ ID NO: 2724639 - RNA, 20 nt, Haemophilus influenzae Rd
cuucguuaaaguugcugaau

SEQ ID NO: 2724640 - RNA, 23 nt, Haemophilus influenzae Rd
cuucguuuucugcuucagauucu

SEQ ID NO: 2724641 - RNA, 12 nt, Haemophilus influenzae Rd
cuucuaaaagag

SEQ ID NO: 2724642 - RNA, 18 nt, Haemophilus influenzae Rd
cuucuaaaauacguuuuu

SEQ ID NO: 2724643 - RNA, 20 nt, Haemophilus influenzae Rd
cuucuaaaauacguuuuuuc

SEQ ID NO: 2724644 - RNA, 17 nt, Haemophilus influenzae Rd
cuucuaaaggcuaaaua

SEQ ID NO: 2724645 - RNA, 22 nt, Haemophilus influenzae Rd
cuucuaaaggcuaaauaaccua

SEQ ID NO: 2724646 - RNA, 14 nt, Haemophilus influenzae Rd
cuucuaauucugca

SEQ ID NO: 2724647 - RNA, 15 nt, Haemophilus influenzae Rd
cuucuaauucuuccc

SEQ ID NO: 2724648 - RNA, 16 nt, Haemophilus influenzae Rd
cuucuaauucuuccca

SEQ ID NO: 2724649 - RNA, 17 nt, Haemophilus influenzae Rd
cuucuaauuguuugcgu

SEQ ID NO: 2724650 - RNA, 16 nt, Haemophilus influenzae Rd
cuucuaauuuuugcaa

SEQ ID NO: 2724651 - RNA, 20 nt, Haemophilus influenzae Rd
cuucuacggucgcaccaccu

SEQ ID NO: 2724652 - RNA, 14 nt, Haemophilus influenzae Rd
cuucuacuugaguu

SEQ ID NO: 2724653 - RNA, 21 nt, Haemophilus influenzae Rd
cuucuagauaguuuucgcaau

SEQ ID NO: 2724654 - RNA, 20 nt, Haemophilus influenzae Rd
cuucuaugccaaucacaaug

SEQ ID NO: 2724655 - RNA, 22 nt, Haemophilus influenzae Rd
cuucuaugccaaucacaaugag

SEQ ID NO: 2724656 - RNA, 22 nt, Haemophilus influenzae Rd
cuucugaacgcgcgccaauaaa

SEQ ID NO: 2724657 - RNA, 19 nt, Haemophilus influenzae Rd
cuucugaauccaaugcacu

SEQ ID NO: 2724658 - RNA, 15 nt, Haemophilus influenzae Rd
cuucugcaccagaaa

SEQ ID NO: 2724659 - RNA, 19 nt, Haemophilus influenzae Rd
cuucugcagaaaaauguuc

SEQ ID NO: 2724660 - RNA, 22 nt, Haemophilus influenzae Rd
cuucugccagauguuggaaauu

SEQ ID NO: 2724661 - RNA, 18 nt, Haemophilus influenzae Rd
cuucugcggaaaugaaac

SEQ ID NO: 2724662 - RNA, 17 nt, Haemophilus influenzae Rd
cuucugcugcacgagcu

SEQ ID NO: 2724663 - RNA, 15 nt, Haemophilus influenzae Rd
cuucuggguaaaaua

SEQ ID NO: 2724664 - RNA, 16 nt, Haemophilus influenzae Rd
cuucuggguaaaauaa

SEQ ID NO: 2724665 - RNA, 16 nt, Haemophilus influenzae Rd
cuucugggucuuuuug

SEQ ID NO: 2724666 - RNA, 20 nt, Haemophilus influenzae Rd
cuucugggucuuuuugugga

SEQ ID NO: 2724667 - RNA, 21 nt, Haemophilus influenzae Rd
cuucugguggaagcuucauau

SEQ ID NO: 2724668 - RNA, 19 nt, Haemophilus influenzae Rd
cuucuguuuugccugcuuc

SEQ ID NO: 2724669 - RNA, 17 nt, Haemophilus influenzae Rd
cuucuucaaagauugca

SEQ ID NO: 2724670 - RNA, 18 nt, Haemophilus influenzae Rd
cuucuucaggugcaacuu

SEQ ID NO: 2724671 - RNA, 22 nt, Haemophilus influenzae Rd
cuucuucaggugcaacuuguug

SEQ ID NO: 2724672 - RNA, 12 nt, Haemophilus influenzae Rd
cuucuucaucgc

SEQ ID NO: 2724673 - RNA, 22 nt, Haemophilus influenzae Rd
cuucuucccaaccuaauuguuc

SEQ ID NO: 2724674 - RNA, 14 nt, Haemophilus influenzae Rd
cuucuuccugcaaa

SEQ ID NO: 2724675 - RNA, 19 nt, Haemophilus influenzae Rd
cuucuucgcuuaaacgaau

SEQ ID NO: 2724676 - RNA, 18 nt, Haemophilus influenzae Rd
cuucuugcagggcuuugu

SEQ ID NO: 2724677 - RNA, 23 nt, Haemophilus influenzae Rd
cuucuuguaaacugcuuucaaaa

SEQ ID NO: 2724678 - RNA, 19 nt, Haemophilus influenzae Rd
cuucuuuaauuucuucaac

SEQ ID NO: 2724679 - RNA, 14 nt, Haemophilus influenzae Rd
cuucuuucaaugca

SEQ ID NO: 2724680 - RNA, 15 nt, Haemophilus influenzae Rd
cuucuuucauuugaa

SEQ ID NO: 2724681 - RNA, 20 nt, Haemophilus influenzae Rd
cuucuuugauauaaauuguu

SEQ ID NO: 2724682 - RNA, 21 nt, Haemophilus influenzae Rd
cuucuuuuauagacuucaagu

SEQ ID NO: 2724683 - RNA, 22 nt, Haemophilus influenzae Rd
cuugaaaccucccaaaaacuaa

SEQ ID NO: 2724684 - RNA, 22 nt, Haemophilus influenzae Rd
cuugaaaguaaucgccccaaaa

SEQ ID NO: 2724685 - RNA, 19 nt, Haemophilus influenzae Rd
cuugaaauaguuaaagaaa

SEQ ID NO: 2724686 - RNA, 23 nt, Haemophilus influenzae Rd
cuugaaauugucguccuucaaau

SEQ ID NO: 2724687 - RNA, 13 nt, Haemophilus influenzae Rd
cuugaacaaaaag

SEQ ID NO: 2724688 - RNA, 23 nt, Haemophilus influenzae Rd
cuugaacagcuuugcugucuuug

SEQ ID NO: 2724689 - RNA, 23 nt, Haemophilus influenzae Rd
cuugaaccagugaccaagcgauu

SEQ ID NO: 2724690 - RNA, 12 nt, Haemophilus influenzae Rd
cuugaacuugac

SEQ ID NO: 2724691 - RNA, 16 nt, Haemophilus influenzae Rd
cuugaagaucuucaua

SEQ ID NO: 2724692 - RNA, 20 nt, Haemophilus influenzae Rd
cuugaagucuauaaaagaag

SEQ ID NO: 2724693 - RNA, 11 nt, Haemophilus influenzae Rd
cuugaauaaua

SEQ ID NO: 2724694 - RNA, 21 nt, Haemophilus influenzae Rd
cuugaauaucagcuacuuccc

SEQ ID NO: 2724695 - RNA, 22 nt, Haemophilus influenzae Rd
cuugaauaucagcuacuuccca

SEQ ID NO: 2724696 - RNA, 13 nt, Haemophilus influenzae Rd
cuugaauaugaug

SEQ ID NO: 2724697 - RNA, 21 nt, Haemophilus influenzae Rd
cuugaauaugauguggcuuuu

SEQ ID NO: 2724698 - RNA, 18 nt, Haemophilus influenzae Rd
cuugaauggcuaucugcu

SEQ ID NO: 2724699 - RNA, 21 nt, Haemophilus influenzae Rd
cuugaauggcuaucugcuuuu

SEQ ID NO: 2724700 - RNA, 17 nt, Haemophilus influenzae Rd
cuugaauugauaaaggc

SEQ ID NO: 2724701 - RNA, 20 nt, Haemophilus influenzae Rd
cuugaauugcauuuucuucc

SEQ ID NO: 2724702 - RNA, 22 nt, Haemophilus influenzae Rd
cuugaauugcauuuucuuccaa

SEQ ID NO: 2724703 - RNA, 18 nt, Haemophilus influenzae Rd
cuugaauugcuccuccua

SEQ ID NO: 2724704 - RNA, 20 nt, Haemophilus influenzae Rd
cuugacaacgcucacuuaau

SEQ ID NO: 2724705 - RNA, 15 nt, Haemophilus influenzae Rd
cuugacauaauuuca

SEQ ID NO: 2724706 - RNA, 21 nt, Haemophilus influenzae Rd
cuugacauaauuucacaauuu

SEQ ID NO: 2724707 - RNA, 17 nt, Haemophilus influenzae Rd
cuugaccgauuaauuca

SEQ ID NO: 2724708 - RNA, 23 nt, Haemophilus influenzae Rd
cuugaccugcagccauaauauuu

SEQ ID NO: 2724709 - RNA, 13 nt, Haemophilus influenzae Rd
cuugaccuguuaa

SEQ ID NO: 2724710 - RNA, 15 nt, Haemophilus influenzae Rd
cuugaccuucaauug

SEQ ID NO: 2724711 - RNA, 14 nt, Haemophilus influenzae Rd
cuugacgcauuaau

SEQ ID NO: 2724712 - RNA, 17 nt, Haemophilus influenzae Rd
cuugacgguuuuuauua

SEQ ID NO: 2724713 - RNA, 18 nt, Haemophilus influenzae Rd
cuugaguugucacaacag

SEQ ID NO: 2724714 - RNA, 17 nt, Haemophilus influenzae Rd
cuugauauaaguucuaa

SEQ ID NO: 2724715 - RNA, 18 nt, Haemophilus influenzae Rd
cuugauauaauauuuugg

SEQ ID NO: 2724716 - RNA, 13 nt, Haemophilus influenzae Rd
cuugauauucaag

SEQ ID NO: 2724717 - RNA, 21 nt, Haemophilus influenzae Rd
cuugauauucaaggagcuuua

SEQ ID NO: 2724718 - RNA, 18 nt, Haemophilus influenzae Rd
cuugaucacauauuuuug

SEQ ID NO: 2724719 - RNA, 19 nt, Haemophilus influenzae Rd
cuugaugauaaucuuccca

SEQ ID NO: 2724720 - RNA, 21 nt, Haemophilus influenzae Rd
cuugaugcucugcauaaaagc

SEQ ID NO: 2724721 - RNA, 23 nt, Haemophilus influenzae Rd
cuugauuucaguagaaucaaggc

SEQ ID NO: 2724722 - RNA, 13 nt, Haemophilus influenzae Rd
cuugcaaauuuuc

SEQ ID NO: 2724723 - RNA, 17 nt, Haemophilus influenzae Rd
cuugcaaauuuucagcu

SEQ ID NO: 2724724 - RNA, 17 nt, Haemophilus influenzae Rd
cuugcacaauuacuucu

SEQ ID NO: 2724725 - RNA, 20 nt, Haemophilus influenzae Rd
cuugcacggcaguaucuugg

SEQ ID NO: 2724726 - RNA, 20 nt, Haemophilus influenzae Rd
cuugcacuaauugugguaaa

SEQ ID NO: 2724727 - RNA, 17 nt, Haemophilus influenzae Rd
cuugcacugcuaauucc

SEQ ID NO: 2724728 - RNA, 16 nt, Haemophilus influenzae Rd
cuugcauaaaccaacu

SEQ ID NO: 2724729 - RNA, 16 nt, Haemophilus influenzae Rd
cuugcauaauuccuuu

SEQ ID NO: 2724730 - RNA, 19 nt, Haemophilus influenzae Rd
cuugcauaauuccuuuuuc

SEQ ID NO: 2724731 - RNA, 19 nt, Haemophilus influenzae Rd
cuugcauucgguuuuaagu

SEQ ID NO: 2724732 - RNA, 15 nt, Haemophilus influenzae Rd
cuugcauuucauuug

SEQ ID NO: 2724733 - RNA, 15 nt, Haemophilus influenzae Rd
cuugcauuucuucag

SEQ ID NO: 2724734 - RNA, 14 nt, Haemophilus influenzae Rd
cuugccaaacauua

SEQ ID NO: 2724735 - RNA, 15 nt, Haemophilus influenzae Rd
cuugccaauucagcu

SEQ ID NO: 2724736 - RNA, 16 nt, Haemophilus influenzae Rd
cuugccgaaaauuuac

SEQ ID NO: 2724737 - RNA, 15 nt, Haemophilus influenzae Rd
cuugccguuuaguuu

SEQ ID NO: 2724738 - RNA, 21 nt, Haemophilus influenzae Rd
cuugcggauuacuuucauuua

SEQ ID NO: 2724739 - RNA, 13 nt, Haemophilus influenzae Rd
cuugcguuaaauc

SEQ ID NO: 2724740 - RNA, 18 nt, Haemophilus influenzae Rd
cuugcguuugguucauca

SEQ ID NO: 2724741 - RNA, 20 nt, Haemophilus influenzae Rd
cuugcuaucgagguuuucgu

SEQ ID NO: 2724742 - RNA, 17 nt, Haemophilus influenzae Rd
cuugcucacgggcagaa

SEQ ID NO: 2724743 - RNA, 23 nt, Haemophilus influenzae Rd
cuugcucacgggcagaaugaauc

SEQ ID NO: 2724744 - RNA, 19 nt, Haemophilus influenzae Rd
cuugcugaaguuguaauaa

SEQ ID NO: 2724745 - RNA, 16 nt, Haemophilus influenzae Rd
cuugcugccacaagau

SEQ ID NO: 2724746 - RNA, 18 nt, Haemophilus influenzae Rd
cuugcuguugguuaaaaa

SEQ ID NO: 2724747 - RNA, 15 nt, Haemophilus influenzae Rd
cuugcuguuuuuccg

SEQ ID NO: 2724748 - RNA, 12 nt, Haemophilus influenzae Rd
cuugcuuaaauu

SEQ ID NO: 2724749 - RNA, 13 nt, Haemophilus influenzae Rd
cuugcuuuaauug

SEQ ID NO: 2724750 - RNA, 12 nt, Haemophilus influenzae Rd
cuugcuuuuuaa

SEQ ID NO: 2724751 - RNA, 14 nt, Haemophilus influenzae Rd
cuuggaauaaauua

SEQ ID NO: 2724752 - RNA, 20 nt, Haemophilus influenzae Rd
cuuggcaacccacuucugca

SEQ ID NO: 2724753 - RNA, 13 nt, Haemophilus influenzae Rd
cuuggcauagaaa

SEQ ID NO: 2724754 - RNA, 16 nt, Haemophilus influenzae Rd
cuuggcauuucaagcu

SEQ ID NO: 2724755 - RNA, 19 nt, Haemophilus influenzae Rd
cuuggcauuucaagcuggu

SEQ ID NO: 2724756 - RNA, 15 nt, Haemophilus influenzae Rd
cuuggcgaguaaauu

SEQ ID NO: 2724757 - RNA, 18 nt, Haemophilus influenzae Rd
cuuggcguucauaucuuu

SEQ ID NO: 2724758 - RNA, 16 nt, Haemophilus influenzae Rd
cuuggcuaacuucuuc

SEQ ID NO: 2724759 - RNA, 15 nt, Haemophilus influenzae Rd
cuugggaaucuggcu

SEQ ID NO: 2724760 - RNA, 16 nt, Haemophilus influenzae Rd
cuugggaaucuggcuu

SEQ ID NO: 2724761 - RNA, 17 nt, Haemophilus influenzae Rd
cuugggauauuccaagg

SEQ ID NO: 2724762 - RNA, 12 nt, Haemophilus influenzae Rd
cuugggcggcuu

SEQ ID NO: 2724763 - RNA, 21 nt, Haemophilus influenzae Rd
cuuggguaaauauaaaugccg

SEQ ID NO: 2724764 - RNA, 17 nt, Haemophilus influenzae Rd
cuugguaagaaagauag

SEQ ID NO: 2724765 - RNA, 16 nt, Haemophilus influenzae Rd
cuugguaguuuuucac

SEQ ID NO: 2724766 - RNA, 17 nt, Haemophilus influenzae Rd
cuuggucacgauuuuuu

SEQ ID NO: 2724767 - RNA, 19 nt, Haemophilus influenzae Rd
cuuggucacugguucaagu

SEQ ID NO: 2724768 - RNA, 20 nt, Haemophilus influenzae Rd
cuuggucacugguucaaguc

SEQ ID NO: 2724769 - RNA, 20 nt, Haemophilus influenzae Rd
cuugguguaauuugaugcuc

SEQ ID NO: 2724770 - RNA, 18 nt, Haemophilus influenzae Rd
cuugguguuguggugcaa

SEQ ID NO: 2724771 - RNA, 12 nt, Haemophilus influenzae Rd
cuugguuaaucc

SEQ ID NO: 2724772 - RNA, 13 nt, Haemophilus influenzae Rd
cuugguuuaaauu

SEQ ID NO: 2724773 - RNA, 21 nt, Haemophilus influenzae Rd
cuugguuuaaauuuuaaaaaa

SEQ ID NO: 2724774 - RNA, 16 nt, Haemophilus influenzae Rd
cuuguaaaauuggugg

SEQ ID NO: 2724775 - RNA, 23 nt, Haemophilus influenzae Rd
cuuguaaagauuguccuuuugcc

SEQ ID NO: 2724776 - RNA, 22 nt, Haemophilus influenzae Rd
cuuguaaugguucuaacacgcc

SEQ ID NO: 2724777 - RNA, 21 nt, Haemophilus influenzae Rd
cuuguaauugauuuucagaaa

SEQ ID NO: 2724778 - RNA, 13 nt, Haemophilus influenzae Rd
cuuguaauuucau

SEQ ID NO: 2724779 - RNA, 17 nt, Haemophilus influenzae Rd
cuuguacaacagcaaua

SEQ ID NO: 2724780 - RNA, 17 nt, Haemophilus influenzae Rd
cuuguagcacauaaaga

SEQ ID NO: 2724781 - RNA, 16 nt, Haemophilus influenzae Rd
cuugucaauaaauccc

SEQ ID NO: 2724782 - RNA, 16 nt, Haemophilus influenzae Rd
cuugucauuaaaaaau

SEQ ID NO: 2724783 - RNA, 19 nt, Haemophilus influenzae Rd
cuugucauuaaaaaauaau

SEQ ID NO: 2724784 - RNA, 18 nt, Haemophilus influenzae Rd
cuugucgcggcaauccac

SEQ ID NO: 2724785 - RNA, 14 nt, Haemophilus influenzae Rd
cuugugaaauaaaa

SEQ ID NO: 2724786 - RNA, 18 nt, Haemophilus influenzae Rd
cuugugaaauaaaauaua

SEQ ID NO: 2724787 - RNA, 13 nt, Haemophilus influenzae Rd
cuugugaaccauu

SEQ ID NO: 2724788 - RNA, 14 nt, Haemophilus influenzae Rd
cuugugcauaaaca

SEQ ID NO: 2724789 - RNA, 16 nt, Haemophilus influenzae Rd
cuugugcauaaacaaa

SEQ ID NO: 2724790 - RNA, 18 nt, Haemophilus influenzae Rd
cuugugcgauaagcgguu

SEQ ID NO: 2724791 - RNA, 23 nt, Haemophilus influenzae Rd
cuugugcgauuaacaauaaugug

SEQ ID NO: 2724792 - RNA, 17 nt, Haemophilus influenzae Rd
cuugugcuauacaaaau

SEQ ID NO: 2724793 - RNA, 20 nt, Haemophilus influenzae Rd
cuugugcucgauuuuuaaaa

SEQ ID NO: 2724794 - RNA, 22 nt, Haemophilus influenzae Rd
cuugugcucgauuuuuaaaagc

SEQ ID NO: 2724795 - RNA, 20 nt, Haemophilus influenzae Rd
cuuguggaauaaaauaaucu

SEQ ID NO: 2724796 - RNA, 16 nt, Haemophilus influenzae Rd
cuuguggaucuaaauc

SEQ ID NO: 2724797 - RNA, 19 nt, Haemophilus influenzae Rd
cuuguggguuuauugguaa

SEQ ID NO: 2724798 - RNA, 16 nt, Haemophilus influenzae Rd
cuugugucuaccgauu

SEQ ID NO: 2724799 - RNA, 14 nt, Haemophilus influenzae Rd
cuuguguuuuagaa

SEQ ID NO: 2724800 - RNA, 14 nt, Haemophilus influenzae Rd
cuuguuaauacacu

SEQ ID NO: 2724801 - RNA, 15 nt, Haemophilus influenzae Rd
cuuguuacaccuugg

SEQ ID NO: 2724802 - RNA, 19 nt, Haemophilus influenzae Rd
cuuguucacguguuuuuuc

SEQ ID NO: 2724803 - RNA, 12 nt, Haemophilus influenzae Rd
cuuguucuaaag

SEQ ID NO: 2724804 - RNA, 22 nt, Haemophilus influenzae Rd
cuuguucuccauuaagcacagg

SEQ ID NO: 2724805 - RNA, 17 nt, Haemophilus influenzae Rd
cuuguucuucauagaag

SEQ ID NO: 2724806 - RNA, 22 nt, Haemophilus influenzae Rd
cuuguucuucggguuuauguaa

SEQ ID NO: 2724807 - RNA, 19 nt, Haemophilus influenzae Rd
cuuguuggaaaaaugcugg

SEQ ID NO: 2724808 - RNA, 18 nt, Haemophilus influenzae Rd
cuuguuguaaauugguuu

SEQ ID NO: 2724809 - RNA, 18 nt, Haemophilus influenzae Rd
cuuguuguucaaaauugc

SEQ ID NO: 2724810 - RNA, 17 nt, Haemophilus influenzae Rd
cuuguuuacugaauaaa

SEQ ID NO: 2724811 - RNA, 12 nt, Haemophilus influenzae Rd
cuuguuuuaaau

SEQ ID NO: 2724812 - RNA, 18 nt, Haemophilus influenzae Rd
cuuguuuuaaaucuucua

SEQ ID NO: 2724813 - RNA, 20 nt, Haemophilus influenzae Rd
cuuguuuuaaaucuucuauc

SEQ ID NO: 2724814 - RNA, 23 nt, Haemophilus influenzae Rd
cuuguuuuaauuguucaauaucu

SEQ ID NO: 2724815 - RNA, 18 nt, Haemophilus influenzae Rd
cuuguuuuccaaacauuu

SEQ ID NO: 2724816 - RNA, 11 nt, Haemophilus influenzae Rd
cuuguuuuuca

SEQ ID NO: 2724817 - RNA, 17 nt, Haemophilus influenzae Rd
cuuuaaagaaauaaauu

SEQ ID NO: 2724818 - RNA, 18 nt, Haemophilus influenzae Rd
cuuuaaagagcaaauuua

SEQ ID NO: 2724819 - RNA, 18 nt, Haemophilus influenzae Rd
cuuuaaauagauaaucag

SEQ ID NO: 2724820 - RNA, 14 nt, Haemophilus influenzae Rd
cuuuaaauauucaa

SEQ ID NO: 2724821 - RNA, 13 nt, Haemophilus influenzae Rd
cuuuaaauauuua

SEQ ID NO: 2724822 - RNA, 14 nt, Haemophilus influenzae Rd
cuuuaaauauuuaa

SEQ ID NO: 2724823 - RNA, 17 nt, Haemophilus influenzae Rd
cuuuaaauauuuaaaaa

SEQ ID NO: 2724824 - RNA, 20 nt, Haemophilus influenzae Rd
cuuuaaauauuuaaaaagaa

SEQ ID NO: 2724825 - RNA, 22 nt, Haemophilus influenzae Rd
cuuuaaauauuuaaaaagaaua

SEQ ID NO: 2724826 - RNA, 22 nt, Haemophilus influenzae Rd
cuuuaaauucuucgaaaauaac

SEQ ID NO: 2724827 - RNA, 20 nt, Haemophilus influenzae Rd
cuuuaaauuguuuaaugaaa

SEQ ID NO: 2724828 - RNA, 12 nt, Haemophilus influenzae Rd
cuuuaaauuuuc

SEQ ID NO: 2724829 - RNA, 15 nt, Haemophilus influenzae Rd
cuuuaacaaaaucaa

SEQ ID NO: 2724830 - RNA, 19 nt, Haemophilus influenzae Rd
cuuuaacaauuacugcaaa

SEQ ID NO: 2724831 - RNA, 14 nt, Haemophilus influenzae Rd
cuuuaacaccaaua

SEQ ID NO: 2724832 - RNA, 13 nt, Haemophilus influenzae Rd
cuuuaacccauuu

SEQ ID NO: 2724833 - RNA, 20 nt, Haemophilus influenzae Rd
cuuuaacugaagcaaucgca

SEQ ID NO: 2724834 - RNA, 20 nt, Haemophilus influenzae Rd
cuuuaacuugcucugguuga

SEQ ID NO: 2724835 - RNA, 15 nt, Haemophilus influenzae Rd
cuuuaagcuuuucua

SEQ ID NO: 2724836 - RNA, 16 nt, Haemophilus influenzae Rd
cuuuaagcuuuucuac

SEQ ID NO: 2724837 - RNA, 12 nt, Haemophilus influenzae Rd
cuuuaauaauca

SEQ ID NO: 2724838 - RNA, 18 nt, Haemophilus influenzae Rd
cuuuaauacguuguuguu

SEQ ID NO: 2724839 - RNA, 16 nt, Haemophilus influenzae Rd
cuuuaauaguaaacuu

SEQ ID NO: 2724840 - RNA, 17 nt, Haemophilus influenzae Rd
cuuuaauaguaaacuuu

SEQ ID NO: 2724841 - RNA, 18 nt, Haemophilus influenzae Rd
cuuuaauaguaaacuuuu

SEQ ID NO: 2724842 - RNA, 21 nt, Haemophilus influenzae Rd
cuuuaauaguaaacuuuuaaa

SEQ ID NO: 2724843 - RNA, 20 nt, Haemophilus influenzae Rd
cuuuaauucgugcaaauuuu

SEQ ID NO: 2724844 - RNA, 14 nt, Haemophilus influenzae Rd
cuuuaauugauuaa

SEQ ID NO: 2724845 - RNA, 17 nt, Haemophilus influenzae Rd
cuuuaauugauuaaaaa

SEQ ID NO: 2724846 - RNA, 12 nt, Haemophilus influenzae Rd
cuuuaauuguuu

SEQ ID NO: 2724847 - RNA, 15 nt, Haemophilus influenzae Rd
cuuuaauuucuucaa

SEQ ID NO: 2724848 - RNA, 17 nt, Haemophilus influenzae Rd
cuuuaauuucuucaacu

SEQ ID NO: 2724849 - RNA, 15 nt, Haemophilus influenzae Rd
cuuuacaaugagugu

SEQ ID NO: 2724850 - RNA, 24 nt, Haemophilus influenzae Rd
cuuuacauuuccuuuacauuuaaa

SEQ ID NO: 2724851 - RNA, 21 nt, Haemophilus influenzae Rd
cuuuacauuuggcaaaauaau

SEQ ID NO: 2724852 - RNA, 13 nt, Haemophilus influenzae Rd
cuuuaccaaauag

SEQ ID NO: 2724853 - RNA, 19 nt, Haemophilus influenzae Rd
cuuuaccauugcguucacu

SEQ ID NO: 2724854 - RNA, 19 nt, Haemophilus influenzae Rd
cuuuacccacacaaacuaa

SEQ ID NO: 2724855 - RNA, 22 nt, Haemophilus influenzae Rd
cuuuaccgaucgcuuucauuuc

SEQ ID NO: 2724856 - RNA, 21 nt, Haemophilus influenzae Rd
cuuuaccgucagccaaauuuu

SEQ ID NO: 2724857 - RNA, 20 nt, Haemophilus influenzae Rd
cuuuaccuugcauuucuuua

SEQ ID NO: 2724858 - RNA, 21 nt, Haemophilus influenzae Rd
cuuuaccuuguaaacuuuccu

SEQ ID NO: 2724859 - RNA, 13 nt, Haemophilus influenzae Rd
cuuuacgacuaaa

SEQ ID NO: 2724860 - RNA, 19 nt, Haemophilus influenzae Rd
cuuuacggauaauuucccu

SEQ ID NO: 2724861 - RNA, 22 nt, Haemophilus influenzae Rd
cuuuacucauaucuaaagcauu

SEQ ID NO: 2724862 - RNA, 18 nt, Haemophilus influenzae Rd
cuuuacuguucaaauaag

SEQ ID NO: 2724863 - RNA, 17 nt, Haemophilus influenzae Rd
cuuuacuuuuuaauaaa

SEQ ID NO: 2724864 - RNA, 15 nt, Haemophilus influenzae Rd
cuuuagacaacaacu

SEQ ID NO: 2724865 - RNA, 18 nt, Haemophilus influenzae Rd
cuuuagacaacaacuuuu

SEQ ID NO: 2724866 - RNA, 22 nt, Haemophilus influenzae Rd
cuuuagacaacaacuuuucuaa

SEQ ID NO: 2724867 - RNA, 15 nt, Haemophilus influenzae Rd
cuuuagauugcucaa

SEQ ID NO: 2724868 - RNA, 13 nt, Haemophilus influenzae Rd
cuuuagcaaucaa

SEQ ID NO: 2724869 - RNA, 22 nt, Haemophilus influenzae Rd
cuuuagcauaaaacaguauuuu

SEQ ID NO: 2724870 - RNA, 21 nt, Haemophilus influenzae Rd
cuuuagcaucguagucuuuca

SEQ ID NO: 2724871 - RNA, 14 nt, Haemophilus influenzae Rd
cuuuagcuaaugca

SEQ ID NO: 2724872 - RNA, 14 nt, Haemophilus influenzae Rd
cuuuaggauuguug

SEQ ID NO: 2724873 - RNA, 21 nt, Haemophilus influenzae Rd
cuuuaggauuguugauuuugg

SEQ ID NO: 2724874 - RNA, 15 nt, Haemophilus influenzae Rd
cuuuauaaauaacau

SEQ ID NO: 2724875 - RNA, 14 nt, Haemophilus influenzae Rd
cuuuaucaagcaca

SEQ ID NO: 2724876 - RNA, 16 nt, Haemophilus influenzae Rd
cuuuaucauaacuaua

SEQ ID NO: 2724877 - RNA, 15 nt, Haemophilus influenzae Rd
cuuuaucaucuuuug

SEQ ID NO: 2724878 - RNA, 21 nt, Haemophilus influenzae Rd
cuuuaucgaggacaaucugcu

SEQ ID NO: 2724879 - RNA, 23 nt, Haemophilus influenzae Rd
cuuuaucgaggacaaucugcugu

SEQ ID NO: 2724880 - RNA, 16 nt, Haemophilus influenzae Rd
cuuuaucuaaaguuac

SEQ ID NO: 2724881 - RNA, 14 nt, Haemophilus influenzae Rd
cuuuaucuauugau

SEQ ID NO: 2724882 - RNA, 18 nt, Haemophilus influenzae Rd
cuuuaugacuauuuuuuu

SEQ ID NO: 2724883 - RNA, 16 nt, Haemophilus influenzae Rd
cuuuauuaaacaaaaa

SEQ ID NO: 2724884 - RNA, 17 nt, Haemophilus influenzae Rd
cuuuauuaaacaaaaac

SEQ ID NO: 2724885 - RNA, 18 nt, Haemophilus influenzae Rd
cuuuauuaaacaaaaacc

SEQ ID NO: 2724886 - RNA, 15 nt, Haemophilus influenzae Rd
cuuuauuacuuuuau

SEQ ID NO: 2724887 - RNA, 17 nt, Haemophilus influenzae Rd
cuuuauuacuuuuaucc

SEQ ID NO: 2724888 - RNA, 22 nt, Haemophilus influenzae Rd
cuuuauuuacccaagccaauua

SEQ ID NO: 2724889 - RNA, 11 nt, Haemophilus influenzae Rd
cuuuauuuaga

SEQ ID NO: 2724890 - RNA, 21 nt, Haemophilus influenzae Rd
cuuuauuugagccaauaacuu

SEQ ID NO: 2724891 - RNA, 19 nt, Haemophilus influenzae Rd
cuuuauuugauuguugcuu

SEQ ID NO: 2724892 - RNA, 12 nt, Haemophilus influenzae Rd
cuuuauuuuguu

SEQ ID NO: 2724893 - RNA, 20 nt, Haemophilus influenzae Rd
cuuuauuuuuucaucauuuc

SEQ ID NO: 2724894 - RNA, 23 nt, Haemophilus influenzae Rd
cuuucaaaaaucaaauuaauuua

SEQ ID NO: 2724895 - RNA, 14 nt, Haemophilus influenzae Rd
cuuucaaauaauug

SEQ ID NO: 2724896 - RNA, 15 nt, Haemophilus influenzae Rd
cuuucaaugcagaaa

SEQ ID NO: 2724897 - RNA, 19 nt, Haemophilus influenzae Rd
cuuucaaugcagaaauaaa

SEQ ID NO: 2724898 - RNA, 13 nt, Haemophilus influenzae Rd
cuuucaauuuucu

SEQ ID NO: 2724899 - RNA, 22 nt, Haemophilus influenzae Rd
cuuucacacugcccuucucugc

SEQ ID NO: 2724900 - RNA, 11 nt, Haemophilus influenzae Rd
cuuucaccaaa

SEQ ID NO: 2724901 - RNA, 12 nt, Haemophilus influenzae Rd
cuuucaccauua

SEQ ID NO: 2724902 - RNA, 17 nt, Haemophilus influenzae Rd
cuuucaccgcuuuucuc

SEQ ID NO: 2724903 - RNA, 17 nt, Haemophilus influenzae Rd
cuuucacgucaccuacu

SEQ ID NO: 2724904 - RNA, 15 nt, Haemophilus influenzae Rd
cuuucacuauuucau

SEQ ID NO: 2724905 - RNA, 20 nt, Haemophilus influenzae Rd
cuuucacuauuucaucuuua

SEQ ID NO: 2724906 - RNA, 18 nt, Haemophilus influenzae Rd
cuuucagcuuccauccac

SEQ ID NO: 2724907 - RNA, 17 nt, Haemophilus influenzae Rd
cuuucaguuaaauuuuc

SEQ ID NO: 2724908 - RNA, 14 nt, Haemophilus influenzae Rd
cuuucauauaaaua

SEQ ID NO: 2724909 - RNA, 21 nt, Haemophilus influenzae Rd
cuuucauccucucgccaaauc

SEQ ID NO: 2724910 - RNA, 19 nt, Haemophilus influenzae Rd
cuuucaucguuugaacaaa

SEQ ID NO: 2724911 - RNA, 23 nt, Haemophilus influenzae Rd
cuuucaucguuugaacaaauuca

SEQ ID NO: 2724912 - RNA, 22 nt, Haemophilus influenzae Rd
cuuucauuccauucuaaaaaaa

SEQ ID NO: 2724913 - RNA, 19 nt, Haemophilus influenzae Rd
cuuucauucguauaaauau

SEQ ID NO: 2724914 - RNA, 14 nt, Haemophilus influenzae Rd
cuuucauuucuucu

SEQ ID NO: 2724915 - RNA, 14 nt, Haemophilus influenzae Rd
cuuucauuuuccaa

SEQ ID NO: 2724916 - RNA, 17 nt, Haemophilus influenzae Rd
cuuuccaaucauauuuc

SEQ ID NO: 2724917 - RNA, 23 nt, Haemophilus influenzae Rd
cuuuccauaccauuuaaaaguaa

SEQ ID NO: 2724918 - RNA, 22 nt, Haemophilus influenzae Rd
cuuuccauacccuugcuucugg

SEQ ID NO: 2724919 - RNA, 16 nt, Haemophilus influenzae Rd
cuuuccauuugaaucu

SEQ ID NO: 2724920 - RNA, 18 nt, Haemophilus influenzae Rd
cuuuccgauuaauauacc

SEQ ID NO: 2724921 - RNA, 19 nt, Haemophilus influenzae Rd
cuuuccguucauaaauagg

SEQ ID NO: 2724922 - RNA, 15 nt, Haemophilus influenzae Rd
cuuuccucuccauca

SEQ ID NO: 2724923 - RNA, 14 nt, Haemophilus influenzae Rd
cuuucgcagccacu

SEQ ID NO: 2724924 - RNA, 17 nt, Haemophilus influenzae Rd
cuuucgcggaauuucag

SEQ ID NO: 2724925 - RNA, 21 nt, Haemophilus influenzae Rd
cuuucgguacgaucacugcca

SEQ ID NO: 2724926 - RNA, 23 nt, Haemophilus influenzae Rd
cuuucgguacgaucacugccacu

SEQ ID NO: 2724927 - RNA, 22 nt, Haemophilus influenzae Rd
cuuucuauuaaaaaaucaucaa

SEQ ID NO: 2724928 - RNA, 24 nt, Haemophilus influenzae Rd
cuuucuauuaaaaaaucaucaauu

SEQ ID NO: 2724929 - RNA, 20 nt, Haemophilus influenzae Rd
cuuucuauuugaauuaaaac

SEQ ID NO: 2724930 - RNA, 15 nt, Haemophilus influenzae Rd
cuuucucaaauauuu

SEQ ID NO: 2724931 - RNA, 19 nt, Haemophilus influenzae Rd
cuuucugaacacucuaucu

SEQ ID NO: 2724932 - RNA, 17 nt, Haemophilus influenzae Rd
cuuucugucaucacauc

SEQ ID NO: 2724933 - RNA, 13 nt, Haemophilus influenzae Rd
cuuucuuaaaaua

SEQ ID NO: 2724934 - RNA, 23 nt, Haemophilus influenzae Rd
cuuucuuauuggacugcauauuc

SEQ ID NO: 2724935 - RNA, 16 nt, Haemophilus influenzae Rd
cuuucuucguuaaagu

SEQ ID NO: 2724936 - RNA, 17 nt, Haemophilus influenzae Rd
cuuucuuuuucaaguuc

SEQ ID NO: 2724937 - RNA, 22 nt, Haemophilus influenzae Rd
cuuugaauguaaaaaauaauuu

SEQ ID NO: 2724938 - RNA, 19 nt, Haemophilus influenzae Rd
cuuugaauugguguuuaaa

SEQ ID NO: 2724939 - RNA, 19 nt, Haemophilus influenzae Rd
cuuugacuaaaguaaauuu

SEQ ID NO: 2724940 - RNA, 23 nt, Haemophilus influenzae Rd
cuuugagaaagaauauaaauaaa

SEQ ID NO: 2724941 - RNA, 18 nt, Haemophilus influenzae Rd
cuuugagguaaaagugcg

SEQ ID NO: 2724942 - RNA, 14 nt, Haemophilus influenzae Rd
cuuugaguaaaaaa

SEQ ID NO: 2724943 - RNA, 20 nt, Haemophilus influenzae Rd
cuuugaugauuccaaaguuu

SEQ ID NO: 2724944 - RNA, 22 nt, Haemophilus influenzae Rd
cuuuggaauauucuuuuuaaau

SEQ ID NO: 2724945 - RNA, 13 nt, Haemophilus influenzae Rd
cuuuggaaugaag

SEQ ID NO: 2724946 - RNA, 20 nt, Haemophilus influenzae Rd
cuuuggauuggauuuugaaa

SEQ ID NO: 2724947 - RNA, 19 nt, Haemophilus influenzae Rd
cuuuggauugguguuuaaa

SEQ ID NO: 2724948 - RNA, 11 nt, Haemophilus influenzae Rd
cuuuggcuaaa

SEQ ID NO: 2724949 - RNA, 17 nt, Haemophilus influenzae Rd
cuuugggaaugccauua

SEQ ID NO: 2724950 - RNA, 22 nt, Haemophilus influenzae Rd
cuuuguaaguuggauucauuaa

SEQ ID NO: 2724951 - RNA, 15 nt, Haemophilus influenzae Rd
cuuuguaaugcuuuu

SEQ ID NO: 2724952 - RNA, 19 nt, Haemophilus influenzae Rd
cuuuguacaccaaaauaac

SEQ ID NO: 2724953 - RNA, 23 nt, Haemophilus influenzae Rd
cuuuguauagaacgguuaugaaa

SEQ ID NO: 2724954 - RNA, 13 nt, Haemophilus influenzae Rd
cuuuguauggcaa

SEQ ID NO: 2724955 - RNA, 22 nt, Haemophilus influenzae Rd
cuuugugaggaaguuaaaauac

SEQ ID NO: 2724956 - RNA, 15 nt, Haemophilus influenzae Rd
cuuugugccauuucu

SEQ ID NO: 2724957 - RNA, 20 nt, Haemophilus influenzae Rd
cuuuguucacaucaaaauug

SEQ ID NO: 2724958 - RNA, 21 nt, Haemophilus influenzae Rd
cuuuguugauuaucuaauuca

SEQ ID NO: 2724959 - RNA, 18 nt, Haemophilus influenzae Rd
cuuuguuuuaaugauaaa

SEQ ID NO: 2724960 - RNA, 19 nt, Haemophilus influenzae Rd
cuuuguuuuaaugauaaau

SEQ ID NO: 2724961 - RNA, 14 nt, Haemophilus influenzae Rd
cuuuguuuuauagc

SEQ ID NO: 2724962 - RNA, 20 nt, Haemophilus influenzae Rd
cuuuuaaaagaccacauucu

SEQ ID NO: 2724963 - RNA, 21 nt, Haemophilus influenzae Rd
cuuuuaaaagaccacauucua

SEQ ID NO: 2724964 - RNA, 13 nt, Haemophilus influenzae Rd
cuuuuaaacguuu

SEQ ID NO: 2724965 - RNA, 23 nt, Haemophilus influenzae Rd
cuuuuaaacuauugaaaauuaaa

SEQ ID NO: 2724966 - RNA, 18 nt, Haemophilus influenzae Rd
cuuuuaaaguguggauuu

SEQ ID NO: 2724967 - RNA, 17 nt, Haemophilus influenzae Rd
cuuuuaacaaauacauc

SEQ ID NO: 2724968 - RNA, 17 nt, Haemophilus influenzae Rd
cuuuuaacacuuuuuca

SEQ ID NO: 2724969 - RNA, 12 nt, Haemophilus influenzae Rd
cuuuuaauuaaa

SEQ ID NO: 2724970 - RNA, 17 nt, Haemophilus influenzae Rd
cuuuuaauuaaauacaa

SEQ ID NO: 2724971 - RNA, 20 nt, Haemophilus influenzae Rd
cuuuuaauuaaauacaaaac

SEQ ID NO: 2724972 - RNA, 15 nt, Haemophilus influenzae Rd
cuuuuaauucauuga

SEQ ID NO: 2724973 - RNA, 20 nt, Haemophilus influenzae Rd
cuuuuaauucgccccaaaca

SEQ ID NO: 2724974 - RNA, 14 nt, Haemophilus influenzae Rd
cuuuuaauuuuuac

SEQ ID NO: 2724975 - RNA, 12 nt, Haemophilus influenzae Rd
cuuuuacauuug

SEQ ID NO: 2724976 - RNA, 12 nt, Haemophilus influenzae Rd
cuuuuaccaauu

SEQ ID NO: 2724977 - RNA, 15 nt, Haemophilus influenzae Rd
cuuuuaccaauugau

SEQ ID NO: 2724978 - RNA, 22 nt, Haemophilus influenzae Rd
cuuuuaccuuuaagcauugucc

SEQ ID NO: 2724979 - RNA, 19 nt, Haemophilus influenzae Rd
cuuuuacgaacguuucauc

SEQ ID NO: 2724980 - RNA, 20 nt, Haemophilus influenzae Rd
cuuuuacgaacguuucauca

SEQ ID NO: 2724981 - RNA, 18 nt, Haemophilus influenzae Rd
cuuuuaguucguuuuuua

SEQ ID NO: 2724982 - RNA, 17 nt, Haemophilus influenzae Rd
cuuuuaguuuccccuga

SEQ ID NO: 2724983 - RNA, 22 nt, Haemophilus influenzae Rd
cuuuuaguuuccccugaaugcg

SEQ ID NO: 2724984 - RNA, 17 nt, Haemophilus influenzae Rd
cuuuuauaaagaucaau

SEQ ID NO: 2724985 - RNA, 18 nt, Haemophilus influenzae Rd
cuuuuauaaagaucaaug

SEQ ID NO: 2724986 - RNA, 18 nt, Haemophilus influenzae Rd
cuuuuauauguaaaauuu

SEQ ID NO: 2724987 - RNA, 20 nt, Haemophilus influenzae Rd
cuuuuauccacaugauauau

SEQ ID NO: 2724988 - RNA, 12 nt, Haemophilus influenzae Rd
cuuuuauccacc

SEQ ID NO: 2724989 - RNA, 14 nt, Haemophilus influenzae Rd
cuuuuaucgagaaa

SEQ ID NO: 2724990 - RNA, 20 nt, Haemophilus influenzae Rd
cuuuuaucucggcuaaaauc

SEQ ID NO: 2724991 - RNA, 21 nt, Haemophilus influenzae Rd
cuuuuaucucggcuaaaaucu

SEQ ID NO: 2724992 - RNA, 14 nt, Haemophilus influenzae Rd
cuuuuauguuucuc

SEQ ID NO: 2724993 - RNA, 14 nt, Haemophilus influenzae Rd
cuuuuauuaacaaa

SEQ ID NO: 2724994 - RNA, 12 nt, Haemophilus influenzae Rd
cuuuuauuguuc

SEQ ID NO: 2724995 - RNA, 12 nt, Haemophilus influenzae Rd
cuuuucaaacaa

SEQ ID NO: 2724996 - RNA, 15 nt, Haemophilus influenzae Rd
cuuuucaaacaacaa

SEQ ID NO: 2724997 - RNA, 17 nt, Haemophilus influenzae Rd
cuuuucaaacaacaagu

SEQ ID NO: 2724998 - RNA, 16 nt, Haemophilus influenzae Rd
cuuuucaaacacaaaa

SEQ ID NO: 2724999 - RNA, 19 nt, Haemophilus influenzae Rd
cuuuucaacacuuuauuac

SEQ ID NO: 2725000 - RNA, 22 nt, Haemophilus influenzae Rd
cuuuucaaguuacuuaauuuug

SEQ ID NO: 2725001 - RNA, 12 nt, Haemophilus influenzae Rd
cuuuucaucuuc

SEQ ID NO: 2725002 - RNA, 19 nt, Haemophilus influenzae Rd
cuuuucaucuuccgugaca

SEQ ID NO: 2725003 - RNA, 17 nt, Haemophilus influenzae Rd
cuuuucccucuuuuuca

SEQ ID NO: 2725004 - RNA, 16 nt, Haemophilus influenzae Rd
cuuuucccuuuucuua

SEQ ID NO: 2725005 - RNA, 18 nt, Haemophilus influenzae Rd
cuuuuccuaaaguuuuug

SEQ ID NO: 2725006 - RNA, 13 nt, Haemophilus influenzae Rd
cuuuuccuuguuu

SEQ ID NO: 2725007 - RNA, 12 nt, Haemophilus influenzae Rd
cuuuucgaauua

SEQ ID NO: 2725008 - RNA, 19 nt, Haemophilus influenzae Rd
cuuuucgaauuaaacguga

SEQ ID NO: 2725009 - RNA, 15 nt, Haemophilus influenzae Rd
cuuuucuaaacgaag

SEQ ID NO: 2725010 - RNA, 20 nt, Haemophilus influenzae Rd
cuuuucuaacgcuuuuaaac

SEQ ID NO: 2725011 - RNA, 16 nt, Haemophilus influenzae Rd
cuuuucuagcaauaaa

SEQ ID NO: 2725012 - RNA, 20 nt, Haemophilus influenzae Rd
cuuuucuauaauuaaacauu

SEQ ID NO: 2725013 - RNA, 15 nt, Haemophilus influenzae Rd
cuuuucuuagauaaa

SEQ ID NO: 2725014 - RNA, 20 nt, Haemophilus influenzae Rd
cuuuucuuaugaaccuaaac

SEQ ID NO: 2725015 - RNA, 15 nt, Haemophilus influenzae Rd
cuuuucuuauuucug

SEQ ID NO: 2725016 - RNA, 13 nt, Haemophilus influenzae Rd
cuuuucuucaucg

SEQ ID NO: 2725017 - RNA, 20 nt, Haemophilus influenzae Rd
cuuuucuucaucgcuuaggg

SEQ ID NO: 2725018 - RNA, 15 nt, Haemophilus influenzae Rd
cuuuucuucuaauuc

SEQ ID NO: 2725019 - RNA, 16 nt, Haemophilus influenzae Rd
cuuuucuucuaauucu

SEQ ID NO: 2725020 - RNA, 22 nt, Haemophilus influenzae Rd
cuuuugaaagauuuucuacaac

SEQ ID NO: 2725021 - RNA, 17 nt, Haemophilus influenzae Rd
cuuuugaaugugagcca

SEQ ID NO: 2725022 - RNA, 20 nt, Haemophilus influenzae Rd
cuuuugagugcuguacacac

SEQ ID NO: 2725023 - RNA, 14 nt, Haemophilus influenzae Rd
cuuuugcaagcauu

SEQ ID NO: 2725024 - RNA, 15 nt, Haemophilus influenzae Rd
cuuuugccauauuua

SEQ ID NO: 2725025 - RNA, 17 nt, Haemophilus influenzae Rd
cuuuugccuaaaaccug

SEQ ID NO: 2725026 - RNA, 13 nt, Haemophilus influenzae Rd
cuuuugcuucaau

SEQ ID NO: 2725027 - RNA, 15 nt, Haemophilus influenzae Rd
cuuuugcuucaauuu

SEQ ID NO: 2725028 - RNA, 14 nt, Haemophilus influenzae Rd
cuuuugcuucacgu

SEQ ID NO: 2725029 - RNA, 21 nt, Haemophilus influenzae Rd
cuuuuggauaaaguauucaua

SEQ ID NO: 2725030 - RNA, 20 nt, Haemophilus influenzae Rd
cuuuuggauacacaaauuga

SEQ ID NO: 2725031 - RNA, 15 nt, Haemophilus influenzae Rd
cuuuuggcauuagcg

SEQ ID NO: 2725032 - RNA, 17 nt, Haemophilus influenzae Rd
cuuuuggguuaaauaau

SEQ ID NO: 2725033 - RNA, 21 nt, Haemophilus influenzae Rd
cuuuuggguuaaauaaugccc

SEQ ID NO: 2725034 - RNA, 12 nt, Haemophilus influenzae Rd
cuuuuguagaaa

SEQ ID NO: 2725035 - RNA, 19 nt, Haemophilus influenzae Rd
cuuuuguauuacgugauuu

SEQ ID NO: 2725036 - RNA, 17 nt, Haemophilus influenzae Rd
cuuuuguauuggguaaa

SEQ ID NO: 2725037 - RNA, 19 nt, Haemophilus influenzae Rd
cuuuugucacagcgcgacu

SEQ ID NO: 2725038 - RNA, 15 nt, Haemophilus influenzae Rd
cuuuuguuacuuucc

SEQ ID NO: 2725039 - RNA, 22 nt, Haemophilus influenzae Rd
cuuuuguugcacccauuuugau

SEQ ID NO: 2725040 - RNA, 21 nt, Haemophilus influenzae Rd
cuuuuguuguuauucuaauua

SEQ ID NO: 2725041 - RNA, 12 nt, Haemophilus influenzae Rd
cuuuuguuuuaa

SEQ ID NO: 2725042 - RNA, 18 nt, Haemophilus influenzae Rd
cuuuuuaauuuauacaaa

SEQ ID NO: 2725043 - RNA, 12 nt, Haemophilus influenzae Rd
cuuuuuauaaaa

SEQ ID NO: 2725044 - RNA, 15 nt, Haemophilus influenzae Rd
cuuuuuauaaaaaaa

SEQ ID NO: 2725045 - RNA, 15 nt, Haemophilus influenzae Rd
cuuuuuaucuaaaaa

SEQ ID NO: 2725046 - RNA, 15 nt, Haemophilus influenzae Rd
cuuuuuaucuaaauu

SEQ ID NO: 2725047 - RNA, 16 nt, Haemophilus influenzae Rd
cuuuuuaucuaaauuu

SEQ ID NO: 2725048 - RNA, 16 nt, Haemophilus influenzae Rd
cuuuuuauguuuuguu

SEQ ID NO: 2725049 - RNA, 17 nt, Haemophilus influenzae Rd
cuuuuuauuagacaaua

SEQ ID NO: 2725050 - RNA, 19 nt, Haemophilus influenzae Rd
cuuuuuauuagacaauaaa

SEQ ID NO: 2725051 - RNA, 13 nt, Haemophilus influenzae Rd
cuuuuuauuuaga

SEQ ID NO: 2725052 - RNA, 17 nt, Haemophilus influenzae Rd
cuuuuucaagaacagaa

SEQ ID NO: 2725053 - RNA, 12 nt, Haemophilus influenzae Rd
cuuuuucaaguu

SEQ ID NO: 2725054 - RNA, 11 nt, Haemophilus influenzae Rd
cuuuuuccuca

SEQ ID NO: 2725055 - RNA, 16 nt, Haemophilus influenzae Rd
cuuuuuccucagcaaa

SEQ ID NO: 2725056 - RNA, 12 nt, Haemophilus influenzae Rd
cuuuuuccugaa

SEQ ID NO: 2725057 - RNA, 19 nt, Haemophilus influenzae Rd
cuuuuuccugaauaacuac

SEQ ID NO: 2725058 - RNA, 11 nt, Haemophilus influenzae Rd
cuuuuuccuuu

SEQ ID NO: 2725059 - RNA, 20 nt, Haemophilus influenzae Rd
cuuuuucugcgcgcaaucca

SEQ ID NO: 2725060 - RNA, 20 nt, Haemophilus influenzae Rd
cuuuuucuuacggauuuuug

SEQ ID NO: 2725061 - RNA, 13 nt, Haemophilus influenzae Rd
cuuuuucuugauc

SEQ ID NO: 2725062 - RNA, 14 nt, Haemophilus influenzae Rd
cuuuuucuugaucu

SEQ ID NO: 2725063 - RNA, 21 nt, Haemophilus influenzae Rd
cuuuuugcagggauuucaaua

SEQ ID NO: 2725064 - RNA, 16 nt, Haemophilus influenzae Rd
cuuuuuguaugagaau

SEQ ID NO: 2725065 - RNA, 18 nt, Haemophilus influenzae Rd
cuuuuugugccaauccau

SEQ ID NO: 2725066 - RNA, 22 nt, Haemophilus influenzae Rd
cuuuuuguuaauaaaagaauau

SEQ ID NO: 2725067 - RNA, 16 nt, Haemophilus influenzae Rd
cuuuuuguuuaaaagc

SEQ ID NO: 2725068 - RNA, 12 nt, Haemophilus influenzae Rd
cuuuuuuaagua

SEQ ID NO: 2725069 - RNA, 18 nt, Haemophilus influenzae Rd
cuuuuuuaaugggauuuu

SEQ ID NO: 2725070 - RNA, 14 nt, Haemophilus influenzae Rd
cuuuuuucaaugcu

SEQ ID NO: 2725071 - RNA, 16 nt, Haemophilus influenzae Rd
cuuuuuucgcaccaau

SEQ ID NO: 2725072 - RNA, 23 nt, Haemophilus influenzae Rd
cuuuuuucuugcuaaaaagaaau

SEQ ID NO: 2725073 - RNA, 16 nt, Haemophilus influenzae Rd
cuuuuuucuuucuagu

SEQ ID NO: 2725074 - RNA, 20 nt, Haemophilus influenzae Rd
cuuuuuugcuuauuuuguug

SEQ ID NO: 2725075 - RNA, 22 nt, Haemophilus influenzae Rd
cuuuuuuuaaucacaaagcuua

SEQ ID NO: 2725076 - RNA, 18 nt, Haemophilus influenzae Rd
cuuuuuuuauauuuuuua

SEQ ID NO: 2725077 - RNA, 21 nt, Haemophilus influenzae Rd
gaaaaaaagugcgguugaaau

SEQ ID NO: 2725078 - RNA, 13 nt, Haemophilus influenzae Rd
gaaaaaacaagag

SEQ ID NO: 2725079 - RNA, 13 nt, Haemophilus influenzae Rd
gaaaaaauaacca

SEQ ID NO: 2725080 - RNA, 16 nt, Haemophilus influenzae Rd
gaaaaagaaaaccugc

SEQ ID NO: 2725081 - RNA, 15 nt, Haemophilus influenzae Rd
gaaaaagcuuccuuu

SEQ ID NO: 2725082 - RNA, 14 nt, Haemophilus influenzae Rd
gaaaaaggcaguaa

SEQ ID NO: 2725083 - RNA, 17 nt, Haemophilus influenzae Rd
gaaaaaggcugcuugau

SEQ ID NO: 2725084 - RNA, 14 nt, Haemophilus influenzae Rd
gaaaaauaaaaaau

SEQ ID NO: 2725085 - RNA, 19 nt, Haemophilus influenzae Rd
gaaaaauccuguucagcuu

SEQ ID NO: 2725086 - RNA, 18 nt, Haemophilus influenzae Rd
gaaaaaucgaagaaauau

SEQ ID NO: 2725087 - RNA, 17 nt, Haemophilus influenzae Rd
gaaaaaugccacuaagg

SEQ ID NO: 2725088 - RNA, 18 nt, Haemophilus influenzae Rd
gaaaaaugcuuguucuga

SEQ ID NO: 2725089 - RNA, 12 nt, Haemophilus influenzae Rd
gaaaaauguuua

SEQ ID NO: 2725090 - RNA, 17 nt, Haemophilus influenzae Rd
gaaaaauuaucaaaaga

SEQ ID NO: 2725091 - RNA, 20 nt, Haemophilus influenzae Rd
gaaaaauuaucaaaagaaaa

SEQ ID NO: 2725092 - RNA, 21 nt, Haemophilus influenzae Rd
gaaaaauugguacgagaaaaa

SEQ ID NO: 2725093 - RNA, 12 nt, Haemophilus influenzae Rd
gaaaacaauaaa

SEQ ID NO: 2725094 - RNA, 21 nt, Haemophilus influenzae Rd
gaaaacagcggucaaaauaga

SEQ ID NO: 2725095 - RNA, 22 nt, Haemophilus influenzae Rd
gaaaacauaauccgcaucuaaa

SEQ ID NO: 2725096 - RNA, 14 nt, Haemophilus influenzae Rd
gaaaaccaaaacau

SEQ ID NO: 2725097 - RNA, 20 nt, Haemophilus influenzae Rd
gaaaacgaugaaguuuucau

SEQ ID NO: 2725098 - RNA, 16 nt, Haemophilus influenzae Rd
gaaaacucgacuuuug

SEQ ID NO: 2725099 - RNA, 14 nt, Haemophilus influenzae Rd
gaaaacuuggaauu

SEQ ID NO: 2725100 - RNA, 13 nt, Haemophilus influenzae Rd
gaaaagaaaacuu

SEQ ID NO: 2725101 - RNA, 14 nt, Haemophilus influenzae Rd
gaaaagaaaacuua

SEQ ID NO: 2725102 - RNA, 18 nt, Haemophilus influenzae Rd
gaaaagaaaguauuaaau

SEQ ID NO: 2725103 - RNA, 19 nt, Haemophilus influenzae Rd
gaaaagaaaguauuaaaua

SEQ ID NO: 2725104 - RNA, 23 nt, Haemophilus influenzae Rd
gaaaagaauaauauuaaagaaaa

SEQ ID NO: 2725105 - RNA, 14 nt, Haemophilus influenzae Rd
gaaaagaauuucau

SEQ ID NO: 2725106 - RNA, 13 nt, Haemophilus influenzae Rd
gaaaaguaaauga

SEQ ID NO: 2725107 - RNA, 21 nt, Haemophilus influenzae Rd
gaaaagugcaugauguuuuuc

SEQ ID NO: 2725108 - RNA, 22 nt, Haemophilus influenzae Rd
gaaaagugcaugauguuuuuca

SEQ ID NO: 2725109 - RNA, 18 nt, Haemophilus influenzae Rd
gaaaagugcggagaaaau

SEQ ID NO: 2725110 - RNA, 17 nt, Haemophilus influenzae Rd
gaaaagugcgguaaaaa

SEQ ID NO: 2725111 - RNA, 16 nt, Haemophilus influenzae Rd
gaaaagugcggucgau

SEQ ID NO: 2725112 - RNA, 22 nt, Haemophilus influenzae Rd
gaaaaguucagauucaauaaua

SEQ ID NO: 2725113 - RNA, 15 nt, Haemophilus influenzae Rd
gaaaaguugaaacug

SEQ ID NO: 2725114 - RNA, 22 nt, Haemophilus influenzae Rd
gaaaaguuuuauauuuuuucuu

SEQ ID NO: 2725115 - RNA, 14 nt, Haemophilus influenzae Rd
gaaaauaacuucau

SEQ ID NO: 2725116 - RNA, 14 nt, Haemophilus influenzae Rd
gaaaauaauauuga

SEQ ID NO: 2725117 - RNA, 21 nt, Haemophilus influenzae Rd
gaaaauacuguuuuaugcuaa

SEQ ID NO: 2725118 - RNA, 19 nt, Haemophilus influenzae Rd
gaaaauagaagccaaauca

SEQ ID NO: 2725119 - RNA, 22 nt, Haemophilus influenzae Rd
gaaaauauucuucauaaaaaaa

SEQ ID NO: 2725120 - RNA, 21 nt, Haemophilus influenzae Rd
gaaaaucacgcucuuuuaucu

SEQ ID NO: 2725121 - RNA, 15 nt, Haemophilus influenzae Rd
gaaaaucaucauauu

SEQ ID NO: 2725122 - RNA, 19 nt, Haemophilus influenzae Rd
gaaaaucccuauaaugcac

SEQ ID NO: 2725123 - RNA, 19 nt, Haemophilus influenzae Rd
gaaaaugcuuauaaaacag

SEQ ID NO: 2725124 - RNA, 11 nt, Haemophilus influenzae Rd
gaaaaugguua

SEQ ID NO: 2725125 - RNA, 19 nt, Haemophilus influenzae Rd
gaaaaugguuacguuuuuc

SEQ ID NO: 2725126 - RNA, 12 nt, Haemophilus influenzae Rd
gaaaauuaaaaa

SEQ ID NO: 2725127 - RNA, 16 nt, Haemophilus influenzae Rd
gaaaauuaaaaauuua

SEQ ID NO: 2725128 - RNA, 21 nt, Haemophilus influenzae Rd
gaaaauuaaaaauuuaauacu

SEQ ID NO: 2725129 - RNA, 16 nt, Haemophilus influenzae Rd
gaaaauuaagaaaaua

SEQ ID NO: 2725130 - RNA, 22 nt, Haemophilus influenzae Rd
gaaaauuauugugagauaugaa

SEQ ID NO: 2725131 - RNA, 17 nt, Haemophilus influenzae Rd
gaaaauugcaccuucuu

SEQ ID NO: 2725132 - RNA, 20 nt, Haemophilus influenzae Rd
gaaaauugcaccuucuuuug

SEQ ID NO: 2725133 - RNA, 22 nt, Haemophilus influenzae Rd
gaaaauuggcgcgccgauaugg

SEQ ID NO: 2725134 - RNA, 21 nt, Haemophilus influenzae Rd
gaaaauuuugccaauuacauu

SEQ ID NO: 2725135 - RNA, 16 nt, Haemophilus influenzae Rd
gaaacaacgcguacuu

SEQ ID NO: 2725136 - RNA, 21 nt, Haemophilus influenzae Rd
gaaacaacgcguacuuuuuua

SEQ ID NO: 2725137 - RNA, 14 nt, Haemophilus influenzae Rd
gaaacaauaaaacu

SEQ ID NO: 2725138 - RNA, 21 nt, Haemophilus influenzae Rd
gaaacaauauguauaauuccu

SEQ ID NO: 2725139 - RNA, 16 nt, Haemophilus influenzae Rd
gaaacagaaauaacac

SEQ ID NO: 2725140 - RNA, 19 nt, Haemophilus influenzae Rd
gaaacagaaauaacacuac

SEQ ID NO: 2725141 - RNA, 12 nt, Haemophilus influenzae Rd
gaaacagcuaaa

SEQ ID NO: 2725142 - RNA, 17 nt, Haemophilus influenzae Rd
gaaacagcuaaaaauga

SEQ ID NO: 2725143 - RNA, 22 nt, Haemophilus influenzae Rd
gaaacaggacaccgcuaaaccu

SEQ ID NO: 2725144 - RNA, 19 nt, Haemophilus influenzae Rd
gaaacagguaauuucucug

SEQ ID NO: 2725145 - RNA, 23 nt, Haemophilus influenzae Rd
gaaacauaaaagaggaaaaucga

SEQ ID NO: 2725146 - RNA, 15 nt, Haemophilus influenzae Rd
gaaacauaucaaaaa

SEQ ID NO: 2725147 - RNA, 16 nt, Haemophilus influenzae Rd
gaaaccaaauccuuuu

SEQ ID NO: 2725148 - RNA, 21 nt, Haemophilus influenzae Rd
gaaaccaacuuugaccauuuc

SEQ ID NO: 2725149 - RNA, 19 nt, Haemophilus influenzae Rd
gaaaccacuaaaaacaagu

SEQ ID NO: 2725150 - RNA, 16 nt, Haemophilus influenzae Rd
gaaaccauugaugaaa

SEQ ID NO: 2725151 - RNA, 17 nt, Haemophilus influenzae Rd
gaaaccauugaugaaau

SEQ ID NO: 2725152 - RNA, 13 nt, Haemophilus influenzae Rd
gaaaccgcauauu

SEQ ID NO: 2725153 - RNA, 19 nt, Haemophilus influenzae Rd
gaaaccugaguaaauaaac

SEQ ID NO: 2725154 - RNA, 14 nt, Haemophilus influenzae Rd
gaaacgagcauauu

SEQ ID NO: 2725155 - RNA, 18 nt, Haemophilus influenzae Rd
gaaacgguuaauaaauuc

SEQ ID NO: 2725156 - RNA, 16 nt, Haemophilus influenzae Rd
gaaacgguuaguacuu

SEQ ID NO: 2725157 - RNA, 17 nt, Haemophilus influenzae Rd
gaaacguaaacaaaaua

SEQ ID NO: 2725158 - RNA, 14 nt, Haemophilus influenzae Rd
gaaacguuggguuu

SEQ ID NO: 2725159 - RNA, 21 nt, Haemophilus influenzae Rd
gaaacuaaagaaucaaauuca

SEQ ID NO: 2725160 - RNA, 21 nt, Haemophilus influenzae Rd
gaaacuacggacuaaauaaau

SEQ ID NO: 2725161 - RNA, 16 nt, Haemophilus influenzae Rd
gaaacuacuuucuauu

SEQ ID NO: 2725162 - RNA, 22 nt, Haemophilus influenzae Rd
gaaacuacuuucuauuaaaaaa

SEQ ID NO: 2725163 - RNA, 13 nt, Haemophilus influenzae Rd
gaaacucaccauu

SEQ ID NO: 2725164 - RNA, 22 nt, Haemophilus influenzae Rd
gaaacugguuuaucacuaauau

SEQ ID NO: 2725165 - RNA, 13 nt, Haemophilus influenzae Rd
gaaagacugcuac

SEQ ID NO: 2725166 - RNA, 15 nt, Haemophilus influenzae Rd
gaaagacuuuauccg

SEQ ID NO: 2725167 - RNA, 18 nt, Haemophilus influenzae Rd
gaaagauuaauuuuccua

SEQ ID NO: 2725168 - RNA, 16 nt, Haemophilus influenzae Rd
gaaagcaauguaguug

SEQ ID NO: 2725169 - RNA, 17 nt, Haemophilus influenzae Rd
gaaagcaugaauaaaaa

SEQ ID NO: 2725170 - RNA, 19 nt, Haemophilus influenzae Rd
gaaagcaugaauaaaaaug

SEQ ID NO: 2725171 - RNA, 20 nt, Haemophilus influenzae Rd
gaaagcaugaauaaaaaugg

SEQ ID NO: 2725172 - RNA, 17 nt, Haemophilus influenzae Rd
gaaagccuuuuaaaaug

SEQ ID NO: 2725173 - RNA, 22 nt, Haemophilus influenzae Rd
gaaagcuauuucggcaguacuc

SEQ ID NO: 2725174 - RNA, 16 nt, Haemophilus influenzae Rd
gaaaggaauagauuua

SEQ ID NO: 2725175 - RNA, 15 nt, Haemophilus influenzae Rd
gaaaggguugcagaa

SEQ ID NO: 2725176 - RNA, 18 nt, Haemophilus influenzae Rd
gaaaguaacaauguagaa

SEQ ID NO: 2725177 - RNA, 10 nt, Haemophilus influenzae Rd
gaaaguaauu

SEQ ID NO: 2725178 - RNA, 19 nt, Haemophilus influenzae Rd
gaaaguauuuucuuuccaa

SEQ ID NO: 2725179 - RNA, 16 nt, Haemophilus influenzae Rd
gaaagucgauucaaau

SEQ ID NO: 2725180 - RNA, 21 nt, Haemophilus influenzae Rd
gaaagugcagcccaaauaaag

SEQ ID NO: 2725181 - RNA, 19 nt, Haemophilus influenzae Rd
gaaagugcggucauuuuug

SEQ ID NO: 2725182 - RNA, 14 nt, Haemophilus influenzae Rd
gaaaguuaaaacag

SEQ ID NO: 2725183 - RNA, 20 nt, Haemophilus influenzae Rd
gaaaguuaagccugauagca

SEQ ID NO: 2725184 - RNA, 22 nt, Haemophilus influenzae Rd
gaaaguuaagccugauagcauu

SEQ ID NO: 2725185 - RNA, 22 nt, Haemophilus influenzae Rd
gaaaguuaccgcucgccaauaa

SEQ ID NO: 2725186 - RNA, 22 nt, Haemophilus influenzae Rd
gaaaguucucgcaaaagugcgg

SEQ ID NO: 2725187 - RNA, 23 nt, Haemophilus influenzae Rd
gaaaguuggccaauuugcauaug

SEQ ID NO: 2725188 - RNA, 18 nt, Haemophilus influenzae Rd
gaaaguuggcuacuauca

SEQ ID NO: 2725189 - RNA, 21 nt, Haemophilus influenzae Rd
gaaaguuuaacuuucaacacg

SEQ ID NO: 2725190 - RNA, 14 nt, Haemophilus influenzae Rd
gaaaguuuuaagug

SEQ ID NO: 2725191 - RNA, 17 nt, Haemophilus influenzae Rd
gaaaguuuuaagugcgg

SEQ ID NO: 2725192 - RNA, 15 nt, Haemophilus influenzae Rd
gaaauaaaauauaug

SEQ ID NO: 2725193 - RNA, 18 nt, Haemophilus influenzae Rd
gaaauaaacgcaucaacu

SEQ ID NO: 2725194 - RNA, 12 nt, Haemophilus influenzae Rd
gaaauaaaucua

SEQ ID NO: 2725195 - RNA, 13 nt, Haemophilus influenzae Rd
gaaauaaaucuaa

SEQ ID NO: 2725196 - RNA, 15 nt, Haemophilus influenzae Rd
gaaauaaaucuaagc

SEQ ID NO: 2725197 - RNA, 12 nt, Haemophilus influenzae Rd
gaaauaaaugau

SEQ ID NO: 2725198 - RNA, 21 nt, Haemophilus influenzae Rd
gaaauaagauuuuugauaaaa

SEQ ID NO: 2725199 - RNA, 17 nt, Haemophilus influenzae Rd
gaaauaccauggauacc

SEQ ID NO: 2725200 - RNA, 15 nt, Haemophilus influenzae Rd
gaaauaccgauaaua

SEQ ID NO: 2725201 - RNA, 16 nt, Haemophilus influenzae Rd
gaaauaccuucuugau

SEQ ID NO: 2725202 - RNA, 16 nt, Haemophilus influenzae Rd
gaaauacgagaaagcu

SEQ ID NO: 2725203 - RNA, 18 nt, Haemophilus influenzae Rd
gaaauagacuacuuaaaa

SEQ ID NO: 2725204 - RNA, 22 nt, Haemophilus influenzae Rd
gaaauagacuacuuaaaauuca

SEQ ID NO: 2725205 - RNA, 15 nt, Haemophilus influenzae Rd
gaaauagcguuuuuc

SEQ ID NO: 2725206 - RNA, 20 nt, Haemophilus influenzae Rd
gaaauaguuaaagaaaauau

SEQ ID NO: 2725207 - RNA, 22 nt, Haemophilus influenzae Rd
gaaauauauuuguuuuuaguuu

SEQ ID NO: 2725208 - RNA, 22 nt, Haemophilus influenzae Rd
gaaauaucagcuacuuguaaga

SEQ ID NO: 2725209 - RNA, 21 nt, Haemophilus influenzae Rd
gaaauaucuaggcuaauuauu

SEQ ID NO: 2725210 - RNA, 21 nt, Haemophilus influenzae Rd
gaaauaugauuuagaacaaua

SEQ ID NO: 2725211 - RNA, 14 nt, Haemophilus influenzae Rd
gaaauauucuugga

SEQ ID NO: 2725212 - RNA, 17 nt, Haemophilus influenzae Rd
gaaauauuuuaauagaa

SEQ ID NO: 2725213 - RNA, 18 nt, Haemophilus influenzae Rd
gaaauauuuuaauagaau

SEQ ID NO: 2725214 - RNA, 12 nt, Haemophilus influenzae Rd
gaaauauuuuua

SEQ ID NO: 2725215 - RNA, 22 nt, Haemophilus influenzae Rd
gaaaucaaggcuuuuuuauucc

SEQ ID NO: 2725216 - RNA, 15 nt, Haemophilus influenzae Rd
gaaaucaccgcacuu

SEQ ID NO: 2725217 - RNA, 13 nt, Haemophilus influenzae Rd
gaaaucauaaacu

SEQ ID NO: 2725218 - RNA, 14 nt, Haemophilus influenzae Rd
gaaaucauuucaau

SEQ ID NO: 2725219 - RNA, 18 nt, Haemophilus influenzae Rd
gaaauccacaaaaucuga

SEQ ID NO: 2725220 - RNA, 17 nt, Haemophilus influenzae Rd
gaaaucccaccuuuuag

SEQ ID NO: 2725221 - RNA, 19 nt, Haemophilus influenzae Rd
gaaaucccgcagggaugcg

SEQ ID NO: 2725222 - RNA, 21 nt, Haemophilus influenzae Rd
gaaaucgcacucacaauacca

SEQ ID NO: 2725223 - RNA, 22 nt, Haemophilus influenzae Rd
gaaaucgcacucacaauaccaa

SEQ ID NO: 2725224 - RNA, 19 nt, Haemophilus influenzae Rd
gaaaucuaauuugcuuaca

SEQ ID NO: 2725225 - RNA, 19 nt, Haemophilus influenzae Rd
gaaaucucuuucaauuuca

SEQ ID NO: 2725226 - RNA, 19 nt, Haemophilus influenzae Rd
gaaaucuuggcucauuuua

SEQ ID NO: 2725227 - RNA, 21 nt, Haemophilus influenzae Rd
gaaaucuuggcucauuuuaaa

SEQ ID NO: 2725228 - RNA, 17 nt, Haemophilus influenzae Rd
gaaaugcuuacaggaaa

SEQ ID NO: 2725229 - RNA, 18 nt, Haemophilus influenzae Rd
gaaaugcuuacaggaaag

SEQ ID NO: 2725230 - RNA, 19 nt, Haemophilus influenzae Rd
gaaaugcuuacaggaaagu

SEQ ID NO: 2725231 - RNA, 20 nt, Haemophilus influenzae Rd
gaaauguaaagauuuuucuu

SEQ ID NO: 2725232 - RNA, 22 nt, Haemophilus influenzae Rd
gaaauguacuggcucuucuuuc

SEQ ID NO: 2725233 - RNA, 20 nt, Haemophilus influenzae Rd
gaaauguugucuaaguaauu

SEQ ID NO: 2725234 - RNA, 23 nt, Haemophilus influenzae Rd
gaaauguuuaauuauagaaaaga

SEQ ID NO: 2725235 - RNA, 13 nt, Haemophilus influenzae Rd
gaaauguuuuuuc

SEQ ID NO: 2725236 - RNA, 16 nt, Haemophilus influenzae Rd
gaaauuaaaauaauau

SEQ ID NO: 2725237 - RNA, 13 nt, Haemophilus influenzae Rd
gaaauuaagcagc

SEQ ID NO: 2725238 - RNA, 17 nt, Haemophilus influenzae Rd
gaaauuaauaagaaaga

SEQ ID NO: 2725239 - RNA, 19 nt, Haemophilus influenzae Rd
gaaauuaauaagaaagaau

SEQ ID NO: 2725240 - RNA, 22 nt, Haemophilus influenzae Rd
gaaauuacugucaccucguaaa

SEQ ID NO: 2725241 - RNA, 18 nt, Haemophilus influenzae Rd
gaaauuacuugaaucuaa

SEQ ID NO: 2725242 - RNA, 21 nt, Haemophilus influenzae Rd
gaaauucacucaauucaaaga

SEQ ID NO: 2725243 - RNA, 16 nt, Haemophilus influenzae Rd
gaaauuccuugccaaa

SEQ ID NO: 2725244 - RNA, 23 nt, Haemophilus influenzae Rd
gaaauucgcuuuuuuaguuagaa

SEQ ID NO: 2725245 - RNA, 22 nt, Haemophilus influenzae Rd
gaaauucuaccugcuguaacgu

SEQ ID NO: 2725246 - RNA, 18 nt, Haemophilus influenzae Rd
gaaauucuucaauaacaa

SEQ ID NO: 2725247 - RNA, 17 nt, Haemophilus influenzae Rd
gaaauugauauaaaugg

SEQ ID NO: 2725248 - RNA, 16 nt, Haemophilus influenzae Rd
gaaauugccaaaaaag

SEQ ID NO: 2725249 - RNA, 23 nt, Haemophilus influenzae Rd
gaaauugcguguuuauauaccau

SEQ ID NO: 2725250 - RNA, 17 nt, Haemophilus influenzae Rd
gaaauuuaauaagaauu

SEQ ID NO: 2725251 - RNA, 20 nt, Haemophilus influenzae Rd
gaaauuuauuauaaaaauau

SEQ ID NO: 2725252 - RNA, 18 nt, Haemophilus influenzae Rd
gaaauuucaaccgcacuu

SEQ ID NO: 2725253 - RNA, 16 nt, Haemophilus influenzae Rd
gaaauuucauauuucu

SEQ ID NO: 2725254 - RNA, 17 nt, Haemophilus influenzae Rd
gaaauuugaauauaaga

SEQ ID NO: 2725255 - RNA, 12 nt, Haemophilus influenzae Rd
gaaauuuuguuu

SEQ ID NO: 2725256 - RNA, 21 nt, Haemophilus influenzae Rd
gaacaaaauaauuauggugaa

SEQ ID NO: 2725257 - RNA, 18 nt, Haemophilus influenzae Rd
gaacaagcauuuuucaua

SEQ ID NO: 2725258 - RNA, 16 nt, Haemophilus influenzae Rd
gaacaagccccacagg

SEQ ID NO: 2725259 - RNA, 21 nt, Haemophilus influenzae Rd
gaacaagcgcaaguucuucau

SEQ ID NO: 2725260 - RNA, 17 nt, Haemophilus influenzae Rd
gaacaaggggaaaauau

SEQ ID NO: 2725261 - RNA, 17 nt, Haemophilus influenzae Rd
gaacaauuucuuuaccu

SEQ ID NO: 2725262 - RNA, 15 nt, Haemophilus influenzae Rd
gaacaccgagaugca

SEQ ID NO: 2725263 - RNA, 16 nt, Haemophilus influenzae Rd
gaacaccuugcguguu

SEQ ID NO: 2725264 - RNA, 10 nt, Haemophilus influenzae Rd
gaacacucua

SEQ ID NO: 2725265 - RNA, 20 nt, Haemophilus influenzae Rd
gaacacucuaucuaaaauau

SEQ ID NO: 2725266 - RNA, 18 nt, Haemophilus influenzae Rd
gaacagccaguaaauugg

SEQ ID NO: 2725267 - RNA, 20 nt, Haemophilus influenzae Rd
gaacagguugcugauaaaga

SEQ ID NO: 2725268 - RNA, 14 nt, Haemophilus influenzae Rd
gaacauaagcaaca

SEQ ID NO: 2725269 - RNA, 19 nt, Haemophilus influenzae Rd
gaacaucaaauccuuguuu

SEQ ID NO: 2725270 - RNA, 17 nt, Haemophilus influenzae Rd
gaacaucauuuucaagu

SEQ ID NO: 2725271 - RNA, 12 nt, Haemophilus influenzae Rd
gaacaugcguuu

SEQ ID NO: 2725272 - RNA, 16 nt, Haemophilus influenzae Rd
gaacaugcguuuucgc

SEQ ID NO: 2725273 - RNA, 21 nt, Haemophilus influenzae Rd
gaacauugugacauuggauua

SEQ ID NO: 2725274 - RNA, 20 nt, Haemophilus influenzae Rd
gaacauuuucugcucuucau

SEQ ID NO: 2725275 - RNA, 18 nt, Haemophilus influenzae Rd
gaaccaaaucuaacauuu

SEQ ID NO: 2725276 - RNA, 23 nt, Haemophilus influenzae Rd
gaaccaaaucuaacauuuccugu

SEQ ID NO: 2725277 - RNA, 16 nt, Haemophilus influenzae Rd
gaaccaacccaauuua

SEQ ID NO: 2725278 - RNA, 18 nt, Haemophilus influenzae Rd
gaaccauagaaagcauug

SEQ ID NO: 2725279 - RNA, 23 nt, Haemophilus influenzae Rd
gaaccauuuauaaugcaaccaaa

SEQ ID NO: 2725280 - RNA, 13 nt, Haemophilus influenzae Rd
gaaccgauuuuaa

SEQ ID NO: 2725281 - RNA, 19 nt, Haemophilus influenzae Rd
gaaccuaucucauccacua

SEQ ID NO: 2725282 - RNA, 18 nt, Haemophilus influenzae Rd
gaaccugucgcaaugaag

SEQ ID NO: 2725283 - RNA, 23 nt, Haemophilus influenzae Rd
gaacgauagccguccauuucaau

SEQ ID NO: 2725284 - RNA, 23 nt, Haemophilus influenzae Rd
gaacgccgcaacuaauaaaccaa

SEQ ID NO: 2725285 - RNA, 16 nt, Haemophilus influenzae Rd
gaacggcgauuuugcg

SEQ ID NO: 2725286 - RNA, 13 nt, Haemophilus influenzae Rd
gaacgguagcagg

SEQ ID NO: 2725287 - RNA, 17 nt, Haemophilus influenzae Rd
gaacguaaauucaggca

SEQ ID NO: 2725288 - RNA, 15 nt, Haemophilus influenzae Rd
gaacguucacguaag

SEQ ID NO: 2725289 - RNA, 19 nt, Haemophilus influenzae Rd
gaacguuuuuuacuugcga

SEQ ID NO: 2725290 - RNA, 21 nt, Haemophilus influenzae Rd
gaacuaaaaggacuaagcuuu

SEQ ID NO: 2725291 - RNA, 12 nt, Haemophilus influenzae Rd
gaacuaaaauau

SEQ ID NO: 2725292 - RNA, 22 nt, Haemophilus influenzae Rd
gaacuaauaagcuuggcuuauu

SEQ ID NO: 2725293 - RNA, 22 nt, Haemophilus influenzae Rd
gaacuauuauuccaaauaucuu

SEQ ID NO: 2725294 - RNA, 16 nt, Haemophilus influenzae Rd
gaacucaauuccuuca

SEQ ID NO: 2725295 - RNA, 17 nt, Haemophilus influenzae Rd
gaacucaauuccuucau

SEQ ID NO: 2725296 - RNA, 21 nt, Haemophilus influenzae Rd
gaacucaauuccuucaucguc

SEQ ID NO: 2725297 - RNA, 19 nt, Haemophilus influenzae Rd
gaacugauucaguguaguu

SEQ ID NO: 2725298 - RNA, 15 nt, Haemophilus influenzae Rd
gaacugcuugcgcuu

SEQ ID NO: 2725299 - RNA, 15 nt, Haemophilus influenzae Rd
gaacugcuuucuucc

SEQ ID NO: 2725300 - RNA, 18 nt, Haemophilus influenzae Rd
gaacuuaugugcaccuuc

SEQ ID NO: 2725301 - RNA, 17 nt, Haemophilus influenzae Rd
gaacuugaauugaagag

SEQ ID NO: 2725302 - RNA, 18 nt, Haemophilus influenzae Rd
gaacuugaauugaagagu

SEQ ID NO: 2725303 - RNA, 18 nt, Haemophilus influenzae Rd
gaacuuuuaaaacacgcc

SEQ ID NO: 2725304 - RNA, 15 nt, Haemophilus influenzae Rd
gaacuuuuuuauaau

SEQ ID NO: 2725305 - RNA, 19 nt, Haemophilus influenzae Rd
gaagaaaaagacgaaaaug

SEQ ID NO: 2725306 - RNA, 17 nt, Haemophilus influenzae Rd
gaagaaaagcauuaaua

SEQ ID NO: 2725307 - RNA, 18 nt, Haemophilus influenzae Rd
gaagaaaauauccaagaa

SEQ ID NO: 2725308 - RNA, 23 nt, Haemophilus influenzae Rd
gaagaaacgagcauauuuuccau

SEQ ID NO: 2725309 - RNA, 14 nt, Haemophilus influenzae Rd
gaagaaauuaagaa

SEQ ID NO: 2725310 - RNA, 12 nt, Haemophilus influenzae Rd
gaagaagauaau

SEQ ID NO: 2725311 - RNA, 18 nt, Haemophilus influenzae Rd
gaagaaguaaaaagaaaa

SEQ ID NO: 2725312 - RNA, 23 nt, Haemophilus influenzae Rd
gaagaauuaguuuuuuauuucua

SEQ ID NO: 2725313 - RNA, 13 nt, Haemophilus influenzae Rd
gaagaugaaagug

SEQ ID NO: 2725314 - RNA, 14 nt, Haemophilus influenzae Rd
gaagauugaaauag

SEQ ID NO: 2725315 - RNA, 17 nt, Haemophilus influenzae Rd
gaagauuuauauuccau

SEQ ID NO: 2725316 - RNA, 13 nt, Haemophilus influenzae Rd
gaagcacugaaau

SEQ ID NO: 2725317 - RNA, 15 nt, Haemophilus influenzae Rd
gaagcacugaaauau

SEQ ID NO: 2725318 - RNA, 20 nt, Haemophilus influenzae Rd
gaagccaucuguaaaccuuu

SEQ ID NO: 2725319 - RNA, 14 nt, Haemophilus influenzae Rd
gaagccauuuuaug

SEQ ID NO: 2725320 - RNA, 16 nt, Haemophilus influenzae Rd
gaagccgaugaaagcu

SEQ ID NO: 2725321 - RNA, 14 nt, Haemophilus influenzae Rd
gaagcguucaaaaa

SEQ ID NO: 2725322 - RNA, 19 nt, Haemophilus influenzae Rd
gaagcucacuuuauauagu

SEQ ID NO: 2725323 - RNA, 21 nt, Haemophilus influenzae Rd
gaagcugcuuuuaauaugcug

SEQ ID NO: 2725324 - RNA, 21 nt, Haemophilus influenzae Rd
gaaggaacaagaccugcuucu

SEQ ID NO: 2725325 - RNA, 21 nt, Haemophilus influenzae Rd
gaaggcuaccugauaccacca

SEQ ID NO: 2725326 - RNA, 21 nt, Haemophilus influenzae Rd
gaaggcuuuucccuuuucuua

SEQ ID NO: 2725327 - RNA, 21 nt, Haemophilus influenzae Rd
gaagguuuaguggguaaacca

SEQ ID NO: 2725328 - RNA, 19 nt, Haemophilus influenzae Rd
gaaguaaaaagaaaagugc

SEQ ID NO: 2725329 - RNA, 17 nt, Haemophilus influenzae Rd
gaaguaauaaucuucuu

SEQ ID NO: 2725330 - RNA, 13 nt, Haemophilus influenzae Rd
gaaguacauucaa

SEQ ID NO: 2725331 - RNA, 18 nt, Haemophilus influenzae Rd
gaaguagcaacaccacca

SEQ ID NO: 2725332 - RNA, 19 nt, Haemophilus influenzae Rd
gaagucacauauuguuucu

SEQ ID NO: 2725333 - RNA, 15 nt, Haemophilus influenzae Rd
gaagugaaagauaaa

SEQ ID NO: 2725334 - RNA, 20 nt, Haemophilus influenzae Rd
gaagugcggaugaaauuuuu

SEQ ID NO: 2725335 - RNA, 23 nt, Haemophilus influenzae Rd
gaagugcggucauuuuucaccgc

SEQ ID NO: 2725336 - RNA, 21 nt, Haemophilus influenzae Rd
gaaguuaaaacuugaauggcu

SEQ ID NO: 2725337 - RNA, 16 nt, Haemophilus influenzae Rd
gaaguuaaaccugcca

SEQ ID NO: 2725338 - RNA, 20 nt, Haemophilus influenzae Rd
gaaguuaauggguuaaaagc

SEQ ID NO: 2725339 - RNA, 18 nt, Haemophilus influenzae Rd
gaaguuguaauaaagcug

SEQ ID NO: 2725340 - RNA, 18 nt, Haemophilus influenzae Rd
gaaguuuaagaaaagugc

SEQ ID NO: 2725341 - RNA, 12 nt, Haemophilus influenzae Rd
gaauaaaaaaaa

SEQ ID NO: 2725342 - RNA, 16 nt, Haemophilus influenzae Rd
gaauaaaaaaaagccc

SEQ ID NO: 2725343 - RNA, 19 nt, Haemophilus influenzae Rd
gaauaaaaaagccuugauu

SEQ ID NO: 2725344 - RNA, 21 nt, Haemophilus influenzae Rd
gaauaaaacggcucaaaucuu

SEQ ID NO: 2725345 - RNA, 17 nt, Haemophilus influenzae Rd
gaauaaaagauaacaaa

SEQ ID NO: 2725346 - RNA, 13 nt, Haemophilus influenzae Rd
gaauaaaauaaga

SEQ ID NO: 2725347 - RNA, 14 nt, Haemophilus influenzae Rd
gaauaaaauaagag

SEQ ID NO: 2725348 - RNA, 13 nt, Haemophilus influenzae Rd
gaauaaaauaauc

SEQ ID NO: 2725349 - RNA, 17 nt, Haemophilus influenzae Rd
gaauaaaccaaugagaa

SEQ ID NO: 2725350 - RNA, 21 nt, Haemophilus influenzae Rd
gaauaaacgccacucuuugaa

SEQ ID NO: 2725351 - RNA, 21 nt, Haemophilus influenzae Rd
gaauaaaugaccgcucuuuaa

SEQ ID NO: 2725352 - RNA, 21 nt, Haemophilus influenzae Rd
gaauaaaugcaucauuaauac

SEQ ID NO: 2725353 - RNA, 14 nt, Haemophilus influenzae Rd
gaauaaauuaaaaa

SEQ ID NO: 2725354 - RNA, 17 nt, Haemophilus influenzae Rd
gaauaaauugaauaucu

SEQ ID NO: 2725355 - RNA, 22 nt, Haemophilus influenzae Rd
gaauaaccacauauagugaaaa

SEQ ID NO: 2725356 - RNA, 20 nt, Haemophilus influenzae Rd
gaauaacccuuguaacguau

SEQ ID NO: 2725357 - RNA, 17 nt, Haemophilus influenzae Rd
gaauaagcgaaaaacau

SEQ ID NO: 2725358 - RNA, 23 nt, Haemophilus influenzae Rd
gaauaauaaugccugcauuaaua

SEQ ID NO: 2725359 - RNA, 17 nt, Haemophilus influenzae Rd
gaauaauauuaaagaaa

SEQ ID NO: 2725360 - RNA, 19 nt, Haemophilus influenzae Rd
gaauaaugugcaaaaauau

SEQ ID NO: 2725361 - RNA, 15 nt, Haemophilus influenzae Rd
gaauaauuaaaucuu

SEQ ID NO: 2725362 - RNA, 24 nt, Haemophilus influenzae Rd
gaauaauuuccaacacauuaucau

SEQ ID NO: 2725363 - RNA, 13 nt, Haemophilus influenzae Rd
gaauaauuuugga

SEQ ID NO: 2725364 - RNA, 14 nt, Haemophilus influenzae Rd
gaauaauuuuggau

SEQ ID NO: 2725365 - RNA, 16 nt, Haemophilus influenzae Rd
gaauaauuuuuauaau

SEQ ID NO: 2725366 - RNA, 15 nt, Haemophilus influenzae Rd
gaauacaagucacgu

SEQ ID NO: 2725367 - RNA, 15 nt, Haemophilus influenzae Rd
gaauacacgaugcuc

SEQ ID NO: 2725368 - RNA, 14 nt, Haemophilus influenzae Rd
gaauacacuuuaaa

SEQ ID NO: 2725369 - RNA, 22 nt, Haemophilus influenzae Rd
gaauacacuuuaaauuuuccug

SEQ ID NO: 2725370 - RNA, 22 nt, Haemophilus influenzae Rd
gaauacaucacgaacuucagcu

SEQ ID NO: 2725371 - RNA, 21 nt, Haemophilus influenzae Rd
gaauacauccauaacuaaaag

SEQ ID NO: 2725372 - RNA, 20 nt, Haemophilus influenzae Rd
gaauaccccaaguuucuaaa

SEQ ID NO: 2725373 - RNA, 13 nt, Haemophilus influenzae Rd
gaauaccugauuu

SEQ ID NO: 2725374 - RNA, 13 nt, Haemophilus influenzae Rd
gaauacgaucugc

SEQ ID NO: 2725375 - RNA, 20 nt, Haemophilus influenzae Rd
gaauacgaucugcaucuaau

SEQ ID NO: 2725376 - RNA, 16 nt, Haemophilus influenzae Rd
gaauacugagaucucu

SEQ ID NO: 2725377 - RNA, 18 nt, Haemophilus influenzae Rd
gaauacugagaucucuau

SEQ ID NO: 2725378 - RNA, 22 nt, Haemophilus influenzae Rd
gaauagccaaaacgaauagaaa

SEQ ID NO: 2725379 - RNA, 15 nt, Haemophilus influenzae Rd
gaauagcuauuuuuc

SEQ ID NO: 2725380 - RNA, 14 nt, Haemophilus influenzae Rd
gaauauaaauaaaa

SEQ ID NO: 2725381 - RNA, 23 nt, Haemophilus influenzae Rd
gaauauaagaaaucucuuucaau

SEQ ID NO: 2725382 - RNA, 22 nt, Haemophilus influenzae Rd
gaauauaauucagcaagaaacu

SEQ ID NO: 2725383 - RNA, 17 nt, Haemophilus influenzae Rd
gaauauaugguucauua

SEQ ID NO: 2725384 - RNA, 14 nt, Haemophilus influenzae Rd
gaauaucagaagaa

SEQ ID NO: 2725385 - RNA, 17 nt, Haemophilus influenzae Rd
gaauaucaucuagauuu

SEQ ID NO: 2725386 - RNA, 16 nt, Haemophilus influenzae Rd
gaauaucgacuaauau

SEQ ID NO: 2725387 - RNA, 22 nt, Haemophilus influenzae Rd
gaauaucuaaaugacgugcuaa

SEQ ID NO: 2725388 - RNA, 18 nt, Haemophilus influenzae Rd
gaauaucuggauguugua

SEQ ID NO: 2725389 - RNA, 20 nt, Haemophilus influenzae Rd
gaauaucuggauguuguaaa

SEQ ID NO: 2725390 - RNA, 15 nt, Haemophilus influenzae Rd
gaauaucuuccacaa

SEQ ID NO: 2725391 - RNA, 21 nt, Haemophilus influenzae Rd
gaauauuaucuccaagaauau

SEQ ID NO: 2725392 - RNA, 15 nt, Haemophilus influenzae Rd
gaauauuccauuaac

SEQ ID NO: 2725393 - RNA, 23 nt, Haemophilus influenzae Rd
gaauauuccauuaacuaaaccau

SEQ ID NO: 2725394 - RNA, 20 nt, Haemophilus influenzae Rd
gaauauucuuuuuaaauauu

SEQ ID NO: 2725395 - RNA, 15 nt, Haemophilus influenzae Rd
gaauauugaucaucu

SEQ ID NO: 2725396 - RNA, 19 nt, Haemophilus influenzae Rd
gaauauugaucaucucgac

SEQ ID NO: 2725397 - RNA, 22 nt, Haemophilus influenzae Rd
gaauauugguagcuaaaaauaa

SEQ ID NO: 2725398 - RNA, 14 nt, Haemophilus influenzae Rd
gaauauuuugcaug

SEQ ID NO: 2725399 - RNA, 20 nt, Haemophilus influenzae Rd
gaauauuuuuuugcuuuucc

SEQ ID NO: 2725400 - RNA, 18 nt, Haemophilus influenzae Rd
gaaucacaacuugaccau

SEQ ID NO: 2725401 - RNA, 13 nt, Haemophilus influenzae Rd
gaaucaucuucau

SEQ ID NO: 2725402 - RNA, 14 nt, Haemophilus influenzae Rd
gaaucccauauuua

SEQ ID NO: 2725403 - RNA, 14 nt, Haemophilus influenzae Rd
gaauccgaaauuaa

SEQ ID NO: 2725404 - RNA, 22 nt, Haemophilus influenzae Rd
gaaucgaacacuguaaauaaac

SEQ ID NO: 2725405 - RNA, 22 nt, Haemophilus influenzae Rd
gaaucgcccacgaaaagcacuu

SEQ ID NO: 2725406 - RNA, 14 nt, Haemophilus influenzae Rd
gaaucuaaaacuau

SEQ ID NO: 2725407 - RNA, 17 nt, Haemophilus influenzae Rd
gaaucucacguacuuuu

SEQ ID NO: 2725408 - RNA, 20 nt, Haemophilus influenzae Rd
gaaucuuagucaaugccuaa

SEQ ID NO: 2725409 - RNA, 12 nt, Haemophilus influenzae Rd
gaaucuuuaucu

SEQ ID NO: 2725410 - RNA, 20 nt, Haemophilus influenzae Rd
gaaugaaaguuuucguaaau

SEQ ID NO: 2725411 - RNA, 17 nt, Haemophilus influenzae Rd
gaaugaaauucagugau

SEQ ID NO: 2725412 - RNA, 16 nt, Haemophilus influenzae Rd
gaaugaagaaauggcg

SEQ ID NO: 2725413 - RNA, 19 nt, Haemophilus influenzae Rd
gaaugaaguuagaaacaga

SEQ ID NO: 2725414 - RNA, 22 nt, Haemophilus influenzae Rd
gaaugaaguuagaaacagaagu

SEQ ID NO: 2725415 - RNA, 14 nt, Haemophilus influenzae Rd
gaaugacuuucacu

SEQ ID NO: 2725416 - RNA, 14 nt, Haemophilus influenzae Rd
gaaugaucugcacc

SEQ ID NO: 2725417 - RNA, 17 nt, Haemophilus influenzae Rd
gaaugcauauuaaugcg

SEQ ID NO: 2725418 - RNA, 23 nt, Haemophilus influenzae Rd
gaaugcaucacugcccaaccaaa

SEQ ID NO: 2725419 - RNA, 21 nt, Haemophilus influenzae Rd
gaaugcuuuuauaagugaaau

SEQ ID NO: 2725420 - RNA, 16 nt, Haemophilus influenzae Rd
gaauggauuauaaaua

SEQ ID NO: 2725421 - RNA, 19 nt, Haemophilus influenzae Rd
gaauggcacgcgcuguauu

SEQ ID NO: 2725422 - RNA, 17 nt, Haemophilus influenzae Rd
gaauggcgaauuucacg

SEQ ID NO: 2725423 - RNA, 17 nt, Haemophilus influenzae Rd
gaauggcuaaagaaaua

SEQ ID NO: 2725424 - RNA, 20 nt, Haemophilus influenzae Rd
gaauggguuaguaaguggua

SEQ ID NO: 2725425 - RNA, 15 nt, Haemophilus influenzae Rd
gaaugguaacauuca

SEQ ID NO: 2725426 - RNA, 23 nt, Haemophilus influenzae Rd
gaaugguauugcguaaaucgaca

SEQ ID NO: 2725427 - RNA, 22 nt, Haemophilus influenzae Rd
gaauguaaaaaauaauuuucau

SEQ ID NO: 2725428 - RNA, 15 nt, Haemophilus influenzae Rd
gaauguaaaaauaac

SEQ ID NO: 2725429 - RNA, 17 nt, Haemophilus influenzae Rd
gaauguagauaaugaua

SEQ ID NO: 2725430 - RNA, 15 nt, Haemophilus influenzae Rd
gaaugucuuaaagau

SEQ ID NO: 2725431 - RNA, 18 nt, Haemophilus influenzae Rd
gaaugucuuaaagauaaa

SEQ ID NO: 2725432 - RNA, 19 nt, Haemophilus influenzae Rd
gaauguugcguaccauauu

SEQ ID NO: 2725433 - RNA, 22 nt, Haemophilus influenzae Rd
gaauguuuucgaucauuugacg

SEQ ID NO: 2725434 - RNA, 13 nt, Haemophilus influenzae Rd
gaauguuuugauu

SEQ ID NO: 2725435 - RNA, 17 nt, Haemophilus influenzae Rd
gaauguuuugauugaga

SEQ ID NO: 2725436 - RNA, 21 nt, Haemophilus influenzae Rd
gaauguuuugauugagauuua

SEQ ID NO: 2725437 - RNA, 13 nt, Haemophilus influenzae Rd
gaauguuuuucau

SEQ ID NO: 2725438 - RNA, 13 nt, Haemophilus influenzae Rd
gaauuaaaacuug

SEQ ID NO: 2725439 - RNA, 16 nt, Haemophilus influenzae Rd
gaauuaaaaguagaag

SEQ ID NO: 2725440 - RNA, 18 nt, Haemophilus influenzae Rd
gaauuaaaauaugauucu

SEQ ID NO: 2725441 - RNA, 14 nt, Haemophilus influenzae Rd
gaauuaaagugcag

SEQ ID NO: 2725442 - RNA, 19 nt, Haemophilus influenzae Rd
gaauuaaagugcagauuuu

SEQ ID NO: 2725443 - RNA, 13 nt, Haemophilus influenzae Rd
gaauuaauaacgc

SEQ ID NO: 2725444 - RNA, 19 nt, Haemophilus influenzae Rd
gaauuagauucggcuaaaa

SEQ ID NO: 2725445 - RNA, 15 nt, Haemophilus influenzae Rd
gaauuaguauaaaca

SEQ ID NO: 2725446 - RNA, 15 nt, Haemophilus influenzae Rd
gaauuaucugaugua

SEQ ID NO: 2725447 - RNA, 22 nt, Haemophilus influenzae Rd
gaauucccaaacgguauuucaa

SEQ ID NO: 2725448 - RNA, 13 nt, Haemophilus influenzae Rd
gaauugaagaguu

SEQ ID NO: 2725449 - RNA, 15 nt, Haemophilus influenzae Rd
gaauugcaaugcaga

SEQ ID NO: 2725450 - RNA, 22 nt, Haemophilus influenzae Rd
gaauugcuccuccuaaugcagc

SEQ ID NO: 2725451 - RNA, 20 nt, Haemophilus influenzae Rd
gaauuggacggcaaaaauau

SEQ ID NO: 2725452 - RNA, 21 nt, Haemophilus influenzae Rd
gaauuggcgcaggcaaaccaa

SEQ ID NO: 2725453 - RNA, 14 nt, Haemophilus influenzae Rd
gaauugguucuaaa

SEQ ID NO: 2725454 - RNA, 18 nt, Haemophilus influenzae Rd
gaauugguucuaaauauu

SEQ ID NO: 2725455 - RNA, 15 nt, Haemophilus influenzae Rd
gaauuguaccuucug

SEQ ID NO: 2725456 - RNA, 17 nt, Haemophilus influenzae Rd
gaauuguguaagacuuu

SEQ ID NO: 2725457 - RNA, 22 nt, Haemophilus influenzae Rd
gaauuuaagucgucgagacuuu

SEQ ID NO: 2725458 - RNA, 14 nt, Haemophilus influenzae Rd
gaauuuaucaucaa

SEQ ID NO: 2725459 - RNA, 14 nt, Haemophilus influenzae Rd
gaauuuaugguuau

SEQ ID NO: 2725460 - RNA, 21 nt, Haemophilus influenzae Rd
gaauuugccugcccauaagug

SEQ ID NO: 2725461 - RNA, 20 nt, Haemophilus influenzae Rd
gaauuuguaagauuuugccu

SEQ ID NO: 2725462 - RNA, 23 nt, Haemophilus influenzae Rd
gaauuuuaaucgcacuuaaaaga

SEQ ID NO: 2725463 - RNA, 15 nt, Haemophilus influenzae Rd
gaauuuuacuucuuc

SEQ ID NO: 2725464 - RNA, 16 nt, Haemophilus influenzae Rd
gaauuuuacuucuuca

SEQ ID NO: 2725465 - RNA, 17 nt, Haemophilus influenzae Rd
gaauuuuacuucuucag

SEQ ID NO: 2725466 - RNA, 15 nt, Haemophilus influenzae Rd
gaauuuucaaugguu

SEQ ID NO: 2725467 - RNA, 16 nt, Haemophilus influenzae Rd
gaauuuucacauuagu

SEQ ID NO: 2725468 - RNA, 19 nt, Haemophilus influenzae Rd
gaauuuucaccguuuuucc

SEQ ID NO: 2725469 - RNA, 23 nt, Haemophilus influenzae Rd
gaauuuucaccguuuuuccuuug

SEQ ID NO: 2725470 - RNA, 18 nt, Haemophilus influenzae Rd
gaauuuucccauuuaacc

SEQ ID NO: 2725471 - RNA, 16 nt, Haemophilus influenzae Rd
gaauuuugcaagccaa

SEQ ID NO: 2725472 - RNA, 19 nt, Haemophilus influenzae Rd
gaauuuugcaagccaauag

SEQ ID NO: 2725473 - RNA, 16 nt, Haemophilus influenzae Rd
gaauuuuugugauuuc

SEQ ID NO: 2725474 - RNA, 19 nt, Haemophilus influenzae Rd
gaauuuuugugauuucaau

SEQ ID NO: 2725475 - RNA, 13 nt, Haemophilus influenzae Rd
gaauuuuuuucaa

SEQ ID NO: 2725476 - RNA, 20 nt, Haemophilus influenzae Rd
gacaaaagagcgguuaaaaa

SEQ ID NO: 2725477 - RNA, 19 nt, Haemophilus influenzae Rd
gacaaacaacguaaaagua

SEQ ID NO: 2725478 - RNA, 19 nt, Haemophilus influenzae Rd
gacaaagggucguuaagaa

SEQ ID NO: 2725479 - RNA, 23 nt, Haemophilus influenzae Rd
gacaaagucgguuuuuaauucag

SEQ ID NO: 2725480 - RNA, 16 nt, Haemophilus influenzae Rd
gacaacaacuuuucua

SEQ ID NO: 2725481 - RNA, 21 nt, Haemophilus influenzae Rd
gacaacacuugcuguuuuucc

SEQ ID NO: 2725482 - RNA, 16 nt, Haemophilus influenzae Rd
gacaacgcucacuuaa

SEQ ID NO: 2725483 - RNA, 19 nt, Haemophilus influenzae Rd
gacaacggggcguauuuua

SEQ ID NO: 2725484 - RNA, 14 nt, Haemophilus influenzae Rd
gacaagaaauaaua

SEQ ID NO: 2725485 - RNA, 18 nt, Haemophilus influenzae Rd
gacaagauaagagcuuac

SEQ ID NO: 2725486 - RNA, 14 nt, Haemophilus influenzae Rd
gacaauauugaaau

SEQ ID NO: 2725487 - RNA, 17 nt, Haemophilus influenzae Rd
gacaauauuuacucuuu

SEQ ID NO: 2725488 - RNA, 23 nt, Haemophilus influenzae Rd
gacaaucacuggcauaucagcau

SEQ ID NO: 2725489 - RNA, 18 nt, Haemophilus influenzae Rd
gacaaugcguaauucucc

SEQ ID NO: 2725490 - RNA, 11 nt, Haemophilus influenzae Rd
gacaauuaaua

SEQ ID NO: 2725491 - RNA, 18 nt, Haemophilus influenzae Rd
gacacaagggauuuaaaa

SEQ ID NO: 2725492 - RNA, 20 nt, Haemophilus influenzae Rd
gacacaagggauuuaaaauc

SEQ ID NO: 2725493 - RNA, 13 nt, Haemophilus influenzae Rd
gacacccaaauua

SEQ ID NO: 2725494 - RNA, 15 nt, Haemophilus influenzae Rd
gacaccuuuaaaaau

SEQ ID NO: 2725495 - RNA, 15 nt, Haemophilus influenzae Rd
gacaccuuuuuccuu

SEQ ID NO: 2725496 - RNA, 21 nt, Haemophilus influenzae Rd
gacacgcucaggaaaacguuc

SEQ ID NO: 2725497 - RNA, 17 nt, Haemophilus influenzae Rd
gacagaaacaaauccug

SEQ ID NO: 2725498 - RNA, 12 nt, Haemophilus influenzae Rd
gacagacuauuu

SEQ ID NO: 2725499 - RNA, 17 nt, Haemophilus influenzae Rd
gacagacuauuucugua

SEQ ID NO: 2725500 - RNA, 21 nt, Haemophilus influenzae Rd
gacagaggggauaaaauaaac

SEQ ID NO: 2725501 - RNA, 18 nt, Haemophilus influenzae Rd
gacaguuuaucucuuucu

SEQ ID NO: 2725502 - RNA, 12 nt, Haemophilus influenzae Rd
gacaguuucgcc

SEQ ID NO: 2725503 - RNA, 23 nt, Haemophilus influenzae Rd
gacaguuucgccugcuaauggcu

SEQ ID NO: 2725504 - RNA, 21 nt, Haemophilus influenzae Rd
gacaguuuguaauccugcauu

SEQ ID NO: 2725505 - RNA, 17 nt, Haemophilus influenzae Rd
gacauaacgagaacgag

SEQ ID NO: 2725506 - RNA, 16 nt, Haemophilus influenzae Rd
gacauagaaaguuuaa

SEQ ID NO: 2725507 - RNA, 17 nt, Haemophilus influenzae Rd
gacauauccucaacauc

SEQ ID NO: 2725508 - RNA, 21 nt, Haemophilus influenzae Rd
gacaucaaucaaauucaacac

SEQ ID NO: 2725509 - RNA, 20 nt, Haemophilus influenzae Rd
gacaucuuaaauuauagaua

SEQ ID NO: 2725510 - RNA, 20 nt, Haemophilus influenzae Rd
gacauuaaagcaauugcuaa

SEQ ID NO: 2725511 - RNA, 15 nt, Haemophilus influenzae Rd
gacauuaagugcauc

SEQ ID NO: 2725512 - RNA, 18 nt, Haemophilus influenzae Rd
gacauuauuuuuacaaau

SEQ ID NO: 2725513 - RNA, 23 nt, Haemophilus influenzae Rd
gacauucaucuuagcuuuuuucu

SEQ ID NO: 2725514 - RNA, 21 nt, Haemophilus influenzae Rd
gacauucgcacccgcuuguuu

SEQ ID NO: 2725515 - RNA, 16 nt, Haemophilus influenzae Rd
gaccaacggauuaaaa

SEQ ID NO: 2725516 - RNA, 18 nt, Haemophilus influenzae Rd
gaccaauauugaaaagua

SEQ ID NO: 2725517 - RNA, 12 nt, Haemophilus influenzae Rd
gaccaaugaaua

SEQ ID NO: 2725518 - RNA, 17 nt, Haemophilus influenzae Rd
gaccauuacagcaagca

SEQ ID NO: 2725519 - RNA, 21 nt, Haemophilus influenzae Rd
gacccaauuagaugauuuuaa

SEQ ID NO: 2725520 - RNA, 23 nt, Haemophilus influenzae Rd
gacccaauuagaugauuuuaaaa

SEQ ID NO: 2725521 - RNA, 18 nt, Haemophilus influenzae Rd
gaccgcacuuuaaaagug

SEQ ID NO: 2725522 - RNA, 22 nt, Haemophilus influenzae Rd
gaccgcacuuuuuauauuuuuu

SEQ ID NO: 2725523 - RNA, 19 nt, Haemophilus influenzae Rd
gaccgcccucuugcacaau

SEQ ID NO: 2725524 - RNA, 22 nt, Haemophilus influenzae Rd
gaccguguuuuucaucaaugca

SEQ ID NO: 2725525 - RNA, 19 nt, Haemophilus influenzae Rd
gaccguuuaacgcagccgc

SEQ ID NO: 2725526 - RNA, 14 nt, Haemophilus influenzae Rd
gaccuaaucccaua

SEQ ID NO: 2725527 - RNA, 16 nt, Haemophilus influenzae Rd
gaccugaagaugauau

SEQ ID NO: 2725528 - RNA, 21 nt, Haemophilus influenzae Rd
gaccugcagccauaauauuua

SEQ ID NO: 2725529 - RNA, 11 nt, Haemophilus influenzae Rd
gacgaaaaauu

SEQ ID NO: 2725530 - RNA, 18 nt, Haemophilus influenzae Rd
gacgagcuuuccaaacaa

SEQ ID NO: 2725531 - RNA, 14 nt, Haemophilus influenzae Rd
gacgauaaccaucu

SEQ ID NO: 2725532 - RNA, 16 nt, Haemophilus influenzae Rd
gacgcaccuuuugaaa

SEQ ID NO: 2725533 - RNA, 21 nt, Haemophilus influenzae Rd
gacgcugcccaaauaaccacu

SEQ ID NO: 2725534 - RNA, 18 nt, Haemophilus influenzae Rd
gacgcuugggcuuuuuca

SEQ ID NO: 2725535 - RNA, 13 nt, Haemophilus influenzae Rd
gacggauuacaau

SEQ ID NO: 2725536 - RNA, 23 nt, Haemophilus influenzae Rd
gacggugcauuugcauaaagcau

SEQ ID NO: 2725537 - RNA, 16 nt, Haemophilus influenzae Rd
gacgguucaguuucaa

SEQ ID NO: 2725538 - RNA, 17 nt, Haemophilus influenzae Rd
gacguaaaaguuuuccg

SEQ ID NO: 2725539 - RNA, 21 nt, Haemophilus influenzae Rd
gacguaauuuacguaaugcuu

SEQ ID NO: 2725540 - RNA, 15 nt, Haemophilus influenzae Rd
gacguaauuugugcg

SEQ ID NO: 2725541 - RNA, 15 nt, Haemophilus influenzae Rd
gacgugcuaauucug

SEQ ID NO: 2725542 - RNA, 23 nt, Haemophilus influenzae Rd
gacguguaaaucuaaaauaaucg

SEQ ID NO: 2725543 - RNA, 16 nt, Haemophilus influenzae Rd
gacguucacguuuuuc

SEQ ID NO: 2725544 - RNA, 17 nt, Haemophilus influenzae Rd
gacguuugauuguaaaa

SEQ ID NO: 2725545 - RNA, 13 nt, Haemophilus influenzae Rd
gacuaaaaccaca

SEQ ID NO: 2725546 - RNA, 14 nt, Haemophilus influenzae Rd
gacuaaacaaauaa

SEQ ID NO: 2725547 - RNA, 22 nt, Haemophilus influenzae Rd
gacuaaacaaauaaaaaguggg

SEQ ID NO: 2725548 - RNA, 17 nt, Haemophilus influenzae Rd
gacuaaaucaaaaauaa

SEQ ID NO: 2725549 - RNA, 22 nt, Haemophilus influenzae Rd
gacuaauuuuuuaauuuuuucu

SEQ ID NO: 2725550 - RNA, 14 nt, Haemophilus influenzae Rd
gacuacauaaccca

SEQ ID NO: 2725551 - RNA, 16 nt, Haemophilus influenzae Rd
gacuagauauaaaaac

SEQ ID NO: 2725552 - RNA, 17 nt, Haemophilus influenzae Rd
gacuauuacaagauaau

SEQ ID NO: 2725553 - RNA, 18 nt, Haemophilus influenzae Rd
gacuauuuagaaauucug

SEQ ID NO: 2725554 - RNA, 15 nt, Haemophilus influenzae Rd
gacucaacgccacuc

SEQ ID NO: 2725555 - RNA, 22 nt, Haemophilus influenzae Rd
gacucagguguuacuuccacua

SEQ ID NO: 2725556 - RNA, 20 nt, Haemophilus influenzae Rd
gacucuguuccacagguuuc

SEQ ID NO: 2725557 - RNA, 18 nt, Haemophilus influenzae Rd
gacuuaaccaaauaggca

SEQ ID NO: 2725558 - RNA, 15 nt, Haemophilus influenzae Rd
gacuuauaaauuuaa

SEQ ID NO: 2725559 - RNA, 16 nt, Haemophilus influenzae Rd
gacuuauaaauuuaaa

SEQ ID NO: 2725560 - RNA, 16 nt, Haemophilus influenzae Rd
gacuucgcuaauuuuu

SEQ ID NO: 2725561 - RNA, 23 nt, Haemophilus influenzae Rd
gacuucuguaugacuauuuagaa

SEQ ID NO: 2725562 - RNA, 17 nt, Haemophilus influenzae Rd
gacuugguggauugugc

SEQ ID NO: 2725563 - RNA, 15 nt, Haemophilus influenzae Rd
gacuuguuuuaaaac

SEQ ID NO: 2725564 - RNA, 16 nt, Haemophilus influenzae Rd
gacuuuauauugacaa

SEQ ID NO: 2725565 - RNA, 23 nt, Haemophilus influenzae Rd
gacuuuaucgaggacaaucugcu

SEQ ID NO: 2725566 - RNA, 20 nt, Haemophilus influenzae Rd
gacuuuauuugauuguugcu

SEQ ID NO: 2725567 - RNA, 19 nt, Haemophilus influenzae Rd
gacuuucaagcaagccaca

SEQ ID NO: 2725568 - RNA, 13 nt, Haemophilus influenzae Rd
gagaaaaauccug

SEQ ID NO: 2725569 - RNA, 16 nt, Haemophilus influenzae Rd
gagaaaauucuccgca

SEQ ID NO: 2725570 - RNA, 23 nt, Haemophilus influenzae Rd
gagaaagaauauaaauaaaacaa

SEQ ID NO: 2725571 - RNA, 16 nt, Haemophilus influenzae Rd
gagaaaguaauggaag

SEQ ID NO: 2725572 - RNA, 21 nt, Haemophilus influenzae Rd
gagaacgagccucaucuaagg

SEQ ID NO: 2725573 - RNA, 12 nt, Haemophilus influenzae Rd
gagaacugaaag

SEQ ID NO: 2725574 - RNA, 19 nt, Haemophilus influenzae Rd
gagaacuuuuaaaacacgc

SEQ ID NO: 2725575 - RNA, 16 nt, Haemophilus influenzae Rd
gagaagcugaauaaaa

SEQ ID NO: 2725576 - RNA, 14 nt, Haemophilus influenzae Rd
gagaauauuuccac

SEQ ID NO: 2725577 - RNA, 17 nt, Haemophilus influenzae Rd
gagaaucuuuaucuucu

SEQ ID NO: 2725578 - RNA, 13 nt, Haemophilus influenzae Rd
gagagaagaaacg

SEQ ID NO: 2725579 - RNA, 13 nt, Haemophilus influenzae Rd
gagauaaaauuuu

SEQ ID NO: 2725580 - RNA, 16 nt, Haemophilus influenzae Rd
gagauaaauuuuuagc

SEQ ID NO: 2725581 - RNA, 16 nt, Haemophilus influenzae Rd
gagauaagcauuuuau

SEQ ID NO: 2725582 - RNA, 18 nt, Haemophilus influenzae Rd
gagauaauaaauauaauu

SEQ ID NO: 2725583 - RNA, 18 nt, Haemophilus influenzae Rd
gagauauaauacguaaau

SEQ ID NO: 2725584 - RNA, 22 nt, Haemophilus influenzae Rd
gagauauaauacguaaauucaa

SEQ ID NO: 2725585 - RNA, 18 nt, Haemophilus influenzae Rd
gagaucgaaauuagguac

SEQ ID NO: 2725586 - RNA, 13 nt, Haemophilus influenzae Rd
gagauuauuucua

SEQ ID NO: 2725587 - RNA, 14 nt, Haemophilus influenzae Rd
gagauuauuucuac

SEQ ID NO: 2725588 - RNA, 15 nt, Haemophilus influenzae Rd
gagauuguaugaaaa

SEQ ID NO: 2725589 - RNA, 18 nt, Haemophilus influenzae Rd
gagauuguaugaaaaaug

SEQ ID NO: 2725590 - RNA, 20 nt, Haemophilus influenzae Rd
gagauuuagcggcuuuuugc

SEQ ID NO: 2725591 - RNA, 21 nt, Haemophilus influenzae Rd
gagauuuauuuugguauuuuu

SEQ ID NO: 2725592 - RNA, 12 nt, Haemophilus influenzae Rd
gagcaaaucaaa

SEQ ID NO: 2725593 - RNA, 20 nt, Haemophilus influenzae Rd
gagcaauauaaucuuuuaca

SEQ ID NO: 2725594 - RNA, 16 nt, Haemophilus influenzae Rd
gagcacaguauuuaua

SEQ ID NO: 2725595 - RNA, 13 nt, Haemophilus influenzae Rd
gagcaccaaauua

SEQ ID NO: 2725596 - RNA, 18 nt, Haemophilus influenzae Rd
gagcaggcugaaggcgcu

SEQ ID NO: 2725597 - RNA, 21 nt, Haemophilus influenzae Rd
gagcaggggauugaaaauccc

SEQ ID NO: 2725598 - RNA, 17 nt, Haemophilus influenzae Rd
gagcauaaacuaaaaua

SEQ ID NO: 2725599 - RNA, 17 nt, Haemophilus influenzae Rd
gagcauaacguauuuuc

SEQ ID NO: 2725600 - RNA, 18 nt, Haemophilus influenzae Rd
gagcauaacguauuuucu

SEQ ID NO: 2725601 - RNA, 19 nt, Haemophilus influenzae Rd
gagcauaaggaccaagcaa

SEQ ID NO: 2725602 - RNA, 14 nt, Haemophilus influenzae Rd
gagcauauuuucca

SEQ ID NO: 2725603 - RNA, 22 nt, Haemophilus influenzae Rd
gagcauauuuuccaucaccuuc

SEQ ID NO: 2725604 - RNA, 17 nt, Haemophilus influenzae Rd
gagcaucgguauuaaug

SEQ ID NO: 2725605 - RNA, 21 nt, Haemophilus influenzae Rd
gagcaucgguauuaaugacac

SEQ ID NO: 2725606 - RNA, 21 nt, Haemophilus influenzae Rd
gagcaucuacccaauaaacau

SEQ ID NO: 2725607 - RNA, 16 nt, Haemophilus influenzae Rd
gagcauuuuuuauuaa

SEQ ID NO: 2725608 - RNA, 20 nt, Haemophilus influenzae Rd
gagcauuuuuuauuaaaaaa

SEQ ID NO: 2725609 - RNA, 17 nt, Haemophilus influenzae Rd
gagccaaauuuaaaaaa

SEQ ID NO: 2725610 - RNA, 13 nt, Haemophilus influenzae Rd
gagccaagaauga

SEQ ID NO: 2725611 - RNA, 22 nt, Haemophilus influenzae Rd
gagccuugggaauaugaaaaag

SEQ ID NO: 2725612 - RNA, 13 nt, Haemophilus influenzae Rd
gagccuuuuucua

SEQ ID NO: 2725613 - RNA, 15 nt, Haemophilus influenzae Rd
gagcgagaccacuuu

SEQ ID NO: 2725614 - RNA, 15 nt, Haemophilus influenzae Rd
gagcgagguaagcug

SEQ ID NO: 2725615 - RNA, 17 nt, Haemophilus influenzae Rd
gagcgaucugcacgaua

SEQ ID NO: 2725616 - RNA, 15 nt, Haemophilus influenzae Rd
gagcggucaauuuuu

SEQ ID NO: 2725617 - RNA, 22 nt, Haemophilus influenzae Rd
gagcuaacuaauucggaagaau

SEQ ID NO: 2725618 - RNA, 21 nt, Haemophilus influenzae Rd
gagcucaauuauuuauacuaa

SEQ ID NO: 2725619 - RNA, 15 nt, Haemophilus influenzae Rd
gagcugggcaaacaa

SEQ ID NO: 2725620 - RNA, 19 nt, Haemophilus influenzae Rd
gagcuuagauaagaaaauc

SEQ ID NO: 2725621 - RNA, 21 nt, Haemophilus influenzae Rd
gaggaaguuaauggguuaaaa

SEQ ID NO: 2725622 - RNA, 15 nt, Haemophilus influenzae Rd
gaggaauauacgcca

SEQ ID NO: 2725623 - RNA, 15 nt, Haemophilus influenzae Rd
gaggauuagaaauga

SEQ ID NO: 2725624 - RNA, 22 nt, Haemophilus influenzae Rd
gaggauuugccucuucuuuugc

SEQ ID NO: 2725625 - RNA, 21 nt, Haemophilus influenzae Rd
gaggauuuuugccguuuucua

SEQ ID NO: 2725626 - RNA, 21 nt, Haemophilus influenzae Rd
gaggccucuacggcaauugga

SEQ ID NO: 2725627 - RNA, 18 nt, Haemophilus influenzae Rd
gaggcuaauaauaaaaag

SEQ ID NO: 2725628 - RNA, 14 nt, Haemophilus influenzae Rd
gaggcuaugauuuu

SEQ ID NO: 2725629 - RNA, 21 nt, Haemophilus influenzae Rd
gaggcugauagucgaaaucau

SEQ ID NO: 2725630 - RNA, 21 nt, Haemophilus influenzae Rd
gagggaucgcauuaucaaaug

SEQ ID NO: 2725631 - RNA, 17 nt, Haemophilus influenzae Rd
gagggucaaaagaaaga

SEQ ID NO: 2725632 - RNA, 13 nt, Haemophilus influenzae Rd
gagguagaaaauc

SEQ ID NO: 2725633 - RNA, 13 nt, Haemophilus influenzae Rd
gagguguuuaugc

SEQ ID NO: 2725634 - RNA, 19 nt, Haemophilus influenzae Rd
gagguuccccuaaaaaaua

SEQ ID NO: 2725635 - RNA, 20 nt, Haemophilus influenzae Rd
gagguuccccuaaaaaauaa

SEQ ID NO: 2725636 - RNA, 17 nt, Haemophilus influenzae Rd
gagguucgaauccucuc

SEQ ID NO: 2725637 - RNA, 11 nt, Haemophilus influenzae Rd
gaguaaaauac

SEQ ID NO: 2725638 - RNA, 16 nt, Haemophilus influenzae Rd
gaguaaucuaauucuu

SEQ ID NO: 2725639 - RNA, 19 nt, Haemophilus influenzae Rd
gaguaaucuaauucuugcc

SEQ ID NO: 2725640 - RNA, 18 nt, Haemophilus influenzae Rd
gaguauaaauuugugugg

SEQ ID NO: 2725641 - RNA, 14 nt, Haemophilus influenzae Rd
gaguaucaaaacuu

SEQ ID NO: 2725642 - RNA, 15 nt, Haemophilus influenzae Rd
gaguaucaaaacuug

SEQ ID NO: 2725643 - RNA, 14 nt, Haemophilus influenzae Rd
gagucaauuugacc

SEQ ID NO: 2725644 - RNA, 14 nt, Haemophilus influenzae Rd
gagucgaugccaag

SEQ ID NO: 2725645 - RNA, 15 nt, Haemophilus influenzae Rd
gagucgcacccgccu

SEQ ID NO: 2725646 - RNA, 21 nt, Haemophilus influenzae Rd
gagucgcacccgccuuaauca

SEQ ID NO: 2725647 - RNA, 13 nt, Haemophilus influenzae Rd
gagugagcauuuc

SEQ ID NO: 2725648 - RNA, 21 nt, Haemophilus influenzae Rd
gagugcgaucaccauaaucaa

SEQ ID NO: 2725649 - RNA, 16 nt, Haemophilus influenzae Rd
gagugcuguacacaca

SEQ ID NO: 2725650 - RNA, 20 nt, Haemophilus influenzae Rd
gaguuaggcauugacuaaga

SEQ ID NO: 2725651 - RNA, 15 nt, Haemophilus influenzae Rd
gaguuauuucuuuaa

SEQ ID NO: 2725652 - RNA, 14 nt, Haemophilus influenzae Rd
gaguucaacgacaa

SEQ ID NO: 2725653 - RNA, 21 nt, Haemophilus influenzae Rd
gaguucucguugcaucuucua

SEQ ID NO: 2725654 - RNA, 17 nt, Haemophilus influenzae Rd
gaguugauuuuaaaaua

SEQ ID NO: 2725655 - RNA, 18 nt, Haemophilus influenzae Rd
gaguuggcucauugugau

SEQ ID NO: 2725656 - RNA, 22 nt, Haemophilus influenzae Rd
gaguugucccgcauauaaaaua

SEQ ID NO: 2725657 - RNA, 16 nt, Haemophilus influenzae Rd
gaguuguuuaaaauua

SEQ ID NO: 2725658 - RNA, 12 nt, Haemophilus influenzae Rd
gaguuuagucuu

SEQ ID NO: 2725659 - RNA, 14 nt, Haemophilus influenzae Rd
gaguuugaauaauu

SEQ ID NO: 2725660 - RNA, 17 nt, Haemophilus influenzae Rd
gaguuugauccacacuu

SEQ ID NO: 2725661 - RNA, 14 nt, Haemophilus influenzae Rd
gauaaaaaagaaau

SEQ ID NO: 2725662 - RNA, 18 nt, Haemophilus influenzae Rd
gauaaaaaaucugcaacu

SEQ ID NO: 2725663 - RNA, 14 nt, Haemophilus influenzae Rd
gauaaaaagugcgg

SEQ ID NO: 2725664 - RNA, 13 nt, Haemophilus influenzae Rd
gauaaaaauaaaa

SEQ ID NO: 2725665 - RNA, 22 nt, Haemophilus influenzae Rd
gauaaaaauaaaaaaacccagu

SEQ ID NO: 2725666 - RNA, 13 nt, Haemophilus influenzae Rd
gauaaaaaucauc

SEQ ID NO: 2725667 - RNA, 22 nt, Haemophilus influenzae Rd
gauaaaacagagaaaaaaauag

SEQ ID NO: 2725668 - RNA, 13 nt, Haemophilus influenzae Rd
gauaaaagugcgg

SEQ ID NO: 2725669 - RNA, 14 nt, Haemophilus influenzae Rd
gauaaaauaaacau

SEQ ID NO: 2725670 - RNA, 21 nt, Haemophilus influenzae Rd
gauaaacacugcgcagauuaa

SEQ ID NO: 2725671 - RNA, 17 nt, Haemophilus influenzae Rd
gauaaaguauucauaua

SEQ ID NO: 2725672 - RNA, 15 nt, Haemophilus influenzae Rd
gauaaaguccauaau

SEQ ID NO: 2725673 - RNA, 17 nt, Haemophilus influenzae Rd
gauaaaucgccccacua

SEQ ID NO: 2725674 - RNA, 18 nt, Haemophilus influenzae Rd
gauaaauguguuaaauaa

SEQ ID NO: 2725675 - RNA, 19 nt, Haemophilus influenzae Rd
gauaaauuauucugcaaca

SEQ ID NO: 2725676 - RNA, 23 nt, Haemophilus influenzae Rd
gauaaauuucaauuaaaucaaaa

SEQ ID NO: 2725677 - RNA, 13 nt, Haemophilus influenzae Rd
gauaaauuucuaa

SEQ ID NO: 2725678 - RNA, 19 nt, Haemophilus influenzae Rd
gauaaauuuuuagcugauu

SEQ ID NO: 2725679 - RNA, 18 nt, Haemophilus influenzae Rd
gauaacaaacccugaauu

SEQ ID NO: 2725680 - RNA, 11 nt, Haemophilus influenzae Rd
gauaacaaauu

SEQ ID NO: 2725681 - RNA, 14 nt, Haemophilus influenzae Rd
gauaacaaauugcu

SEQ ID NO: 2725682 - RNA, 20 nt, Haemophilus influenzae Rd
gauaacaacucacaauaaua

SEQ ID NO: 2725683 - RNA, 17 nt, Haemophilus influenzae Rd
gauaacaauuuuugcau

SEQ ID NO: 2725684 - RNA, 19 nt, Haemophilus influenzae Rd
gauaacaauuuuugcauuu

SEQ ID NO: 2725685 - RNA, 22 nt, Haemophilus influenzae Rd
gauaacacgccauuaccacugc

SEQ ID NO: 2725686 - RNA, 23 nt, Haemophilus influenzae Rd
gauaaccaaaauauuucauuugc

SEQ ID NO: 2725687 - RNA, 18 nt, Haemophilus influenzae Rd
gauaacccuccgcauuaa

SEQ ID NO: 2725688 - RNA, 13 nt, Haemophilus influenzae Rd
gauaaccuucaau

SEQ ID NO: 2725689 - RNA, 22 nt, Haemophilus influenzae Rd
gauaaccuuuaccgucaauaaa

SEQ ID NO: 2725690 - RNA, 15 nt, Haemophilus influenzae Rd
gauaacguaaguaau

SEQ ID NO: 2725691 - RNA, 16 nt, Haemophilus influenzae Rd
gauaacuaauuucgca

SEQ ID NO: 2725692 - RNA, 19 nt, Haemophilus influenzae Rd
gauaacuaugccuucuuca

SEQ ID NO: 2725693 - RNA, 15 nt, Haemophilus influenzae Rd
gauaacuuagaaaau

SEQ ID NO: 2725694 - RNA, 16 nt, Haemophilus influenzae Rd
gauaacuuagaaaaua

SEQ ID NO: 2725695 - RNA, 17 nt, Haemophilus influenzae Rd
gauaacuuagaaaauau

SEQ ID NO: 2725696 - RNA, 17 nt, Haemophilus influenzae Rd
gauaacuucuucauucc

SEQ ID NO: 2725697 - RNA, 23 nt, Haemophilus influenzae Rd
gauaacuuucaguuaaauuuuca

SEQ ID NO: 2725698 - RNA, 15 nt, Haemophilus influenzae Rd
gauaagagcuuacuu

SEQ ID NO: 2725699 - RNA, 14 nt, Haemophilus influenzae Rd
gauaaggaaaauac

SEQ ID NO: 2725700 - RNA, 17 nt, Haemophilus influenzae Rd
gauaaggcagaaaugaa

SEQ ID NO: 2725701 - RNA, 19 nt, Haemophilus influenzae Rd
gauaagggcguagauauug

SEQ ID NO: 2725702 - RNA, 17 nt, Haemophilus influenzae Rd
gauaagguauguaccau

SEQ ID NO: 2725703 - RNA, 15 nt, Haemophilus influenzae Rd
gauaaguaaugaaaa

SEQ ID NO: 2725704 - RNA, 22 nt, Haemophilus influenzae Rd
gauaaguaaugaaaauugcaaa

SEQ ID NO: 2725705 - RNA, 15 nt, Haemophilus influenzae Rd
gauaaguagaaaaau

SEQ ID NO: 2725706 - RNA, 16 nt, Haemophilus influenzae Rd
gauaaguagaaaaauu

SEQ ID NO: 2725707 - RNA, 18 nt, Haemophilus influenzae Rd
gauaaguggggaaaaaua

SEQ ID NO: 2725708 - RNA, 22 nt, Haemophilus influenzae Rd
gauaaguggggaaaaauauuaa

SEQ ID NO: 2725709 - RNA, 21 nt, Haemophilus influenzae Rd
gauaaguugggauaagcuuuu

SEQ ID NO: 2725710 - RNA, 14 nt, Haemophilus influenzae Rd
gauaauaaaaaaac

SEQ ID NO: 2725711 - RNA, 14 nt, Haemophilus influenzae Rd
gauaauaaaaugga

SEQ ID NO: 2725712 - RNA, 22 nt, Haemophilus influenzae Rd
gauaauaaagcuacuaaaaauu

SEQ ID NO: 2725713 - RNA, 14 nt, Haemophilus influenzae Rd
gauaauacacguua

SEQ ID NO: 2725714 - RNA, 16 nt, Haemophilus influenzae Rd
gauaauacagaaauau

SEQ ID NO: 2725715 - RNA, 16 nt, Haemophilus influenzae Rd
gauaauaguaucagcu

SEQ ID NO: 2725716 - RNA, 22 nt, Haemophilus influenzae Rd
gauaauaucgcccgcuuuaagu

SEQ ID NO: 2725717 - RNA, 18 nt, Haemophilus influenzae Rd
gauaauauguuuugccaa

SEQ ID NO: 2725718 - RNA, 20 nt, Haemophilus influenzae Rd
gauaauauuccaaaaaauaa

SEQ ID NO: 2725719 - RNA, 13 nt, Haemophilus influenzae Rd
gauaauauuuuug

SEQ ID NO: 2725720 - RNA, 15 nt, Haemophilus influenzae Rd
gauaauauuuuugcc

SEQ ID NO: 2725721 - RNA, 17 nt, Haemophilus influenzae Rd
gauaauauuuuugccaa

SEQ ID NO: 2725722 - RNA, 16 nt, Haemophilus influenzae Rd
gauaaucaaaaaugcu

SEQ ID NO: 2725723 - RNA, 16 nt, Haemophilus influenzae Rd
gauaaucgcaagguca

SEQ ID NO: 2725724 - RNA, 17 nt, Haemophilus influenzae Rd
gauaaucuaaaaaaccu

SEQ ID NO: 2725725 - RNA, 17 nt, Haemophilus influenzae Rd
gauaaucuacaaaacau

SEQ ID NO: 2725726 - RNA, 15 nt, Haemophilus influenzae Rd
gauaaucuucccauu

SEQ ID NO: 2725727 - RNA, 16 nt, Haemophilus influenzae Rd
gauaaugauagaugaa

SEQ ID NO: 2725728 - RNA, 22 nt, Haemophilus influenzae Rd
gauaaugccucuuuaacauugu

SEQ ID NO: 2725729 - RNA, 20 nt, Haemophilus influenzae Rd
gauaaugguuacagaaauau

SEQ ID NO: 2725730 - RNA, 17 nt, Haemophilus influenzae Rd
gauaauguucuuuuaaa

SEQ ID NO: 2725731 - RNA, 16 nt, Haemophilus influenzae Rd
gauaauuaaagucaga

SEQ ID NO: 2725732 - RNA, 15 nt, Haemophilus influenzae Rd
gauaauuaacaauau

SEQ ID NO: 2725733 - RNA, 16 nt, Haemophilus influenzae Rd
gauaauuaaggucuua

SEQ ID NO: 2725734 - RNA, 16 nt, Haemophilus influenzae Rd
gauaauuggcaauaau

SEQ ID NO: 2725735 - RNA, 18 nt, Haemophilus influenzae Rd
gauaauuggcaauaaugu

SEQ ID NO: 2725736 - RNA, 15 nt, Haemophilus influenzae Rd
gauaauuuaacugaa

SEQ ID NO: 2725737 - RNA, 15 nt, Haemophilus influenzae Rd
gauaauuuaagcaaa

SEQ ID NO: 2725738 - RNA, 16 nt, Haemophilus influenzae Rd
gauaauuuuucacugu

SEQ ID NO: 2725739 - RNA, 15 nt, Haemophilus influenzae Rd
gauacaaaauguuua

SEQ ID NO: 2725740 - RNA, 19 nt, Haemophilus influenzae Rd
gauacaaaauguuuacgcu

SEQ ID NO: 2725741 - RNA, 16 nt, Haemophilus influenzae Rd
gauacaaagauuucau

SEQ ID NO: 2725742 - RNA, 11 nt, Haemophilus influenzae Rd
gauacaaauaa

SEQ ID NO: 2725743 - RNA, 15 nt, Haemophilus influenzae Rd
gauacauaauauuga

SEQ ID NO: 2725744 - RNA, 15 nt, Haemophilus influenzae Rd
gauacauuucuaaaa

SEQ ID NO: 2725745 - RNA, 14 nt, Haemophilus influenzae Rd
gauaccaagauaau

SEQ ID NO: 2725746 - RNA, 15 nt, Haemophilus influenzae Rd
gauaccaagauaaua

SEQ ID NO: 2725747 - RNA, 20 nt, Haemophilus influenzae Rd
gauaccaagauaauaaaguu

SEQ ID NO: 2725748 - RNA, 14 nt, Haemophilus influenzae Rd
gauaccaauaauca

SEQ ID NO: 2725749 - RNA, 14 nt, Haemophilus influenzae Rd
gauaccuaaaccuu

SEQ ID NO: 2725750 - RNA, 18 nt, Haemophilus influenzae Rd
gauacgaaauagcguuuu

SEQ ID NO: 2725751 - RNA, 14 nt, Haemophilus influenzae Rd
gauacgaauguuug

SEQ ID NO: 2725752 - RNA, 15 nt, Haemophilus influenzae Rd
gauacggcaaauuaa

SEQ ID NO: 2725753 - RNA, 13 nt, Haemophilus influenzae Rd
gauacguuucaua

SEQ ID NO: 2725754 - RNA, 20 nt, Haemophilus influenzae Rd
gauacuauauuuucuucugc

SEQ ID NO: 2725755 - RNA, 20 nt, Haemophilus influenzae Rd
gauacuuggcguucauaucu

SEQ ID NO: 2725756 - RNA, 11 nt, Haemophilus influenzae Rd
gauacuuucua

SEQ ID NO: 2725757 - RNA, 18 nt, Haemophilus influenzae Rd
gauacuuuuaauuaaaua

SEQ ID NO: 2725758 - RNA, 19 nt, Haemophilus influenzae Rd
gauagcaaugccaaucuaa

SEQ ID NO: 2725759 - RNA, 21 nt, Haemophilus influenzae Rd
gauagccaaagguugcggcga

SEQ ID NO: 2725760 - RNA, 18 nt, Haemophilus influenzae Rd
gauagccguccauuucaa

SEQ ID NO: 2725761 - RNA, 15 nt, Haemophilus influenzae Rd
gauagccucuucuuu

SEQ ID NO: 2725762 - RNA, 18 nt, Haemophilus influenzae Rd
gauagcugccgaauagau

SEQ ID NO: 2725763 - RNA, 20 nt, Haemophilus influenzae Rd
gauagggauuuuuacuaaau

SEQ ID NO: 2725764 - RNA, 14 nt, Haemophilus influenzae Rd
gauagguaauaaua

SEQ ID NO: 2725765 - RNA, 17 nt, Haemophilus influenzae Rd
gauaguaaaaaaucaag

SEQ ID NO: 2725766 - RNA, 19 nt, Haemophilus influenzae Rd
gauaguaaaaaaucaagcc

SEQ ID NO: 2725767 - RNA, 21 nt, Haemophilus influenzae Rd
gauagugcccgcuacaaauaa

SEQ ID NO: 2725768 - RNA, 22 nt, Haemophilus influenzae Rd
gauagugcccgcuacaaauaag

SEQ ID NO: 2725769 - RNA, 14 nt, Haemophilus influenzae Rd
gauauaaaaacuau

SEQ ID NO: 2725770 - RNA, 13 nt, Haemophilus influenzae Rd
gauauaaaaaugg

SEQ ID NO: 2725771 - RNA, 22 nt, Haemophilus influenzae Rd
gauauaaaagugcgguaaaaau

SEQ ID NO: 2725772 - RNA, 11 nt, Haemophilus influenzae Rd
gauauaaauug

SEQ ID NO: 2725773 - RNA, 22 nt, Haemophilus influenzae Rd
gauauaacguaaucaaauccac

SEQ ID NO: 2725774 - RNA, 23 nt, Haemophilus influenzae Rd
gauauaaguucuaaauaaacuac

SEQ ID NO: 2725775 - RNA, 19 nt, Haemophilus influenzae Rd
gauauaauacguaaauuca

SEQ ID NO: 2725776 - RNA, 17 nt, Haemophilus influenzae Rd
gauauaccauucuuuca

SEQ ID NO: 2725777 - RNA, 18 nt, Haemophilus influenzae Rd
gauauaccauucuuucaa

SEQ ID NO: 2725778 - RNA, 15 nt, Haemophilus influenzae Rd
gauauagaaaucaua

SEQ ID NO: 2725779 - RNA, 21 nt, Haemophilus influenzae Rd
gauauaguggcuuuaaagguu

SEQ ID NO: 2725780 - RNA, 17 nt, Haemophilus influenzae Rd
gauauaucagugcuugc

SEQ ID NO: 2725781 - RNA, 16 nt, Haemophilus influenzae Rd
gauauaugauuauaaa

SEQ ID NO: 2725782 - RNA, 16 nt, Haemophilus influenzae Rd
gauauauuaacuugcu

SEQ ID NO: 2725783 - RNA, 16 nt, Haemophilus influenzae Rd
gauauauuauuuacaa

SEQ ID NO: 2725784 - RNA, 13 nt, Haemophilus influenzae Rd
gauaugaaauaaa

SEQ ID NO: 2725785 - RNA, 17 nt, Haemophilus influenzae Rd
gauauguuaauaagccc

SEQ ID NO: 2725786 - RNA, 11 nt, Haemophilus influenzae Rd
gauauuaauac

SEQ ID NO: 2725787 - RNA, 16 nt, Haemophilus influenzae Rd
gauauuauuauuaaau

SEQ ID NO: 2725788 - RNA, 16 nt, Haemophilus influenzae Rd
gauauuccaagguuuu

SEQ ID NO: 2725789 - RNA, 14 nt, Haemophilus influenzae Rd
gauauugcacaaua

SEQ ID NO: 2725790 - RNA, 15 nt, Haemophilus influenzae Rd
gauauuggauuuacu

SEQ ID NO: 2725791 - RNA, 23 nt, Haemophilus influenzae Rd
gauauuuauaaguaaucacagau

SEQ ID NO: 2725792 - RNA, 13 nt, Haemophilus influenzae Rd
gauauuuuuauca

SEQ ID NO: 2725793 - RNA, 21 nt, Haemophilus influenzae Rd
gauauuuuuaucaauaacuga

SEQ ID NO: 2725794 - RNA, 20 nt, Haemophilus influenzae Rd
gaucaaaaauauccacuucc

SEQ ID NO: 2725795 - RNA, 15 nt, Haemophilus influenzae Rd
gaucaacauaacguu

SEQ ID NO: 2725796 - RNA, 18 nt, Haemophilus influenzae Rd
gaucaagcacuuuuccuu

SEQ ID NO: 2725797 - RNA, 19 nt, Haemophilus influenzae Rd
gaucaagcacuuuuccuuu

SEQ ID NO: 2725798 - RNA, 17 nt, Haemophilus influenzae Rd
gaucaauggguuuaaaa

SEQ ID NO: 2725799 - RNA, 13 nt, Haemophilus influenzae Rd
gaucaccauaauc

SEQ ID NO: 2725800 - RNA, 21 nt, Haemophilus influenzae Rd
gaucacgcaaaggaacaauuu

SEQ ID NO: 2725801 - RNA, 15 nt, Haemophilus influenzae Rd
gaucacuucugcaua

SEQ ID NO: 2725802 - RNA, 21 nt, Haemophilus influenzae Rd
gaucacuucugcauaacuuaa

SEQ ID NO: 2725803 - RNA, 22 nt, Haemophilus influenzae Rd
gaucagaaguuaaaacuugaau

SEQ ID NO: 2725804 - RNA, 16 nt, Haemophilus influenzae Rd
gaucaggaucaaaaau

SEQ ID NO: 2725805 - RNA, 12 nt, Haemophilus influenzae Rd
gaucauaaauuu

SEQ ID NO: 2725806 - RNA, 17 nt, Haemophilus influenzae Rd
gaucauaauccacuaaa

SEQ ID NO: 2725807 - RNA, 17 nt, Haemophilus influenzae Rd
gaucaugguuguaauaa

SEQ ID NO: 2725808 - RNA, 15 nt, Haemophilus influenzae Rd
gaucauuagcaacuu

SEQ ID NO: 2725809 - RNA, 23 nt, Haemophilus influenzae Rd
gaucauuuuuuuaaauauuuuua

SEQ ID NO: 2725810 - RNA, 21 nt, Haemophilus influenzae Rd
gauccacacuucaucacuaaa

SEQ ID NO: 2725811 - RNA, 22 nt, Haemophilus influenzae Rd
gauccaguuggcgugcuuccau

SEQ ID NO: 2725812 - RNA, 16 nt, Haemophilus influenzae Rd
gauccauacaguaaaa

SEQ ID NO: 2725813 - RNA, 20 nt, Haemophilus influenzae Rd
gauccauacaguaaaaauag

SEQ ID NO: 2725814 - RNA, 13 nt, Haemophilus influenzae Rd
gauccauuaauaa

SEQ ID NO: 2725815 - RNA, 22 nt, Haemophilus influenzae Rd
gauccauuaauaacugaauaau

SEQ ID NO: 2725816 - RNA, 20 nt, Haemophilus influenzae Rd
gaucccagcauaaauaaaua

SEQ ID NO: 2725817 - RNA, 19 nt, Haemophilus influenzae Rd
gaucgaaaaaucuuugaau

SEQ ID NO: 2725818 - RNA, 21 nt, Haemophilus influenzae Rd
gaucggacuuuuuucuuaaau

SEQ ID NO: 2725819 - RNA, 17 nt, Haemophilus influenzae Rd
gaucgucuugaccugca

SEQ ID NO: 2725820 - RNA, 13 nt, Haemophilus influenzae Rd
gaucguuuucucg

SEQ ID NO: 2725821 - RNA, 16 nt, Haemophilus influenzae Rd
gaucuaaaucauuuau

SEQ ID NO: 2725822 - RNA, 15 nt, Haemophilus influenzae Rd
gaucuaauacaguuu

SEQ ID NO: 2725823 - RNA, 13 nt, Haemophilus influenzae Rd
gaucuaauccauu

SEQ ID NO: 2725824 - RNA, 14 nt, Haemophilus influenzae Rd
gaucuaauuugcca

SEQ ID NO: 2725825 - RNA, 16 nt, Haemophilus influenzae Rd
gaucuaauuugccaag

SEQ ID NO: 2725826 - RNA, 22 nt, Haemophilus influenzae Rd
gaucuacaucaguaccuuuaau

SEQ ID NO: 2725827 - RNA, 14 nt, Haemophilus influenzae Rd
gaucuauuccuaau

SEQ ID NO: 2725828 - RNA, 15 nt, Haemophilus influenzae Rd
gaucuauuugauuua

SEQ ID NO: 2725829 - RNA, 16 nt, Haemophilus influenzae Rd
gaucucagaauuuauu

SEQ ID NO: 2725830 - RNA, 13 nt, Haemophilus influenzae Rd
gaucucuuucuau

SEQ ID NO: 2725831 - RNA, 18 nt, Haemophilus influenzae Rd
gaucugaccccaaaaagu

SEQ ID NO: 2725832 - RNA, 13 nt, Haemophilus influenzae Rd
gaucugcacccca

SEQ ID NO: 2725833 - RNA, 23 nt, Haemophilus influenzae Rd
gaucugcugguacgagcacagua

SEQ ID NO: 2725834 - RNA, 13 nt, Haemophilus influenzae Rd
gaucuguuuuaag

SEQ ID NO: 2725835 - RNA, 16 nt, Haemophilus influenzae Rd
gaucuucaaucaucau

SEQ ID NO: 2725836 - RNA, 18 nt, Haemophilus influenzae Rd
gaucuucggauuuuucaa

SEQ ID NO: 2725837 - RNA, 22 nt, Haemophilus influenzae Rd
gaucuuuuguuacuuuccauuc

SEQ ID NO: 2725838 - RNA, 14 nt, Haemophilus influenzae Rd
gaugaaaucauuac

SEQ ID NO: 2725839 - RNA, 15 nt, Haemophilus influenzae Rd
gaugaaauuuauuau

SEQ ID NO: 2725840 - RNA, 21 nt, Haemophilus influenzae Rd
gaugaaccauaaacaauauaa

SEQ ID NO: 2725841 - RNA, 14 nt, Haemophilus influenzae Rd
gaugaagaaaauuu

SEQ ID NO: 2725842 - RNA, 15 nt, Haemophilus influenzae Rd
gaugaagaaaauuuc

SEQ ID NO: 2725843 - RNA, 17 nt, Haemophilus influenzae Rd
gaugaagaaaauuucug

SEQ ID NO: 2725844 - RNA, 19 nt, Haemophilus influenzae Rd
gaugaagaaaauuucugcu

SEQ ID NO: 2725845 - RNA, 11 nt, Haemophilus influenzae Rd
gaugaagauga

SEQ ID NO: 2725846 - RNA, 19 nt, Haemophilus influenzae Rd
gaugaaugccacaaauaaa

SEQ ID NO: 2725847 - RNA, 23 nt, Haemophilus influenzae Rd
gaugaauggguuaguaaguggua

SEQ ID NO: 2725848 - RNA, 15 nt, Haemophilus influenzae Rd
gaugaauuaagacgg

SEQ ID NO: 2725849 - RNA, 18 nt, Haemophilus influenzae Rd
gaugacaaaagugcgguu

SEQ ID NO: 2725850 - RNA, 18 nt, Haemophilus influenzae Rd
gaugacauaucaauuugc

SEQ ID NO: 2725851 - RNA, 17 nt, Haemophilus influenzae Rd
gaugaccucgcuauaaa

SEQ ID NO: 2725852 - RNA, 15 nt, Haemophilus influenzae Rd
gaugaccuguacuug

SEQ ID NO: 2725853 - RNA, 15 nt, Haemophilus influenzae Rd
gaugacuaaacaaau

SEQ ID NO: 2725854 - RNA, 16 nt, Haemophilus influenzae Rd
gaugacuggcaaaaau

SEQ ID NO: 2725855 - RNA, 17 nt, Haemophilus influenzae Rd
gaugauaaucuucccau

SEQ ID NO: 2725856 - RNA, 14 nt, Haemophilus influenzae Rd
gaugauaauuucau

SEQ ID NO: 2725857 - RNA, 17 nt, Haemophilus influenzae Rd
gaugauaauuucaucgc

SEQ ID NO: 2725858 - RNA, 16 nt, Haemophilus influenzae Rd
gaugaugcaggaaagg

SEQ ID NO: 2725859 - RNA, 20 nt, Haemophilus influenzae Rd
gaugauggccaugacaagca

SEQ ID NO: 2725860 - RNA, 19 nt, Haemophilus influenzae Rd
gaugaugggaugaaaucaa

SEQ ID NO: 2725861 - RNA, 14 nt, Haemophilus influenzae Rd
gaugauuaacuauu

SEQ ID NO: 2725862 - RNA, 16 nt, Haemophilus influenzae Rd
gaugauuccaaaguuu

SEQ ID NO: 2725863 - RNA, 23 nt, Haemophilus influenzae Rd
gaugauuugcauaaaaccagcau

SEQ ID NO: 2725864 - RNA, 13 nt, Haemophilus influenzae Rd
gaugauuuuaaag

SEQ ID NO: 2725865 - RNA, 15 nt, Haemophilus influenzae Rd
gaugauuuucauucc

SEQ ID NO: 2725866 - RNA, 21 nt, Haemophilus influenzae Rd
gaugauuuuuacaaguuaaag

SEQ ID NO: 2725867 - RNA, 17 nt, Haemophilus influenzae Rd
gaugcaacgcauuagca

SEQ ID NO: 2725868 - RNA, 21 nt, Haemophilus influenzae Rd
gaugcaacgcauuagcaucca

SEQ ID NO: 2725869 - RNA, 13 nt, Haemophilus influenzae Rd
gaugcaccaauac

SEQ ID NO: 2725870 - RNA, 20 nt, Haemophilus influenzae Rd
gaugcauacuuguaguggau

SEQ ID NO: 2725871 - RNA, 21 nt, Haemophilus influenzae Rd
gaugcauuuuuuaaucuaugg

SEQ ID NO: 2725872 - RNA, 16 nt, Haemophilus influenzae Rd
gaugccagcaaguuca

SEQ ID NO: 2725873 - RNA, 14 nt, Haemophilus influenzae Rd
gaugccauuaaaac

SEQ ID NO: 2725874 - RNA, 22 nt, Haemophilus influenzae Rd
gaugcgauccaaaauucugugu

SEQ ID NO: 2725875 - RNA, 16 nt, Haemophilus influenzae Rd
gauggaauaaauuuug

SEQ ID NO: 2725876 - RNA, 19 nt, Haemophilus influenzae Rd
gauggcaguuuggaaagag

SEQ ID NO: 2725877 - RNA, 15 nt, Haemophilus influenzae Rd
gauggcgugaaauau

SEQ ID NO: 2725878 - RNA, 15 nt, Haemophilus influenzae Rd
gaugguaauagagua

SEQ ID NO: 2725879 - RNA, 20 nt, Haemophilus influenzae Rd
gauguaaaagauaaaacaga

SEQ ID NO: 2725880 - RNA, 13 nt, Haemophilus influenzae Rd
gauguaaauuuuc

SEQ ID NO: 2725881 - RNA, 23 nt, Haemophilus influenzae Rd
gauguaaugagcacgccuaauac

SEQ ID NO: 2725882 - RNA, 16 nt, Haemophilus influenzae Rd
gauguaauugagcguc

SEQ ID NO: 2725883 - RNA, 17 nt, Haemophilus influenzae Rd
gauguaccaaaauguug

SEQ ID NO: 2725884 - RNA, 14 nt, Haemophilus influenzae Rd
gauguaggcaaaaa

SEQ ID NO: 2725885 - RNA, 23 nt, Haemophilus influenzae Rd
gaugucaggaucgguaaguugug

SEQ ID NO: 2725886 - RNA, 21 nt, Haemophilus influenzae Rd
gaugucuaaaugugcccagcg

SEQ ID NO: 2725887 - RNA, 17 nt, Haemophilus influenzae Rd
gaugucuggcugaguaa

SEQ ID NO: 2725888 - RNA, 14 nt, Haemophilus influenzae Rd
gaugugaauaucca

SEQ ID NO: 2725889 - RNA, 20 nt, Haemophilus influenzae Rd
gaugugcuugaugucaguga

SEQ ID NO: 2725890 - RNA, 18 nt, Haemophilus influenzae Rd
gauguucuaaaucaucag

SEQ ID NO: 2725891 - RNA, 19 nt, Haemophilus influenzae Rd
gauguuguaaaaucucuau

SEQ ID NO: 2725892 - RNA, 22 nt, Haemophilus influenzae Rd
gauguuuuugaaguaaaaaaau

SEQ ID NO: 2725893 - RNA, 11 nt, Haemophilus influenzae Rd
gauuaaaaguc

SEQ ID NO: 2725894 - RNA, 21 nt, Haemophilus influenzae Rd
gauuaaagggcugcuacaauu

SEQ ID NO: 2725895 - RNA, 22 nt, Haemophilus influenzae Rd
gauuaaauauuuucauuuaugu

SEQ ID NO: 2725896 - RNA, 13 nt, Haemophilus influenzae Rd
gauuaacaauaau

SEQ ID NO: 2725897 - RNA, 19 nt, Haemophilus influenzae Rd
gauuaacuuucucacuuau

SEQ ID NO: 2725898 - RNA, 16 nt, Haemophilus influenzae Rd
gauuaagaaaauuguc

SEQ ID NO: 2725899 - RNA, 20 nt, Haemophilus influenzae Rd
gauuaaucagugucuuaacu

SEQ ID NO: 2725900 - RNA, 18 nt, Haemophilus influenzae Rd
gauuaauccgcucaucgc

SEQ ID NO: 2725901 - RNA, 13 nt, Haemophilus influenzae Rd
gauuaaucuuuuu

SEQ ID NO: 2725902 - RNA, 17 nt, Haemophilus influenzae Rd
gauuaaucuuuuuucuu

SEQ ID NO: 2725903 - RNA, 23 nt, Haemophilus influenzae Rd
gauuaaucuuuuuucuugcuaaa

SEQ ID NO: 2725904 - RNA, 15 nt, Haemophilus influenzae Rd
gauuaaugcuauaaa

SEQ ID NO: 2725905 - RNA, 19 nt, Haemophilus influenzae Rd
gauuaaugcuauaaaucca

SEQ ID NO: 2725906 - RNA, 13 nt, Haemophilus influenzae Rd
gauuaauuaaauu

SEQ ID NO: 2725907 - RNA, 17 nt, Haemophilus influenzae Rd
gauuaauuauauuuucu

SEQ ID NO: 2725908 - RNA, 21 nt, Haemophilus influenzae Rd
gauuaauuuuuuauaaaauuu

SEQ ID NO: 2725909 - RNA, 22 nt, Haemophilus influenzae Rd
gauuaccacccaaaauuucagc

SEQ ID NO: 2725910 - RNA, 18 nt, Haemophilus influenzae Rd
gauuaccaggaaauauuc

SEQ ID NO: 2725911 - RNA, 23 nt, Haemophilus influenzae Rd
gauuacgcguacgcaauuuagau

SEQ ID NO: 2725912 - RNA, 22 nt, Haemophilus influenzae Rd
gauuacguagaaaacaauaaaa

SEQ ID NO: 2725913 - RNA, 15 nt, Haemophilus influenzae Rd
gauuacguguaguug

SEQ ID NO: 2725914 - RNA, 22 nt, Haemophilus influenzae Rd
gauuacuuaaaguuaucaaaca

SEQ ID NO: 2725915 - RNA, 17 nt, Haemophilus influenzae Rd
gauuacuucgcaggaau

SEQ ID NO: 2725916 - RNA, 15 nt, Haemophilus influenzae Rd
gauuagaaaugauca

SEQ ID NO: 2725917 - RNA, 19 nt, Haemophilus influenzae Rd
gauuagagccaucacguuc

SEQ ID NO: 2725918 - RNA, 15 nt, Haemophilus influenzae Rd
gauuagugugauuuu

SEQ ID NO: 2725919 - RNA, 14 nt, Haemophilus influenzae Rd
gauuauaaauuagc

SEQ ID NO: 2725920 - RNA, 19 nt, Haemophilus influenzae Rd
gauuauauuguugcacauu

SEQ ID NO: 2725921 - RNA, 15 nt, Haemophilus influenzae Rd
gauuaucauuaaaua

SEQ ID NO: 2725922 - RNA, 18 nt, Haemophilus influenzae Rd
gauuaucauuaaauauaa

SEQ ID NO: 2725923 - RNA, 13 nt, Haemophilus influenzae Rd
gauuaucuagaaa

SEQ ID NO: 2725924 - RNA, 21 nt, Haemophilus influenzae Rd
gauuauguagcaguugcuaaa

SEQ ID NO: 2725925 - RNA, 15 nt, Haemophilus influenzae Rd
gauuauugcacuaau

SEQ ID NO: 2725926 - RNA, 16 nt, Haemophilus influenzae Rd
gauuauugcacuaaua

SEQ ID NO: 2725927 - RNA, 20 nt, Haemophilus influenzae Rd
gauuauuuggcaaaugauaa

SEQ ID NO: 2725928 - RNA, 18 nt, Haemophilus influenzae Rd
gauucaaacgcguuaaau

SEQ ID NO: 2725929 - RNA, 13 nt, Haemophilus influenzae Rd
gauucaaaucuaa

SEQ ID NO: 2725930 - RNA, 19 nt, Haemophilus influenzae Rd
gauucaaugcuuccuucaa

SEQ ID NO: 2725931 - RNA, 20 nt, Haemophilus influenzae Rd
gauucacgaucacuuguuuu

SEQ ID NO: 2725932 - RNA, 22 nt, Haemophilus influenzae Rd
gauucacgguguuuuuuaauaa

SEQ ID NO: 2725933 - RNA, 17 nt, Haemophilus influenzae Rd
gauucagaaaaagcuuc

SEQ ID NO: 2725934 - RNA, 19 nt, Haemophilus influenzae Rd
gauucauuaaguuuucuac

SEQ ID NO: 2725935 - RNA, 14 nt, Haemophilus influenzae Rd
gauuccucugcagg

SEQ ID NO: 2725936 - RNA, 17 nt, Haemophilus influenzae Rd
gauuccucugcaggcau

SEQ ID NO: 2725937 - RNA, 23 nt, Haemophilus influenzae Rd
gauuccucugcaggcauuuucaa

SEQ ID NO: 2725938 - RNA, 14 nt, Haemophilus influenzae Rd
gauucgcacguuuu

SEQ ID NO: 2725939 - RNA, 16 nt, Haemophilus influenzae Rd
gauucgccuugcuuuu

SEQ ID NO: 2725940 - RNA, 14 nt, Haemophilus influenzae Rd
gauucuaaaaacuc

SEQ ID NO: 2725941 - RNA, 13 nt, Haemophilus influenzae Rd
gauucuaaauauu

SEQ ID NO: 2725942 - RNA, 21 nt, Haemophilus influenzae Rd
gauucuaauuccccuucaaau

SEQ ID NO: 2725943 - RNA, 19 nt, Haemophilus influenzae Rd
gauucugugcaauauuucc

SEQ ID NO: 2725944 - RNA, 10 nt, Haemophilus influenzae Rd
gauucuucca

SEQ ID NO: 2725945 - RNA, 23 nt, Haemophilus influenzae Rd
gauucuuccaauuacuaaugccg

SEQ ID NO: 2725946 - RNA, 19 nt, Haemophilus influenzae Rd
gauucuuugagucggggau

SEQ ID NO: 2725947 - RNA, 21 nt, Haemophilus influenzae Rd
gauugaacguuuaacuucaac

SEQ ID NO: 2725948 - RNA, 16 nt, Haemophilus influenzae Rd
gauugaaucaauuuuu

SEQ ID NO: 2725949 - RNA, 22 nt, Haemophilus influenzae Rd
gauugacauuuuacuuuagcaa

SEQ ID NO: 2725950 - RNA, 13 nt, Haemophilus influenzae Rd
gauugaccaauga

SEQ ID NO: 2725951 - RNA, 16 nt, Haemophilus influenzae Rd
gauugaccgcccaaca

SEQ ID NO: 2725952 - RNA, 13 nt, Haemophilus influenzae Rd
gauugacuuguuu

SEQ ID NO: 2725953 - RNA, 22 nt, Haemophilus influenzae Rd
gauugacuuguuuuaaaacuau

SEQ ID NO: 2725954 - RNA, 21 nt, Haemophilus influenzae Rd
gauugagaaaauguauaaagc

SEQ ID NO: 2725955 - RNA, 20 nt, Haemophilus influenzae Rd
gauugaucagaaguuaaaac

SEQ ID NO: 2725956 - RNA, 22 nt, Haemophilus influenzae Rd
gauugaugcgaaaauggcuaaa

SEQ ID NO: 2725957 - RNA, 17 nt, Haemophilus influenzae Rd
gauugauggaucauaag

SEQ ID NO: 2725958 - RNA, 16 nt, Haemophilus influenzae Rd
gauugauuuaguucaa

SEQ ID NO: 2725959 - RNA, 16 nt, Haemophilus influenzae Rd
gauugauuuucuuucu

SEQ ID NO: 2725960 - RNA, 15 nt, Haemophilus influenzae Rd
gauugcaagugagcu

SEQ ID NO: 2725961 - RNA, 13 nt, Haemophilus influenzae Rd
gauugcaccuaau

SEQ ID NO: 2725962 - RNA, 15 nt, Haemophilus influenzae Rd
gauugcaugaaaugu

SEQ ID NO: 2725963 - RNA, 18 nt, Haemophilus influenzae Rd
gauugcgagucaaauuuu

SEQ ID NO: 2725964 - RNA, 15 nt, Haemophilus influenzae Rd
gauugcuaaauaaau

SEQ ID NO: 2725965 - RNA, 13 nt, Haemophilus influenzae Rd
gauugcuuuaacu

SEQ ID NO: 2725966 - RNA, 15 nt, Haemophilus influenzae Rd
gauuggauuuugaaa

SEQ ID NO: 2725967 - RNA, 16 nt, Haemophilus influenzae Rd
gauuguucgguaagcg

SEQ ID NO: 2725968 - RNA, 19 nt, Haemophilus influenzae Rd
gauuuaaauugaaaaaaua

SEQ ID NO: 2725969 - RNA, 20 nt, Haemophilus influenzae Rd
gauuuaauaccauacauaaa

SEQ ID NO: 2725970 - RNA, 17 nt, Haemophilus influenzae Rd
gauuuaaucauuacuua

SEQ ID NO: 2725971 - RNA, 15 nt, Haemophilus influenzae Rd
gauuuaauguauaaa

SEQ ID NO: 2725972 - RNA, 20 nt, Haemophilus influenzae Rd
gauuuaauuuauuuucuaau

SEQ ID NO: 2725973 - RNA, 20 nt, Haemophilus influenzae Rd
gauuuagguuucaauuuacc

SEQ ID NO: 2725974 - RNA, 23 nt, Haemophilus influenzae Rd
gauuuauacgugaaccaacccaa

SEQ ID NO: 2725975 - RNA, 23 nt, Haemophilus influenzae Rd
gauuuauauuccauuauuuauca

SEQ ID NO: 2725976 - RNA, 14 nt, Haemophilus influenzae Rd
gauuuaucuucccc

SEQ ID NO: 2725977 - RNA, 13 nt, Haemophilus influenzae Rd
gauuuauuaauag

SEQ ID NO: 2725978 - RNA, 20 nt, Haemophilus influenzae Rd
gauuuauuuaacaaugaaau

SEQ ID NO: 2725979 - RNA, 12 nt, Haemophilus influenzae Rd
gauuuauuucug

SEQ ID NO: 2725980 - RNA, 20 nt, Haemophilus influenzae Rd
gauuuauuuugguauuuuug

SEQ ID NO: 2725981 - RNA, 18 nt, Haemophilus influenzae Rd
gauuucaguaucaauacc

SEQ ID NO: 2725982 - RNA, 14 nt, Haemophilus influenzae Rd
gauuucaucuucau

SEQ ID NO: 2725983 - RNA, 23 nt, Haemophilus influenzae Rd
gauuucauuggcgguuuugccaa

SEQ ID NO: 2725984 - RNA, 18 nt, Haemophilus influenzae Rd
gauuuccaucuaaaaguu

SEQ ID NO: 2725985 - RNA, 18 nt, Haemophilus influenzae Rd
gauuucuguuaaaucuac

SEQ ID NO: 2725986 - RNA, 16 nt, Haemophilus influenzae Rd
gauuucuuuugguuua

SEQ ID NO: 2725987 - RNA, 13 nt, Haemophilus influenzae Rd
gauuugaaccuuc

SEQ ID NO: 2725988 - RNA, 19 nt, Haemophilus influenzae Rd
gauuugcaaagcuaccuac

SEQ ID NO: 2725989 - RNA, 15 nt, Haemophilus influenzae Rd
gauuugcacuuucua

SEQ ID NO: 2725990 - RNA, 18 nt, Haemophilus influenzae Rd
gauuugccucuucuuuug

SEQ ID NO: 2725991 - RNA, 19 nt, Haemophilus influenzae Rd
gauuuggcguucguguuca

SEQ ID NO: 2725992 - RNA, 14 nt, Haemophilus influenzae Rd
gauuuguugugaaa

SEQ ID NO: 2725993 - RNA, 18 nt, Haemophilus influenzae Rd
gauuuuaaagaauguuug

SEQ ID NO: 2725994 - RNA, 15 nt, Haemophilus influenzae Rd
gauuuuaaaguaaau

SEQ ID NO: 2725995 - RNA, 10 nt, Haemophilus influenzae Rd
gauuuuaaau

SEQ ID NO: 2725996 - RNA, 22 nt, Haemophilus influenzae Rd
gauuuuaccgcacuuuuuuucu

SEQ ID NO: 2725997 - RNA, 17 nt, Haemophilus influenzae Rd
gauuuuacgauuucugc

SEQ ID NO: 2725998 - RNA, 19 nt, Haemophilus influenzae Rd
gauuuuacgauuucugccu

SEQ ID NO: 2725999 - RNA, 22 nt, Haemophilus influenzae Rd
gauuuuacuuuuucuaauaauu

SEQ ID NO: 2726000 - RNA, 15 nt, Haemophilus influenzae Rd
gauuuuagaaaaauc

SEQ ID NO: 2726001 - RNA, 13 nt, Haemophilus influenzae Rd
gauuuuaguuucu

SEQ ID NO: 2726002 - RNA, 23 nt, Haemophilus influenzae Rd
gauuuuauucauaaauuccuuuu

SEQ ID NO: 2726003 - RNA, 14 nt, Haemophilus influenzae Rd
gauuuucacuaauu

SEQ ID NO: 2726004 - RNA, 21 nt, Haemophilus influenzae Rd
gauuuuccccgcucuuuccau

SEQ ID NO: 2726005 - RNA, 20 nt, Haemophilus influenzae Rd
gauuuucucgugugaaauua

SEQ ID NO: 2726006 - RNA, 16 nt, Haemophilus influenzae Rd
gauuuucuuagcuuca

SEQ ID NO: 2726007 - RNA, 20 nt, Haemophilus influenzae Rd
gauuuucuuagcuucaucuu

SEQ ID NO: 2726008 - RNA, 12 nt, Haemophilus influenzae Rd
gauuuucuuauc

SEQ ID NO: 2726009 - RNA, 12 nt, Haemophilus influenzae Rd
gauuuucuucau

SEQ ID NO: 2726010 - RNA, 18 nt, Haemophilus influenzae Rd
gauuuugccguucaaaac

SEQ ID NO: 2726011 - RNA, 16 nt, Haemophilus influenzae Rd
gauuuugguucguuuu

SEQ ID NO: 2726012 - RNA, 18 nt, Haemophilus influenzae Rd
gauuuugucuaagguuuc

SEQ ID NO: 2726013 - RNA, 22 nt, Haemophilus influenzae Rd
gauuuuguuuucuuuuuuucuu

SEQ ID NO: 2726014 - RNA, 13 nt, Haemophilus influenzae Rd
gauuuuugauaaa

SEQ ID NO: 2726015 - RNA, 23 nt, Haemophilus influenzae Rd
gauuuuuuaugaccaaauaccac

SEQ ID NO: 2726016 - RNA, 17 nt, Haemophilus influenzae Rd
gauuuuuuauuaauuau

SEQ ID NO: 2726017 - RNA, 19 nt, Haemophilus influenzae Rd
gauuuuuuuauaaaaaaac

SEQ ID NO: 2726018 - RNA, 18 nt, Haemophilus influenzae Rd
gauuuuuuucagaaauga

SEQ ID NO: 2726019 - RNA, 24 nt, Haemophilus influenzae Rd
gauuuuuuuuauaucuucucuugg

SEQ ID NO: 2726020 - RNA, 23 nt, Haemophilus influenzae Rd
gcaaaaaacuuugguuuguuaaa

SEQ ID NO: 2726021 - RNA, 17 nt, Haemophilus influenzae Rd
gcaaaaaauacauugcu

SEQ ID NO: 2726022 - RNA, 15 nt, Haemophilus influenzae Rd
gcaaaaacaaguggu

SEQ ID NO: 2726023 - RNA, 15 nt, Haemophilus influenzae Rd
gcaaaaauacuaacu

SEQ ID NO: 2726024 - RNA, 24 nt, Haemophilus influenzae Rd
gcaaaaauaucggcaucuacaccu

SEQ ID NO: 2726025 - RNA, 22 nt, Haemophilus influenzae Rd
gcaaaaaugacaucauuaauaa

SEQ ID NO: 2726026 - RNA, 19 nt, Haemophilus influenzae Rd
gcaaaaccgcuauuacuua

SEQ ID NO: 2726027 - RNA, 15 nt, Haemophilus influenzae Rd
gcaaaaccuaacaua

SEQ ID NO: 2726028 - RNA, 19 nt, Haemophilus influenzae Rd
gcaaaacgugcugcagcuu

SEQ ID NO: 2726029 - RNA, 13 nt, Haemophilus influenzae Rd
gcaaaacugaaag

SEQ ID NO: 2726030 - RNA, 15 nt, Haemophilus influenzae Rd
gcaaaacugaaagaa

SEQ ID NO: 2726031 - RNA, 17 nt, Haemophilus influenzae Rd
gcaaaagacgaagaaac

SEQ ID NO: 2726032 - RNA, 18 nt, Haemophilus influenzae Rd
gcaaaagacgaagaaaca

SEQ ID NO: 2726033 - RNA, 15 nt, Haemophilus influenzae Rd
gcaaaagcaauaaug

SEQ ID NO: 2726034 - RNA, 17 nt, Haemophilus influenzae Rd
gcaaaagccaauaagag

SEQ ID NO: 2726035 - RNA, 17 nt, Haemophilus influenzae Rd
gcaaaaucgcaauauua

SEQ ID NO: 2726036 - RNA, 16 nt, Haemophilus influenzae Rd
gcaaaaucucuggaga

SEQ ID NO: 2726037 - RNA, 19 nt, Haemophilus influenzae Rd
gcaaaauuuaguccuucug

SEQ ID NO: 2726038 - RNA, 18 nt, Haemophilus influenzae Rd
gcaaacaaguuucuaaaa

SEQ ID NO: 2726039 - RNA, 23 nt, Haemophilus influenzae Rd
gcaaacaaguuucuaaaaucacu

SEQ ID NO: 2726040 - RNA, 17 nt, Haemophilus influenzae Rd
gcaaacuacaacuuuuu

SEQ ID NO: 2726041 - RNA, 18 nt, Haemophilus influenzae Rd
gcaaacucgguuuauuuu

SEQ ID NO: 2726042 - RNA, 22 nt, Haemophilus influenzae Rd
gcaaagguuuuauuuugaacaa

SEQ ID NO: 2726043 - RNA, 23 nt, Haemophilus influenzae Rd
gcaaagguuuuauuuugaacaau

SEQ ID NO: 2726044 - RNA, 22 nt, Haemophilus influenzae Rd
gcaaaguauuuuucuaaaucgu

SEQ ID NO: 2726045 - RNA, 20 nt, Haemophilus influenzae Rd
gcaaagugcgguaagaaaau

SEQ ID NO: 2726046 - RNA, 20 nt, Haemophilus influenzae Rd
gcaaauacguauaauugacc

SEQ ID NO: 2726047 - RNA, 14 nt, Haemophilus influenzae Rd
gcaaauacuucacc

SEQ ID NO: 2726048 - RNA, 16 nt, Haemophilus influenzae Rd
gcaaauacuucaccgu

SEQ ID NO: 2726049 - RNA, 16 nt, Haemophilus influenzae Rd
gcaaaugaggaaaaua

SEQ ID NO: 2726050 - RNA, 19 nt, Haemophilus influenzae Rd
gcaaauggacuaaauuuag

SEQ ID NO: 2726051 - RNA, 13 nt, Haemophilus influenzae Rd
gcaaauuaaauca

SEQ ID NO: 2726052 - RNA, 14 nt, Haemophilus influenzae Rd
gcaaauuaaaucac

SEQ ID NO: 2726053 - RNA, 20 nt, Haemophilus influenzae Rd
gcaaauugcccuguugaaac

SEQ ID NO: 2726054 - RNA, 22 nt, Haemophilus influenzae Rd
gcaaauugcccuguugaaacag

SEQ ID NO: 2726055 - RNA, 21 nt, Haemophilus influenzae Rd
gcaacaaagugcggcaaaaaa

SEQ ID NO: 2726056 - RNA, 13 nt, Haemophilus influenzae Rd
gcaacaaauauug

SEQ ID NO: 2726057 - RNA, 14 nt, Haemophilus influenzae Rd
gcaacaauaacugc

SEQ ID NO: 2726058 - RNA, 21 nt, Haemophilus influenzae Rd
gcaacaauaacugccacauca

SEQ ID NO: 2726059 - RNA, 15 nt, Haemophilus influenzae Rd
gcaacacuugcugcc

SEQ ID NO: 2726060 - RNA, 14 nt, Haemophilus influenzae Rd
gcaacagugauacu

SEQ ID NO: 2726061 - RNA, 19 nt, Haemophilus influenzae Rd
gcaacaucaauaacaagcu

SEQ ID NO: 2726062 - RNA, 16 nt, Haemophilus influenzae Rd
gcaaccagcagaaaau

SEQ ID NO: 2726063 - RNA, 18 nt, Haemophilus influenzae Rd
gcaacccacuucugcacc

SEQ ID NO: 2726064 - RNA, 18 nt, Haemophilus influenzae Rd
gcaaccuguggcaggugg

SEQ ID NO: 2726065 - RNA, 15 nt, Haemophilus influenzae Rd
gcaacgcauuagcau

SEQ ID NO: 2726066 - RNA, 13 nt, Haemophilus influenzae Rd
gcaacggcagcgg

SEQ ID NO: 2726067 - RNA, 13 nt, Haemophilus influenzae Rd
gcaacuaaauuca

SEQ ID NO: 2726068 - RNA, 17 nt, Haemophilus influenzae Rd
gcaacuaauaaaccaau

SEQ ID NO: 2726069 - RNA, 21 nt, Haemophilus influenzae Rd
gcaacuaauaaaccaauaaga

SEQ ID NO: 2726070 - RNA, 13 nt, Haemophilus influenzae Rd
gcaacuuuugcaa

SEQ ID NO: 2726071 - RNA, 15 nt, Haemophilus influenzae Rd
gcaacuuuugcaaaa

SEQ ID NO: 2726072 - RNA, 20 nt, Haemophilus influenzae Rd
gcaacuuuugcaaaauugcu

SEQ ID NO: 2726073 - RNA, 23 nt, Haemophilus influenzae Rd
gcaagaaauucacucaauucaaa

SEQ ID NO: 2726074 - RNA, 20 nt, Haemophilus influenzae Rd
gcaagaacuugauaaucauu

SEQ ID NO: 2726075 - RNA, 23 nt, Haemophilus influenzae Rd
gcaagagaggcaccugaauaacg

SEQ ID NO: 2726076 - RNA, 14 nt, Haemophilus influenzae Rd
gcaagauacuuuua

SEQ ID NO: 2726077 - RNA, 16 nt, Haemophilus influenzae Rd
gcaagaugaauuaaga

SEQ ID NO: 2726078 - RNA, 19 nt, Haemophilus influenzae Rd
gcaagcaaacagcaauaaa

SEQ ID NO: 2726079 - RNA, 20 nt, Haemophilus influenzae Rd
gcaagcaguuuacgguuaag

SEQ ID NO: 2726080 - RNA, 15 nt, Haemophilus influenzae Rd
gcaagcauuaaauau

SEQ ID NO: 2726081 - RNA, 18 nt, Haemophilus influenzae Rd
gcaagccaaguuguaaaa

SEQ ID NO: 2726082 - RNA, 19 nt, Haemophilus influenzae Rd
gcaagcgcguuuaucaucu

SEQ ID NO: 2726083 - RNA, 14 nt, Haemophilus influenzae Rd
gcaagcguuaaugu

SEQ ID NO: 2726084 - RNA, 14 nt, Haemophilus influenzae Rd
gcaagcuaccuugu

SEQ ID NO: 2726085 - RNA, 17 nt, Haemophilus influenzae Rd
gcaagcuggcuuggguu

SEQ ID NO: 2726086 - RNA, 19 nt, Haemophilus influenzae Rd
gcaaggauauuuccauagu

SEQ ID NO: 2726087 - RNA, 16 nt, Haemophilus influenzae Rd
gcaaguaauuuaaaaa

SEQ ID NO: 2726088 - RNA, 17 nt, Haemophilus influenzae Rd
gcaaguacucuugucaa

SEQ ID NO: 2726089 - RNA, 21 nt, Haemophilus influenzae Rd
gcaagucugcugaaauacaaa

SEQ ID NO: 2726090 - RNA, 16 nt, Haemophilus influenzae Rd
gcaagugcaguuucag

SEQ ID NO: 2726091 - RNA, 13 nt, Haemophilus influenzae Rd
gcaaguuguaaau

SEQ ID NO: 2726092 - RNA, 12 nt, Haemophilus influenzae Rd
gcaauaaagcuu

SEQ ID NO: 2726093 - RNA, 13 nt, Haemophilus influenzae Rd
gcaauaaauaaua

SEQ ID NO: 2726094 - RNA, 15 nt, Haemophilus influenzae Rd
gcaauaaauaauagg

SEQ ID NO: 2726095 - RNA, 19 nt, Haemophilus influenzae Rd
gcaauaaauucguacaaau

SEQ ID NO: 2726096 - RNA, 22 nt, Haemophilus influenzae Rd
gcaauaagugcgguaaaaaaau

SEQ ID NO: 2726097 - RNA, 22 nt, Haemophilus influenzae Rd
gcaauaaucacaguaccuacau

SEQ ID NO: 2726098 - RNA, 13 nt, Haemophilus influenzae Rd
gcaauaccacagc

SEQ ID NO: 2726099 - RNA, 20 nt, Haemophilus influenzae Rd
gcaauagcgaccaacaguua

SEQ ID NO: 2726100 - RNA, 20 nt, Haemophilus influenzae Rd
gcaauaguuggguaaucaaa

SEQ ID NO: 2726101 - RNA, 22 nt, Haemophilus influenzae Rd
gcaauaguuggguaaucaaauu

SEQ ID NO: 2726102 - RNA, 14 nt, Haemophilus influenzae Rd
gcaauaucaauccc

SEQ ID NO: 2726103 - RNA, 17 nt, Haemophilus influenzae Rd
gcaauaugauuagucua

SEQ ID NO: 2726104 - RNA, 14 nt, Haemophilus influenzae Rd
gcaauaugcacuaa

SEQ ID NO: 2726105 - RNA, 22 nt, Haemophilus influenzae Rd
gcaauauggguucaauauaacu

SEQ ID NO: 2726106 - RNA, 15 nt, Haemophilus influenzae Rd
gcaauauuuaauaua

SEQ ID NO: 2726107 - RNA, 12 nt, Haemophilus influenzae Rd
gcaauauuucaa

SEQ ID NO: 2726108 - RNA, 13 nt, Haemophilus influenzae Rd
gcaauauuucaau

SEQ ID NO: 2726109 - RNA, 14 nt, Haemophilus influenzae Rd
gcaaucaaaaauga

SEQ ID NO: 2726110 - RNA, 16 nt, Haemophilus influenzae Rd
gcaaucaacacaccua

SEQ ID NO: 2726111 - RNA, 14 nt, Haemophilus influenzae Rd
gcaaucagcaacau

SEQ ID NO: 2726112 - RNA, 14 nt, Haemophilus influenzae Rd
gcaauccaacguuu

SEQ ID NO: 2726113 - RNA, 16 nt, Haemophilus influenzae Rd
gcaaucccaagcagcc

SEQ ID NO: 2726114 - RNA, 18 nt, Haemophilus influenzae Rd
gcaaucguaagauccaaa

SEQ ID NO: 2726115 - RNA, 13 nt, Haemophilus influenzae Rd
gcaaucuucacaa

SEQ ID NO: 2726116 - RNA, 15 nt, Haemophilus influenzae Rd
gcaaucuucacaaau

SEQ ID NO: 2726117 - RNA, 19 nt, Haemophilus influenzae Rd
gcaaugcaaaaguaaauaa

SEQ ID NO: 2726118 - RNA, 15 nt, Haemophilus influenzae Rd
gcaaugccaaucuaa

SEQ ID NO: 2726119 - RNA, 20 nt, Haemophilus influenzae Rd
gcaaugccagcgcuugcacc

SEQ ID NO: 2726120 - RNA, 23 nt, Haemophilus influenzae Rd
gcaaugcuuuaaucauuuucacu

SEQ ID NO: 2726121 - RNA, 15 nt, Haemophilus influenzae Rd
gcaauggaauaccag

SEQ ID NO: 2726122 - RNA, 22 nt, Haemophilus influenzae Rd
gcaauggcuuguuccacauuau

SEQ ID NO: 2726123 - RNA, 20 nt, Haemophilus influenzae Rd
gcaaugguucgagaaacuuu

SEQ ID NO: 2726124 - RNA, 20 nt, Haemophilus influenzae Rd
gcaauguaguuggcauauca

SEQ ID NO: 2726125 - RNA, 15 nt, Haemophilus influenzae Rd
gcaauguauucaaac

SEQ ID NO: 2726126 - RNA, 16 nt, Haemophilus influenzae Rd
gcaauuaauccaucau

SEQ ID NO: 2726127 - RNA, 14 nt, Haemophilus influenzae Rd
gcaauuaauggcaa

SEQ ID NO: 2726128 - RNA, 22 nt, Haemophilus influenzae Rd
gcaauuaauucguccauucugu

SEQ ID NO: 2726129 - RNA, 15 nt, Haemophilus influenzae Rd
gcaauuaucaagcug

SEQ ID NO: 2726130 - RNA, 15 nt, Haemophilus influenzae Rd
gcaauucaaauuuuu

SEQ ID NO: 2726131 - RNA, 19 nt, Haemophilus influenzae Rd
gcaauucgccugcuugaua

SEQ ID NO: 2726132 - RNA, 17 nt, Haemophilus influenzae Rd
gcaauucugcucugcac

SEQ ID NO: 2726133 - RNA, 15 nt, Haemophilus influenzae Rd
gcaauugaaacuaaa

SEQ ID NO: 2726134 - RNA, 14 nt, Haemophilus influenzae Rd
gcaauugaauaaag

SEQ ID NO: 2726135 - RNA, 18 nt, Haemophilus influenzae Rd
gcaauuucaucacaucaa

SEQ ID NO: 2726136 - RNA, 15 nt, Haemophilus influenzae Rd
gcaauuuccauucua

SEQ ID NO: 2726137 - RNA, 14 nt, Haemophilus influenzae Rd
gcaauuucugccau

SEQ ID NO: 2726138 - RNA, 13 nt, Haemophilus influenzae Rd
gcaauuugaaaag

SEQ ID NO: 2726139 - RNA, 14 nt, Haemophilus influenzae Rd
gcaauuugaaaaga

SEQ ID NO: 2726140 - RNA, 16 nt, Haemophilus influenzae Rd
gcaauuugaaaagaau

SEQ ID NO: 2726141 - RNA, 17 nt, Haemophilus influenzae Rd
gcaauuugaaaagaauu

SEQ ID NO: 2726142 - RNA, 22 nt, Haemophilus influenzae Rd
gcaauuugaauuaauacgccaa

SEQ ID NO: 2726143 - RNA, 13 nt, Haemophilus influenzae Rd
gcaauuuuucuaa

SEQ ID NO: 2726144 - RNA, 15 nt, Haemophilus influenzae Rd
gcacaaaaaauucuu

SEQ ID NO: 2726145 - RNA, 18 nt, Haemophilus influenzae Rd
gcacaacaugcccuuucu

SEQ ID NO: 2726146 - RNA, 15 nt, Haemophilus influenzae Rd
gcacaacgguugaaa

SEQ ID NO: 2726147 - RNA, 15 nt, Haemophilus influenzae Rd
gcacaagcaccacuu

SEQ ID NO: 2726148 - RNA, 11 nt, Haemophilus influenzae Rd
gcacaaucaaa

SEQ ID NO: 2726149 - RNA, 11 nt, Haemophilus influenzae Rd
gcacaaucgca

SEQ ID NO: 2726150 - RNA, 21 nt, Haemophilus influenzae Rd
gcacaccaccugaugcuuuaa

SEQ ID NO: 2726151 - RNA, 14 nt, Haemophilus influenzae Rd
gcacaguauuuaua

SEQ ID NO: 2726152 - RNA, 12 nt, Haemophilus influenzae Rd
gcacauaacaaa

SEQ ID NO: 2726153 - RNA, 18 nt, Haemophilus influenzae Rd
gcacaucaaauucuaaaa

SEQ ID NO: 2726154 - RNA, 17 nt, Haemophilus influenzae Rd
gcacauuaauuugugag

SEQ ID NO: 2726155 - RNA, 12 nt, Haemophilus influenzae Rd
gcacauucugag

SEQ ID NO: 2726156 - RNA, 19 nt, Haemophilus influenzae Rd
gcacauucugagcuuuucu

SEQ ID NO: 2726157 - RNA, 14 nt, Haemophilus influenzae Rd
gcaccaaagcaaaa

SEQ ID NO: 2726158 - RNA, 17 nt, Haemophilus influenzae Rd
gcaccaaauuaaaaaua

SEQ ID NO: 2726159 - RNA, 18 nt, Haemophilus influenzae Rd
gcaccaauaccaauaauu

SEQ ID NO: 2726160 - RNA, 20 nt, Haemophilus influenzae Rd
gcaccacgaccuaagaaaag

SEQ ID NO: 2726161 - RNA, 20 nt, Haemophilus influenzae Rd
gcaccacuucgccacguaac

SEQ ID NO: 2726162 - RNA, 17 nt, Haemophilus influenzae Rd
gcaccagaaauagaagc

SEQ ID NO: 2726163 - RNA, 14 nt, Haemophilus influenzae Rd
gcaccaucacguaa

SEQ ID NO: 2726164 - RNA, 12 nt, Haemophilus influenzae Rd
gcaccaucauag

SEQ ID NO: 2726165 - RNA, 19 nt, Haemophilus influenzae Rd
gcaccaucguuaaaccaaa

SEQ ID NO: 2726166 - RNA, 16 nt, Haemophilus influenzae Rd
gcaccccaaaagcugg

SEQ ID NO: 2726167 - RNA, 16 nt, Haemophilus influenzae Rd
gcacccgcuguaauug

SEQ ID NO: 2726168 - RNA, 22 nt, Haemophilus influenzae Rd
gcacccuaauucauuaaggugc

SEQ ID NO: 2726169 - RNA, 16 nt, Haemophilus influenzae Rd
gcaccgucauuuucaa

SEQ ID NO: 2726170 - RNA, 21 nt, Haemophilus influenzae Rd
gcaccgucauuuucaagccac

SEQ ID NO: 2726171 - RNA, 13 nt, Haemophilus influenzae Rd
gcaccuaaaaguu

SEQ ID NO: 2726172 - RNA, 16 nt, Haemophilus influenzae Rd
gcaccuaagucaggaa

SEQ ID NO: 2726173 - RNA, 15 nt, Haemophilus influenzae Rd
gcaccuuaauuagau

SEQ ID NO: 2726174 - RNA, 17 nt, Haemophilus influenzae Rd
gcaccuucaacauuuuu

SEQ ID NO: 2726175 - RNA, 21 nt, Haemophilus influenzae Rd
gcaccuucaacauuuuuugcu

SEQ ID NO: 2726176 - RNA, 14 nt, Haemophilus influenzae Rd
gcaccuucagccac

SEQ ID NO: 2726177 - RNA, 15 nt, Haemophilus influenzae Rd
gcaccuugagaaaua

SEQ ID NO: 2726178 - RNA, 17 nt, Haemophilus influenzae Rd
gcaccuuguaaccaagc

SEQ ID NO: 2726179 - RNA, 19 nt, Haemophilus influenzae Rd
gcaccuuuugaaaaacucg

SEQ ID NO: 2726180 - RNA, 18 nt, Haemophilus influenzae Rd
gcaccuuuugcaagcauu

SEQ ID NO: 2726181 - RNA, 19 nt, Haemophilus influenzae Rd
gcaccuuuugcaagcauuc

SEQ ID NO: 2726182 - RNA, 23 nt, Haemophilus influenzae Rd
gcacgaccacccauuaaauagcg

SEQ ID NO: 2726183 - RNA, 13 nt, Haemophilus influenzae Rd
gcacgagcaauaa

SEQ ID NO: 2726184 - RNA, 19 nt, Haemophilus influenzae Rd
gcacgauaguggaauaaug

SEQ ID NO: 2726185 - RNA, 21 nt, Haemophilus influenzae Rd
gcacgauaguggaauaaugaa

SEQ ID NO: 2726186 - RNA, 22 nt, Haemophilus influenzae Rd
gcacgaucuaauugcggaaaaa

SEQ ID NO: 2726187 - RNA, 16 nt, Haemophilus influenzae Rd
gcacguaacaaaugca

SEQ ID NO: 2726188 - RNA, 15 nt, Haemophilus influenzae Rd
gcacuaaaccugcuu

SEQ ID NO: 2726189 - RNA, 12 nt, Haemophilus influenzae Rd
gcacucacaaua

SEQ ID NO: 2726190 - RNA, 20 nt, Haemophilus influenzae Rd
gcacucuuucaaaaaucaaa

SEQ ID NO: 2726191 - RNA, 17 nt, Haemophilus influenzae Rd
gcacugcggguucgguu

SEQ ID NO: 2726192 - RNA, 15 nt, Haemophilus influenzae Rd
gcacugguucugggu

SEQ ID NO: 2726193 - RNA, 15 nt, Haemophilus influenzae Rd
gcacuguuauauaaa

SEQ ID NO: 2726194 - RNA, 19 nt, Haemophilus influenzae Rd
gcacuguuauauaaacaau

SEQ ID NO: 2726195 - RNA, 14 nt, Haemophilus influenzae Rd
gcacuguugugaag

SEQ ID NO: 2726196 - RNA, 19 nt, Haemophilus influenzae Rd
gcacuguugugaaguuuuu

SEQ ID NO: 2726197 - RNA, 14 nt, Haemophilus influenzae Rd
gcacuuaauaaaua

SEQ ID NO: 2726198 - RNA, 17 nt, Haemophilus influenzae Rd
gcacuuagauuugaacc

SEQ ID NO: 2726199 - RNA, 22 nt, Haemophilus influenzae Rd
gcacuucaaaaagugcgguucu

SEQ ID NO: 2726200 - RNA, 12 nt, Haemophilus influenzae Rd
gcacuucaauuu

SEQ ID NO: 2726201 - RNA, 20 nt, Haemophilus influenzae Rd
gcacuucagcauaauguuug

SEQ ID NO: 2726202 - RNA, 16 nt, Haemophilus influenzae Rd
gcacuucuaugaagaa

SEQ ID NO: 2726203 - RNA, 12 nt, Haemophilus influenzae Rd
gcacuucuucag

SEQ ID NO: 2726204 - RNA, 14 nt, Haemophilus influenzae Rd
gcacuugcaucuaa

SEQ ID NO: 2726205 - RNA, 20 nt, Haemophilus influenzae Rd
gcacuugccacaacugaagc

SEQ ID NO: 2726206 - RNA, 16 nt, Haemophilus influenzae Rd
gcacuuggcgaacauu

SEQ ID NO: 2726207 - RNA, 18 nt, Haemophilus influenzae Rd
gcacuugggcugcaugaa

SEQ ID NO: 2726208 - RNA, 20 nt, Haemophilus influenzae Rd
gcacuuggguaaauauaaau

SEQ ID NO: 2726209 - RNA, 23 nt, Haemophilus influenzae Rd
gcacuuuaaagaaauaaauuuau

SEQ ID NO: 2726210 - RNA, 18 nt, Haemophilus influenzae Rd
gcacuuuaccauuacaua

SEQ ID NO: 2726211 - RNA, 14 nt, Haemophilus influenzae Rd
gcacuuuagaaaau

SEQ ID NO: 2726212 - RNA, 15 nt, Haemophilus influenzae Rd
gcacuuuagaaaaua

SEQ ID NO: 2726213 - RNA, 19 nt, Haemophilus influenzae Rd
gcacuuuaucuagacaaaa

SEQ ID NO: 2726214 - RNA, 16 nt, Haemophilus influenzae Rd
gcacuuuauucaacgg

SEQ ID NO: 2726215 - RNA, 19 nt, Haemophilus influenzae Rd
gcacuuuccauaccauuua

SEQ ID NO: 2726216 - RNA, 19 nt, Haemophilus influenzae Rd
gcacuuuccaucauugcuc

SEQ ID NO: 2726217 - RNA, 23 nt, Haemophilus influenzae Rd
gcacuuucuauacuaucugaucc

SEQ ID NO: 2726218 - RNA, 17 nt, Haemophilus influenzae Rd
gcacuuucuucuuuuag

SEQ ID NO: 2726219 - RNA, 21 nt, Haemophilus influenzae Rd
gcacuuuggaauauucuuuuu

SEQ ID NO: 2726220 - RNA, 18 nt, Haemophilus influenzae Rd
gcacuuuguggcuuuuca

SEQ ID NO: 2726221 - RNA, 17 nt, Haemophilus influenzae Rd
gcacuuuuaaaauuagu

SEQ ID NO: 2726222 - RNA, 13 nt, Haemophilus influenzae Rd
gcacuuuuaacca

SEQ ID NO: 2726223 - RNA, 16 nt, Haemophilus influenzae Rd
gcacuuuuaauuaaua

SEQ ID NO: 2726224 - RNA, 23 nt, Haemophilus influenzae Rd
gcacuuuuauauguaaaauuuuu

SEQ ID NO: 2726225 - RNA, 14 nt, Haemophilus influenzae Rd
gcacuuuuauauuu

SEQ ID NO: 2726226 - RNA, 13 nt, Haemophilus influenzae Rd
gcacuuuuccuuu

SEQ ID NO: 2726227 - RNA, 17 nt, Haemophilus influenzae Rd
gcacuuuugaucugcac

SEQ ID NO: 2726228 - RNA, 21 nt, Haemophilus influenzae Rd
gcacuuuuggauaaaguauuc

SEQ ID NO: 2726229 - RNA, 16 nt, Haemophilus influenzae Rd
gcacuuuugugauuaa

SEQ ID NO: 2726230 - RNA, 13 nt, Haemophilus influenzae Rd
gcacuuuuuaaua

SEQ ID NO: 2726231 - RNA, 17 nt, Haemophilus influenzae Rd
gcacuuuuucuugaucu

SEQ ID NO: 2726232 - RNA, 13 nt, Haemophilus influenzae Rd
gcacuuuuuucua

SEQ ID NO: 2726233 - RNA, 21 nt, Haemophilus influenzae Rd
gcacuuuuuuucuuauuucuu

SEQ ID NO: 2726234 - RNA, 15 nt, Haemophilus influenzae Rd
gcagaaaaauguuca

SEQ ID NO: 2726235 - RNA, 19 nt, Haemophilus influenzae Rd
gcagaacgguaagccgcua

SEQ ID NO: 2726236 - RNA, 22 nt, Haemophilus influenzae Rd
gcagaaugaaucguuuguucug

SEQ ID NO: 2726237 - RNA, 21 nt, Haemophilus influenzae Rd
gcagaauuucgucaaaaaugu

SEQ ID NO: 2726238 - RNA, 15 nt, Haemophilus influenzae Rd
gcagacaaguuuaau

SEQ ID NO: 2726239 - RNA, 14 nt, Haemophilus influenzae Rd
gcagagaagaaaua

SEQ ID NO: 2726240 - RNA, 20 nt, Haemophilus influenzae Rd
gcagauuauugcacuaauaa

SEQ ID NO: 2726241 - RNA, 20 nt, Haemophilus influenzae Rd
gcagauuuuuauaucuaaau

SEQ ID NO: 2726242 - RNA, 22 nt, Haemophilus influenzae Rd
gcagauuuuuauaucuaaauaa

SEQ ID NO: 2726243 - RNA, 22 nt, Haemophilus influenzae Rd
gcagauuuuuuauuaauaaacu

SEQ ID NO: 2726244 - RNA, 17 nt, Haemophilus influenzae Rd
gcagcagguuuuccuac

SEQ ID NO: 2726245 - RNA, 12 nt, Haemophilus influenzae Rd
gcagcauuuaaa

SEQ ID NO: 2726246 - RNA, 16 nt, Haemophilus influenzae Rd
gcagccauaaaugcua

SEQ ID NO: 2726247 - RNA, 16 nt, Haemophilus influenzae Rd
gcagccgcaacggcag

SEQ ID NO: 2726248 - RNA, 18 nt, Haemophilus influenzae Rd
gcagccuuguucugcagc

SEQ ID NO: 2726249 - RNA, 22 nt, Haemophilus influenzae Rd
gcagcuaacaaaauuaaugcca

SEQ ID NO: 2726250 - RNA, 15 nt, Haemophilus influenzae Rd
gcagcuaauaggcuu

SEQ ID NO: 2726251 - RNA, 15 nt, Haemophilus influenzae Rd
gcaggaauauuagga

SEQ ID NO: 2726252 - RNA, 13 nt, Haemophilus influenzae Rd
gcaggaaugaaag

SEQ ID NO: 2726253 - RNA, 17 nt, Haemophilus influenzae Rd
gcagggaaaaauuuuac

SEQ ID NO: 2726254 - RNA, 20 nt, Haemophilus influenzae Rd
gcagggaaagucgcaguauu

SEQ ID NO: 2726255 - RNA, 15 nt, Haemophilus influenzae Rd
gcaggggauugaaaa

SEQ ID NO: 2726256 - RNA, 23 nt, Haemophilus influenzae Rd
gcagguacacggccguaaugaau

SEQ ID NO: 2726257 - RNA, 19 nt, Haemophilus influenzae Rd
gcaggugagccauuaagaa

SEQ ID NO: 2726258 - RNA, 19 nt, Haemophilus influenzae Rd
gcaggugucacagcaagaa

SEQ ID NO: 2726259 - RNA, 19 nt, Haemophilus influenzae Rd
gcagguuguuuuuguaaaa

SEQ ID NO: 2726260 - RNA, 19 nt, Haemophilus influenzae Rd
gcagguuuuuuauuucuca

SEQ ID NO: 2726261 - RNA, 20 nt, Haemophilus influenzae Rd
gcagguuuuuuauuucucau

SEQ ID NO: 2726262 - RNA, 17 nt, Haemophilus influenzae Rd
gcaguagccuauaacga

SEQ ID NO: 2726263 - RNA, 16 nt, Haemophilus influenzae Rd
gcagugguaaauuuua

SEQ ID NO: 2726264 - RNA, 16 nt, Haemophilus influenzae Rd
gcaguugcuaaaucac

SEQ ID NO: 2726265 - RNA, 17 nt, Haemophilus influenzae Rd
gcaguuucugguuccau

SEQ ID NO: 2726266 - RNA, 23 nt, Haemophilus influenzae Rd
gcaguuucuuuguucacaucaaa

SEQ ID NO: 2726267 - RNA, 13 nt, Haemophilus influenzae Rd
gcauaaaagcacg

SEQ ID NO: 2726268 - RNA, 13 nt, Haemophilus influenzae Rd
gcauaaaauaauu

SEQ ID NO: 2726269 - RNA, 15 nt, Haemophilus influenzae Rd
gcauaaacaaaauaa

SEQ ID NO: 2726270 - RNA, 16 nt, Haemophilus influenzae Rd
gcauaaacuaaaauau

SEQ ID NO: 2726271 - RNA, 17 nt, Haemophilus influenzae Rd
gcauaaggaccaagcaa

SEQ ID NO: 2726272 - RNA, 16 nt, Haemophilus influenzae Rd
gcauaauacuugacaa

SEQ ID NO: 2726273 - RNA, 17 nt, Haemophilus influenzae Rd
gcauacccgcuucuaag

SEQ ID NO: 2726274 - RNA, 19 nt, Haemophilus influenzae Rd
gcauagaaugcaacaagua

SEQ ID NO: 2726275 - RNA, 15 nt, Haemophilus influenzae Rd
gcauagccguucuua

SEQ ID NO: 2726276 - RNA, 18 nt, Haemophilus influenzae Rd
gcauaggugucaauccac

SEQ ID NO: 2726277 - RNA, 18 nt, Haemophilus influenzae Rd
gcauaucacgauaagcaa

SEQ ID NO: 2726278 - RNA, 12 nt, Haemophilus influenzae Rd
gcauaucagcau

SEQ ID NO: 2726279 - RNA, 22 nt, Haemophilus influenzae Rd
gcauaucgauaauuuaacugaa

SEQ ID NO: 2726280 - RNA, 22 nt, Haemophilus influenzae Rd
gcauauguugguaauucagcgc

SEQ ID NO: 2726281 - RNA, 12 nt, Haemophilus influenzae Rd
gcauauuuucca

SEQ ID NO: 2726282 - RNA, 15 nt, Haemophilus influenzae Rd
gcauauuuuguucua

SEQ ID NO: 2726283 - RNA, 14 nt, Haemophilus influenzae Rd
gcaucaaaacguuc

SEQ ID NO: 2726284 - RNA, 21 nt, Haemophilus influenzae Rd
gcaucaaaauaaauaaaauau

SEQ ID NO: 2726285 - RNA, 18 nt, Haemophilus influenzae Rd
gcaucaacauaaauagag

SEQ ID NO: 2726286 - RNA, 14 nt, Haemophilus influenzae Rd
gcaucaacuugauu

SEQ ID NO: 2726287 - RNA, 14 nt, Haemophilus influenzae Rd
gcaucagauccgcg

SEQ ID NO: 2726288 - RNA, 16 nt, Haemophilus influenzae Rd
gcaucagauuuuucgc

SEQ ID NO: 2726289 - RNA, 13 nt, Haemophilus influenzae Rd
gcaucagccaccu

SEQ ID NO: 2726290 - RNA, 21 nt, Haemophilus influenzae Rd
gcauccacaccaccagacaaa

SEQ ID NO: 2726291 - RNA, 16 nt, Haemophilus influenzae Rd
gcauccacuucaucca

SEQ ID NO: 2726292 - RNA, 18 nt, Haemophilus influenzae Rd
gcauccaucgacauacaa

SEQ ID NO: 2726293 - RNA, 15 nt, Haemophilus influenzae Rd
gcauccauucucaaa

SEQ ID NO: 2726294 - RNA, 22 nt, Haemophilus influenzae Rd
gcaucgcccaauuuggcaaaag

SEQ ID NO: 2726295 - RNA, 20 nt, Haemophilus influenzae Rd
gcaucgcuggcuaaauuuuu

SEQ ID NO: 2726296 - RNA, 17 nt, Haemophilus influenzae Rd
gcaucgugaugauuuuc

SEQ ID NO: 2726297 - RNA, 21 nt, Haemophilus influenzae Rd
gcaucguuuacaucacguaag

SEQ ID NO: 2726298 - RNA, 13 nt, Haemophilus influenzae Rd
gcaucugauuuuc

SEQ ID NO: 2726299 - RNA, 15 nt, Haemophilus influenzae Rd
gcaucugauuuucag

SEQ ID NO: 2726300 - RNA, 15 nt, Haemophilus influenzae Rd
gcaucuguaucuuua

SEQ ID NO: 2726301 - RNA, 19 nt, Haemophilus influenzae Rd
gcaucuguugugaaugcaa

SEQ ID NO: 2726302 - RNA, 22 nt, Haemophilus influenzae Rd
gcaucuuuuucuguaauauaug

SEQ ID NO: 2726303 - RNA, 14 nt, Haemophilus influenzae Rd
gcaugaauaucuuc

SEQ ID NO: 2726304 - RNA, 18 nt, Haemophilus influenzae Rd
gcauuaaaucaaauuuag

SEQ ID NO: 2726305 - RNA, 12 nt, Haemophilus influenzae Rd
gcauuaagaagu

SEQ ID NO: 2726306 - RNA, 15 nt, Haemophilus influenzae Rd
gcauuaauaaucuaa

SEQ ID NO: 2726307 - RNA, 21 nt, Haemophilus influenzae Rd
gcauuaauaaucuaauccaaa

SEQ ID NO: 2726308 - RNA, 10 nt, Haemophilus influenzae Rd
gcauuaauag

SEQ ID NO: 2726309 - RNA, 20 nt, Haemophilus influenzae Rd
gcauuaauaggaauaacaca

SEQ ID NO: 2726310 - RNA, 20 nt, Haemophilus influenzae Rd
gcauuacaaagccuugauuc

SEQ ID NO: 2726311 - RNA, 23 nt, Haemophilus influenzae Rd
gcauucacaaaaguuugcaacau

SEQ ID NO: 2726312 - RNA, 15 nt, Haemophilus influenzae Rd
gcauugaguuuuucu

SEQ ID NO: 2726313 - RNA, 18 nt, Haemophilus influenzae Rd
gcauugauugcuaaauaa

SEQ ID NO: 2726314 - RNA, 20 nt, Haemophilus influenzae Rd
gcauugauugcuaaauaaau

SEQ ID NO: 2726315 - RNA, 19 nt, Haemophilus influenzae Rd
gcauugcccgcuucuucga

SEQ ID NO: 2726316 - RNA, 21 nt, Haemophilus influenzae Rd
gcauugcgccuuuuuggaaac

SEQ ID NO: 2726317 - RNA, 15 nt, Haemophilus influenzae Rd
gcauugcugugcgac

SEQ ID NO: 2726318 - RNA, 20 nt, Haemophilus influenzae Rd
gcauuggaaugguauaaaaa

SEQ ID NO: 2726319 - RNA, 20 nt, Haemophilus influenzae Rd
gcauuguaaaccaaauuucu

SEQ ID NO: 2726320 - RNA, 21 nt, Haemophilus influenzae Rd
gcauuguuugcuaauguaguu

SEQ ID NO: 2726321 - RNA, 22 nt, Haemophilus influenzae Rd
gcauuuaaauaaggaucuugua

SEQ ID NO: 2726322 - RNA, 14 nt, Haemophilus influenzae Rd
gcauuuaaauauua

SEQ ID NO: 2726323 - RNA, 23 nt, Haemophilus influenzae Rd
gcauuuacauaaacggcugccgc

SEQ ID NO: 2726324 - RNA, 13 nt, Haemophilus influenzae Rd
gcauuucaagcug

SEQ ID NO: 2726325 - RNA, 17 nt, Haemophilus influenzae Rd
gcauuugcauaaagcau

SEQ ID NO: 2726326 - RNA, 23 nt, Haemophilus influenzae Rd
gcauuugccguaaagauacacgu

SEQ ID NO: 2726327 - RNA, 13 nt, Haemophilus influenzae Rd
gcauuuucuucca

SEQ ID NO: 2726328 - RNA, 17 nt, Haemophilus influenzae Rd
gcauuuuuaauggauuc

SEQ ID NO: 2726329 - RNA, 15 nt, Haemophilus influenzae Rd
gcauuuuucauacaa

SEQ ID NO: 2726330 - RNA, 18 nt, Haemophilus influenzae Rd
gcauuuuucuuuaaaauu

SEQ ID NO: 2726331 - RNA, 16 nt, Haemophilus influenzae Rd
gcauuuuuuauuuuua

SEQ ID NO: 2726332 - RNA, 16 nt, Haemophilus influenzae Rd
gccaaaaaagcccaag

SEQ ID NO: 2726333 - RNA, 15 nt, Haemophilus influenzae Rd
gccaaaaccauucag

SEQ ID NO: 2726334 - RNA, 15 nt, Haemophilus influenzae Rd
gccaaaaucaucaca

SEQ ID NO: 2726335 - RNA, 16 nt, Haemophilus influenzae Rd
gccaaaaugagcuuuu

SEQ ID NO: 2726336 - RNA, 12 nt, Haemophilus influenzae Rd
gccaaaauucug

SEQ ID NO: 2726337 - RNA, 16 nt, Haemophilus influenzae Rd
gccaaaccaucucgaa

SEQ ID NO: 2726338 - RNA, 23 nt, Haemophilus influenzae Rd
gccaaagcauuuagagcaagcaa

SEQ ID NO: 2726339 - RNA, 14 nt, Haemophilus influenzae Rd
gccaaauaugaacu

SEQ ID NO: 2726340 - RNA, 20 nt, Haemophilus influenzae Rd
gccaaauucaguaucaaaua

SEQ ID NO: 2726341 - RNA, 19 nt, Haemophilus influenzae Rd
gccaaauucauucuugcuu

SEQ ID NO: 2726342 - RNA, 18 nt, Haemophilus influenzae Rd
gccaaauuuaaaaaagcc

SEQ ID NO: 2726343 - RNA, 12 nt, Haemophilus influenzae Rd
gccaacaacuua

SEQ ID NO: 2726344 - RNA, 18 nt, Haemophilus influenzae Rd
gccaacgcuuaaugaacu

SEQ ID NO: 2726345 - RNA, 14 nt, Haemophilus influenzae Rd
gccaacguaagcac

SEQ ID NO: 2726346 - RNA, 16 nt, Haemophilus influenzae Rd
gccaacuucuacaccu

SEQ ID NO: 2726347 - RNA, 15 nt, Haemophilus influenzae Rd
gccaagaauaaaaug

SEQ ID NO: 2726348 - RNA, 16 nt, Haemophilus influenzae Rd
gccaaguacaauuaaa

SEQ ID NO: 2726349 - RNA, 18 nt, Haemophilus influenzae Rd
gccaaguccccauuugua

SEQ ID NO: 2726350 - RNA, 21 nt, Haemophilus influenzae Rd
gccaaguccccauuuguagaa

SEQ ID NO: 2726351 - RNA, 22 nt, Haemophilus influenzae Rd
gccaaguccccauuuguagaaa

SEQ ID NO: 2726352 - RNA, 12 nt, Haemophilus influenzae Rd
gccaagugcagc

SEQ ID NO: 2726353 - RNA, 18 nt, Haemophilus influenzae Rd
gccaauaaaaaguacagc

SEQ ID NO: 2726354 - RNA, 16 nt, Haemophilus influenzae Rd
gccaauaauaaagcuc

SEQ ID NO: 2726355 - RNA, 14 nt, Haemophilus influenzae Rd
gccaauagguugca

SEQ ID NO: 2726356 - RNA, 22 nt, Haemophilus influenzae Rd
gccaauauggaacaguugaaaa

SEQ ID NO: 2726357 - RNA, 13 nt, Haemophilus influenzae Rd
gccaaugccucuu

SEQ ID NO: 2726358 - RNA, 16 nt, Haemophilus influenzae Rd
gccaauugaauuaaaa

SEQ ID NO: 2726359 - RNA, 20 nt, Haemophilus influenzae Rd
gccaauuugcauauguuggu

SEQ ID NO: 2726360 - RNA, 16 nt, Haemophilus influenzae Rd
gccacaaauaaacaaa

SEQ ID NO: 2726361 - RNA, 23 nt, Haemophilus influenzae Rd
gccacaacugaagcuucuucacc

SEQ ID NO: 2726362 - RNA, 13 nt, Haemophilus influenzae Rd
gccaccauuuggu

SEQ ID NO: 2726363 - RNA, 19 nt, Haemophilus influenzae Rd
gccaccgguacagaugcca

SEQ ID NO: 2726364 - RNA, 16 nt, Haemophilus influenzae Rd
gccaccuuuuguagaa

SEQ ID NO: 2726365 - RNA, 20 nt, Haemophilus influenzae Rd
gccacugauuauauuguugc

SEQ ID NO: 2726366 - RNA, 18 nt, Haemophilus influenzae Rd
gccacugcccuauuugug

SEQ ID NO: 2726367 - RNA, 14 nt, Haemophilus influenzae Rd
gccacuggugcuga

SEQ ID NO: 2726368 - RNA, 15 nt, Haemophilus influenzae Rd
gccacuguugugaag

SEQ ID NO: 2726369 - RNA, 19 nt, Haemophilus influenzae Rd
gccacuucagcuaauaaag

SEQ ID NO: 2726370 - RNA, 18 nt, Haemophilus influenzae Rd
gccacuucuucaaagauu

SEQ ID NO: 2726371 - RNA, 20 nt, Haemophilus influenzae Rd
gccagaccuaagguuaauuu

SEQ ID NO: 2726372 - RNA, 19 nt, Haemophilus influenzae Rd
gccagauacaaauaacaca

SEQ ID NO: 2726373 - RNA, 20 nt, Haemophilus influenzae Rd
gccagcaccacguucauaaa

SEQ ID NO: 2726374 - RNA, 19 nt, Haemophilus influenzae Rd
gccagcagugccaaccacc

SEQ ID NO: 2726375 - RNA, 15 nt, Haemophilus influenzae Rd
gccagccuggauaag

SEQ ID NO: 2726376 - RNA, 14 nt, Haemophilus influenzae Rd
gccagcuaaagaaa

SEQ ID NO: 2726377 - RNA, 19 nt, Haemophilus influenzae Rd
gccagcuaaagaaagcaau

SEQ ID NO: 2726378 - RNA, 15 nt, Haemophilus influenzae Rd
gccagcuacaucuaa

SEQ ID NO: 2726379 - RNA, 15 nt, Haemophilus influenzae Rd
gccagcuuaagcugg

SEQ ID NO: 2726380 - RNA, 18 nt, Haemophilus influenzae Rd
gccagcuuaagcuggcgu

SEQ ID NO: 2726381 - RNA, 17 nt, Haemophilus influenzae Rd
gccaguaauuuuacagu

SEQ ID NO: 2726382 - RNA, 20 nt, Haemophilus influenzae Rd
gccaguugaaagaauaucaa

SEQ ID NO: 2726383 - RNA, 16 nt, Haemophilus influenzae Rd
gccaguuggguuaaau

SEQ ID NO: 2726384 - RNA, 16 nt, Haemophilus influenzae Rd
gccauaaauaaaucaa

SEQ ID NO: 2726385 - RNA, 17 nt, Haemophilus influenzae Rd
gccauaaauaaaucaau

SEQ ID NO: 2726386 - RNA, 21 nt, Haemophilus influenzae Rd
gccauaauaacgccacccgca

SEQ ID NO: 2726387 - RNA, 13 nt, Haemophilus influenzae Rd
gccauaauaauca

SEQ ID NO: 2726388 - RNA, 18 nt, Haemophilus influenzae Rd
gccauaauaaucacaaca

SEQ ID NO: 2726389 - RNA, 18 nt, Haemophilus influenzae Rd
gccauaggauuauucacc

SEQ ID NO: 2726390 - RNA, 18 nt, Haemophilus influenzae Rd
gccauauaagcaaagaaa

SEQ ID NO: 2726391 - RNA, 23 nt, Haemophilus influenzae Rd
gccauauaagcaaagaaauuuaa

SEQ ID NO: 2726392 - RNA, 17 nt, Haemophilus influenzae Rd
gccauauccguaucauu

SEQ ID NO: 2726393 - RNA, 16 nt, Haemophilus influenzae Rd
gccauauuuucccagu

SEQ ID NO: 2726394 - RNA, 15 nt, Haemophilus influenzae Rd
gccaucaauaaaaag

SEQ ID NO: 2726395 - RNA, 22 nt, Haemophilus influenzae Rd
gccaucacagucuuuuaacaca

SEQ ID NO: 2726396 - RNA, 15 nt, Haemophilus influenzae Rd
gccaucaccaagaau

SEQ ID NO: 2726397 - RNA, 13 nt, Haemophilus influenzae Rd
gccaucaguaaag

SEQ ID NO: 2726398 - RNA, 18 nt, Haemophilus influenzae Rd
gccauggcuuuuuccuga

SEQ ID NO: 2726399 - RNA, 14 nt, Haemophilus influenzae Rd
gccauuaaaauuca

SEQ ID NO: 2726400 - RNA, 14 nt, Haemophilus influenzae Rd
gccauuaccacugc

SEQ ID NO: 2726401 - RNA, 15 nt, Haemophilus influenzae Rd
gccauucacauucuu

SEQ ID NO: 2726402 - RNA, 21 nt, Haemophilus influenzae Rd
gccauugcaccaucguuaaac

SEQ ID NO: 2726403 - RNA, 18 nt, Haemophilus influenzae Rd
gccauugcuagccaauaa

SEQ ID NO: 2726404 - RNA, 20 nt, Haemophilus influenzae Rd
gccauuuucgguuaaguaau

SEQ ID NO: 2726405 - RNA, 21 nt, Haemophilus influenzae Rd
gccauuuucgguuaaguaauc

SEQ ID NO: 2726406 - RNA, 21 nt, Haemophilus influenzae Rd
gccauuuucuaccgcacuuau

SEQ ID NO: 2726407 - RNA, 17 nt, Haemophilus influenzae Rd
gccauuuucugcaucca

SEQ ID NO: 2726408 - RNA, 13 nt, Haemophilus influenzae Rd
gccauuuuuaaaa

SEQ ID NO: 2726409 - RNA, 15 nt, Haemophilus influenzae Rd
gccauuuuuaaaacg

SEQ ID NO: 2726410 - RNA, 14 nt, Haemophilus influenzae Rd
gccauuuuuaaguu

SEQ ID NO: 2726411 - RNA, 14 nt, Haemophilus influenzae Rd
gccauuuuuuccua

SEQ ID NO: 2726412 - RNA, 14 nt, Haemophilus influenzae Rd
gcccaaaugcaaca

SEQ ID NO: 2726413 - RNA, 23 nt, Haemophilus influenzae Rd
gcccaagcgaacaaucgcuuggc

SEQ ID NO: 2726414 - RNA, 14 nt, Haemophilus influenzae Rd
gcccaauccagauu

SEQ ID NO: 2726415 - RNA, 18 nt, Haemophilus influenzae Rd
gcccaaucuagaagauca

SEQ ID NO: 2726416 - RNA, 22 nt, Haemophilus influenzae Rd
gcccacauagcuugaauugcuc

SEQ ID NO: 2726417 - RNA, 13 nt, Haemophilus influenzae Rd
gcccacauuugga

SEQ ID NO: 2726418 - RNA, 23 nt, Haemophilus influenzae Rd
gcccacccuacgauacuuuuaau

SEQ ID NO: 2726419 - RNA, 20 nt, Haemophilus influenzae Rd
gcccacuuuuccuaaaguuu

SEQ ID NO: 2726420 - RNA, 18 nt, Haemophilus influenzae Rd
gcccagagcaccaaauua

SEQ ID NO: 2726421 - RNA, 11 nt, Haemophilus influenzae Rd
gcccagcaauu

SEQ ID NO: 2726422 - RNA, 19 nt, Haemophilus influenzae Rd
gcccauaagugagaaaaua

SEQ ID NO: 2726423 - RNA, 14 nt, Haemophilus influenzae Rd
gcccaucuugccaa

SEQ ID NO: 2726424 - RNA, 15 nt, Haemophilus influenzae Rd
gcccauuagauguga

SEQ ID NO: 2726425 - RNA, 16 nt, Haemophilus influenzae Rd
gcccauuccacaagcc

SEQ ID NO: 2726426 - RNA, 15 nt, Haemophilus influenzae Rd
gcccauuccacccau

SEQ ID NO: 2726427 - RNA, 15 nt, Haemophilus influenzae Rd
gccccaauauuuuuc

SEQ ID NO: 2726428 - RNA, 16 nt, Haemophilus influenzae Rd
gccccagcaagaagca

SEQ ID NO: 2726429 - RNA, 15 nt, Haemophilus influenzae Rd
gcccccccagcgacc

SEQ ID NO: 2726430 - RNA, 18 nt, Haemophilus influenzae Rd
gccccuacuuuaaagaau

SEQ ID NO: 2726431 - RNA, 21 nt, Haemophilus influenzae Rd
gcccgaacagaaagccccagu

SEQ ID NO: 2726432 - RNA, 21 nt, Haemophilus influenzae Rd
gcccuacgccuaauucaucuu

SEQ ID NO: 2726433 - RNA, 14 nt, Haemophilus influenzae Rd
gcccucgccuugca

SEQ ID NO: 2726434 - RNA, 22 nt, Haemophilus influenzae Rd
gcccugaaagucgauucaaaua

SEQ ID NO: 2726435 - RNA, 19 nt, Haemophilus influenzae Rd
gcccugugccguaaaacuc

SEQ ID NO: 2726436 - RNA, 15 nt, Haemophilus influenzae Rd
gcccuguugaaacag

SEQ ID NO: 2726437 - RNA, 18 nt, Haemophilus influenzae Rd
gcccuuaaccaucuuuuu

SEQ ID NO: 2726438 - RNA, 23 nt, Haemophilus influenzae Rd
gcccuuaaccaucuuuuuuugca

SEQ ID NO: 2726439 - RNA, 13 nt, Haemophilus influenzae Rd
gcccuuaauacug

SEQ ID NO: 2726440 - RNA, 15 nt, Haemophilus influenzae Rd
gcccuuuauuuuguu

SEQ ID NO: 2726441 - RNA, 15 nt, Haemophilus influenzae Rd
gcccuuuuucaauua

SEQ ID NO: 2726442 - RNA, 23 nt, Haemophilus influenzae Rd
gccgaaaaugguuacguuuuucc

SEQ ID NO: 2726443 - RNA, 21 nt, Haemophilus influenzae Rd
gccgaauaaacgaccuucauc

SEQ ID NO: 2726444 - RNA, 14 nt, Haemophilus influenzae Rd
gccgacuuuuacau

SEQ ID NO: 2726445 - RNA, 21 nt, Haemophilus influenzae Rd
gccgcaaaaccuaacauaaug

SEQ ID NO: 2726446 - RNA, 12 nt, Haemophilus influenzae Rd
gccgcaccuuga

SEQ ID NO: 2726447 - RNA, 22 nt, Haemophilus influenzae Rd
gccgccuuuuucauauucccaa

SEQ ID NO: 2726448 - RNA, 21 nt, Haemophilus influenzae Rd
gccgcgaugauagaaccaaua

SEQ ID NO: 2726449 - RNA, 14 nt, Haemophilus influenzae Rd
gccgcuaaugguug

SEQ ID NO: 2726450 - RNA, 17 nt, Haemophilus influenzae Rd
gccgcugcaacaaauaa

SEQ ID NO: 2726451 - RNA, 16 nt, Haemophilus influenzae Rd
gccgcugcagcaggaa

SEQ ID NO: 2726452 - RNA, 22 nt, Haemophilus influenzae Rd
gccgcuuguugauuaauacgcu

SEQ ID NO: 2726453 - RNA, 16 nt, Haemophilus influenzae Rd
gccgcuuuuugaucuc

SEQ ID NO: 2726454 - RNA, 12 nt, Haemophilus influenzae Rd
gccguaaugcuu

SEQ ID NO: 2726455 - RNA, 16 nt, Haemophilus influenzae Rd
gccguacuguucuguu

SEQ ID NO: 2726456 - RNA, 15 nt, Haemophilus influenzae Rd
gccguauugaauaau

SEQ ID NO: 2726457 - RNA, 13 nt, Haemophilus influenzae Rd
gccgugauaacaa

SEQ ID NO: 2726458 - RNA, 22 nt, Haemophilus influenzae Rd
gccgugauaacaacucacaaua

SEQ ID NO: 2726459 - RNA, 15 nt, Haemophilus influenzae Rd
gccguuuaguuucaa

SEQ ID NO: 2726460 - RNA, 14 nt, Haemophilus influenzae Rd
gccuaaacacauaa

SEQ ID NO: 2726461 - RNA, 18 nt, Haemophilus influenzae Rd
gccuaaacacauaauauu

SEQ ID NO: 2726462 - RNA, 18 nt, Haemophilus influenzae Rd
gccuaaacgcucuuuaau

SEQ ID NO: 2726463 - RNA, 21 nt, Haemophilus influenzae Rd
gccuaaauacauuuagugcua

SEQ ID NO: 2726464 - RNA, 20 nt, Haemophilus influenzae Rd
gccuaacccccuuaauucua

SEQ ID NO: 2726465 - RNA, 16 nt, Haemophilus influenzae Rd
gccuaagauuuuaucu

SEQ ID NO: 2726466 - RNA, 17 nt, Haemophilus influenzae Rd
gccuaagccaaauccaa

SEQ ID NO: 2726467 - RNA, 15 nt, Haemophilus influenzae Rd
gccuaauaaaaaaua

SEQ ID NO: 2726468 - RNA, 16 nt, Haemophilus influenzae Rd
gccuaauaaaaaauaa

SEQ ID NO: 2726469 - RNA, 14 nt, Haemophilus influenzae Rd
gccuacacgagaau

SEQ ID NO: 2726470 - RNA, 15 nt, Haemophilus influenzae Rd
gccuagauauuucua

SEQ ID NO: 2726471 - RNA, 17 nt, Haemophilus influenzae Rd
gccuauuuuuagaaaau

SEQ ID NO: 2726472 - RNA, 13 nt, Haemophilus influenzae Rd
gccucagcaauuu

SEQ ID NO: 2726473 - RNA, 20 nt, Haemophilus influenzae Rd
gccucagcgugaauauaaga

SEQ ID NO: 2726474 - RNA, 18 nt, Haemophilus influenzae Rd
gccucagguauuucuuca

SEQ ID NO: 2726475 - RNA, 22 nt, Haemophilus influenzae Rd
gccucagguauuucuucaauau

SEQ ID NO: 2726476 - RNA, 17 nt, Haemophilus influenzae Rd
gccucgauauuuauaag

SEQ ID NO: 2726477 - RNA, 14 nt, Haemophilus influenzae Rd
gccucuguauuuuu

SEQ ID NO: 2726478 - RNA, 13 nt, Haemophilus influenzae Rd
gccucuuuaucua

SEQ ID NO: 2726479 - RNA, 14 nt, Haemophilus influenzae Rd
gccucuuuaucuau

SEQ ID NO: 2726480 - RNA, 21 nt, Haemophilus influenzae Rd
gccucuuuaucuauugauucu

SEQ ID NO: 2726481 - RNA, 18 nt, Haemophilus influenzae Rd
gccugaaaaagcuaaaaa

SEQ ID NO: 2726482 - RNA, 21 nt, Haemophilus influenzae Rd
gccugaaaaagcuaaaaaaac

SEQ ID NO: 2726483 - RNA, 22 nt, Haemophilus influenzae Rd
gccugaaaaagcuaaaaaaaca

SEQ ID NO: 2726484 - RNA, 14 nt, Haemophilus influenzae Rd
gccugagcguuaaa

SEQ ID NO: 2726485 - RNA, 15 nt, Haemophilus influenzae Rd
gccugauccacuuac

SEQ ID NO: 2726486 - RNA, 14 nt, Haemophilus influenzae Rd
gccugauucgccaa

SEQ ID NO: 2726487 - RNA, 13 nt, Haemophilus influenzae Rd
gccugcaaauaag

SEQ ID NO: 2726488 - RNA, 14 nt, Haemophilus influenzae Rd
gccugcauuaauaa

SEQ ID NO: 2726489 - RNA, 20 nt, Haemophilus influenzae Rd
gccugcccaaguugugccaa

SEQ ID NO: 2726490 - RNA, 15 nt, Haemophilus influenzae Rd
gccugcgagcaguuu

SEQ ID NO: 2726491 - RNA, 17 nt, Haemophilus influenzae Rd
gccugcuacagaagcug

SEQ ID NO: 2726492 - RNA, 15 nt, Haemophilus influenzae Rd
gccuguuucacaagu

SEQ ID NO: 2726493 - RNA, 21 nt, Haemophilus influenzae Rd
gccuguuucacgaucauaaau

SEQ ID NO: 2726494 - RNA, 17 nt, Haemophilus influenzae Rd
gccuuagccuguucuuc

SEQ ID NO: 2726495 - RNA, 23 nt, Haemophilus influenzae Rd
gccuucacaaacccauuuauaac

SEQ ID NO: 2726496 - RNA, 15 nt, Haemophilus influenzae Rd
gccuucagccugcuc

SEQ ID NO: 2726497 - RNA, 17 nt, Haemophilus influenzae Rd
gccuucauuugcccaua

SEQ ID NO: 2726498 - RNA, 22 nt, Haemophilus influenzae Rd
gccuucgcuauuuuucgcuacg

SEQ ID NO: 2726499 - RNA, 15 nt, Haemophilus influenzae Rd
gccuucuaaaauaag

SEQ ID NO: 2726500 - RNA, 17 nt, Haemophilus influenzae Rd
gccuucuaaaauaagaa

SEQ ID NO: 2726501 - RNA, 11 nt, Haemophilus influenzae Rd
gccuucuucac

SEQ ID NO: 2726502 - RNA, 15 nt, Haemophilus influenzae Rd
gccuugagauguuuc

SEQ ID NO: 2726503 - RNA, 18 nt, Haemophilus influenzae Rd
gccuugaugcucugcaua

SEQ ID NO: 2726504 - RNA, 14 nt, Haemophilus influenzae Rd
gccuugcauaaugc

SEQ ID NO: 2726505 - RNA, 19 nt, Haemophilus influenzae Rd
gccuugcuuuuaauaaugu

SEQ ID NO: 2726506 - RNA, 15 nt, Haemophilus influenzae Rd
gccuugggcuaacau

SEQ ID NO: 2726507 - RNA, 18 nt, Haemophilus influenzae Rd
gccuugugcauaaacaaa

SEQ ID NO: 2726508 - RNA, 19 nt, Haemophilus influenzae Rd
gccuugugcauaaacaaau

SEQ ID NO: 2726509 - RNA, 19 nt, Haemophilus influenzae Rd
gccuuguucugcagcaaga

SEQ ID NO: 2726510 - RNA, 13 nt, Haemophilus influenzae Rd
gccuuuaaaguca

SEQ ID NO: 2726511 - RNA, 17 nt, Haemophilus influenzae Rd
gccuuuccguucauaaa

SEQ ID NO: 2726512 - RNA, 22 nt, Haemophilus influenzae Rd
gccuuugguuggggucagauca

SEQ ID NO: 2726513 - RNA, 17 nt, Haemophilus influenzae Rd
gccuuugucuuauucaa

SEQ ID NO: 2726514 - RNA, 12 nt, Haemophilus influenzae Rd
gccuuuuaaaau

SEQ ID NO: 2726515 - RNA, 19 nt, Haemophilus influenzae Rd
gccuuuuaaaaugaacaaa

SEQ ID NO: 2726516 - RNA, 18 nt, Haemophilus influenzae Rd
gccuuuuaauaaacccuc

SEQ ID NO: 2726517 - RNA, 14 nt, Haemophilus influenzae Rd
gccuuuuaguucgu

SEQ ID NO: 2726518 - RNA, 23 nt, Haemophilus influenzae Rd
gccuuuuugcuuaccaaccgaau

SEQ ID NO: 2726519 - RNA, 19 nt, Haemophilus influenzae Rd
gcgaaccugauaaguagaa

SEQ ID NO: 2726520 - RNA, 17 nt, Haemophilus influenzae Rd
gcgaagagauucuaauu

SEQ ID NO: 2726521 - RNA, 16 nt, Haemophilus influenzae Rd
gcgaaucgcuucagaa

SEQ ID NO: 2726522 - RNA, 17 nt, Haemophilus influenzae Rd
gcgaauuaaagugcaga

SEQ ID NO: 2726523 - RNA, 22 nt, Haemophilus influenzae Rd
gcgaauuuaagaaaaaauauaa

SEQ ID NO: 2726524 - RNA, 19 nt, Haemophilus influenzae Rd
gcgacagaaaccgcauauu

SEQ ID NO: 2726525 - RNA, 23 nt, Haemophilus influenzae Rd
gcgacagaggggauaaaauaaac

SEQ ID NO: 2726526 - RNA, 17 nt, Haemophilus influenzae Rd
gcgacauuaagugcauc

SEQ ID NO: 2726527 - RNA, 17 nt, Haemophilus influenzae Rd
gcgaccauuacagcaag

SEQ ID NO: 2726528 - RNA, 23 nt, Haemophilus influenzae Rd
gcgacucaccgcaauaauaccuu

SEQ ID NO: 2726529 - RNA, 19 nt, Haemophilus influenzae Rd
gcgaggcauucauucauuu

SEQ ID NO: 2726530 - RNA, 15 nt, Haemophilus influenzae Rd
gcgaguaaaauaaaa

SEQ ID NO: 2726531 - RNA, 15 nt, Haemophilus influenzae Rd
gcgagucgcacccgc

SEQ ID NO: 2726532 - RNA, 16 nt, Haemophilus influenzae Rd
gcgauagaaauaaaga

SEQ ID NO: 2726533 - RNA, 14 nt, Haemophilus influenzae Rd
gcgauauucuuuug

SEQ ID NO: 2726534 - RNA, 19 nt, Haemophilus influenzae Rd
gcgaucaccgcccuuuuua

SEQ ID NO: 2726535 - RNA, 15 nt, Haemophilus influenzae Rd
gcgaucacugcaccg

SEQ ID NO: 2726536 - RNA, 21 nt, Haemophilus influenzae Rd
gcgaucgcuccaccaugaaua

SEQ ID NO: 2726537 - RNA, 12 nt, Haemophilus influenzae Rd
gcgaucugcacu

SEQ ID NO: 2726538 - RNA, 12 nt, Haemophilus influenzae Rd
gcgaugaaauua

SEQ ID NO: 2726539 - RNA, 21 nt, Haemophilus influenzae Rd
gcgaugagucgcuuuaucuuc

SEQ ID NO: 2726540 - RNA, 19 nt, Haemophilus influenzae Rd
gcgauggcaguuuggaaag

SEQ ID NO: 2726541 - RNA, 12 nt, Haemophilus influenzae Rd
gcgauguuuucc

SEQ ID NO: 2726542 - RNA, 17 nt, Haemophilus influenzae Rd
gcgauuacugucaaucc

SEQ ID NO: 2726543 - RNA, 12 nt, Haemophilus influenzae Rd
gcgauuaugagu

SEQ ID NO: 2726544 - RNA, 20 nt, Haemophilus influenzae Rd
gcgcaaaacgugcugcagcu

SEQ ID NO: 2726545 - RNA, 18 nt, Haemophilus influenzae Rd
gcgcagcaauuaauaaua

SEQ ID NO: 2726546 - RNA, 13 nt, Haemophilus influenzae Rd
gcgcauuaaacug

SEQ ID NO: 2726547 - RNA, 15 nt, Haemophilus influenzae Rd
gcgcauuuaauacug

SEQ ID NO: 2726548 - RNA, 16 nt, Haemophilus influenzae Rd
gcgccacuuccccaag

SEQ ID NO: 2726549 - RNA, 15 nt, Haemophilus influenzae Rd
gcgcugauuuuucac

SEQ ID NO: 2726550 - RNA, 17 nt, Haemophilus influenzae Rd
gcgcuuagcaauguuuu

SEQ ID NO: 2726551 - RNA, 15 nt, Haemophilus influenzae Rd
gcgcuuucaauuuuc

SEQ ID NO: 2726552 - RNA, 14 nt, Haemophilus influenzae Rd
gcggacuuuuucau

SEQ ID NO: 2726553 - RNA, 22 nt, Haemophilus influenzae Rd
gcggacuuuuucauuaucuuua

SEQ ID NO: 2726554 - RNA, 11 nt, Haemophilus influenzae Rd
gcggagaaaau

SEQ ID NO: 2726555 - RNA, 12 nt, Haemophilus influenzae Rd
gcggauaaaaua

SEQ ID NO: 2726556 - RNA, 13 nt, Haemophilus influenzae Rd
gcggauaaccaaa

SEQ ID NO: 2726557 - RNA, 15 nt, Haemophilus influenzae Rd
gcggauauggauauu

SEQ ID NO: 2726558 - RNA, 18 nt, Haemophilus influenzae Rd
gcggauucgccaaagcua

SEQ ID NO: 2726559 - RNA, 11 nt, Haemophilus influenzae Rd
gcggcaaaaaa

SEQ ID NO: 2726560 - RNA, 21 nt, Haemophilus influenzae Rd
gcggcggaauucaucaagcuc

SEQ ID NO: 2726561 - RNA, 14 nt, Haemophilus influenzae Rd
gcggcuauggcagc

SEQ ID NO: 2726562 - RNA, 18 nt, Haemophilus influenzae Rd
gcggcuauggcagccgca

SEQ ID NO: 2726563 - RNA, 23 nt, Haemophilus influenzae Rd
gcggcuucaucuaagguuucgau

SEQ ID NO: 2726564 - RNA, 13 nt, Haemophilus influenzae Rd
gcgguaaaaaaau

SEQ ID NO: 2726565 - RNA, 14 nt, Haemophilus influenzae Rd
gcgguaaaaauuua

SEQ ID NO: 2726566 - RNA, 20 nt, Haemophilus influenzae Rd
gcgguaaaauuuuuagugau

SEQ ID NO: 2726567 - RNA, 20 nt, Haemophilus influenzae Rd
gcgguaaaucuacuuuauug

SEQ ID NO: 2726568 - RNA, 13 nt, Haemophilus influenzae Rd
gcgguaaauuuuu

SEQ ID NO: 2726569 - RNA, 17 nt, Haemophilus influenzae Rd
gcgguaagaaaaucaac

SEQ ID NO: 2726570 - RNA, 13 nt, Haemophilus influenzae Rd
gcgguaucaaugc

SEQ ID NO: 2726571 - RNA, 21 nt, Haemophilus influenzae Rd
gcgguccguuuucaaugcaaa

SEQ ID NO: 2726572 - RNA, 11 nt, Haemophilus influenzae Rd
gcggugauuuu

SEQ ID NO: 2726573 - RNA, 21 nt, Haemophilus influenzae Rd
gcggugauuuuuuuauuuguu

SEQ ID NO: 2726574 - RNA, 18 nt, Haemophilus influenzae Rd
gcggugcaauuugaaaag

SEQ ID NO: 2726575 - RNA, 17 nt, Haemophilus influenzae Rd
gcgguuaaaauaaaaga

SEQ ID NO: 2726576 - RNA, 15 nt, Haemophilus influenzae Rd
gcgguuaauuuucac

SEQ ID NO: 2726577 - RNA, 23 nt, Haemophilus influenzae Rd
gcgguuauuuaguuuaacuuuuu

SEQ ID NO: 2726578 - RNA, 13 nt, Haemophilus influenzae Rd
gcguaaaaaugcu

SEQ ID NO: 2726579 - RNA, 22 nt, Haemophilus influenzae Rd
gcguaaaaaugcuguuucuaau

SEQ ID NO: 2726580 - RNA, 22 nt, Haemophilus influenzae Rd
gcguaaacauuuuguaucuaaa

SEQ ID NO: 2726581 - RNA, 16 nt, Haemophilus influenzae Rd
gcguaaaguuuuaaac

SEQ ID NO: 2726582 - RNA, 16 nt, Haemophilus influenzae Rd
gcguaaccaaagaaag

SEQ ID NO: 2726583 - RNA, 18 nt, Haemophilus influenzae Rd
gcguaacccaaagcacaa

SEQ ID NO: 2726584 - RNA, 16 nt, Haemophilus influenzae Rd
gcguaagcaccuucaa

SEQ ID NO: 2726585 - RNA, 17 nt, Haemophilus influenzae Rd
gcguaaugccaucacca

SEQ ID NO: 2726586 - RNA, 23 nt, Haemophilus influenzae Rd
gcguacuuuuuuaccuucagcac

SEQ ID NO: 2726587 - RNA, 17 nt, Haemophilus influenzae Rd
gcguagaaugcaaacau

SEQ ID NO: 2726588 - RNA, 20 nt, Haemophilus influenzae Rd
gcguagccuagugcuaaaau

SEQ ID NO: 2726589 - RNA, 14 nt, Haemophilus influenzae Rd
gcguagcugcaggg

SEQ ID NO: 2726590 - RNA, 23 nt, Haemophilus influenzae Rd
gcguaucauacuaaaaaauuaaa

SEQ ID NO: 2726591 - RNA, 21 nt, Haemophilus influenzae Rd
gcguauuuuacggauuuauau

SEQ ID NO: 2726592 - RNA, 22 nt, Haemophilus influenzae Rd
gcgucgcagccuuguucugcag

SEQ ID NO: 2726593 - RNA, 21 nt, Haemophilus influenzae Rd
gcgucuaaugccgccuuaucu

SEQ ID NO: 2726594 - RNA, 14 nt, Haemophilus influenzae Rd
gcgugaaaagcugc

SEQ ID NO: 2726595 - RNA, 20 nt, Haemophilus influenzae Rd
gcgugaauauaagaaaucuc

SEQ ID NO: 2726596 - RNA, 23 nt, Haemophilus influenzae Rd
gcgugagcuugauuuucagcacu

SEQ ID NO: 2726597 - RNA, 16 nt, Haemophilus influenzae Rd
gcguggaggauuaauu

SEQ ID NO: 2726598 - RNA, 23 nt, Haemophilus influenzae Rd
gcguguuucgcgugauuuaggga

SEQ ID NO: 2726599 - RNA, 12 nt, Haemophilus influenzae Rd
gcguuaaaucaa

SEQ ID NO: 2726600 - RNA, 15 nt, Haemophilus influenzae Rd
gcguuaaguaauuuu

SEQ ID NO: 2726601 - RNA, 23 nt, Haemophilus influenzae Rd
gcguuauccaucaagaaaguuuu

SEQ ID NO: 2726602 - RNA, 22 nt, Haemophilus influenzae Rd
gcguucauaucuuuaccuguuu

SEQ ID NO: 2726603 - RNA, 14 nt, Haemophilus influenzae Rd
gcguucaucuuaua

SEQ ID NO: 2726604 - RNA, 19 nt, Haemophilus influenzae Rd
gcguucgauaacaauuuuu

SEQ ID NO: 2726605 - RNA, 20 nt, Haemophilus influenzae Rd
gcguucgauaacaauuuuug

SEQ ID NO: 2726606 - RNA, 14 nt, Haemophilus influenzae Rd
gcguuggcagcuuu

SEQ ID NO: 2726607 - RNA, 20 nt, Haemophilus influenzae Rd
gcguuuaaagucaauggcug

SEQ ID NO: 2726608 - RNA, 16 nt, Haemophilus influenzae Rd
gcguuuaauaucgcca

SEQ ID NO: 2726609 - RNA, 13 nt, Haemophilus influenzae Rd
gcguuucaaaugc

SEQ ID NO: 2726610 - RNA, 23 nt, Haemophilus influenzae Rd
gcguuugguucaucauuugcucu

SEQ ID NO: 2726611 - RNA, 12 nt, Haemophilus influenzae Rd
gcguuuuaaaau

SEQ ID NO: 2726612 - RNA, 14 nt, Haemophilus influenzae Rd
gcguuuuucugggu

SEQ ID NO: 2726613 - RNA, 14 nt, Haemophilus influenzae Rd
gcguuuuuuauaaa

SEQ ID NO: 2726614 - RNA, 12 nt, Haemophilus influenzae Rd
gcguuuuuucuu

SEQ ID NO: 2726615 - RNA, 22 nt, Haemophilus influenzae Rd
gcguuuuuuuaucauagagcca

SEQ ID NO: 2726616 - RNA, 19 nt, Haemophilus influenzae Rd
gcuaaaaagaaauaaaaga

SEQ ID NO: 2726617 - RNA, 23 nt, Haemophilus influenzae Rd
gcuaaaacagaaguugaaaauaa

SEQ ID NO: 2726618 - RNA, 19 nt, Haemophilus influenzae Rd
gcuaaaauaaaaccuucug

SEQ ID NO: 2726619 - RNA, 13 nt, Haemophilus influenzae Rd
gcuaaaauuaaag

SEQ ID NO: 2726620 - RNA, 22 nt, Haemophilus influenzae Rd
gcuaaacuuuucgcaaaauauc

SEQ ID NO: 2726621 - RNA, 20 nt, Haemophilus influenzae Rd
gcuaaaggaauggcaaagaa

SEQ ID NO: 2726622 - RNA, 22 nt, Haemophilus influenzae Rd
gcuaaaguucucaaaaaguuaa

SEQ ID NO: 2726623 - RNA, 14 nt, Haemophilus influenzae Rd
gcuaaaucaccuaa

SEQ ID NO: 2726624 - RNA, 24 nt, Haemophilus influenzae Rd
gcuaaaucauaagcaauaauuuca

SEQ ID NO: 2726625 - RNA, 12 nt, Haemophilus influenzae Rd
gcuaaauccaga

SEQ ID NO: 2726626 - RNA, 20 nt, Haemophilus influenzae Rd
gcuaaaucuguuucauuugu

SEQ ID NO: 2726627 - RNA, 22 nt, Haemophilus influenzae Rd
gcuaaaucuguuucauuuguua

SEQ ID NO: 2726628 - RNA, 19 nt, Haemophilus influenzae Rd
gcuaaauuccccaagguau

SEQ ID NO: 2726629 - RNA, 17 nt, Haemophilus influenzae Rd
gcuaaauuuuuuugcau

SEQ ID NO: 2726630 - RNA, 15 nt, Haemophilus influenzae Rd
gcuaacaaauaaugc

SEQ ID NO: 2726631 - RNA, 16 nt, Haemophilus influenzae Rd
gcuaacaaauaaugcc

SEQ ID NO: 2726632 - RNA, 14 nt, Haemophilus influenzae Rd
gcuaacaaauuuaa

SEQ ID NO: 2726633 - RNA, 20 nt, Haemophilus influenzae Rd
gcuaacauaucaauuacgua

SEQ ID NO: 2726634 - RNA, 20 nt, Haemophilus influenzae Rd
gcuaacauugcaucagccac

SEQ ID NO: 2726635 - RNA, 15 nt, Haemophilus influenzae Rd
gcuaacucaucaaca

SEQ ID NO: 2726636 - RNA, 15 nt, Haemophilus influenzae Rd
gcuaacuggcaauac

SEQ ID NO: 2726637 - RNA, 22 nt, Haemophilus influenzae Rd
gcuaagacaccugcaagugcgg

SEQ ID NO: 2726638 - RNA, 14 nt, Haemophilus influenzae Rd
gcuaagacauucau

SEQ ID NO: 2726639 - RNA, 13 nt, Haemophilus influenzae Rd
gcuaagccaauaa

SEQ ID NO: 2726640 - RNA, 15 nt, Haemophilus influenzae Rd
gcuaaggcaaaaaaa

SEQ ID NO: 2726641 - RNA, 16 nt, Haemophilus influenzae Rd
gcuaaguacaaaagag

SEQ ID NO: 2726642 - RNA, 14 nt, Haemophilus influenzae Rd
gcuaaguuugcuau

SEQ ID NO: 2726643 - RNA, 15 nt, Haemophilus influenzae Rd
gcuaauaauaaaaag

SEQ ID NO: 2726644 - RNA, 17 nt, Haemophilus influenzae Rd
gcuaauaaucuauuucu

SEQ ID NO: 2726645 - RNA, 17 nt, Haemophilus influenzae Rd
gcuaauccaauuucaca

SEQ ID NO: 2726646 - RNA, 22 nt, Haemophilus influenzae Rd
gcuaaucgcccuauuaaaacag

SEQ ID NO: 2726647 - RNA, 12 nt, Haemophilus influenzae Rd
gcuaauucuucu

SEQ ID NO: 2726648 - RNA, 17 nt, Haemophilus influenzae Rd
gcuaauuuaagaaaaac

SEQ ID NO: 2726649 - RNA, 20 nt, Haemophilus influenzae Rd
gcuaauuuaagaaaaacgcc

SEQ ID NO: 2726650 - RNA, 14 nt, Haemophilus influenzae Rd
gcuaauuuuuaaaa

SEQ ID NO: 2726651 - RNA, 15 nt, Haemophilus influenzae Rd
gcuacaaauaagcca

SEQ ID NO: 2726652 - RNA, 15 nt, Haemophilus influenzae Rd
gcuacacccacuuca

SEQ ID NO: 2726653 - RNA, 16 nt, Haemophilus influenzae Rd
gcuacagcaaauccuu

SEQ ID NO: 2726654 - RNA, 11 nt, Haemophilus influenzae Rd
gcuacagugag

SEQ ID NO: 2726655 - RNA, 19 nt, Haemophilus influenzae Rd
gcuacaucaacaaauguca

SEQ ID NO: 2726656 - RNA, 15 nt, Haemophilus influenzae Rd
gcuaccuucaaccac

SEQ ID NO: 2726657 - RNA, 21 nt, Haemophilus influenzae Rd
gcuacgaaccgagcggucaga

SEQ ID NO: 2726658 - RNA, 23 nt, Haemophilus influenzae Rd
gcuacguuagagaauaaguaguu

SEQ ID NO: 2726659 - RNA, 14 nt, Haemophilus influenzae Rd
gcuacguuugcacg

SEQ ID NO: 2726660 - RNA, 20 nt, Haemophilus influenzae Rd
gcuacuuuuagcuaaaacua

SEQ ID NO: 2726661 - RNA, 14 nt, Haemophilus influenzae Rd
gcuagccaauaauc

SEQ ID NO: 2726662 - RNA, 22 nt, Haemophilus influenzae Rd
gcuagcgaauuagguugaauuu

SEQ ID NO: 2726663 - RNA, 14 nt, Haemophilus influenzae Rd
gcuaguucuuccuu

SEQ ID NO: 2726664 - RNA, 22 nt, Haemophilus influenzae Rd
gcuaguucuuccuugguuaauc

SEQ ID NO: 2726665 - RNA, 20 nt, Haemophilus influenzae Rd
gcuauaaaucguauaagccc

SEQ ID NO: 2726666 - RNA, 22 nt, Haemophilus influenzae Rd
gcuauaaguaacuuuagaacau

SEQ ID NO: 2726667 - RNA, 21 nt, Haemophilus influenzae Rd
gcuaucaggcuuaacuuucuc

SEQ ID NO: 2726668 - RNA, 19 nt, Haemophilus influenzae Rd
gcuauccaaccuaauaacg

SEQ ID NO: 2726669 - RNA, 18 nt, Haemophilus influenzae Rd
gcuaucgucaaauuuaaa

SEQ ID NO: 2726670 - RNA, 20 nt, Haemophilus influenzae Rd
gcuaucuuuugguaaauacu

SEQ ID NO: 2726671 - RNA, 18 nt, Haemophilus influenzae Rd
gcuauggcaaugaauaaa

SEQ ID NO: 2726672 - RNA, 20 nt, Haemophilus influenzae Rd
gcuauggcaaugaauaaaca

SEQ ID NO: 2726673 - RNA, 14 nt, Haemophilus influenzae Rd
gcuauuaaaaaaag

SEQ ID NO: 2726674 - RNA, 16 nt, Haemophilus influenzae Rd
gcuauuaaaaaaagca

SEQ ID NO: 2726675 - RNA, 19 nt, Haemophilus influenzae Rd
gcuauuacuuacuacuuug

SEQ ID NO: 2726676 - RNA, 21 nt, Haemophilus influenzae Rd
gcuauuaguaauaaauucaaa

SEQ ID NO: 2726677 - RNA, 20 nt, Haemophilus influenzae Rd
gcuauuaucauaaacaauuu

SEQ ID NO: 2726678 - RNA, 21 nt, Haemophilus influenzae Rd
gcuauuuuauaauuaauaaaa

SEQ ID NO: 2726679 - RNA, 16 nt, Haemophilus influenzae Rd
gcuauuuuauuuagaa

SEQ ID NO: 2726680 - RNA, 19 nt, Haemophilus influenzae Rd
gcuauuuucuaaugaaauu

SEQ ID NO: 2726681 - RNA, 12 nt, Haemophilus influenzae Rd
gcucaaaaugcu

SEQ ID NO: 2726682 - RNA, 11 nt, Haemophilus influenzae Rd
gcucaaauaaa

SEQ ID NO: 2726683 - RNA, 23 nt, Haemophilus influenzae Rd
gcucaaauaaauugcccucugca

SEQ ID NO: 2726684 - RNA, 15 nt, Haemophilus influenzae Rd
gcucaagccuuuggu

SEQ ID NO: 2726685 - RNA, 12 nt, Haemophilus influenzae Rd
gcucaauuucug

SEQ ID NO: 2726686 - RNA, 22 nt, Haemophilus influenzae Rd
gcucacacugauuguggugaga

SEQ ID NO: 2726687 - RNA, 21 nt, Haemophilus influenzae Rd
gcucacggguuggaagaaugu

SEQ ID NO: 2726688 - RNA, 15 nt, Haemophilus influenzae Rd
gcucacuaauucccc

SEQ ID NO: 2726689 - RNA, 20 nt, Haemophilus influenzae Rd
gcucagccaguuuucuagcu

SEQ ID NO: 2726690 - RNA, 17 nt, Haemophilus influenzae Rd
gcucaggaaaacguuca

SEQ ID NO: 2726691 - RNA, 19 nt, Haemophilus influenzae Rd
gcucaguugguagagcacg

SEQ ID NO: 2726692 - RNA, 14 nt, Haemophilus influenzae Rd
gcuccaaucaucau

SEQ ID NO: 2726693 - RNA, 16 nt, Haemophilus influenzae Rd
gcuccaaucaucaucc

SEQ ID NO: 2726694 - RNA, 19 nt, Haemophilus influenzae Rd
gcuccaguaagcauauuug

SEQ ID NO: 2726695 - RNA, 19 nt, Haemophilus influenzae Rd
gcuccccuucauaagcccc

SEQ ID NO: 2726696 - RNA, 18 nt, Haemophilus influenzae Rd
gcuccgccaccuacgccu

SEQ ID NO: 2726697 - RNA, 20 nt, Haemophilus influenzae Rd
gcucgaaaucacaggcuuca

SEQ ID NO: 2726698 - RNA, 13 nt, Haemophilus influenzae Rd
gcucgccaauaaa

SEQ ID NO: 2726699 - RNA, 18 nt, Haemophilus influenzae Rd
gcucgccaauaaaauguu

SEQ ID NO: 2726700 - RNA, 19 nt, Haemophilus influenzae Rd
gcucgccaauaaaauguua

SEQ ID NO: 2726701 - RNA, 21 nt, Haemophilus influenzae Rd
gcucgcuccccuucauaagcc

SEQ ID NO: 2726702 - RNA, 22 nt, Haemophilus influenzae Rd
gcucgcuccccuucauaagccc

SEQ ID NO: 2726703 - RNA, 21 nt, Haemophilus influenzae Rd
gcucgcuuuuguauuggguaa

SEQ ID NO: 2726704 - RNA, 14 nt, Haemophilus influenzae Rd
gcucggaauguuuu

SEQ ID NO: 2726705 - RNA, 17 nt, Haemophilus influenzae Rd
gcucggucgauggcugg

SEQ ID NO: 2726706 - RNA, 19 nt, Haemophilus influenzae Rd
gcucguauaauauuuucuu

SEQ ID NO: 2726707 - RNA, 16 nt, Haemophilus influenzae Rd
gcucgugauuaucuaa

SEQ ID NO: 2726708 - RNA, 17 nt, Haemophilus influenzae Rd
gcucguuguagcccaau

SEQ ID NO: 2726709 - RNA, 18 nt, Haemophilus influenzae Rd
gcucuaaauuaauuuacu

SEQ ID NO: 2726710 - RNA, 17 nt, Haemophilus influenzae Rd
gcucuaccaacugagcu

SEQ ID NO: 2726711 - RNA, 16 nt, Haemophilus influenzae Rd
gcucuaccuaaaauaa

SEQ ID NO: 2726712 - RNA, 12 nt, Haemophilus influenzae Rd
gcucuagaaaau

SEQ ID NO: 2726713 - RNA, 22 nt, Haemophilus influenzae Rd
gcucuagcucucguuguucuuu

SEQ ID NO: 2726714 - RNA, 16 nt, Haemophilus influenzae Rd
gcucugaucacaauga

SEQ ID NO: 2726715 - RNA, 12 nt, Haemophilus influenzae Rd
gcucugcaccuu

SEQ ID NO: 2726716 - RNA, 14 nt, Haemophilus influenzae Rd
gcucuguaaaacau

SEQ ID NO: 2726717 - RNA, 23 nt, Haemophilus influenzae Rd
gcucuguaaaacauuucaucgca

SEQ ID NO: 2726718 - RNA, 13 nt, Haemophilus influenzae Rd
gcucuguauuuug

SEQ ID NO: 2726719 - RNA, 18 nt, Haemophilus influenzae Rd
gcucuucagcuucuucau

SEQ ID NO: 2726720 - RNA, 14 nt, Haemophilus influenzae Rd
gcucuucaucaaaa

SEQ ID NO: 2726721 - RNA, 15 nt, Haemophilus influenzae Rd
gcucuuggauuuuuu

SEQ ID NO: 2726722 - RNA, 14 nt, Haemophilus influenzae Rd
gcucuuuaacaaau

SEQ ID NO: 2726723 - RNA, 15 nt, Haemophilus influenzae Rd
gcucuuuaacaaauu

SEQ ID NO: 2726724 - RNA, 14 nt, Haemophilus influenzae Rd
gcucuuuuaucucg

SEQ ID NO: 2726725 - RNA, 18 nt, Haemophilus influenzae Rd
gcucuuuucggugcuuga

SEQ ID NO: 2726726 - RNA, 18 nt, Haemophilus influenzae Rd
gcucuuuuuauuuagaac

SEQ ID NO: 2726727 - RNA, 15 nt, Haemophilus influenzae Rd
gcucuuuuuguugau

SEQ ID NO: 2726728 - RNA, 16 nt, Haemophilus influenzae Rd
gcucuuuuuguugauc

SEQ ID NO: 2726729 - RNA, 23 nt, Haemophilus influenzae Rd
gcucuuuuuguugaucuaacguu

SEQ ID NO: 2726730 - RNA, 19 nt, Haemophilus influenzae Rd
gcugaaagaaauuuuaucc

SEQ ID NO: 2726731 - RNA, 16 nt, Haemophilus influenzae Rd
gcugaagucguuucau

SEQ ID NO: 2726732 - RNA, 15 nt, Haemophilus influenzae Rd
gcugaauagcaaaua

SEQ ID NO: 2726733 - RNA, 13 nt, Haemophilus influenzae Rd
gcugacaaauuug

SEQ ID NO: 2726734 - RNA, 19 nt, Haemophilus influenzae Rd
gcugacaaauuuguugauc

SEQ ID NO: 2726735 - RNA, 20 nt, Haemophilus influenzae Rd
gcugacauaaauacaccacu

SEQ ID NO: 2726736 - RNA, 16 nt, Haemophilus influenzae Rd
gcugacgguucaguuu

SEQ ID NO: 2726737 - RNA, 22 nt, Haemophilus influenzae Rd
gcugacguguaaaucuaaaaua

SEQ ID NO: 2726738 - RNA, 23 nt, Haemophilus influenzae Rd
gcugauaauaaagcuacuaaaaa

SEQ ID NO: 2726739 - RNA, 12 nt, Haemophilus influenzae Rd
gcugauauaaaa

SEQ ID NO: 2726740 - RNA, 22 nt, Haemophilus influenzae Rd
gcugaucuugguagaaaauuug

SEQ ID NO: 2726741 - RNA, 16 nt, Haemophilus influenzae Rd
gcugauucuaaugcca

SEQ ID NO: 2726742 - RNA, 12 nt, Haemophilus influenzae Rd
gcugauuuaccu

SEQ ID NO: 2726743 - RNA, 19 nt, Haemophilus influenzae Rd
gcugauuuuuuaaaguaau

SEQ ID NO: 2726744 - RNA, 12 nt, Haemophilus influenzae Rd
gcugcaauaauu

SEQ ID NO: 2726745 - RNA, 17 nt, Haemophilus influenzae Rd
gcugcacaagcaccacu

SEQ ID NO: 2726746 - RNA, 15 nt, Haemophilus influenzae Rd
gcugcagcugcugcu

SEQ ID NO: 2726747 - RNA, 21 nt, Haemophilus influenzae Rd
gcugcaguacuuucacaccca

SEQ ID NO: 2726748 - RNA, 15 nt, Haemophilus influenzae Rd
gcugcauaaagcuca

SEQ ID NO: 2726749 - RNA, 19 nt, Haemophilus influenzae Rd
gcugcauaaagcucagcca

SEQ ID NO: 2726750 - RNA, 16 nt, Haemophilus influenzae Rd
gcugcaugaagaacuu

SEQ ID NO: 2726751 - RNA, 15 nt, Haemophilus influenzae Rd
gcugccuaacccccu

SEQ ID NO: 2726752 - RNA, 21 nt, Haemophilus influenzae Rd
gcugccucuucauuguggaaa

SEQ ID NO: 2726753 - RNA, 16 nt, Haemophilus influenzae Rd
gcugcuacaauuucau

SEQ ID NO: 2726754 - RNA, 22 nt, Haemophilus influenzae Rd
gcugcucuaccgacugagcuaa

SEQ ID NO: 2726755 - RNA, 15 nt, Haemophilus influenzae Rd
gcugcugaauuuguu

SEQ ID NO: 2726756 - RNA, 14 nt, Haemophilus influenzae Rd
gcugcugcaccaga

SEQ ID NO: 2726757 - RNA, 19 nt, Haemophilus influenzae Rd
gcugcugcaccagagaaaa

SEQ ID NO: 2726758 - RNA, 13 nt, Haemophilus influenzae Rd
gcugcuuaaagca

SEQ ID NO: 2726759 - RNA, 18 nt, Haemophilus influenzae Rd
gcugcuugauauaauauu

SEQ ID NO: 2726760 - RNA, 14 nt, Haemophilus influenzae Rd
gcuggaauauggaa

SEQ ID NO: 2726761 - RNA, 16 nt, Haemophilus influenzae Rd
gcuggaauauuuuucu

SEQ ID NO: 2726762 - RNA, 19 nt, Haemophilus influenzae Rd
gcuggcguuuuuuauaaac

SEQ ID NO: 2726763 - RNA, 13 nt, Haemophilus influenzae Rd
gcuggcuaaauuu

SEQ ID NO: 2726764 - RNA, 21 nt, Haemophilus influenzae Rd
gcuggcuaacaaauaaugccu

SEQ ID NO: 2726765 - RNA, 22 nt, Haemophilus influenzae Rd
gcugggaauacgcgucuuucug

SEQ ID NO: 2726766 - RNA, 17 nt, Haemophilus influenzae Rd
gcuguaaaaaaucuuua

SEQ ID NO: 2726767 - RNA, 12 nt, Haemophilus influenzae Rd
gcuguaaaucgc

SEQ ID NO: 2726768 - RNA, 14 nt, Haemophilus influenzae Rd
gcuguaaaucuuua

SEQ ID NO: 2726769 - RNA, 22 nt, Haemophilus influenzae Rd
gcuguaaugaucacuucauaaa

SEQ ID NO: 2726770 - RNA, 14 nt, Haemophilus influenzae Rd
gcuguaccagcgau

SEQ ID NO: 2726771 - RNA, 14 nt, Haemophilus influenzae Rd
gcuguagaaauuaa

SEQ ID NO: 2726772 - RNA, 23 nt, Haemophilus influenzae Rd
gcugucaaacgaaaaaaauaaaa

SEQ ID NO: 2726773 - RNA, 15 nt, Haemophilus influenzae Rd
gcuguccaauauaaa

SEQ ID NO: 2726774 - RNA, 17 nt, Haemophilus influenzae Rd
gcugucgcuucuaauuc

SEQ ID NO: 2726775 - RNA, 14 nt, Haemophilus influenzae Rd
gcugucuaauuuuu

SEQ ID NO: 2726776 - RNA, 16 nt, Haemophilus influenzae Rd
gcugugcaagcauuuc

SEQ ID NO: 2726777 - RNA, 13 nt, Haemophilus influenzae Rd
gcuguguaaaaca

SEQ ID NO: 2726778 - RNA, 15 nt, Haemophilus influenzae Rd
gcuguguaagcuggc

SEQ ID NO: 2726779 - RNA, 20 nt, Haemophilus influenzae Rd
gcuguguugauauucaauuu

SEQ ID NO: 2726780 - RNA, 16 nt, Haemophilus influenzae Rd
gcuguucuucuaaugu

SEQ ID NO: 2726781 - RNA, 15 nt, Haemophilus influenzae Rd
gcuguugguuaaaaa

SEQ ID NO: 2726782 - RNA, 22 nt, Haemophilus influenzae Rd
gcuguugugaguaagucuucuu

SEQ ID NO: 2726783 - RNA, 19 nt, Haemophilus influenzae Rd
gcuguuuaaaucuaagccu

SEQ ID NO: 2726784 - RNA, 19 nt, Haemophilus influenzae Rd
gcuguuucaaugucuuuuu

SEQ ID NO: 2726785 - RNA, 14 nt, Haemophilus influenzae Rd
gcuguuuucaauuu

SEQ ID NO: 2726786 - RNA, 23 nt, Haemophilus influenzae Rd
gcuguuuuuccgcuaaugcccac

SEQ ID NO: 2726787 - RNA, 14 nt, Haemophilus influenzae Rd
gcuuaaagcaauca

SEQ ID NO: 2726788 - RNA, 18 nt, Haemophilus influenzae Rd
gcuuaaaugaucuaaugg

SEQ ID NO: 2726789 - RNA, 20 nt, Haemophilus influenzae Rd
gcuuaaccaucacaaaggaa

SEQ ID NO: 2726790 - RNA, 14 nt, Haemophilus influenzae Rd
gcuuaagccuuuau

SEQ ID NO: 2726791 - RNA, 13 nt, Haemophilus influenzae Rd
gcuuaagucagca

SEQ ID NO: 2726792 - RNA, 21 nt, Haemophilus influenzae Rd
gcuuaagucagcauaaacaaa

SEQ ID NO: 2726793 - RNA, 16 nt, Haemophilus influenzae Rd
gcuuaauucuugccau

SEQ ID NO: 2726794 - RNA, 19 nt, Haemophilus influenzae Rd
gcuuaauugcuguuagcaa

SEQ ID NO: 2726795 - RNA, 15 nt, Haemophilus influenzae Rd
gcuuacaaaauauac

SEQ ID NO: 2726796 - RNA, 16 nt, Haemophilus influenzae Rd
gcuuacagcaaaagca

SEQ ID NO: 2726797 - RNA, 17 nt, Haemophilus influenzae Rd
gcuuaccuuaauuaauc

SEQ ID NO: 2726798 - RNA, 22 nt, Haemophilus influenzae Rd
gcuuaccuuaauuaaucuuuuu

SEQ ID NO: 2726799 - RNA, 20 nt, Haemophilus influenzae Rd
gcuuacucauuuaucaaaca

SEQ ID NO: 2726800 - RNA, 12 nt, Haemophilus influenzae Rd
gcuuagugaaaa

SEQ ID NO: 2726801 - RNA, 21 nt, Haemophilus influenzae Rd
gcuuauaagcuguauuacuua

SEQ ID NO: 2726802 - RNA, 18 nt, Haemophilus influenzae Rd
gcuuaucuaacuaaaaua

SEQ ID NO: 2726803 - RNA, 21 nt, Haemophilus influenzae Rd
gcuuaucuacugcuucauaaa

SEQ ID NO: 2726804 - RNA, 22 nt, Haemophilus influenzae Rd
gcuuauggagggggauaacgac

SEQ ID NO: 2726805 - RNA, 17 nt, Haemophilus influenzae Rd
gcuuauuuacuuuauaa

SEQ ID NO: 2726806 - RNA, 18 nt, Haemophilus influenzae Rd
gcuuauuuacuuuauaaa

SEQ ID NO: 2726807 - RNA, 19 nt, Haemophilus influenzae Rd
gcuucaaaaucaccauauu

SEQ ID NO: 2726808 - RNA, 16 nt, Haemophilus influenzae Rd
gcuucagaaaauaaau

SEQ ID NO: 2726809 - RNA, 22 nt, Haemophilus influenzae Rd
gcuucaguauccgccaaugcuu

SEQ ID NO: 2726810 - RNA, 18 nt, Haemophilus influenzae Rd
gcuucauaaaaaccuguu

SEQ ID NO: 2726811 - RNA, 21 nt, Haemophilus influenzae Rd
gcuucaucagccgcuuuuuga

SEQ ID NO: 2726812 - RNA, 15 nt, Haemophilus influenzae Rd
gcuuccaacauaugc

SEQ ID NO: 2726813 - RNA, 15 nt, Haemophilus influenzae Rd
gcuuccagaaaauug

SEQ ID NO: 2726814 - RNA, 13 nt, Haemophilus influenzae Rd
gcuuccauuugga

SEQ ID NO: 2726815 - RNA, 19 nt, Haemophilus influenzae Rd
gcuuccauuuggaauacuc

SEQ ID NO: 2726816 - RNA, 22 nt, Haemophilus influenzae Rd
gcuucgccauuuuuaaaaauaa

SEQ ID NO: 2726817 - RNA, 17 nt, Haemophilus influenzae Rd
gcuucgcgcuaaaucau

SEQ ID NO: 2726818 - RNA, 14 nt, Haemophilus influenzae Rd
gcuucuaauuuuug

SEQ ID NO: 2726819 - RNA, 17 nt, Haemophilus influenzae Rd
gcuucuaauuuuugcaa

SEQ ID NO: 2726820 - RNA, 22 nt, Haemophilus influenzae Rd
gcuucuaauuuuugcaauggcu

SEQ ID NO: 2726821 - RNA, 22 nt, Haemophilus influenzae Rd
gcuucuucaucgcucaucguau

SEQ ID NO: 2726822 - RNA, 18 nt, Haemophilus influenzae Rd
gcuucuucgauaaaaucu

SEQ ID NO: 2726823 - RNA, 16 nt, Haemophilus influenzae Rd
gcuucuuuaucggcaa

SEQ ID NO: 2726824 - RNA, 13 nt, Haemophilus influenzae Rd
gcuugaacaaaaa

SEQ ID NO: 2726825 - RNA, 15 nt, Haemophilus influenzae Rd
gcuugaauaaauccc

SEQ ID NO: 2726826 - RNA, 15 nt, Haemophilus influenzae Rd
gcuugaauaaaugac

SEQ ID NO: 2726827 - RNA, 19 nt, Haemophilus influenzae Rd
gcuugaauugcuccuccua

SEQ ID NO: 2726828 - RNA, 17 nt, Haemophilus influenzae Rd
gcuugagcugcugcaag

SEQ ID NO: 2726829 - RNA, 22 nt, Haemophilus influenzae Rd
gcuugaguuucgccagcaccac

SEQ ID NO: 2726830 - RNA, 22 nt, Haemophilus influenzae Rd
gcuugauaaccuucaaugguuu

SEQ ID NO: 2726831 - RNA, 22 nt, Haemophilus influenzae Rd
gcuugauacauuucuaaaauaa

SEQ ID NO: 2726832 - RNA, 15 nt, Haemophilus influenzae Rd
gcuugaugucaguga

SEQ ID NO: 2726833 - RNA, 17 nt, Haemophilus influenzae Rd
gcuugaugucagugaau

SEQ ID NO: 2726834 - RNA, 21 nt, Haemophilus influenzae Rd
gcuugcauucacaaaaguuug

SEQ ID NO: 2726835 - RNA, 15 nt, Haemophilus influenzae Rd
gcuugcauuucuuca

SEQ ID NO: 2726836 - RNA, 20 nt, Haemophilus influenzae Rd
gcuugccaauugaauuaaaa

SEQ ID NO: 2726837 - RNA, 19 nt, Haemophilus influenzae Rd
gcuugcgguugaauuucuu

SEQ ID NO: 2726838 - RNA, 11 nt, Haemophilus influenzae Rd
gcuugcucaau

SEQ ID NO: 2726839 - RNA, 16 nt, Haemophilus influenzae Rd
gcuugcuguucgauuu

SEQ ID NO: 2726840 - RNA, 15 nt, Haemophilus influenzae Rd
gcuuggaaauguuua

SEQ ID NO: 2726841 - RNA, 18 nt, Haemophilus influenzae Rd
gcuuggaauaaauuaauu

SEQ ID NO: 2726842 - RNA, 17 nt, Haemophilus influenzae Rd
gcuuggauauucugcau

SEQ ID NO: 2726843 - RNA, 15 nt, Haemophilus influenzae Rd
gcuugggaaucuggc

SEQ ID NO: 2726844 - RNA, 21 nt, Haemophilus influenzae Rd
gcuugggcgauggcucgcucc

SEQ ID NO: 2726845 - RNA, 22 nt, Haemophilus influenzae Rd
gcuugguaauaaucaauuaaug

SEQ ID NO: 2726846 - RNA, 18 nt, Haemophilus influenzae Rd
gcuugugaaauaaaauau

SEQ ID NO: 2726847 - RNA, 23 nt, Haemophilus influenzae Rd
gcuugugcuauacaaaauuuugu

SEQ ID NO: 2726848 - RNA, 16 nt, Haemophilus influenzae Rd
gcuuguucagcaacau

SEQ ID NO: 2726849 - RNA, 19 nt, Haemophilus influenzae Rd
gcuuguuucaucauucugg

SEQ ID NO: 2726850 - RNA, 13 nt, Haemophilus influenzae Rd
gcuuuaaauuguu

SEQ ID NO: 2726851 - RNA, 22 nt, Haemophilus influenzae Rd
gcuuuaacccauuuauuuaaau

SEQ ID NO: 2726852 - RNA, 17 nt, Haemophilus influenzae Rd
gcuuuaaguaaaaguaa

SEQ ID NO: 2726853 - RNA, 22 nt, Haemophilus influenzae Rd
gcuuuaauucgugcaaauuuuu

SEQ ID NO: 2726854 - RNA, 13 nt, Haemophilus influenzae Rd
gcuuuaauuucuu

SEQ ID NO: 2726855 - RNA, 17 nt, Haemophilus influenzae Rd
gcuuuaauuuuaucuaa

SEQ ID NO: 2726856 - RNA, 12 nt, Haemophilus influenzae Rd
gcuuuacaauga

SEQ ID NO: 2726857 - RNA, 13 nt, Haemophilus influenzae Rd
gcuuuaccuuuua

SEQ ID NO: 2726858 - RNA, 23 nt, Haemophilus influenzae Rd
gcuuuacuacaucagguuuaaua

SEQ ID NO: 2726859 - RNA, 15 nt, Haemophilus influenzae Rd
gcuuuaucaaagaau

SEQ ID NO: 2726860 - RNA, 16 nt, Haemophilus influenzae Rd
gcuuuauuuaaauuaa

SEQ ID NO: 2726861 - RNA, 14 nt, Haemophilus influenzae Rd
gcuuuauuuagaau

SEQ ID NO: 2726862 - RNA, 19 nt, Haemophilus influenzae Rd
gcuuuauuuagaauuuuua

SEQ ID NO: 2726863 - RNA, 21 nt, Haemophilus influenzae Rd
gcuuucaacacaacaucagcu

SEQ ID NO: 2726864 - RNA, 21 nt, Haemophilus influenzae Rd
gcuuucacuauuucaucuuua

SEQ ID NO: 2726865 - RNA, 17 nt, Haemophilus influenzae Rd
gcuuucauaaauucauc

SEQ ID NO: 2726866 - RNA, 23 nt, Haemophilus influenzae Rd
gcuuucauacgcgcccauucauu

SEQ ID NO: 2726867 - RNA, 15 nt, Haemophilus influenzae Rd
gcuuucauuuuccaa

SEQ ID NO: 2726868 - RNA, 17 nt, Haemophilus influenzae Rd
gcuuuccuauucuaaac

SEQ ID NO: 2726869 - RNA, 18 nt, Haemophilus influenzae Rd
gcuuucuuauauauaaaa

SEQ ID NO: 2726870 - RNA, 15 nt, Haemophilus influenzae Rd
gcuuucuuauucagu

SEQ ID NO: 2726871 - RNA, 22 nt, Haemophilus influenzae Rd
gcuuucuuuuucaaguucagcu

SEQ ID NO: 2726872 - RNA, 20 nt, Haemophilus influenzae Rd
gcuuugagaaagaauauaaa

SEQ ID NO: 2726873 - RNA, 23 nt, Haemophilus influenzae Rd
gcuuugagaaagaauauaaauaa

SEQ ID NO: 2726874 - RNA, 17 nt, Haemophilus influenzae Rd
gcuuugauaaaugguuu

SEQ ID NO: 2726875 - RNA, 18 nt, Haemophilus influenzae Rd
gcuuugauaaaugguuuc

SEQ ID NO: 2726876 - RNA, 17 nt, Haemophilus influenzae Rd
gcuuugccaauuccuug

SEQ ID NO: 2726877 - RNA, 21 nt, Haemophilus influenzae Rd
gcuuugccacggcacauucug

SEQ ID NO: 2726878 - RNA, 13 nt, Haemophilus influenzae Rd
gcuuugccuaauu

SEQ ID NO: 2726879 - RNA, 19 nt, Haemophilus influenzae Rd
gcuuugcuuggaucacgca

SEQ ID NO: 2726880 - RNA, 14 nt, Haemophilus influenzae Rd
gcuuuguaaguugg

SEQ ID NO: 2726881 - RNA, 13 nt, Haemophilus influenzae Rd
gcuuugugauuga

SEQ ID NO: 2726882 - RNA, 14 nt, Haemophilus influenzae Rd
gcuuuguuguuuau

SEQ ID NO: 2726883 - RNA, 14 nt, Haemophilus influenzae Rd
gcuuuuaaauuuuu

SEQ ID NO: 2726884 - RNA, 14 nt, Haemophilus influenzae Rd
gcuuuuaacaaaua

SEQ ID NO: 2726885 - RNA, 16 nt, Haemophilus influenzae Rd
gcuuuuaacaaauaca

SEQ ID NO: 2726886 - RNA, 17 nt, Haemophilus influenzae Rd
gcuuuuacgaacguuuc

SEQ ID NO: 2726887 - RNA, 14 nt, Haemophilus influenzae Rd
gcuuuuaucaagua

SEQ ID NO: 2726888 - RNA, 15 nt, Haemophilus influenzae Rd
gcuuuucccucuuuu

SEQ ID NO: 2726889 - RNA, 19 nt, Haemophilus influenzae Rd
gcuuuucccuuuucuuauu

SEQ ID NO: 2726890 - RNA, 22 nt, Haemophilus influenzae Rd
gcuuuucgcgccaccuccaauu

SEQ ID NO: 2726891 - RNA, 21 nt, Haemophilus influenzae Rd
gcuuuucucaaaacaucuuua

SEQ ID NO: 2726892 - RNA, 20 nt, Haemophilus influenzae Rd
gcuuuucuuuuauacuuacu

SEQ ID NO: 2726893 - RNA, 11 nt, Haemophilus influenzae Rd
gcuuuugcuuc

SEQ ID NO: 2726894 - RNA, 15 nt, Haemophilus influenzae Rd
gcuuuuggucuucuu

SEQ ID NO: 2726895 - RNA, 17 nt, Haemophilus influenzae Rd
gcuuuuuacguucaugu

SEQ ID NO: 2726896 - RNA, 16 nt, Haemophilus influenzae Rd
gcuuuuuccucagcaa

SEQ ID NO: 2726897 - RNA, 18 nt, Haemophilus influenzae Rd
gcuuuuugaucucuuucu

SEQ ID NO: 2726898 - RNA, 22 nt, Haemophilus influenzae Rd
gcuuuuugcacgguguuuucuu

SEQ ID NO: 2726899 - RNA, 20 nt, Haemophilus influenzae Rd
gcuuuuuuauuuuauauauu

SEQ ID NO: 2726900 - RNA, 15 nt, Haemophilus influenzae Rd
gcuuuuuucaaugcu

SEQ ID NO: 2726901 - RNA, 16 nt, Haemophilus influenzae Rd
gcuuuuuucgcaccaa

SEQ ID NO: 2726902 - RNA, 14 nt, Haemophilus influenzae Rd
gcuuuuuucuuaca

SEQ ID NO: 2726903 - RNA, 21 nt, Haemophilus influenzae Rd
ggaaaaauaaauggauuuaau

SEQ ID NO: 2726904 - RNA, 11 nt, Haemophilus influenzae Rd
ggaaaaauuuu

SEQ ID NO: 2726905 - RNA, 18 nt, Haemophilus influenzae Rd
ggaaaagccuuaaccugc

SEQ ID NO: 2726906 - RNA, 16 nt, Haemophilus influenzae Rd
ggaaaaguaagaaacu

SEQ ID NO: 2726907 - RNA, 16 nt, Haemophilus influenzae Rd
ggaaaaugcuuauaaa

SEQ ID NO: 2726908 - RNA, 21 nt, Haemophilus influenzae Rd
ggaaaauuuuaaacagcaaaa

SEQ ID NO: 2726909 - RNA, 10 nt, Haemophilus influenzae Rd
ggaaaccagc

SEQ ID NO: 2726910 - RNA, 17 nt, Haemophilus influenzae Rd
ggaaacguaaaauaucu

SEQ ID NO: 2726911 - RNA, 18 nt, Haemophilus influenzae Rd
ggaaacuacggacuaaau

SEQ ID NO: 2726912 - RNA, 21 nt, Haemophilus influenzae Rd
ggaaacuacggacuaaauaaa

SEQ ID NO: 2726913 - RNA, 17 nt, Haemophilus influenzae Rd
ggaaacuaugcagaauc

SEQ ID NO: 2726914 - RNA, 19 nt, Haemophilus influenzae Rd
ggaaaggcauuagauuuga

SEQ ID NO: 2726915 - RNA, 14 nt, Haemophilus influenzae Rd
ggaaaggcauuuuu

SEQ ID NO: 2726916 - RNA, 23 nt, Haemophilus influenzae Rd
ggaaagucccgugagcauuuagu

SEQ ID NO: 2726917 - RNA, 18 nt, Haemophilus influenzae Rd
ggaaagugcagcccaaau

SEQ ID NO: 2726918 - RNA, 20 nt, Haemophilus influenzae Rd
ggaaagugcagcccaaauaa

SEQ ID NO: 2726919 - RNA, 21 nt, Haemophilus influenzae Rd
ggaaagugcagcccaaauaaa

SEQ ID NO: 2726920 - RNA, 21 nt, Haemophilus influenzae Rd
ggaaagugcgguaauuauaga

SEQ ID NO: 2726921 - RNA, 20 nt, Haemophilus influenzae Rd
ggaaauaacaaaaacaauca

SEQ ID NO: 2726922 - RNA, 21 nt, Haemophilus influenzae Rd
ggaaaugaaaccaaauccuuu

SEQ ID NO: 2726923 - RNA, 14 nt, Haemophilus influenzae Rd
ggaaauucuucaau

SEQ ID NO: 2726924 - RNA, 17 nt, Haemophilus influenzae Rd
ggaaauugccaaaaaag

SEQ ID NO: 2726925 - RNA, 16 nt, Haemophilus influenzae Rd
ggaaauuugagauuuu

SEQ ID NO: 2726926 - RNA, 20 nt, Haemophilus influenzae Rd
ggaacaauuucuagcgguaa

SEQ ID NO: 2726927 - RNA, 16 nt, Haemophilus influenzae Rd
ggaacaguaaauuuaa

SEQ ID NO: 2726928 - RNA, 22 nt, Haemophilus influenzae Rd
ggaacguuuuuuacuuggaaua

SEQ ID NO: 2726929 - RNA, 17 nt, Haemophilus influenzae Rd
ggaacucuuucaccauu

SEQ ID NO: 2726930 - RNA, 16 nt, Haemophilus influenzae Rd
ggaagcgaauuuaaga

SEQ ID NO: 2726931 - RNA, 23 nt, Haemophilus influenzae Rd
ggaaggcuaccugauaccaccac

SEQ ID NO: 2726932 - RNA, 22 nt, Haemophilus influenzae Rd
ggaaguuaugggcugacauaaa

SEQ ID NO: 2726933 - RNA, 13 nt, Haemophilus influenzae Rd
ggaauaauaucgu

SEQ ID NO: 2726934 - RNA, 14 nt, Haemophilus influenzae Rd
ggaauaauuuuccu

SEQ ID NO: 2726935 - RNA, 23 nt, Haemophilus influenzae Rd
ggaauaccacaguccccauaucu

SEQ ID NO: 2726936 - RNA, 11 nt, Haemophilus influenzae Rd
ggaauauucaa

SEQ ID NO: 2726937 - RNA, 16 nt, Haemophilus influenzae Rd
ggaauauucaacgcgc

SEQ ID NO: 2726938 - RNA, 21 nt, Haemophilus influenzae Rd
ggaauccagcguuaaguaauu

SEQ ID NO: 2726939 - RNA, 15 nt, Haemophilus influenzae Rd
ggaaucgguagacac

SEQ ID NO: 2726940 - RNA, 14 nt, Haemophilus influenzae Rd
ggaaucuggcuuau

SEQ ID NO: 2726941 - RNA, 16 nt, Haemophilus influenzae Rd
ggaaugcccagcaauu

SEQ ID NO: 2726942 - RNA, 16 nt, Haemophilus influenzae Rd
ggaauggauguaauga

SEQ ID NO: 2726943 - RNA, 13 nt, Haemophilus influenzae Rd
ggaauguaaaauu

SEQ ID NO: 2726944 - RNA, 14 nt, Haemophilus influenzae Rd
ggaauucaucaagc

SEQ ID NO: 2726945 - RNA, 15 nt, Haemophilus influenzae Rd
ggaauugguagacac

SEQ ID NO: 2726946 - RNA, 23 nt, Haemophilus influenzae Rd
ggaauuugguuccccuuucugaa

SEQ ID NO: 2726947 - RNA, 16 nt, Haemophilus influenzae Rd
ggaauuuuuuacugcu

SEQ ID NO: 2726948 - RNA, 12 nt, Haemophilus influenzae Rd
ggacaauguucg

SEQ ID NO: 2726949 - RNA, 14 nt, Haemophilus influenzae Rd
ggacauaagagaac

SEQ ID NO: 2726950 - RNA, 21 nt, Haemophilus influenzae Rd
ggacauaagagaaccgaacac

SEQ ID NO: 2726951 - RNA, 13 nt, Haemophilus influenzae Rd
ggacuaaaccuau

SEQ ID NO: 2726952 - RNA, 23 nt, Haemophilus influenzae Rd
ggacuaaauuagaauuuaguccu

SEQ ID NO: 2726953 - RNA, 18 nt, Haemophilus influenzae Rd
ggacuaagcuuuuuuuaa

SEQ ID NO: 2726954 - RNA, 19 nt, Haemophilus influenzae Rd
ggacucgcuguaacaucaa

SEQ ID NO: 2726955 - RNA, 15 nt, Haemophilus influenzae Rd
ggacugcauauucau

SEQ ID NO: 2726956 - RNA, 16 nt, Haemophilus influenzae Rd
ggacuggacuccaagg

SEQ ID NO: 2726957 - RNA, 15 nt, Haemophilus influenzae Rd
ggacuuacaucugug

SEQ ID NO: 2726958 - RNA, 22 nt, Haemophilus influenzae Rd
ggagagcuuagauacauaaaaa

SEQ ID NO: 2726959 - RNA, 22 nt, Haemophilus influenzae Rd
ggagauaauauuccaaaaaaua

SEQ ID NO: 2726960 - RNA, 11 nt, Haemophilus influenzae Rd
ggagcauuuug

SEQ ID NO: 2726961 - RNA, 23 nt, Haemophilus influenzae Rd
ggaggagccaaauuuaaaaaagc

SEQ ID NO: 2726962 - RNA, 18 nt, Haemophilus influenzae Rd
ggaggaucgauuaaaauu

SEQ ID NO: 2726963 - RNA, 18 nt, Haemophilus influenzae Rd
ggagugagcgguuuuucc

SEQ ID NO: 2726964 - RNA, 22 nt, Haemophilus influenzae Rd
ggauaaaauaaacauuuuucau

SEQ ID NO: 2726965 - RNA, 18 nt, Haemophilus influenzae Rd
ggauaaauuauucugcaa

SEQ ID NO: 2726966 - RNA, 13 nt, Haemophilus influenzae Rd
ggauaaccaaaau

SEQ ID NO: 2726967 - RNA, 19 nt, Haemophilus influenzae Rd
ggauaaggcagaaaugaau

SEQ ID NO: 2726968 - RNA, 23 nt, Haemophilus influenzae Rd
ggauaauguucuuuuaaaagacc

SEQ ID NO: 2726969 - RNA, 19 nt, Haemophilus influenzae Rd
ggauaauguuucacuuugc

SEQ ID NO: 2726970 - RNA, 15 nt, Haemophilus influenzae Rd
ggauauagaaaucau

SEQ ID NO: 2726971 - RNA, 16 nt, Haemophilus influenzae Rd
ggauaucuuguugaua

SEQ ID NO: 2726972 - RNA, 17 nt, Haemophilus influenzae Rd
ggaucaaaaauauccac

SEQ ID NO: 2726973 - RNA, 15 nt, Haemophilus influenzae Rd
ggaucaacauaacgu

SEQ ID NO: 2726974 - RNA, 14 nt, Haemophilus influenzae Rd
ggaucaagauuugc

SEQ ID NO: 2726975 - RNA, 20 nt, Haemophilus influenzae Rd
ggaucacccauuaaauaaaa

SEQ ID NO: 2726976 - RNA, 18 nt, Haemophilus influenzae Rd
ggaucauaaguaaaacca

SEQ ID NO: 2726977 - RNA, 22 nt, Haemophilus influenzae Rd
ggaucuuccaauaauucuuuaa

SEQ ID NO: 2726978 - RNA, 19 nt, Haemophilus influenzae Rd
ggaucuuguggaucuaaau

SEQ ID NO: 2726979 - RNA, 12 nt, Haemophilus influenzae Rd
ggaugaaaucaa

SEQ ID NO: 2726980 - RNA, 17 nt, Haemophilus influenzae Rd
ggauggcuaaauacaac

SEQ ID NO: 2726981 - RNA, 15 nt, Haemophilus influenzae Rd
ggauguucaaguaaa

SEQ ID NO: 2726982 - RNA, 13 nt, Haemophilus influenzae Rd
ggauuaagaaaau

SEQ ID NO: 2726983 - RNA, 21 nt, Haemophilus influenzae Rd
  misc_feature (11)..(11): n is a, c, g or u
ggauuaauagnaaaaauuuag

SEQ ID NO: 2726984 - RNA, 19 nt, Haemophilus influenzae Rd
ggauuagcauaaaauuaac

SEQ ID NO: 2726985 - RNA, 15 nt, Haemophilus influenzae Rd
ggauuaguaagugcu

SEQ ID NO: 2726986 - RNA, 14 nt, Haemophilus influenzae Rd
ggauuauuaaaauu

SEQ ID NO: 2726987 - RNA, 19 nt, Haemophilus influenzae Rd
ggauucauuugcaaaucaa

SEQ ID NO: 2726988 - RNA, 20 nt, Haemophilus influenzae Rd
ggauuggaccguuugguaaa

SEQ ID NO: 2726989 - RNA, 14 nt, Haemophilus influenzae Rd
ggauuggauucacg

SEQ ID NO: 2726990 - RNA, 20 nt, Haemophilus influenzae Rd
ggauuggguuguuacguuuc

SEQ ID NO: 2726991 - RNA, 18 nt, Haemophilus influenzae Rd
ggauugguuggaaacgaa

SEQ ID NO: 2726992 - RNA, 16 nt, Haemophilus influenzae Rd
ggauuuuguaauaaaa

SEQ ID NO: 2726993 - RNA, 22 nt, Haemophilus influenzae Rd
ggauuuuucgcaggaucacaau

SEQ ID NO: 2726994 - RNA, 23 nt, Haemophilus influenzae Rd
ggauuuuugccguuuucuacuuc

SEQ ID NO: 2726995 - RNA, 22 nt, Haemophilus influenzae Rd
ggauuuuuuauuuugugaucuu

SEQ ID NO: 2726996 - RNA, 13 nt, Haemophilus influenzae Rd
ggcaaaaaaauca

SEQ ID NO: 2726997 - RNA, 12 nt, Haemophilus influenzae Rd
ggcaaaaaauac

SEQ ID NO: 2726998 - RNA, 23 nt, Haemophilus influenzae Rd
ggcaaaaacacucucagaauuaa

SEQ ID NO: 2726999 - RNA, 14 nt, Haemophilus influenzae Rd
ggcaaacaaaauaa

SEQ ID NO: 2727000 - RNA, 22 nt, Haemophilus influenzae Rd
ggcaaaggcuucauuugcuucu

SEQ ID NO: 2727001 - RNA, 20 nt, Haemophilus influenzae Rd
ggcaaauaaaauagacaaua

SEQ ID NO: 2727002 - RNA, 12 nt, Haemophilus influenzae Rd
ggcaaauagcaa

SEQ ID NO: 2727003 - RNA, 16 nt, Haemophilus influenzae Rd
ggcaaaugggugcuug

SEQ ID NO: 2727004 - RNA, 19 nt, Haemophilus influenzae Rd
ggcaacccacuucugcacc

SEQ ID NO: 2727005 - RNA, 22 nt, Haemophilus influenzae Rd
ggcaagaaauucacucaauuca

SEQ ID NO: 2727006 - RNA, 23 nt, Haemophilus influenzae Rd
ggcaagcaaacagcaauaaauaa

SEQ ID NO: 2727007 - RNA, 18 nt, Haemophilus influenzae Rd
ggcaauaauguugcugau

SEQ ID NO: 2727008 - RNA, 10 nt, Haemophilus influenzae Rd
ggcaauaauu

SEQ ID NO: 2727009 - RNA, 17 nt, Haemophilus influenzae Rd
ggcaauacuacggcgua

SEQ ID NO: 2727010 - RNA, 15 nt, Haemophilus influenzae Rd
ggcaaucauaaucgc

SEQ ID NO: 2727011 - RNA, 13 nt, Haemophilus influenzae Rd
ggcaauccugcuu

SEQ ID NO: 2727012 - RNA, 17 nt, Haemophilus influenzae Rd
ggcaaugaauaaacaga

SEQ ID NO: 2727013 - RNA, 23 nt, Haemophilus influenzae Rd
ggcaccguuccuggauaaagugu

SEQ ID NO: 2727014 - RNA, 23 nt, Haemophilus influenzae Rd
ggcacgaccaauauugaaaagua

SEQ ID NO: 2727015 - RNA, 19 nt, Haemophilus influenzae Rd
ggcagaauuacguuguugu

SEQ ID NO: 2727016 - RNA, 21 nt, Haemophilus influenzae Rd
ggcagaauuucgucaaaaaug

SEQ ID NO: 2727017 - RNA, 21 nt, Haemophilus influenzae Rd
ggcagcaagaccccaagcaaa

SEQ ID NO: 2727018 - RNA, 20 nt, Haemophilus influenzae Rd
ggcagccauaaaugcuacuu

SEQ ID NO: 2727019 - RNA, 18 nt, Haemophilus influenzae Rd
ggcaguuuggaaagagua

SEQ ID NO: 2727020 - RNA, 15 nt, Haemophilus influenzae Rd
ggcauaaagaaacag

SEQ ID NO: 2727021 - RNA, 20 nt, Haemophilus influenzae Rd
ggcauaaagaaacaggacac

SEQ ID NO: 2727022 - RNA, 22 nt, Haemophilus influenzae Rd
ggcauauugcuugcauucacaa

SEQ ID NO: 2727023 - RNA, 13 nt, Haemophilus influenzae Rd
ggcaucaauaaua

SEQ ID NO: 2727024 - RNA, 16 nt, Haemophilus influenzae Rd
ggcaucaauaauacgu

SEQ ID NO: 2727025 - RNA, 16 nt, Haemophilus influenzae Rd
ggcauccaaaguacac

SEQ ID NO: 2727026 - RNA, 13 nt, Haemophilus influenzae Rd
ggcauucauugga

SEQ ID NO: 2727027 - RNA, 12 nt, Haemophilus influenzae Rd
ggcauuggcaag

SEQ ID NO: 2727028 - RNA, 23 nt, Haemophilus influenzae Rd
ggcauuuuugcuggcguuuuuua

SEQ ID NO: 2727029 - RNA, 22 nt, Haemophilus influenzae Rd
ggccacucauacguucaacaau

SEQ ID NO: 2727030 - RNA, 23 nt, Haemophilus influenzae Rd
ggcgaacauaacuuuuuggcaua

SEQ ID NO: 2727031 - RNA, 15 nt, Haemophilus influenzae Rd
ggcgaaccacauaau

SEQ ID NO: 2727032 - RNA, 22 nt, Haemophilus influenzae Rd
ggcgaaccuuucauauaaauaa

SEQ ID NO: 2727033 - RNA, 13 nt, Haemophilus influenzae Rd
ggcgaaggcaaau

SEQ ID NO: 2727034 - RNA, 20 nt, Haemophilus influenzae Rd
ggcgaccauuacagcaagca

SEQ ID NO: 2727035 - RNA, 14 nt, Haemophilus influenzae Rd
ggcgacgauuuaau

SEQ ID NO: 2727036 - RNA, 12 nt, Haemophilus influenzae Rd
ggcgagauuaaa

SEQ ID NO: 2727037 - RNA, 15 nt, Haemophilus influenzae Rd
ggcgagggauuuuaa

SEQ ID NO: 2727038 - RNA, 19 nt, Haemophilus influenzae Rd
ggcgagugcggcaaagguu

SEQ ID NO: 2727039 - RNA, 13 nt, Haemophilus influenzae Rd
ggcgauauaaguu

SEQ ID NO: 2727040 - RNA, 17 nt, Haemophilus influenzae Rd
ggcgaugacauuguugu

SEQ ID NO: 2727041 - RNA, 20 nt, Haemophilus influenzae Rd
ggcguaaaccguggcauaau

SEQ ID NO: 2727042 - RNA, 13 nt, Haemophilus influenzae Rd
ggcguaaauccug

SEQ ID NO: 2727043 - RNA, 22 nt, Haemophilus influenzae Rd
ggcguaaucguagaaaucaaaa

SEQ ID NO: 2727044 - RNA, 23 nt, Haemophilus influenzae Rd
ggcguaucauacuaaaaaauuaa

SEQ ID NO: 2727045 - RNA, 16 nt, Haemophilus influenzae Rd
ggcgugaaaaauauca

SEQ ID NO: 2727046 - RNA, 15 nt, Haemophilus influenzae Rd
ggcguucauaucuuu

SEQ ID NO: 2727047 - RNA, 17 nt, Haemophilus influenzae Rd
ggcguuuacuuggcauu

SEQ ID NO: 2727048 - RNA, 15 nt, Haemophilus influenzae Rd
ggcguuuaggagaag

SEQ ID NO: 2727049 - RNA, 21 nt, Haemophilus influenzae Rd
ggcuaaaccgauuuugacuuu

SEQ ID NO: 2727050 - RNA, 15 nt, Haemophilus influenzae Rd
ggcuaaauucacuga

SEQ ID NO: 2727051 - RNA, 21 nt, Haemophilus influenzae Rd
ggcuaagguuuaacugauuag

SEQ ID NO: 2727052 - RNA, 14 nt, Haemophilus influenzae Rd
ggcuaguucuuccu

SEQ ID NO: 2727053 - RNA, 13 nt, Haemophilus influenzae Rd
ggcuaucugcuuu

SEQ ID NO: 2727054 - RNA, 15 nt, Haemophilus influenzae Rd
ggcuaugauuuuaaa

SEQ ID NO: 2727055 - RNA, 22 nt, Haemophilus influenzae Rd
ggcuauuucagcuugaagugug

SEQ ID NO: 2727056 - RNA, 23 nt, Haemophilus influenzae Rd
ggcuauuugaaacugguuuauca

SEQ ID NO: 2727057 - RNA, 21 nt, Haemophilus influenzae Rd
ggcucaucauuaugaaaaaaa

SEQ ID NO: 2727058 - RNA, 21 nt, Haemophilus influenzae Rd
ggcucauugugaucagagccu

SEQ ID NO: 2727059 - RNA, 12 nt, Haemophilus influenzae Rd
ggcuccgccacc

SEQ ID NO: 2727060 - RNA, 20 nt, Haemophilus influenzae Rd
ggcucuaacauaccgcucau

SEQ ID NO: 2727061 - RNA, 12 nt, Haemophilus influenzae Rd
ggcucuacuuug

SEQ ID NO: 2727062 - RNA, 14 nt, Haemophilus influenzae Rd
ggcugaaaaaauau

SEQ ID NO: 2727063 - RNA, 20 nt, Haemophilus influenzae Rd
ggcugaaauucuaaaaaaau

SEQ ID NO: 2727064 - RNA, 13 nt, Haemophilus influenzae Rd
ggcugauauauua

SEQ ID NO: 2727065 - RNA, 17 nt, Haemophilus influenzae Rd
ggcugauuccaaacugg

SEQ ID NO: 2727066 - RNA, 17 nt, Haemophilus influenzae Rd
ggcugauuuuaaauauc

SEQ ID NO: 2727067 - RNA, 15 nt, Haemophilus influenzae Rd
ggcugccuucaaugg

SEQ ID NO: 2727068 - RNA, 17 nt, Haemophilus influenzae Rd
ggcuguaaaaaaucuuu

SEQ ID NO: 2727069 - RNA, 17 nt, Haemophilus influenzae Rd
ggcuuacagcaaaagca

SEQ ID NO: 2727070 - RNA, 17 nt, Haemophilus influenzae Rd
ggcuuagauaauaaaau

SEQ ID NO: 2727071 - RNA, 17 nt, Haemophilus influenzae Rd
ggcuuauuuguuuuaua

SEQ ID NO: 2727072 - RNA, 17 nt, Haemophilus influenzae Rd
ggcuuauuuuuaaacaa

SEQ ID NO: 2727073 - RNA, 22 nt, Haemophilus influenzae Rd
ggcuucaguccgccuuuuugcu

SEQ ID NO: 2727074 - RNA, 23 nt, Haemophilus influenzae Rd
ggcuucaucuaacaauagaauug

SEQ ID NO: 2727075 - RNA, 15 nt, Haemophilus influenzae Rd
ggcuucucaaaugaa

SEQ ID NO: 2727076 - RNA, 17 nt, Haemophilus influenzae Rd
ggcuucucaaaugaaau

SEQ ID NO: 2727077 - RNA, 19 nt, Haemophilus influenzae Rd
ggcuugcucuguauuuugu

SEQ ID NO: 2727078 - RNA, 13 nt, Haemophilus influenzae Rd
ggcuuguuuuuuc

SEQ ID NO: 2727079 - RNA, 17 nt, Haemophilus influenzae Rd
ggcuuuaaagguuuaaa

SEQ ID NO: 2727080 - RNA, 20 nt, Haemophilus influenzae Rd
ggcuuuaaagguuuaaaccu

SEQ ID NO: 2727081 - RNA, 21 nt, Haemophilus influenzae Rd
ggcuuuaaagguuuaaaccuu

SEQ ID NO: 2727082 - RNA, 17 nt, Haemophilus influenzae Rd
ggcuuuaagcuuuucua

SEQ ID NO: 2727083 - RNA, 13 nt, Haemophilus influenzae Rd
ggcuuucaccaaa

SEQ ID NO: 2727084 - RNA, 21 nt, Haemophilus influenzae Rd
ggcuuucacuauuucaucuuu

SEQ ID NO: 2727085 - RNA, 23 nt, Haemophilus influenzae Rd
ggcuuuuguuuauaucuuuauua

SEQ ID NO: 2727086 - RNA, 11 nt, Haemophilus influenzae Rd
ggcuuuuugcu

SEQ ID NO: 2727087 - RNA, 22 nt, Haemophilus influenzae Rd
ggcuuuuuuauuuuauauauua

SEQ ID NO: 2727088 - RNA, 21 nt, Haemophilus influenzae Rd
gggaaaacauaauauuuuccc

SEQ ID NO: 2727089 - RNA, 21 nt, Haemophilus influenzae Rd
gggaaaauauuauguuuuccc

SEQ ID NO: 2727090 - RNA, 19 nt, Haemophilus influenzae Rd
gggaaacaauaucuaagau

SEQ ID NO: 2727091 - RNA, 12 nt, Haemophilus influenzae Rd
gggaaauccagc

SEQ ID NO: 2727092 - RNA, 15 nt, Haemophilus influenzae Rd
gggaaggcuuuuccc

SEQ ID NO: 2727093 - RNA, 14 nt, Haemophilus influenzae Rd
gggaauagcucagu

SEQ ID NO: 2727094 - RNA, 23 nt, Haemophilus influenzae Rd
gggaaucuggcuuauggaggggg

SEQ ID NO: 2727095 - RNA, 20 nt, Haemophilus influenzae Rd
gggaccauuuuuccagcaaa

SEQ ID NO: 2727096 - RNA, 16 nt, Haemophilus influenzae Rd
gggauaagcuuuugag

SEQ ID NO: 2727097 - RNA, 16 nt, Haemophilus influenzae Rd
gggaucauuucaucug

SEQ ID NO: 2727098 - RNA, 19 nt, Haemophilus influenzae Rd
gggaucuauuugauuuaac

SEQ ID NO: 2727099 - RNA, 16 nt, Haemophilus influenzae Rd
gggaugaaaucaaaau

SEQ ID NO: 2727100 - RNA, 16 nt, Haemophilus influenzae Rd
gggaugguuaauuuuu

SEQ ID NO: 2727101 - RNA, 15 nt, Haemophilus influenzae Rd
gggauucgguuuuuc

SEQ ID NO: 2727102 - RNA, 24 nt, Haemophilus influenzae Rd
gggauugacuaccaauauuaucgu

SEQ ID NO: 2727103 - RNA, 15 nt, Haemophilus influenzae Rd
gggauuucaaacaau

SEQ ID NO: 2727104 - RNA, 21 nt, Haemophilus influenzae Rd
gggauuuuauuuaauauaauu

SEQ ID NO: 2727105 - RNA, 23 nt, Haemophilus influenzae Rd
gggauuuucaucuauuuuauuaa

SEQ ID NO: 2727106 - RNA, 17 nt, Haemophilus influenzae Rd
gggauuuugucaccaaa

SEQ ID NO: 2727107 - RNA, 15 nt, Haemophilus influenzae Rd
gggcaaacgcucuuu

SEQ ID NO: 2727108 - RNA, 15 nt, Haemophilus influenzae Rd
gggcaacagucagug

SEQ ID NO: 2727109 - RNA, 18 nt, Haemophilus influenzae Rd
gggcaacagugauacuuc

SEQ ID NO: 2727110 - RNA, 11 nt, Haemophilus influenzae Rd
gggcaaucaaa

SEQ ID NO: 2727111 - RNA, 14 nt, Haemophilus influenzae Rd
gggcaccauuuaaa

SEQ ID NO: 2727112 - RNA, 21 nt, Haemophilus influenzae Rd
gggcauccaaaguacacaaga

SEQ ID NO: 2727113 - RNA, 22 nt, Haemophilus influenzae Rd
gggcgauaaaaauuaaggaaag

SEQ ID NO: 2727114 - RNA, 19 nt, Haemophilus influenzae Rd
gggcugaauggauuauaaa

SEQ ID NO: 2727115 - RNA, 14 nt, Haemophilus influenzae Rd
gggcuuguuuuuuc

SEQ ID NO: 2727116 - RNA, 22 nt, Haemophilus influenzae Rd
gggcuuuaucauaacuauaauu

SEQ ID NO: 2727117 - RNA, 21 nt, Haemophilus influenzae Rd
ggggacgcaccuuuugaaaaa

SEQ ID NO: 2727118 - RNA, 17 nt, Haemophilus influenzae Rd
ggguaaaauaaugcaaa

SEQ ID NO: 2727119 - RNA, 20 nt, Haemophilus influenzae Rd
ggguaaaauaaugcaaaaac

SEQ ID NO: 2727120 - RNA, 17 nt, Haemophilus influenzae Rd
ggguaaaccaaacgaga

SEQ ID NO: 2727121 - RNA, 13 nt, Haemophilus influenzae Rd
ggguagaaauccc

SEQ ID NO: 2727122 - RNA, 13 nt, Haemophilus influenzae Rd
ggguaguuuauaa

SEQ ID NO: 2727123 - RNA, 23 nt, Haemophilus influenzae Rd
ggguauucacuuaauugugugcg

SEQ ID NO: 2727124 - RNA, 22 nt, Haemophilus influenzae Rd
gggucaagauuaaucuuuuuuc

SEQ ID NO: 2727125 - RNA, 23 nt, Haemophilus influenzae Rd
ggguuauauucagcaaaaucacu

SEQ ID NO: 2727126 - RNA, 13 nt, Haemophilus influenzae Rd
ggguucuuuuuug

SEQ ID NO: 2727127 - RNA, 18 nt, Haemophilus influenzae Rd
ggguuggaagaauguuuu

SEQ ID NO: 2727128 - RNA, 18 nt, Haemophilus influenzae Rd
ggguuucggauaauaauu

SEQ ID NO: 2727129 - RNA, 12 nt, Haemophilus influenzae Rd
gguaaaaaucau

SEQ ID NO: 2727130 - RNA, 22 nt, Haemophilus influenzae Rd
gguaaaaauucuuuuuucuucc

SEQ ID NO: 2727131 - RNA, 12 nt, Haemophilus influenzae Rd
gguaaaaauuuc

SEQ ID NO: 2727132 - RNA, 22 nt, Haemophilus influenzae Rd
gguaaaagugcgguaaaaauua

SEQ ID NO: 2727133 - RNA, 16 nt, Haemophilus influenzae Rd
gguaaaauaaugcaaa

SEQ ID NO: 2727134 - RNA, 13 nt, Haemophilus influenzae Rd
gguaaaauuaaug

SEQ ID NO: 2727135 - RNA, 18 nt, Haemophilus influenzae Rd
gguaaaauucuauuaaaa

SEQ ID NO: 2727136 - RNA, 17 nt, Haemophilus influenzae Rd
gguaaacgaacuucacu

SEQ ID NO: 2727137 - RNA, 20 nt, Haemophilus influenzae Rd
gguaaagccaacuuuuucua

SEQ ID NO: 2727138 - RNA, 23 nt, Haemophilus influenzae Rd
gguaaaugucuucuguuuggaua

SEQ ID NO: 2727139 - RNA, 23 nt, Haemophilus influenzae Rd
gguaacauaaugauuucuaaacu

SEQ ID NO: 2727140 - RNA, 18 nt, Haemophilus influenzae Rd
gguaagauuuuaugaaau

SEQ ID NO: 2727141 - RNA, 19 nt, Haemophilus influenzae Rd
gguaauaaaucaaaagaau

SEQ ID NO: 2727142 - RNA, 18 nt, Haemophilus influenzae Rd
gguaauguuaucgacuuc

SEQ ID NO: 2727143 - RNA, 22 nt, Haemophilus influenzae Rd
gguaauugcccaauaaaaguaa

SEQ ID NO: 2727144 - RNA, 21 nt, Haemophilus influenzae Rd
gguaauuuaaggcuuuuucug

SEQ ID NO: 2727145 - RNA, 21 nt, Haemophilus influenzae Rd
gguacauguugggcuaaaaau

SEQ ID NO: 2727146 - RNA, 20 nt, Haemophilus influenzae Rd
gguagacacaagggauuuaa

SEQ ID NO: 2727147 - RNA, 23 nt, Haemophilus influenzae Rd
gguagagcagcggacuuuuaauc

SEQ ID NO: 2727148 - RNA, 17 nt, Haemophilus influenzae Rd
gguagcaauaaccaaua

SEQ ID NO: 2727149 - RNA, 16 nt, Haemophilus influenzae Rd
gguauaaaaaaucggu

SEQ ID NO: 2727150 - RNA, 19 nt, Haemophilus influenzae Rd
gguauaaaccuugcauuuc

SEQ ID NO: 2727151 - RNA, 11 nt, Haemophilus influenzae Rd
gguauacuuua

SEQ ID NO: 2727152 - RNA, 16 nt, Haemophilus influenzae Rd
gguauacuuuauugau

SEQ ID NO: 2727153 - RNA, 20 nt, Haemophilus influenzae Rd
gguaucacaaagcacuaauc

SEQ ID NO: 2727154 - RNA, 15 nt, Haemophilus influenzae Rd
gguaucagaaauuac

SEQ ID NO: 2727155 - RNA, 16 nt, Haemophilus influenzae Rd
gguaucggucuugcua

SEQ ID NO: 2727156 - RNA, 12 nt, Haemophilus influenzae Rd
gguaucuaaauu

SEQ ID NO: 2727157 - RNA, 20 nt, Haemophilus influenzae Rd
gguauuucaauuugaacaaa

SEQ ID NO: 2727158 - RNA, 20 nt, Haemophilus influenzae Rd
gguauuuuuuauugaaauuu

SEQ ID NO: 2727159 - RNA, 12 nt, Haemophilus influenzae Rd
ggucaaaaugca

SEQ ID NO: 2727160 - RNA, 21 nt, Haemophilus influenzae Rd
ggucaacauaaagauuaaaau

SEQ ID NO: 2727161 - RNA, 21 nt, Haemophilus influenzae Rd
ggucaagaucggaauauuuuu

SEQ ID NO: 2727162 - RNA, 19 nt, Haemophilus influenzae Rd
ggucaauaaaaauaauguu

SEQ ID NO: 2727163 - RNA, 22 nt, Haemophilus influenzae Rd
ggucaauaaaaauaauguuuuu

SEQ ID NO: 2727164 - RNA, 16 nt, Haemophilus influenzae Rd
ggucaauuuuuucaca

SEQ ID NO: 2727165 - RNA, 20 nt, Haemophilus influenzae Rd
ggucacgauuuuuuuauaaa

SEQ ID NO: 2727166 - RNA, 13 nt, Haemophilus influenzae Rd
ggucacuugugau

SEQ ID NO: 2727167 - RNA, 18 nt, Haemophilus influenzae Rd
ggucagaaauauguuuua

SEQ ID NO: 2727168 - RNA, 20 nt, Haemophilus influenzae Rd
ggucagucuaccauuuggga

SEQ ID NO: 2727169 - RNA, 20 nt, Haemophilus influenzae Rd
ggucaucucuuguuuuucca

SEQ ID NO: 2727170 - RNA, 22 nt, Haemophilus influenzae Rd
ggucaucucuuguuuuuccaau

SEQ ID NO: 2727171 - RNA, 23 nt, Haemophilus influenzae Rd
gguccccccuaccggacuugaac

SEQ ID NO: 2727172 - RNA, 18 nt, Haemophilus influenzae Rd
ggucgauucugucgcaga

SEQ ID NO: 2727173 - RNA, 14 nt, Haemophilus influenzae Rd
ggucgcaccaccuu

SEQ ID NO: 2727174 - RNA, 19 nt, Haemophilus influenzae Rd
ggucgcaccaccuuuauua

SEQ ID NO: 2727175 - RNA, 23 nt, Haemophilus influenzae Rd
ggucgguauucauaucaaugcca

SEQ ID NO: 2727176 - RNA, 18 nt, Haemophilus influenzae Rd
ggucugcaauaauaucug

SEQ ID NO: 2727177 - RNA, 14 nt, Haemophilus influenzae Rd
ggucuguugcaaau

SEQ ID NO: 2727178 - RNA, 20 nt, Haemophilus influenzae Rd
ggucuguugcaaauuuuuca

SEQ ID NO: 2727179 - RNA, 23 nt, Haemophilus influenzae Rd
ggugaaauuucaccgcauucuuc

SEQ ID NO: 2727180 - RNA, 21 nt, Haemophilus influenzae Rd
ggugagauuucuugcuaaaau

SEQ ID NO: 2727181 - RNA, 14 nt, Haemophilus influenzae Rd
ggugcagauuaauu

SEQ ID NO: 2727182 - RNA, 19 nt, Haemophilus influenzae Rd
ggugcagauuuuuuauuaa

SEQ ID NO: 2727183 - RNA, 19 nt, Haemophilus influenzae Rd
ggugcagauuuuuuauuua

SEQ ID NO: 2727184 - RNA, 23 nt, Haemophilus influenzae Rd
ggugcagauuuuuuauuuauuaa

SEQ ID NO: 2727185 - RNA, 12 nt, Haemophilus influenzae Rd
ggugcuauuuua

SEQ ID NO: 2727186 - RNA, 17 nt, Haemophilus influenzae Rd
ggugcuuaacugaaaau

SEQ ID NO: 2727187 - RNA, 19 nt, Haemophilus influenzae Rd
ggugcuuacuuuauuuuua

SEQ ID NO: 2727188 - RNA, 20 nt, Haemophilus influenzae Rd
ggugcuuacuuuauuuuuaa

SEQ ID NO: 2727189 - RNA, 19 nt, Haemophilus influenzae Rd
ggugcuuguuuuaaaauuu

SEQ ID NO: 2727190 - RNA, 18 nt, Haemophilus influenzae Rd
ggugcuuuaaguaaaagu

SEQ ID NO: 2727191 - RNA, 21 nt, Haemophilus influenzae Rd
ggugcuuugugauugacauuu

SEQ ID NO: 2727192 - RNA, 15 nt, Haemophilus influenzae Rd
ggugcuuuuaaauuu

SEQ ID NO: 2727193 - RNA, 17 nt, Haemophilus influenzae Rd
gguggaaagguugcuau

SEQ ID NO: 2727194 - RNA, 19 nt, Haemophilus influenzae Rd
ggugggcugaagcccaccc

SEQ ID NO: 2727195 - RNA, 17 nt, Haemophilus influenzae Rd
ggugggcuuuagcccac

SEQ ID NO: 2727196 - RNA, 14 nt, Haemophilus influenzae Rd
ggugguggaauaaa

SEQ ID NO: 2727197 - RNA, 18 nt, Haemophilus influenzae Rd
gguguaacgcuuaaccau

SEQ ID NO: 2727198 - RNA, 19 nt, Haemophilus influenzae Rd
gguguuauuugagcaagau

SEQ ID NO: 2727199 - RNA, 21 nt, Haemophilus influenzae Rd
gguuaaaaguaagcaauuuuc

SEQ ID NO: 2727200 - RNA, 13 nt, Haemophilus influenzae Rd
gguuaaaauaaaa

SEQ ID NO: 2727201 - RNA, 18 nt, Haemophilus influenzae Rd
gguuaaaauauuccuucg

SEQ ID NO: 2727202 - RNA, 17 nt, Haemophilus influenzae Rd
gguuaaguaaucuggug

SEQ ID NO: 2727203 - RNA, 16 nt, Haemophilus influenzae Rd
gguuaaugcuucuaau

SEQ ID NO: 2727204 - RNA, 20 nt, Haemophilus influenzae Rd
gguuaauguaaacaaaaaua

SEQ ID NO: 2727205 - RNA, 22 nt, Haemophilus influenzae Rd
gguuaauuuucaccgcacuuuc

SEQ ID NO: 2727206 - RNA, 12 nt, Haemophilus influenzae Rd
gguuaguacuug

SEQ ID NO: 2727207 - RNA, 23 nt, Haemophilus influenzae Rd
gguuauuuaguuuaacuuuuuua

SEQ ID NO: 2727208 - RNA, 22 nt, Haemophilus influenzae Rd
gguuauuucuugccaaaaauua

SEQ ID NO: 2727209 - RNA, 22 nt, Haemophilus influenzae Rd
gguuauuugcaauaaaauuugc

SEQ ID NO: 2727210 - RNA, 18 nt, Haemophilus influenzae Rd
gguucagcccuuuuaguu

SEQ ID NO: 2727211 - RNA, 16 nt, Haemophilus influenzae Rd
gguucaucuaauaaua

SEQ ID NO: 2727212 - RNA, 15 nt, Haemophilus influenzae Rd
gguuccccuuucuga

SEQ ID NO: 2727213 - RNA, 10 nt, Haemophilus influenzae Rd
gguuccucag

SEQ ID NO: 2727214 - RNA, 20 nt, Haemophilus influenzae Rd
gguucgcuucauuauauucc

SEQ ID NO: 2727215 - RNA, 11 nt, Haemophilus influenzae Rd
gguucuuuuaa

SEQ ID NO: 2727216 - RNA, 13 nt, Haemophilus influenzae Rd
gguucuuuuaauu

SEQ ID NO: 2727217 - RNA, 16 nt, Haemophilus influenzae Rd
gguugcgauuuuugca

SEQ ID NO: 2727218 - RNA, 13 nt, Haemophilus influenzae Rd
gguuggaagaaaa

SEQ ID NO: 2727219 - RNA, 19 nt, Haemophilus influenzae Rd
gguuggccuguuggaauuu

SEQ ID NO: 2727220 - RNA, 15 nt, Haemophilus influenzae Rd
gguuguuuuuguaaa

SEQ ID NO: 2727221 - RNA, 13 nt, Haemophilus influenzae Rd
gguuuaaauuuua

SEQ ID NO: 2727222 - RNA, 14 nt, Haemophilus influenzae Rd
gguuuaaauuuuaa

SEQ ID NO: 2727223 - RNA, 12 nt, Haemophilus influenzae Rd
gguuuaauaauc

SEQ ID NO: 2727224 - RNA, 20 nt, Haemophilus influenzae Rd
gguuuaucacuaauauaaag

SEQ ID NO: 2727225 - RNA, 19 nt, Haemophilus influenzae Rd
gguuuaucuuuauugccau

SEQ ID NO: 2727226 - RNA, 16 nt, Haemophilus influenzae Rd
gguuucagaauaaaga

SEQ ID NO: 2727227 - RNA, 14 nt, Haemophilus influenzae Rd
gguuucuugcccaa

SEQ ID NO: 2727228 - RNA, 11 nt, Haemophilus influenzae Rd
gguuugacaua

SEQ ID NO: 2727229 - RNA, 15 nt, Haemophilus influenzae Rd
gguuugcacuuuaaa

SEQ ID NO: 2727230 - RNA, 16 nt, Haemophilus influenzae Rd
gguuuuacauauaaag

SEQ ID NO: 2727231 - RNA, 13 nt, Haemophilus influenzae Rd
gguuuucaucauu

SEQ ID NO: 2727232 - RNA, 20 nt, Haemophilus influenzae Rd
gguuuuccacuucuucuuua

SEQ ID NO: 2727233 - RNA, 23 nt, Haemophilus influenzae Rd
gguuuuccuacagugacuaaaac

SEQ ID NO: 2727234 - RNA, 14 nt, Haemophilus influenzae Rd
gguuuuguuuuaua

SEQ ID NO: 2727235 - RNA, 20 nt, Haemophilus influenzae Rd
gguuuuuuuauuuuuaucau

SEQ ID NO: 2727236 - RNA, 21 nt, Haemophilus influenzae Rd
guaaaaaaaagcgugauuuuu

SEQ ID NO: 2727237 - RNA, 19 nt, Haemophilus influenzae Rd
guaaaaaaguuugauaaag

SEQ ID NO: 2727238 - RNA, 15 nt, Haemophilus influenzae Rd
guaaaaaaucaagcc

SEQ ID NO: 2727239 - RNA, 23 nt, Haemophilus influenzae Rd
guaaaaagugcggugaaauuuua

SEQ ID NO: 2727240 - RNA, 20 nt, Haemophilus influenzae Rd
guaaaaauaaaaacauugcc

SEQ ID NO: 2727241 - RNA, 23 nt, Haemophilus influenzae Rd
guaaaaauaaucacuugauaaaa

SEQ ID NO: 2727242 - RNA, 22 nt, Haemophilus influenzae Rd
guaaaaaucauuaaauaacuca

SEQ ID NO: 2727243 - RNA, 11 nt, Haemophilus influenzae Rd
guaaaaaugcu

SEQ ID NO: 2727244 - RNA, 21 nt, Haemophilus influenzae Rd
guaaaaauucuuuuuucuucc

SEQ ID NO: 2727245 - RNA, 16 nt, Haemophilus influenzae Rd
guaaaacaaaaggcaa

SEQ ID NO: 2727246 - RNA, 20 nt, Haemophilus influenzae Rd
guaaaacauuguuuuguuca

SEQ ID NO: 2727247 - RNA, 14 nt, Haemophilus influenzae Rd
guaaaacauuucau

SEQ ID NO: 2727248 - RNA, 17 nt, Haemophilus influenzae Rd
guaaaaggacuaaauuc

SEQ ID NO: 2727249 - RNA, 19 nt, Haemophilus influenzae Rd
guaaaaggacuaaauucug

SEQ ID NO: 2727250 - RNA, 12 nt, Haemophilus influenzae Rd
guaaaagugcgg

SEQ ID NO: 2727251 - RNA, 16 nt, Haemophilus influenzae Rd
guaaaagugcgguuga

SEQ ID NO: 2727252 - RNA, 15 nt, Haemophilus influenzae Rd
guaaaauaaaaagga

SEQ ID NO: 2727253 - RNA, 22 nt, Haemophilus influenzae Rd
guaaaauaaugcaaaaacaagu

SEQ ID NO: 2727254 - RNA, 12 nt, Haemophilus influenzae Rd
guaaaauaucca

SEQ ID NO: 2727255 - RNA, 17 nt, Haemophilus influenzae Rd
guaaaauucuauuaaaa

SEQ ID NO: 2727256 - RNA, 20 nt, Haemophilus influenzae Rd
guaaaauucuauuaaaauau

SEQ ID NO: 2727257 - RNA, 19 nt, Haemophilus influenzae Rd
guaaaauuggguuuugcgu

SEQ ID NO: 2727258 - RNA, 21 nt, Haemophilus influenzae Rd
guaaaauuuuuagugauuuua

SEQ ID NO: 2727259 - RNA, 23 nt, Haemophilus influenzae Rd
guaaaauuuuuagugauuuuaaa

SEQ ID NO: 2727260 - RNA, 22 nt, Haemophilus influenzae Rd
guaaacaaaauaccccaauuaa

SEQ ID NO: 2727261 - RNA, 22 nt, Haemophilus influenzae Rd
guaaacaagauucugaaagaua

SEQ ID NO: 2727262 - RNA, 16 nt, Haemophilus influenzae Rd
guaaacaaguauaaaa

SEQ ID NO: 2727263 - RNA, 14 nt, Haemophilus influenzae Rd
guaaacaauucuau

SEQ ID NO: 2727264 - RNA, 15 nt, Haemophilus influenzae Rd
guaaacauuuuguau

SEQ ID NO: 2727265 - RNA, 18 nt, Haemophilus influenzae Rd
guaaaccaagugaaauuc

SEQ ID NO: 2727266 - RNA, 22 nt, Haemophilus influenzae Rd
guaaacccacaacuuuuucauc

SEQ ID NO: 2727267 - RNA, 13 nt, Haemophilus influenzae Rd
guaaacccuuuag

SEQ ID NO: 2727268 - RNA, 19 nt, Haemophilus influenzae Rd
guaaacgaccuugcaaauu

SEQ ID NO: 2727269 - RNA, 22 nt, Haemophilus influenzae Rd
guaaacgccaucaaccauaaca

SEQ ID NO: 2727270 - RNA, 16 nt, Haemophilus influenzae Rd
guaaacuaaaucuugc

SEQ ID NO: 2727271 - RNA, 19 nt, Haemophilus influenzae Rd
guaaacugcuuucaaaagg

SEQ ID NO: 2727272 - RNA, 19 nt, Haemophilus influenzae Rd
guaaacuuuccucaaguuu

SEQ ID NO: 2727273 - RNA, 13 nt, Haemophilus influenzae Rd
guaaagauugucc

SEQ ID NO: 2727274 - RNA, 21 nt, Haemophilus influenzae Rd
guaaauaacacaucagaaaau

SEQ ID NO: 2727275 - RNA, 13 nt, Haemophilus influenzae Rd
guaaauaagccau

SEQ ID NO: 2727276 - RNA, 11 nt, Haemophilus influenzae Rd
guaaauaaucc

SEQ ID NO: 2727277 - RNA, 20 nt, Haemophilus influenzae Rd
guaaauaauccagauaacaa

SEQ ID NO: 2727278 - RNA, 17 nt, Haemophilus influenzae Rd
guaaauaguuauuuauu

SEQ ID NO: 2727279 - RNA, 21 nt, Haemophilus influenzae Rd
guaaauaugccuuauauuuca

SEQ ID NO: 2727280 - RNA, 14 nt, Haemophilus influenzae Rd
guaaauauuuuuua

SEQ ID NO: 2727281 - RNA, 20 nt, Haemophilus influenzae Rd
guaaaucaauguuuucagcu

SEQ ID NO: 2727282 - RNA, 19 nt, Haemophilus influenzae Rd
guaaaucggcuggauuucc

SEQ ID NO: 2727283 - RNA, 22 nt, Haemophilus influenzae Rd
guaaaucuacuuggacauuguu

SEQ ID NO: 2727284 - RNA, 16 nt, Haemophilus influenzae Rd
guaaaucugauucaga

SEQ ID NO: 2727285 - RNA, 23 nt, Haemophilus influenzae Rd
guaaaucugauucagaaaaagcu

SEQ ID NO: 2727286 - RNA, 23 nt, Haemophilus influenzae Rd
guaaaugcgcuuuuaauuuagcu

SEQ ID NO: 2727287 - RNA, 14 nt, Haemophilus influenzae Rd
guaaauuaugccca

SEQ ID NO: 2727288 - RNA, 14 nt, Haemophilus influenzae Rd
guaaauuauuuauu

SEQ ID NO: 2727289 - RNA, 16 nt, Haemophilus influenzae Rd
guaaauuauuuauuua

SEQ ID NO: 2727290 - RNA, 22 nt, Haemophilus influenzae Rd
guaaauucucgguuguuucauc

SEQ ID NO: 2727291 - RNA, 23 nt, Haemophilus influenzae Rd
guaaauugguuaauguaaacaaa

SEQ ID NO: 2727292 - RNA, 21 nt, Haemophilus influenzae Rd
guaaauugguuuuauccugua

SEQ ID NO: 2727293 - RNA, 13 nt, Haemophilus influenzae Rd
guaaauuuuaaaa

SEQ ID NO: 2727294 - RNA, 12 nt, Haemophilus influenzae Rd
guaaauuuucag

SEQ ID NO: 2727295 - RNA, 23 nt, Haemophilus influenzae Rd
guaaauuuucagcguuuucaacu

SEQ ID NO: 2727296 - RNA, 15 nt, Haemophilus influenzae Rd
guaaauuuuccaauu

SEQ ID NO: 2727297 - RNA, 19 nt, Haemophilus influenzae Rd
guaaauuuuuccacauuaa

SEQ ID NO: 2727298 - RNA, 11 nt, Haemophilus influenzae Rd
guaacaacugc

SEQ ID NO: 2727299 - RNA, 12 nt, Haemophilus influenzae Rd
guaacaacugcu

SEQ ID NO: 2727300 - RNA, 15 nt, Haemophilus influenzae Rd
guaacaauguagaaa

SEQ ID NO: 2727301 - RNA, 10 nt, Haemophilus influenzae Rd
guaacaucaa

SEQ ID NO: 2727302 - RNA, 11 nt, Haemophilus influenzae Rd
guaaccaaaga

SEQ ID NO: 2727303 - RNA, 21 nt, Haemophilus influenzae Rd
guaaccaagcuguaccagcga

SEQ ID NO: 2727304 - RNA, 13 nt, Haemophilus influenzae Rd
guaacccaaagca

SEQ ID NO: 2727305 - RNA, 22 nt, Haemophilus influenzae Rd
guaacgcccccgccauuuugaa

SEQ ID NO: 2727306 - RNA, 18 nt, Haemophilus influenzae Rd
guaacgccguauuuuuaa

SEQ ID NO: 2727307 - RNA, 22 nt, Haemophilus influenzae Rd
guaacguugcucuuucaaguuu

SEQ ID NO: 2727308 - RNA, 20 nt, Haemophilus influenzae Rd
guaacuguuuguuuuuucua

SEQ ID NO: 2727309 - RNA, 18 nt, Haemophilus influenzae Rd
guaacuucugcugcacga

SEQ ID NO: 2727310 - RNA, 20 nt, Haemophilus influenzae Rd
guaagaucagauuuuuuuca

SEQ ID NO: 2727311 - RNA, 12 nt, Haemophilus influenzae Rd
guaagaucuucu

SEQ ID NO: 2727312 - RNA, 14 nt, Haemophilus influenzae Rd
guaagcaaguacaa

SEQ ID NO: 2727313 - RNA, 18 nt, Haemophilus influenzae Rd
guaagcaauuuucugcag

SEQ ID NO: 2727314 - RNA, 16 nt, Haemophilus influenzae Rd
guaagcauuaaaaauu

SEQ ID NO: 2727315 - RNA, 18 nt, Haemophilus influenzae Rd
guaagcgguaacgacaaa

SEQ ID NO: 2727316 - RNA, 15 nt, Haemophilus influenzae Rd
guaagggcaaaaaau

SEQ ID NO: 2727317 - RNA, 17 nt, Haemophilus influenzae Rd
guaaggguaucacaaag

SEQ ID NO: 2727318 - RNA, 18 nt, Haemophilus influenzae Rd
guaagguuucuaaaugaa

SEQ ID NO: 2727319 - RNA, 14 nt, Haemophilus influenzae Rd
guaaguaaugaaaa

SEQ ID NO: 2727320 - RNA, 14 nt, Haemophilus influenzae Rd
guaagugguaucaa

SEQ ID NO: 2727321 - RNA, 19 nt, Haemophilus influenzae Rd
guaaguguagcaauaaaca

SEQ ID NO: 2727322 - RNA, 12 nt, Haemophilus influenzae Rd
guaaguuuuaca

SEQ ID NO: 2727323 - RNA, 14 nt, Haemophilus influenzae Rd
guaauaaaaaauac

SEQ ID NO: 2727324 - RNA, 13 nt, Haemophilus influenzae Rd
guaauaaauaaaa

SEQ ID NO: 2727325 - RNA, 20 nt, Haemophilus influenzae Rd
guaauaaauucaaaaaaugu

SEQ ID NO: 2727326 - RNA, 23 nt, Haemophilus influenzae Rd
guaauaaggcuugcacaauaauc

SEQ ID NO: 2727327 - RNA, 17 nt, Haemophilus influenzae Rd
guaauaaguauuuugca

SEQ ID NO: 2727328 - RNA, 17 nt, Haemophilus influenzae Rd
guaauaaucuucuuccc

SEQ ID NO: 2727329 - RNA, 14 nt, Haemophilus influenzae Rd
guaauacaaaauau

SEQ ID NO: 2727330 - RNA, 15 nt, Haemophilus influenzae Rd
guaauagaguaccaa

SEQ ID NO: 2727331 - RNA, 21 nt, Haemophilus influenzae Rd
guaauagauaaaguaguuuua

SEQ ID NO: 2727332 - RNA, 17 nt, Haemophilus influenzae Rd
guaauagccauuuugga

SEQ ID NO: 2727333 - RNA, 24 nt, Haemophilus influenzae Rd
guaauauaaguuauuuauauaauu

SEQ ID NO: 2727334 - RNA, 15 nt, Haemophilus influenzae Rd
guaauauguaauauu

SEQ ID NO: 2727335 - RNA, 19 nt, Haemophilus influenzae Rd
guaauccaaguauaaaaaa

SEQ ID NO: 2727336 - RNA, 22 nt, Haemophilus influenzae Rd
guaauccauuuugaacaagguu

SEQ ID NO: 2727337 - RNA, 20 nt, Haemophilus influenzae Rd
guaaucgccccaaaagcugc

SEQ ID NO: 2727338 - RNA, 21 nt, Haemophilus influenzae Rd
guaaucgcucugcaagacuau

SEQ ID NO: 2727339 - RNA, 13 nt, Haemophilus influenzae Rd
guaaucuaaauau

SEQ ID NO: 2727340 - RNA, 18 nt, Haemophilus influenzae Rd
guaaucuaauucuugccc

SEQ ID NO: 2727341 - RNA, 15 nt, Haemophilus influenzae Rd
guaaugaaagaaaca

SEQ ID NO: 2727342 - RNA, 20 nt, Haemophilus influenzae Rd
guaaugacgugguuugcacc

SEQ ID NO: 2727343 - RNA, 18 nt, Haemophilus influenzae Rd
guaaugcaaaccauuuau

SEQ ID NO: 2727344 - RNA, 19 nt, Haemophilus influenzae Rd
guaaugcaaaccauuuauc

SEQ ID NO: 2727345 - RNA, 15 nt, Haemophilus influenzae Rd
guaaugcuaaauaua

SEQ ID NO: 2727346 - RNA, 16 nt, Haemophilus influenzae Rd
guaaugcuaaauauau

SEQ ID NO: 2727347 - RNA, 20 nt, Haemophilus influenzae Rd
guaaugcuugggaaucuggc

SEQ ID NO: 2727348 - RNA, 18 nt, Haemophilus influenzae Rd
guaaugcuuuauuuaaau

SEQ ID NO: 2727349 - RNA, 14 nt, Haemophilus influenzae Rd
guaauggaagaaua

SEQ ID NO: 2727350 - RNA, 14 nt, Haemophilus influenzae Rd
guaauggaauaugg

SEQ ID NO: 2727351 - RNA, 17 nt, Haemophilus influenzae Rd
guaauguuggaucccaa

SEQ ID NO: 2727352 - RNA, 22 nt, Haemophilus influenzae Rd
guaauguuuaaaguaagaauua

SEQ ID NO: 2727353 - RNA, 14 nt, Haemophilus influenzae Rd
guaauuaaaaauaa

SEQ ID NO: 2727354 - RNA, 22 nt, Haemophilus influenzae Rd
guaauuaaaaucacauaaaaaa

SEQ ID NO: 2727355 - RNA, 14 nt, Haemophilus influenzae Rd
guaauuaaacaaaa

SEQ ID NO: 2727356 - RNA, 16 nt, Haemophilus influenzae Rd
guaauuaagguuucuu

SEQ ID NO: 2727357 - RNA, 19 nt, Haemophilus influenzae Rd
guaauuauagagaaauaau

SEQ ID NO: 2727358 - RNA, 16 nt, Haemophilus influenzae Rd
guaauucgcaaauccu

SEQ ID NO: 2727359 - RNA, 23 nt, Haemophilus influenzae Rd
guaauucggcgugcguaccuugu

SEQ ID NO: 2727360 - RNA, 15 nt, Haemophilus influenzae Rd
guaauucuggcuguu

SEQ ID NO: 2727361 - RNA, 21 nt, Haemophilus influenzae Rd
guaauucuggcuguuuugcca

SEQ ID NO: 2727362 - RNA, 18 nt, Haemophilus influenzae Rd
guaauugauucgauaaau

SEQ ID NO: 2727363 - RNA, 23 nt, Haemophilus influenzae Rd
guaauuguagccguaaguuaaac

SEQ ID NO: 2727364 - RNA, 16 nt, Haemophilus influenzae Rd
guaauuuaaaaaguag

SEQ ID NO: 2727365 - RNA, 15 nt, Haemophilus influenzae Rd
guaauuuaucgccau

SEQ ID NO: 2727366 - RNA, 14 nt, Haemophilus influenzae Rd
guaauuucaaaucu

SEQ ID NO: 2727367 - RNA, 16 nt, Haemophilus influenzae Rd
guaauuucucaccaaa

SEQ ID NO: 2727368 - RNA, 17 nt, Haemophilus influenzae Rd
guaauuucucaccaaau

SEQ ID NO: 2727369 - RNA, 20 nt, Haemophilus influenzae Rd
guaauuucucaccaaauugu

SEQ ID NO: 2727370 - RNA, 20 nt, Haemophilus influenzae Rd
guaauuugaucuaauuugcc

SEQ ID NO: 2727371 - RNA, 22 nt, Haemophilus influenzae Rd
guaauuugaugcucagaaagac

SEQ ID NO: 2727372 - RNA, 18 nt, Haemophilus influenzae Rd
guaauuuggcguaaacac

SEQ ID NO: 2727373 - RNA, 22 nt, Haemophilus influenzae Rd
guaauuuggggcuaauuuauua

SEQ ID NO: 2727374 - RNA, 22 nt, Haemophilus influenzae Rd
guaauuuuggcgaaccuuucau

SEQ ID NO: 2727375 - RNA, 14 nt, Haemophilus influenzae Rd
guacaacauuuuga

SEQ ID NO: 2727376 - RNA, 17 nt, Haemophilus influenzae Rd
guacacaagaaaguuua

SEQ ID NO: 2727377 - RNA, 20 nt, Haemophilus influenzae Rd
guacacaaugcuaucaggcu

SEQ ID NO: 2727378 - RNA, 17 nt, Haemophilus influenzae Rd
guacauccgauggcaau

SEQ ID NO: 2727379 - RNA, 15 nt, Haemophilus influenzae Rd
guacaucuggauauu

SEQ ID NO: 2727380 - RNA, 22 nt, Haemophilus influenzae Rd
guacaucuggauauugcucaau

SEQ ID NO: 2727381 - RNA, 22 nt, Haemophilus influenzae Rd
guacauuaauguaaucaauugg

SEQ ID NO: 2727382 - RNA, 21 nt, Haemophilus influenzae Rd
guacauuauuaaccguuuuua

SEQ ID NO: 2727383 - RNA, 15 nt, Haemophilus influenzae Rd
guaccaaauuccauu

SEQ ID NO: 2727384 - RNA, 16 nt, Haemophilus influenzae Rd
guaccacgguugauac

SEQ ID NO: 2727385 - RNA, 20 nt, Haemophilus influenzae Rd
guaccauugugccaaauuca

SEQ ID NO: 2727386 - RNA, 13 nt, Haemophilus influenzae Rd
guaccuucugcug

SEQ ID NO: 2727387 - RNA, 14 nt, Haemophilus influenzae Rd
guaccuucugcugc

SEQ ID NO: 2727388 - RNA, 12 nt, Haemophilus influenzae Rd
guaccuuuaaau

SEQ ID NO: 2727389 - RNA, 20 nt, Haemophilus influenzae Rd
guaccuuuaaauucuucgaa

SEQ ID NO: 2727390 - RNA, 22 nt, Haemophilus influenzae Rd
guacgaauuaagcgaacaccuu

SEQ ID NO: 2727391 - RNA, 18 nt, Haemophilus influenzae Rd
guacgauaaacacugcgc

SEQ ID NO: 2727392 - RNA, 13 nt, Haemophilus influenzae Rd
guacgccacauac

SEQ ID NO: 2727393 - RNA, 20 nt, Haemophilus influenzae Rd
guacgccaugccaagcuaau

SEQ ID NO: 2727394 - RNA, 21 nt, Haemophilus influenzae Rd
guacguccaugaacuguaauu

SEQ ID NO: 2727395 - RNA, 21 nt, Haemophilus influenzae Rd
guacgucuuuuggcguuaaag

SEQ ID NO: 2727396 - RNA, 15 nt, Haemophilus influenzae Rd
guacuaauuguugua

SEQ ID NO: 2727397 - RNA, 17 nt, Haemophilus influenzae Rd
guacucgaaaaggcaaa

SEQ ID NO: 2727398 - RNA, 21 nt, Haemophilus influenzae Rd
guacuguugcgauuuccacuu

SEQ ID NO: 2727399 - RNA, 19 nt, Haemophilus influenzae Rd
guacuucacaguaaagauu

SEQ ID NO: 2727400 - RNA, 16 nt, Haemophilus influenzae Rd
guacuuggauugcaug

SEQ ID NO: 2727401 - RNA, 20 nt, Haemophilus influenzae Rd
guacuuggauugcaugaaau

SEQ ID NO: 2727402 - RNA, 21 nt, Haemophilus influenzae Rd
guacuuuuaacacuuuuucac

SEQ ID NO: 2727403 - RNA, 18 nt, Haemophilus influenzae Rd
guagaaaaucgcaauaaa

SEQ ID NO: 2727404 - RNA, 18 nt, Haemophilus influenzae Rd
guagaaaauuugaacagg

SEQ ID NO: 2727405 - RNA, 13 nt, Haemophilus influenzae Rd
guagaaaggcaau

SEQ ID NO: 2727406 - RNA, 19 nt, Haemophilus influenzae Rd
guagaaugggcauugacua

SEQ ID NO: 2727407 - RNA, 21 nt, Haemophilus influenzae Rd
guagacacaagggauuuaaaa

SEQ ID NO: 2727408 - RNA, 14 nt, Haemophilus influenzae Rd
guagagauaauaaa

SEQ ID NO: 2727409 - RNA, 18 nt, Haemophilus influenzae Rd
guagauaaaauauucaaa

SEQ ID NO: 2727410 - RNA, 22 nt, Haemophilus influenzae Rd
guagcacuuuccaucauugcuc

SEQ ID NO: 2727411 - RNA, 22 nt, Haemophilus influenzae Rd
guagccuuuaugacuauuuuuu

SEQ ID NO: 2727412 - RNA, 15 nt, Haemophilus influenzae Rd
guagcgcacugccgc

SEQ ID NO: 2727413 - RNA, 20 nt, Haemophilus influenzae Rd
guagcugaaacuaaaagggu

SEQ ID NO: 2727414 - RNA, 21 nt, Haemophilus influenzae Rd
guagcugaauaucagaagaau

SEQ ID NO: 2727415 - RNA, 19 nt, Haemophilus influenzae Rd
guaggauguucaaguaaau

SEQ ID NO: 2727416 - RNA, 13 nt, Haemophilus influenzae Rd
guagguaguuuuc

SEQ ID NO: 2727417 - RNA, 16 nt, Haemophilus influenzae Rd
guaguaaauuuuccaa

SEQ ID NO: 2727418 - RNA, 19 nt, Haemophilus influenzae Rd
guaguacaucauuugcaau

SEQ ID NO: 2727419 - RNA, 15 nt, Haemophilus influenzae Rd
guaguagauaacaac

SEQ ID NO: 2727420 - RNA, 16 nt, Haemophilus influenzae Rd
guaguagcguaaauca

SEQ ID NO: 2727421 - RNA, 18 nt, Haemophilus influenzae Rd
guagugaguauguugcuu

SEQ ID NO: 2727422 - RNA, 22 nt, Haemophilus influenzae Rd
guaguggugguggaauaaauaa

SEQ ID NO: 2727423 - RNA, 19 nt, Haemophilus influenzae Rd
guaguuaaaccaaauuuug

SEQ ID NO: 2727424 - RNA, 14 nt, Haemophilus influenzae Rd
guaguuggaacuga

SEQ ID NO: 2727425 - RNA, 12 nt, Haemophilus influenzae Rd
guaguuggcaua

SEQ ID NO: 2727426 - RNA, 18 nt, Haemophilus influenzae Rd
guaguuuaggaaguaaau

SEQ ID NO: 2727427 - RNA, 17 nt, Haemophilus influenzae Rd
guaguuuauaaaaaaau

SEQ ID NO: 2727428 - RNA, 18 nt, Haemophilus influenzae Rd
guaguuuauaaaaaaauc

SEQ ID NO: 2727429 - RNA, 17 nt, Haemophilus influenzae Rd
guaguuuucaauaucaa

SEQ ID NO: 2727430 - RNA, 22 nt, Haemophilus influenzae Rd
guaguuuucuguauaccaacca

SEQ ID NO: 2727431 - RNA, 20 nt, Haemophilus influenzae Rd
guaguuuuucacgccgauac

SEQ ID NO: 2727432 - RNA, 12 nt, Haemophilus influenzae Rd
guauaaaccuug

SEQ ID NO: 2727433 - RNA, 17 nt, Haemophilus influenzae Rd
guauaaaccuugcauuu

SEQ ID NO: 2727434 - RNA, 16 nt, Haemophilus influenzae Rd
guauaaagcauaauau

SEQ ID NO: 2727435 - RNA, 17 nt, Haemophilus influenzae Rd
guauaagcaaugcaagc

SEQ ID NO: 2727436 - RNA, 20 nt, Haemophilus influenzae Rd
guauaagcuaaagcaauugc

SEQ ID NO: 2727437 - RNA, 22 nt, Haemophilus influenzae Rd
guauaauauuuucuuuuauccg

SEQ ID NO: 2727438 - RNA, 13 nt, Haemophilus influenzae Rd
guauacuuuauaa

SEQ ID NO: 2727439 - RNA, 20 nt, Haemophilus influenzae Rd
guauagaacgguuaugaaaa

SEQ ID NO: 2727440 - RNA, 15 nt, Haemophilus influenzae Rd
guauagcuuugcuuu

SEQ ID NO: 2727441 - RNA, 15 nt, Haemophilus influenzae Rd
guauagcuuuuugca

SEQ ID NO: 2727442 - RNA, 16 nt, Haemophilus influenzae Rd
guauagcuuuuugcac

SEQ ID NO: 2727443 - RNA, 18 nt, Haemophilus influenzae Rd
guauauucgccuucacaa

SEQ ID NO: 2727444 - RNA, 16 nt, Haemophilus influenzae Rd
guauauuuaucuaagc

SEQ ID NO: 2727445 - RNA, 16 nt, Haemophilus influenzae Rd
guaucaaauacacaaa

SEQ ID NO: 2727446 - RNA, 17 nt, Haemophilus influenzae Rd
guaucaauuuuauugaa

SEQ ID NO: 2727447 - RNA, 19 nt, Haemophilus influenzae Rd
guaucacgcacaccaccug

SEQ ID NO: 2727448 - RNA, 18 nt, Haemophilus influenzae Rd
guaucagcuguugcaaug

SEQ ID NO: 2727449 - RNA, 21 nt, Haemophilus influenzae Rd
guaucagcuguugcaaugaca

SEQ ID NO: 2727450 - RNA, 16 nt, Haemophilus influenzae Rd
guaucuaaauuugcug

SEQ ID NO: 2727451 - RNA, 16 nt, Haemophilus influenzae Rd
guaucuacuuuauuca

SEQ ID NO: 2727452 - RNA, 21 nt, Haemophilus influenzae Rd
guaugacaaacggaaaauuug

SEQ ID NO: 2727453 - RNA, 18 nt, Haemophilus influenzae Rd
guaugacuauuuagaaau

SEQ ID NO: 2727454 - RNA, 13 nt, Haemophilus influenzae Rd
guaugccaguggg

SEQ ID NO: 2727455 - RNA, 23 nt, Haemophilus influenzae Rd
guaugggagacgccuaaacguug

SEQ ID NO: 2727456 - RNA, 17 nt, Haemophilus influenzae Rd
guauguauuuucaacaa

SEQ ID NO: 2727457 - RNA, 14 nt, Haemophilus influenzae Rd
guauuaaauaccgc

SEQ ID NO: 2727458 - RNA, 10 nt, Haemophilus influenzae Rd
guauuaagua

SEQ ID NO: 2727459 - RNA, 12 nt, Haemophilus influenzae Rd
guauuaaguaaa

SEQ ID NO: 2727460 - RNA, 15 nt, Haemophilus influenzae Rd
guauuagaaguaaau

SEQ ID NO: 2727461 - RNA, 18 nt, Haemophilus influenzae Rd
guauuagaaguaaauuca

SEQ ID NO: 2727462 - RNA, 19 nt, Haemophilus influenzae Rd
guauucagugccuaaauuu

SEQ ID NO: 2727463 - RNA, 21 nt, Haemophilus influenzae Rd
guauucagugccuaaauuucc

SEQ ID NO: 2727464 - RNA, 19 nt, Haemophilus influenzae Rd
guauucauauaauucauua

SEQ ID NO: 2727465 - RNA, 22 nt, Haemophilus influenzae Rd
guauucauauaauucauuagcc

SEQ ID NO: 2727466 - RNA, 20 nt, Haemophilus influenzae Rd
guauucaugauguaauucug

SEQ ID NO: 2727467 - RNA, 21 nt, Haemophilus influenzae Rd
guauucgccacgauaggaucu

SEQ ID NO: 2727468 - RNA, 24 nt, Haemophilus influenzae Rd
guauucgggcuucucaaaugaaau

SEQ ID NO: 2727469 - RNA, 23 nt, Haemophilus influenzae Rd
guauucuuuaaagagcaaauuua

SEQ ID NO: 2727470 - RNA, 17 nt, Haemophilus influenzae Rd
guauugaacuaaaauau

SEQ ID NO: 2727471 - RNA, 17 nt, Haemophilus influenzae Rd
guauugaauaauuacuu

SEQ ID NO: 2727472 - RNA, 15 nt, Haemophilus influenzae Rd
guauugcauaaaagc

SEQ ID NO: 2727473 - RNA, 22 nt, Haemophilus influenzae Rd
guauuguuggcccaacagaaau

SEQ ID NO: 2727474 - RNA, 18 nt, Haemophilus influenzae Rd
guauuuacaagucucuau

SEQ ID NO: 2727475 - RNA, 13 nt, Haemophilus influenzae Rd
guauuuacuaaau

SEQ ID NO: 2727476 - RNA, 16 nt, Haemophilus influenzae Rd
guauuuacuaaauucu

SEQ ID NO: 2727477 - RNA, 16 nt, Haemophilus influenzae Rd
guauuuacugauuuua

SEQ ID NO: 2727478 - RNA, 21 nt, Haemophilus influenzae Rd
guauuuccuauuuacguaaaa

SEQ ID NO: 2727479 - RNA, 19 nt, Haemophilus influenzae Rd
guauuucgucuuaauuuuu

SEQ ID NO: 2727480 - RNA, 15 nt, Haemophilus influenzae Rd
guauuuuauuuauag

SEQ ID NO: 2727481 - RNA, 13 nt, Haemophilus influenzae Rd
guauuuuccaugc

SEQ ID NO: 2727482 - RNA, 12 nt, Haemophilus influenzae Rd
guauuuucucau

SEQ ID NO: 2727483 - RNA, 12 nt, Haemophilus influenzae Rd
guauuuugcaag

SEQ ID NO: 2727484 - RNA, 12 nt, Haemophilus influenzae Rd
guauuuuuauuu

SEQ ID NO: 2727485 - RNA, 18 nt, Haemophilus influenzae Rd
guauuuuuauuuauagca

SEQ ID NO: 2727486 - RNA, 19 nt, Haemophilus influenzae Rd
guauuuuucauaucuuccg

SEQ ID NO: 2727487 - RNA, 20 nt, Haemophilus influenzae Rd
guauuuuucauaucuuccgu

SEQ ID NO: 2727488 - RNA, 13 nt, Haemophilus influenzae Rd
guauuuuugaaug

SEQ ID NO: 2727489 - RNA, 21 nt, Haemophilus influenzae Rd
guauuuuugucccaaaauauu

SEQ ID NO: 2727490 - RNA, 12 nt, Haemophilus influenzae Rd
guauuuuuuaau

SEQ ID NO: 2727491 - RNA, 12 nt, Haemophilus influenzae Rd
guauuuuuuagu

SEQ ID NO: 2727492 - RNA, 21 nt, Haemophilus influenzae Rd
guauuuuuuauugaaauuuua

SEQ ID NO: 2727493 - RNA, 14 nt, Haemophilus influenzae Rd
guauuuuuuuauuu

SEQ ID NO: 2727494 - RNA, 23 nt, Haemophilus influenzae Rd
guauuuuuuuauuuacuuuauuu

SEQ ID NO: 2727495 - RNA, 21 nt, Haemophilus influenzae Rd
gucaaaauuaugcugauuuga

SEQ ID NO: 2727496 - RNA, 17 nt, Haemophilus influenzae Rd
gucaagaucggaauauu

SEQ ID NO: 2727497 - RNA, 19 nt, Haemophilus influenzae Rd
gucaagugguuuauuuuuu

SEQ ID NO: 2727498 - RNA, 19 nt, Haemophilus influenzae Rd
gucaauaaaaauaauguuu

SEQ ID NO: 2727499 - RNA, 17 nt, Haemophilus influenzae Rd
gucaauauauucuuggu

SEQ ID NO: 2727500 - RNA, 19 nt, Haemophilus influenzae Rd
gucaauugcuaaaccugca

SEQ ID NO: 2727501 - RNA, 19 nt, Haemophilus influenzae Rd
gucaauuuacccacaacuc

SEQ ID NO: 2727502 - RNA, 13 nt, Haemophilus influenzae Rd
gucaauuuuucua

SEQ ID NO: 2727503 - RNA, 15 nt, Haemophilus influenzae Rd
gucacagcaagaaca

SEQ ID NO: 2727504 - RNA, 22 nt, Haemophilus influenzae Rd
gucaccaucacaagcaaguuug

SEQ ID NO: 2727505 - RNA, 20 nt, Haemophilus influenzae Rd
gucacgauuuuuuuauaaaa

SEQ ID NO: 2727506 - RNA, 16 nt, Haemophilus influenzae Rd
gucacgcuguaaacaa

SEQ ID NO: 2727507 - RNA, 22 nt, Haemophilus influenzae Rd
gucacgcuguaaacaagauucu

SEQ ID NO: 2727508 - RNA, 22 nt, Haemophilus influenzae Rd
gucacugcaguaaaaucuucac

SEQ ID NO: 2727509 - RNA, 20 nt, Haemophilus influenzae Rd
gucacuucuucaauacguuu

SEQ ID NO: 2727510 - RNA, 20 nt, Haemophilus influenzae Rd
gucagcaauacccgcuucaa

SEQ ID NO: 2727511 - RNA, 14 nt, Haemophilus influenzae Rd
gucagcauaaacaa

SEQ ID NO: 2727512 - RNA, 21 nt, Haemophilus influenzae Rd
gucagcauaaacaaaauaaac

SEQ ID NO: 2727513 - RNA, 15 nt, Haemophilus influenzae Rd
gucagugaauuuagc

SEQ ID NO: 2727514 - RNA, 22 nt, Haemophilus influenzae Rd
gucaguuugcuuugauaaaugg

SEQ ID NO: 2727515 - RNA, 18 nt, Haemophilus influenzae Rd
gucauauaaccacguaau

SEQ ID NO: 2727516 - RNA, 11 nt, Haemophilus influenzae Rd
gucauauucau

SEQ ID NO: 2727517 - RNA, 22 nt, Haemophilus influenzae Rd
gucaucacucguugguauuuac

SEQ ID NO: 2727518 - RNA, 20 nt, Haemophilus influenzae Rd
gucaucagaaauaucuucaa

SEQ ID NO: 2727519 - RNA, 21 nt, Haemophilus influenzae Rd
gucaucgaguuuuaucuucaa

SEQ ID NO: 2727520 - RNA, 16 nt, Haemophilus influenzae Rd
gucaugccgcaaucaa

SEQ ID NO: 2727521 - RNA, 19 nt, Haemophilus influenzae Rd
gucaugugauuaaacggac

SEQ ID NO: 2727522 - RNA, 15 nt, Haemophilus influenzae Rd
gucauuaaaaaauaa

SEQ ID NO: 2727523 - RNA, 17 nt, Haemophilus influenzae Rd
gucauuaauuuuuucac

SEQ ID NO: 2727524 - RNA, 21 nt, Haemophilus influenzae Rd
gucauucaaugcagaaauacu

SEQ ID NO: 2727525 - RNA, 17 nt, Haemophilus influenzae Rd
gucauugggcguaaugu

SEQ ID NO: 2727526 - RNA, 14 nt, Haemophilus influenzae Rd
gucauuuaauucug

SEQ ID NO: 2727527 - RNA, 13 nt, Haemophilus influenzae Rd
gucauuuauaaaa

SEQ ID NO: 2727528 - RNA, 18 nt, Haemophilus influenzae Rd
gucauuuauggaaauaaa

SEQ ID NO: 2727529 - RNA, 16 nt, Haemophilus influenzae Rd
guccaaagaaguuuuc

SEQ ID NO: 2727530 - RNA, 14 nt, Haemophilus influenzae Rd
guccaagguuuuaa

SEQ ID NO: 2727531 - RNA, 12 nt, Haemophilus influenzae Rd
guccaccacugg

SEQ ID NO: 2727532 - RNA, 21 nt, Haemophilus influenzae Rd
guccaucaaaaaaauaagugu

SEQ ID NO: 2727533 - RNA, 17 nt, Haemophilus influenzae Rd
gucccaaaauauuuuca

SEQ ID NO: 2727534 - RNA, 20 nt, Haemophilus influenzae Rd
gucccgcauauaaaauaaag

SEQ ID NO: 2727535 - RNA, 18 nt, Haemophilus influenzae Rd
gucccuguucaaauucug

SEQ ID NO: 2727536 - RNA, 20 nt, Haemophilus influenzae Rd
guccgaccauuaaauccuga

SEQ ID NO: 2727537 - RNA, 23 nt, Haemophilus influenzae Rd
guccgugccaaagcauuaaguuu

SEQ ID NO: 2727538 - RNA, 19 nt, Haemophilus influenzae Rd
guccugcagccgccaugga

SEQ ID NO: 2727539 - RNA, 22 nt, Haemophilus influenzae Rd
guccuucauugauggaauaaau

SEQ ID NO: 2727540 - RNA, 21 nt, Haemophilus influenzae Rd
gucgcacguuuacuuuuucca

SEQ ID NO: 2727541 - RNA, 12 nt, Haemophilus influenzae Rd
gucgcuaacaua

SEQ ID NO: 2727542 - RNA, 22 nt, Haemophilus influenzae Rd
gucgcuaauaccgcguauuauc

SEQ ID NO: 2727543 - RNA, 13 nt, Haemophilus influenzae Rd
gucgcuacauuuc

SEQ ID NO: 2727544 - RNA, 19 nt, Haemophilus influenzae Rd
gucgcuucuaauucugcac

SEQ ID NO: 2727545 - RNA, 21 nt, Haemophilus influenzae Rd
gucgcuuuucccucuuuuuca

SEQ ID NO: 2727546 - RNA, 14 nt, Haemophilus influenzae Rd
gucgcuuuuuccuc

SEQ ID NO: 2727547 - RNA, 23 nt, Haemophilus influenzae Rd
gucguaaugaaaaccuucaauug

SEQ ID NO: 2727548 - RNA, 15 nt, Haemophilus influenzae Rd
gucgugaucugcauc

SEQ ID NO: 2727549 - RNA, 16 nt, Haemophilus influenzae Rd
gucguuauuuuuugcu

SEQ ID NO: 2727550 - RNA, 19 nt, Haemophilus influenzae Rd
gucguuguuccuaaugugc

SEQ ID NO: 2727551 - RNA, 22 nt, Haemophilus influenzae Rd
gucuaaagagcggucgguuuuu

SEQ ID NO: 2727552 - RNA, 15 nt, Haemophilus influenzae Rd
gucuaacuuuuucaa

SEQ ID NO: 2727553 - RNA, 22 nt, Haemophilus influenzae Rd
gucuaaugaugcuucagcguug

SEQ ID NO: 2727554 - RNA, 17 nt, Haemophilus influenzae Rd
gucuaaugccgccuuau

SEQ ID NO: 2727555 - RNA, 17 nt, Haemophilus influenzae Rd
gucuaauuuuuuauuca

SEQ ID NO: 2727556 - RNA, 12 nt, Haemophilus influenzae Rd
gucuaucuaaga

SEQ ID NO: 2727557 - RNA, 15 nt, Haemophilus influenzae Rd
gucuaucuaagauaa

SEQ ID NO: 2727558 - RNA, 13 nt, Haemophilus influenzae Rd
gucuauuauaaau

SEQ ID NO: 2727559 - RNA, 13 nt, Haemophilus influenzae Rd
gucuauuuugacc

SEQ ID NO: 2727560 - RNA, 18 nt, Haemophilus influenzae Rd
gucucaaaucguuugucg

SEQ ID NO: 2727561 - RNA, 15 nt, Haemophilus influenzae Rd
gucucaaauuuuuca

SEQ ID NO: 2727562 - RNA, 22 nt, Haemophilus influenzae Rd
gucucucaccgugccacgccca

SEQ ID NO: 2727563 - RNA, 14 nt, Haemophilus influenzae Rd
gucugaaauuuuua

SEQ ID NO: 2727564 - RNA, 21 nt, Haemophilus influenzae Rd
gucugcgccuaaaauauuuuc

SEQ ID NO: 2727565 - RNA, 16 nt, Haemophilus influenzae Rd
gucugcuccaaauaau

SEQ ID NO: 2727566 - RNA, 18 nt, Haemophilus influenzae Rd
gucugcuccaaauaaucc

SEQ ID NO: 2727567 - RNA, 15 nt, Haemophilus influenzae Rd
gucuggcugaguaaa

SEQ ID NO: 2727568 - RNA, 12 nt, Haemophilus influenzae Rd
gucuguuuaaaa

SEQ ID NO: 2727569 - RNA, 19 nt, Haemophilus influenzae Rd
gucuguuuaaaaacggaau

SEQ ID NO: 2727570 - RNA, 19 nt, Haemophilus influenzae Rd
gucuuaaucuuaucaaaca

SEQ ID NO: 2727571 - RNA, 16 nt, Haemophilus influenzae Rd
gucuuacuuuuuguuu

SEQ ID NO: 2727572 - RNA, 20 nt, Haemophilus influenzae Rd
gucuuacuuuuuguuuguaa

SEQ ID NO: 2727573 - RNA, 19 nt, Haemophilus influenzae Rd
gucuuagacucguuuuuua

SEQ ID NO: 2727574 - RNA, 17 nt, Haemophilus influenzae Rd
gucuucaagucuuuuuu

SEQ ID NO: 2727575 - RNA, 18 nt, Haemophilus influenzae Rd
gucuucaagucuuuuuuu

SEQ ID NO: 2727576 - RNA, 18 nt, Haemophilus influenzae Rd
gucuucaucuuuaaacau

SEQ ID NO: 2727577 - RNA, 21 nt, Haemophilus influenzae Rd
gucuuccacaacggaagauuu

SEQ ID NO: 2727578 - RNA, 18 nt, Haemophilus influenzae Rd
gucuugaccugcagccau

SEQ ID NO: 2727579 - RNA, 18 nt, Haemophilus influenzae Rd
gucuuguuuucaauaguu

SEQ ID NO: 2727580 - RNA, 22 nt, Haemophilus influenzae Rd
gucuuuaggauuguugauuuug

SEQ ID NO: 2727581 - RNA, 13 nt, Haemophilus influenzae Rd
gucuuuguuaucg

SEQ ID NO: 2727582 - RNA, 13 nt, Haemophilus influenzae Rd
gucuuuuggcguu

SEQ ID NO: 2727583 - RNA, 21 nt, Haemophilus influenzae Rd
gucuuuuuaauuuaaauaaag

SEQ ID NO: 2727584 - RNA, 12 nt, Haemophilus influenzae Rd
gugaaaaaauaa

SEQ ID NO: 2727585 - RNA, 22 nt, Haemophilus influenzae Rd
gugaaaggaaacgcccauuuau

SEQ ID NO: 2727586 - RNA, 13 nt, Haemophilus influenzae Rd
gugaaauaaaaua

SEQ ID NO: 2727587 - RNA, 19 nt, Haemophilus influenzae Rd
gugaaauuacucaucugaa

SEQ ID NO: 2727588 - RNA, 22 nt, Haemophilus influenzae Rd
gugaaauuacuugaaucuaauc

SEQ ID NO: 2727589 - RNA, 18 nt, Haemophilus influenzae Rd
gugaaauucuaccugcug

SEQ ID NO: 2727590 - RNA, 16 nt, Haemophilus influenzae Rd
gugaacugcuugcgcu

SEQ ID NO: 2727591 - RNA, 17 nt, Haemophilus influenzae Rd
gugaacuuugugccauu

SEQ ID NO: 2727592 - RNA, 19 nt, Haemophilus influenzae Rd
gugaaguuauaguauauuu

SEQ ID NO: 2727593 - RNA, 18 nt, Haemophilus influenzae Rd
gugaaguuuaugaucuac

SEQ ID NO: 2727594 - RNA, 16 nt, Haemophilus influenzae Rd
gugaauaucugucauu

SEQ ID NO: 2727595 - RNA, 19 nt, Haemophilus influenzae Rd
gugaaucacaacauauaaa

SEQ ID NO: 2727596 - RNA, 20 nt, Haemophilus influenzae Rd
gugaaucacaacauauaaau

SEQ ID NO: 2727597 - RNA, 21 nt, Haemophilus influenzae Rd
gugaaugcauuggcugaauuu

SEQ ID NO: 2727598 - RNA, 17 nt, Haemophilus influenzae Rd
gugaauuuagccauuuu

SEQ ID NO: 2727599 - RNA, 17 nt, Haemophilus influenzae Rd
gugacagcuugcauauu

SEQ ID NO: 2727600 - RNA, 13 nt, Haemophilus influenzae Rd
gugaccagucauu

SEQ ID NO: 2727601 - RNA, 16 nt, Haemophilus influenzae Rd
gugaccugcgauaaua

SEQ ID NO: 2727602 - RNA, 22 nt, Haemophilus influenzae Rd
gugacuuuuugugccaauccau

SEQ ID NO: 2727603 - RNA, 13 nt, Haemophilus influenzae Rd
gugagauccuuua

SEQ ID NO: 2727604 - RNA, 15 nt, Haemophilus influenzae Rd
gugagauuucuugcu

SEQ ID NO: 2727605 - RNA, 15 nt, Haemophilus influenzae Rd
gugagcaguggcuug

SEQ ID NO: 2727606 - RNA, 16 nt, Haemophilus influenzae Rd
gugagcuaagcauuuc

SEQ ID NO: 2727607 - RNA, 17 nt, Haemophilus influenzae Rd
gugagcuugauuuucag

SEQ ID NO: 2727608 - RNA, 15 nt, Haemophilus influenzae Rd
gugaguaaaauauag

SEQ ID NO: 2727609 - RNA, 17 nt, Haemophilus influenzae Rd
gugagugagcauuucgu

SEQ ID NO: 2727610 - RNA, 20 nt, Haemophilus influenzae Rd
gugauacggaaaguauuuuc

SEQ ID NO: 2727611 - RNA, 21 nt, Haemophilus influenzae Rd
gugaucacaaggcucaucauu

SEQ ID NO: 2727612 - RNA, 13 nt, Haemophilus influenzae Rd
gugaucauuugga

SEQ ID NO: 2727613 - RNA, 19 nt, Haemophilus influenzae Rd
gugaucccagcauaaauaa

SEQ ID NO: 2727614 - RNA, 13 nt, Haemophilus influenzae Rd
gugaugaaacaau

SEQ ID NO: 2727615 - RNA, 21 nt, Haemophilus influenzae Rd
gugaugcgugucaaauuaauu

SEQ ID NO: 2727616 - RNA, 13 nt, Haemophilus influenzae Rd
gugauguaauauu

SEQ ID NO: 2727617 - RNA, 18 nt, Haemophilus influenzae Rd
gugauguaccaauuugua

SEQ ID NO: 2727618 - RNA, 14 nt, Haemophilus influenzae Rd
gugauuaaaauuga

SEQ ID NO: 2727619 - RNA, 18 nt, Haemophilus influenzae Rd
gugauuaagugcggugaa

SEQ ID NO: 2727620 - RNA, 23 nt, Haemophilus influenzae Rd
gugauugacauuuuacuuuagca

SEQ ID NO: 2727621 - RNA, 14 nt, Haemophilus influenzae Rd
gugauuuaccaaua

SEQ ID NO: 2727622 - RNA, 18 nt, Haemophilus influenzae Rd
gugauuucuauguuauua

SEQ ID NO: 2727623 - RNA, 13 nt, Haemophilus influenzae Rd
gugauuuuagaaa

SEQ ID NO: 2727624 - RNA, 21 nt, Haemophilus influenzae Rd
gugauuuuaguuucuaauucu

SEQ ID NO: 2727625 - RNA, 20 nt, Haemophilus influenzae Rd
gugauuuucagcaaaaugcg

SEQ ID NO: 2727626 - RNA, 14 nt, Haemophilus influenzae Rd
gugauuuuuuucau

SEQ ID NO: 2727627 - RNA, 16 nt, Haemophilus influenzae Rd
gugauuuuuuucauuu

SEQ ID NO: 2727628 - RNA, 16 nt, Haemophilus influenzae Rd
gugcaaauuuuuucaa

SEQ ID NO: 2727629 - RNA, 15 nt, Haemophilus influenzae Rd
gugcaauuugaucuu

SEQ ID NO: 2727630 - RNA, 20 nt, Haemophilus influenzae Rd
gugcacccgccgcaccuaaa

SEQ ID NO: 2727631 - RNA, 18 nt, Haemophilus influenzae Rd
gugcaugagcuuugcuuu

SEQ ID NO: 2727632 - RNA, 21 nt, Haemophilus influenzae Rd
gugcauguuuacuuaaaucuu

SEQ ID NO: 2727633 - RNA, 19 nt, Haemophilus influenzae Rd
gugcauuaaaucaaauuua

SEQ ID NO: 2727634 - RNA, 17 nt, Haemophilus influenzae Rd
gugcauuaaugccucag

SEQ ID NO: 2727635 - RNA, 17 nt, Haemophilus influenzae Rd
gugccaauacuugcagu

SEQ ID NO: 2727636 - RNA, 19 nt, Haemophilus influenzae Rd
gugccagcuggaaauucca

SEQ ID NO: 2727637 - RNA, 16 nt, Haemophilus influenzae Rd
gugccauguacauuaa

SEQ ID NO: 2727638 - RNA, 17 nt, Haemophilus influenzae Rd
gugccauuucuaaacca

SEQ ID NO: 2727639 - RNA, 20 nt, Haemophilus influenzae Rd
gugccauuuggucuaacauu

SEQ ID NO: 2727640 - RNA, 16 nt, Haemophilus influenzae Rd
gugcccgcuacaaaua

SEQ ID NO: 2727641 - RNA, 18 nt, Haemophilus influenzae Rd
gugcccgcuacaaauaag

SEQ ID NO: 2727642 - RNA, 22 nt, Haemophilus influenzae Rd
gugcgauaguguucgcaauuaa

SEQ ID NO: 2727643 - RNA, 13 nt, Haemophilus influenzae Rd
gugcgauauuuuu

SEQ ID NO: 2727644 - RNA, 21 nt, Haemophilus influenzae Rd
gugcgccaccuuuuguagaaa

SEQ ID NO: 2727645 - RNA, 23 nt, Haemophilus influenzae Rd
gugcgccauuuuuaaaacggcuc

SEQ ID NO: 2727646 - RNA, 14 nt, Haemophilus influenzae Rd
gugcggaaaauuuu

SEQ ID NO: 2727647 - RNA, 18 nt, Haemophilus influenzae Rd
gugcggaaauauuuuaau

SEQ ID NO: 2727648 - RNA, 14 nt, Haemophilus influenzae Rd
gugcggagaaaauu

SEQ ID NO: 2727649 - RNA, 17 nt, Haemophilus influenzae Rd
gugcggauuaagauggc

SEQ ID NO: 2727650 - RNA, 13 nt, Haemophilus influenzae Rd
gugcggcaaaaaa

SEQ ID NO: 2727651 - RNA, 15 nt, Haemophilus influenzae Rd
gugcgguaagaaaau

SEQ ID NO: 2727652 - RNA, 14 nt, Haemophilus influenzae Rd
gugcgguaaucuuu

SEQ ID NO: 2727653 - RNA, 14 nt, Haemophilus influenzae Rd
gugcgguacguccc

SEQ ID NO: 2727654 - RNA, 20 nt, Haemophilus influenzae Rd
gugcgguuaaaaaagaaaua

SEQ ID NO: 2727655 - RNA, 15 nt, Haemophilus influenzae Rd
gugcgguugaaauuu

SEQ ID NO: 2727656 - RNA, 22 nt, Haemophilus influenzae Rd
gugcuaaaauaaaaccuucugg

SEQ ID NO: 2727657 - RNA, 23 nt, Haemophilus influenzae Rd
gugcuaaauggaauguagauaau

SEQ ID NO: 2727658 - RNA, 17 nt, Haemophilus influenzae Rd
gugcuauacaaaauuuu

SEQ ID NO: 2727659 - RNA, 18 nt, Haemophilus influenzae Rd
gugcuauacaaaauuuug

SEQ ID NO: 2727660 - RNA, 19 nt, Haemophilus influenzae Rd
gugcuauagcuugcagauu

SEQ ID NO: 2727661 - RNA, 14 nt, Haemophilus influenzae Rd
gugcucgauuuuua

SEQ ID NO: 2727662 - RNA, 14 nt, Haemophilus influenzae Rd
gugcugcaacuggg

SEQ ID NO: 2727663 - RNA, 12 nt, Haemophilus influenzae Rd
gugcuguuuuca

SEQ ID NO: 2727664 - RNA, 19 nt, Haemophilus influenzae Rd
gugcuuaacugaaaauuca

SEQ ID NO: 2727665 - RNA, 15 nt, Haemophilus influenzae Rd
gugcuucauagaaac

SEQ ID NO: 2727666 - RNA, 14 nt, Haemophilus influenzae Rd
gugcuuguuuuaaa

SEQ ID NO: 2727667 - RNA, 23 nt, Haemophilus influenzae Rd
gugcuuugcugccacuucagcua

SEQ ID NO: 2727668 - RNA, 18 nt, Haemophilus influenzae Rd
gugcuuuuaaauuuuuaa

SEQ ID NO: 2727669 - RNA, 18 nt, Haemophilus influenzae Rd
guggaaauugccaaaaaa

SEQ ID NO: 2727670 - RNA, 14 nt, Haemophilus influenzae Rd
guggaagguaauuu

SEQ ID NO: 2727671 - RNA, 19 nt, Haemophilus influenzae Rd
guggaaucgguagacacaa

SEQ ID NO: 2727672 - RNA, 14 nt, Haemophilus influenzae Rd
guggacguuucaaa

SEQ ID NO: 2727673 - RNA, 15 nt, Haemophilus influenzae Rd
guggaguuauuucuu

SEQ ID NO: 2727674 - RNA, 19 nt, Haemophilus influenzae Rd
guggauaauucaucaaaau

SEQ ID NO: 2727675 - RNA, 22 nt, Haemophilus influenzae Rd
guggauaauucaucaaaauuua

SEQ ID NO: 2727676 - RNA, 20 nt, Haemophilus influenzae Rd
guggaucaugguaauuuaau

SEQ ID NO: 2727677 - RNA, 14 nt, Haemophilus influenzae Rd
guggauugauaauu

SEQ ID NO: 2727678 - RNA, 17 nt, Haemophilus influenzae Rd
guggauugguuggaaac

SEQ ID NO: 2727679 - RNA, 23 nt, Haemophilus influenzae Rd
guggcaauaguuggguaaucaaa

SEQ ID NO: 2727680 - RNA, 22 nt, Haemophilus influenzae Rd
guggcacgccuaauucuugcca

SEQ ID NO: 2727681 - RNA, 22 nt, Haemophilus influenzae Rd
guggcgaaauuuccgcagguga

SEQ ID NO: 2727682 - RNA, 18 nt, Haemophilus influenzae Rd
guggcuuuucugauaauu

SEQ ID NO: 2727683 - RNA, 19 nt, Haemophilus influenzae Rd
guggcuuuucugauaauuu

SEQ ID NO: 2727684 - RNA, 14 nt, Haemophilus influenzae Rd
gugggaauuuuccc

SEQ ID NO: 2727685 - RNA, 21 nt, Haemophilus influenzae Rd
guggguaaaccaaacgagaaa

SEQ ID NO: 2727686 - RNA, 14 nt, Haemophilus influenzae Rd
gugggugcugcaac

SEQ ID NO: 2727687 - RNA, 21 nt, Haemophilus influenzae Rd
gugguaaauaauuuucaguga

SEQ ID NO: 2727688 - RNA, 14 nt, Haemophilus influenzae Rd
gugguauucuuucc

SEQ ID NO: 2727689 - RNA, 20 nt, Haemophilus influenzae Rd
guguagauaaaauauucaaa

SEQ ID NO: 2727690 - RNA, 14 nt, Haemophilus influenzae Rd
guguauaacaaaua

SEQ ID NO: 2727691 - RNA, 20 nt, Haemophilus influenzae Rd
guguauggucgguauucaua

SEQ ID NO: 2727692 - RNA, 21 nt, Haemophilus influenzae Rd
gugucaaaugccgcuaauggu

SEQ ID NO: 2727693 - RNA, 23 nt, Haemophilus influenzae Rd
gugucacagcaagaacagccagu

SEQ ID NO: 2727694 - RNA, 18 nt, Haemophilus influenzae Rd
gugucggugguucgauuc

SEQ ID NO: 2727695 - RNA, 17 nt, Haemophilus influenzae Rd
gugucucugcccauaag

SEQ ID NO: 2727696 - RNA, 15 nt, Haemophilus influenzae Rd
gugugauguauuuuc

SEQ ID NO: 2727697 - RNA, 24 nt, Haemophilus influenzae Rd
gugugcaauaaccguacauucuuc

SEQ ID NO: 2727698 - RNA, 22 nt, Haemophilus influenzae Rd
gugugcuugcauuuacauaaac

SEQ ID NO: 2727699 - RNA, 13 nt, Haemophilus influenzae Rd
guguggaaaaaug

SEQ ID NO: 2727700 - RNA, 18 nt, Haemophilus influenzae Rd
guguuauuggaaaauuca

SEQ ID NO: 2727701 - RNA, 16 nt, Haemophilus influenzae Rd
guguucgcuuccuuuc

SEQ ID NO: 2727702 - RNA, 14 nt, Haemophilus influenzae Rd
guguuucagcuucg

SEQ ID NO: 2727703 - RNA, 15 nt, Haemophilus influenzae Rd
guguuugaaaagaaa

SEQ ID NO: 2727704 - RNA, 17 nt, Haemophilus influenzae Rd
guguuuuguaauugcuc

SEQ ID NO: 2727705 - RNA, 12 nt, Haemophilus influenzae Rd
guguuuuuucac

SEQ ID NO: 2727706 - RNA, 11 nt, Haemophilus influenzae Rd
guuaaaaauag

SEQ ID NO: 2727707 - RNA, 21 nt, Haemophilus influenzae Rd
guuaaaacaaaagaaauuuua

SEQ ID NO: 2727708 - RNA, 15 nt, Haemophilus influenzae Rd
guuaaaaguaagcaa

SEQ ID NO: 2727709 - RNA, 22 nt, Haemophilus influenzae Rd
guuaaaauugccccuucaccuu

SEQ ID NO: 2727710 - RNA, 19 nt, Haemophilus influenzae Rd
guuaaacagcuuuccugua

SEQ ID NO: 2727711 - RNA, 15 nt, Haemophilus influenzae Rd
guuaaaccaaauaau

SEQ ID NO: 2727712 - RNA, 17 nt, Haemophilus influenzae Rd
guuaaaccaacaacugc

SEQ ID NO: 2727713 - RNA, 16 nt, Haemophilus influenzae Rd
guuaaacccuguuuua

SEQ ID NO: 2727714 - RNA, 14 nt, Haemophilus influenzae Rd
guuaaaccuaaauc

SEQ ID NO: 2727715 - RNA, 16 nt, Haemophilus influenzae Rd
guuaaaccuaaauccc

SEQ ID NO: 2727716 - RNA, 14 nt, Haemophilus influenzae Rd
guuaaacgcauauu

SEQ ID NO: 2727717 - RNA, 21 nt, Haemophilus influenzae Rd
guuaaacugccgccuucuucc

SEQ ID NO: 2727718 - RNA, 19 nt, Haemophilus influenzae Rd
guuaaagugcgguagaaau

SEQ ID NO: 2727719 - RNA, 15 nt, Haemophilus influenzae Rd
guuaaaguuucuguu

SEQ ID NO: 2727720 - RNA, 15 nt, Haemophilus influenzae Rd
guuaaauaagcuaga

SEQ ID NO: 2727721 - RNA, 11 nt, Haemophilus influenzae Rd
guuaaauaaug

SEQ ID NO: 2727722 - RNA, 12 nt, Haemophilus influenzae Rd
guuaaauaaugc

SEQ ID NO: 2727723 - RNA, 13 nt, Haemophilus influenzae Rd
guuaaauaaugcc

SEQ ID NO: 2727724 - RNA, 16 nt, Haemophilus influenzae Rd
guuaaaucacuuucau

SEQ ID NO: 2727725 - RNA, 10 nt, Haemophilus influenzae Rd
guuaaauguu

SEQ ID NO: 2727726 - RNA, 14 nt, Haemophilus influenzae Rd
guuaaauuuagauu

SEQ ID NO: 2727727 - RNA, 13 nt, Haemophilus influenzae Rd
guuaagcaaauuu

SEQ ID NO: 2727728 - RNA, 15 nt, Haemophilus influenzae Rd
guuaagcaccaucau

SEQ ID NO: 2727729 - RNA, 16 nt, Haemophilus influenzae Rd
guuaagcaccaucaua

SEQ ID NO: 2727730 - RNA, 22 nt, Haemophilus influenzae Rd
guuaagccgauauuaucuaaac

SEQ ID NO: 2727731 - RNA, 16 nt, Haemophilus influenzae Rd
guuaagucauuugagc

SEQ ID NO: 2727732 - RNA, 22 nt, Haemophilus influenzae Rd
guuaauaaaccuuuuucuaaca

SEQ ID NO: 2727733 - RNA, 15 nt, Haemophilus influenzae Rd
guuaauaaauccaug

SEQ ID NO: 2727734 - RNA, 14 nt, Haemophilus influenzae Rd
guuaauaaccaaga

SEQ ID NO: 2727735 - RNA, 18 nt, Haemophilus influenzae Rd
guuaauaagcccaacuua

SEQ ID NO: 2727736 - RNA, 13 nt, Haemophilus influenzae Rd
guuaauaaucaca

SEQ ID NO: 2727737 - RNA, 15 nt, Haemophilus influenzae Rd
guuaauacuugcgau

SEQ ID NO: 2727738 - RNA, 14 nt, Haemophilus influenzae Rd
guuaauagcgaaac

SEQ ID NO: 2727739 - RNA, 14 nt, Haemophilus influenzae Rd
guuaauagcgucua

SEQ ID NO: 2727740 - RNA, 18 nt, Haemophilus influenzae Rd
guuaauaggcaauguucc

SEQ ID NO: 2727741 - RNA, 20 nt, Haemophilus influenzae Rd
guuaauccuaguuuuuuccc

SEQ ID NO: 2727742 - RNA, 17 nt, Haemophilus influenzae Rd
guuaaucgaaaauuuac

SEQ ID NO: 2727743 - RNA, 17 nt, Haemophilus influenzae Rd
guuaauggaugaauaca

SEQ ID NO: 2727744 - RNA, 19 nt, Haemophilus influenzae Rd
guuaauggguuaaaagcca

SEQ ID NO: 2727745 - RNA, 14 nt, Haemophilus influenzae Rd
guuaauguaaacaa

SEQ ID NO: 2727746 - RNA, 14 nt, Haemophilus influenzae Rd
guuaauuaagcagc

SEQ ID NO: 2727747 - RNA, 15 nt, Haemophilus influenzae Rd
guuaauuaauugcuc

SEQ ID NO: 2727748 - RNA, 18 nt, Haemophilus influenzae Rd
guuaauuaccacaugcau

SEQ ID NO: 2727749 - RNA, 23 nt, Haemophilus influenzae Rd
guuaauucacuacgauuuaaugu

SEQ ID NO: 2727750 - RNA, 21 nt, Haemophilus influenzae Rd
guuaauugugcggauuuaucu

SEQ ID NO: 2727751 - RNA, 22 nt, Haemophilus influenzae Rd
guuaauuuuuaaagaaaucauu

SEQ ID NO: 2727752 - RNA, 21 nt, Haemophilus influenzae Rd
guuacaaacaaucuuaacugc

SEQ ID NO: 2727753 - RNA, 13 nt, Haemophilus influenzae Rd
guuacaacguguu

SEQ ID NO: 2727754 - RNA, 16 nt, Haemophilus influenzae Rd
guuacagcugcauaaa

SEQ ID NO: 2727755 - RNA, 18 nt, Haemophilus influenzae Rd
guuacagcugcauaaagc

SEQ ID NO: 2727756 - RNA, 22 nt, Haemophilus influenzae Rd
guuacaucuucaaaaacauaau

SEQ ID NO: 2727757 - RNA, 18 nt, Haemophilus influenzae Rd
guuaccaauaacuaaaaa

SEQ ID NO: 2727758 - RNA, 13 nt, Haemophilus influenzae Rd
guuaccgcugcag

SEQ ID NO: 2727759 - RNA, 16 nt, Haemophilus influenzae Rd
guuaccgcuucuuccu

SEQ ID NO: 2727760 - RNA, 17 nt, Haemophilus influenzae Rd
guuaccgcuucuuccug

SEQ ID NO: 2727761 - RNA, 14 nt, Haemophilus influenzae Rd
guuacgaacuucag

SEQ ID NO: 2727762 - RNA, 15 nt, Haemophilus influenzae Rd
guuacguaauauuua

SEQ ID NO: 2727763 - RNA, 13 nt, Haemophilus influenzae Rd
guuacuaaaauaa

SEQ ID NO: 2727764 - RNA, 22 nt, Haemophilus influenzae Rd
guuacuaaaauaauuuuuugaa

SEQ ID NO: 2727765 - RNA, 13 nt, Haemophilus influenzae Rd
guuacucauucua

SEQ ID NO: 2727766 - RNA, 16 nt, Haemophilus influenzae Rd
guuacuuaauuuugcu

SEQ ID NO: 2727767 - RNA, 13 nt, Haemophilus influenzae Rd
guuacuucuuuca

SEQ ID NO: 2727768 - RNA, 22 nt, Haemophilus influenzae Rd
guuacuuggaugaaaucaaaca

SEQ ID NO: 2727769 - RNA, 21 nt, Haemophilus influenzae Rd
guuagaaauacauuauuaaaa

SEQ ID NO: 2727770 - RNA, 15 nt, Haemophilus influenzae Rd
guuagaacaacaaua

SEQ ID NO: 2727771 - RNA, 15 nt, Haemophilus influenzae Rd
guuagaauaaaccaa

SEQ ID NO: 2727772 - RNA, 14 nt, Haemophilus influenzae Rd
guuagaauguagcu

SEQ ID NO: 2727773 - RNA, 18 nt, Haemophilus influenzae Rd
guuagacuaugaaaucaa

SEQ ID NO: 2727774 - RNA, 13 nt, Haemophilus influenzae Rd
guuagauacuuua

SEQ ID NO: 2727775 - RNA, 19 nt, Haemophilus influenzae Rd
guuagauacuuuacguaaa

SEQ ID NO: 2727776 - RNA, 12 nt, Haemophilus influenzae Rd
guuagcuaaaaa

SEQ ID NO: 2727777 - RNA, 21 nt, Haemophilus influenzae Rd
guuaguacgcuuaacuaauuu

SEQ ID NO: 2727778 - RNA, 13 nt, Haemophilus influenzae Rd
guuaguuuguauu

SEQ ID NO: 2727779 - RNA, 21 nt, Haemophilus influenzae Rd
guuaguuuguauuugagcauu

SEQ ID NO: 2727780 - RNA, 19 nt, Haemophilus influenzae Rd
guuaguuuuuuauguguuu

SEQ ID NO: 2727781 - RNA, 18 nt, Haemophilus influenzae Rd
guuauaagccuaaaccaa

SEQ ID NO: 2727782 - RNA, 22 nt, Haemophilus influenzae Rd
guuauacgccccuugauaauuc

SEQ ID NO: 2727783 - RNA, 14 nt, Haemophilus influenzae Rd
guuauacugaauua

SEQ ID NO: 2727784 - RNA, 18 nt, Haemophilus influenzae Rd
guuauaguauauuuaucu

SEQ ID NO: 2727785 - RNA, 14 nt, Haemophilus influenzae Rd
guuaucaaagaaac

SEQ ID NO: 2727786 - RNA, 20 nt, Haemophilus influenzae Rd
guuaucuguagaaacuaagc

SEQ ID NO: 2727787 - RNA, 13 nt, Haemophilus influenzae Rd
guuaucuuuaaag

SEQ ID NO: 2727788 - RNA, 14 nt, Haemophilus influenzae Rd
guuaugaaauugcu

SEQ ID NO: 2727789 - RNA, 12 nt, Haemophilus influenzae Rd
guuaugaagccc

SEQ ID NO: 2727790 - RNA, 23 nt, Haemophilus influenzae Rd
guuaugaagcccuauaccaccag

SEQ ID NO: 2727791 - RNA, 22 nt, Haemophilus influenzae Rd
guuaugcaaauacauauuuuua

SEQ ID NO: 2727792 - RNA, 23 nt, Haemophilus influenzae Rd
guuaugcguuuuuaauuuuaugc

SEQ ID NO: 2727793 - RNA, 15 nt, Haemophilus influenzae Rd
guuaugcuuuauucu

SEQ ID NO: 2727794 - RNA, 23 nt, Haemophilus influenzae Rd
guuaugggcugacauaaauacac

SEQ ID NO: 2727795 - RNA, 21 nt, Haemophilus influenzae Rd
guuauuaagcgugcuuugcug

SEQ ID NO: 2727796 - RNA, 17 nt, Haemophilus influenzae Rd
guuauuacuucaccaau

SEQ ID NO: 2727797 - RNA, 13 nt, Haemophilus influenzae Rd
guuauuaugaaau

SEQ ID NO: 2727798 - RNA, 14 nt, Haemophilus influenzae Rd
guuauuaugaaauu

SEQ ID NO: 2727799 - RNA, 16 nt, Haemophilus influenzae Rd
guuauuggaaaauuca

SEQ ID NO: 2727800 - RNA, 12 nt, Haemophilus influenzae Rd
guuauuuaaccu

SEQ ID NO: 2727801 - RNA, 12 nt, Haemophilus influenzae Rd
guuauuucuugc

SEQ ID NO: 2727802 - RNA, 16 nt, Haemophilus influenzae Rd
guuauuuugauaacgc

SEQ ID NO: 2727803 - RNA, 13 nt, Haemophilus influenzae Rd
guuauuuuuucaa

SEQ ID NO: 2727804 - RNA, 23 nt, Haemophilus influenzae Rd
guuauuuuuucaauuuaaaucaa

SEQ ID NO: 2727805 - RNA, 13 nt, Haemophilus influenzae Rd
guucaaaaauauu

SEQ ID NO: 2727806 - RNA, 15 nt, Haemophilus influenzae Rd
guucaaaaauauuau

SEQ ID NO: 2727807 - RNA, 16 nt, Haemophilus influenzae Rd
guucaaaacuaucaaa

SEQ ID NO: 2727808 - RNA, 19 nt, Haemophilus influenzae Rd
guucaaaaucagcuaauaa

SEQ ID NO: 2727809 - RNA, 12 nt, Haemophilus influenzae Rd
guucaaauaaug

SEQ ID NO: 2727810 - RNA, 19 nt, Haemophilus influenzae Rd
guucaaaugaaagaagaaa

SEQ ID NO: 2727811 - RNA, 20 nt, Haemophilus influenzae Rd
guucaaauuucuucacugug

SEQ ID NO: 2727812 - RNA, 14 nt, Haemophilus influenzae Rd
guucaacaccuaaa

SEQ ID NO: 2727813 - RNA, 20 nt, Haemophilus influenzae Rd
guucaagaugugauauuaaa

SEQ ID NO: 2727814 - RNA, 23 nt, Haemophilus influenzae Rd
guucaagaugugauauuaaacag

SEQ ID NO: 2727815 - RNA, 21 nt, Haemophilus influenzae Rd
guucaagccuuugcgugccau

SEQ ID NO: 2727816 - RNA, 13 nt, Haemophilus influenzae Rd
guucaauaaaaau

SEQ ID NO: 2727817 - RNA, 13 nt, Haemophilus influenzae Rd
guucaauaacucu

SEQ ID NO: 2727818 - RNA, 13 nt, Haemophilus influenzae Rd
guucaauaauauu

SEQ ID NO: 2727819 - RNA, 20 nt, Haemophilus influenzae Rd
guucaauagucguuuaacca

SEQ ID NO: 2727820 - RNA, 15 nt, Haemophilus influenzae Rd
guucaauauaacuca

SEQ ID NO: 2727821 - RNA, 20 nt, Haemophilus influenzae Rd
guucaauuuggaaaccugca

SEQ ID NO: 2727822 - RNA, 21 nt, Haemophilus influenzae Rd
guucacaaaucuaaaaauaug

SEQ ID NO: 2727823 - RNA, 17 nt, Haemophilus influenzae Rd
guucacagagaauaaau

SEQ ID NO: 2727824 - RNA, 15 nt, Haemophilus influenzae Rd
guucacguuuuucau

SEQ ID NO: 2727825 - RNA, 16 nt, Haemophilus influenzae Rd
guucagauucaauaau

SEQ ID NO: 2727826 - RNA, 21 nt, Haemophilus influenzae Rd
guucagccaauuuuucaaaac

SEQ ID NO: 2727827 - RNA, 21 nt, Haemophilus influenzae Rd
guucagcccuuuuaguuuccc

SEQ ID NO: 2727828 - RNA, 14 nt, Haemophilus influenzae Rd
guucauaaauagga

SEQ ID NO: 2727829 - RNA, 14 nt, Haemophilus influenzae Rd
guucauauuguuuc

SEQ ID NO: 2727830 - RNA, 14 nt, Haemophilus influenzae Rd
guucauauuugaag

SEQ ID NO: 2727831 - RNA, 18 nt, Haemophilus influenzae Rd
guucaucaacugcaacaa

SEQ ID NO: 2727832 - RNA, 23 nt, Haemophilus influenzae Rd
guucaucaucaucgauaaauuca

SEQ ID NO: 2727833 - RNA, 16 nt, Haemophilus influenzae Rd
guucaucauuugcucu

SEQ ID NO: 2727834 - RNA, 15 nt, Haemophilus influenzae Rd
guucaugugggcuuu

SEQ ID NO: 2727835 - RNA, 18 nt, Haemophilus influenzae Rd
guuccaauaggaaacuac

SEQ ID NO: 2727836 - RNA, 14 nt, Haemophilus influenzae Rd
guuccaauuuugga

SEQ ID NO: 2727837 - RNA, 16 nt, Haemophilus influenzae Rd
guuccaccacccuucu

SEQ ID NO: 2727838 - RNA, 21 nt, Haemophilus influenzae Rd
guuccacuucauaaauccaau

SEQ ID NO: 2727839 - RNA, 13 nt, Haemophilus influenzae Rd
guuccaggaaaau

SEQ ID NO: 2727840 - RNA, 16 nt, Haemophilus influenzae Rd
guuccgaucaaauugu

SEQ ID NO: 2727841 - RNA, 18 nt, Haemophilus influenzae Rd
guucgauaacaauuuuug

SEQ ID NO: 2727842 - RNA, 22 nt, Haemophilus influenzae Rd
guucgauaacaauuuuugcauu

SEQ ID NO: 2727843 - RNA, 20 nt, Haemophilus influenzae Rd
guucgauggaaaugaguaaa

SEQ ID NO: 2727844 - RNA, 12 nt, Haemophilus influenzae Rd
guucgcaaugaa

SEQ ID NO: 2727845 - RNA, 17 nt, Haemophilus influenzae Rd
guucgccugauuucgcu

SEQ ID NO: 2727846 - RNA, 13 nt, Haemophilus influenzae Rd
guucggacuuaca

SEQ ID NO: 2727847 - RNA, 15 nt, Haemophilus influenzae Rd
guucgguuaaagaag

SEQ ID NO: 2727848 - RNA, 20 nt, Haemophilus influenzae Rd
guucguuugguucgauaaac

SEQ ID NO: 2727849 - RNA, 12 nt, Haemophilus influenzae Rd
guucuaaaaugg

SEQ ID NO: 2727850 - RNA, 23 nt, Haemophilus influenzae Rd
guucuaaaggcugagguucaaaa

SEQ ID NO: 2727851 - RNA, 18 nt, Haemophilus influenzae Rd
guucuaaauauuuuucaa

SEQ ID NO: 2727852 - RNA, 16 nt, Haemophilus influenzae Rd
guucuaagguauaaau

SEQ ID NO: 2727853 - RNA, 18 nt, Haemophilus influenzae Rd
guucuaagguauaaauaa

SEQ ID NO: 2727854 - RNA, 16 nt, Haemophilus influenzae Rd
guucuaauguuaauuu

SEQ ID NO: 2727855 - RNA, 19 nt, Haemophilus influenzae Rd
guucucacuaacuuuccua

SEQ ID NO: 2727856 - RNA, 16 nt, Haemophilus influenzae Rd
guucucgcaaaagugc

SEQ ID NO: 2727857 - RNA, 19 nt, Haemophilus influenzae Rd
guucucguugcaucuucua

SEQ ID NO: 2727858 - RNA, 18 nt, Haemophilus influenzae Rd
guucugcacgaagugcgg

SEQ ID NO: 2727859 - RNA, 15 nt, Haemophilus influenzae Rd
guucugcaucaauaa

SEQ ID NO: 2727860 - RNA, 19 nt, Haemophilus influenzae Rd
guucugccgcugcaacaaa

SEQ ID NO: 2727861 - RNA, 13 nt, Haemophilus influenzae Rd
guucuguaauuca

SEQ ID NO: 2727862 - RNA, 12 nt, Haemophilus influenzae Rd
guucuuccccuc

SEQ ID NO: 2727863 - RNA, 20 nt, Haemophilus influenzae Rd
guucuucugggauuggcuug

SEQ ID NO: 2727864 - RNA, 16 nt, Haemophilus influenzae Rd
guucuugaugauaauc

SEQ ID NO: 2727865 - RNA, 17 nt, Haemophilus influenzae Rd
guucuugaugauaaucu

SEQ ID NO: 2727866 - RNA, 22 nt, Haemophilus influenzae Rd
guucuugaugauaaucuuccca

SEQ ID NO: 2727867 - RNA, 23 nt, Haemophilus influenzae Rd
guucuuguaagccaaauaaugca

SEQ ID NO: 2727868 - RNA, 17 nt, Haemophilus influenzae Rd
guucuuguucaaguugu

SEQ ID NO: 2727869 - RNA, 10 nt, Haemophilus influenzae Rd
guucuuucug

SEQ ID NO: 2727870 - RNA, 21 nt, Haemophilus influenzae Rd
guucuuuguuaccuuuuccaa

SEQ ID NO: 2727871 - RNA, 20 nt, Haemophilus influenzae Rd
guucuuuugguaauaaauca

SEQ ID NO: 2727872 - RNA, 21 nt, Haemophilus influenzae Rd
guugaaaagaauaauauuaaa

SEQ ID NO: 2727873 - RNA, 13 nt, Haemophilus influenzae Rd
guugaaaauaaau

SEQ ID NO: 2727874 - RNA, 21 nt, Haemophilus influenzae Rd
guugaagcuaauucuucuauu

SEQ ID NO: 2727875 - RNA, 14 nt, Haemophilus influenzae Rd
guugaaucgcacuu

SEQ ID NO: 2727876 - RNA, 20 nt, Haemophilus influenzae Rd
guugaauuucuuuuucugcu

SEQ ID NO: 2727877 - RNA, 23 nt, Haemophilus influenzae Rd
guugaauuuucaaugguuuauaa

SEQ ID NO: 2727878 - RNA, 20 nt, Haemophilus influenzae Rd
guugaauuuuugugauuuca

SEQ ID NO: 2727879 - RNA, 19 nt, Haemophilus influenzae Rd
guugagcauaacguauuuu

SEQ ID NO: 2727880 - RNA, 15 nt, Haemophilus influenzae Rd
guugagccaauuuuc

SEQ ID NO: 2727881 - RNA, 20 nt, Haemophilus influenzae Rd
guugagcgagguaagcugaa

SEQ ID NO: 2727882 - RNA, 21 nt, Haemophilus influenzae Rd
guugaguauagucauucaaug

SEQ ID NO: 2727883 - RNA, 19 nt, Haemophilus influenzae Rd
guugauauucaauuuaucg

SEQ ID NO: 2727884 - RNA, 12 nt, Haemophilus influenzae Rd
guugauauucac

SEQ ID NO: 2727885 - RNA, 15 nt, Haemophilus influenzae Rd
guugaucagcaauca

SEQ ID NO: 2727886 - RNA, 19 nt, Haemophilus influenzae Rd
guugaucuacaucaguacc

SEQ ID NO: 2727887 - RNA, 23 nt, Haemophilus influenzae Rd
guugaucuacaucaguaccuuua

SEQ ID NO: 2727888 - RNA, 22 nt, Haemophilus influenzae Rd
guugauuaagucgauaaagaau

SEQ ID NO: 2727889 - RNA, 16 nt, Haemophilus influenzae Rd
guugauuagcuaauau

SEQ ID NO: 2727890 - RNA, 21 nt, Haemophilus influenzae Rd
guugauugacuuguuuuaaaa

SEQ ID NO: 2727891 - RNA, 17 nt, Haemophilus influenzae Rd
guugauuuaucauaaug

SEQ ID NO: 2727892 - RNA, 23 nt, Haemophilus influenzae Rd
guugauuuuccccgcucuuucca

SEQ ID NO: 2727893 - RNA, 23 nt, Haemophilus influenzae Rd
guugauuuugguucguuuugggg

SEQ ID NO: 2727894 - RNA, 14 nt, Haemophilus influenzae Rd
guugauuuuugacg

SEQ ID NO: 2727895 - RNA, 18 nt, Haemophilus influenzae Rd
guugcacauuaauuugug

SEQ ID NO: 2727896 - RNA, 20 nt, Haemophilus influenzae Rd
guugcacauuaauuugugag

SEQ ID NO: 2727897 - RNA, 20 nt, Haemophilus influenzae Rd
guugcacccacuaaaauuug

SEQ ID NO: 2727898 - RNA, 15 nt, Haemophilus influenzae Rd
guugcaccuuuaaau

SEQ ID NO: 2727899 - RNA, 16 nt, Haemophilus influenzae Rd
guugcaccuuuauuug

SEQ ID NO: 2727900 - RNA, 15 nt, Haemophilus influenzae Rd
guugcagauuuaccc

SEQ ID NO: 2727901 - RNA, 15 nt, Haemophilus influenzae Rd
guugcaucuucuauu

SEQ ID NO: 2727902 - RNA, 18 nt, Haemophilus influenzae Rd
guugcauuagaaaucaac

SEQ ID NO: 2727903 - RNA, 14 nt, Haemophilus influenzae Rd
guugccauaaaaaa

SEQ ID NO: 2727904 - RNA, 15 nt, Haemophilus influenzae Rd
guugccauaaauuug

SEQ ID NO: 2727905 - RNA, 22 nt, Haemophilus influenzae Rd
guugcccuagugcaaccacaca

SEQ ID NO: 2727906 - RNA, 21 nt, Haemophilus influenzae Rd
guugcgauuuccacuuuuuca

SEQ ID NO: 2727907 - RNA, 20 nt, Haemophilus influenzae Rd
guugcgugaugaccugcaga

SEQ ID NO: 2727908 - RNA, 18 nt, Haemophilus influenzae Rd
guugcucagccaguuuuc

SEQ ID NO: 2727909 - RNA, 21 nt, Haemophilus influenzae Rd
guugcucagccaguuuucuag

SEQ ID NO: 2727910 - RNA, 22 nt, Haemophilus influenzae Rd
guugcucagccaguuuucuagc

SEQ ID NO: 2727911 - RNA, 23 nt, Haemophilus influenzae Rd
guugcucugcguucaagccuuug

SEQ ID NO: 2727912 - RNA, 21 nt, Haemophilus influenzae Rd
guugcugaauauccagugcca

SEQ ID NO: 2727913 - RNA, 20 nt, Haemophilus influenzae Rd
guugcuguguugauauucaa

SEQ ID NO: 2727914 - RNA, 13 nt, Haemophilus influenzae Rd
guugcuucaauug

SEQ ID NO: 2727915 - RNA, 14 nt, Haemophilus influenzae Rd
guugcuuugccaau

SEQ ID NO: 2727916 - RNA, 13 nt, Haemophilus influenzae Rd
guugcuuuuauca

SEQ ID NO: 2727917 - RNA, 19 nt, Haemophilus influenzae Rd
guuggaaauuuaagugagu

SEQ ID NO: 2727918 - RNA, 16 nt, Haemophilus influenzae Rd
guuggaagaauguuuu

SEQ ID NO: 2727919 - RNA, 19 nt, Haemophilus influenzae Rd
guuggaucacaaacaauau

SEQ ID NO: 2727920 - RNA, 19 nt, Haemophilus influenzae Rd
guuggcaacauauuuucua

SEQ ID NO: 2727921 - RNA, 13 nt, Haemophilus influenzae Rd
guuggcauaucaa

SEQ ID NO: 2727922 - RNA, 14 nt, Haemophilus influenzae Rd
guuggcucaagccu

SEQ ID NO: 2727923 - RNA, 17 nt, Haemophilus influenzae Rd
guuggcuuccagaaaau

SEQ ID NO: 2727924 - RNA, 16 nt, Haemophilus influenzae Rd
guugggacugccacgg

SEQ ID NO: 2727925 - RNA, 22 nt, Haemophilus influenzae Rd
guuggguaaucaaauucaauug

SEQ ID NO: 2727926 - RNA, 19 nt, Haemophilus influenzae Rd
guugguaaaucuaacaauc

SEQ ID NO: 2727927 - RNA, 12 nt, Haemophilus influenzae Rd
guuguaaaagug

SEQ ID NO: 2727928 - RNA, 17 nt, Haemophilus influenzae Rd
guuguaauuguugaaug

SEQ ID NO: 2727929 - RNA, 23 nt, Haemophilus influenzae Rd
guugucacaacagauugagcggu

SEQ ID NO: 2727930 - RNA, 21 nt, Haemophilus influenzae Rd
guugucguuauuaugaaauuu

SEQ ID NO: 2727931 - RNA, 17 nt, Haemophilus influenzae Rd
guugugacucaaacuug

SEQ ID NO: 2727932 - RNA, 20 nt, Haemophilus influenzae Rd
guuguguuucaacaaaaaua

SEQ ID NO: 2727933 - RNA, 20 nt, Haemophilus influenzae Rd
guuguuccgcuaguuuuuua

SEQ ID NO: 2727934 - RNA, 14 nt, Haemophilus influenzae Rd
guuguucuuuauaa

SEQ ID NO: 2727935 - RNA, 13 nt, Haemophilus influenzae Rd
guuguuuuggauu

SEQ ID NO: 2727936 - RNA, 22 nt, Haemophilus influenzae Rd
guuuaaagagaucacuguaaau

SEQ ID NO: 2727937 - RNA, 14 nt, Haemophilus influenzae Rd
guuuaaaguaagaa

SEQ ID NO: 2727938 - RNA, 17 nt, Haemophilus influenzae Rd
guuuaaaucuaagccuu

SEQ ID NO: 2727939 - RNA, 12 nt, Haemophilus influenzae Rd
guuuaaauuuua

SEQ ID NO: 2727940 - RNA, 15 nt, Haemophilus influenzae Rd
guuuaaauuuuaaaa

SEQ ID NO: 2727941 - RNA, 23 nt, Haemophilus influenzae Rd
guuuaaccacguauuuuuuaaua

SEQ ID NO: 2727942 - RNA, 12 nt, Haemophilus influenzae Rd
guuuaacuucaa

SEQ ID NO: 2727943 - RNA, 23 nt, Haemophilus influenzae Rd
guuuaacuucaaccacuucaaau

SEQ ID NO: 2727944 - RNA, 13 nt, Haemophilus influenzae Rd
guuuaauaucgcc

SEQ ID NO: 2727945 - RNA, 18 nt, Haemophilus influenzae Rd
guuuaauauuuuuuucaa

SEQ ID NO: 2727946 - RNA, 17 nt, Haemophilus influenzae Rd
guuuaauccaaacuaaa

SEQ ID NO: 2727947 - RNA, 22 nt, Haemophilus influenzae Rd
guuuaauucuucgaugcuuuuu

SEQ ID NO: 2727948 - RNA, 19 nt, Haemophilus influenzae Rd
guuuacccacuugguaaac

SEQ ID NO: 2727949 - RNA, 16 nt, Haemophilus influenzae Rd
guuuaccgcaaaauua

SEQ ID NO: 2727950 - RNA, 16 nt, Haemophilus influenzae Rd
guuuacgauaaugcca

SEQ ID NO: 2727951 - RNA, 22 nt, Haemophilus influenzae Rd
guuuacgcuaauuuaagaaaaa

SEQ ID NO: 2727952 - RNA, 23 nt, Haemophilus influenzae Rd
guuuacgcuaauuuaagaaaaac

SEQ ID NO: 2727953 - RNA, 16 nt, Haemophilus influenzae Rd
guuuacugaauaaaaa

SEQ ID NO: 2727954 - RNA, 13 nt, Haemophilus influenzae Rd
guuuacuuaaaau

SEQ ID NO: 2727955 - RNA, 13 nt, Haemophilus influenzae Rd
guuuacuuggcau

SEQ ID NO: 2727956 - RNA, 22 nt, Haemophilus influenzae Rd
guuuacuuuuuccauaauaacg

SEQ ID NO: 2727957 - RNA, 23 nt, Haemophilus influenzae Rd
guuuacuuuuuccauaauaacga

SEQ ID NO: 2727958 - RNA, 14 nt, Haemophilus influenzae Rd
guuuagcaaacaau

SEQ ID NO: 2727959 - RNA, 16 nt, Haemophilus influenzae Rd
guuuauagaugaacuc

SEQ ID NO: 2727960 - RNA, 22 nt, Haemophilus influenzae Rd
guuuauauaccauuugauucac

SEQ ID NO: 2727961 - RNA, 23 nt, Haemophilus influenzae Rd
guuuauauucuggcaauauuuca

SEQ ID NO: 2727962 - RNA, 12 nt, Haemophilus influenzae Rd
guuuaucaucug

SEQ ID NO: 2727963 - RNA, 18 nt, Haemophilus influenzae Rd
guuuaucguauucccaaa

SEQ ID NO: 2727964 - RNA, 16 nt, Haemophilus influenzae Rd
guuuaucgucugcacg

SEQ ID NO: 2727965 - RNA, 16 nt, Haemophilus influenzae Rd
guuuaucucuuucuua

SEQ ID NO: 2727966 - RNA, 13 nt, Haemophilus influenzae Rd
guuuauuuauuca

SEQ ID NO: 2727967 - RNA, 15 nt, Haemophilus influenzae Rd
guuuauuuauucagc

SEQ ID NO: 2727968 - RNA, 15 nt, Haemophilus influenzae Rd
guuucaaaucguuug

SEQ ID NO: 2727969 - RNA, 16 nt, Haemophilus influenzae Rd
guuucaacaaaaauac

SEQ ID NO: 2727970 - RNA, 21 nt, Haemophilus influenzae Rd
guuucaacaaaaauacguugu

SEQ ID NO: 2727971 - RNA, 14 nt, Haemophilus influenzae Rd
guuucaacauaucg

SEQ ID NO: 2727972 - RNA, 16 nt, Haemophilus influenzae Rd
guuucaacuuggaaag

SEQ ID NO: 2727973 - RNA, 14 nt, Haemophilus influenzae Rd
guuucaagucguua

SEQ ID NO: 2727974 - RNA, 19 nt, Haemophilus influenzae Rd
guuucaaugucuuuuucuu

SEQ ID NO: 2727975 - RNA, 16 nt, Haemophilus influenzae Rd
guuucaauuuacccac

SEQ ID NO: 2727976 - RNA, 20 nt, Haemophilus influenzae Rd
guuucauacaacgcucugca

SEQ ID NO: 2727977 - RNA, 19 nt, Haemophilus influenzae Rd
guuucaucacuucaaaaaa

SEQ ID NO: 2727978 - RNA, 19 nt, Haemophilus influenzae Rd
guuucauuuuugcaccaaa

SEQ ID NO: 2727979 - RNA, 22 nt, Haemophilus influenzae Rd
guuucauuuuugcaccaaauuc

SEQ ID NO: 2727980 - RNA, 20 nt, Haemophilus influenzae Rd
guuuccaaauuccgcaauau

SEQ ID NO: 2727981 - RNA, 18 nt, Haemophilus influenzae Rd
guuuccaaguauuuucug

SEQ ID NO: 2727982 - RNA, 16 nt, Haemophilus influenzae Rd
guuucgauacuuucuu

SEQ ID NO: 2727983 - RNA, 16 nt, Haemophilus influenzae Rd
guuucgcauaaaaauu

SEQ ID NO: 2727984 - RNA, 17 nt, Haemophilus influenzae Rd
guuucgccagcaccacg

SEQ ID NO: 2727985 - RNA, 19 nt, Haemophilus influenzae Rd
guuucggauaauaauuuuu

SEQ ID NO: 2727986 - RNA, 12 nt, Haemophilus influenzae Rd
guuucuaaaaua

SEQ ID NO: 2727987 - RNA, 19 nt, Haemophilus influenzae Rd
guuucuaaaaucacuuuua

SEQ ID NO: 2727988 - RNA, 14 nt, Haemophilus influenzae Rd
guuucuaauaccaa

SEQ ID NO: 2727989 - RNA, 13 nt, Haemophilus influenzae Rd
guuucuaauuuuu

SEQ ID NO: 2727990 - RNA, 18 nt, Haemophilus influenzae Rd
guuucuugggauuuugcc

SEQ ID NO: 2727991 - RNA, 23 nt, Haemophilus influenzae Rd
guuucuuuguucacaucaaaauu

SEQ ID NO: 2727992 - RNA, 15 nt, Haemophilus influenzae Rd
guuugaaaagaaaua

SEQ ID NO: 2727993 - RNA, 22 nt, Haemophilus influenzae Rd
guuugaaaagaaauauauuauu

SEQ ID NO: 2727994 - RNA, 14 nt, Haemophilus influenzae Rd
guuugaaaucaaau

SEQ ID NO: 2727995 - RNA, 18 nt, Haemophilus influenzae Rd
guuugaacaaauucagcu

SEQ ID NO: 2727996 - RNA, 14 nt, Haemophilus influenzae Rd
guuugaaggcaaaa

SEQ ID NO: 2727997 - RNA, 23 nt, Haemophilus influenzae Rd
guuugaauaauugaucugcuggu

SEQ ID NO: 2727998 - RNA, 16 nt, Haemophilus influenzae Rd
guuugagcaaaucaaa

SEQ ID NO: 2727999 - RNA, 15 nt, Haemophilus influenzae Rd
guuugauaaauaucu

SEQ ID NO: 2728000 - RNA, 15 nt, Haemophilus influenzae Rd
guuugauccacacuu

SEQ ID NO: 2728001 - RNA, 20 nt, Haemophilus influenzae Rd
guuugaucgguuuuauuauu

SEQ ID NO: 2728002 - RNA, 21 nt, Haemophilus influenzae Rd
guuugccgaagccuaaaucuu

SEQ ID NO: 2728003 - RNA, 22 nt, Haemophilus influenzae Rd
guuugcguaucacuuaaaccaa

SEQ ID NO: 2728004 - RNA, 21 nt, Haemophilus influenzae Rd
guuugcuaauguaguuggaac

SEQ ID NO: 2728005 - RNA, 21 nt, Haemophilus influenzae Rd
guuugcuaccuucaaccaccc

SEQ ID NO: 2728006 - RNA, 19 nt, Haemophilus influenzae Rd
guuugcucucgucaauaca

SEQ ID NO: 2728007 - RNA, 19 nt, Haemophilus influenzae Rd
guuuggcacaacaucagau

SEQ ID NO: 2728008 - RNA, 20 nt, Haemophilus influenzae Rd
guuugguuaccgcugcaggu

SEQ ID NO: 2728009 - RNA, 18 nt, Haemophilus influenzae Rd
guuugguucgauaaacau

SEQ ID NO: 2728010 - RNA, 20 nt, Haemophilus influenzae Rd
guuuguaaaaguaggagcaa

SEQ ID NO: 2728011 - RNA, 18 nt, Haemophilus influenzae Rd
guuuguagcgauauucuu

SEQ ID NO: 2728012 - RNA, 22 nt, Haemophilus influenzae Rd
guuugucgcaggugucacagca

SEQ ID NO: 2728013 - RNA, 21 nt, Haemophilus influenzae Rd
guuugucguaauaacauucag

SEQ ID NO: 2728014 - RNA, 17 nt, Haemophilus influenzae Rd
guuugugcguuuuuuaa

SEQ ID NO: 2728015 - RNA, 16 nt, Haemophilus influenzae Rd
guuugugcuaaauuaa

SEQ ID NO: 2728016 - RNA, 18 nt, Haemophilus influenzae Rd
guuugugcuaaauuaaau

SEQ ID NO: 2728017 - RNA, 16 nt, Haemophilus influenzae Rd
guuuguggaauaccau

SEQ ID NO: 2728018 - RNA, 15 nt, Haemophilus influenzae Rd
guuuguuuuuaaccu

SEQ ID NO: 2728019 - RNA, 22 nt, Haemophilus influenzae Rd
guuuuaaaaaauaaauuuaaau

SEQ ID NO: 2728020 - RNA, 14 nt, Haemophilus influenzae Rd
guuuuaaaaucucu

SEQ ID NO: 2728021 - RNA, 18 nt, Haemophilus influenzae Rd
guuuuaaaaucucucaaa

SEQ ID NO: 2728022 - RNA, 23 nt, Haemophilus influenzae Rd
guuuuaaaaucucucaaaaauca

SEQ ID NO: 2728023 - RNA, 11 nt, Haemophilus influenzae Rd
guuuuaaaauu

SEQ ID NO: 2728024 - RNA, 12 nt, Haemophilus influenzae Rd
guuuuaaaccac

SEQ ID NO: 2728025 - RNA, 17 nt, Haemophilus influenzae Rd
guuuuaaaucuucuauc

SEQ ID NO: 2728026 - RNA, 21 nt, Haemophilus influenzae Rd
guuuuaaccguuauaacguuu

SEQ ID NO: 2728027 - RNA, 15 nt, Haemophilus influenzae Rd
guuuuaaguuuucac

SEQ ID NO: 2728028 - RNA, 19 nt, Haemophilus influenzae Rd
guuuuaauaaaaacgugcu

SEQ ID NO: 2728029 - RNA, 13 nt, Haemophilus influenzae Rd
guuuuaauacuaa

SEQ ID NO: 2728030 - RNA, 21 nt, Haemophilus influenzae Rd
guuuuacaccaacggcauuuc

SEQ ID NO: 2728031 - RNA, 21 nt, Haemophilus influenzae Rd
guuuuaccuucaguuuucauu

SEQ ID NO: 2728032 - RNA, 21 nt, Haemophilus influenzae Rd
guuuuacgcuguucuucuaau

SEQ ID NO: 2728033 - RNA, 14 nt, Haemophilus influenzae Rd
guuuuaucagaaug

SEQ ID NO: 2728034 - RNA, 21 nt, Haemophilus influenzae Rd
guuuuaucgagauuucuuuga

SEQ ID NO: 2728035 - RNA, 18 nt, Haemophilus influenzae Rd
guuuuaugaauaacuuua

SEQ ID NO: 2728036 - RNA, 21 nt, Haemophilus influenzae Rd
guuuuauuagcgaaaauuuug

SEQ ID NO: 2728037 - RNA, 14 nt, Haemophilus influenzae Rd
guuuuauuuauucu

SEQ ID NO: 2728038 - RNA, 19 nt, Haemophilus influenzae Rd
guuuuauuuuccaucaucu

SEQ ID NO: 2728039 - RNA, 17 nt, Haemophilus influenzae Rd
guuuuauuuuuccacug

SEQ ID NO: 2728040 - RNA, 18 nt, Haemophilus influenzae Rd
guuuucaaauuaaccgca

SEQ ID NO: 2728041 - RNA, 20 nt, Haemophilus influenzae Rd
guuuucaacagugaaaccaa

SEQ ID NO: 2728042 - RNA, 16 nt, Haemophilus influenzae Rd
guuuucaauacgccaa

SEQ ID NO: 2728043 - RNA, 21 nt, Haemophilus influenzae Rd
guuuucaauaucaaagaaaaa

SEQ ID NO: 2728044 - RNA, 22 nt, Haemophilus influenzae Rd
guuuucacgcugacuuaaugca

SEQ ID NO: 2728045 - RNA, 15 nt, Haemophilus influenzae Rd
guuuuccaaaaacca

SEQ ID NO: 2728046 - RNA, 17 nt, Haemophilus influenzae Rd
guuuuccacuucuucuu

SEQ ID NO: 2728047 - RNA, 17 nt, Haemophilus influenzae Rd
guuuuccguauuuucac

SEQ ID NO: 2728048 - RNA, 23 nt, Haemophilus influenzae Rd
guuuuccguauuuucacgguuuu

SEQ ID NO: 2728049 - RNA, 19 nt, Haemophilus influenzae Rd
guuuucgccaucaucagcu

SEQ ID NO: 2728050 - RNA, 15 nt, Haemophilus influenzae Rd
guuuucgugauuuug

SEQ ID NO: 2728051 - RNA, 13 nt, Haemophilus influenzae Rd
guuuucucguccg

SEQ ID NO: 2728052 - RNA, 18 nt, Haemophilus influenzae Rd
guuuucugaacuaaaaua

SEQ ID NO: 2728053 - RNA, 12 nt, Haemophilus influenzae Rd
guuuucuugcca

SEQ ID NO: 2728054 - RNA, 19 nt, Haemophilus influenzae Rd
guuuucuugccaaaauuca

SEQ ID NO: 2728055 - RNA, 22 nt, Haemophilus influenzae Rd
guuuucuuuugcccuuaaccau

SEQ ID NO: 2728056 - RNA, 16 nt, Haemophilus influenzae Rd
guuuucuuuuuuucau

SEQ ID NO: 2728057 - RNA, 20 nt, Haemophilus influenzae Rd
guuuugaaguuaucaauaaa

SEQ ID NO: 2728058 - RNA, 18 nt, Haemophilus influenzae Rd
guuuugagugagauaaau

SEQ ID NO: 2728059 - RNA, 22 nt, Haemophilus influenzae Rd
guuuugauucgccuuauauccc

SEQ ID NO: 2728060 - RNA, 14 nt, Haemophilus influenzae Rd
guuuugcaaaccaa

SEQ ID NO: 2728061 - RNA, 24 nt, Haemophilus influenzae Rd
guuuugcaauaaaguugagaauuu

SEQ ID NO: 2728062 - RNA, 13 nt, Haemophilus influenzae Rd
guuuugcaccacg

SEQ ID NO: 2728063 - RNA, 19 nt, Haemophilus influenzae Rd
guuuugccaauacuuagcg

SEQ ID NO: 2728064 - RNA, 17 nt, Haemophilus influenzae Rd
guuuugccacaaagcaa

SEQ ID NO: 2728065 - RNA, 14 nt, Haemophilus influenzae Rd
guuuugcguugcgg

SEQ ID NO: 2728066 - RNA, 14 nt, Haemophilus influenzae Rd
guuuugcuguaaau

SEQ ID NO: 2728067 - RNA, 18 nt, Haemophilus influenzae Rd
guuuuggagguaguuuag

SEQ ID NO: 2728068 - RNA, 18 nt, Haemophilus influenzae Rd
guuuuggcauuuucaauc

SEQ ID NO: 2728069 - RNA, 15 nt, Haemophilus influenzae Rd
guuuugggauaaucu

SEQ ID NO: 2728070 - RNA, 13 nt, Haemophilus influenzae Rd
guuuuguauaagg

SEQ ID NO: 2728071 - RNA, 20 nt, Haemophilus influenzae Rd
guuuuguucaucuaacacaa

SEQ ID NO: 2728072 - RNA, 18 nt, Haemophilus influenzae Rd
guuuuuacgugcgaauuu

SEQ ID NO: 2728073 - RNA, 12 nt, Haemophilus influenzae Rd
guuuuucaaaaa

SEQ ID NO: 2728074 - RNA, 16 nt, Haemophilus influenzae Rd
guuuuucaaaaauuuu

SEQ ID NO: 2728075 - RNA, 22 nt, Haemophilus influenzae Rd
guuuuuccacuuaauauugcca

SEQ ID NO: 2728076 - RNA, 12 nt, Haemophilus influenzae Rd
guuuuuccauuc

SEQ ID NO: 2728077 - RNA, 14 nt, Haemophilus influenzae Rd
guuuuucgaucucu

SEQ ID NO: 2728078 - RNA, 21 nt, Haemophilus influenzae Rd
guuuuucgcugcagcugcugc

SEQ ID NO: 2728079 - RNA, 18 nt, Haemophilus influenzae Rd
guuuuugcauagccacua

SEQ ID NO: 2728080 - RNA, 15 nt, Haemophilus influenzae Rd
guuuuugguaauuua

SEQ ID NO: 2728081 - RNA, 12 nt, Haemophilus influenzae Rd
guuuuuguuucg

SEQ ID NO: 2728082 - RNA, 16 nt, Haemophilus influenzae Rd
guuuuuuaauaaaauc

SEQ ID NO: 2728083 - RNA, 16 nt, Haemophilus influenzae Rd
guuuuuuacuugcgau

SEQ ID NO: 2728084 - RNA, 12 nt, Haemophilus influenzae Rd
guuuuuuaggcu

SEQ ID NO: 2728085 - RNA, 18 nt, Haemophilus influenzae Rd
guuuuuuauaaacuucug

SEQ ID NO: 2728086 - RNA, 22 nt, Haemophilus influenzae Rd
guuuuuuauuuuguguauuaag

SEQ ID NO: 2728087 - RNA, 18 nt, Haemophilus influenzae Rd
guuuuuugaugaaaauua

SEQ ID NO: 2728088 - RNA, 14 nt, Haemophilus influenzae Rd
guuuuuuuauaaaa

SEQ ID NO: 2728089 - RNA, 17 nt, Haemophilus influenzae Rd
guuuuuuuauaaaccaa

SEQ ID NO: 2728090 - RNA, 16 nt, Haemophilus influenzae Rd
guuuuuuuauagccaa

SEQ ID NO: 2728091 - RNA, 12 nt, Haemophilus influenzae Rd
uaaaaaaaagcg

SEQ ID NO: 2728092 - RNA, 19 nt, Haemophilus influenzae Rd
uaaaaaaacccaguuuuaa

SEQ ID NO: 2728093 - RNA, 20 nt, Haemophilus influenzae Rd
uaaaaaaacguuaaauuuag

SEQ ID NO: 2728094 - RNA, 13 nt, Haemophilus influenzae Rd
uaaaaaaagcaau

SEQ ID NO: 2728095 - RNA, 16 nt, Haemophilus influenzae Rd
uaaaaaaauaguuaau

SEQ ID NO: 2728096 - RNA, 20 nt, Haemophilus influenzae Rd
uaaaaaaauccuaaauaaag

SEQ ID NO: 2728097 - RNA, 17 nt, Haemophilus influenzae Rd
uaaaaaaaucugcacuu

SEQ ID NO: 2728098 - RNA, 24 nt, Haemophilus influenzae Rd
uaaaaaacccgcuuuuaacaaaua

SEQ ID NO: 2728099 - RNA, 20 nt, Haemophilus influenzae Rd
uaaaaaacccguaauuaaaa

SEQ ID NO: 2728100 - RNA, 17 nt, Haemophilus influenzae Rd
uaaaaaaccgagucuua

SEQ ID NO: 2728101 - RNA, 22 nt, Haemophilus influenzae Rd
uaaaaaaccuugggauauucca

SEQ ID NO: 2728102 - RNA, 18 nt, Haemophilus influenzae Rd
uaaaaaagaguaaauauu

SEQ ID NO: 2728103 - RNA, 13 nt, Haemophilus influenzae Rd
uaaaaaagcaaaa

SEQ ID NO: 2728104 - RNA, 20 nt, Haemophilus influenzae Rd
uaaaaaagccuuauuguacu

SEQ ID NO: 2728105 - RNA, 14 nt, Haemophilus influenzae Rd
uaaaaaauaaauua

SEQ ID NO: 2728106 - RNA, 13 nt, Haemophilus influenzae Rd
uaaaaaauaacaa

SEQ ID NO: 2728107 - RNA, 22 nt, Haemophilus influenzae Rd
uaaaaaauaauuuaguuauaug

SEQ ID NO: 2728108 - RNA, 15 nt, Haemophilus influenzae Rd
uaaaaaauaguuaau

SEQ ID NO: 2728109 - RNA, 16 nt, Haemophilus influenzae Rd
uaaaaaauaguuaaua

SEQ ID NO: 2728110 - RNA, 12 nt, Haemophilus influenzae Rd
uaaaaaaucuag

SEQ ID NO: 2728111 - RNA, 12 nt, Haemophilus influenzae Rd
uaaaaaaucuau

SEQ ID NO: 2728112 - RNA, 14 nt, Haemophilus influenzae Rd
uaaaaaaucuaucc

SEQ ID NO: 2728113 - RNA, 13 nt, Haemophilus influenzae Rd
uaaaaaaucucca

SEQ ID NO: 2728114 - RNA, 23 nt, Haemophilus influenzae Rd
uaaaaaaugcgcugauuuuucac

SEQ ID NO: 2728115 - RNA, 14 nt, Haemophilus influenzae Rd
uaaaaaauuaaaag

SEQ ID NO: 2728116 - RNA, 15 nt, Haemophilus influenzae Rd
uaaaaacaaauauau

SEQ ID NO: 2728117 - RNA, 17 nt, Haemophilus influenzae Rd
uaaaaacaaauauauuu

SEQ ID NO: 2728118 - RNA, 21 nt, Haemophilus influenzae Rd
uaaaaaccgcugucauauuca

SEQ ID NO: 2728119 - RNA, 12 nt, Haemophilus influenzae Rd
uaaaaagaaaua

SEQ ID NO: 2728120 - RNA, 22 nt, Haemophilus influenzae Rd
uaaaaagaaauaaaagauaaac

SEQ ID NO: 2728121 - RNA, 14 nt, Haemophilus influenzae Rd
uaaaaagacuaaac

SEQ ID NO: 2728122 - RNA, 22 nt, Haemophilus influenzae Rd
uaaaaagauaacuuagaaaaua

SEQ ID NO: 2728123 - RNA, 21 nt, Haemophilus influenzae Rd
uaaaaaggaaauaauuuccuu

SEQ ID NO: 2728124 - RNA, 17 nt, Haemophilus influenzae Rd
uaaaaagugcgguaaau

SEQ ID NO: 2728125 - RNA, 20 nt, Haemophilus influenzae Rd
uaaaaagugcgguaaauuuu

SEQ ID NO: 2728126 - RNA, 16 nt, Haemophilus influenzae Rd
uaaaaauaaaaacauu

SEQ ID NO: 2728127 - RNA, 14 nt, Haemophilus influenzae Rd
uaaaaauaaacauu

SEQ ID NO: 2728128 - RNA, 12 nt, Haemophilus influenzae Rd
uaaaaauaaaua

SEQ ID NO: 2728129 - RNA, 23 nt, Haemophilus influenzae Rd
uaaaaauaacccuuacuuuauac

SEQ ID NO: 2728130 - RNA, 16 nt, Haemophilus influenzae Rd
uaaaaauaaccuauaa

SEQ ID NO: 2728131 - RNA, 14 nt, Haemophilus influenzae Rd
uaaaaauaaucacu

SEQ ID NO: 2728132 - RNA, 16 nt, Haemophilus influenzae Rd
uaaaaauaauuagaua

SEQ ID NO: 2728133 - RNA, 22 nt, Haemophilus influenzae Rd
uaaaaauaauuagauaauacag

SEQ ID NO: 2728134 - RNA, 16 nt, Haemophilus influenzae Rd
uaaaaauaauuuuacu

SEQ ID NO: 2728135 - RNA, 13 nt, Haemophilus influenzae Rd
uaaaaauauauuu

SEQ ID NO: 2728136 - RNA, 15 nt, Haemophilus influenzae Rd
uaaaaauauguauuu

SEQ ID NO: 2728137 - RNA, 15 nt, Haemophilus influenzae Rd
uaaaaauauuaagca

SEQ ID NO: 2728138 - RNA, 15 nt, Haemophilus influenzae Rd
uaaaaauauuuuaau

SEQ ID NO: 2728139 - RNA, 16 nt, Haemophilus influenzae Rd
uaaaaaucaucguauu

SEQ ID NO: 2728140 - RNA, 19 nt, Haemophilus influenzae Rd
uaaaaaucaucguauuaaa

SEQ ID NO: 2728141 - RNA, 20 nt, Haemophilus influenzae Rd
uaaaaaucaucguauuaaaa

SEQ ID NO: 2728142 - RNA, 21 nt, Haemophilus influenzae Rd
uaaaaaucaucguauuaaaag

SEQ ID NO: 2728143 - RNA, 16 nt, Haemophilus influenzae Rd
uaaaaaucauuaaaua

SEQ ID NO: 2728144 - RNA, 21 nt, Haemophilus influenzae Rd
uaaaaauccgccacuuugaug

SEQ ID NO: 2728145 - RNA, 14 nt, Haemophilus influenzae Rd
uaaaaaucguacau

SEQ ID NO: 2728146 - RNA, 20 nt, Haemophilus influenzae Rd
uaaaaaucguacaucgaaaa

SEQ ID NO: 2728147 - RNA, 20 nt, Haemophilus influenzae Rd
uaaaaaucugugauauauau

SEQ ID NO: 2728148 - RNA, 16 nt, Haemophilus influenzae Rd
uaaaaaugaauaaaau

SEQ ID NO: 2728149 - RNA, 17 nt, Haemophilus influenzae Rd
uaaaaaugagauuauuu

SEQ ID NO: 2728150 - RNA, 20 nt, Haemophilus influenzae Rd
uaaaaaugagauuauuucua

SEQ ID NO: 2728151 - RNA, 19 nt, Haemophilus influenzae Rd
uaaaaaugcuguuucuaau

SEQ ID NO: 2728152 - RNA, 11 nt, Haemophilus influenzae Rd
uaaaaaugcuu

SEQ ID NO: 2728153 - RNA, 15 nt, Haemophilus influenzae Rd
uaaaaauggaaaaag

SEQ ID NO: 2728154 - RNA, 17 nt, Haemophilus influenzae Rd
uaaaaauguuauaaaua

SEQ ID NO: 2728155 - RNA, 13 nt, Haemophilus influenzae Rd
uaaaaauuaaccg

SEQ ID NO: 2728156 - RNA, 15 nt, Haemophilus influenzae Rd
uaaaaauuaaggaaa

SEQ ID NO: 2728157 - RNA, 12 nt, Haemophilus influenzae Rd
uaaaaauuaaug

SEQ ID NO: 2728158 - RNA, 19 nt, Haemophilus influenzae Rd
uaaaaauuagguaacuaaa

SEQ ID NO: 2728159 - RNA, 20 nt, Haemophilus influenzae Rd
uaaaaauuagguaacuaaag

SEQ ID NO: 2728160 - RNA, 17 nt, Haemophilus influenzae Rd
uaaaaauuaucaucauu

SEQ ID NO: 2728161 - RNA, 20 nt, Haemophilus influenzae Rd
uaaaaauucaccgcacuuuu

SEQ ID NO: 2728162 - RNA, 21 nt, Haemophilus influenzae Rd
uaaaaauugaucuaaauuauc

SEQ ID NO: 2728163 - RNA, 13 nt, Haemophilus influenzae Rd
uaaaaauuggaaa

SEQ ID NO: 2728164 - RNA, 20 nt, Haemophilus influenzae Rd
uaaaaauuggaaaauaaaau

SEQ ID NO: 2728165 - RNA, 19 nt, Haemophilus influenzae Rd
uaaaaauuguaaaaccgca

SEQ ID NO: 2728166 - RNA, 21 nt, Haemophilus influenzae Rd
uaaaaauuguugauuccucug

SEQ ID NO: 2728167 - RNA, 13 nt, Haemophilus influenzae Rd
uaaaaauuuaaaa

SEQ ID NO: 2728168 - RNA, 16 nt, Haemophilus influenzae Rd
uaaaaauuuaaaagca

SEQ ID NO: 2728169 - RNA, 19 nt, Haemophilus influenzae Rd
uaaaaauuuaaaagcaccu

SEQ ID NO: 2728170 - RNA, 17 nt, Haemophilus influenzae Rd
uaaaaauuuaaauauaa

SEQ ID NO: 2728171 - RNA, 19 nt, Haemophilus influenzae Rd
uaaaaauuuaaauauaauu

SEQ ID NO: 2728172 - RNA, 15 nt, Haemophilus influenzae Rd
uaaaacaaagucaau

SEQ ID NO: 2728173 - RNA, 19 nt, Haemophilus influenzae Rd
uaaaacaaugcaaauacaa

SEQ ID NO: 2728174 - RNA, 19 nt, Haemophilus influenzae Rd
uaaaacaccgucuaaauug

SEQ ID NO: 2728175 - RNA, 20 nt, Haemophilus influenzae Rd
uaaaacaccgucuaaauuga

SEQ ID NO: 2728176 - RNA, 23 nt, Haemophilus influenzae Rd
uaaaacacguuugccagaaagca

SEQ ID NO: 2728177 - RNA, 19 nt, Haemophilus influenzae Rd
uaaaacagagaaaaaaaua

SEQ ID NO: 2728178 - RNA, 20 nt, Haemophilus influenzae Rd
uaaaacagagcgucaaaauu

SEQ ID NO: 2728179 - RNA, 20 nt, Haemophilus influenzae Rd
uaaaacagcaggaauauuag

SEQ ID NO: 2728180 - RNA, 12 nt, Haemophilus influenzae Rd
uaaaacauuuca

SEQ ID NO: 2728181 - RNA, 23 nt, Haemophilus influenzae Rd
uaaaaccaaaagauucaacaaua

SEQ ID NO: 2728182 - RNA, 16 nt, Haemophilus influenzae Rd
uaaaaccaauaauccu

SEQ ID NO: 2728183 - RNA, 22 nt, Haemophilus influenzae Rd
uaaaaccaauuuuuucauacaa

SEQ ID NO: 2728184 - RNA, 18 nt, Haemophilus influenzae Rd
uaaaaccacaauaaaaua

SEQ ID NO: 2728185 - RNA, 15 nt, Haemophilus influenzae Rd
uaaaaccucagaaga

SEQ ID NO: 2728186 - RNA, 20 nt, Haemophilus influenzae Rd
uaaaaccuucuggguaaaau

SEQ ID NO: 2728187 - RNA, 18 nt, Haemophilus influenzae Rd
uaaaacgcgcauuaaacu

SEQ ID NO: 2728188 - RNA, 21 nt, Haemophilus influenzae Rd
uaaaacgggaucuauuugauu

SEQ ID NO: 2728189 - RNA, 15 nt, Haemophilus influenzae Rd
uaaaacuaauuugca

SEQ ID NO: 2728190 - RNA, 16 nt, Haemophilus influenzae Rd
uaaaacuauaaaaauu

SEQ ID NO: 2728191 - RNA, 18 nt, Haemophilus influenzae Rd
uaaaacuauuuuuaauuu

SEQ ID NO: 2728192 - RNA, 23 nt, Haemophilus influenzae Rd
uaaaacuauuuuuaauuuugaag

SEQ ID NO: 2728193 - RNA, 12 nt, Haemophilus influenzae Rd
uaaaacuuccua

SEQ ID NO: 2728194 - RNA, 14 nt, Haemophilus influenzae Rd
uaaaacuuccuaau

SEQ ID NO: 2728195 - RNA, 16 nt, Haemophilus influenzae Rd
uaaaacuugcaaacca

SEQ ID NO: 2728196 - RNA, 17 nt, Haemophilus influenzae Rd
uaaaacuugcaaaccaa

SEQ ID NO: 2728197 - RNA, 18 nt, Haemophilus influenzae Rd
uaaaacuugcgacuuggu

SEQ ID NO: 2728198 - RNA, 17 nt, Haemophilus influenzae Rd
uaaaagaagaaugcggu

SEQ ID NO: 2728199 - RNA, 18 nt, Haemophilus influenzae Rd
uaaaagagagcuucucuu

SEQ ID NO: 2728200 - RNA, 15 nt, Haemophilus influenzae Rd
uaaaagauaaaacag

SEQ ID NO: 2728201 - RNA, 19 nt, Haemophilus influenzae Rd
uaaaagauaaaacagagaa

SEQ ID NO: 2728202 - RNA, 22 nt, Haemophilus influenzae Rd
uaaaagauaaaacagagaaaaa

SEQ ID NO: 2728203 - RNA, 14 nt, Haemophilus influenzae Rd
uaaaagauaaacaa

SEQ ID NO: 2728204 - RNA, 18 nt, Haemophilus influenzae Rd
uaaaagauacacucacuu

SEQ ID NO: 2728205 - RNA, 17 nt, Haemophilus influenzae Rd
uaaaagcaccuaaaauu

SEQ ID NO: 2728206 - RNA, 16 nt, Haemophilus influenzae Rd
uaaaagcauuacaaag

SEQ ID NO: 2728207 - RNA, 22 nt, Haemophilus influenzae Rd
uaaaagccuucagccugcucac

SEQ ID NO: 2728208 - RNA, 20 nt, Haemophilus influenzae Rd
uaaaagcuguuguuguggau

SEQ ID NO: 2728209 - RNA, 14 nt, Haemophilus influenzae Rd
uaaaaggcaaagca

SEQ ID NO: 2728210 - RNA, 19 nt, Haemophilus influenzae Rd
uaaaaggcuuucuguguua

SEQ ID NO: 2728211 - RNA, 22 nt, Haemophilus influenzae Rd
uaaaaggcuuucuguguuagaa

SEQ ID NO: 2728212 - RNA, 18 nt, Haemophilus influenzae Rd
uaaaagggaacauuuucu

SEQ ID NO: 2728213 - RNA, 14 nt, Haemophilus influenzae Rd
uaaaaguaaaaaua

SEQ ID NO: 2728214 - RNA, 16 nt, Haemophilus influenzae Rd
uaaaaguaaaaauaaa

SEQ ID NO: 2728215 - RNA, 20 nt, Haemophilus influenzae Rd
uaaaaguaaaaauaaaaaca

SEQ ID NO: 2728216 - RNA, 13 nt, Haemophilus influenzae Rd
uaaaaguaaacaa

SEQ ID NO: 2728217 - RNA, 15 nt, Haemophilus influenzae Rd
uaaaaguaaacaauu

SEQ ID NO: 2728218 - RNA, 18 nt, Haemophilus influenzae Rd
uaaaaguaaauaagccau

SEQ ID NO: 2728219 - RNA, 16 nt, Haemophilus influenzae Rd
uaaaaguagaagguuu

SEQ ID NO: 2728220 - RNA, 18 nt, Haemophilus influenzae Rd
uaaaaguagcacuuucca

SEQ ID NO: 2728221 - RNA, 20 nt, Haemophilus influenzae Rd
uaaaaguagcacuuuccauc

SEQ ID NO: 2728222 - RNA, 17 nt, Haemophilus influenzae Rd
uaaaaguaucuugcuuu

SEQ ID NO: 2728223 - RNA, 16 nt, Haemophilus influenzae Rd
uaaaagugcggcuuca

SEQ ID NO: 2728224 - RNA, 19 nt, Haemophilus influenzae Rd
uaaaagugcggcuucauuu

SEQ ID NO: 2728225 - RNA, 12 nt, Haemophilus influenzae Rd
uaaaagugcggu

SEQ ID NO: 2728226 - RNA, 18 nt, Haemophilus influenzae Rd
uaaaagugcgguaaauuu

SEQ ID NO: 2728227 - RNA, 22 nt, Haemophilus influenzae Rd
uaaaagugcgguaaauuuuuaa

SEQ ID NO: 2728228 - RNA, 22 nt, Haemophilus influenzae Rd
uaaaagugcgguuaaaauuucu

SEQ ID NO: 2728229 - RNA, 22 nt, Haemophilus influenzae Rd
uaaaagugcgguugauuuuccu

SEQ ID NO: 2728230 - RNA, 17 nt, Haemophilus influenzae Rd
uaaaaguggaagucauu

SEQ ID NO: 2728231 - RNA, 18 nt, Haemophilus influenzae Rd
uaaaaguuagauugaacg

SEQ ID NO: 2728232 - RNA, 16 nt, Haemophilus influenzae Rd
uaaaaguuguuuugcu

SEQ ID NO: 2728233 - RNA, 17 nt, Haemophilus influenzae Rd
uaaaaguuuacuauuaa

SEQ ID NO: 2728234 - RNA, 19 nt, Haemophilus influenzae Rd
uaaaaguuuacuauuaaag

SEQ ID NO: 2728235 - RNA, 23 nt, Haemophilus influenzae Rd
uaaaaguuuaguccuuaauuuaa

SEQ ID NO: 2728236 - RNA, 15 nt, Haemophilus influenzae Rd
uaaaaguuugauuaa

SEQ ID NO: 2728237 - RNA, 14 nt, Haemophilus influenzae Rd
uaaaaguuuuccga

SEQ ID NO: 2728238 - RNA, 20 nt, Haemophilus influenzae Rd
uaaaaguuuuccgacaacac

SEQ ID NO: 2728239 - RNA, 13 nt, Haemophilus influenzae Rd
uaaaauaaaaaau

SEQ ID NO: 2728240 - RNA, 12 nt, Haemophilus influenzae Rd
uaaaauaaaaag

SEQ ID NO: 2728241 - RNA, 21 nt, Haemophilus influenzae Rd
uaaaauaaaacccaguuuaaa

SEQ ID NO: 2728242 - RNA, 19 nt, Haemophilus influenzae Rd
uaaaauaaacauuuuucau

SEQ ID NO: 2728243 - RNA, 21 nt, Haemophilus influenzae Rd
uaaaauaaacauuuuucauuu

SEQ ID NO: 2728244 - RNA, 22 nt, Haemophilus influenzae Rd
uaaaauaaagaaacguaaacaa

SEQ ID NO: 2728245 - RNA, 15 nt, Haemophilus influenzae Rd
uaaaauaaauuuugg

SEQ ID NO: 2728246 - RNA, 18 nt, Haemophilus influenzae Rd
uaaaauaaccuuaaauca

SEQ ID NO: 2728247 - RNA, 19 nt, Haemophilus influenzae Rd
uaaaauaaccuuaaaucaa

SEQ ID NO: 2728248 - RNA, 12 nt, Haemophilus influenzae Rd
uaaaauaagaau

SEQ ID NO: 2728249 - RNA, 16 nt, Haemophilus influenzae Rd
uaaaauaauaucacaa

SEQ ID NO: 2728250 - RNA, 19 nt, Haemophilus influenzae Rd
uaaaauaauaucacaacca

SEQ ID NO: 2728251 - RNA, 13 nt, Haemophilus influenzae Rd
uaaaauaauaucc

SEQ ID NO: 2728252 - RNA, 20 nt, Haemophilus influenzae Rd
uaaaauaauauccaauguaa

SEQ ID NO: 2728253 - RNA, 13 nt, Haemophilus influenzae Rd
uaaaauacgcccc

SEQ ID NO: 2728254 - RNA, 24 nt, Haemophilus influenzae Rd
uaaaauagugacaguaauguaaua

SEQ ID NO: 2728255 - RNA, 17 nt, Haemophilus influenzae Rd
uaaaauaguuuucacaa

SEQ ID NO: 2728256 - RNA, 15 nt, Haemophilus influenzae Rd
uaaaauauaacauuu

SEQ ID NO: 2728257 - RNA, 17 nt, Haemophilus influenzae Rd
uaaaauauaacauuuau

SEQ ID NO: 2728258 - RNA, 18 nt, Haemophilus influenzae Rd
uaaaauauacaauucuug

SEQ ID NO: 2728259 - RNA, 16 nt, Haemophilus influenzae Rd
uaaaauauauaaucuu

SEQ ID NO: 2728260 - RNA, 15 nt, Haemophilus influenzae Rd
uaaaauauauauuau

SEQ ID NO: 2728261 - RNA, 21 nt, Haemophilus influenzae Rd
uaaaauauauauuaucgucua

SEQ ID NO: 2728262 - RNA, 18 nt, Haemophilus influenzae Rd
uaaaauauauuaauuauu

SEQ ID NO: 2728263 - RNA, 19 nt, Haemophilus influenzae Rd
uaaaauauccacauaacca

SEQ ID NO: 2728264 - RNA, 21 nt, Haemophilus influenzae Rd
uaaaauauccacauaaccaaa

SEQ ID NO: 2728265 - RNA, 22 nt, Haemophilus influenzae Rd
uaaaauauccacauaaccaaag

SEQ ID NO: 2728266 - RNA, 14 nt, Haemophilus influenzae Rd
uaaaauaucuuguu

SEQ ID NO: 2728267 - RNA, 21 nt, Haemophilus influenzae Rd
uaaaauaucuuguuuuaauau

SEQ ID NO: 2728268 - RNA, 14 nt, Haemophilus influenzae Rd
uaaaauauuuaauu

SEQ ID NO: 2728269 - RNA, 22 nt, Haemophilus influenzae Rd
uaaaauauuuggcugauauauu

SEQ ID NO: 2728270 - RNA, 17 nt, Haemophilus influenzae Rd
uaaaauauuuuuuauuu

SEQ ID NO: 2728271 - RNA, 22 nt, Haemophilus influenzae Rd
uaaaaucaaccgcacuuuauuc

SEQ ID NO: 2728272 - RNA, 23 nt, Haemophilus influenzae Rd
uaaaaucaaccgcacuuuauuca

SEQ ID NO: 2728273 - RNA, 14 nt, Haemophilus influenzae Rd
uaaaaucaauaaua

SEQ ID NO: 2728274 - RNA, 15 nt, Haemophilus influenzae Rd
uaaaaucaauaauau

SEQ ID NO: 2728275 - RNA, 15 nt, Haemophilus influenzae Rd
uaaaaucacauaaaa

SEQ ID NO: 2728276 - RNA, 20 nt, Haemophilus influenzae Rd
uaaaaucacauaaaaaauga

SEQ ID NO: 2728277 - RNA, 16 nt, Haemophilus influenzae Rd
uaaaaucagcccuuau

SEQ ID NO: 2728278 - RNA, 12 nt, Haemophilus influenzae Rd
uaaaaucgccug

SEQ ID NO: 2728279 - RNA, 23 nt, Haemophilus influenzae Rd
uaaaaucgccugacauuuuugcc

SEQ ID NO: 2728280 - RNA, 12 nt, Haemophilus influenzae Rd
uaaaaucucuau

SEQ ID NO: 2728281 - RNA, 16 nt, Haemophilus influenzae Rd
uaaaaucucucaaaaa

SEQ ID NO: 2728282 - RNA, 21 nt, Haemophilus influenzae Rd
uaaaaucucucaaaaaucaac

SEQ ID NO: 2728283 - RNA, 18 nt, Haemophilus influenzae Rd
uaaaaucuuuggauuggu

SEQ ID NO: 2728284 - RNA, 17 nt, Haemophilus influenzae Rd
uaaaaugaacaaaaaau

SEQ ID NO: 2728285 - RNA, 18 nt, Haemophilus influenzae Rd
uaaaaugaacaaaaaauu

SEQ ID NO: 2728286 - RNA, 14 nt, Haemophilus influenzae Rd
uaaaauggauaaac

SEQ ID NO: 2728287 - RNA, 18 nt, Haemophilus influenzae Rd
uaaaauggauaaaccgua

SEQ ID NO: 2728288 - RNA, 21 nt, Haemophilus influenzae Rd
uaaaauggcgguuuuuuaauu

SEQ ID NO: 2728289 - RNA, 22 nt, Haemophilus influenzae Rd
uaaaauggcgguuuuuuaauuu

SEQ ID NO: 2728290 - RNA, 16 nt, Haemophilus influenzae Rd
uaaaaugggucaagau

SEQ ID NO: 2728291 - RNA, 19 nt, Haemophilus influenzae Rd
uaaaaugguuuaaauaacc

SEQ ID NO: 2728292 - RNA, 15 nt, Haemophilus influenzae Rd
uaaaauguaauagcc

SEQ ID NO: 2728293 - RNA, 18 nt, Haemophilus influenzae Rd
uaaaauguaauagccauu

SEQ ID NO: 2728294 - RNA, 17 nt, Haemophilus influenzae Rd
uaaaauguugaauauaa

SEQ ID NO: 2728295 - RNA, 19 nt, Haemophilus influenzae Rd
uaaaauguugaauauaaua

SEQ ID NO: 2728296 - RNA, 16 nt, Haemophilus influenzae Rd
uaaaauguuuauauuu

SEQ ID NO: 2728297 - RNA, 15 nt, Haemophilus influenzae Rd
uaaaauuaagcaaua

SEQ ID NO: 2728298 - RNA, 18 nt, Haemophilus influenzae Rd
uaaaauuaaugugcuaua

SEQ ID NO: 2728299 - RNA, 16 nt, Haemophilus influenzae Rd
uaaaauuacaaaacca

SEQ ID NO: 2728300 - RNA, 15 nt, Haemophilus influenzae Rd
uaaaauuaccgcacu

SEQ ID NO: 2728301 - RNA, 21 nt, Haemophilus influenzae Rd
uaaaauuaccgcacuuuuuau

SEQ ID NO: 2728302 - RNA, 21 nt, Haemophilus influenzae Rd
uaaaauuaguaacagguaaaa

SEQ ID NO: 2728303 - RNA, 23 nt, Haemophilus influenzae Rd
uaaaauuagugaugaugguguuc

SEQ ID NO: 2728304 - RNA, 16 nt, Haemophilus influenzae Rd
uaaaauuauaauauuu

SEQ ID NO: 2728305 - RNA, 22 nt, Haemophilus influenzae Rd
uaaaauucaaagauuauuuaau

SEQ ID NO: 2728306 - RNA, 19 nt, Haemophilus influenzae Rd
uaaaauuccuuauuuuacu

SEQ ID NO: 2728307 - RNA, 21 nt, Haemophilus influenzae Rd
uaaaauucgacgauaaccauc

SEQ ID NO: 2728308 - RNA, 19 nt, Haemophilus influenzae Rd
uaaaauucuauuaaaauau

SEQ ID NO: 2728309 - RNA, 24 nt, Haemophilus influenzae Rd
uaaaauugccgccaguaagaucuu

SEQ ID NO: 2728310 - RNA, 22 nt, Haemophilus influenzae Rd
uaaaauugcuuuguuaauucac

SEQ ID NO: 2728311 - RNA, 23 nt, Haemophilus influenzae Rd
uaaaauugcuuuguuaauucacg

SEQ ID NO: 2728312 - RNA, 18 nt, Haemophilus influenzae Rd
uaaaauuuauuacaaaca

SEQ ID NO: 2728313 - RNA, 23 nt, Haemophilus influenzae Rd
uaaaauuuauuuuaaaaucaucu

SEQ ID NO: 2728314 - RNA, 16 nt, Haemophilus influenzae Rd
uaaaauuucuucuaca

SEQ ID NO: 2728315 - RNA, 20 nt, Haemophilus influenzae Rd
uaaaauuucuuuuguuuuaa

SEQ ID NO: 2728316 - RNA, 17 nt, Haemophilus influenzae Rd
uaaaauuuuuaccauau

SEQ ID NO: 2728317 - RNA, 24 nt, Haemophilus influenzae Rd
uaaaauuuuuaucuuuaaagaaua

SEQ ID NO: 2728318 - RNA, 12 nt, Haemophilus influenzae Rd
uaaacaaaaaua

SEQ ID NO: 2728319 - RNA, 13 nt, Haemophilus influenzae Rd
uaaacaaaauacc

SEQ ID NO: 2728320 - RNA, 13 nt, Haemophilus influenzae Rd
uaaacaaaaucuu

SEQ ID NO: 2728321 - RNA, 13 nt, Haemophilus influenzae Rd
uaaacaaaccuaa

SEQ ID NO: 2728322 - RNA, 17 nt, Haemophilus influenzae Rd
uaaacaaaccuaaaccu

SEQ ID NO: 2728323 - RNA, 15 nt, Haemophilus influenzae Rd
uaaacaaacuuucau

SEQ ID NO: 2728324 - RNA, 12 nt, Haemophilus influenzae Rd
uaaacaaagaau

SEQ ID NO: 2728325 - RNA, 23 nt, Haemophilus influenzae Rd
uaaacaaagaaucuuaaauucau

SEQ ID NO: 2728326 - RNA, 17 nt, Haemophilus influenzae Rd
uaaacaagauucugaaa

SEQ ID NO: 2728327 - RNA, 23 nt, Haemophilus influenzae Rd
uaaacaagauucugaaagauauu

SEQ ID NO: 2728328 - RNA, 17 nt, Haemophilus influenzae Rd
uaaacaagcucuagaaa

SEQ ID NO: 2728329 - RNA, 19 nt, Haemophilus influenzae Rd
uaaacaagcucuagaaaau

SEQ ID NO: 2728330 - RNA, 19 nt, Haemophilus influenzae Rd
uaaacaauauauucggaaa

SEQ ID NO: 2728331 - RNA, 21 nt, Haemophilus influenzae Rd
uaaacaauauauucggaaaaa

SEQ ID NO: 2728332 - RNA, 19 nt, Haemophilus influenzae Rd
uaaacaauuccccuuccuu

SEQ ID NO: 2728333 - RNA, 12 nt, Haemophilus influenzae Rd
uaaacaauuuca

SEQ ID NO: 2728334 - RNA, 21 nt, Haemophilus influenzae Rd
uaaacaauuucauuacguguu

SEQ ID NO: 2728335 - RNA, 20 nt, Haemophilus influenzae Rd
uaaacacuuaaauaguuaau

SEQ ID NO: 2728336 - RNA, 15 nt, Haemophilus influenzae Rd
uaaacagaauuuacg

SEQ ID NO: 2728337 - RNA, 22 nt, Haemophilus influenzae Rd
uaaacagucugcgccuaaaaua

SEQ ID NO: 2728338 - RNA, 17 nt, Haemophilus influenzae Rd
uaaacauacaucuaauu

SEQ ID NO: 2728339 - RNA, 19 nt, Haemophilus influenzae Rd
uaaacauauugaugauuaa

SEQ ID NO: 2728340 - RNA, 17 nt, Haemophilus influenzae Rd
uaaacauccgaauaaau

SEQ ID NO: 2728341 - RNA, 14 nt, Haemophilus influenzae Rd
uaaacauuuuucau

SEQ ID NO: 2728342 - RNA, 15 nt, Haemophilus influenzae Rd
uaaacauuuuucauu

SEQ ID NO: 2728343 - RNA, 12 nt, Haemophilus influenzae Rd
uaaacauuuuuu

SEQ ID NO: 2728344 - RNA, 14 nt, Haemophilus influenzae Rd
uaaacauuuuuuca

SEQ ID NO: 2728345 - RNA, 16 nt, Haemophilus influenzae Rd
uaaaccaaauuucuug

SEQ ID NO: 2728346 - RNA, 15 nt, Haemophilus influenzae Rd
uaaaccaacaacugc

SEQ ID NO: 2728347 - RNA, 23 nt, Haemophilus influenzae Rd
uaaaccaccgauuaauaaaauca

SEQ ID NO: 2728348 - RNA, 22 nt, Haemophilus influenzae Rd
uaaaccaccguucuauauuuug

SEQ ID NO: 2728349 - RNA, 21 nt, Haemophilus influenzae Rd
uaaaccacguugugcagcuag

SEQ ID NO: 2728350 - RNA, 17 nt, Haemophilus influenzae Rd
uaaaccagcaagauaag

SEQ ID NO: 2728351 - RNA, 17 nt, Haemophilus influenzae Rd
uaaaccaguuaaauccu

SEQ ID NO: 2728352 - RNA, 19 nt, Haemophilus influenzae Rd
uaaaccccguuuuuuagaa

SEQ ID NO: 2728353 - RNA, 22 nt, Haemophilus influenzae Rd
uaaacccuuuagcauaaaacag

SEQ ID NO: 2728354 - RNA, 16 nt, Haemophilus influenzae Rd
uaaaccgcaucaaaau

SEQ ID NO: 2728355 - RNA, 16 nt, Haemophilus influenzae Rd
uaaaccgccaaaaauu

SEQ ID NO: 2728356 - RNA, 18 nt, Haemophilus influenzae Rd
uaaaccgucauuuauaaa

SEQ ID NO: 2728357 - RNA, 17 nt, Haemophilus influenzae Rd
uaaaccuuauuuuaaau

SEQ ID NO: 2728358 - RNA, 17 nt, Haemophilus influenzae Rd
uaaaccuugugauguac

SEQ ID NO: 2728359 - RNA, 15 nt, Haemophilus influenzae Rd
uaaacgaagaaaaag

SEQ ID NO: 2728360 - RNA, 21 nt, Haemophilus influenzae Rd
uaaacgagaaccaaaacgcaa

SEQ ID NO: 2728361 - RNA, 16 nt, Haemophilus influenzae Rd
uaaacgagauaagcau

SEQ ID NO: 2728362 - RNA, 22 nt, Haemophilus influenzae Rd
uaaacgaugugcauugaauuuu

SEQ ID NO: 2728363 - RNA, 22 nt, Haemophilus influenzae Rd
uaaacgccaucaaccauaacaa

SEQ ID NO: 2728364 - RNA, 23 nt, Haemophilus influenzae Rd
uaaacgcucuuuaauacgagcug

SEQ ID NO: 2728365 - RNA, 22 nt, Haemophilus influenzae Rd
uaaacgcugacguacaauuuca

SEQ ID NO: 2728366 - RNA, 23 nt, Haemophilus influenzae Rd
uaaacgcuguuuugcuuccuuau

SEQ ID NO: 2728367 - RNA, 18 nt, Haemophilus influenzae Rd
uaaacggaacucuugaua

SEQ ID NO: 2728368 - RNA, 18 nt, Haemophilus influenzae Rd
uaaacggaguuuuccauu

SEQ ID NO: 2728369 - RNA, 23 nt, Haemophilus influenzae Rd
uaaacggcgugccauugcuaaau

SEQ ID NO: 2728370 - RNA, 14 nt, Haemophilus influenzae Rd
uaaacguaacuaaa

SEQ ID NO: 2728371 - RNA, 17 nt, Haemophilus influenzae Rd
uaaacguaacuaaaaaa

SEQ ID NO: 2728372 - RNA, 20 nt, Haemophilus influenzae Rd
uaaacguucuuggaaaucuu

SEQ ID NO: 2728373 - RNA, 21 nt, Haemophilus influenzae Rd
uaaacguucuuggaaaucuug

SEQ ID NO: 2728374 - RNA, 20 nt, Haemophilus influenzae Rd
uaaacguugaaucgcacuua

SEQ ID NO: 2728375 - RNA, 14 nt, Haemophilus influenzae Rd
uaaacuaaaauauc

SEQ ID NO: 2728376 - RNA, 13 nt, Haemophilus influenzae Rd
uaaacuaaaucuu

SEQ ID NO: 2728377 - RNA, 23 nt, Haemophilus influenzae Rd
uaaacuaauuccgacuaaaacca

SEQ ID NO: 2728378 - RNA, 18 nt, Haemophilus influenzae Rd
uaaacucaaugaauuaaa

SEQ ID NO: 2728379 - RNA, 13 nt, Haemophilus influenzae Rd
uaaacucagaaua

SEQ ID NO: 2728380 - RNA, 15 nt, Haemophilus influenzae Rd
uaaacucgaaggaaa

SEQ ID NO: 2728381 - RNA, 16 nt, Haemophilus influenzae Rd
uaaacucuaagcuuaa

SEQ ID NO: 2728382 - RNA, 17 nt, Haemophilus influenzae Rd
uaaacuggaugaaauca

SEQ ID NO: 2728383 - RNA, 18 nt, Haemophilus influenzae Rd
uaaacuggaugaaaucau

SEQ ID NO: 2728384 - RNA, 19 nt, Haemophilus influenzae Rd
uaaacuggaugaaaucauu

SEQ ID NO: 2728385 - RNA, 18 nt, Haemophilus influenzae Rd
uaaacuucuauguuugca

SEQ ID NO: 2728386 - RNA, 23 nt, Haemophilus influenzae Rd
uaaacuucugcaaguugagcaua

SEQ ID NO: 2728387 - RNA, 14 nt, Haemophilus influenzae Rd
uaaacuugauauaa

SEQ ID NO: 2728388 - RNA, 16 nt, Haemophilus influenzae Rd
uaaacuuguuaaauaa

SEQ ID NO: 2728389 - RNA, 22 nt, Haemophilus influenzae Rd
uaaacuuguuaaauaaacacaa

SEQ ID NO: 2728390 - RNA, 20 nt, Haemophilus influenzae Rd
uaaacuuuagagauuuuauu

SEQ ID NO: 2728391 - RNA, 22 nt, Haemophilus influenzae Rd
uaaacuuuagagauuuuauuca

SEQ ID NO: 2728392 - RNA, 20 nt, Haemophilus influenzae Rd
uaaacuuucgauaguuaaau

SEQ ID NO: 2728393 - RNA, 13 nt, Haemophilus influenzae Rd
uaaacuuuuaauu

SEQ ID NO: 2728394 - RNA, 18 nt, Haemophilus influenzae Rd
uaaacuuuucgcaaaaua

SEQ ID NO: 2728395 - RNA, 23 nt, Haemophilus influenzae Rd
uaaacuuuucgcaaaauaucacu

SEQ ID NO: 2728396 - RNA, 17 nt, Haemophilus influenzae Rd
uaaagaaaauacaauau

SEQ ID NO: 2728397 - RNA, 21 nt, Haemophilus influenzae Rd
uaaagaaaauacauaauuaaa

SEQ ID NO: 2728398 - RNA, 20 nt, Haemophilus influenzae Rd
uaaagaaacguaaacaaaau

SEQ ID NO: 2728399 - RNA, 14 nt, Haemophilus influenzae Rd
uaaagaaagcaaug

SEQ ID NO: 2728400 - RNA, 20 nt, Haemophilus influenzae Rd
uaaagaaauaagcaauuuca

SEQ ID NO: 2728401 - RNA, 14 nt, Haemophilus influenzae Rd
uaaagaaauuucau

SEQ ID NO: 2728402 - RNA, 13 nt, Haemophilus influenzae Rd
uaaagaaccacaa

SEQ ID NO: 2728403 - RNA, 23 nt, Haemophilus influenzae Rd
uaaagaacuauuauuccaaauau

SEQ ID NO: 2728404 - RNA, 16 nt, Haemophilus influenzae Rd
uaaagaagaaaaucuu

SEQ ID NO: 2728405 - RNA, 17 nt, Haemophilus influenzae Rd
uaaagaagugagaaaua

SEQ ID NO: 2728406 - RNA, 13 nt, Haemophilus influenzae Rd
uaaagaauauucu

SEQ ID NO: 2728407 - RNA, 16 nt, Haemophilus influenzae Rd
uaaagaauauuuuaau

SEQ ID NO: 2728408 - RNA, 17 nt, Haemophilus influenzae Rd
uaaagaaucaaauucac

SEQ ID NO: 2728409 - RNA, 18 nt, Haemophilus influenzae Rd
uaaagaaucaaauucacg

SEQ ID NO: 2728410 - RNA, 21 nt, Haemophilus influenzae Rd
uaaagacguuugauuguaaaa

SEQ ID NO: 2728411 - RNA, 15 nt, Haemophilus influenzae Rd
uaaagagaauauuuc

SEQ ID NO: 2728412 - RNA, 17 nt, Haemophilus influenzae Rd
uaaagagaauauuucca

SEQ ID NO: 2728413 - RNA, 19 nt, Haemophilus influenzae Rd
uaaagagaauauuuccacu

SEQ ID NO: 2728414 - RNA, 15 nt, Haemophilus influenzae Rd
uaaagagaucacugu

SEQ ID NO: 2728415 - RNA, 23 nt, Haemophilus influenzae Rd
uaaagagaucacuguaaauaaua

SEQ ID NO: 2728416 - RNA, 17 nt, Haemophilus influenzae Rd
uaaagagcaaauuuaaa

SEQ ID NO: 2728417 - RNA, 20 nt, Haemophilus influenzae Rd
uaaagagcaaauuuaaauaa

SEQ ID NO: 2728418 - RNA, 18 nt, Haemophilus influenzae Rd
uaaagaguaccacuuuca

SEQ ID NO: 2728419 - RNA, 23 nt, Haemophilus influenzae Rd
uaaagagugaccagucauugauu

SEQ ID NO: 2728420 - RNA, 21 nt, Haemophilus influenzae Rd
uaaagaguguuauaaagcucu

SEQ ID NO: 2728421 - RNA, 18 nt, Haemophilus influenzae Rd
uaaagaguuauaaaccca

SEQ ID NO: 2728422 - RNA, 18 nt, Haemophilus influenzae Rd
uaaagaguucguccaaaa

SEQ ID NO: 2728423 - RNA, 23 nt, Haemophilus influenzae Rd
uaaagaguucguccaaaaucucu

SEQ ID NO: 2728424 - RNA, 15 nt, Haemophilus influenzae Rd
uaaagauaaauuaua

SEQ ID NO: 2728425 - RNA, 19 nt, Haemophilus influenzae Rd
uaaagauaaggacgaagga

SEQ ID NO: 2728426 - RNA, 20 nt, Haemophilus influenzae Rd
uaaagaucauucacaucuug

SEQ ID NO: 2728427 - RNA, 20 nt, Haemophilus influenzae Rd
uaaagauggacguguugugg

SEQ ID NO: 2728428 - RNA, 21 nt, Haemophilus influenzae Rd
uaaagcaacugaaauaugacu

SEQ ID NO: 2728429 - RNA, 18 nt, Haemophilus influenzae Rd
uaaagcaauauuuagauc

SEQ ID NO: 2728430 - RNA, 12 nt, Haemophilus influenzae Rd
uaaagcaccaua

SEQ ID NO: 2728431 - RNA, 15 nt, Haemophilus influenzae Rd
uaaagcaccauaaug

SEQ ID NO: 2728432 - RNA, 23 nt, Haemophilus influenzae Rd
uaaagcacccaucacauuuucaa

SEQ ID NO: 2728433 - RNA, 18 nt, Haemophilus influenzae Rd
uaaagcauaauauuccuu

SEQ ID NO: 2728434 - RNA, 21 nt, Haemophilus influenzae Rd
uaaagcaucgcuagacggucg

SEQ ID NO: 2728435 - RNA, 22 nt, Haemophilus influenzae Rd
uaaagccacauaauaagaaagu

SEQ ID NO: 2728436 - RNA, 11 nt, Haemophilus influenzae Rd
uaaagcccugu

SEQ ID NO: 2728437 - RNA, 19 nt, Haemophilus influenzae Rd
uaaagcgaucaucauuaaa

SEQ ID NO: 2728438 - RNA, 18 nt, Haemophilus influenzae Rd
uaaagcuacaucaacaaa

SEQ ID NO: 2728439 - RNA, 17 nt, Haemophilus influenzae Rd
uaaagcuauaaguaacu

SEQ ID NO: 2728440 - RNA, 13 nt, Haemophilus influenzae Rd
uaaagcucagcca

SEQ ID NO: 2728441 - RNA, 15 nt, Haemophilus influenzae Rd
uaaagcucguauaau

SEQ ID NO: 2728442 - RNA, 18 nt, Haemophilus influenzae Rd
uaaagcucuaauugaaau

SEQ ID NO: 2728443 - RNA, 20 nt, Haemophilus influenzae Rd
uaaagcugaauaaauaaacc

SEQ ID NO: 2728444 - RNA, 19 nt, Haemophilus influenzae Rd
uaaagcugaccgcacuuuu

SEQ ID NO: 2728445 - RNA, 18 nt, Haemophilus influenzae Rd
uaaagcuugaaaaaaccg

SEQ ID NO: 2728446 - RNA, 15 nt, Haemophilus influenzae Rd
uaaaggauuaaauaa

SEQ ID NO: 2728447 - RNA, 17 nt, Haemophilus influenzae Rd
uaaaggauuaaauaaca

SEQ ID NO: 2728448 - RNA, 15 nt, Haemophilus influenzae Rd
uaaagggaagugaua

SEQ ID NO: 2728449 - RNA, 17 nt, Haemophilus influenzae Rd
uaaagggcugcuacaau

SEQ ID NO: 2728450 - RNA, 21 nt, Haemophilus influenzae Rd
uaaagggcugcuacaauuuca

SEQ ID NO: 2728451 - RNA, 12 nt, Haemophilus influenzae Rd
uaaaguaaaaua

SEQ ID NO: 2728452 - RNA, 19 nt, Haemophilus influenzae Rd
uaaaguaaacccuuuagca

SEQ ID NO: 2728453 - RNA, 15 nt, Haemophilus influenzae Rd
uaaaguaagaauuag

SEQ ID NO: 2728454 - RNA, 12 nt, Haemophilus influenzae Rd
uaaaguauacuu

SEQ ID NO: 2728455 - RNA, 17 nt, Haemophilus influenzae Rd
uaaaguauucauauaau

SEQ ID NO: 2728456 - RNA, 22 nt, Haemophilus influenzae Rd
uaaaguauucauauaauucauu

SEQ ID NO: 2728457 - RNA, 18 nt, Haemophilus influenzae Rd
uaaagucgguuuuuucau

SEQ ID NO: 2728458 - RNA, 19 nt, Haemophilus influenzae Rd
uaaagucgguuuuuucaua

SEQ ID NO: 2728459 - RNA, 17 nt, Haemophilus influenzae Rd
uaaagugaccgccuuua

SEQ ID NO: 2728460 - RNA, 23 nt, Haemophilus influenzae Rd
uaaagugcagauuuuuuuauaaa

SEQ ID NO: 2728461 - RNA, 23 nt, Haemophilus influenzae Rd
uaaagugcggaaauauuuuaaua

SEQ ID NO: 2728462 - RNA, 21 nt, Haemophilus influenzae Rd
uaaagugcgguaaaauucuau

SEQ ID NO: 2728463 - RNA, 21 nt, Haemophilus influenzae Rd
uaaagugcggucaauuuucaa

SEQ ID NO: 2728464 - RNA, 21 nt, Haemophilus influenzae Rd
uaaagugcggucugaaaauca

SEQ ID NO: 2728465 - RNA, 23 nt, Haemophilus influenzae Rd
uaaagugcggucugaaaaucaaa

SEQ ID NO: 2728466 - RNA, 17 nt, Haemophilus influenzae Rd
uaaagugcgguuaauuu

SEQ ID NO: 2728467 - RNA, 21 nt, Haemophilus influenzae Rd
uaaaguguggauuuuguaaua

SEQ ID NO: 2728468 - RNA, 22 nt, Haemophilus influenzae Rd
uaaaguuauuuggaauguugug

SEQ ID NO: 2728469 - RNA, 13 nt, Haemophilus influenzae Rd
uaaaguucucaaa

SEQ ID NO: 2728470 - RNA, 15 nt, Haemophilus influenzae Rd
uaaaguucucaaaaa

SEQ ID NO: 2728471 - RNA, 23 nt, Haemophilus influenzae Rd
uaaaguuucuuuuacauuuggau

SEQ ID NO: 2728472 - RNA, 14 nt, Haemophilus influenzae Rd
uaaaguuuuaaacc

SEQ ID NO: 2728473 - RNA, 14 nt, Haemophilus influenzae Rd
uaaaguuuuuucaa

SEQ ID NO: 2728474 - RNA, 16 nt, Haemophilus influenzae Rd
uaaaguuuuuucaaua

SEQ ID NO: 2728475 - RNA, 15 nt, Haemophilus influenzae Rd
uaaauaaaaaauaaa

SEQ ID NO: 2728476 - RNA, 12 nt, Haemophilus influenzae Rd
uaaauaaaaaug

SEQ ID NO: 2728477 - RNA, 21 nt, Haemophilus influenzae Rd
uaaauaaaaaugaauaaaauu

SEQ ID NO: 2728478 - RNA, 14 nt, Haemophilus influenzae Rd
uaaauaaaaaugau

SEQ ID NO: 2728479 - RNA, 16 nt, Haemophilus influenzae Rd
uaaauaaaacaaggaa

SEQ ID NO: 2728480 - RNA, 19 nt, Haemophilus influenzae Rd
uaaauaaaacacaguuauu

SEQ ID NO: 2728481 - RNA, 13 nt, Haemophilus influenzae Rd
uaaauaaaauaac

SEQ ID NO: 2728482 - RNA, 20 nt, Haemophilus influenzae Rd
uaaauaaaauaacaaaaaag

SEQ ID NO: 2728483 - RNA, 15 nt, Haemophilus influenzae Rd
uaaauaaaauauuug

SEQ ID NO: 2728484 - RNA, 21 nt, Haemophilus influenzae Rd
uaaauaaacgagauaagcauu

SEQ ID NO: 2728485 - RNA, 16 nt, Haemophilus influenzae Rd
uaaauaaagauuauuu

SEQ ID NO: 2728486 - RNA, 12 nt, Haemophilus influenzae Rd
uaaauaaaucaa

SEQ ID NO: 2728487 - RNA, 14 nt, Haemophilus influenzae Rd
uaaauaaaucaaua

SEQ ID NO: 2728488 - RNA, 12 nt, Haemophilus influenzae Rd
uaaauaaaucac

SEQ ID NO: 2728489 - RNA, 23 nt, Haemophilus influenzae Rd
uaaauaaauuccuacacccauua

SEQ ID NO: 2728490 - RNA, 21 nt, Haemophilus influenzae Rd
uaaauaacuaccuaauaaagc

SEQ ID NO: 2728491 - RNA, 13 nt, Haemophilus influenzae Rd
uaaauaaggaauu

SEQ ID NO: 2728492 - RNA, 16 nt, Haemophilus influenzae Rd
uaaauaauaaauccaa

SEQ ID NO: 2728493 - RNA, 12 nt, Haemophilus influenzae Rd
uaaauaauagua

SEQ ID NO: 2728494 - RNA, 22 nt, Haemophilus influenzae Rd
uaaauaauccagauaacaaacc

SEQ ID NO: 2728495 - RNA, 12 nt, Haemophilus influenzae Rd
uaaauaauuaaa

SEQ ID NO: 2728496 - RNA, 14 nt, Haemophilus influenzae Rd
uaaauaauuaaaaa

SEQ ID NO: 2728497 - RNA, 15 nt, Haemophilus influenzae Rd
uaaauaauuaaaaau

SEQ ID NO: 2728498 - RNA, 18 nt, Haemophilus influenzae Rd
uaaauaauuaaaaauaaa

SEQ ID NO: 2728499 - RNA, 20 nt, Haemophilus influenzae Rd
uaaauaauuaaaaauaaaua

SEQ ID NO: 2728500 - RNA, 13 nt, Haemophilus influenzae Rd
uaaauaauucagc

SEQ ID NO: 2728501 - RNA, 13 nt, Haemophilus influenzae Rd
uaaauaauuuucu

SEQ ID NO: 2728502 - RNA, 21 nt, Haemophilus influenzae Rd
uaaauacagcucaaaaugcuc

SEQ ID NO: 2728503 - RNA, 18 nt, Haemophilus influenzae Rd
uaaauacauuuagugcua

SEQ ID NO: 2728504 - RNA, 18 nt, Haemophilus influenzae Rd
uaaauaccaggauuauua

SEQ ID NO: 2728505 - RNA, 21 nt, Haemophilus influenzae Rd
uaaauacuaauaggaguaaaa

SEQ ID NO: 2728506 - RNA, 19 nt, Haemophilus influenzae Rd
uaaauacuugcuuaugcaa

SEQ ID NO: 2728507 - RNA, 20 nt, Haemophilus influenzae Rd
uaaauagauaaucagcccaa

SEQ ID NO: 2728508 - RNA, 23 nt, Haemophilus influenzae Rd
uaaauagauccgcaauauaguca

SEQ ID NO: 2728509 - RNA, 13 nt, Haemophilus influenzae Rd
uaaauagccgaca

SEQ ID NO: 2728510 - RNA, 18 nt, Haemophilus influenzae Rd
uaaauagccgacaucuau

SEQ ID NO: 2728511 - RNA, 15 nt, Haemophilus influenzae Rd
uaaauagcuaacaau

SEQ ID NO: 2728512 - RNA, 16 nt, Haemophilus influenzae Rd
uaaauagcuaacaaua

SEQ ID NO: 2728513 - RNA, 21 nt, Haemophilus influenzae Rd
uaaauaggaaacucuuacuuu

SEQ ID NO: 2728514 - RNA, 18 nt, Haemophilus influenzae Rd
uaaauaggcucauuuuuu

SEQ ID NO: 2728515 - RNA, 22 nt, Haemophilus influenzae Rd
uaaauaggcucauuuuuucucu

SEQ ID NO: 2728516 - RNA, 19 nt, Haemophilus influenzae Rd
uaaauagguaucacuuaaa

SEQ ID NO: 2728517 - RNA, 22 nt, Haemophilus influenzae Rd
uaaauaguuaauugauuuaaaa

SEQ ID NO: 2728518 - RNA, 16 nt, Haemophilus influenzae Rd
uaaauauaauuuccua

SEQ ID NO: 2728519 - RNA, 17 nt, Haemophilus influenzae Rd
uaaauauaauuuccuau

SEQ ID NO: 2728520 - RNA, 16 nt, Haemophilus influenzae Rd
uaaauauaucaagcag

SEQ ID NO: 2728521 - RNA, 20 nt, Haemophilus influenzae Rd
uaaauauauccauaaacauu

SEQ ID NO: 2728522 - RNA, 13 nt, Haemophilus influenzae Rd
uaaauaucagccc

SEQ ID NO: 2728523 - RNA, 23 nt, Haemophilus influenzae Rd
uaaauaucagcccuuuguuuuaa

SEQ ID NO: 2728524 - RNA, 15 nt, Haemophilus influenzae Rd
uaaauaucuaaacuu

SEQ ID NO: 2728525 - RNA, 18 nt, Haemophilus influenzae Rd
uaaauaugauaaaugcaa

SEQ ID NO: 2728526 - RNA, 18 nt, Haemophilus influenzae Rd
uaaauaugccuuauauuu

SEQ ID NO: 2728527 - RNA, 21 nt, Haemophilus influenzae Rd
uaaauauguugaauaguaaag

SEQ ID NO: 2728528 - RNA, 23 nt, Haemophilus influenzae Rd
uaaauauguugaauaguaaagaa

SEQ ID NO: 2728529 - RNA, 13 nt, Haemophilus influenzae Rd
uaaauauuacuua

SEQ ID NO: 2728530 - RNA, 15 nt, Haemophilus influenzae Rd
uaaauauuauuaaaa

SEQ ID NO: 2728531 - RNA, 18 nt, Haemophilus influenzae Rd
uaaauauucaauuacaua

SEQ ID NO: 2728532 - RNA, 19 nt, Haemophilus influenzae Rd
uaaauauugauuacccauu

SEQ ID NO: 2728533 - RNA, 13 nt, Haemophilus influenzae Rd
uaaauauuuaaaa

SEQ ID NO: 2728534 - RNA, 17 nt, Haemophilus influenzae Rd
uaaauauuuaaaaagaa

SEQ ID NO: 2728535 - RNA, 20 nt, Haemophilus influenzae Rd
uaaauauuuaaaaagaauau

SEQ ID NO: 2728536 - RNA, 21 nt, Haemophilus influenzae Rd
uaaauauuuaaaaagaauauu

SEQ ID NO: 2728537 - RNA, 16 nt, Haemophilus influenzae Rd
uaaauauuuaaagugc

SEQ ID NO: 2728538 - RNA, 19 nt, Haemophilus influenzae Rd
uaaauauuuaggcuauuuu

SEQ ID NO: 2728539 - RNA, 13 nt, Haemophilus influenzae Rd
uaaauauuucacu

SEQ ID NO: 2728540 - RNA, 16 nt, Haemophilus influenzae Rd
uaaauauuuuuacaaa

SEQ ID NO: 2728541 - RNA, 15 nt, Haemophilus influenzae Rd
uaaauauuuuuuagu

SEQ ID NO: 2728542 - RNA, 16 nt, Haemophilus influenzae Rd
uaaaucaaaaauuaag

SEQ ID NO: 2728543 - RNA, 14 nt, Haemophilus influenzae Rd
uaaaucaaauuuag

SEQ ID NO: 2728544 - RNA, 13 nt, Haemophilus influenzae Rd
uaaaucaacaauu

SEQ ID NO: 2728545 - RNA, 19 nt, Haemophilus influenzae Rd
uaaaucacacaguuauaca

SEQ ID NO: 2728546 - RNA, 22 nt, Haemophilus influenzae Rd
uaaaucacccgcauaaccacua

SEQ ID NO: 2728547 - RNA, 20 nt, Haemophilus influenzae Rd
uaaaucacccggcacauaaa

SEQ ID NO: 2728548 - RNA, 16 nt, Haemophilus influenzae Rd
uaaaucacuuucauua

SEQ ID NO: 2728549 - RNA, 19 nt, Haemophilus influenzae Rd
uaaaucacuuucauuaaaa

SEQ ID NO: 2728550 - RNA, 18 nt, Haemophilus influenzae Rd
uaaaucagcgaguuugau

SEQ ID NO: 2728551 - RNA, 21 nt, Haemophilus influenzae Rd
uaaaucaucggguaaauuuag

SEQ ID NO: 2728552 - RNA, 17 nt, Haemophilus influenzae Rd
uaaaucaugaauaauuu

SEQ ID NO: 2728553 - RNA, 20 nt, Haemophilus influenzae Rd
uaaaucaugaauaauuuugu

SEQ ID NO: 2728554 - RNA, 18 nt, Haemophilus influenzae Rd
uaaauccaucaauucuuc

SEQ ID NO: 2728555 - RNA, 24 nt, Haemophilus influenzae Rd
uaaaucccaagguugcucaaucca

SEQ ID NO: 2728556 - RNA, 22 nt, Haemophilus influenzae Rd
uaaauccccugucaauuuuucu

SEQ ID NO: 2728557 - RNA, 15 nt, Haemophilus influenzae Rd
uaaauccguaaaaua

SEQ ID NO: 2728558 - RNA, 13 nt, Haemophilus influenzae Rd
uaaauccucagca

SEQ ID NO: 2728559 - RNA, 23 nt, Haemophilus influenzae Rd
uaaauccucagcaauuucuucag

SEQ ID NO: 2728560 - RNA, 21 nt, Haemophilus influenzae Rd
uaaauccuucaggauaaaaca

SEQ ID NO: 2728561 - RNA, 14 nt, Haemophilus influenzae Rd
uaaauccuucgccg

SEQ ID NO: 2728562 - RNA, 17 nt, Haemophilus influenzae Rd
uaaaucggcuuuaucau

SEQ ID NO: 2728563 - RNA, 18 nt, Haemophilus influenzae Rd
uaaaucggcuuuaucauc

SEQ ID NO: 2728564 - RNA, 20 nt, Haemophilus influenzae Rd
uaaaucggcuuuaucaucuu

SEQ ID NO: 2728565 - RNA, 14 nt, Haemophilus influenzae Rd
uaaaucggugcggu

SEQ ID NO: 2728566 - RNA, 19 nt, Haemophilus influenzae Rd
uaaaucuaagcgaccugaa

SEQ ID NO: 2728567 - RNA, 19 nt, Haemophilus influenzae Rd
uaaaucuauuccuuucuuu

SEQ ID NO: 2728568 - RNA, 20 nt, Haemophilus influenzae Rd
uaaaucugguggagaaaugu

SEQ ID NO: 2728569 - RNA, 15 nt, Haemophilus influenzae Rd
uaaaucuuauuaaua

SEQ ID NO: 2728570 - RNA, 23 nt, Haemophilus influenzae Rd
uaaaucuugcuuuugguuuucug

SEQ ID NO: 2728571 - RNA, 12 nt, Haemophilus influenzae Rd
uaaaucuuuauc

SEQ ID NO: 2728572 - RNA, 13 nt, Haemophilus influenzae Rd
uaaaugaaguuuu

SEQ ID NO: 2728573 - RNA, 20 nt, Haemophilus influenzae Rd
uaaaugacauauaauauuaa

SEQ ID NO: 2728574 - RNA, 13 nt, Haemophilus influenzae Rd
uaaaugauaaaaa

SEQ ID NO: 2728575 - RNA, 16 nt, Haemophilus influenzae Rd
uaaaugaucagcuaaa

SEQ ID NO: 2728576 - RNA, 23 nt, Haemophilus influenzae Rd
uaaaugauuauccacuaaaaaac

SEQ ID NO: 2728577 - RNA, 23 nt, Haemophilus influenzae Rd
uaaaugauuaucuuguacuaacg

SEQ ID NO: 2728578 - RNA, 19 nt, Haemophilus influenzae Rd
uaaaugcacauuuuuacca

SEQ ID NO: 2728579 - RNA, 14 nt, Haemophilus influenzae Rd
uaaaugcaucauua

SEQ ID NO: 2728580 - RNA, 20 nt, Haemophilus influenzae Rd
uaaaugcaucauuaauacac

SEQ ID NO: 2728581 - RNA, 21 nt, Haemophilus influenzae Rd
uaaaugcaucauuaauacaca

SEQ ID NO: 2728582 - RNA, 23 nt, Haemophilus influenzae Rd
uaaaugcaucauuaauacacaaa

SEQ ID NO: 2728583 - RNA, 19 nt, Haemophilus influenzae Rd
uaaaugcgggaauagcuca

SEQ ID NO: 2728584 - RNA, 21 nt, Haemophilus influenzae Rd
uaaaugcgggaauagcucagu

SEQ ID NO: 2728585 - RNA, 15 nt, Haemophilus influenzae Rd
uaaaugcuaaaauua

SEQ ID NO: 2728586 - RNA, 15 nt, Haemophilus influenzae Rd
uaaaugcucgaauau

SEQ ID NO: 2728587 - RNA, 16 nt, Haemophilus influenzae Rd
uaaaugcuguagaaau

SEQ ID NO: 2728588 - RNA, 21 nt, Haemophilus influenzae Rd
uaaaugcuguagaaauuaaua

SEQ ID NO: 2728589 - RNA, 15 nt, Haemophilus influenzae Rd
uaaauggcucaagua

SEQ ID NO: 2728590 - RNA, 17 nt, Haemophilus influenzae Rd
uaaauggcucaaguauu

SEQ ID NO: 2728591 - RNA, 16 nt, Haemophilus influenzae Rd
uaaaugggacaaagca

SEQ ID NO: 2728592 - RNA, 15 nt, Haemophilus influenzae Rd
uaaaugugauuucca

SEQ ID NO: 2728593 - RNA, 15 nt, Haemophilus influenzae Rd
uaaauguuaauggcu

SEQ ID NO: 2728594 - RNA, 17 nt, Haemophilus influenzae Rd
uaaauuaaaaagacuaa

SEQ ID NO: 2728595 - RNA, 11 nt, Haemophilus influenzae Rd
uaaauuaaauu

SEQ ID NO: 2728596 - RNA, 19 nt, Haemophilus influenzae Rd
uaaauuaaggacuaaacuu

SEQ ID NO: 2728597 - RNA, 15 nt, Haemophilus influenzae Rd
uaaauuaauaagcca

SEQ ID NO: 2728598 - RNA, 13 nt, Haemophilus influenzae Rd
uaaauuaauuacu

SEQ ID NO: 2728599 - RNA, 19 nt, Haemophilus influenzae Rd
uaaauuacauucccaaaua

SEQ ID NO: 2728600 - RNA, 20 nt, Haemophilus influenzae Rd
uaaauuacauucccaaauaa

SEQ ID NO: 2728601 - RNA, 18 nt, Haemophilus influenzae Rd
uaaauuacgaccuuuacu

SEQ ID NO: 2728602 - RNA, 14 nt, Haemophilus influenzae Rd
uaaauuagcucaau

SEQ ID NO: 2728603 - RNA, 22 nt, Haemophilus influenzae Rd
uaaauuaggaauuugaucacga

SEQ ID NO: 2728604 - RNA, 13 nt, Haemophilus influenzae Rd
uaaauuaggcauu

SEQ ID NO: 2728605 - RNA, 20 nt, Haemophilus influenzae Rd
uaaauuaggcauuugaagau

SEQ ID NO: 2728606 - RNA, 14 nt, Haemophilus influenzae Rd
uaaauuaguuuaaa

SEQ ID NO: 2728607 - RNA, 18 nt, Haemophilus influenzae Rd
uaaauuaugcccaauuac

SEQ ID NO: 2728608 - RNA, 22 nt, Haemophilus influenzae Rd
uaaauuauggguguuuaaauuu

SEQ ID NO: 2728609 - RNA, 16 nt, Haemophilus influenzae Rd
uaaauuauuaaauagc

SEQ ID NO: 2728610 - RNA, 14 nt, Haemophilus influenzae Rd
uaaauuauuuuaau

SEQ ID NO: 2728611 - RNA, 15 nt, Haemophilus influenzae Rd
uaaauuauuuuaaua

SEQ ID NO: 2728612 - RNA, 21 nt, Haemophilus influenzae Rd
uaaauuauuuuuuauccuauu

SEQ ID NO: 2728613 - RNA, 14 nt, Haemophilus influenzae Rd
uaaauucaauacuu

SEQ ID NO: 2728614 - RNA, 13 nt, Haemophilus influenzae Rd
uaaauucaauuuu

SEQ ID NO: 2728615 - RNA, 21 nt, Haemophilus influenzae Rd
uaaauucacugacaucaagca

SEQ ID NO: 2728616 - RNA, 14 nt, Haemophilus influenzae Rd
uaaauucacugugu

SEQ ID NO: 2728617 - RNA, 18 nt, Haemophilus influenzae Rd
uaaauucaguuaagaaaa

SEQ ID NO: 2728618 - RNA, 13 nt, Haemophilus influenzae Rd
uaaauucauuuaa

SEQ ID NO: 2728619 - RNA, 15 nt, Haemophilus influenzae Rd
uaaauucauuuaaaa

SEQ ID NO: 2728620 - RNA, 22 nt, Haemophilus influenzae Rd
uaaauucauuuaaaauauauau

SEQ ID NO: 2728621 - RNA, 17 nt, Haemophilus influenzae Rd
uaaauucggaauauuca

SEQ ID NO: 2728622 - RNA, 18 nt, Haemophilus influenzae Rd
uaaauucggaauauucaa

SEQ ID NO: 2728623 - RNA, 20 nt, Haemophilus influenzae Rd
uaaauucguacaaaugaaaa

SEQ ID NO: 2728624 - RNA, 21 nt, Haemophilus influenzae Rd
uaaauucucaagaauauauuu

SEQ ID NO: 2728625 - RNA, 21 nt, Haemophilus influenzae Rd
uaaauucuccccgaugauuuu

SEQ ID NO: 2728626 - RNA, 18 nt, Haemophilus influenzae Rd
uaaauucucgccauaaua

SEQ ID NO: 2728627 - RNA, 16 nt, Haemophilus influenzae Rd
uaaauucuuaccaaaa

SEQ ID NO: 2728628 - RNA, 13 nt, Haemophilus influenzae Rd
uaaauucuucaag

SEQ ID NO: 2728629 - RNA, 22 nt, Haemophilus influenzae Rd
uaaauucuucaaguguuuuugc

SEQ ID NO: 2728630 - RNA, 12 nt, Haemophilus influenzae Rd
uaaauugaaaaa

SEQ ID NO: 2728631 - RNA, 14 nt, Haemophilus influenzae Rd
uaaauugaaaaaau

SEQ ID NO: 2728632 - RNA, 15 nt, Haemophilus influenzae Rd
uaaauugaaaaaaua

SEQ ID NO: 2728633 - RNA, 15 nt, Haemophilus influenzae Rd
uaaauugagauaacg

SEQ ID NO: 2728634 - RNA, 19 nt, Haemophilus influenzae Rd
uaaauugagaucaaaaauc

SEQ ID NO: 2728635 - RNA, 20 nt, Haemophilus influenzae Rd
uaaauugagaucaaaaauca

SEQ ID NO: 2728636 - RNA, 21 nt, Haemophilus influenzae Rd
uaaauugcuucgugugcaccc

SEQ ID NO: 2728637 - RNA, 16 nt, Haemophilus influenzae Rd
uaaauuguaacuauau

SEQ ID NO: 2728638 - RNA, 20 nt, Haemophilus influenzae Rd
uaaauugugauggaaguagu

SEQ ID NO: 2728639 - RNA, 18 nt, Haemophilus influenzae Rd
uaaauuuaaaggcggauu

SEQ ID NO: 2728640 - RNA, 20 nt, Haemophilus influenzae Rd
uaaauuuaaccacuaaaaaa

SEQ ID NO: 2728641 - RNA, 20 nt, Haemophilus influenzae Rd
uaaauuuaguggcuaaauua

SEQ ID NO: 2728642 - RNA, 15 nt, Haemophilus influenzae Rd
uaaauuucaauuaaa

SEQ ID NO: 2728643 - RNA, 20 nt, Haemophilus influenzae Rd
uaaauuucaauuaaaucaaa

SEQ ID NO: 2728644 - RNA, 23 nt, Haemophilus influenzae Rd
uaaauuucagcuuaaauacuaau

SEQ ID NO: 2728645 - RNA, 23 nt, Haemophilus influenzae Rd
uaaauuuccucagguucaaacau

SEQ ID NO: 2728646 - RNA, 20 nt, Haemophilus influenzae Rd
uaaauuugaucguuaauauc

SEQ ID NO: 2728647 - RNA, 22 nt, Haemophilus influenzae Rd
uaaauuuggauaguuuauuaau

SEQ ID NO: 2728648 - RNA, 14 nt, Haemophilus influenzae Rd
uaaauuugguucaa

SEQ ID NO: 2728649 - RNA, 17 nt, Haemophilus influenzae Rd
uaaauuugguucaauuu

SEQ ID NO: 2728650 - RNA, 12 nt, Haemophilus influenzae Rd
uaaauuuuaaaa

SEQ ID NO: 2728651 - RNA, 14 nt, Haemophilus influenzae Rd
uaaauuuuaaaaaa

SEQ ID NO: 2728652 - RNA, 13 nt, Haemophilus influenzae Rd
uaaauuuuaaaau

SEQ ID NO: 2728653 - RNA, 14 nt, Haemophilus influenzae Rd
uaaauuuuaaaaua

SEQ ID NO: 2728654 - RNA, 16 nt, Haemophilus influenzae Rd
uaaauuuuaaaauagu

SEQ ID NO: 2728655 - RNA, 18 nt, Haemophilus influenzae Rd
uaaauuuuaaaauaguuu

SEQ ID NO: 2728656 - RNA, 16 nt, Haemophilus influenzae Rd
uaaauuuuaaaaucuu

SEQ ID NO: 2728657 - RNA, 23 nt, Haemophilus influenzae Rd
uaaauuuuauuccaccacagccc

SEQ ID NO: 2728658 - RNA, 19 nt, Haemophilus influenzae Rd
uaaauuuugcuuuaaauca

SEQ ID NO: 2728659 - RNA, 14 nt, Haemophilus influenzae Rd
uaaauuuuuaauaa

SEQ ID NO: 2728660 - RNA, 22 nt, Haemophilus influenzae Rd
uaaauuuuuaauaaaguaaaau

SEQ ID NO: 2728661 - RNA, 17 nt, Haemophilus influenzae Rd
uaaauuuuuaauuuucu

SEQ ID NO: 2728662 - RNA, 14 nt, Haemophilus influenzae Rd
uaaauuuuuaguuu

SEQ ID NO: 2728663 - RNA, 16 nt, Haemophilus influenzae Rd
uaaauuuuuaguuugu

SEQ ID NO: 2728664 - RNA, 12 nt, Haemophilus influenzae Rd
uaaauuuuucca

SEQ ID NO: 2728665 - RNA, 22 nt, Haemophilus influenzae Rd
uaaauuuuuccacauuaaacug

SEQ ID NO: 2728666 - RNA, 16 nt, Haemophilus influenzae Rd
uaaauuuuuggcugcu

SEQ ID NO: 2728667 - RNA, 18 nt, Haemophilus influenzae Rd
uaaauuuuuuaauucagu

SEQ ID NO: 2728668 - RNA, 14 nt, Haemophilus influenzae Rd
uaaauuuuuuugau

SEQ ID NO: 2728669 - RNA, 13 nt, Haemophilus influenzae Rd
uaaauuuuuuugc

SEQ ID NO: 2728670 - RNA, 14 nt, Haemophilus influenzae Rd
uaaauuuuuuugca

SEQ ID NO: 2728671 - RNA, 20 nt, Haemophilus influenzae Rd
uaacaaaaacaaucacugaa

SEQ ID NO: 2728672 - RNA, 22 nt, Haemophilus influenzae Rd
uaacaaaagggcgauuaaaaac

SEQ ID NO: 2728673 - RNA, 15 nt, Haemophilus influenzae Rd
uaacaaaauggcuuu

SEQ ID NO: 2728674 - RNA, 17 nt, Haemophilus influenzae Rd
uaacaaaauuaaugcca

SEQ ID NO: 2728675 - RNA, 20 nt, Haemophilus influenzae Rd
uaacaaagccugcuacauuu

SEQ ID NO: 2728676 - RNA, 14 nt, Haemophilus influenzae Rd
uaacaaauaauuau

SEQ ID NO: 2728677 - RNA, 15 nt, Haemophilus influenzae Rd
uaacaaauaauuauu

SEQ ID NO: 2728678 - RNA, 17 nt, Haemophilus influenzae Rd
uaacaaauaauuauuau

SEQ ID NO: 2728679 - RNA, 20 nt, Haemophilus influenzae Rd
uaacaaauacaucuucacaa

SEQ ID NO: 2728680 - RNA, 19 nt, Haemophilus influenzae Rd
uaacaaauaggauaaaaau

SEQ ID NO: 2728681 - RNA, 13 nt, Haemophilus influenzae Rd
uaacaaauucacu

SEQ ID NO: 2728682 - RNA, 16 nt, Haemophilus influenzae Rd
uaacaaauucacuguc

SEQ ID NO: 2728683 - RNA, 14 nt, Haemophilus influenzae Rd
uaacaacaaaagug

SEQ ID NO: 2728684 - RNA, 15 nt, Haemophilus influenzae Rd
uaacaacaaagucaa

SEQ ID NO: 2728685 - RNA, 20 nt, Haemophilus influenzae Rd
uaacaacaaagucaauacac

SEQ ID NO: 2728686 - RNA, 21 nt, Haemophilus influenzae Rd
uaacaaccuuugguaaaagaa

SEQ ID NO: 2728687 - RNA, 15 nt, Haemophilus influenzae Rd
uaacaagaaaaauca

SEQ ID NO: 2728688 - RNA, 16 nt, Haemophilus influenzae Rd
uaacaauaauuugcca

SEQ ID NO: 2728689 - RNA, 18 nt, Haemophilus influenzae Rd
uaacaauauaucagacaa

SEQ ID NO: 2728690 - RNA, 21 nt, Haemophilus influenzae Rd
uaacaauauucgcuucuuuua

SEQ ID NO: 2728691 - RNA, 15 nt, Haemophilus influenzae Rd
uaacaaugaaauuau

SEQ ID NO: 2728692 - RNA, 17 nt, Haemophilus influenzae Rd
uaacaauguagaaaugg

SEQ ID NO: 2728693 - RNA, 13 nt, Haemophilus influenzae Rd
uaacacaaccauc

SEQ ID NO: 2728694 - RNA, 18 nt, Haemophilus influenzae Rd
uaacacaaccaucuucaa

SEQ ID NO: 2728695 - RNA, 19 nt, Haemophilus influenzae Rd
uaacacaaccaucuucaac

SEQ ID NO: 2728696 - RNA, 13 nt, Haemophilus influenzae Rd
uaacacaccaaca

SEQ ID NO: 2728697 - RNA, 18 nt, Haemophilus influenzae Rd
uaacacaccgucuugcca

SEQ ID NO: 2728698 - RNA, 16 nt, Haemophilus influenzae Rd
uaacacagaaaccaau

SEQ ID NO: 2728699 - RNA, 12 nt, Haemophilus influenzae Rd
uaacacagaaag

SEQ ID NO: 2728700 - RNA, 15 nt, Haemophilus influenzae Rd
uaacacagaugaaaa

SEQ ID NO: 2728701 - RNA, 18 nt, Haemophilus influenzae Rd
uaacacaucagaaaauca

SEQ ID NO: 2728702 - RNA, 12 nt, Haemophilus influenzae Rd
uaacacaugcaa

SEQ ID NO: 2728703 - RNA, 17 nt, Haemophilus influenzae Rd
uaacaccaaacagagug

SEQ ID NO: 2728704 - RNA, 14 nt, Haemophilus influenzae Rd
uaacaccaauauug

SEQ ID NO: 2728705 - RNA, 19 nt, Haemophilus influenzae Rd
uaacaccagugaauaaaca

SEQ ID NO: 2728706 - RNA, 11 nt, Haemophilus influenzae Rd
uaacaccauug

SEQ ID NO: 2728707 - RNA, 21 nt, Haemophilus influenzae Rd
uaacacgaaaccaacgaaaau

SEQ ID NO: 2728708 - RNA, 21 nt, Haemophilus influenzae Rd
uaacacucauuguaaagccca

SEQ ID NO: 2728709 - RNA, 13 nt, Haemophilus influenzae Rd
uaacacuuuuuca

SEQ ID NO: 2728710 - RNA, 13 nt, Haemophilus influenzae Rd
uaacacuuuuucu

SEQ ID NO: 2728711 - RNA, 14 nt, Haemophilus influenzae Rd
uaacagcaaacuua

SEQ ID NO: 2728712 - RNA, 16 nt, Haemophilus influenzae Rd
uaacagcaaacuuaaa

SEQ ID NO: 2728713 - RNA, 17 nt, Haemophilus influenzae Rd
uaacagcuagaauaaag

SEQ ID NO: 2728714 - RNA, 13 nt, Haemophilus influenzae Rd
uaacagcucugua

SEQ ID NO: 2728715 - RNA, 16 nt, Haemophilus influenzae Rd
uaacagcucuguaaaa

SEQ ID NO: 2728716 - RNA, 22 nt, Haemophilus influenzae Rd
uaacaggaauuugcucaauaau

SEQ ID NO: 2728717 - RNA, 17 nt, Haemophilus influenzae Rd
uaacagggcauaaauca

SEQ ID NO: 2728718 - RNA, 15 nt, Haemophilus influenzae Rd
uaacauaacuuucca

SEQ ID NO: 2728719 - RNA, 20 nt, Haemophilus influenzae Rd
uaacauaaugauuucuaaac

SEQ ID NO: 2728720 - RNA, 15 nt, Haemophilus influenzae Rd
uaacauaauuguguu

SEQ ID NO: 2728721 - RNA, 15 nt, Haemophilus influenzae Rd
uaacauaccuagauu

SEQ ID NO: 2728722 - RNA, 15 nt, Haemophilus influenzae Rd
uaacauagaaaucac

SEQ ID NO: 2728723 - RNA, 16 nt, Haemophilus influenzae Rd
uaacauagaaaucacu

SEQ ID NO: 2728724 - RNA, 21 nt, Haemophilus influenzae Rd
uaacauaggguguucaacuuc

SEQ ID NO: 2728725 - RNA, 23 nt, Haemophilus influenzae Rd
uaacauaucguuaucuuuaaaga

SEQ ID NO: 2728726 - RNA, 19 nt, Haemophilus influenzae Rd
uaacaucuuaguauuuuau

SEQ ID NO: 2728727 - RNA, 20 nt, Haemophilus influenzae Rd
uaacaucuuaguauuuuauu

SEQ ID NO: 2728728 - RNA, 18 nt, Haemophilus influenzae Rd
uaacaugguuaaaauauu

SEQ ID NO: 2728729 - RNA, 16 nt, Haemophilus influenzae Rd
uaacauuaauaaacca

SEQ ID NO: 2728730 - RNA, 18 nt, Haemophilus influenzae Rd
uaacauuccguuuuuaau

SEQ ID NO: 2728731 - RNA, 17 nt, Haemophilus influenzae Rd
uaacauuguuuuaaugu

SEQ ID NO: 2728732 - RNA, 21 nt, Haemophilus influenzae Rd
uaacauuuaacaauggcaaca

SEQ ID NO: 2728733 - RNA, 19 nt, Haemophilus influenzae Rd
uaaccaaaauauuucauuu

SEQ ID NO: 2728734 - RNA, 11 nt, Haemophilus influenzae Rd
uaaccaaagaa

SEQ ID NO: 2728735 - RNA, 13 nt, Haemophilus influenzae Rd
uaaccaacauaaa

SEQ ID NO: 2728736 - RNA, 23 nt, Haemophilus influenzae Rd
uaaccaacauaaacauuggucgc

SEQ ID NO: 2728737 - RNA, 19 nt, Haemophilus influenzae Rd
uaaccaacguggcuuuucu

SEQ ID NO: 2728738 - RNA, 16 nt, Haemophilus influenzae Rd
uaaccaagccaaacua

SEQ ID NO: 2728739 - RNA, 17 nt, Haemophilus influenzae Rd
uaaccaagccaaacuau

SEQ ID NO: 2728740 - RNA, 19 nt, Haemophilus influenzae Rd
uaaccaagcguuaauccaa

SEQ ID NO: 2728741 - RNA, 17 nt, Haemophilus influenzae Rd
uaaccaauauaauuuac

SEQ ID NO: 2728742 - RNA, 20 nt, Haemophilus influenzae Rd
uaaccacaaaaucugcuccg

SEQ ID NO: 2728743 - RNA, 22 nt, Haemophilus influenzae Rd
uaaccacauauagugaaaaaau

SEQ ID NO: 2728744 - RNA, 23 nt, Haemophilus influenzae Rd
uaaccacauauagugaaaaaaua

SEQ ID NO: 2728745 - RNA, 17 nt, Haemophilus influenzae Rd
uaaccacguaauucuug

SEQ ID NO: 2728746 - RNA, 19 nt, Haemophilus influenzae Rd
uaaccacguauuuuuuaau

SEQ ID NO: 2728747 - RNA, 16 nt, Haemophilus influenzae Rd
uaaccacuacguguag

SEQ ID NO: 2728748 - RNA, 19 nt, Haemophilus influenzae Rd
uaaccacuacguguagaag

SEQ ID NO: 2728749 - RNA, 18 nt, Haemophilus influenzae Rd
uaaccacuagccauugca

SEQ ID NO: 2728750 - RNA, 20 nt, Haemophilus influenzae Rd
uaaccacuugucauuaaaaa

SEQ ID NO: 2728751 - RNA, 22 nt, Haemophilus influenzae Rd
uaaccacuugucauuaaaaaau

SEQ ID NO: 2728752 - RNA, 22 nt, Haemophilus influenzae Rd
uaaccaucccagucaaaaaugu

SEQ ID NO: 2728753 - RNA, 12 nt, Haemophilus influenzae Rd
uaaccaucccuu

SEQ ID NO: 2728754 - RNA, 23 nt, Haemophilus influenzae Rd
uaaccaucccuuuuuacauuauu

SEQ ID NO: 2728755 - RNA, 23 nt, Haemophilus influenzae Rd
uaaccaucuauauuugaguuauu

SEQ ID NO: 2728756 - RNA, 14 nt, Haemophilus influenzae Rd
uaaccauucccauu

SEQ ID NO: 2728757 - RNA, 20 nt, Haemophilus influenzae Rd
uaacccauuacuaaaucccu

SEQ ID NO: 2728758 - RNA, 11 nt, Haemophilus influenzae Rd
uaacccauuua

SEQ ID NO: 2728759 - RNA, 20 nt, Haemophilus influenzae Rd
uaacccccuuaauucuaagg

SEQ ID NO: 2728760 - RNA, 14 nt, Haemophilus influenzae Rd
uaaccccuuuucug

SEQ ID NO: 2728761 - RNA, 16 nt, Haemophilus influenzae Rd
uaaccgcacuuuaaau

SEQ ID NO: 2728762 - RNA, 16 nt, Haemophilus influenzae Rd
uaaccgcacuuucauu

SEQ ID NO: 2728763 - RNA, 18 nt, Haemophilus influenzae Rd
uaaccgcacuuucauucc

SEQ ID NO: 2728764 - RNA, 16 nt, Haemophilus influenzae Rd
uaaccgcacuuuuaau

SEQ ID NO: 2728765 - RNA, 18 nt, Haemophilus influenzae Rd
uaaccgcacuuuuuaaua

SEQ ID NO: 2728766 - RNA, 18 nt, Haemophilus influenzae Rd
uaaccgugcucaauuucu

SEQ ID NO: 2728767 - RNA, 22 nt, Haemophilus influenzae Rd
uaaccuaaaauagagcaaauau

SEQ ID NO: 2728768 - RNA, 20 nt, Haemophilus influenzae Rd
uaaccuaauuucauaaaaau

SEQ ID NO: 2728769 - RNA, 21 nt, Haemophilus influenzae Rd
uaaccuagaacaaaaggcuuu

SEQ ID NO: 2728770 - RNA, 22 nt, Haemophilus influenzae Rd
uaaccuagaacaaaaggcuuuu

SEQ ID NO: 2728771 - RNA, 14 nt, Haemophilus influenzae Rd
uaaccuaucaucug

SEQ ID NO: 2728772 - RNA, 15 nt, Haemophilus influenzae Rd
uaaccucgaaucaca

SEQ ID NO: 2728773 - RNA, 17 nt, Haemophilus influenzae Rd
uaaccugcggauuucac

SEQ ID NO: 2728774 - RNA, 14 nt, Haemophilus influenzae Rd
uaaccuuacugccu

SEQ ID NO: 2728775 - RNA, 21 nt, Haemophilus influenzae Rd
uaaccuuacugccuuuuucuu

SEQ ID NO: 2728776 - RNA, 17 nt, Haemophilus influenzae Rd
uaaccuuagcaccacuu

SEQ ID NO: 2728777 - RNA, 21 nt, Haemophilus influenzae Rd
uaaccuucaaugguuuuacug

SEQ ID NO: 2728778 - RNA, 21 nt, Haemophilus influenzae Rd
uaacgauaagauuugcuuuuu

SEQ ID NO: 2728779 - RNA, 18 nt, Haemophilus influenzae Rd
uaacgauauguuaauaag

SEQ ID NO: 2728780 - RNA, 19 nt, Haemophilus influenzae Rd
uaacgauguugcaaccuuc

SEQ ID NO: 2728781 - RNA, 21 nt, Haemophilus influenzae Rd
uaacgauguugcaaccuucag

SEQ ID NO: 2728782 - RNA, 20 nt, Haemophilus influenzae Rd
uaacgcaucaccacaaaaua

SEQ ID NO: 2728783 - RNA, 23 nt, Haemophilus influenzae Rd
uaacgcaucaccacaaaauaaau

SEQ ID NO: 2728784 - RNA, 22 nt, Haemophilus influenzae Rd
uaacgcauuguuacaaauuccu

SEQ ID NO: 2728785 - RNA, 22 nt, Haemophilus influenzae Rd
uaacgcccccgccauuuugaau

SEQ ID NO: 2728786 - RNA, 20 nt, Haemophilus influenzae Rd
uaacgcguacuucccgcaca

SEQ ID NO: 2728787 - RNA, 20 nt, Haemophilus influenzae Rd
uaacgcucaaaaauuucaga

SEQ ID NO: 2728788 - RNA, 17 nt, Haemophilus influenzae Rd
uaacgcucauaagcauu

SEQ ID NO: 2728789 - RNA, 21 nt, Haemophilus influenzae Rd
uaacgcuccccuugauuauuu

SEQ ID NO: 2728790 - RNA, 22 nt, Haemophilus influenzae Rd
uaacgcugcuuaaagcaaucaa

SEQ ID NO: 2728791 - RNA, 14 nt, Haemophilus influenzae Rd
uaacgcuuuuaaac

SEQ ID NO: 2728792 - RNA, 19 nt, Haemophilus influenzae Rd
uaacggcaaaaucauuaaa

SEQ ID NO: 2728793 - RNA, 17 nt, Haemophilus influenzae Rd
uaacgggcauuuuucuu

SEQ ID NO: 2728794 - RNA, 20 nt, Haemophilus influenzae Rd
uaacgggcuuaaacuuuuuu

SEQ ID NO: 2728795 - RNA, 15 nt, Haemophilus influenzae Rd
uaacgguuuucgauu

SEQ ID NO: 2728796 - RNA, 15 nt, Haemophilus influenzae Rd
uaacguauuuucuca

SEQ ID NO: 2728797 - RNA, 14 nt, Haemophilus influenzae Rd
uaacgucauuaauu

SEQ ID NO: 2728798 - RNA, 18 nt, Haemophilus influenzae Rd
uaacguuacuaaaauccu

SEQ ID NO: 2728799 - RNA, 19 nt, Haemophilus influenzae Rd
uaacguuaucaucuguaaa

SEQ ID NO: 2728800 - RNA, 14 nt, Haemophilus influenzae Rd
uaacuaaaaauacc

SEQ ID NO: 2728801 - RNA, 14 nt, Haemophilus influenzae Rd
uaacuaaaccauuu

SEQ ID NO: 2728802 - RNA, 13 nt, Haemophilus influenzae Rd
uaacuacaacaca

SEQ ID NO: 2728803 - RNA, 19 nt, Haemophilus influenzae Rd
uaacuacaacuucaucaau

SEQ ID NO: 2728804 - RNA, 17 nt, Haemophilus influenzae Rd
uaacuaggcaucaaaau

SEQ ID NO: 2728805 - RNA, 18 nt, Haemophilus influenzae Rd
uaacuaugccuucuucac

SEQ ID NO: 2728806 - RNA, 23 nt, Haemophilus influenzae Rd
uaacuauuggcaucaaaacguuc

SEQ ID NO: 2728807 - RNA, 16 nt, Haemophilus influenzae Rd
uaacucaaaauacuca

SEQ ID NO: 2728808 - RNA, 17 nt, Haemophilus influenzae Rd
uaacucaacaccgcaaa

SEQ ID NO: 2728809 - RNA, 20 nt, Haemophilus influenzae Rd
uaacucaucaacaaaaugcu

SEQ ID NO: 2728810 - RNA, 23 nt, Haemophilus influenzae Rd
uaacucuaaagcggaugguaaua

SEQ ID NO: 2728811 - RNA, 17 nt, Haemophilus influenzae Rd
uaacugaagcaaucgca

SEQ ID NO: 2728812 - RNA, 22 nt, Haemophilus influenzae Rd
uaacugaucggauuucuuuauu

SEQ ID NO: 2728813 - RNA, 15 nt, Haemophilus influenzae Rd
uaacugcuuuuuucc

SEQ ID NO: 2728814 - RNA, 18 nt, Haemophilus influenzae Rd
uaacugcuuuuuuccagc

SEQ ID NO: 2728815 - RNA, 22 nt, Haemophilus influenzae Rd
uaacuguaucuacuuuauucaa

SEQ ID NO: 2728816 - RNA, 19 nt, Haemophilus influenzae Rd
uaacugugugauuuauuua

SEQ ID NO: 2728817 - RNA, 22 nt, Haemophilus influenzae Rd
uaacuuaaucauuuuuuaacuu

SEQ ID NO: 2728818 - RNA, 13 nt, Haemophilus influenzae Rd
uaacuuagaaaau

SEQ ID NO: 2728819 - RNA, 15 nt, Haemophilus influenzae Rd
uaacuuagaaaauau

SEQ ID NO: 2728820 - RNA, 16 nt, Haemophilus influenzae Rd
uaacuuagaaaauauc

SEQ ID NO: 2728821 - RNA, 16 nt, Haemophilus influenzae Rd
uaacuuaguaaggcac

SEQ ID NO: 2728822 - RNA, 17 nt, Haemophilus influenzae Rd
uaacuuaucuaaaaaga

SEQ ID NO: 2728823 - RNA, 17 nt, Haemophilus influenzae Rd
uaacuucaaccacuuca

SEQ ID NO: 2728824 - RNA, 19 nt, Haemophilus influenzae Rd
uaacuugcgauaauaucag

SEQ ID NO: 2728825 - RNA, 17 nt, Haemophilus influenzae Rd
uaacuugcgauacaaac

SEQ ID NO: 2728826 - RNA, 15 nt, Haemophilus influenzae Rd
uaacuuuaaguaauc

SEQ ID NO: 2728827 - RNA, 12 nt, Haemophilus influenzae Rd
uaacuuuaauua

SEQ ID NO: 2728828 - RNA, 17 nt, Haemophilus influenzae Rd
uaacuuuccuacuauag

SEQ ID NO: 2728829 - RNA, 12 nt, Haemophilus influenzae Rd
uaacuuuuaauu

SEQ ID NO: 2728830 - RNA, 16 nt, Haemophilus influenzae Rd
uaacuuuuaauucuug

SEQ ID NO: 2728831 - RNA, 17 nt, Haemophilus influenzae Rd
uaacuuuuaauucuugu

SEQ ID NO: 2728832 - RNA, 22 nt, Haemophilus influenzae Rd
uaacuuuucaaguuacuuaauu

SEQ ID NO: 2728833 - RNA, 21 nt, Haemophilus influenzae Rd
uaacuuuuuuauuuguuaaua

SEQ ID NO: 2728834 - RNA, 17 nt, Haemophilus influenzae Rd
uaagaaaaaauauaaaa

SEQ ID NO: 2728835 - RNA, 14 nt, Haemophilus influenzae Rd
uaagaaaauaauau

SEQ ID NO: 2728836 - RNA, 17 nt, Haemophilus influenzae Rd
uaagaaaauagaaagaa

SEQ ID NO: 2728837 - RNA, 20 nt, Haemophilus influenzae Rd
uaagaaaauagaagccaaau

SEQ ID NO: 2728838 - RNA, 13 nt, Haemophilus influenzae Rd
uaagaaaaucaaa

SEQ ID NO: 2728839 - RNA, 17 nt, Haemophilus influenzae Rd
uaagaaaaucccuugcu

SEQ ID NO: 2728840 - RNA, 22 nt, Haemophilus influenzae Rd
uaagaaagaaacugaaguauaa

SEQ ID NO: 2728841 - RNA, 16 nt, Haemophilus influenzae Rd
uaagaaagcuaauggu

SEQ ID NO: 2728842 - RNA, 16 nt, Haemophilus influenzae Rd
uaagaaauaacgauaa

SEQ ID NO: 2728843 - RNA, 20 nt, Haemophilus influenzae Rd
uaagaaaucucuuucaauuu

SEQ ID NO: 2728844 - RNA, 15 nt, Haemophilus influenzae Rd
uaagaaauuuucuuu

SEQ ID NO: 2728845 - RNA, 19 nt, Haemophilus influenzae Rd
uaagaauaccgaguucaag

SEQ ID NO: 2728846 - RNA, 20 nt, Haemophilus influenzae Rd
uaagacaccugcaagugcgg

SEQ ID NO: 2728847 - RNA, 18 nt, Haemophilus influenzae Rd
uaagagaggagaaauaau

SEQ ID NO: 2728848 - RNA, 22 nt, Haemophilus influenzae Rd
uaagagaggagaaauaaucucu

SEQ ID NO: 2728849 - RNA, 20 nt, Haemophilus influenzae Rd
uaagauaaacgcauagaaau

SEQ ID NO: 2728850 - RNA, 22 nt, Haemophilus influenzae Rd
uaagauaguagagucauuuaca

SEQ ID NO: 2728851 - RNA, 20 nt, Haemophilus influenzae Rd
uaagaucuucuacuguuaau

SEQ ID NO: 2728852 - RNA, 15 nt, Haemophilus influenzae Rd
uaagaugacuuguuu

SEQ ID NO: 2728853 - RNA, 15 nt, Haemophilus influenzae Rd
uaagaugauaaauuc

SEQ ID NO: 2728854 - RNA, 22 nt, Haemophilus influenzae Rd
uaagauguuguaaaaucucuau

SEQ ID NO: 2728855 - RNA, 23 nt, Haemophilus influenzae Rd
uaagauuacccacuaaguauuaa

SEQ ID NO: 2728856 - RNA, 15 nt, Haemophilus influenzae Rd
uaagauuuacagaac

SEQ ID NO: 2728857 - RNA, 19 nt, Haemophilus influenzae Rd
uaagauuuuugauaaaaaa

SEQ ID NO: 2728858 - RNA, 23 nt, Haemophilus influenzae Rd
uaagauuuuugauaaaaaagaaa

SEQ ID NO: 2728859 - RNA, 22 nt, Haemophilus influenzae Rd
uaagcaaaaacacguuuugcac

SEQ ID NO: 2728860 - RNA, 19 nt, Haemophilus influenzae Rd
uaagcaaaaucauauugau

SEQ ID NO: 2728861 - RNA, 14 nt, Haemophilus influenzae Rd
uaagcaaagaaauu

SEQ ID NO: 2728862 - RNA, 17 nt, Haemophilus influenzae Rd
uaagcaaagaaauuuaa

SEQ ID NO: 2728863 - RNA, 16 nt, Haemophilus influenzae Rd
uaagcaauaauuucau

SEQ ID NO: 2728864 - RNA, 17 nt, Haemophilus influenzae Rd
uaagcaauaauuucauu

SEQ ID NO: 2728865 - RNA, 14 nt, Haemophilus influenzae Rd
uaagcaaucuugcc

SEQ ID NO: 2728866 - RNA, 14 nt, Haemophilus influenzae Rd
uaagcaauuucacg

SEQ ID NO: 2728867 - RNA, 18 nt, Haemophilus influenzae Rd
uaagcaauuuucugcaga

SEQ ID NO: 2728868 - RNA, 19 nt, Haemophilus influenzae Rd
uaagcaauuuucugcagaa

SEQ ID NO: 2728869 - RNA, 23 nt, Haemophilus influenzae Rd
uaagcaccgaaagguguuuuuuu

SEQ ID NO: 2728870 - RNA, 16 nt, Haemophilus influenzae Rd
uaagcacuuguacauc

SEQ ID NO: 2728871 - RNA, 14 nt, Haemophilus influenzae Rd
uaagcauaaaagug

SEQ ID NO: 2728872 - RNA, 21 nt, Haemophilus influenzae Rd
uaagcauccaucgacauacaa

SEQ ID NO: 2728873 - RNA, 15 nt, Haemophilus influenzae Rd
uaagcauuaaaaauu

SEQ ID NO: 2728874 - RNA, 19 nt, Haemophilus influenzae Rd
uaagccaaaaccuagaaau

SEQ ID NO: 2728875 - RNA, 12 nt, Haemophilus influenzae Rd
uaagccaaaucc

SEQ ID NO: 2728876 - RNA, 22 nt, Haemophilus influenzae Rd
uaagccacucuaaguuuaagug

SEQ ID NO: 2728877 - RNA, 21 nt, Haemophilus influenzae Rd
uaagccagaacauauaaccca

SEQ ID NO: 2728878 - RNA, 15 nt, Haemophilus influenzae Rd
uaagccauuggaaaa

SEQ ID NO: 2728879 - RNA, 14 nt, Haemophilus influenzae Rd
uaagcccaacuuaa

SEQ ID NO: 2728880 - RNA, 21 nt, Haemophilus influenzae Rd
uaagcccccacgcgacuaaag

SEQ ID NO: 2728881 - RNA, 15 nt, Haemophilus influenzae Rd
uaagccgcaccaaua

SEQ ID NO: 2728882 - RNA, 20 nt, Haemophilus influenzae Rd
uaagccgccugauguuugag

SEQ ID NO: 2728883 - RNA, 18 nt, Haemophilus influenzae Rd
uaagccgcuauuucacuc

SEQ ID NO: 2728884 - RNA, 22 nt, Haemophilus influenzae Rd
uaagccguguucuagugcaaca

SEQ ID NO: 2728885 - RNA, 14 nt, Haemophilus influenzae Rd
uaagccuaaaccaa

SEQ ID NO: 2728886 - RNA, 21 nt, Haemophilus influenzae Rd
uaagccuguuaugcuuuauuc

SEQ ID NO: 2728887 - RNA, 15 nt, Haemophilus influenzae Rd
uaagccuugcauaau

SEQ ID NO: 2728888 - RNA, 14 nt, Haemophilus influenzae Rd
uaagccuuuucaua

SEQ ID NO: 2728889 - RNA, 19 nt, Haemophilus influenzae Rd
uaagcgguaacgacaaaac

SEQ ID NO: 2728890 - RNA, 13 nt, Haemophilus influenzae Rd
uaagcguaccauu

SEQ ID NO: 2728891 - RNA, 16 nt, Haemophilus influenzae Rd
uaagcuaaguacaaaa

SEQ ID NO: 2728892 - RNA, 16 nt, Haemophilus influenzae Rd
uaagcuaauuuuucag

SEQ ID NO: 2728893 - RNA, 16 nt, Haemophilus influenzae Rd
uaagcuaucgucaaau

SEQ ID NO: 2728894 - RNA, 20 nt, Haemophilus influenzae Rd
uaagcuaucgucaaauuuaa

SEQ ID NO: 2728895 - RNA, 22 nt, Haemophilus influenzae Rd
uaagcucacuugcauauccgcu

SEQ ID NO: 2728896 - RNA, 15 nt, Haemophilus influenzae Rd
uaagcucucuacuaa

SEQ ID NO: 2728897 - RNA, 15 nt, Haemophilus influenzae Rd
uaagcugauucuuca

SEQ ID NO: 2728898 - RNA, 15 nt, Haemophilus influenzae Rd
uaagcuguauuacuu

SEQ ID NO: 2728899 - RNA, 18 nt, Haemophilus influenzae Rd
uaagcugugguaaaaaua

SEQ ID NO: 2728900 - RNA, 22 nt, Haemophilus influenzae Rd
uaagcuuaauauguucuuuguu

SEQ ID NO: 2728901 - RNA, 23 nt, Haemophilus influenzae Rd
uaagcuuaauauguucuuuguug

SEQ ID NO: 2728902 - RNA, 16 nt, Haemophilus influenzae Rd
uaagcuuuucuagcaa

SEQ ID NO: 2728903 - RNA, 15 nt, Haemophilus influenzae Rd
uaaggaaauugcagg

SEQ ID NO: 2728904 - RNA, 21 nt, Haemophilus influenzae Rd
uaaggacgaaggauaaauuga

SEQ ID NO: 2728905 - RNA, 13 nt, Haemophilus influenzae Rd
uaaggacuaaacu

SEQ ID NO: 2728906 - RNA, 17 nt, Haemophilus influenzae Rd
uaaggacuaaacuuuua

SEQ ID NO: 2728907 - RNA, 16 nt, Haemophilus influenzae Rd
uaaggaucuuguaaag

SEQ ID NO: 2728908 - RNA, 15 nt, Haemophilus influenzae Rd
uaaggauugaccgcc

SEQ ID NO: 2728909 - RNA, 21 nt, Haemophilus influenzae Rd
uaaggauuuauuuaacaauga

SEQ ID NO: 2728910 - RNA, 14 nt, Haemophilus influenzae Rd
uaaggcaagauaca

SEQ ID NO: 2728911 - RNA, 21 nt, Haemophilus influenzae Rd
uaaggcaccuuuuugcucugg

SEQ ID NO: 2728912 - RNA, 23 nt, Haemophilus influenzae Rd
uaaggcguaaaacuauuaucuac

SEQ ID NO: 2728913 - RNA, 21 nt, Haemophilus influenzae Rd
uaaggcuaacucugguucaaa

SEQ ID NO: 2728914 - RNA, 16 nt, Haemophilus influenzae Rd
uaaggcuuuaccuuuu

SEQ ID NO: 2728915 - RNA, 13 nt, Haemophilus influenzae Rd
uaaggcuuuucuu

SEQ ID NO: 2728916 - RNA, 16 nt, Haemophilus influenzae Rd
uaagggacuucaggag

SEQ ID NO: 2728917 - RNA, 12 nt, Haemophilus influenzae Rd
uaagggcaaaaa

SEQ ID NO: 2728918 - RNA, 17 nt, Haemophilus influenzae Rd
uaaggguauacuuuauu

SEQ ID NO: 2728919 - RNA, 15 nt, Haemophilus influenzae Rd
uaaggguaucacaaa

SEQ ID NO: 2728920 - RNA, 22 nt, Haemophilus influenzae Rd
uaaggugcagauuaauuauauu

SEQ ID NO: 2728921 - RNA, 16 nt, Haemophilus influenzae Rd
uaagguuauacugccu

SEQ ID NO: 2728922 - RNA, 20 nt, Haemophilus influenzae Rd
uaagguucgauaguauuuua

SEQ ID NO: 2728923 - RNA, 23 nt, Haemophilus influenzae Rd
uaagguuuggacaccuuuuuccu

SEQ ID NO: 2728924 - RNA, 15 nt, Haemophilus influenzae Rd
uaaguaaaaccauua

SEQ ID NO: 2728925 - RNA, 16 nt, Haemophilus influenzae Rd
uaaguaaaauagucac

SEQ ID NO: 2728926 - RNA, 16 nt, Haemophilus influenzae Rd
uaaguaagucaagcua

SEQ ID NO: 2728927 - RNA, 22 nt, Haemophilus influenzae Rd
uaaguaagucaagcuaaucucu

SEQ ID NO: 2728928 - RNA, 14 nt, Haemophilus influenzae Rd
uaaguaauacauuu

SEQ ID NO: 2728929 - RNA, 15 nt, Haemophilus influenzae Rd
uaaguacgauaaaca

SEQ ID NO: 2728930 - RNA, 17 nt, Haemophilus influenzae Rd
uaaguacgauaaacacu

SEQ ID NO: 2728931 - RNA, 14 nt, Haemophilus influenzae Rd
uaaguagaaaaauu

SEQ ID NO: 2728932 - RNA, 20 nt, Haemophilus influenzae Rd
uaaguagaaaaauugguacg

SEQ ID NO: 2728933 - RNA, 18 nt, Haemophilus influenzae Rd
uaaguagcguaaaccuug

SEQ ID NO: 2728934 - RNA, 14 nt, Haemophilus influenzae Rd
uaaguaguguuuua

SEQ ID NO: 2728935 - RNA, 20 nt, Haemophilus influenzae Rd
uaaguaguguuuuauuuaua

SEQ ID NO: 2728936 - RNA, 17 nt, Haemophilus influenzae Rd
uaaguauaacuuaaauc

SEQ ID NO: 2728937 - RNA, 13 nt, Haemophilus influenzae Rd
uaaguaugccaua

SEQ ID NO: 2728938 - RNA, 22 nt, Haemophilus influenzae Rd
uaaguauucaugauguaauucu

SEQ ID NO: 2728939 - RNA, 12 nt, Haemophilus influenzae Rd
uaaguauuuugc

SEQ ID NO: 2728940 - RNA, 18 nt, Haemophilus influenzae Rd
uaagucagcauaaacaaa

SEQ ID NO: 2728941 - RNA, 20 nt, Haemophilus influenzae Rd
uaagucaggaauaaaagauu

SEQ ID NO: 2728942 - RNA, 22 nt, Haemophilus influenzae Rd
uaaguccaaguuuucacuucgu

SEQ ID NO: 2728943 - RNA, 14 nt, Haemophilus influenzae Rd
uaagucgauaaaga

SEQ ID NO: 2728944 - RNA, 23 nt, Haemophilus influenzae Rd
uaagucgcuaauuuuuuuucuaa

SEQ ID NO: 2728945 - RNA, 17 nt, Haemophilus influenzae Rd
uaagucgugaucugcau

SEQ ID NO: 2728946 - RNA, 19 nt, Haemophilus influenzae Rd
uaagucuauuacuaaaauu

SEQ ID NO: 2728947 - RNA, 14 nt, Haemophilus influenzae Rd
uaagugagaaaaua

SEQ ID NO: 2728948 - RNA, 17 nt, Haemophilus influenzae Rd
uaagugcgguaaaaaaa

SEQ ID NO: 2728949 - RNA, 19 nt, Haemophilus influenzae Rd
uaagugcgguauuuuuauu

SEQ ID NO: 2728950 - RNA, 20 nt, Haemophilus influenzae Rd
uaagugcgguugaaaauucu

SEQ ID NO: 2728951 - RNA, 19 nt, Haemophilus influenzae Rd
uaagugcguguauauauuu

SEQ ID NO: 2728952 - RNA, 15 nt, Haemophilus influenzae Rd
uaaguggcauaaaga

SEQ ID NO: 2728953 - RNA, 21 nt, Haemophilus influenzae Rd
uaaguggggaaaaauauuaaa

SEQ ID NO: 2728954 - RNA, 20 nt, Haemophilus influenzae Rd
uaaguguagcaauaaacaga

SEQ ID NO: 2728955 - RNA, 21 nt, Haemophilus influenzae Rd
uaaguuaaaccaacaacugca

SEQ ID NO: 2728956 - RNA, 23 nt, Haemophilus influenzae Rd
uaaguuauuuauauaauuuaaca

SEQ ID NO: 2728957 - RNA, 20 nt, Haemophilus influenzae Rd
uaaguucaacaccuaaauga

SEQ ID NO: 2728958 - RNA, 14 nt, Haemophilus influenzae Rd
uaaguucaucaacu

SEQ ID NO: 2728959 - RNA, 15 nt, Haemophilus influenzae Rd
uaaguucuaaauaaa

SEQ ID NO: 2728960 - RNA, 20 nt, Haemophilus influenzae Rd
uaaguucuacccauucaaau

SEQ ID NO: 2728961 - RNA, 15 nt, Haemophilus influenzae Rd
uaaguuggauucauu

SEQ ID NO: 2728962 - RNA, 16 nt, Haemophilus influenzae Rd
uaaguuggcugaaagc

SEQ ID NO: 2728963 - RNA, 19 nt, Haemophilus influenzae Rd
uaaguugggcuuauuuguu

SEQ ID NO: 2728964 - RNA, 15 nt, Haemophilus influenzae Rd
uaaguuugagcaaau

SEQ ID NO: 2728965 - RNA, 21 nt, Haemophilus influenzae Rd
uaaguuugcuaauuuauccaa

SEQ ID NO: 2728966 - RNA, 15 nt, Haemophilus influenzae Rd
uaauaaaaaauaaag

SEQ ID NO: 2728967 - RNA, 13 nt, Haemophilus influenzae Rd
uaauaaaaaauac

SEQ ID NO: 2728968 - RNA, 14 nt, Haemophilus influenzae Rd
uaauaaaaauuaaa

SEQ ID NO: 2728969 - RNA, 22 nt, Haemophilus influenzae Rd
uaauaaaaccucagaagaaauu

SEQ ID NO: 2728970 - RNA, 13 nt, Haemophilus influenzae Rd
uaauaaaauauac

SEQ ID NO: 2728971 - RNA, 16 nt, Haemophilus influenzae Rd
uaauaaaauguuuaua

SEQ ID NO: 2728972 - RNA, 12 nt, Haemophilus influenzae Rd
uaauaaaauuua

SEQ ID NO: 2728973 - RNA, 13 nt, Haemophilus influenzae Rd
uaauaaaauuuau

SEQ ID NO: 2728974 - RNA, 14 nt, Haemophilus influenzae Rd
uaauaaacauacau

SEQ ID NO: 2728975 - RNA, 14 nt, Haemophilus influenzae Rd
uaauaaaccaacau

SEQ ID NO: 2728976 - RNA, 13 nt, Haemophilus influenzae Rd
uaauaaaccaaua

SEQ ID NO: 2728977 - RNA, 17 nt, Haemophilus influenzae Rd
uaauaaaccuuuuucua

SEQ ID NO: 2728978 - RNA, 23 nt, Haemophilus influenzae Rd
uaauaaaccuuuuucuaacacaa

SEQ ID NO: 2728979 - RNA, 23 nt, Haemophilus influenzae Rd
uaauaaacggaguuuuccauuug

SEQ ID NO: 2728980 - RNA, 19 nt, Haemophilus influenzae Rd
uaauaaacggauugcauau

SEQ ID NO: 2728981 - RNA, 11 nt, Haemophilus influenzae Rd
uaauaaagcgu

SEQ ID NO: 2728982 - RNA, 19 nt, Haemophilus influenzae Rd
uaauaaagcuacuaaaaau

SEQ ID NO: 2728983 - RNA, 20 nt, Haemophilus influenzae Rd
uaauaaagcuacuaaaaauu

SEQ ID NO: 2728984 - RNA, 12 nt, Haemophilus influenzae Rd
uaauaaauauaa

SEQ ID NO: 2728985 - RNA, 14 nt, Haemophilus influenzae Rd
uaauaaauauaauu

SEQ ID NO: 2728986 - RNA, 12 nt, Haemophilus influenzae Rd
uaauaaauauua

SEQ ID NO: 2728987 - RNA, 17 nt, Haemophilus influenzae Rd
uaauaaauauuauuaaa

SEQ ID NO: 2728988 - RNA, 15 nt, Haemophilus influenzae Rd
uaauaaauauugauu

SEQ ID NO: 2728989 - RNA, 16 nt, Haemophilus influenzae Rd
uaauaaaucaaaagaa

SEQ ID NO: 2728990 - RNA, 16 nt, Haemophilus influenzae Rd
uaauaaaucaagcaau

SEQ ID NO: 2728991 - RNA, 14 nt, Haemophilus influenzae Rd
uaauaaauuuuauu

SEQ ID NO: 2728992 - RNA, 21 nt, Haemophilus influenzae Rd
uaauaaauuuuucgccuaauu

SEQ ID NO: 2728993 - RNA, 18 nt, Haemophilus influenzae Rd
uaauaacauagaaaucac

SEQ ID NO: 2728994 - RNA, 19 nt, Haemophilus influenzae Rd
uaauaacauagaaaucacu

SEQ ID NO: 2728995 - RNA, 13 nt, Haemophilus influenzae Rd
uaauaacauuccg

SEQ ID NO: 2728996 - RNA, 14 nt, Haemophilus influenzae Rd
uaauaaccaagaaa

SEQ ID NO: 2728997 - RNA, 14 nt, Haemophilus influenzae Rd
uaauaaccauacaa

SEQ ID NO: 2728998 - RNA, 15 nt, Haemophilus influenzae Rd
uaauaacgcaagcac

SEQ ID NO: 2728999 - RNA, 20 nt, Haemophilus influenzae Rd
uaauaacguguaaauugcuu

SEQ ID NO: 2729000 - RNA, 19 nt, Haemophilus influenzae Rd
uaauaacugaauaauuucc

SEQ ID NO: 2729001 - RNA, 15 nt, Haemophilus influenzae Rd
uaauaagaaaaucaa

SEQ ID NO: 2729002 - RNA, 23 nt, Haemophilus influenzae Rd
uaauaagaaaaucaaagauauuu

SEQ ID NO: 2729003 - RNA, 16 nt, Haemophilus influenzae Rd
uaauaagaauacaaau

SEQ ID NO: 2729004 - RNA, 17 nt, Haemophilus influenzae Rd
uaauaagaauacaaauu

SEQ ID NO: 2729005 - RNA, 16 nt, Haemophilus influenzae Rd
uaauaagauuuuuaac

SEQ ID NO: 2729006 - RNA, 20 nt, Haemophilus influenzae Rd
uaauaagccauuuucugcau

SEQ ID NO: 2729007 - RNA, 19 nt, Haemophilus influenzae Rd
uaauaagcuaaguacaaaa

SEQ ID NO: 2729008 - RNA, 17 nt, Haemophilus influenzae Rd
uaauaagcuaucgucaa

SEQ ID NO: 2729009 - RNA, 22 nt, Haemophilus influenzae Rd
uaauaagugcgguuaauuuuca

SEQ ID NO: 2729010 - RNA, 16 nt, Haemophilus influenzae Rd
uaauaaguuuucauca

SEQ ID NO: 2729011 - RNA, 13 nt, Haemophilus influenzae Rd
uaauaauaaaaag

SEQ ID NO: 2729012 - RNA, 14 nt, Haemophilus influenzae Rd
uaauaaucaaaucu

SEQ ID NO: 2729013 - RNA, 15 nt, Haemophilus influenzae Rd
uaauaaucaaaucuu

SEQ ID NO: 2729014 - RNA, 21 nt, Haemophilus influenzae Rd
uaauaaucaauuaaugggcua

SEQ ID NO: 2729015 - RNA, 19 nt, Haemophilus influenzae Rd
uaauaaucacaauuuuuaa

SEQ ID NO: 2729016 - RNA, 19 nt, Haemophilus influenzae Rd
uaauaauccucuuuaaaau

SEQ ID NO: 2729017 - RNA, 21 nt, Haemophilus influenzae Rd
uaauaauccucuuuaaaauua

SEQ ID NO: 2729018 - RNA, 13 nt, Haemophilus influenzae Rd
uaauaaucgaaaa

SEQ ID NO: 2729019 - RNA, 15 nt, Haemophilus influenzae Rd
uaauaaucgaaaaag

SEQ ID NO: 2729020 - RNA, 23 nt, Haemophilus influenzae Rd
uaauaaucgaaaaaguucuuucu

SEQ ID NO: 2729021 - RNA, 15 nt, Haemophilus influenzae Rd
uaauaaucuaaucca

SEQ ID NO: 2729022 - RNA, 15 nt, Haemophilus influenzae Rd
uaauaaucuuaaaua

SEQ ID NO: 2729023 - RNA, 14 nt, Haemophilus influenzae Rd
uaauaaucuucuuc

SEQ ID NO: 2729024 - RNA, 16 nt, Haemophilus influenzae Rd
uaauaaucuucuuccc

SEQ ID NO: 2729025 - RNA, 17 nt, Haemophilus influenzae Rd
uaauaaucuucuuccca

SEQ ID NO: 2729026 - RNA, 19 nt, Haemophilus influenzae Rd
uaauaaucuucuugaagau

SEQ ID NO: 2729027 - RNA, 21 nt, Haemophilus influenzae Rd
uaauaaugccugcauuaauaa

SEQ ID NO: 2729028 - RNA, 13 nt, Haemophilus influenzae Rd
uaauaauucauua

SEQ ID NO: 2729029 - RNA, 15 nt, Haemophilus influenzae Rd
uaauaauuuaaauuu

SEQ ID NO: 2729030 - RNA, 17 nt, Haemophilus influenzae Rd
uaauaauuuaaauuuau

SEQ ID NO: 2729031 - RNA, 11 nt, Haemophilus influenzae Rd
uaauacaaaau

SEQ ID NO: 2729032 - RNA, 15 nt, Haemophilus influenzae Rd
uaauacaaagcgauu

SEQ ID NO: 2729033 - RNA, 16 nt, Haemophilus influenzae Rd
uaauacacaaaaucca

SEQ ID NO: 2729034 - RNA, 9 nt, Haemophilus influenzae Rd
uaauacacc

SEQ ID NO: 2729035 - RNA, 13 nt, Haemophilus influenzae Rd
uaauacaccaaua

SEQ ID NO: 2729036 - RNA, 22 nt, Haemophilus influenzae Rd
uaauacaccaauaauuaaacag

SEQ ID NO: 2729037 - RNA, 22 nt, Haemophilus influenzae Rd
uaauacacgaggaacuaacgcc

SEQ ID NO: 2729038 - RNA, 23 nt, Haemophilus influenzae Rd
uaauacagaaauaugaaauuucu

SEQ ID NO: 2729039 - RNA, 17 nt, Haemophilus influenzae Rd
uaauacagugcagaaaa

SEQ ID NO: 2729040 - RNA, 14 nt, Haemophilus influenzae Rd
uaauacauuuucau

SEQ ID NO: 2729041 - RNA, 14 nt, Haemophilus influenzae Rd
uaauaccaaaauug

SEQ ID NO: 2729042 - RNA, 15 nt, Haemophilus influenzae Rd
uaauaccaauaauaa

SEQ ID NO: 2729043 - RNA, 16 nt, Haemophilus influenzae Rd
uaauaccaauaauaau

SEQ ID NO: 2729044 - RNA, 20 nt, Haemophilus influenzae Rd
uaauaccauacauaaaaucu

SEQ ID NO: 2729045 - RNA, 16 nt, Haemophilus influenzae Rd
uaauaccgcagcaggu

SEQ ID NO: 2729046 - RNA, 15 nt, Haemophilus influenzae Rd
uaauaccuuuccauu

SEQ ID NO: 2729047 - RNA, 17 nt, Haemophilus influenzae Rd
uaauacgcggucagaaa

SEQ ID NO: 2729048 - RNA, 15 nt, Haemophilus influenzae Rd
uaauacguaaauuca

SEQ ID NO: 2729049 - RNA, 16 nt, Haemophilus influenzae Rd
uaauacguaaauucaa

SEQ ID NO: 2729050 - RNA, 12 nt, Haemophilus influenzae Rd
uaauacgucaau

SEQ ID NO: 2729051 - RNA, 16 nt, Haemophilus influenzae Rd
uaauacgucaauugcu

SEQ ID NO: 2729052 - RNA, 13 nt, Haemophilus influenzae Rd
uaauacguuguug

SEQ ID NO: 2729053 - RNA, 21 nt, Haemophilus influenzae Rd
uaauacguuguuguucuuucc

SEQ ID NO: 2729054 - RNA, 18 nt, Haemophilus influenzae Rd
uaauacugcugaauaaac

SEQ ID NO: 2729055 - RNA, 14 nt, Haemophilus influenzae Rd
uaauacuugaccaa

SEQ ID NO: 2729056 - RNA, 21 nt, Haemophilus influenzae Rd
uaauacuuggugcaauaaaau

SEQ ID NO: 2729057 - RNA, 15 nt, Haemophilus influenzae Rd
uaauacuuucuuuuc

SEQ ID NO: 2729058 - RNA, 20 nt, Haemophilus influenzae Rd
uaauacuuucuuuucaauuu

SEQ ID NO: 2729059 - RNA, 15 nt, Haemophilus influenzae Rd
uaauagaaaacauug

SEQ ID NO: 2729060 - RNA, 13 nt, Haemophilus influenzae Rd
uaauagaaacuaa

SEQ ID NO: 2729061 - RNA, 21 nt, Haemophilus influenzae Rd
uaauagaacuguuauuugcaa

SEQ ID NO: 2729062 - RNA, 19 nt, Haemophilus influenzae Rd
uaauagaauuuugcaagcc

SEQ ID NO: 2729063 - RNA, 15 nt, Haemophilus influenzae Rd
uaauagacugaaaaa

SEQ ID NO: 2729064 - RNA, 14 nt, Haemophilus influenzae Rd
uaauagaguaccaa

SEQ ID NO: 2729065 - RNA, 22 nt, Haemophilus influenzae Rd
uaauagauaagaaguuaucauu

SEQ ID NO: 2729066 - RNA, 20 nt, Haemophilus influenzae Rd
uaauagcuucuuuuaucgac

SEQ ID NO: 2729067 - RNA, 15 nt, Haemophilus influenzae Rd
uaauaggaauaacac

SEQ ID NO: 2729068 - RNA, 23 nt, Haemophilus influenzae Rd
uaauaggcaauguuccaccacuc

SEQ ID NO: 2729069 - RNA, 18 nt, Haemophilus influenzae Rd
uaauagguauaagaguuu

SEQ ID NO: 2729070 - RNA, 17 nt, Haemophilus influenzae Rd
  misc_feature (7)..(7): n is a, c, g or u
uaauagnaaaaauuuag

SEQ ID NO: 2729071 - RNA, 13 nt, Haemophilus influenzae Rd
uaauaguaaacuu

SEQ ID NO: 2729072 - RNA, 23 nt, Haemophilus influenzae Rd
uaauaguugagcuaaagugcggu

SEQ ID NO: 2729073 - RNA, 18 nt, Haemophilus influenzae Rd
uaauauaaaggauuuuau

SEQ ID NO: 2729074 - RNA, 12 nt, Haemophilus influenzae Rd
uaauauaaauua

SEQ ID NO: 2729075 - RNA, 15 nt, Haemophilus influenzae Rd
uaauauaaauuaugu

SEQ ID NO: 2729076 - RNA, 23 nt, Haemophilus influenzae Rd
uaauauaaguuauuuauauaauu

SEQ ID NO: 2729077 - RNA, 15 nt, Haemophilus influenzae Rd
uaauauaauaaauuc

SEQ ID NO: 2729078 - RNA, 16 nt, Haemophilus influenzae Rd
uaauauagcaaacuag

SEQ ID NO: 2729079 - RNA, 19 nt, Haemophilus influenzae Rd
uaauauaggcgaacaaaag

SEQ ID NO: 2729080 - RNA, 16 nt, Haemophilus influenzae Rd
uaauauaugaaaaaua

SEQ ID NO: 2729081 - RNA, 15 nt, Haemophilus influenzae Rd
uaauauauucaauuc

SEQ ID NO: 2729082 - RNA, 17 nt, Haemophilus influenzae Rd
uaauaucaagucaaaaa

SEQ ID NO: 2729083 - RNA, 22 nt, Haemophilus influenzae Rd
uaauaucauggcgaccauucuc

SEQ ID NO: 2729084 - RNA, 23 nt, Haemophilus influenzae Rd
uaauaucgcccgcuuuaaguccu

SEQ ID NO: 2729085 - RNA, 21 nt, Haemophilus influenzae Rd
uaauaugcauucaaauuucaa

SEQ ID NO: 2729086 - RNA, 14 nt, Haemophilus influenzae Rd
uaauauguaauauu

SEQ ID NO: 2729087 - RNA, 15 nt, Haemophilus influenzae Rd
uaauauguaauauuu

SEQ ID NO: 2729088 - RNA, 15 nt, Haemophilus influenzae Rd
uaauauguucuuugu

SEQ ID NO: 2729089 - RNA, 23 nt, Haemophilus influenzae Rd
uaauauguucuuuguugaugauu

SEQ ID NO: 2729090 - RNA, 13 nt, Haemophilus influenzae Rd
uaauauuaaagaa

SEQ ID NO: 2729091 - RNA, 18 nt, Haemophilus influenzae Rd
uaauauuaucgaauagau

SEQ ID NO: 2729092 - RNA, 15 nt, Haemophilus influenzae Rd
uaauauucaaaacau

SEQ ID NO: 2729093 - RNA, 19 nt, Haemophilus influenzae Rd
uaauauuccaaaaaauaag

SEQ ID NO: 2729094 - RNA, 16 nt, Haemophilus influenzae Rd
uaauauugcaccauaa

SEQ ID NO: 2729095 - RNA, 21 nt, Haemophilus influenzae Rd
uaauauugccauaauaaucac

SEQ ID NO: 2729096 - RNA, 12 nt, Haemophilus influenzae Rd
uaauauuuaaaa

SEQ ID NO: 2729097 - RNA, 20 nt, Haemophilus influenzae Rd
uaauauuuaccgcuuucaau

SEQ ID NO: 2729098 - RNA, 11 nt, Haemophilus influenzae Rd
uaauauuucuu

SEQ ID NO: 2729099 - RNA, 21 nt, Haemophilus influenzae Rd
uaauauuucuucauuuuaaau

SEQ ID NO: 2729100 - RNA, 14 nt, Haemophilus influenzae Rd
uaauauuuuugcca

SEQ ID NO: 2729101 - RNA, 12 nt, Haemophilus influenzae Rd
uaaucaaaaaug

SEQ ID NO: 2729102 - RNA, 17 nt, Haemophilus influenzae Rd
uaaucaauuaaagaaau

SEQ ID NO: 2729103 - RNA, 16 nt, Haemophilus influenzae Rd
uaaucacaaagcuuag

SEQ ID NO: 2729104 - RNA, 14 nt, Haemophilus influenzae Rd
uaaucacaaauauu

SEQ ID NO: 2729105 - RNA, 16 nt, Haemophilus influenzae Rd
uaaucacaacaaacca

SEQ ID NO: 2729106 - RNA, 15 nt, Haemophilus influenzae Rd
uaaucacugaauuuc

SEQ ID NO: 2729107 - RNA, 13 nt, Haemophilus influenzae Rd
uaaucacuugaag

SEQ ID NO: 2729108 - RNA, 22 nt, Haemophilus influenzae Rd
uaaucacuugaagucuauaaaa

SEQ ID NO: 2729109 - RNA, 20 nt, Haemophilus influenzae Rd
uaaucacuugugcgauuaac

SEQ ID NO: 2729110 - RNA, 23 nt, Haemophilus influenzae Rd
uaaucagaacaagcauuuuucau

SEQ ID NO: 2729111 - RNA, 14 nt, Haemophilus influenzae Rd
uaaucaggcugugc

SEQ ID NO: 2729112 - RNA, 14 nt, Haemophilus influenzae Rd
uaaucauaaaaaaa

SEQ ID NO: 2729113 - RNA, 17 nt, Haemophilus influenzae Rd
uaaucauaaaaaaaucu

SEQ ID NO: 2729114 - RNA, 16 nt, Haemophilus influenzae Rd
uaaucauaucuaacau

SEQ ID NO: 2729115 - RNA, 13 nt, Haemophilus influenzae Rd
uaaucauugaaau

SEQ ID NO: 2729116 - RNA, 17 nt, Haemophilus influenzae Rd
uaaucauugcaagugca

SEQ ID NO: 2729117 - RNA, 20 nt, Haemophilus influenzae Rd
uaaucauuuuuuaacuugau

SEQ ID NO: 2729118 - RNA, 19 nt, Haemophilus influenzae Rd
uaauccaaacuaaaugcuc

SEQ ID NO: 2729119 - RNA, 13 nt, Haemophilus influenzae Rd
uaauccaaaucaa

SEQ ID NO: 2729120 - RNA, 18 nt, Haemophilus influenzae Rd
uaauccaaggaauuggau

SEQ ID NO: 2729121 - RNA, 14 nt, Haemophilus influenzae Rd
uaauccaagugcau

SEQ ID NO: 2729122 - RNA, 13 nt, Haemophilus influenzae Rd
uaauccaauccau

SEQ ID NO: 2729123 - RNA, 16 nt, Haemophilus influenzae Rd
uaauccacaauucuua

SEQ ID NO: 2729124 - RNA, 14 nt, Haemophilus influenzae Rd
uaauccagcuacau

SEQ ID NO: 2729125 - RNA, 13 nt, Haemophilus influenzae Rd
uaauccagucauu

SEQ ID NO: 2729126 - RNA, 18 nt, Haemophilus influenzae Rd
uaauccagucauugggcg

SEQ ID NO: 2729127 - RNA, 18 nt, Haemophilus influenzae Rd
uaauccaucgcaagauaa

SEQ ID NO: 2729128 - RNA, 23 nt, Haemophilus influenzae Rd
uaauccauuuugaacaagguuuc

SEQ ID NO: 2729129 - RNA, 19 nt, Haemophilus influenzae Rd
uaauccguuaaauuuagau

SEQ ID NO: 2729130 - RNA, 15 nt, Haemophilus influenzae Rd
uaauccuaaaaugcu

SEQ ID NO: 2729131 - RNA, 14 nt, Haemophilus influenzae Rd
uaauccuaaauuau

SEQ ID NO: 2729132 - RNA, 22 nt, Haemophilus influenzae Rd
uaauccuacuuguacaagugcu

SEQ ID NO: 2729133 - RNA, 15 nt, Haemophilus influenzae Rd
uaauccuaguuuuuu

SEQ ID NO: 2729134 - RNA, 17 nt, Haemophilus influenzae Rd
uaauccuaguuuuuucc

SEQ ID NO: 2729135 - RNA, 13 nt, Haemophilus influenzae Rd
uaauccuuuuguu

SEQ ID NO: 2729136 - RNA, 19 nt, Haemophilus influenzae Rd
uaaucgaucuauauucguu

SEQ ID NO: 2729137 - RNA, 20 nt, Haemophilus influenzae Rd
uaaucgaucuuuuuuuuguu

SEQ ID NO: 2729138 - RNA, 19 nt, Haemophilus influenzae Rd
uaaucgccaaaaucaucac

SEQ ID NO: 2729139 - RNA, 20 nt, Haemophilus influenzae Rd
uaaucgccaaaaucaucaca

SEQ ID NO: 2729140 - RNA, 17 nt, Haemophilus influenzae Rd
uaaucgcccuauuaaaa

SEQ ID NO: 2729141 - RNA, 20 nt, Haemophilus influenzae Rd
uaaucgcucugcaagacuau

SEQ ID NO: 2729142 - RNA, 17 nt, Haemophilus influenzae Rd
uaaucggcaauguuuua

SEQ ID NO: 2729143 - RNA, 16 nt, Haemophilus influenzae Rd
uaaucguagaaaucaa

SEQ ID NO: 2729144 - RNA, 23 nt, Haemophilus influenzae Rd
uaaucguagaaaucaaaaaugcu

SEQ ID NO: 2729145 - RNA, 15 nt, Haemophilus influenzae Rd
uaaucguccaaagaa

SEQ ID NO: 2729146 - RNA, 18 nt, Haemophilus influenzae Rd
uaaucguuaccaagaaac

SEQ ID NO: 2729147 - RNA, 22 nt, Haemophilus influenzae Rd
uaaucguugccccaucauuuua

SEQ ID NO: 2729148 - RNA, 12 nt, Haemophilus influenzae Rd
uaaucuaauucu

SEQ ID NO: 2729149 - RNA, 14 nt, Haemophilus influenzae Rd
uaaucuacaaaaca

SEQ ID NO: 2729150 - RNA, 14 nt, Haemophilus influenzae Rd
uaaucuauuucuuu

SEQ ID NO: 2729151 - RNA, 16 nt, Haemophilus influenzae Rd
uaaucuauuucuuuga

SEQ ID NO: 2729152 - RNA, 22 nt, Haemophilus influenzae Rd
uaaucuauuucuuugaguaaaa

SEQ ID NO: 2729153 - RNA, 16 nt, Haemophilus influenzae Rd
uaaucugaauuuccau

SEQ ID NO: 2729154 - RNA, 16 nt, Haemophilus influenzae Rd
uaaucugauaaauuuu

SEQ ID NO: 2729155 - RNA, 15 nt, Haemophilus influenzae Rd
uaaucugauuauucu

SEQ ID NO: 2729156 - RNA, 18 nt, Haemophilus influenzae Rd
uaaucugauugagaaaau

SEQ ID NO: 2729157 - RNA, 21 nt, Haemophilus influenzae Rd
uaaucuggcaagccaaguugu

SEQ ID NO: 2729158 - RNA, 20 nt, Haemophilus influenzae Rd
uaaucuggugcuuguuuuaa

SEQ ID NO: 2729159 - RNA, 21 nt, Haemophilus influenzae Rd
uaaucugucacgagcuaaaaa

SEQ ID NO: 2729160 - RNA, 22 nt, Haemophilus influenzae Rd
uaaucugucacgagcuaaaaaa

SEQ ID NO: 2729161 - RNA, 20 nt, Haemophilus influenzae Rd
uaaucuuaaagaauuucuuu

SEQ ID NO: 2729162 - RNA, 14 nt, Haemophilus influenzae Rd
uaaucuuaaauaau

SEQ ID NO: 2729163 - RNA, 15 nt, Haemophilus influenzae Rd
uaaucuucauacuua

SEQ ID NO: 2729164 - RNA, 14 nt, Haemophilus influenzae Rd
uaaucuucccauuu

SEQ ID NO: 2729165 - RNA, 15 nt, Haemophilus influenzae Rd
uaaucuugugcugug

SEQ ID NO: 2729166 - RNA, 13 nt, Haemophilus influenzae Rd
uaaucuuuaaaau

SEQ ID NO: 2729167 - RNA, 18 nt, Haemophilus influenzae Rd
uaaucuuuaaauuuugcu

SEQ ID NO: 2729168 - RNA, 20 nt, Haemophilus influenzae Rd
uaaucuuucacugcauuuuc

SEQ ID NO: 2729169 - RNA, 23 nt, Haemophilus influenzae Rd
uaaucuuuuacaccguccaaggu

SEQ ID NO: 2729170 - RNA, 14 nt, Haemophilus influenzae Rd
uaaucuuuuuucuu

SEQ ID NO: 2729171 - RNA, 12 nt, Haemophilus influenzae Rd
uaaugaaaacag

SEQ ID NO: 2729172 - RNA, 16 nt, Haemophilus influenzae Rd
uaaugaaccaaaucua

SEQ ID NO: 2729173 - RNA, 21 nt, Haemophilus influenzae Rd
uaaugaaccaaaucuaacauu

SEQ ID NO: 2729174 - RNA, 13 nt, Haemophilus influenzae Rd
uaaugaacgaacu

SEQ ID NO: 2729175 - RNA, 21 nt, Haemophilus influenzae Rd
uaaugaacgaacuaaaauggu

SEQ ID NO: 2729176 - RNA, 16 nt, Haemophilus influenzae Rd
uaaugacauuaaagca

SEQ ID NO: 2729177 - RNA, 22 nt, Haemophilus influenzae Rd
uaaugagcacgccuaauaccaa

SEQ ID NO: 2729178 - RNA, 20 nt, Haemophilus influenzae Rd
uaaugauaaguuuugucuga

SEQ ID NO: 2729179 - RNA, 15 nt, Haemophilus influenzae Rd
uaaugauaaucuaaa

SEQ ID NO: 2729180 - RNA, 20 nt, Haemophilus influenzae Rd
uaaugauaaucuaaaaaacc

SEQ ID NO: 2729181 - RNA, 19 nt, Haemophilus influenzae Rd
uaaugaugaaugcuuuuau

SEQ ID NO: 2729182 - RNA, 17 nt, Haemophilus influenzae Rd
uaaugcaaccaaacaaa

SEQ ID NO: 2729183 - RNA, 13 nt, Haemophilus influenzae Rd
uaaugcaauuuca

SEQ ID NO: 2729184 - RNA, 14 nt, Haemophilus influenzae Rd
uaaugcaauuucaa

SEQ ID NO: 2729185 - RNA, 23 nt, Haemophilus influenzae Rd
uaaugcagaccaacguaaaaucg

SEQ ID NO: 2729186 - RNA, 20 nt, Haemophilus influenzae Rd
uaaugcagcagcuucuucuu

SEQ ID NO: 2729187 - RNA, 24 nt, Haemophilus influenzae Rd
uaaugcagcagcuucuucuuccug

SEQ ID NO: 2729188 - RNA, 19 nt, Haemophilus influenzae Rd
uaaugcauugauugcuaaa

SEQ ID NO: 2729189 - RNA, 15 nt, Haemophilus influenzae Rd
uaaugccaagaaagu

SEQ ID NO: 2729190 - RNA, 23 nt, Haemophilus influenzae Rd
uaaugccauuggacacaauaaua

SEQ ID NO: 2729191 - RNA, 23 nt, Haemophilus influenzae Rd
uaaugccucgauauuuauaagua

SEQ ID NO: 2729192 - RNA, 17 nt, Haemophilus influenzae Rd
uaaugccugcauuaaua

SEQ ID NO: 2729193 - RNA, 14 nt, Haemophilus influenzae Rd
uaaugcuaaaccaa

SEQ ID NO: 2729194 - RNA, 18 nt, Haemophilus influenzae Rd
uaaugcuaaaccaauuuc

SEQ ID NO: 2729195 - RNA, 14 nt, Haemophilus influenzae Rd
uaaugcuaauuuca

SEQ ID NO: 2729196 - RNA, 18 nt, Haemophilus influenzae Rd
uaaugcugaguaccaaaa

SEQ ID NO: 2729197 - RNA, 22 nt, Haemophilus influenzae Rd
uaaugcugaguaccaaaaggug

SEQ ID NO: 2729198 - RNA, 16 nt, Haemophilus influenzae Rd
uaaugcuucuaauccc

SEQ ID NO: 2729199 - RNA, 20 nt, Haemophilus influenzae Rd
uaaugcuuuaaauuguuuaa

SEQ ID NO: 2729200 - RNA, 22 nt, Haemophilus influenzae Rd
uaaugcuuuaaauuguuuaaug

SEQ ID NO: 2729201 - RNA, 13 nt, Haemophilus influenzae Rd
uaaugcuuuaauu

SEQ ID NO: 2729202 - RNA, 21 nt, Haemophilus influenzae Rd
uaaugcuuuauuuaaauuaaa

SEQ ID NO: 2729203 - RNA, 15 nt, Haemophilus influenzae Rd
uaauggaauauggcg

SEQ ID NO: 2729204 - RNA, 16 nt, Haemophilus influenzae Rd
uaauggacggaaugaa

SEQ ID NO: 2729205 - RNA, 22 nt, Haemophilus influenzae Rd
uaauggagguuuuacauauaaa

SEQ ID NO: 2729206 - RNA, 19 nt, Haemophilus influenzae Rd
uaauggauauagaaaucau

SEQ ID NO: 2729207 - RNA, 17 nt, Haemophilus influenzae Rd
uaauggcgauaauuauu

SEQ ID NO: 2729208 - RNA, 22 nt, Haemophilus influenzae Rd
uaauggguaaucaauauuuauu

SEQ ID NO: 2729209 - RNA, 23 nt, Haemophilus influenzae Rd
uaaugguuacagaaauauuauua

SEQ ID NO: 2729210 - RNA, 22 nt, Haemophilus influenzae Rd
uaaugguugcauuugcucaaua

SEQ ID NO: 2729211 - RNA, 20 nt, Haemophilus influenzae Rd
uaaugguuggaagaaaagca

SEQ ID NO: 2729212 - RNA, 20 nt, Haemophilus influenzae Rd
uaaugguuguaaauuuucaa

SEQ ID NO: 2729213 - RNA, 14 nt, Haemophilus influenzae Rd
uaauguaaacaaaa

SEQ ID NO: 2729214 - RNA, 15 nt, Haemophilus influenzae Rd
uaauguaauaaaaaa

SEQ ID NO: 2729215 - RNA, 19 nt, Haemophilus influenzae Rd
uaauguagagcucaauuau

SEQ ID NO: 2729216 - RNA, 21 nt, Haemophilus influenzae Rd
uaauguagagcucaauuauuu

SEQ ID NO: 2729217 - RNA, 22 nt, Haemophilus influenzae Rd
uaauguccacuuuuggaaacua

SEQ ID NO: 2729218 - RNA, 22 nt, Haemophilus influenzae Rd
uaaugucuuuaggauuguugau

SEQ ID NO: 2729219 - RNA, 14 nt, Haemophilus influenzae Rd
uaauguguucuguu

SEQ ID NO: 2729220 - RNA, 17 nt, Haemophilus influenzae Rd
uaauguuaauuuuaaau

SEQ ID NO: 2729221 - RNA, 14 nt, Haemophilus influenzae Rd
uaauguuuaaagua

SEQ ID NO: 2729222 - RNA, 19 nt, Haemophilus influenzae Rd
uaauguuuaaaguaagaau

SEQ ID NO: 2729223 - RNA, 14 nt, Haemophilus influenzae Rd
uaauguuuaagcca

SEQ ID NO: 2729224 - RNA, 12 nt, Haemophilus influenzae Rd
uaauguuucaua

SEQ ID NO: 2729225 - RNA, 22 nt, Haemophilus influenzae Rd
uaauguuuguuccacuucauaa

SEQ ID NO: 2729226 - RNA, 17 nt, Haemophilus influenzae Rd
uaauguuuucauuaauu

SEQ ID NO: 2729227 - RNA, 20 nt, Haemophilus influenzae Rd
uaauguuuucauuaauuuca

SEQ ID NO: 2729228 - RNA, 12 nt, Haemophilus influenzae Rd
uaauguuuucuu

SEQ ID NO: 2729229 - RNA, 13 nt, Haemophilus influenzae Rd
uaauuaaaaauaa

SEQ ID NO: 2729230 - RNA, 15 nt, Haemophilus influenzae Rd
uaauuaaaaauaacc

SEQ ID NO: 2729231 - RNA, 18 nt, Haemophilus influenzae Rd
uaauuaaaaauaaccgcc

SEQ ID NO: 2729232 - RNA, 12 nt, Haemophilus influenzae Rd
uaauuaaaagga

SEQ ID NO: 2729233 - RNA, 13 nt, Haemophilus influenzae Rd
uaauuaaacauuu

SEQ ID NO: 2729234 - RNA, 19 nt, Haemophilus influenzae Rd
uaauuaaacuuucaauuuu

SEQ ID NO: 2729235 - RNA, 22 nt, Haemophilus influenzae Rd
uaauuaaacuuucaauuuuucc

SEQ ID NO: 2729236 - RNA, 18 nt, Haemophilus influenzae Rd
uaauuaaagccacauaau

SEQ ID NO: 2729237 - RNA, 14 nt, Haemophilus influenzae Rd
uaauuaaagucaga

SEQ ID NO: 2729238 - RNA, 15 nt, Haemophilus influenzae Rd
uaauuaaagucagau

SEQ ID NO: 2729239 - RNA, 16 nt, Haemophilus influenzae Rd
uaauuaaauaaacauu

SEQ ID NO: 2729240 - RNA, 22 nt, Haemophilus influenzae Rd
uaauuaaauaaacauuaugaaa

SEQ ID NO: 2729241 - RNA, 19 nt, Haemophilus influenzae Rd
uaauuaaauucauuuaaaa

SEQ ID NO: 2729242 - RNA, 12 nt, Haemophilus influenzae Rd
uaauuaacaaau

SEQ ID NO: 2729243 - RNA, 18 nt, Haemophilus influenzae Rd
uaauuaacgcucaaaaau

SEQ ID NO: 2729244 - RNA, 23 nt, Haemophilus influenzae Rd
uaauuaacgcucaaaaauuucag

SEQ ID NO: 2729245 - RNA, 19 nt, Haemophilus influenzae Rd
uaauuaacgugcauuuuua

SEQ ID NO: 2729246 - RNA, 23 nt, Haemophilus influenzae Rd
uaauuaagagaggagaaauaauc

SEQ ID NO: 2729247 - RNA, 23 nt, Haemophilus influenzae Rd
uaauuaaguuugagcaaaucaaa

SEQ ID NO: 2729248 - RNA, 14 nt, Haemophilus influenzae Rd
uaauuaauaaaaaa

SEQ ID NO: 2729249 - RNA, 15 nt, Haemophilus influenzae Rd
uaauuaauauuagau

SEQ ID NO: 2729250 - RNA, 18 nt, Haemophilus influenzae Rd
uaauuaccugugaaaaca

SEQ ID NO: 2729251 - RNA, 17 nt, Haemophilus influenzae Rd
uaauuacgccuaaccaa

SEQ ID NO: 2729252 - RNA, 20 nt, Haemophilus influenzae Rd
uaauuacgccugcccaaguu

SEQ ID NO: 2729253 - RNA, 17 nt, Haemophilus influenzae Rd
uaauuacucacuauaac

SEQ ID NO: 2729254 - RNA, 21 nt, Haemophilus influenzae Rd
uaauuacugucgaaccaaguu

SEQ ID NO: 2729255 - RNA, 13 nt, Haemophilus influenzae Rd
uaauuagaauaac

SEQ ID NO: 2729256 - RNA, 14 nt, Haemophilus influenzae Rd
uaauuagaauaaca

SEQ ID NO: 2729257 - RNA, 22 nt, Haemophilus influenzae Rd
uaauuagaauaacaacaaaagu

SEQ ID NO: 2729258 - RNA, 19 nt, Haemophilus influenzae Rd
uaauuagauaauacagaaa

SEQ ID NO: 2729259 - RNA, 20 nt, Haemophilus influenzae Rd
uaauuagauaauacagaaau

SEQ ID NO: 2729260 - RNA, 22 nt, Haemophilus influenzae Rd
uaauuagguucgcuauguuuaa

SEQ ID NO: 2729261 - RNA, 18 nt, Haemophilus influenzae Rd
uaauuaguuauacuuaau

SEQ ID NO: 2729262 - RNA, 13 nt, Haemophilus influenzae Rd
uaauuauaaaaua

SEQ ID NO: 2729263 - RNA, 19 nt, Haemophilus influenzae Rd
uaauuaucaaaaagaaaua

SEQ ID NO: 2729264 - RNA, 18 nt, Haemophilus influenzae Rd
uaauuaucaacaucaacu

SEQ ID NO: 2729265 - RNA, 22 nt, Haemophilus influenzae Rd
uaauuauggugaauaaaaccgc

SEQ ID NO: 2729266 - RNA, 15 nt, Haemophilus influenzae Rd
uaauuauuuaaaucu

SEQ ID NO: 2729267 - RNA, 13 nt, Haemophilus influenzae Rd
uaauuauuuuaga

SEQ ID NO: 2729268 - RNA, 15 nt, Haemophilus influenzae Rd
uaauuauuuuuagcu

SEQ ID NO: 2729269 - RNA, 15 nt, Haemophilus influenzae Rd
uaauucaaacaggcu

SEQ ID NO: 2729270 - RNA, 18 nt, Haemophilus influenzae Rd
uaauucaagaugauauuu

SEQ ID NO: 2729271 - RNA, 23 nt, Haemophilus influenzae Rd
uaauucaauaucugcacguaaag

SEQ ID NO: 2729272 - RNA, 22 nt, Haemophilus influenzae Rd
uaauucacgaauguuuucgauc

SEQ ID NO: 2729273 - RNA, 20 nt, Haemophilus influenzae Rd
uaauucacgcauuuaaauaa

SEQ ID NO: 2729274 - RNA, 14 nt, Haemophilus influenzae Rd
uaauucagcaagaa

SEQ ID NO: 2729275 - RNA, 21 nt, Haemophilus influenzae Rd
uaauucagcgagagaauauuu

SEQ ID NO: 2729276 - RNA, 22 nt, Haemophilus influenzae Rd
uaauucagcgagagaauauuua

SEQ ID NO: 2729277 - RNA, 13 nt, Haemophilus influenzae Rd
uaauucagcggca

SEQ ID NO: 2729278 - RNA, 21 nt, Haemophilus influenzae Rd
uaauucagcggcauuugcauc

SEQ ID NO: 2729279 - RNA, 20 nt, Haemophilus influenzae Rd
uaauucagcggcuuucuuca

SEQ ID NO: 2729280 - RNA, 20 nt, Haemophilus influenzae Rd
uaauucagggauuaagaaaa

SEQ ID NO: 2729281 - RNA, 21 nt, Haemophilus influenzae Rd
uaauucagggauuaagaaaau

SEQ ID NO: 2729282 - RNA, 18 nt, Haemophilus influenzae Rd
uaauucaggugggaaaua

SEQ ID NO: 2729283 - RNA, 19 nt, Haemophilus influenzae Rd
uaauucaggugggaaauaa

SEQ ID NO: 2729284 - RNA, 23 nt, Haemophilus influenzae Rd
uaauucaguguaauguuuuaaua

SEQ ID NO: 2729285 - RNA, 17 nt, Haemophilus influenzae Rd
uaauucaguucaauuua

SEQ ID NO: 2729286 - RNA, 15 nt, Haemophilus influenzae Rd
uaauucaucaaaauu

SEQ ID NO: 2729287 - RNA, 19 nt, Haemophilus influenzae Rd
uaauucauuacauaauacu

SEQ ID NO: 2729288 - RNA, 15 nt, Haemophilus influenzae Rd
uaauucauuagccaa

SEQ ID NO: 2729289 - RNA, 19 nt, Haemophilus influenzae Rd
uaauucauugaguuuaguc

SEQ ID NO: 2729290 - RNA, 20 nt, Haemophilus influenzae Rd
uaauucauugaugcccacuu

SEQ ID NO: 2729291 - RNA, 14 nt, Haemophilus influenzae Rd
uaauuccaccgcac

SEQ ID NO: 2729292 - RNA, 14 nt, Haemophilus influenzae Rd
uaauuccccuucaa

SEQ ID NO: 2729293 - RNA, 18 nt, Haemophilus influenzae Rd
uaauuccccuucaaauau

SEQ ID NO: 2729294 - RNA, 13 nt, Haemophilus influenzae Rd
uaauuccgcaccu

SEQ ID NO: 2729295 - RNA, 14 nt, Haemophilus influenzae Rd
uaauuccuaaaaua

SEQ ID NO: 2729296 - RNA, 18 nt, Haemophilus influenzae Rd
uaauuccuuuuucuacuu

SEQ ID NO: 2729297 - RNA, 15 nt, Haemophilus influenzae Rd
uaauucgcaaauccu

SEQ ID NO: 2729298 - RNA, 16 nt, Haemophilus influenzae Rd
uaauucgugcaaauuu

SEQ ID NO: 2729299 - RNA, 23 nt, Haemophilus influenzae Rd
uaauucgugccacaugauaaaaa

SEQ ID NO: 2729300 - RNA, 20 nt, Haemophilus influenzae Rd
uaauucguuaauaaauccau

SEQ ID NO: 2729301 - RNA, 14 nt, Haemophilus influenzae Rd
uaauucuacaccag

SEQ ID NO: 2729302 - RNA, 15 nt, Haemophilus influenzae Rd
uaauucugcccuuuu

SEQ ID NO: 2729303 - RNA, 14 nt, Haemophilus influenzae Rd
uaauucugguaaua

SEQ ID NO: 2729304 - RNA, 12 nt, Haemophilus influenzae Rd
uaauucuuccaa

SEQ ID NO: 2729305 - RNA, 19 nt, Haemophilus influenzae Rd
uaauucuucgaugcuuuuu

SEQ ID NO: 2729306 - RNA, 22 nt, Haemophilus influenzae Rd
uaauucuucgaugcuuuuucau

SEQ ID NO: 2729307 - RNA, 14 nt, Haemophilus influenzae Rd
uaauucuugccaga

SEQ ID NO: 2729308 - RNA, 12 nt, Haemophilus influenzae Rd
uaauucuuuuug

SEQ ID NO: 2729309 - RNA, 22 nt, Haemophilus influenzae Rd
uaauugaagcaauugaaacuaa

SEQ ID NO: 2729310 - RNA, 17 nt, Haemophilus influenzae Rd
uaauugaauuguguaag

SEQ ID NO: 2729311 - RNA, 19 nt, Haemophilus influenzae Rd
uaauugacaauuaauauaa

SEQ ID NO: 2729312 - RNA, 15 nt, Haemophilus influenzae Rd
uaauugaguguggug

SEQ ID NO: 2729313 - RNA, 14 nt, Haemophilus influenzae Rd
uaauugaugcuaaa

SEQ ID NO: 2729314 - RNA, 19 nt, Haemophilus influenzae Rd
uaauugauggcgugaaaua

SEQ ID NO: 2729315 - RNA, 12 nt, Haemophilus influenzae Rd
uaauugauuaaa

SEQ ID NO: 2729316 - RNA, 20 nt, Haemophilus influenzae Rd
uaauugauucgauaaauuag

SEQ ID NO: 2729317 - RNA, 16 nt, Haemophilus influenzae Rd
uaauugauuuaaaaau

SEQ ID NO: 2729318 - RNA, 17 nt, Haemophilus influenzae Rd
uaauugauuuaaaaauc

SEQ ID NO: 2729319 - RNA, 15 nt, Haemophilus influenzae Rd
uaauugauuuuaaag

SEQ ID NO: 2729320 - RNA, 20 nt, Haemophilus influenzae Rd
uaauugcaauguauucuguu

SEQ ID NO: 2729321 - RNA, 15 nt, Haemophilus influenzae Rd
uaauuggaaaaguaa

SEQ ID NO: 2729322 - RNA, 18 nt, Haemophilus influenzae Rd
uaauuggaaaaguaagaa

SEQ ID NO: 2729323 - RNA, 18 nt, Haemophilus influenzae Rd
uaauuggaaauaauauuc

SEQ ID NO: 2729324 - RNA, 20 nt, Haemophilus influenzae Rd
uaauuggaaauaauauucaa

SEQ ID NO: 2729325 - RNA, 14 nt, Haemophilus influenzae Rd
uaauuggacaagaa

SEQ ID NO: 2729326 - RNA, 21 nt, Haemophilus influenzae Rd
uaauuggacaagaaauaauaa

SEQ ID NO: 2729327 - RNA, 18 nt, Haemophilus influenzae Rd
uaauuggcaauaauguug

SEQ ID NO: 2729328 - RNA, 19 nt, Haemophilus influenzae Rd
uaauuggcgaaggcaaauc

SEQ ID NO: 2729329 - RNA, 16 nt, Haemophilus influenzae Rd
uaauugguaaaauuaa

SEQ ID NO: 2729330 - RNA, 15 nt, Haemophilus influenzae Rd
uaauugugauaaaug

SEQ ID NO: 2729331 - RNA, 17 nt, Haemophilus influenzae Rd
uaauugugauaaaugug

SEQ ID NO: 2729332 - RNA, 16 nt, Haemophilus influenzae Rd
uaauugugcuaaauaa

SEQ ID NO: 2729333 - RNA, 20 nt, Haemophilus influenzae Rd
uaauugugggaaaguuggcc

SEQ ID NO: 2729334 - RNA, 17 nt, Haemophilus influenzae Rd
uaauuuaaaaaaucacc

SEQ ID NO: 2729335 - RNA, 21 nt, Haemophilus influenzae Rd
uaauuuaaaaaaucaccgcac

SEQ ID NO: 2729336 - RNA, 23 nt, Haemophilus influenzae Rd
uaauuuaaaaaaucaccgcacuu

SEQ ID NO: 2729337 - RNA, 12 nt, Haemophilus influenzae Rd
uaauuuaaaaag

SEQ ID NO: 2729338 - RNA, 18 nt, Haemophilus influenzae Rd
uaauuuaaaaaguaguau

SEQ ID NO: 2729339 - RNA, 18 nt, Haemophilus influenzae Rd
uaauuuaaauaaagcauu

SEQ ID NO: 2729340 - RNA, 12 nt, Haemophilus influenzae Rd
uaauuuaaauuu

SEQ ID NO: 2729341 - RNA, 22 nt, Haemophilus influenzae Rd
uaauuuaacauaacuuuccaua

SEQ ID NO: 2729342 - RNA, 15 nt, Haemophilus influenzae Rd
uaauuuaauucuaaa

SEQ ID NO: 2729343 - RNA, 18 nt, Haemophilus influenzae Rd
uaauuuacuggaaauucu

SEQ ID NO: 2729344 - RNA, 20 nt, Haemophilus influenzae Rd
uaauuuagaaaaagaaaacc

SEQ ID NO: 2729345 - RNA, 23 nt, Haemophilus influenzae Rd
uaauuuagaaaaagaaaaccugc

SEQ ID NO: 2729346 - RNA, 17 nt, Haemophilus influenzae Rd
uaauuuagauaaaaauu

SEQ ID NO: 2729347 - RNA, 12 nt, Haemophilus influenzae Rd
uaauuuauacua

SEQ ID NO: 2729348 - RNA, 22 nt, Haemophilus influenzae Rd
uaauuuaucaucuaguuuuaau

SEQ ID NO: 2729349 - RNA, 15 nt, Haemophilus influenzae Rd
uaauuuauuaaaaau

SEQ ID NO: 2729350 - RNA, 12 nt, Haemophilus influenzae Rd
uaauuuauucaa

SEQ ID NO: 2729351 - RNA, 13 nt, Haemophilus influenzae Rd
uaauuucaaaauc

SEQ ID NO: 2729352 - RNA, 16 nt, Haemophilus influenzae Rd
uaauuucaaaaucaca

SEQ ID NO: 2729353 - RNA, 23 nt, Haemophilus influenzae Rd
uaauuucaaaaucacaucgccaa

SEQ ID NO: 2729354 - RNA, 15 nt, Haemophilus influenzae Rd
uaauuucaaaucuuc

SEQ ID NO: 2729355 - RNA, 14 nt, Haemophilus influenzae Rd
uaauuucaauauaa

SEQ ID NO: 2729356 - RNA, 17 nt, Haemophilus influenzae Rd
uaauuucacauuaugau

SEQ ID NO: 2729357 - RNA, 21 nt, Haemophilus influenzae Rd
  misc_feature (9)..(9): n is a, c, g or u
uaauuucanagagguuuccuu

SEQ ID NO: 2729358 - RNA, 22 nt, Haemophilus influenzae Rd
uaauuucaucccagauuuuacu

SEQ ID NO: 2729359 - RNA, 15 nt, Haemophilus influenzae Rd
uaauuucaucgcguu

SEQ ID NO: 2729360 - RNA, 21 nt, Haemophilus influenzae Rd
uaauuucauucaacaauucau

SEQ ID NO: 2729361 - RNA, 13 nt, Haemophilus influenzae Rd
uaauuucauuuua

SEQ ID NO: 2729362 - RNA, 16 nt, Haemophilus influenzae Rd
uaauuucccuaaaauc

SEQ ID NO: 2729363 - RNA, 18 nt, Haemophilus influenzae Rd
uaauuucccuaaaaucuu

SEQ ID NO: 2729364 - RNA, 19 nt, Haemophilus influenzae Rd
uaauuucccuaaaaucuuc

SEQ ID NO: 2729365 - RNA, 16 nt, Haemophilus influenzae Rd
uaauuucgaucucaga

SEQ ID NO: 2729366 - RNA, 14 nt, Haemophilus influenzae Rd
uaauuucguagaga

SEQ ID NO: 2729367 - RNA, 21 nt, Haemophilus influenzae Rd
uaauuucucaccaaauuguuc

SEQ ID NO: 2729368 - RNA, 21 nt, Haemophilus influenzae Rd
uaauuucucagcuuucuaacg

SEQ ID NO: 2729369 - RNA, 18 nt, Haemophilus influenzae Rd
uaauuucugcgauauauu

SEQ ID NO: 2729370 - RNA, 17 nt, Haemophilus influenzae Rd
uaauuucuuuuccuugc

SEQ ID NO: 2729371 - RNA, 20 nt, Haemophilus influenzae Rd
uaauuugaccuucauaaacu

SEQ ID NO: 2729372 - RNA, 19 nt, Haemophilus influenzae Rd
uaauuugacgauaauauuu

SEQ ID NO: 2729373 - RNA, 16 nt, Haemophilus influenzae Rd
uaauuugaugcucaga

SEQ ID NO: 2729374 - RNA, 14 nt, Haemophilus influenzae Rd
uaauuugcacacuu

SEQ ID NO: 2729375 - RNA, 16 nt, Haemophilus influenzae Rd
uaauuugcacacuuaa

SEQ ID NO: 2729376 - RNA, 18 nt, Haemophilus influenzae Rd
uaauuugcacacuuaaac

SEQ ID NO: 2729377 - RNA, 19 nt, Haemophilus influenzae Rd
uaauuugcacacuuaaacu

SEQ ID NO: 2729378 - RNA, 14 nt, Haemophilus influenzae Rd
uaauuugcaucauu

SEQ ID NO: 2729379 - RNA, 16 nt, Haemophilus influenzae Rd
uaauuugccaucacga

SEQ ID NO: 2729380 - RNA, 19 nt, Haemophilus influenzae Rd
uaauuugccaucacucaau

SEQ ID NO: 2729381 - RNA, 12 nt, Haemophilus influenzae Rd
uaauuugcccca

SEQ ID NO: 2729382 - RNA, 14 nt, Haemophilus influenzae Rd
uaauuugugcggau

SEQ ID NO: 2729383 - RNA, 15 nt, Haemophilus influenzae Rd
uaauuuguuuuucga

SEQ ID NO: 2729384 - RNA, 16 nt, Haemophilus influenzae Rd
uaauuuguuuuucgau

SEQ ID NO: 2729385 - RNA, 11 nt, Haemophilus influenzae Rd
uaauuuuaaaa

SEQ ID NO: 2729386 - RNA, 12 nt, Haemophilus influenzae Rd
uaauuuuaaaac

SEQ ID NO: 2729387 - RNA, 11 nt, Haemophilus influenzae Rd
uaauuuuaauu

SEQ ID NO: 2729388 - RNA, 12 nt, Haemophilus influenzae Rd
uaauuuuaauuc

SEQ ID NO: 2729389 - RNA, 17 nt, Haemophilus influenzae Rd
uaauuuuaccaagaaau

SEQ ID NO: 2729390 - RNA, 18 nt, Haemophilus influenzae Rd
uaauuuuaccaagaaaua

SEQ ID NO: 2729391 - RNA, 21 nt, Haemophilus influenzae Rd
uaauuuuacguaguacaucau

SEQ ID NO: 2729392 - RNA, 22 nt, Haemophilus influenzae Rd
uaauuuuacguaguacaucauu

SEQ ID NO: 2729393 - RNA, 17 nt, Haemophilus influenzae Rd
uaauuuuaguauucuuu

SEQ ID NO: 2729394 - RNA, 14 nt, Haemophilus influenzae Rd
uaauuuuauagcuu

SEQ ID NO: 2729395 - RNA, 23 nt, Haemophilus influenzae Rd
uaauuuuauagcuuuaguuuuag

SEQ ID NO: 2729396 - RNA, 22 nt, Haemophilus influenzae Rd
uaauuuuauuuuuugcggacgc

SEQ ID NO: 2729397 - RNA, 17 nt, Haemophilus influenzae Rd
uaauuuucaauagccaa

SEQ ID NO: 2729398 - RNA, 14 nt, Haemophilus influenzae Rd
uaauuuucacauaa

SEQ ID NO: 2729399 - RNA, 22 nt, Haemophilus influenzae Rd
uaauuuucagugauuccaacaa

SEQ ID NO: 2729400 - RNA, 18 nt, Haemophilus influenzae Rd
uaauuuugaagucuuaau

SEQ ID NO: 2729401 - RNA, 22 nt, Haemophilus influenzae Rd
uaauuuuggcgaaccuuucaua

SEQ ID NO: 2729402 - RNA, 12 nt, Haemophilus influenzae Rd
uaauuuuuaaaa

SEQ ID NO: 2729403 - RNA, 13 nt, Haemophilus influenzae Rd
uaauuuuuaaaau

SEQ ID NO: 2729404 - RNA, 13 nt, Haemophilus influenzae Rd
uaauuuuuagauu

SEQ ID NO: 2729405 - RNA, 17 nt, Haemophilus influenzae Rd
uaauuuuuagauuauuu

SEQ ID NO: 2729406 - RNA, 14 nt, Haemophilus influenzae Rd
uaauuuuuuacgau

SEQ ID NO: 2729407 - RNA, 15 nt, Haemophilus influenzae Rd
uaauuuuuuauaaaa

SEQ ID NO: 2729408 - RNA, 17 nt, Haemophilus influenzae Rd
uaauuuuuuauaaaauu

SEQ ID NO: 2729409 - RNA, 17 nt, Haemophilus influenzae Rd
uaauuuuuucuaaauuu

SEQ ID NO: 2729410 - RNA, 14 nt, Haemophilus influenzae Rd
uaauuuuuucuguu

SEQ ID NO: 2729411 - RNA, 15 nt, Haemophilus influenzae Rd
uaauuuuuugaauau

SEQ ID NO: 2729412 - RNA, 20 nt, Haemophilus influenzae Rd
uacaaaaaagccacuuucaa

SEQ ID NO: 2729413 - RNA, 17 nt, Haemophilus influenzae Rd
uacaaaaaagugcgguu

SEQ ID NO: 2729414 - RNA, 22 nt, Haemophilus influenzae Rd
uacaaaaagugcgguuaaaaau

SEQ ID NO: 2729415 - RNA, 21 nt, Haemophilus influenzae Rd
uacaaacgguuucaauaugac

SEQ ID NO: 2729416 - RNA, 12 nt, Haemophilus influenzae Rd
uacaaagcacga

SEQ ID NO: 2729417 - RNA, 20 nt, Haemophilus influenzae Rd
uacaaauaacacagaaacca

SEQ ID NO: 2729418 - RNA, 20 nt, Haemophilus influenzae Rd
uacaaauaaccuaucccaaa

SEQ ID NO: 2729419 - RNA, 17 nt, Haemophilus influenzae Rd
uacaaauuccucugaac

SEQ ID NO: 2729420 - RNA, 14 nt, Haemophilus influenzae Rd
uacaaauuuagaua

SEQ ID NO: 2729421 - RNA, 15 nt, Haemophilus influenzae Rd
uacaaauuuagauaa

SEQ ID NO: 2729422 - RNA, 18 nt, Haemophilus influenzae Rd
uacaacgccgccaauauc

SEQ ID NO: 2729423 - RNA, 17 nt, Haemophilus influenzae Rd
uacaacgcucugcaccu

SEQ ID NO: 2729424 - RNA, 21 nt, Haemophilus influenzae Rd
uacaacgcucugcaccuucac

SEQ ID NO: 2729425 - RNA, 17 nt, Haemophilus influenzae Rd
uacaacgugaaguaaau

SEQ ID NO: 2729426 - RNA, 21 nt, Haemophilus influenzae Rd
uacaacuaaucccacuuguug

SEQ ID NO: 2729427 - RNA, 24 nt, Haemophilus influenzae Rd
uacaacuucaucaauggcaucgcu

SEQ ID NO: 2729428 - RNA, 15 nt, Haemophilus influenzae Rd
uacaacuuuuuauuu

SEQ ID NO: 2729429 - RNA, 18 nt, Haemophilus influenzae Rd
uacaagaaagaaauauaa

SEQ ID NO: 2729430 - RNA, 19 nt, Haemophilus influenzae Rd
uacaagaaagaaauauaau

SEQ ID NO: 2729431 - RNA, 20 nt, Haemophilus influenzae Rd
uacaagauaaucagugauua

SEQ ID NO: 2729432 - RNA, 22 nt, Haemophilus influenzae Rd
uacaagauaaucagugauuaua

SEQ ID NO: 2729433 - RNA, 19 nt, Haemophilus influenzae Rd
uacaagguacuugaacuug

SEQ ID NO: 2729434 - RNA, 20 nt, Haemophilus influenzae Rd
uacaagguagauugauacag

SEQ ID NO: 2729435 - RNA, 23 nt, Haemophilus influenzae Rd
uacaaguacuacuggcauuuuuu

SEQ ID NO: 2729436 - RNA, 16 nt, Haemophilus influenzae Rd
uacaaguauuuuccuu

SEQ ID NO: 2729437 - RNA, 18 nt, Haemophilus influenzae Rd
uacaagucucuaugauuu

SEQ ID NO: 2729438 - RNA, 20 nt, Haemophilus influenzae Rd
uacaaguggcgguaaaaaug

SEQ ID NO: 2729439 - RNA, 19 nt, Haemophilus influenzae Rd
uacaauauuuauuucuaua

SEQ ID NO: 2729440 - RNA, 20 nt, Haemophilus influenzae Rd
uacaauauuuauuucuauag

SEQ ID NO: 2729441 - RNA, 16 nt, Haemophilus influenzae Rd
uacaaucaaaaaaucu

SEQ ID NO: 2729442 - RNA, 20 nt, Haemophilus influenzae Rd
uacaaucacgaucugcaaca

SEQ ID NO: 2729443 - RNA, 17 nt, Haemophilus influenzae Rd
uacaaucauagaaaucc

SEQ ID NO: 2729444 - RNA, 22 nt, Haemophilus influenzae Rd
uacaauccuaacuuuucuucaa

SEQ ID NO: 2729445 - RNA, 23 nt, Haemophilus influenzae Rd
uacaauccuaacuuuucuucaau

SEQ ID NO: 2729446 - RNA, 15 nt, Haemophilus influenzae Rd
uacaaugcucacuuc

SEQ ID NO: 2729447 - RNA, 22 nt, Haemophilus influenzae Rd
uacaauuaauuaaauaugauaa

SEQ ID NO: 2729448 - RNA, 14 nt, Haemophilus influenzae Rd
uacaauuucauuaa

SEQ ID NO: 2729449 - RNA, 21 nt, Haemophilus influenzae Rd
uacaauuucauuaauuuuauu

SEQ ID NO: 2729450 - RNA, 15 nt, Haemophilus influenzae Rd
uacaauuuuuuucaa

SEQ ID NO: 2729451 - RNA, 14 nt, Haemophilus influenzae Rd
uacacaaaauauuc

SEQ ID NO: 2729452 - RNA, 13 nt, Haemophilus influenzae Rd
uacacaaaaucca

SEQ ID NO: 2729453 - RNA, 14 nt, Haemophilus influenzae Rd
uacacaaaauccau

SEQ ID NO: 2729454 - RNA, 16 nt, Haemophilus influenzae Rd
uacacaccaucaacuu

SEQ ID NO: 2729455 - RNA, 23 nt, Haemophilus influenzae Rd
uacacaucagagcgaauacuguu

SEQ ID NO: 2729456 - RNA, 18 nt, Haemophilus influenzae Rd
uacacauggccaauuuca

SEQ ID NO: 2729457 - RNA, 14 nt, Haemophilus influenzae Rd
uacacauugccaua

SEQ ID NO: 2729458 - RNA, 17 nt, Haemophilus influenzae Rd
uacacauuucuucuagu

SEQ ID NO: 2729459 - RNA, 17 nt, Haemophilus influenzae Rd
uacacccacugauuuuu

SEQ ID NO: 2729460 - RNA, 18 nt, Haemophilus influenzae Rd
uacaccguccaagguuuu

SEQ ID NO: 2729461 - RNA, 21 nt, Haemophilus influenzae Rd
uacaccguccaagguuuuaau

SEQ ID NO: 2729462 - RNA, 18 nt, Haemophilus influenzae Rd
uacacgagcaauggcaau

SEQ ID NO: 2729463 - RNA, 21 nt, Haemophilus influenzae Rd
uacacggauuggguuguuacg

SEQ ID NO: 2729464 - RNA, 15 nt, Haemophilus influenzae Rd
uacacguucagcuug

SEQ ID NO: 2729465 - RNA, 15 nt, Haemophilus influenzae Rd
uacacuuaaauuaua

SEQ ID NO: 2729466 - RNA, 16 nt, Haemophilus influenzae Rd
uacacuuaaauuauau

SEQ ID NO: 2729467 - RNA, 15 nt, Haemophilus influenzae Rd
uacacuucuaaaaua

SEQ ID NO: 2729468 - RNA, 23 nt, Haemophilus influenzae Rd
uacacuucugccagauguuggaa

SEQ ID NO: 2729469 - RNA, 20 nt, Haemophilus influenzae Rd
uacacuuuuaacuuaaucau

SEQ ID NO: 2729470 - RNA, 22 nt, Haemophilus influenzae Rd
uacacuuuuaacuuaaucauuu

SEQ ID NO: 2729471 - RNA, 18 nt, Haemophilus influenzae Rd
uacagaaaccagaaauag

SEQ ID NO: 2729472 - RNA, 17 nt, Haemophilus influenzae Rd
uacagaaauaugaaauu

SEQ ID NO: 2729473 - RNA, 18 nt, Haemophilus influenzae Rd
uacagaaauaugaaauuu

SEQ ID NO: 2729474 - RNA, 13 nt, Haemophilus influenzae Rd
uacagaaauauua

SEQ ID NO: 2729475 - RNA, 18 nt, Haemophilus influenzae Rd
uacagaaauauuauuaag

SEQ ID NO: 2729476 - RNA, 13 nt, Haemophilus influenzae Rd
uacagaacaaaau

SEQ ID NO: 2729477 - RNA, 15 nt, Haemophilus influenzae Rd
uacagaacaaaauaa

SEQ ID NO: 2729478 - RNA, 22 nt, Haemophilus influenzae Rd
uacagaaccgccguauugaaua

SEQ ID NO: 2729479 - RNA, 17 nt, Haemophilus influenzae Rd
uacagaagcugcgaauu

SEQ ID NO: 2729480 - RNA, 14 nt, Haemophilus influenzae Rd
uacagauaaaucag

SEQ ID NO: 2729481 - RNA, 16 nt, Haemophilus influenzae Rd
uacagauacagaagga

SEQ ID NO: 2729482 - RNA, 19 nt, Haemophilus influenzae Rd
uacagcaaaccaaggaauu

SEQ ID NO: 2729483 - RNA, 15 nt, Haemophilus influenzae Rd
uacagcacuaaaagc

SEQ ID NO: 2729484 - RNA, 23 nt, Haemophilus influenzae Rd
uacagcacuaaaagcauuacaaa

SEQ ID NO: 2729485 - RNA, 21 nt, Haemophilus influenzae Rd
uacagcgaacauuuuugguuu

SEQ ID NO: 2729486 - RNA, 17 nt, Haemophilus influenzae Rd
uacagcugcauaaagcu

SEQ ID NO: 2729487 - RNA, 18 nt, Haemophilus influenzae Rd
uacaguacaauuaauuaa

SEQ ID NO: 2729488 - RNA, 16 nt, Haemophilus influenzae Rd
uacaguaccuauauac

SEQ ID NO: 2729489 - RNA, 21 nt, Haemophilus influenzae Rd
uacagugacaaauuuugcauu

SEQ ID NO: 2729490 - RNA, 15 nt, Haemophilus influenzae Rd
uacaguuucaacaaa

SEQ ID NO: 2729491 - RNA, 22 nt, Haemophilus influenzae Rd
uacaguuugcgugaauaucuaa

SEQ ID NO: 2729492 - RNA, 12 nt, Haemophilus influenzae Rd
uacauaaucuug

SEQ ID NO: 2729493 - RNA, 19 nt, Haemophilus influenzae Rd
uacauaaugggcuuuccaa

SEQ ID NO: 2729494 - RNA, 21 nt, Haemophilus influenzae Rd
uacauagaacguuuuuuacuu

SEQ ID NO: 2729495 - RNA, 13 nt, Haemophilus influenzae Rd
uacauauaaagau

SEQ ID NO: 2729496 - RNA, 15 nt, Haemophilus influenzae Rd
uacaucaacaaaugu

SEQ ID NO: 2729497 - RNA, 15 nt, Haemophilus influenzae Rd
uacaucacgaacuuc

SEQ ID NO: 2729498 - RNA, 17 nt, Haemophilus influenzae Rd
uacaucacuaauacgcg

SEQ ID NO: 2729499 - RNA, 17 nt, Haemophilus influenzae Rd
uacaucagguuuaauaa

SEQ ID NO: 2729500 - RNA, 21 nt, Haemophilus influenzae Rd
uacaucaguaccuuuaauuaa

SEQ ID NO: 2729501 - RNA, 17 nt, Haemophilus influenzae Rd
uacaucauuugcaauau

SEQ ID NO: 2729502 - RNA, 14 nt, Haemophilus influenzae Rd
uacaucgaaaacau

SEQ ID NO: 2729503 - RNA, 15 nt, Haemophilus influenzae Rd
uacaucgaaaacaua

SEQ ID NO: 2729504 - RNA, 16 nt, Haemophilus influenzae Rd
uacaucgaaaacauaa

SEQ ID NO: 2729505 - RNA, 13 nt, Haemophilus influenzae Rd
uacaucuaaaccg

SEQ ID NO: 2729506 - RNA, 13 nt, Haemophilus influenzae Rd
uacaucuaaugcc

SEQ ID NO: 2729507 - RNA, 23 nt, Haemophilus influenzae Rd
uacaucuacuguggcaaguugaa

SEQ ID NO: 2729508 - RNA, 16 nt, Haemophilus influenzae Rd
uacaucuucaaaaaca

SEQ ID NO: 2729509 - RNA, 19 nt, Haemophilus influenzae Rd
uacaucuucaaaaacauaa

SEQ ID NO: 2729510 - RNA, 11 nt, Haemophilus influenzae Rd
uacaucuucac

SEQ ID NO: 2729511 - RNA, 15 nt, Haemophilus influenzae Rd
uacaucuugcguuaa

SEQ ID NO: 2729512 - RNA, 20 nt, Haemophilus influenzae Rd
uacaucuugcguuaaaucaa

SEQ ID NO: 2729513 - RNA, 13 nt, Haemophilus influenzae Rd
uacauuaaaagau

SEQ ID NO: 2729514 - RNA, 14 nt, Haemophilus influenzae Rd
uacauuaaaagaua

SEQ ID NO: 2729515 - RNA, 14 nt, Haemophilus influenzae Rd
uacauuaaucacca

SEQ ID NO: 2729516 - RNA, 12 nt, Haemophilus influenzae Rd
uacauuauuaaa

SEQ ID NO: 2729517 - RNA, 11 nt, Haemophilus influenzae Rd
uacauuauuga

SEQ ID NO: 2729518 - RNA, 22 nt, Haemophilus influenzae Rd
uacauucagugguaaucauuaa

SEQ ID NO: 2729519 - RNA, 14 nt, Haemophilus influenzae Rd
uacauucccaaaua

SEQ ID NO: 2729520 - RNA, 15 nt, Haemophilus influenzae Rd
uacauucccaaauaa

SEQ ID NO: 2729521 - RNA, 23 nt, Haemophilus influenzae Rd
uacauucuccagacugcauugca

SEQ ID NO: 2729522 - RNA, 18 nt, Haemophilus influenzae Rd
uacauucuuccgcaauuu

SEQ ID NO: 2729523 - RNA, 22 nt, Haemophilus influenzae Rd
uacauugaagcgggcgaugaaa

SEQ ID NO: 2729524 - RNA, 22 nt, Haemophilus influenzae Rd
uacauugcuauggcaaugaaua

SEQ ID NO: 2729525 - RNA, 18 nt, Haemophilus influenzae Rd
uacauuugacgaauggca

SEQ ID NO: 2729526 - RNA, 20 nt, Haemophilus influenzae Rd
uacauuugccccaacaacau

SEQ ID NO: 2729527 - RNA, 20 nt, Haemophilus influenzae Rd
uaccaaaaggugguuuugca

SEQ ID NO: 2729528 - RNA, 13 nt, Haemophilus influenzae Rd
uaccaaaauuuaa

SEQ ID NO: 2729529 - RNA, 15 nt, Haemophilus influenzae Rd
uaccaaaauuuaaaa

SEQ ID NO: 2729530 - RNA, 16 nt, Haemophilus influenzae Rd
uaccaaaauuuaaaau

SEQ ID NO: 2729531 - RNA, 17 nt, Haemophilus influenzae Rd
uaccaaaugaccaaggc

SEQ ID NO: 2729532 - RNA, 21 nt, Haemophilus influenzae Rd
uaccaaccgguaaaauuaaug

SEQ ID NO: 2729533 - RNA, 21 nt, Haemophilus influenzae Rd
uaccaauaauaauaucgcccg

SEQ ID NO: 2729534 - RNA, 15 nt, Haemophilus influenzae Rd
uaccaauaaucaaua

SEQ ID NO: 2729535 - RNA, 14 nt, Haemophilus influenzae Rd
uaccaauacgauaa

SEQ ID NO: 2729536 - RNA, 17 nt, Haemophilus influenzae Rd
uaccaauucaaaaacca

SEQ ID NO: 2729537 - RNA, 20 nt, Haemophilus influenzae Rd
uaccaauucaaaaaccaaac

SEQ ID NO: 2729538 - RNA, 14 nt, Haemophilus influenzae Rd
uaccacauaaaugu

SEQ ID NO: 2729539 - RNA, 21 nt, Haemophilus influenzae Rd
uaccacaucauuauugccuuu

SEQ ID NO: 2729540 - RNA, 23 nt, Haemophilus influenzae Rd
uaccaccagucggcauuaucugu

SEQ ID NO: 2729541 - RNA, 18 nt, Haemophilus influenzae Rd
uaccacccaaaauuucag

SEQ ID NO: 2729542 - RNA, 19 nt, Haemophilus influenzae Rd
uaccacccaaaauuucagc

SEQ ID NO: 2729543 - RNA, 17 nt, Haemophilus influenzae Rd
uaccaccgcuaaaucau

SEQ ID NO: 2729544 - RNA, 16 nt, Haemophilus influenzae Rd
uaccacgguugauacc

SEQ ID NO: 2729545 - RNA, 22 nt, Haemophilus influenzae Rd
uaccacguucuuguaagccaaa

SEQ ID NO: 2729546 - RNA, 16 nt, Haemophilus influenzae Rd
uaccacuccccaaaaa

SEQ ID NO: 2729547 - RNA, 17 nt, Haemophilus influenzae Rd
uaccacuugccaaacau

SEQ ID NO: 2729548 - RNA, 23 nt, Haemophilus influenzae Rd
uaccacuuucaacuguucuucug

SEQ ID NO: 2729549 - RNA, 18 nt, Haemophilus influenzae Rd
uaccagagcguuuaaagu

SEQ ID NO: 2729550 - RNA, 21 nt, Haemophilus influenzae Rd
uaccauacagccugcgauugc

SEQ ID NO: 2729551 - RNA, 18 nt, Haemophilus influenzae Rd
uaccaugccauuuccuac

SEQ ID NO: 2729552 - RNA, 16 nt, Haemophilus influenzae Rd
uaccaugcugauuauu

SEQ ID NO: 2729553 - RNA, 18 nt, Haemophilus influenzae Rd
uaccauucuuucaauaau

SEQ ID NO: 2729554 - RNA, 21 nt, Haemophilus influenzae Rd
uaccauucuuucaauaauuuu

SEQ ID NO: 2729555 - RNA, 21 nt, Haemophilus influenzae Rd
uaccauugcguucacucacuu

SEQ ID NO: 2729556 - RNA, 15 nt, Haemophilus influenzae Rd
uaccauuuaucucuu

SEQ ID NO: 2729557 - RNA, 13 nt, Haemophilus influenzae Rd
uaccauuuaucuu

SEQ ID NO: 2729558 - RNA, 13 nt, Haemophilus influenzae Rd
uacccaaauuuau

SEQ ID NO: 2729559 - RNA, 13 nt, Haemophilus influenzae Rd
uacccaacaaauu

SEQ ID NO: 2729560 - RNA, 21 nt, Haemophilus influenzae Rd
uacccacuucauauaaaucaa

SEQ ID NO: 2729561 - RNA, 18 nt, Haemophilus influenzae Rd
uacccauuucgaucauau

SEQ ID NO: 2729562 - RNA, 13 nt, Haemophilus influenzae Rd
uaccccaauuaag

SEQ ID NO: 2729563 - RNA, 18 nt, Haemophilus influenzae Rd
uaccccucguucucccac

SEQ ID NO: 2729564 - RNA, 18 nt, Haemophilus influenzae Rd
uacccgggccaaauaaua

SEQ ID NO: 2729565 - RNA, 16 nt, Haemophilus influenzae Rd
uacccguauuaaauac

SEQ ID NO: 2729566 - RNA, 18 nt, Haemophilus influenzae Rd
uacccgugccuaauucac

SEQ ID NO: 2729567 - RNA, 14 nt, Haemophilus influenzae Rd
uacccuauucuaaa

SEQ ID NO: 2729568 - RNA, 14 nt, Haemophilus influenzae Rd
uaccgaaguaagau

SEQ ID NO: 2729569 - RNA, 15 nt, Haemophilus influenzae Rd
uaccgcaaucuucac

SEQ ID NO: 2729570 - RNA, 23 nt, Haemophilus influenzae Rd
uaccgcaccuuuacguuuaacug

SEQ ID NO: 2729571 - RNA, 22 nt, Haemophilus influenzae Rd
uaccgcacuuuuuuucuuauuu

SEQ ID NO: 2729572 - RNA, 16 nt, Haemophilus influenzae Rd
uaccgcauuuuuaaug

SEQ ID NO: 2729573 - RNA, 14 nt, Haemophilus influenzae Rd
uaccgcucauugcu

SEQ ID NO: 2729574 - RNA, 14 nt, Haemophilus influenzae Rd
uaccgcuucuuccu

SEQ ID NO: 2729575 - RNA, 23 nt, Haemophilus influenzae Rd
uaccgucagccaaauuuuucuuu

SEQ ID NO: 2729576 - RNA, 20 nt, Haemophilus influenzae Rd
uaccgucaugggauaaacau

SEQ ID NO: 2729577 - RNA, 22 nt, Haemophilus influenzae Rd
uaccgucuaaacggaaauauug

SEQ ID NO: 2729578 - RNA, 14 nt, Haemophilus influenzae Rd
uaccguuaaggcau

SEQ ID NO: 2729579 - RNA, 13 nt, Haemophilus influenzae Rd
uaccuaaaauaaa

SEQ ID NO: 2729580 - RNA, 16 nt, Haemophilus influenzae Rd
uaccuaaaauaaauuu

SEQ ID NO: 2729581 - RNA, 16 nt, Haemophilus influenzae Rd
uaccuaauggauauag

SEQ ID NO: 2729582 - RNA, 13 nt, Haemophilus influenzae Rd
uaccugaugaaau

SEQ ID NO: 2729583 - RNA, 22 nt, Haemophilus influenzae Rd
uaccugaugaaaucauuacaca

SEQ ID NO: 2729584 - RNA, 18 nt, Haemophilus influenzae Rd
uaccugauucauugcauu

SEQ ID NO: 2729585 - RNA, 16 nt, Haemophilus influenzae Rd
uaccugguugcauaaa

SEQ ID NO: 2729586 - RNA, 21 nt, Haemophilus influenzae Rd
uaccuguuucguacauuguuu

SEQ ID NO: 2729587 - RNA, 14 nt, Haemophilus influenzae Rd
uaccuuaauuaauc

SEQ ID NO: 2729588 - RNA, 17 nt, Haemophilus influenzae Rd
uaccuuaauuaaucuuu

SEQ ID NO: 2729589 - RNA, 20 nt, Haemophilus influenzae Rd
uaccuuagccaaaucaucua

SEQ ID NO: 2729590 - RNA, 13 nt, Haemophilus influenzae Rd
uaccuucaaccac

SEQ ID NO: 2729591 - RNA, 17 nt, Haemophilus influenzae Rd
uaccuucgccuacuucu

SEQ ID NO: 2729592 - RNA, 20 nt, Haemophilus influenzae Rd
uaccuucuugauuauuuaau

SEQ ID NO: 2729593 - RNA, 16 nt, Haemophilus influenzae Rd
uaccuugcauuucuuu

SEQ ID NO: 2729594 - RNA, 13 nt, Haemophilus influenzae Rd
uaccuuuaagcau

SEQ ID NO: 2729595 - RNA, 15 nt, Haemophilus influenzae Rd
uaccuuuaagcauug

SEQ ID NO: 2729596 - RNA, 13 nt, Haemophilus influenzae Rd
uacgaaauacgca

SEQ ID NO: 2729597 - RNA, 12 nt, Haemophilus influenzae Rd
uacgaauaaacg

SEQ ID NO: 2729598 - RNA, 21 nt, Haemophilus influenzae Rd
uacgaauuaagcgaacaccuu

SEQ ID NO: 2729599 - RNA, 14 nt, Haemophilus influenzae Rd
uacgaauugguucu

SEQ ID NO: 2729600 - RNA, 19 nt, Haemophilus influenzae Rd
uacgacaucuuaaauuaua

SEQ ID NO: 2729601 - RNA, 22 nt, Haemophilus influenzae Rd
uacgagaaacgauaauguucac

SEQ ID NO: 2729602 - RNA, 22 nt, Haemophilus influenzae Rd
uacgagaaagguguaauuccau

SEQ ID NO: 2729603 - RNA, 18 nt, Haemophilus influenzae Rd
uacgaguaaaaaaucuau

SEQ ID NO: 2729604 - RNA, 20 nt, Haemophilus influenzae Rd
uacgauaaugccauuugcuu

SEQ ID NO: 2729605 - RNA, 16 nt, Haemophilus influenzae Rd
uacgauaguaaaaaau

SEQ ID NO: 2729606 - RNA, 20 nt, Haemophilus influenzae Rd
uacgaucacgauuuuucucu

SEQ ID NO: 2729607 - RNA, 17 nt, Haemophilus influenzae Rd
uacgauuguauuuuaaa

SEQ ID NO: 2729608 - RNA, 15 nt, Haemophilus influenzae Rd
uacgccauucuuuau

SEQ ID NO: 2729609 - RNA, 13 nt, Haemophilus influenzae Rd
uacgcccauugaa

SEQ ID NO: 2729610 - RNA, 20 nt, Haemophilus influenzae Rd
uacgcccauugaaaauacag

SEQ ID NO: 2729611 - RNA, 12 nt, Haemophilus influenzae Rd
uacgccuaacca

SEQ ID NO: 2729612 - RNA, 19 nt, Haemophilus influenzae Rd
uacgccuccauuaguuguu

SEQ ID NO: 2729613 - RNA, 21 nt, Haemophilus influenzae Rd
uacgcuuuaacgagaauauuc

SEQ ID NO: 2729614 - RNA, 19 nt, Haemophilus influenzae Rd
uacggacuaaauaaaucac

SEQ ID NO: 2729615 - RNA, 18 nt, Haemophilus influenzae Rd
uacggauaauuucccuaa

SEQ ID NO: 2729616 - RNA, 18 nt, Haemophilus influenzae Rd
uacggcaaauuaaaucac

SEQ ID NO: 2729617 - RNA, 13 nt, Haemophilus influenzae Rd
uacggcguagaau

SEQ ID NO: 2729618 - RNA, 18 nt, Haemophilus influenzae Rd
uacggcguagaaugcaaa

SEQ ID NO: 2729619 - RNA, 20 nt, Haemophilus influenzae Rd
uacgguuauuuuuuucuaac

SEQ ID NO: 2729620 - RNA, 16 nt, Haemophilus influenzae Rd
uacguaauauuuaccg

SEQ ID NO: 2729621 - RNA, 14 nt, Haemophilus influenzae Rd
uacguaaugcuuuu

SEQ ID NO: 2729622 - RNA, 15 nt, Haemophilus influenzae Rd
uacguaguacaucau

SEQ ID NO: 2729623 - RNA, 19 nt, Haemophilus influenzae Rd
uacguauugaacuaaaaua

SEQ ID NO: 2729624 - RNA, 15 nt, Haemophilus influenzae Rd
uacguggcucaucca

SEQ ID NO: 2729625 - RNA, 21 nt, Haemophilus influenzae Rd
uacguugaguauagucauuca

SEQ ID NO: 2729626 - RNA, 22 nt, Haemophilus influenzae Rd
uacguugaguauagucauucaa

SEQ ID NO: 2729627 - RNA, 21 nt, Haemophilus influenzae Rd
uacguuguuguucuaacauuu

SEQ ID NO: 2729628 - RNA, 12 nt, Haemophilus influenzae Rd
uacguuucacua

SEQ ID NO: 2729629 - RNA, 17 nt, Haemophilus influenzae Rd
uacguuuuguuuuaauu

SEQ ID NO: 2729630 - RNA, 20 nt, Haemophilus influenzae Rd
uacuaaaaaauuaaauugua

SEQ ID NO: 2729631 - RNA, 13 nt, Haemophilus influenzae Rd
uacuaaauuagua

SEQ ID NO: 2729632 - RNA, 18 nt, Haemophilus influenzae Rd
uacuaaauucuuuugcca

SEQ ID NO: 2729633 - RNA, 14 nt, Haemophilus influenzae Rd
uacuaacucaaaau

SEQ ID NO: 2729634 - RNA, 15 nt, Haemophilus influenzae Rd
uacuaacucaaaaua

SEQ ID NO: 2729635 - RNA, 20 nt, Haemophilus influenzae Rd
uacuaauaggaguaaaaaua

SEQ ID NO: 2729636 - RNA, 17 nt, Haemophilus influenzae Rd
uacuaauucaagcaaau

SEQ ID NO: 2729637 - RNA, 19 nt, Haemophilus influenzae Rd
uacuaauucaagcaaauau

SEQ ID NO: 2729638 - RNA, 15 nt, Haemophilus influenzae Rd
uacuaauucauuaca

SEQ ID NO: 2729639 - RNA, 12 nt, Haemophilus influenzae Rd
uacuaauuguug

SEQ ID NO: 2729640 - RNA, 15 nt, Haemophilus influenzae Rd
uacuaauuguuguaa

SEQ ID NO: 2729641 - RNA, 21 nt, Haemophilus influenzae Rd
uacuacagcccaauuauuggc

SEQ ID NO: 2729642 - RNA, 12 nt, Haemophilus influenzae Rd
uacuacguaaag

SEQ ID NO: 2729643 - RNA, 19 nt, Haemophilus influenzae Rd
uacuacguguucaucaucg

SEQ ID NO: 2729644 - RNA, 16 nt, Haemophilus influenzae Rd
uacuacuggcauuuuu

SEQ ID NO: 2729645 - RNA, 14 nt, Haemophilus influenzae Rd
uacuacuuuggauu

SEQ ID NO: 2729646 - RNA, 19 nt, Haemophilus influenzae Rd
uacuacuuuggauuggauu

SEQ ID NO: 2729647 - RNA, 20 nt, Haemophilus influenzae Rd
uacuagcucguaaagaucau

SEQ ID NO: 2729648 - RNA, 16 nt, Haemophilus influenzae Rd
uacuauaggaauauca

SEQ ID NO: 2729649 - RNA, 18 nt, Haemophilus influenzae Rd
uacuaugaggauuuucau

SEQ ID NO: 2729650 - RNA, 15 nt, Haemophilus influenzae Rd
uacuauuaauucucu

SEQ ID NO: 2729651 - RNA, 15 nt, Haemophilus influenzae Rd
uacuauuggcguaau

SEQ ID NO: 2729652 - RNA, 17 nt, Haemophilus influenzae Rd
uacucaaagaaauagau

SEQ ID NO: 2729653 - RNA, 21 nt, Haemophilus influenzae Rd
uacucaaagaaauagauuauu

SEQ ID NO: 2729654 - RNA, 21 nt, Haemophilus influenzae Rd
uacucaugaguuguuuuuuca

SEQ ID NO: 2729655 - RNA, 22 nt, Haemophilus influenzae Rd
uacucauuuaucaaacaagccc

SEQ ID NO: 2729656 - RNA, 13 nt, Haemophilus influenzae Rd
uacucuuaauuuu

SEQ ID NO: 2729657 - RNA, 18 nt, Haemophilus influenzae Rd
uacucuuuuuuagauaaa

SEQ ID NO: 2729658 - RNA, 12 nt, Haemophilus influenzae Rd
uacugaauaaaa

SEQ ID NO: 2729659 - RNA, 14 nt, Haemophilus influenzae Rd
uacugaauaaaaaa

SEQ ID NO: 2729660 - RNA, 14 nt, Haemophilus influenzae Rd
uacugacuuucuaa

SEQ ID NO: 2729661 - RNA, 20 nt, Haemophilus influenzae Rd
uacugauaccguuaaggcau

SEQ ID NO: 2729662 - RNA, 11 nt, Haemophilus influenzae Rd
uacugauuuua

SEQ ID NO: 2729663 - RNA, 19 nt, Haemophilus influenzae Rd
uacuggaaauucuucaaua

SEQ ID NO: 2729664 - RNA, 14 nt, Haemophilus influenzae Rd
uacuggcacuaaac

SEQ ID NO: 2729665 - RNA, 15 nt, Haemophilus influenzae Rd
uacuggugaaauuaa

SEQ ID NO: 2729666 - RNA, 20 nt, Haemophilus influenzae Rd
uacugucgaaccaaguugga

SEQ ID NO: 2729667 - RNA, 15 nt, Haemophilus influenzae Rd
uacuguuaauuugcc

SEQ ID NO: 2729668 - RNA, 13 nt, Haemophilus influenzae Rd
uacuguucaaaua

SEQ ID NO: 2729669 - RNA, 13 nt, Haemophilus influenzae Rd
uacuuaaaauuca

SEQ ID NO: 2729670 - RNA, 17 nt, Haemophilus influenzae Rd
uacuuaauugauuuuaa

SEQ ID NO: 2729671 - RNA, 20 nt, Haemophilus influenzae Rd
uacuuaauugauuuuaaaga

SEQ ID NO: 2729672 - RNA, 13 nt, Haemophilus influenzae Rd
uacuuagauaaau

SEQ ID NO: 2729673 - RNA, 14 nt, Haemophilus influenzae Rd
uacuuagauaaauu

SEQ ID NO: 2729674 - RNA, 21 nt, Haemophilus influenzae Rd
uacuuagcgugcuaauuccaa

SEQ ID NO: 2729675 - RNA, 21 nt, Haemophilus influenzae Rd
uacuucacaguaaagauuaga

SEQ ID NO: 2729676 - RNA, 12 nt, Haemophilus influenzae Rd
uacuucaucaaa

SEQ ID NO: 2729677 - RNA, 19 nt, Haemophilus influenzae Rd
uacuuccgcuuuaauaauc

SEQ ID NO: 2729678 - RNA, 22 nt, Haemophilus influenzae Rd
uacuucuagaaaauaaccaaua

SEQ ID NO: 2729679 - RNA, 19 nt, Haemophilus influenzae Rd
uacuucuuuagcugcaaua

SEQ ID NO: 2729680 - RNA, 22 nt, Haemophilus influenzae Rd
uacuugaccagagccaaauaca

SEQ ID NO: 2729681 - RNA, 14 nt, Haemophilus influenzae Rd
uacuugcagugaug

SEQ ID NO: 2729682 - RNA, 19 nt, Haemophilus influenzae Rd
uacuuggaaacggaaaaug

SEQ ID NO: 2729683 - RNA, 15 nt, Haemophilus influenzae Rd
uacuuggaauaucau

SEQ ID NO: 2729684 - RNA, 14 nt, Haemophilus influenzae Rd
uacuuggaugaaau

SEQ ID NO: 2729685 - RNA, 19 nt, Haemophilus influenzae Rd
uacuuggaugaaaucaaac

SEQ ID NO: 2729686 - RNA, 21 nt, Haemophilus influenzae Rd
uacuuggcguucauaucuuua

SEQ ID NO: 2729687 - RNA, 17 nt, Haemophilus influenzae Rd
uacuuggggcuaauuuu

SEQ ID NO: 2729688 - RNA, 16 nt, Haemophilus influenzae Rd
uacuugugcauuuggg

SEQ ID NO: 2729689 - RNA, 12 nt, Haemophilus influenzae Rd
uacuuguuuaug

SEQ ID NO: 2729690 - RNA, 17 nt, Haemophilus influenzae Rd
uacuuguuuaugucuaa

SEQ ID NO: 2729691 - RNA, 13 nt, Haemophilus influenzae Rd
uacuuuaaagaau

SEQ ID NO: 2729692 - RNA, 20 nt, Haemophilus influenzae Rd
uacuuuaaagaauauucuuu

SEQ ID NO: 2729693 - RNA, 16 nt, Haemophilus influenzae Rd
uacuuuacguaaagua

SEQ ID NO: 2729694 - RNA, 12 nt, Haemophilus influenzae Rd
uacuuuauaaau

SEQ ID NO: 2729695 - RNA, 17 nt, Haemophilus influenzae Rd
uacuuuauacuaaaagu

SEQ ID NO: 2729696 - RNA, 22 nt, Haemophilus influenzae Rd
uacuuuauugcggaguuuuaau

SEQ ID NO: 2729697 - RNA, 19 nt, Haemophilus influenzae Rd
uacuuucagaauguugcgu

SEQ ID NO: 2729698 - RNA, 16 nt, Haemophilus influenzae Rd
uacuuuccaauuccau

SEQ ID NO: 2729699 - RNA, 15 nt, Haemophilus influenzae Rd
uacuuucuaauuauu

SEQ ID NO: 2729700 - RNA, 20 nt, Haemophilus influenzae Rd
uacuuuuaacacuuuuucac

SEQ ID NO: 2729701 - RNA, 19 nt, Haemophilus influenzae Rd
uacuuuuacgacuaauuuu

SEQ ID NO: 2729702 - RNA, 16 nt, Haemophilus influenzae Rd
uacuuuuagaauaaau

SEQ ID NO: 2729703 - RNA, 23 nt, Haemophilus influenzae Rd
uacuuuugauuuauuaauagaua

SEQ ID NO: 2729704 - RNA, 16 nt, Haemophilus influenzae Rd
uacuuuuuaauaaauc

SEQ ID NO: 2729705 - RNA, 14 nt, Haemophilus influenzae Rd
uacuuuuuauuagu

SEQ ID NO: 2729706 - RNA, 15 nt, Haemophilus influenzae Rd
uacuuuuuauuuuug

SEQ ID NO: 2729707 - RNA, 16 nt, Haemophilus influenzae Rd
uacuuuuucuaauaau

SEQ ID NO: 2729708 - RNA, 23 nt, Haemophilus influenzae Rd
uacuuuuugacccgcuuuuaaug

SEQ ID NO: 2729709 - RNA, 21 nt, Haemophilus influenzae Rd
uacuuuuuuaccuucagcacu

SEQ ID NO: 2729710 - RNA, 22 nt, Haemophilus influenzae Rd
uagaaaaaagaucagguuaaug

SEQ ID NO: 2729711 - RNA, 18 nt, Haemophilus influenzae Rd
uagaaaaagaaaaccugc

SEQ ID NO: 2729712 - RNA, 18 nt, Haemophilus influenzae Rd
uagaaaaaucgaagaaau

SEQ ID NO: 2729713 - RNA, 22 nt, Haemophilus influenzae Rd
uagaaaaauugguacgagaaaa

SEQ ID NO: 2729714 - RNA, 14 nt, Haemophilus influenzae Rd
uagaaaaauuuaau

SEQ ID NO: 2729715 - RNA, 14 nt, Haemophilus influenzae Rd
uagaaaaucagauu

SEQ ID NO: 2729716 - RNA, 17 nt, Haemophilus influenzae Rd
uagaaaaucgcaauaaa

SEQ ID NO: 2729717 - RNA, 14 nt, Haemophilus influenzae Rd
uagaaacagaagua

SEQ ID NO: 2729718 - RNA, 23 nt, Haemophilus influenzae Rd
uagaaacuuuccauacccuugcu

SEQ ID NO: 2729719 - RNA, 15 nt, Haemophilus influenzae Rd
uagaaagaauauuua

SEQ ID NO: 2729720 - RNA, 18 nt, Haemophilus influenzae Rd
uagaaaguggcuuaauuu

SEQ ID NO: 2729721 - RNA, 14 nt, Haemophilus influenzae Rd
uagaaauaaagaua

SEQ ID NO: 2729722 - RNA, 18 nt, Haemophilus influenzae Rd
uagaaauacauuauuaaa

SEQ ID NO: 2729723 - RNA, 20 nt, Haemophilus influenzae Rd
uagaaauacauuauuaaaag

SEQ ID NO: 2729724 - RNA, 19 nt, Haemophilus influenzae Rd
uagaaaucaaaaaugcuuu

SEQ ID NO: 2729725 - RNA, 19 nt, Haemophilus influenzae Rd
uagaaaucacaauaaaagc

SEQ ID NO: 2729726 - RNA, 17 nt, Haemophilus influenzae Rd
uagaaaucacuaaauuu

SEQ ID NO: 2729727 - RNA, 20 nt, Haemophilus influenzae Rd
uagaaaucauaaacugauaa

SEQ ID NO: 2729728 - RNA, 18 nt, Haemophilus influenzae Rd
uagaaaucccuugaccac

SEQ ID NO: 2729729 - RNA, 11 nt, Haemophilus influenzae Rd
uagaaaugauc

SEQ ID NO: 2729730 - RNA, 18 nt, Haemophilus influenzae Rd
uagaaaugaucaaaucaa

SEQ ID NO: 2729731 - RNA, 19 nt, Haemophilus influenzae Rd
uagaaauucgauugcauuu

SEQ ID NO: 2729732 - RNA, 19 nt, Haemophilus influenzae Rd
uagaaauugccauauaagc

SEQ ID NO: 2729733 - RNA, 20 nt, Haemophilus influenzae Rd
uagaaauuuuggcuuaauua

SEQ ID NO: 2729734 - RNA, 22 nt, Haemophilus influenzae Rd
uagaacaacaauacguugaacu

SEQ ID NO: 2729735 - RNA, 15 nt, Haemophilus influenzae Rd
uagaacaauauuuau

SEQ ID NO: 2729736 - RNA, 14 nt, Haemophilus influenzae Rd
uagaaccaggcgaa

SEQ ID NO: 2729737 - RNA, 19 nt, Haemophilus influenzae Rd
uagaaccgucuuuaaauag

SEQ ID NO: 2729738 - RNA, 16 nt, Haemophilus influenzae Rd
uagaacgcacacaaca

SEQ ID NO: 2729739 - RNA, 17 nt, Haemophilus influenzae Rd
uagaacuguuauuugca

SEQ ID NO: 2729740 - RNA, 15 nt, Haemophilus influenzae Rd
uagaagccaaaucau

SEQ ID NO: 2729741 - RNA, 19 nt, Haemophilus influenzae Rd
uagaaggcuaguucuuccu

SEQ ID NO: 2729742 - RNA, 15 nt, Haemophilus influenzae Rd
uagaaguaaauucag

SEQ ID NO: 2729743 - RNA, 23 nt, Haemophilus influenzae Rd
uagaauaaaccaaugagaaaaag

SEQ ID NO: 2729744 - RNA, 14 nt, Haemophilus influenzae Rd
uagaauaaauuaaa

SEQ ID NO: 2729745 - RNA, 16 nt, Haemophilus influenzae Rd
uagaauaaauuaaaaa

SEQ ID NO: 2729746 - RNA, 14 nt, Haemophilus influenzae Rd
uagaauaacaacaa

SEQ ID NO: 2729747 - RNA, 18 nt, Haemophilus influenzae Rd
uagaauaacaacaaaagu

SEQ ID NO: 2729748 - RNA, 13 nt, Haemophilus influenzae Rd
uagaauauuuugc

SEQ ID NO: 2729749 - RNA, 15 nt, Haemophilus influenzae Rd
uagaauauuuugcau

SEQ ID NO: 2729750 - RNA, 21 nt, Haemophilus influenzae Rd
uagaauauuuugcauguuauu

SEQ ID NO: 2729751 - RNA, 14 nt, Haemophilus influenzae Rd
uagaaucaauggcu

SEQ ID NO: 2729752 - RNA, 13 nt, Haemophilus influenzae Rd
uagaaugaaaaac

SEQ ID NO: 2729753 - RNA, 17 nt, Haemophilus influenzae Rd
uagaaugaaaaacauuc

SEQ ID NO: 2729754 - RNA, 12 nt, Haemophilus influenzae Rd
uagaaugcaaac

SEQ ID NO: 2729755 - RNA, 16 nt, Haemophilus influenzae Rd
uagaaugcaacaagua

SEQ ID NO: 2729756 - RNA, 23 nt, Haemophilus influenzae Rd
uagaaugggcauugacuaaggcc

SEQ ID NO: 2729757 - RNA, 16 nt, Haemophilus influenzae Rd
uagaauguaaauuauu

SEQ ID NO: 2729758 - RNA, 17 nt, Haemophilus influenzae Rd
uagaauguaaauuauuu

SEQ ID NO: 2729759 - RNA, 16 nt, Haemophilus influenzae Rd
uagaauuauuuaaacu

SEQ ID NO: 2729760 - RNA, 20 nt, Haemophilus influenzae Rd
uagaauuuauaguuuaaacu

SEQ ID NO: 2729761 - RNA, 23 nt, Haemophilus influenzae Rd
uagaauuuuaccgcacuuuauua

SEQ ID NO: 2729762 - RNA, 14 nt, Haemophilus influenzae Rd
uagaauuuuuauuu

SEQ ID NO: 2729763 - RNA, 19 nt, Haemophilus influenzae Rd
uagaauuuuuauuuuuacu

SEQ ID NO: 2729764 - RNA, 16 nt, Haemophilus influenzae Rd
uagacaacuaacauuu

SEQ ID NO: 2729765 - RNA, 15 nt, Haemophilus influenzae Rd
uagacaauauugaaa

SEQ ID NO: 2729766 - RNA, 22 nt, Haemophilus influenzae Rd
uagacacaagggauuuaaaauc

SEQ ID NO: 2729767 - RNA, 23 nt, Haemophilus influenzae Rd
uagacacaagggauuuaaaaucc

SEQ ID NO: 2729768 - RNA, 21 nt, Haemophilus influenzae Rd
uagacauagaaaguuuaacuu

SEQ ID NO: 2729769 - RNA, 15 nt, Haemophilus influenzae Rd
uagacauuguuugau

SEQ ID NO: 2729770 - RNA, 17 nt, Haemophilus influenzae Rd
uagaccgcuauuuuuaa

SEQ ID NO: 2729771 - RNA, 15 nt, Haemophilus influenzae Rd
uagacgauugccuuu

SEQ ID NO: 2729772 - RNA, 15 nt, Haemophilus influenzae Rd
uagacuaugaaauca

SEQ ID NO: 2729773 - RNA, 17 nt, Haemophilus influenzae Rd
uagacuaugaaaucaag

SEQ ID NO: 2729774 - RNA, 18 nt, Haemophilus influenzae Rd
uagacucguuuuuuauuu

SEQ ID NO: 2729775 - RNA, 23 nt, Haemophilus influenzae Rd
uagacuuaauuucacauuaugau

SEQ ID NO: 2729776 - RNA, 21 nt, Haemophilus influenzae Rd
uagagacaaacaacguaaaag

SEQ ID NO: 2729777 - RNA, 13 nt, Haemophilus influenzae Rd
uagagagaaaaau

SEQ ID NO: 2729778 - RNA, 17 nt, Haemophilus influenzae Rd
uagagauuguaugaaaa

SEQ ID NO: 2729779 - RNA, 24 nt, Haemophilus influenzae Rd
uagagauuguaugaaaaaugcuug

SEQ ID NO: 2729780 - RNA, 20 nt, Haemophilus influenzae Rd
uagagcaagcaauauaauca

SEQ ID NO: 2729781 - RNA, 19 nt, Haemophilus influenzae Rd
uagagcaggggauugaaaa

SEQ ID NO: 2729782 - RNA, 23 nt, Haemophilus influenzae Rd
uagagcgauggcaguuuggaaag

SEQ ID NO: 2729783 - RNA, 12 nt, Haemophilus influenzae Rd
uagagcuugccu

SEQ ID NO: 2729784 - RNA, 23 nt, Haemophilus influenzae Rd
uagaggcugaagccauuuuaugc

SEQ ID NO: 2729785 - RNA, 21 nt, Haemophilus influenzae Rd
uagauaaaaagugcgguaaau

SEQ ID NO: 2729786 - RNA, 15 nt, Haemophilus influenzae Rd
uagauaaaauuaauc

SEQ ID NO: 2729787 - RNA, 23 nt, Haemophilus influenzae Rd
uagauaaaauuaaucauaaaaau

SEQ ID NO: 2729788 - RNA, 20 nt, Haemophilus influenzae Rd
uagauaaacgcuguuuugcu

SEQ ID NO: 2729789 - RNA, 19 nt, Haemophilus influenzae Rd
uagauaaaguaguuuuagu

SEQ ID NO: 2729790 - RNA, 18 nt, Haemophilus influenzae Rd
uagauaaauuucaauuaa

SEQ ID NO: 2729791 - RNA, 19 nt, Haemophilus influenzae Rd
uagauaacguucauauugu

SEQ ID NO: 2729792 - RNA, 21 nt, Haemophilus influenzae Rd
uagauaacguucauauuguuu

SEQ ID NO: 2729793 - RNA, 13 nt, Haemophilus influenzae Rd
uagauaacuucuu

SEQ ID NO: 2729794 - RNA, 16 nt, Haemophilus influenzae Rd
uagauaauaaaaaaac

SEQ ID NO: 2729795 - RNA, 15 nt, Haemophilus influenzae Rd
uagauaauaaaaugg

SEQ ID NO: 2729796 - RNA, 23 nt, Haemophilus influenzae Rd
uagauaauacagaaauaugaaau

SEQ ID NO: 2729797 - RNA, 16 nt, Haemophilus influenzae Rd
uagauacaaaauguuu

SEQ ID NO: 2729798 - RNA, 12 nt, Haemophilus influenzae Rd
uagauacaaaga

SEQ ID NO: 2729799 - RNA, 18 nt, Haemophilus influenzae Rd
uagauacaagaaagaaau

SEQ ID NO: 2729800 - RNA, 17 nt, Haemophilus influenzae Rd
uagauacauaaaaaaca

SEQ ID NO: 2729801 - RNA, 23 nt, Haemophilus influenzae Rd
uagauacauaacgccaagguuau

SEQ ID NO: 2729802 - RNA, 21 nt, Haemophilus influenzae Rd
uagauagaagauuuaaaacaa

SEQ ID NO: 2729803 - RNA, 23 nt, Haemophilus influenzae Rd
uagauagaagauuuaaaacaaga

SEQ ID NO: 2729804 - RNA, 22 nt, Haemophilus influenzae Rd
uagauagggauuuuuacuaaau

SEQ ID NO: 2729805 - RNA, 13 nt, Haemophilus influenzae Rd
uagauauaaaaac

SEQ ID NO: 2729806 - RNA, 18 nt, Haemophilus influenzae Rd
uagauaugugaauaaaau

SEQ ID NO: 2729807 - RNA, 20 nt, Haemophilus influenzae Rd
uagauauuauuuauuuugaa

SEQ ID NO: 2729808 - RNA, 14 nt, Haemophilus influenzae Rd
uagauauuguucua

SEQ ID NO: 2729809 - RNA, 23 nt, Haemophilus influenzae Rd
uagauauuguucuacugguuuuu

SEQ ID NO: 2729810 - RNA, 23 nt, Haemophilus influenzae Rd
uagaucacaguugugaaaaaacg

SEQ ID NO: 2729811 - RNA, 21 nt, Haemophilus influenzae Rd
uagaucagccccuuaauuauu

SEQ ID NO: 2729812 - RNA, 19 nt, Haemophilus influenzae Rd
uagaucauaaaaaaaugua

SEQ ID NO: 2729813 - RNA, 15 nt, Haemophilus influenzae Rd
uagaucgauuuuccu

SEQ ID NO: 2729814 - RNA, 21 nt, Haemophilus influenzae Rd
uagaucgauuuuccucuuuua

SEQ ID NO: 2729815 - RNA, 14 nt, Haemophilus influenzae Rd
uagaugaaauuuau

SEQ ID NO: 2729816 - RNA, 20 nt, Haemophilus influenzae Rd
uagaugaaauuuauuauaaa

SEQ ID NO: 2729817 - RNA, 22 nt, Haemophilus influenzae Rd
uagaugaaauuuauuauaaaaa

SEQ ID NO: 2729818 - RNA, 16 nt, Haemophilus influenzae Rd
uagaugaagugaacuu

SEQ ID NO: 2729819 - RNA, 18 nt, Haemophilus influenzae Rd
uagaugaauuagaaaaau

SEQ ID NO: 2729820 - RNA, 14 nt, Haemophilus influenzae Rd
uagaugauuuuaaa

SEQ ID NO: 2729821 - RNA, 19 nt, Haemophilus influenzae Rd
uagaugauuuuaaaauaaa

SEQ ID NO: 2729822 - RNA, 19 nt, Haemophilus influenzae Rd
uagauguaacugaaacuaa

SEQ ID NO: 2729823 - RNA, 16 nt, Haemophilus influenzae Rd
uagauuacgcuuuacu

SEQ ID NO: 2729824 - RNA, 22 nt, Haemophilus influenzae Rd
uagauuacuuuuagauaaauuu

SEQ ID NO: 2729825 - RNA, 19 nt, Haemophilus influenzae Rd
uagauucggcuaaaacaga

SEQ ID NO: 2729826 - RNA, 17 nt, Haemophilus influenzae Rd
uagauucuaagguugcu

SEQ ID NO: 2729827 - RNA, 15 nt, Haemophilus influenzae Rd
uagauugaaaaguaa

SEQ ID NO: 2729828 - RNA, 19 nt, Haemophilus influenzae Rd
uagauuggauggagagaau

SEQ ID NO: 2729829 - RNA, 13 nt, Haemophilus influenzae Rd
uagauuuaaacaa

SEQ ID NO: 2729830 - RNA, 20 nt, Haemophilus influenzae Rd
uagauuuaagcaauaaacaa

SEQ ID NO: 2729831 - RNA, 22 nt, Haemophilus influenzae Rd
uagauuuaagcuuauuucacuu

SEQ ID NO: 2729832 - RNA, 16 nt, Haemophilus influenzae Rd
uagauuuaauaucuuc

SEQ ID NO: 2729833 - RNA, 21 nt, Haemophilus influenzae Rd
uagauuuaauaucuucuaaua

SEQ ID NO: 2729834 - RNA, 22 nt, Haemophilus influenzae Rd
uagauuuauuuacugauuuaaa

SEQ ID NO: 2729835 - RNA, 19 nt, Haemophilus influenzae Rd
uagauuucuguuaaaucua

SEQ ID NO: 2729836 - RNA, 17 nt, Haemophilus influenzae Rd
uagauuugaaccuucac

SEQ ID NO: 2729837 - RNA, 18 nt, Haemophilus influenzae Rd
uagauuugaaucaauuag

SEQ ID NO: 2729838 - RNA, 13 nt, Haemophilus influenzae Rd
uagauuugacuuc

SEQ ID NO: 2729839 - RNA, 13 nt, Haemophilus influenzae Rd
uagauuugugaac

SEQ ID NO: 2729840 - RNA, 21 nt, Haemophilus influenzae Rd
uagauuuucaucguuaauuaa

SEQ ID NO: 2729841 - RNA, 21 nt, Haemophilus influenzae Rd
uagauuuucuucaucauacaa

SEQ ID NO: 2729842 - RNA, 14 nt, Haemophilus influenzae Rd
uagauuuuuauuca

SEQ ID NO: 2729843 - RNA, 17 nt, Haemophilus influenzae Rd
uagcaaagaauuaaaau

SEQ ID NO: 2729844 - RNA, 17 nt, Haemophilus influenzae Rd
uagcaacaccaccagcg

SEQ ID NO: 2729845 - RNA, 19 nt, Haemophilus influenzae Rd
uagcaagaacaauuaauac

SEQ ID NO: 2729846 - RNA, 20 nt, Haemophilus influenzae Rd
uagcaaggcguucaauauua

SEQ ID NO: 2729847 - RNA, 23 nt, Haemophilus influenzae Rd
uagcaauaauggcgguaaaaaag

SEQ ID NO: 2729848 - RNA, 20 nt, Haemophilus influenzae Rd
uagcaauaucugcuaauacu

SEQ ID NO: 2729849 - RNA, 12 nt, Haemophilus influenzae Rd
uagcaaucaauu

SEQ ID NO: 2729850 - RNA, 14 nt, Haemophilus influenzae Rd
uagcacauaaagac

SEQ ID NO: 2729851 - RNA, 18 nt, Haemophilus influenzae Rd
uagcauaaaacaguauuu

SEQ ID NO: 2729852 - RNA, 20 nt, Haemophilus influenzae Rd
uagcauaaaacaguauuuuc

SEQ ID NO: 2729853 - RNA, 15 nt, Haemophilus influenzae Rd
uagcauaaaauuaac

SEQ ID NO: 2729854 - RNA, 18 nt, Haemophilus influenzae Rd
uagcauaaguuaauucac

SEQ ID NO: 2729855 - RNA, 13 nt, Haemophilus influenzae Rd
uagcauaauaaaa

SEQ ID NO: 2729856 - RNA, 12 nt, Haemophilus influenzae Rd
uagcauagauau

SEQ ID NO: 2729857 - RNA, 16 nt, Haemophilus influenzae Rd
uagcauagauauauug

SEQ ID NO: 2729858 - RNA, 16 nt, Haemophilus influenzae Rd
uagcaucaaaauaaau

SEQ ID NO: 2729859 - RNA, 17 nt, Haemophilus influenzae Rd
uagcaucaaaauaaaua

SEQ ID NO: 2729860 - RNA, 15 nt, Haemophilus influenzae Rd
uagcaucugauuuuc

SEQ ID NO: 2729861 - RNA, 23 nt, Haemophilus influenzae Rd
uagcauucccacgguuccaagca

SEQ ID NO: 2729862 - RNA, 21 nt, Haemophilus influenzae Rd
uagcauuuaaauauuaucuuc

SEQ ID NO: 2729863 - RNA, 18 nt, Haemophilus influenzae Rd
uagccaaaacgaauagaa

SEQ ID NO: 2729864 - RNA, 22 nt, Haemophilus influenzae Rd
uagccaaaacgaauagaaauag

SEQ ID NO: 2729865 - RNA, 19 nt, Haemophilus influenzae Rd
uagccaaggauuugacaua

SEQ ID NO: 2729866 - RNA, 17 nt, Haemophilus influenzae Rd
uagccaauaauaaagcu

SEQ ID NO: 2729867 - RNA, 14 nt, Haemophilus influenzae Rd
uagccaauuuuguc

SEQ ID NO: 2729868 - RNA, 15 nt, Haemophilus influenzae Rd
uagccauaaauaaau

SEQ ID NO: 2729869 - RNA, 12 nt, Haemophilus influenzae Rd
uagccauugcac

SEQ ID NO: 2729870 - RNA, 22 nt, Haemophilus influenzae Rd
uagcccauaauuaaacagcaca

SEQ ID NO: 2729871 - RNA, 16 nt, Haemophilus influenzae Rd
uagcccgaaaauuaag

SEQ ID NO: 2729872 - RNA, 23 nt, Haemophilus influenzae Rd
uagcccgccuaauauuucuuuuu

SEQ ID NO: 2729873 - RNA, 16 nt, Haemophilus influenzae Rd
uagccguccauuucaa

SEQ ID NO: 2729874 - RNA, 20 nt, Haemophilus influenzae Rd
uagccguccauuucaaucac

SEQ ID NO: 2729875 - RNA, 23 nt, Haemophilus influenzae Rd
uagccuaagauuuuaucuaacuc

SEQ ID NO: 2729876 - RNA, 15 nt, Haemophilus influenzae Rd
uagccuaguauuuuu

SEQ ID NO: 2729877 - RNA, 18 nt, Haemophilus influenzae Rd
uagccuagugcuaaaaua

SEQ ID NO: 2729878 - RNA, 17 nt, Haemophilus influenzae Rd
uagccucuucuuuugau

SEQ ID NO: 2729879 - RNA, 18 nt, Haemophilus influenzae Rd
uagccuggcacuaagaaa

SEQ ID NO: 2729880 - RNA, 14 nt, Haemophilus influenzae Rd
uagccuguucuucc

SEQ ID NO: 2729881 - RNA, 21 nt, Haemophilus influenzae Rd
uagccuguuucacaaguucuu

SEQ ID NO: 2729882 - RNA, 16 nt, Haemophilus influenzae Rd
uagcgaagcguaaaag

SEQ ID NO: 2729883 - RNA, 15 nt, Haemophilus influenzae Rd
uagcgaguauaagca

SEQ ID NO: 2729884 - RNA, 15 nt, Haemophilus influenzae Rd
uagcgauaaaauaua

SEQ ID NO: 2729885 - RNA, 18 nt, Haemophilus influenzae Rd
uagcgauccuaaaaaacc

SEQ ID NO: 2729886 - RNA, 13 nt, Haemophilus influenzae Rd
uagcgcaaucaac

SEQ ID NO: 2729887 - RNA, 21 nt, Haemophilus influenzae Rd
uagcguaguauggcaagugca

SEQ ID NO: 2729888 - RNA, 13 nt, Haemophilus influenzae Rd
uagcguauuuugu

SEQ ID NO: 2729889 - RNA, 21 nt, Haemophilus influenzae Rd
uagcguccuacuacagcccaa

SEQ ID NO: 2729890 - RNA, 15 nt, Haemophilus influenzae Rd
uagcgucuuuuugca

SEQ ID NO: 2729891 - RNA, 16 nt, Haemophilus influenzae Rd
uagcgucuuuuugcac

SEQ ID NO: 2729892 - RNA, 14 nt, Haemophilus influenzae Rd
uagcuaaaaauaau

SEQ ID NO: 2729893 - RNA, 17 nt, Haemophilus influenzae Rd
uagcuaaauacuugcuu

SEQ ID NO: 2729894 - RNA, 14 nt, Haemophilus influenzae Rd
uagcuauuuuucaa

SEQ ID NO: 2729895 - RNA, 16 nt, Haemophilus influenzae Rd
uagcuauuuuucaaua

SEQ ID NO: 2729896 - RNA, 18 nt, Haemophilus influenzae Rd
uagcucucguuguucuuu

SEQ ID NO: 2729897 - RNA, 16 nt, Haemophilus influenzae Rd
uagcucucuuuuuaug

SEQ ID NO: 2729898 - RNA, 22 nt, Haemophilus influenzae Rd
uagcugaaaaauaaaaaauauu

SEQ ID NO: 2729899 - RNA, 21 nt, Haemophilus influenzae Rd
uagcugaaaucccuuagaaaa

SEQ ID NO: 2729900 - RNA, 17 nt, Haemophilus influenzae Rd
uagcugauaauaaagcu

SEQ ID NO: 2729901 - RNA, 17 nt, Haemophilus influenzae Rd
uagcugauuuuuuaaag

SEQ ID NO: 2729902 - RNA, 22 nt, Haemophilus influenzae Rd
uagcugccgaauagauuuaaac

SEQ ID NO: 2729903 - RNA, 18 nt, Haemophilus influenzae Rd
uagcugucucauuuugcu

SEQ ID NO: 2729904 - RNA, 18 nt, Haemophilus influenzae Rd
uagcugugguaaauaauu

SEQ ID NO: 2729905 - RNA, 20 nt, Haemophilus influenzae Rd
uagcuuaauagagaauaauu

SEQ ID NO: 2729906 - RNA, 17 nt, Haemophilus influenzae Rd
uagcuuaccuuaauuaa

SEQ ID NO: 2729907 - RNA, 21 nt, Haemophilus influenzae Rd
uagcuuaccuuaauuaaucuu

SEQ ID NO: 2729908 - RNA, 18 nt, Haemophilus influenzae Rd
uagcuucaagcugcauuu

SEQ ID NO: 2729909 - RNA, 17 nt, Haemophilus influenzae Rd
uagcuucaucuucauca

SEQ ID NO: 2729910 - RNA, 14 nt, Haemophilus influenzae Rd
uagcuucugccagc

SEQ ID NO: 2729911 - RNA, 14 nt, Haemophilus influenzae Rd
uagcuugaauauuu

SEQ ID NO: 2729912 - RNA, 16 nt, Haemophilus influenzae Rd
uagcuugaauugcucc

SEQ ID NO: 2729913 - RNA, 18 nt, Haemophilus influenzae Rd
uagcuuuuuaauuguguu

SEQ ID NO: 2729914 - RNA, 24 nt, Haemophilus influenzae Rd
uaggaaguaaauaguuauaagcgu

SEQ ID NO: 2729915 - RNA, 23 nt, Haemophilus influenzae Rd
uaggaauaacacaccaacaacga

SEQ ID NO: 2729916 - RNA, 23 nt, Haemophilus influenzae Rd
uaggaauaucuuugacuaaauca

SEQ ID NO: 2729917 - RNA, 23 nt, Haemophilus influenzae Rd
uaggaauuugaucacgaguaaua

SEQ ID NO: 2729918 - RNA, 15 nt, Haemophilus influenzae Rd
uaggauaaauaaacu

SEQ ID NO: 2729919 - RNA, 15 nt, Haemophilus influenzae Rd
uaggaucguugaaug

SEQ ID NO: 2729920 - RNA, 17 nt, Haemophilus influenzae Rd
uaggaucuauauuuccc

SEQ ID NO: 2729921 - RNA, 20 nt, Haemophilus influenzae Rd
uaggauuagcauaaaauuaa

SEQ ID NO: 2729922 - RNA, 13 nt, Haemophilus influenzae Rd
uaggauuccacuu

SEQ ID NO: 2729923 - RNA, 19 nt, Haemophilus influenzae Rd
uaggauuguugauuuuggu

SEQ ID NO: 2729924 - RNA, 13 nt, Haemophilus influenzae Rd
uaggcaaaaacac

SEQ ID NO: 2729925 - RNA, 22 nt, Haemophilus influenzae Rd
uaggcaaaaacacucucagaau

SEQ ID NO: 2729926 - RNA, 22 nt, Haemophilus influenzae Rd
uaggcgacgcugcaaaaugaac

SEQ ID NO: 2729927 - RNA, 16 nt, Haemophilus influenzae Rd
uaggcgugcguuuuuu

SEQ ID NO: 2729928 - RNA, 14 nt, Haemophilus influenzae Rd
uaggcuaauuauuu

SEQ ID NO: 2729929 - RNA, 20 nt, Haemophilus influenzae Rd
uaggcuauuuuauaauuaau

SEQ ID NO: 2729930 - RNA, 18 nt, Haemophilus influenzae Rd
uaggcugaauacauuaag

SEQ ID NO: 2729931 - RNA, 15 nt, Haemophilus influenzae Rd
uaggcuuaauucuug

SEQ ID NO: 2729932 - RNA, 13 nt, Haemophilus influenzae Rd
uaggcuuaucuac

SEQ ID NO: 2729933 - RNA, 15 nt, Haemophilus influenzae Rd
uagggaauaaaaaag

SEQ ID NO: 2729934 - RNA, 11 nt, Haemophilus influenzae Rd
uagggauuaag

SEQ ID NO: 2729935 - RNA, 20 nt, Haemophilus influenzae Rd
uaggggggaccauuuuucca

SEQ ID NO: 2729936 - RNA, 11 nt, Haemophilus influenzae Rd
uagguaaaaau

SEQ ID NO: 2729937 - RNA, 15 nt, Haemophilus influenzae Rd
uagguaaauuugguu

SEQ ID NO: 2729938 - RNA, 18 nt, Haemophilus influenzae Rd
uagguacguuuuguuuua

SEQ ID NO: 2729939 - RNA, 14 nt, Haemophilus influenzae Rd
uagguaguuuucaa

SEQ ID NO: 2729940 - RNA, 23 nt, Haemophilus influenzae Rd
uagguauuaucgccaucacgcca

SEQ ID NO: 2729941 - RNA, 19 nt, Haemophilus influenzae Rd
uaggugggcuuuagcccac

SEQ ID NO: 2729942 - RNA, 16 nt, Haemophilus influenzae Rd
uagguugcacccacuu

SEQ ID NO: 2729943 - RNA, 13 nt, Haemophilus influenzae Rd
uagguuuuguauu

SEQ ID NO: 2729944 - RNA, 13 nt, Haemophilus influenzae Rd
uaguaaaaaauca

SEQ ID NO: 2729945 - RNA, 14 nt, Haemophilus influenzae Rd
uaguaaaaauuguu

SEQ ID NO: 2729946 - RNA, 15 nt, Haemophilus influenzae Rd
uaguaaaaauuguug

SEQ ID NO: 2729947 - RNA, 12 nt, Haemophilus influenzae Rd
uaguaaagaaau

SEQ ID NO: 2729948 - RNA, 16 nt, Haemophilus influenzae Rd
uaguaaagaauauuuu

SEQ ID NO: 2729949 - RNA, 19 nt, Haemophilus influenzae Rd
uaguaaagaauauuuuaau

SEQ ID NO: 2729950 - RNA, 20 nt, Haemophilus influenzae Rd
uaguaaagaauauuuuaaug

SEQ ID NO: 2729951 - RNA, 18 nt, Haemophilus influenzae Rd
uaguaaaguuuagcuuua

SEQ ID NO: 2729952 - RNA, 12 nt, Haemophilus influenzae Rd
uaguaaauaaca

SEQ ID NO: 2729953 - RNA, 16 nt, Haemophilus influenzae Rd
uaguaaauuuuccaau

SEQ ID NO: 2729954 - RNA, 15 nt, Haemophilus influenzae Rd
uaguaagauuuugac

SEQ ID NO: 2729955 - RNA, 21 nt, Haemophilus influenzae Rd
uaguaagcaccaaaauuuguu

SEQ ID NO: 2729956 - RNA, 22 nt, Haemophilus influenzae Rd
uaguaagcugauucuucauaaa

SEQ ID NO: 2729957 - RNA, 12 nt, Haemophilus influenzae Rd
uaguaaggcacu

SEQ ID NO: 2729958 - RNA, 22 nt, Haemophilus influenzae Rd
uaguaagugguaucaaucggca

SEQ ID NO: 2729959 - RNA, 14 nt, Haemophilus influenzae Rd
uaguaauauagcaa

SEQ ID NO: 2729960 - RNA, 14 nt, Haemophilus influenzae Rd
uaguaauuggcaaa

SEQ ID NO: 2729961 - RNA, 17 nt, Haemophilus influenzae Rd
uaguaauuuuaauucuu

SEQ ID NO: 2729962 - RNA, 20 nt, Haemophilus influenzae Rd
uaguaucagcuguugcaaug

SEQ ID NO: 2729963 - RNA, 19 nt, Haemophilus influenzae Rd
uagucacagaaccuaaugc

SEQ ID NO: 2729964 - RNA, 22 nt, Haemophilus influenzae Rd
uagucacuugugguuauuugau

SEQ ID NO: 2729965 - RNA, 20 nt, Haemophilus influenzae Rd
uagucauacagaaaccagaa

SEQ ID NO: 2729966 - RNA, 15 nt, Haemophilus influenzae Rd
uagucauucaaugca

SEQ ID NO: 2729967 - RNA, 16 nt, Haemophilus influenzae Rd
uaguccuuaauuuaau

SEQ ID NO: 2729968 - RNA, 16 nt, Haemophilus influenzae Rd
uaguccuuaauuuuau

SEQ ID NO: 2729969 - RNA, 15 nt, Haemophilus influenzae Rd
uaguccuuuagaaaa

SEQ ID NO: 2729970 - RNA, 16 nt, Haemophilus influenzae Rd
uagucgucuauuuauu

SEQ ID NO: 2729971 - RNA, 14 nt, Haemophilus influenzae Rd
uagucguuuaacca

SEQ ID NO: 2729972 - RNA, 17 nt, Haemophilus influenzae Rd
uagucuaacuuuuucaa

SEQ ID NO: 2729973 - RNA, 22 nt, Haemophilus influenzae Rd
uagucuacaagaaaccaaaaua

SEQ ID NO: 2729974 - RNA, 20 nt, Haemophilus influenzae Rd
uagucuucccaagauuuuau

SEQ ID NO: 2729975 - RNA, 13 nt, Haemophilus influenzae Rd
uagucuuuuuaau

SEQ ID NO: 2729976 - RNA, 13 nt, Haemophilus influenzae Rd
uagugaaaagaaa

SEQ ID NO: 2729977 - RNA, 16 nt, Haemophilus influenzae Rd
uagugaaugaugccau

SEQ ID NO: 2729978 - RNA, 12 nt, Haemophilus influenzae Rd
uagugauaaaug

SEQ ID NO: 2729979 - RNA, 16 nt, Haemophilus influenzae Rd
uagugaugaugguguu

SEQ ID NO: 2729980 - RNA, 20 nt, Haemophilus influenzae Rd
uagugccaaucaagauaacu

SEQ ID NO: 2729981 - RNA, 16 nt, Haemophilus influenzae Rd
uagugcugcuguuuua

SEQ ID NO: 2729982 - RNA, 23 nt, Haemophilus influenzae Rd
uagugcuguauauuuuuaauuug

SEQ ID NO: 2729983 - RNA, 20 nt, Haemophilus influenzae Rd
uaguggagagcuuagauaca

SEQ ID NO: 2729984 - RNA, 20 nt, Haemophilus influenzae Rd
uaguggcaauccaacagcuu

SEQ ID NO: 2729985 - RNA, 22 nt, Haemophilus influenzae Rd
uaguggugguggaauaaauaac

SEQ ID NO: 2729986 - RNA, 23 nt, Haemophilus influenzae Rd
uaguggugguggaauaaauaaca

SEQ ID NO: 2729987 - RNA, 20 nt, Haemophilus influenzae Rd
uaguuaaaccaaauuuugau

SEQ ID NO: 2729988 - RNA, 18 nt, Haemophilus influenzae Rd
uaguuaaagaaaauauuu

SEQ ID NO: 2729989 - RNA, 19 nt, Haemophilus influenzae Rd
uaguuaaagaaaauauuua

SEQ ID NO: 2729990 - RNA, 12 nt, Haemophilus influenzae Rd
uaguuaaugcag

SEQ ID NO: 2729991 - RNA, 21 nt, Haemophilus influenzae Rd
uaguuacguuuaguaaaauaa

SEQ ID NO: 2729992 - RNA, 16 nt, Haemophilus influenzae Rd
uaguuagaagugaaau

SEQ ID NO: 2729993 - RNA, 18 nt, Haemophilus influenzae Rd
uaguuagaagugaaauau

SEQ ID NO: 2729994 - RNA, 17 nt, Haemophilus influenzae Rd
uaguuagcuaaaaaaac

SEQ ID NO: 2729995 - RNA, 21 nt, Haemophilus influenzae Rd
uaguuagcuaaaaaaacuaga

SEQ ID NO: 2729996 - RNA, 21 nt, Haemophilus influenzae Rd
uaguuauaagcguucuacaau

SEQ ID NO: 2729997 - RNA, 18 nt, Haemophilus influenzae Rd
uaguuauuuauuccuuca

SEQ ID NO: 2729998 - RNA, 17 nt, Haemophilus influenzae Rd
uaguuauuuauuuaaga

SEQ ID NO: 2729999 - RNA, 11 nt, Haemophilus influenzae Rd
uaguucaauuu

SEQ ID NO: 2730000 - RNA, 14 nt, Haemophilus influenzae Rd
uaguucaucaucau

SEQ ID NO: 2730001 - RNA, 19 nt, Haemophilus influenzae Rd
uaguucuucaaauugcaaa

SEQ ID NO: 2730002 - RNA, 20 nt, Haemophilus influenzae Rd
uaguuggaucauuauccaaa

SEQ ID NO: 2730003 - RNA, 19 nt, Haemophilus influenzae Rd
uaguuggguaaucaaauuc

SEQ ID NO: 2730004 - RNA, 19 nt, Haemophilus influenzae Rd
uaguuggguauucacuuaa

SEQ ID NO: 2730005 - RNA, 15 nt, Haemophilus influenzae Rd
uaguugguaaagauu

SEQ ID NO: 2730006 - RNA, 21 nt, Haemophilus influenzae Rd
uaguuguuucaccauuuccuu

SEQ ID NO: 2730007 - RNA, 13 nt, Haemophilus influenzae Rd
uaguuguuuuagu

SEQ ID NO: 2730008 - RNA, 17 nt, Haemophilus influenzae Rd
uaguuuaggaaguaaau

SEQ ID NO: 2730009 - RNA, 13 nt, Haemophilus influenzae Rd
uaguuuauaaaaa

SEQ ID NO: 2730010 - RNA, 17 nt, Haemophilus influenzae Rd
uaguuuauaaaaaaauc

SEQ ID NO: 2730011 - RNA, 18 nt, Haemophilus influenzae Rd
uaguuuauaaaaaaaucu

SEQ ID NO: 2730012 - RNA, 14 nt, Haemophilus influenzae Rd
uaguuuauuaauuu

SEQ ID NO: 2730013 - RNA, 17 nt, Haemophilus influenzae Rd
uaguuuauuaauuugcu

SEQ ID NO: 2730014 - RNA, 18 nt, Haemophilus influenzae Rd
uaguuuccccugaaugcg

SEQ ID NO: 2730015 - RNA, 11 nt, Haemophilus influenzae Rd
uaguuucuaau

SEQ ID NO: 2730016 - RNA, 13 nt, Haemophilus influenzae Rd
uaguuucuaauuc

SEQ ID NO: 2730017 - RNA, 15 nt, Haemophilus influenzae Rd
uaguuucuaauucuu

SEQ ID NO: 2730018 - RNA, 18 nt, Haemophilus influenzae Rd
uaguuucuaauucuucca

SEQ ID NO: 2730019 - RNA, 16 nt, Haemophilus influenzae Rd
uaguuuggcucuucuu

SEQ ID NO: 2730020 - RNA, 17 nt, Haemophilus influenzae Rd
uaguuuggcucuucuuu

SEQ ID NO: 2730021 - RNA, 18 nt, Haemophilus influenzae Rd
uaguuuggcucuucuuua

SEQ ID NO: 2730022 - RNA, 18 nt, Haemophilus influenzae Rd
uaguuuguuucucaaguu

SEQ ID NO: 2730023 - RNA, 20 nt, Haemophilus influenzae Rd
uaguuuuaguaauuuuaauu

SEQ ID NO: 2730024 - RNA, 19 nt, Haemophilus influenzae Rd
uaguuuuauaguuuuuagu

SEQ ID NO: 2730025 - RNA, 20 nt, Haemophilus influenzae Rd
uaguuuuccuuucuuuccga

SEQ ID NO: 2730026 - RNA, 14 nt, Haemophilus influenzae Rd
uaguuuuguauaag

SEQ ID NO: 2730027 - RNA, 13 nt, Haemophilus influenzae Rd
uaguuuuuauuau

SEQ ID NO: 2730028 - RNA, 17 nt, Haemophilus influenzae Rd
uaguuuuucgcugcagc

SEQ ID NO: 2730029 - RNA, 20 nt, Haemophilus influenzae Rd
uaguuuuuuacguaauaagu

SEQ ID NO: 2730030 - RNA, 16 nt, Haemophilus influenzae Rd
uaguuuuuuauuucua

SEQ ID NO: 2730031 - RNA, 22 nt, Haemophilus influenzae Rd
uaguuuuuuuauaaaaaaaucg

SEQ ID NO: 2730032 - RNA, 10 nt, Haemophilus influenzae Rd
uauaaaaaaa

SEQ ID NO: 2730033 - RNA, 12 nt, Haemophilus influenzae Rd
uauaaaaaaaca

SEQ ID NO: 2730034 - RNA, 19 nt, Haemophilus influenzae Rd
uauaaaaaaacuaaaaaca

SEQ ID NO: 2730035 - RNA, 20 nt, Haemophilus influenzae Rd
uauaaaaauauuuuaauaaa

SEQ ID NO: 2730036 - RNA, 19 nt, Haemophilus influenzae Rd
uauaaaaauuauuuucuag

SEQ ID NO: 2730037 - RNA, 20 nt, Haemophilus influenzae Rd
uauaaaaccccguucaauuu

SEQ ID NO: 2730038 - RNA, 13 nt, Haemophilus influenzae Rd
uauaaaauaaaau

SEQ ID NO: 2730039 - RNA, 15 nt, Haemophilus influenzae Rd
uauaaaauaaagaaa

SEQ ID NO: 2730040 - RNA, 15 nt, Haemophilus influenzae Rd
uauaaaauauauaau

SEQ ID NO: 2730041 - RNA, 15 nt, Haemophilus influenzae Rd
uauaaacaauucccc

SEQ ID NO: 2730042 - RNA, 18 nt, Haemophilus influenzae Rd
uauaaaccaguuaaaucc

SEQ ID NO: 2730043 - RNA, 19 nt, Haemophilus influenzae Rd
uauaaacccaucauaaaua

SEQ ID NO: 2730044 - RNA, 21 nt, Haemophilus influenzae Rd
uauaaaccuugcauuucauuu

SEQ ID NO: 2730045 - RNA, 21 nt, Haemophilus influenzae Rd
uauaaacguugugaacuuugu

SEQ ID NO: 2730046 - RNA, 14 nt, Haemophilus influenzae Rd
uauaaacuaucuug

SEQ ID NO: 2730047 - RNA, 15 nt, Haemophilus influenzae Rd
uauaaacugacagaa

SEQ ID NO: 2730048 - RNA, 18 nt, Haemophilus influenzae Rd
uauaaagaguaccacuuu

SEQ ID NO: 2730049 - RNA, 19 nt, Haemophilus influenzae Rd
uauaaagucgguuuuuuca

SEQ ID NO: 2730050 - RNA, 13 nt, Haemophilus influenzae Rd
uauaaauaaaaaa

SEQ ID NO: 2730051 - RNA, 22 nt, Haemophilus influenzae Rd
uauaaauaacaugguuaaaaua

SEQ ID NO: 2730052 - RNA, 12 nt, Haemophilus influenzae Rd
uauaaauaauuu

SEQ ID NO: 2730053 - RNA, 14 nt, Haemophilus influenzae Rd
uauaaauaauuuuc

SEQ ID NO: 2730054 - RNA, 17 nt, Haemophilus influenzae Rd
uauaaauccguaaaaua

SEQ ID NO: 2730055 - RNA, 15 nt, Haemophilus influenzae Rd
uauaaaucuauuccu

SEQ ID NO: 2730056 - RNA, 21 nt, Haemophilus influenzae Rd
uauaaaucuauuccuuucuuu

SEQ ID NO: 2730057 - RNA, 17 nt, Haemophilus influenzae Rd
uauaaaugacauauaau

SEQ ID NO: 2730058 - RNA, 21 nt, Haemophilus influenzae Rd
uauaaaugccgccuuuuaaua

SEQ ID NO: 2730059 - RNA, 20 nt, Haemophilus influenzae Rd
uauaaauggaaaccauugau

SEQ ID NO: 2730060 - RNA, 20 nt, Haemophilus influenzae Rd
uauaaauggguuuuaucuuu

SEQ ID NO: 2730061 - RNA, 19 nt, Haemophilus influenzae Rd
uauaaauuagcuuaauaaa

SEQ ID NO: 2730062 - RNA, 17 nt, Haemophilus influenzae Rd
uauaacaaguuagaugc

SEQ ID NO: 2730063 - RNA, 14 nt, Haemophilus influenzae Rd
uauaacaccaaaca

SEQ ID NO: 2730064 - RNA, 14 nt, Haemophilus influenzae Rd
uauaacauuuauuu

SEQ ID NO: 2730065 - RNA, 17 nt, Haemophilus influenzae Rd
uauaaccacguaauucu

SEQ ID NO: 2730066 - RNA, 19 nt, Haemophilus influenzae Rd
uauaacguuuaaaaauuaa

SEQ ID NO: 2730067 - RNA, 20 nt, Haemophilus influenzae Rd
uauaacguuuaaaaauuaau

SEQ ID NO: 2730068 - RNA, 12 nt, Haemophilus influenzae Rd
uauaacucaaca

SEQ ID NO: 2730069 - RNA, 20 nt, Haemophilus influenzae Rd
uauaacugugugauuuauuu

SEQ ID NO: 2730070 - RNA, 13 nt, Haemophilus influenzae Rd
uauaacuuaaauc

SEQ ID NO: 2730071 - RNA, 19 nt, Haemophilus influenzae Rd
uauaacuuaaaucaacuug

SEQ ID NO: 2730072 - RNA, 21 nt, Haemophilus influenzae Rd
uauaagaaaaguuuuauauuu

SEQ ID NO: 2730073 - RNA, 18 nt, Haemophilus influenzae Rd
uauaagaguuuccuuaua

SEQ ID NO: 2730074 - RNA, 14 nt, Haemophilus influenzae Rd
uauaagauuaauga

SEQ ID NO: 2730075 - RNA, 16 nt, Haemophilus influenzae Rd
uauaagauuuuugcca

SEQ ID NO: 2730076 - RNA, 12 nt, Haemophilus influenzae Rd
uauaagcaaauu

SEQ ID NO: 2730077 - RNA, 17 nt, Haemophilus influenzae Rd
uauaagcuaaagcaauu

SEQ ID NO: 2730078 - RNA, 17 nt, Haemophilus influenzae Rd
uauaagcuauuuacugu

SEQ ID NO: 2730079 - RNA, 19 nt, Haemophilus influenzae Rd
uauaagcuguauuacuuau

SEQ ID NO: 2730080 - RNA, 20 nt, Haemophilus influenzae Rd
uauaagcugugguaaaaaua

SEQ ID NO: 2730081 - RNA, 19 nt, Haemophilus influenzae Rd
uauaagggcgaaauaucgc

SEQ ID NO: 2730082 - RNA, 18 nt, Haemophilus influenzae Rd
uauaagguaguuuuccuu

SEQ ID NO: 2730083 - RNA, 20 nt, Haemophilus influenzae Rd
uauaaguaacuuuagaacau

SEQ ID NO: 2730084 - RNA, 21 nt, Haemophilus influenzae Rd
uauaagugccaacaauaucac

SEQ ID NO: 2730085 - RNA, 16 nt, Haemophilus influenzae Rd
uauaaguucuaaauaa

SEQ ID NO: 2730086 - RNA, 16 nt, Haemophilus influenzae Rd
uauaaguuuuuugcca

SEQ ID NO: 2730087 - RNA, 15 nt, Haemophilus influenzae Rd
uauaauaaauucaau

SEQ ID NO: 2730088 - RNA, 20 nt, Haemophilus influenzae Rd
uauaauacguaaauucaaua

SEQ ID NO: 2730089 - RNA, 15 nt, Haemophilus influenzae Rd
uauaauauuuucuuu

SEQ ID NO: 2730090 - RNA, 19 nt, Haemophilus influenzae Rd
uauaauauuuucuuuuauc

SEQ ID NO: 2730091 - RNA, 15 nt, Haemophilus influenzae Rd
uauaaucaauuauuu

SEQ ID NO: 2730092 - RNA, 16 nt, Haemophilus influenzae Rd
uauaaucaauuucuaa

SEQ ID NO: 2730093 - RNA, 20 nt, Haemophilus influenzae Rd
uauaaucaggaauaaaccac

SEQ ID NO: 2730094 - RNA, 16 nt, Haemophilus influenzae Rd
uauaauccauucagcc

SEQ ID NO: 2730095 - RNA, 15 nt, Haemophilus influenzae Rd
uauaauccguuaauc

SEQ ID NO: 2730096 - RNA, 20 nt, Haemophilus influenzae Rd
uauaaucuccauaauauugu

SEQ ID NO: 2730097 - RNA, 15 nt, Haemophilus influenzae Rd
uauaaucuuuaaaau

SEQ ID NO: 2730098 - RNA, 15 nt, Haemophilus influenzae Rd
uauaaugaauuaugc

SEQ ID NO: 2730099 - RNA, 14 nt, Haemophilus influenzae Rd
uauaauuaaacauu

SEQ ID NO: 2730100 - RNA, 19 nt, Haemophilus influenzae Rd
uauaauuaaacauuuccaa

SEQ ID NO: 2730101 - RNA, 18 nt, Haemophilus influenzae Rd
uauaauuaaaguuacuuu

SEQ ID NO: 2730102 - RNA, 17 nt, Haemophilus influenzae Rd
uauaauuaaauucauuu

SEQ ID NO: 2730103 - RNA, 14 nt, Haemophilus influenzae Rd
uauaauuaauaaaa

SEQ ID NO: 2730104 - RNA, 16 nt, Haemophilus influenzae Rd
uauaauuaauaaaaaa

SEQ ID NO: 2730105 - RNA, 19 nt, Haemophilus influenzae Rd
uauaauuaaucugcaccuu

SEQ ID NO: 2730106 - RNA, 20 nt, Haemophilus influenzae Rd
uauaauuagaucauaaaaaa

SEQ ID NO: 2730107 - RNA, 12 nt, Haemophilus influenzae Rd
uauaauucagca

SEQ ID NO: 2730108 - RNA, 16 nt, Haemophilus influenzae Rd
uauaauuccuaaaaua

SEQ ID NO: 2730109 - RNA, 17 nt, Haemophilus influenzae Rd
uauaauuuaacauaacu

SEQ ID NO: 2730110 - RNA, 12 nt, Haemophilus influenzae Rd
uauaauuuugau

SEQ ID NO: 2730111 - RNA, 23 nt, Haemophilus influenzae Rd
uauacaaaaaagccacuuucaau

SEQ ID NO: 2730112 - RNA, 16 nt, Haemophilus influenzae Rd
uauacaaaacuaaaaa

SEQ ID NO: 2730113 - RNA, 22 nt, Haemophilus influenzae Rd
uauacaaaacuaaaaaaauuca

SEQ ID NO: 2730114 - RNA, 14 nt, Haemophilus influenzae Rd
uauacaaaauugug

SEQ ID NO: 2730115 - RNA, 15 nt, Haemophilus influenzae Rd
uauacaaaauuuugu

SEQ ID NO: 2730116 - RNA, 16 nt, Haemophilus influenzae Rd
uauacagcacuaaaag

SEQ ID NO: 2730117 - RNA, 17 nt, Haemophilus influenzae Rd
uauacaguuagaacaac

SEQ ID NO: 2730118 - RNA, 19 nt, Haemophilus influenzae Rd
uauacaguuagaacaacaa

SEQ ID NO: 2730119 - RNA, 13 nt, Haemophilus influenzae Rd
uauacaguucacg

SEQ ID NO: 2730120 - RNA, 15 nt, Haemophilus influenzae Rd
uauacaucucauaaa

SEQ ID NO: 2730121 - RNA, 13 nt, Haemophilus influenzae Rd
uauaccaaccauu

SEQ ID NO: 2730122 - RNA, 22 nt, Haemophilus influenzae Rd
uauaccauucuuucaauaauuu

SEQ ID NO: 2730123 - RNA, 13 nt, Haemophilus influenzae Rd
uauaccauuugau

SEQ ID NO: 2730124 - RNA, 15 nt, Haemophilus influenzae Rd
uauaccuaucuuauu

SEQ ID NO: 2730125 - RNA, 22 nt, Haemophilus influenzae Rd
uauacgaucacgauuuuucucu

SEQ ID NO: 2730126 - RNA, 20 nt, Haemophilus influenzae Rd
uauacgccaggcucuguaau

SEQ ID NO: 2730127 - RNA, 20 nt, Haemophilus influenzae Rd
uauacgugaaccaacccaau

SEQ ID NO: 2730128 - RNA, 19 nt, Haemophilus influenzae Rd
uauacugcucuuggauuuu

SEQ ID NO: 2730129 - RNA, 15 nt, Haemophilus influenzae Rd
uauacuuaauuucuc

SEQ ID NO: 2730130 - RNA, 14 nt, Haemophilus influenzae Rd
uauacuugccaaaa

SEQ ID NO: 2730131 - RNA, 20 nt, Haemophilus influenzae Rd
uauacuuuuuugauacuaac

SEQ ID NO: 2730132 - RNA, 21 nt, Haemophilus influenzae Rd
uauagaacgguuaugaaaaau

SEQ ID NO: 2730133 - RNA, 13 nt, Haemophilus influenzae Rd
uauagaauuauuu

SEQ ID NO: 2730134 - RNA, 20 nt, Haemophilus influenzae Rd
uauagacuugggggcagcga

SEQ ID NO: 2730135 - RNA, 15 nt, Haemophilus influenzae Rd
uauagagaaauaauc

SEQ ID NO: 2730136 - RNA, 21 nt, Haemophilus influenzae Rd
uauagauaaaauguugaauau

SEQ ID NO: 2730137 - RNA, 23 nt, Haemophilus influenzae Rd
uauagauuuaguccuuaauuuua

SEQ ID NO: 2730138 - RNA, 18 nt, Haemophilus influenzae Rd
uauagccuucgcuauuuu

SEQ ID NO: 2730139 - RNA, 23 nt, Haemophilus influenzae Rd
uauagcuuuaguuuuagggaaga

SEQ ID NO: 2730140 - RNA, 14 nt, Haemophilus influenzae Rd
uauaggaauaucau

SEQ ID NO: 2730141 - RNA, 23 nt, Haemophilus influenzae Rd
uauaggauaagcugcuuaauuaa

SEQ ID NO: 2730142 - RNA, 17 nt, Haemophilus influenzae Rd
uauagggaauaaaaaag

SEQ ID NO: 2730143 - RNA, 20 nt, Haemophilus influenzae Rd
uauagggcaugcacaacaug

SEQ ID NO: 2730144 - RNA, 17 nt, Haemophilus influenzae Rd
uauagucauucaaugca

SEQ ID NO: 2730145 - RNA, 14 nt, Haemophilus influenzae Rd
uauagugaaaaaau

SEQ ID NO: 2730146 - RNA, 15 nt, Haemophilus influenzae Rd
uauagugauuauuua

SEQ ID NO: 2730147 - RNA, 21 nt, Haemophilus influenzae Rd
uauaguggcuuuaaagguuua

SEQ ID NO: 2730148 - RNA, 15 nt, Haemophilus influenzae Rd
uauaguuaaugcagu

SEQ ID NO: 2730149 - RNA, 14 nt, Haemophilus influenzae Rd
uauaguuuaaacuc

SEQ ID NO: 2730150 - RNA, 16 nt, Haemophilus influenzae Rd
uauaguuuuauuuuaa

SEQ ID NO: 2730151 - RNA, 19 nt, Haemophilus influenzae Rd
uauaguuuuauuuuaauuu

SEQ ID NO: 2730152 - RNA, 21 nt, Haemophilus influenzae Rd
uauauaaaaaacccgcuuauu

SEQ ID NO: 2730153 - RNA, 12 nt, Haemophilus influenzae Rd
uauauaaauccg

SEQ ID NO: 2730154 - RNA, 14 nt, Haemophilus influenzae Rd
uauauaaauuuaga

SEQ ID NO: 2730155 - RNA, 19 nt, Haemophilus influenzae Rd
uauauaauuuaacauaacu

SEQ ID NO: 2730156 - RNA, 18 nt, Haemophilus influenzae Rd
uauauacauuaacaaugc

SEQ ID NO: 2730157 - RNA, 16 nt, Haemophilus influenzae Rd
uauauaccuuaacauu

SEQ ID NO: 2730158 - RNA, 13 nt, Haemophilus influenzae Rd
uauauauaaaaua

SEQ ID NO: 2730159 - RNA, 14 nt, Haemophilus influenzae Rd
uauauaucauggca

SEQ ID NO: 2730160 - RNA, 17 nt, Haemophilus influenzae Rd
uauauauccaaaugccu

SEQ ID NO: 2730161 - RNA, 16 nt, Haemophilus influenzae Rd
uauauaugauaaaaau

SEQ ID NO: 2730162 - RNA, 17 nt, Haemophilus influenzae Rd
uauauaugauaaaaaua

SEQ ID NO: 2730163 - RNA, 18 nt, Haemophilus influenzae Rd
uauauaugauaaaaauaa

SEQ ID NO: 2730164 - RNA, 18 nt, Haemophilus influenzae Rd
uauaucacagauuuuuaa

SEQ ID NO: 2730165 - RNA, 22 nt, Haemophilus influenzae Rd
uauaucacagauuuuuaaauca

SEQ ID NO: 2730166 - RNA, 21 nt, Haemophilus influenzae Rd
uauaucacagauuuuuuauua

SEQ ID NO: 2730167 - RNA, 23 nt, Haemophilus influenzae Rd
uauaucagaaaagacaucacugg

SEQ ID NO: 2730168 - RNA, 15 nt, Haemophilus influenzae Rd
uauauccugcacauc

SEQ ID NO: 2730169 - RNA, 17 nt, Haemophilus influenzae Rd
uauaucgaauuaaagaa

SEQ ID NO: 2730170 - RNA, 13 nt, Haemophilus influenzae Rd
uauaucuaaauaa

SEQ ID NO: 2730171 - RNA, 19 nt, Haemophilus influenzae Rd
uauaucuuuauuauuucug

SEQ ID NO: 2730172 - RNA, 14 nt, Haemophilus influenzae Rd
uauaugaaaaauaa

SEQ ID NO: 2730173 - RNA, 21 nt, Haemophilus influenzae Rd
uauaugaguuucagagauuua

SEQ ID NO: 2730174 - RNA, 14 nt, Haemophilus influenzae Rd
uauauuaacuugcu

SEQ ID NO: 2730175 - RNA, 14 nt, Haemophilus influenzae Rd
uauauuauugugau

SEQ ID NO: 2730176 - RNA, 16 nt, Haemophilus influenzae Rd
uauauuccuuauucaa

SEQ ID NO: 2730177 - RNA, 18 nt, Haemophilus influenzae Rd
uauauucuggcaauauuu

SEQ ID NO: 2730178 - RNA, 11 nt, Haemophilus influenzae Rd
uauauucugua

SEQ ID NO: 2730179 - RNA, 17 nt, Haemophilus influenzae Rd
uauauugcauaaucaua

SEQ ID NO: 2730180 - RNA, 16 nt, Haemophilus influenzae Rd
uauauuuacaacugca

SEQ ID NO: 2730181 - RNA, 20 nt, Haemophilus influenzae Rd
uauauuucggcauaauggca

SEQ ID NO: 2730182 - RNA, 11 nt, Haemophilus influenzae Rd
uauauuucuaa

SEQ ID NO: 2730183 - RNA, 12 nt, Haemophilus influenzae Rd
uauauuucuaau

SEQ ID NO: 2730184 - RNA, 21 nt, Haemophilus influenzae Rd
uauauuugaguuauuuuuaau

SEQ ID NO: 2730185 - RNA, 17 nt, Haemophilus influenzae Rd
uauauuuuaucaacuaa

SEQ ID NO: 2730186 - RNA, 14 nt, Haemophilus influenzae Rd
uauauuuugaauaa

SEQ ID NO: 2730187 - RNA, 22 nt, Haemophilus influenzae Rd
uaucaaaaaacgaaauuuuuca

SEQ ID NO: 2730188 - RNA, 13 nt, Haemophilus influenzae Rd
uaucaaaaagaaa

SEQ ID NO: 2730189 - RNA, 13 nt, Haemophilus influenzae Rd
uaucaaaaaguug

SEQ ID NO: 2730190 - RNA, 15 nt, Haemophilus influenzae Rd
uaucaaaacuugcua

SEQ ID NO: 2730191 - RNA, 22 nt, Haemophilus influenzae Rd
uaucaaacaguucaauaaaaau

SEQ ID NO: 2730192 - RNA, 19 nt, Haemophilus influenzae Rd
uaucaacaguaaauuuuuc

SEQ ID NO: 2730193 - RNA, 15 nt, Haemophilus influenzae Rd
uaucaacuaaaucau

SEQ ID NO: 2730194 - RNA, 21 nt, Haemophilus influenzae Rd
uaucaagcacaaucaggcgau

SEQ ID NO: 2730195 - RNA, 21 nt, Haemophilus influenzae Rd
uaucaagcugugcaaaacuag

SEQ ID NO: 2730196 - RNA, 23 nt, Haemophilus influenzae Rd
uaucaauaccaauugaugcacaa

SEQ ID NO: 2730197 - RNA, 13 nt, Haemophilus influenzae Rd
uaucaaucauauc

SEQ ID NO: 2730198 - RNA, 17 nt, Haemophilus influenzae Rd
uaucaaucgguuucaca

SEQ ID NO: 2730199 - RNA, 17 nt, Haemophilus influenzae Rd
uaucaaugaauauaaaa

SEQ ID NO: 2730200 - RNA, 18 nt, Haemophilus influenzae Rd
uaucaaugaauauaaaau

SEQ ID NO: 2730201 - RNA, 21 nt, Haemophilus influenzae Rd
uaucaaugcucucuuuuaauc

SEQ ID NO: 2730202 - RNA, 22 nt, Haemophilus influenzae Rd
uaucaauguuugugcguuuuuu

SEQ ID NO: 2730203 - RNA, 22 nt, Haemophilus influenzae Rd
uaucaauuacguaaucauccac

SEQ ID NO: 2730204 - RNA, 13 nt, Haemophilus influenzae Rd
uaucaauuccuuc

SEQ ID NO: 2730205 - RNA, 15 nt, Haemophilus influenzae Rd
uaucaauuucauuug

SEQ ID NO: 2730206 - RNA, 17 nt, Haemophilus influenzae Rd
uaucaauuucauuugca

SEQ ID NO: 2730207 - RNA, 13 nt, Haemophilus influenzae Rd
uaucaauuugcca

SEQ ID NO: 2730208 - RNA, 15 nt, Haemophilus influenzae Rd
uaucacaaagcacua

SEQ ID NO: 2730209 - RNA, 18 nt, Haemophilus influenzae Rd
uaucacagauuuuuaaau

SEQ ID NO: 2730210 - RNA, 23 nt, Haemophilus influenzae Rd
uaucacauuuuauugaagaguaa

SEQ ID NO: 2730211 - RNA, 19 nt, Haemophilus influenzae Rd
uaucacgaaaaucacgcuc

SEQ ID NO: 2730212 - RNA, 17 nt, Haemophilus influenzae Rd
uaucacgcaccacuuca

SEQ ID NO: 2730213 - RNA, 15 nt, Haemophilus influenzae Rd
uaucacuuaaaccaa

SEQ ID NO: 2730214 - RNA, 22 nt, Haemophilus influenzae Rd
uaucacuuaaaccaaauugauu

SEQ ID NO: 2730215 - RNA, 20 nt, Haemophilus influenzae Rd
uaucacuucuguaagcagcu

SEQ ID NO: 2730216 - RNA, 22 nt, Haemophilus influenzae Rd
uaucacuucuguaagcagcuaa

SEQ ID NO: 2730217 - RNA, 22 nt, Haemophilus influenzae Rd
uaucacuuuguacaccaaaaua

SEQ ID NO: 2730218 - RNA, 13 nt, Haemophilus influenzae Rd
uaucagauuuagg

SEQ ID NO: 2730219 - RNA, 17 nt, Haemophilus influenzae Rd
uaucauaaacaauuuca

SEQ ID NO: 2730220 - RNA, 19 nt, Haemophilus influenzae Rd
uaucauaaacaauuucauu

SEQ ID NO: 2730221 - RNA, 21 nt, Haemophilus influenzae Rd
uaucauaacgggcauuuuucu

SEQ ID NO: 2730222 - RNA, 14 nt, Haemophilus influenzae Rd
uaucauaacuauaa

SEQ ID NO: 2730223 - RNA, 16 nt, Haemophilus influenzae Rd
uaucauaacuauaauu

SEQ ID NO: 2730224 - RNA, 14 nt, Haemophilus influenzae Rd
uaucauacuaaaaa

SEQ ID NO: 2730225 - RNA, 15 nt, Haemophilus influenzae Rd
uaucauacuaaaaaa

SEQ ID NO: 2730226 - RNA, 17 nt, Haemophilus influenzae Rd
uaucauacuaaaaaauu

SEQ ID NO: 2730227 - RNA, 15 nt, Haemophilus influenzae Rd
uaucaucaagauuua

SEQ ID NO: 2730228 - RNA, 15 nt, Haemophilus influenzae Rd
uaucaucauuuuuau

SEQ ID NO: 2730229 - RNA, 22 nt, Haemophilus influenzae Rd
uaucauccgcuuguaauuucau

SEQ ID NO: 2730230 - RNA, 21 nt, Haemophilus influenzae Rd
uaucaucgcguuuauuuuuau

SEQ ID NO: 2730231 - RNA, 13 nt, Haemophilus influenzae Rd
uaucaucuagauu

SEQ ID NO: 2730232 - RNA, 23 nt, Haemophilus influenzae Rd
uaucaucuagauuucuauccauu

SEQ ID NO: 2730233 - RNA, 19 nt, Haemophilus influenzae Rd
uaucaucuguaaaccauuc

SEQ ID NO: 2730234 - RNA, 21 nt, Haemophilus influenzae Rd
uaucauggcacaaaauaauga

SEQ ID NO: 2730235 - RNA, 22 nt, Haemophilus influenzae Rd
uaucauggcgaccauucucuaa

SEQ ID NO: 2730236 - RNA, 20 nt, Haemophilus influenzae Rd
uaucauuaaaacaaagggcu

SEQ ID NO: 2730237 - RNA, 19 nt, Haemophilus influenzae Rd
uaucauuaaucuuauacaa

SEQ ID NO: 2730238 - RNA, 20 nt, Haemophilus influenzae Rd
uaucauuacccgucacugca

SEQ ID NO: 2730239 - RNA, 22 nt, Haemophilus influenzae Rd
uaucauuuaacggggauuuuuu

SEQ ID NO: 2730240 - RNA, 18 nt, Haemophilus influenzae Rd
uaucauuugaauuaauaa

SEQ ID NO: 2730241 - RNA, 14 nt, Haemophilus influenzae Rd
uauccaaaauuaaa

SEQ ID NO: 2730242 - RNA, 22 nt, Haemophilus influenzae Rd
uauccaaaauuaaauugaaaaa

SEQ ID NO: 2730243 - RNA, 16 nt, Haemophilus influenzae Rd
uauccaacauuaauaa

SEQ ID NO: 2730244 - RNA, 14 nt, Haemophilus influenzae Rd
uauccaccagcaca

SEQ ID NO: 2730245 - RNA, 12 nt, Haemophilus influenzae Rd
uauccacuucau

SEQ ID NO: 2730246 - RNA, 14 nt, Haemophilus influenzae Rd
uauccagugccauu

SEQ ID NO: 2730247 - RNA, 21 nt, Haemophilus influenzae Rd
uauccagugccauuuggucua

SEQ ID NO: 2730248 - RNA, 15 nt, Haemophilus influenzae Rd
uauccaucaagaaag

SEQ ID NO: 2730249 - RNA, 17 nt, Haemophilus influenzae Rd
uauccauccagaaaauu

SEQ ID NO: 2730250 - RNA, 18 nt, Haemophilus influenzae Rd
uauccauuucuaaaggca

SEQ ID NO: 2730251 - RNA, 14 nt, Haemophilus influenzae Rd
uaucccaaauuaaa

SEQ ID NO: 2730252 - RNA, 14 nt, Haemophilus influenzae Rd
uauccgagagaaag

SEQ ID NO: 2730253 - RNA, 18 nt, Haemophilus influenzae Rd
uauccgagcucuuucauu

SEQ ID NO: 2730254 - RNA, 15 nt, Haemophilus influenzae Rd
uauccuauaaaacaa

SEQ ID NO: 2730255 - RNA, 17 nt, Haemophilus influenzae Rd
uauccuauuaauuuaau

SEQ ID NO: 2730256 - RNA, 20 nt, Haemophilus influenzae Rd
uaucgaggacaaucugcugu

SEQ ID NO: 2730257 - RNA, 17 nt, Haemophilus influenzae Rd
uaucgagguuuucguau

SEQ ID NO: 2730258 - RNA, 12 nt, Haemophilus influenzae Rd
uaucgcaaucaa

SEQ ID NO: 2730259 - RNA, 13 nt, Haemophilus influenzae Rd
uaucgcaaucacg

SEQ ID NO: 2730260 - RNA, 14 nt, Haemophilus influenzae Rd
uaucgcaaucacga

SEQ ID NO: 2730261 - RNA, 16 nt, Haemophilus influenzae Rd
uaucgcacuuuuuuca

SEQ ID NO: 2730262 - RNA, 12 nt, Haemophilus influenzae Rd
uaucgccaauaa

SEQ ID NO: 2730263 - RNA, 15 nt, Haemophilus influenzae Rd
uaucgcccauucuac

SEQ ID NO: 2730264 - RNA, 14 nt, Haemophilus influenzae Rd
uaucgcccgcuuua

SEQ ID NO: 2730265 - RNA, 23 nt, Haemophilus influenzae Rd
uaucgcucaauaaggugcuaauu

SEQ ID NO: 2730266 - RNA, 13 nt, Haemophilus influenzae Rd
uaucggauucuga

SEQ ID NO: 2730267 - RNA, 22 nt, Haemophilus influenzae Rd
uaucggcaaucaauucaucuug

SEQ ID NO: 2730268 - RNA, 17 nt, Haemophilus influenzae Rd
uaucgguuggauuuuaa

SEQ ID NO: 2730269 - RNA, 14 nt, Haemophilus influenzae Rd
uaucguaaaaaauu

SEQ ID NO: 2730270 - RNA, 15 nt, Haemophilus influenzae Rd
uaucguagguuuuuu

SEQ ID NO: 2730271 - RNA, 14 nt, Haemophilus influenzae Rd
uaucgucuaucuaa

SEQ ID NO: 2730272 - RNA, 23 nt, Haemophilus influenzae Rd
uaucguguaaaaguuguuuugcu

SEQ ID NO: 2730273 - RNA, 18 nt, Haemophilus influenzae Rd
uaucuaaaauauaacauu

SEQ ID NO: 2730274 - RNA, 16 nt, Haemophilus influenzae Rd
uaucuaaacuucaauu

SEQ ID NO: 2730275 - RNA, 17 nt, Haemophilus influenzae Rd
uaucuaaauauauuuuu

SEQ ID NO: 2730276 - RNA, 22 nt, Haemophilus influenzae Rd
uaucuaaauuacauuuuuucua

SEQ ID NO: 2730277 - RNA, 14 nt, Haemophilus influenzae Rd
uaucuaaauuugcu

SEQ ID NO: 2730278 - RNA, 18 nt, Haemophilus influenzae Rd
uaucuaacucuuggcuaa

SEQ ID NO: 2730279 - RNA, 15 nt, Haemophilus influenzae Rd
uaucuaagauaaauu

SEQ ID NO: 2730280 - RNA, 16 nt, Haemophilus influenzae Rd
uaucuaagauaaauuu

SEQ ID NO: 2730281 - RNA, 19 nt, Haemophilus influenzae Rd
uaucuaagauaaauuuaaa

SEQ ID NO: 2730282 - RNA, 14 nt, Haemophilus influenzae Rd
uaucuaauagauuu

SEQ ID NO: 2730283 - RNA, 22 nt, Haemophilus influenzae Rd
uaucuacaaucaaaaaaucuac

SEQ ID NO: 2730284 - RNA, 19 nt, Haemophilus influenzae Rd
uaucuaccacaucaaauuu

SEQ ID NO: 2730285 - RNA, 21 nt, Haemophilus influenzae Rd
uaucuaccacaucaaauuuau

SEQ ID NO: 2730286 - RNA, 14 nt, Haemophilus influenzae Rd
uaucuagaaaacuc

SEQ ID NO: 2730287 - RNA, 15 nt, Haemophilus influenzae Rd
uaucuagacuuucuu

SEQ ID NO: 2730288 - RNA, 14 nt, Haemophilus influenzae Rd
uaucuauaucuuua

SEQ ID NO: 2730289 - RNA, 17 nt, Haemophilus influenzae Rd
uaucuaugauuucauuu

SEQ ID NO: 2730290 - RNA, 17 nt, Haemophilus influenzae Rd
uaucuauuggauaaauu

SEQ ID NO: 2730291 - RNA, 17 nt, Haemophilus influenzae Rd
uaucuccaagaauauuu

SEQ ID NO: 2730292 - RNA, 18 nt, Haemophilus influenzae Rd
uaucuccaagaauauuuc

SEQ ID NO: 2730293 - RNA, 21 nt, Haemophilus influenzae Rd
uaucucccaaauccccccauu

SEQ ID NO: 2730294 - RNA, 19 nt, Haemophilus influenzae Rd
uaucucgaauaucgacuaa

SEQ ID NO: 2730295 - RNA, 22 nt, Haemophilus influenzae Rd
uaucucgaauaucgacuaauau

SEQ ID NO: 2730296 - RNA, 14 nt, Haemophilus influenzae Rd
uaucucugccaucc

SEQ ID NO: 2730297 - RNA, 13 nt, Haemophilus influenzae Rd
uaucucuuacagu

SEQ ID NO: 2730298 - RNA, 21 nt, Haemophilus influenzae Rd
uaucucuuacaguaccuauau

SEQ ID NO: 2730299 - RNA, 13 nt, Haemophilus influenzae Rd
uaucugaaaauau

SEQ ID NO: 2730300 - RNA, 17 nt, Haemophilus influenzae Rd
uaucugacacuaaccaa

SEQ ID NO: 2730301 - RNA, 23 nt, Haemophilus influenzae Rd
uaucugauccacgguauuuucuu

SEQ ID NO: 2730302 - RNA, 19 nt, Haemophilus influenzae Rd
uaucugauguagcuugaau

SEQ ID NO: 2730303 - RNA, 21 nt, Haemophilus influenzae Rd
uaucugauguagcuugaauau

SEQ ID NO: 2730304 - RNA, 21 nt, Haemophilus influenzae Rd
uaucugauuuaaucauuacuu

SEQ ID NO: 2730305 - RNA, 20 nt, Haemophilus influenzae Rd
uaucuggauguuguaaaaua

SEQ ID NO: 2730306 - RNA, 22 nt, Haemophilus influenzae Rd
uaucuucaaaauaguaaaaauu

SEQ ID NO: 2730307 - RNA, 14 nt, Haemophilus influenzae Rd
uaucuuccacaaca

SEQ ID NO: 2730308 - RNA, 20 nt, Haemophilus influenzae Rd
uaucuuccguuguuuuggau

SEQ ID NO: 2730309 - RNA, 13 nt, Haemophilus influenzae Rd
uaucuuuagcuug

SEQ ID NO: 2730310 - RNA, 21 nt, Haemophilus influenzae Rd
uaucuuugauuuucuuauuaa

SEQ ID NO: 2730311 - RNA, 21 nt, Haemophilus influenzae Rd
uaucuuuuucgauaagauugu

SEQ ID NO: 2730312 - RNA, 15 nt, Haemophilus influenzae Rd
uaugaaaaaggcggc

SEQ ID NO: 2730313 - RNA, 15 nt, Haemophilus influenzae Rd
uaugaaaaauaauca

SEQ ID NO: 2730314 - RNA, 19 nt, Haemophilus influenzae Rd
uaugaaaaauaaucaucua

SEQ ID NO: 2730315 - RNA, 22 nt, Haemophilus influenzae Rd
uaugaaacagcuaaaaaugaau

SEQ ID NO: 2730316 - RNA, 15 nt, Haemophilus influenzae Rd
uaugaaauaaagaaa

SEQ ID NO: 2730317 - RNA, 15 nt, Haemophilus influenzae Rd
uaugaaaucaaggac

SEQ ID NO: 2730318 - RNA, 14 nt, Haemophilus influenzae Rd
uaugaaauugcugu

SEQ ID NO: 2730319 - RNA, 21 nt, Haemophilus influenzae Rd
uaugaaauuuguugauagaaa

SEQ ID NO: 2730320 - RNA, 22 nt, Haemophilus influenzae Rd
uaugaacuuguucgucaccgua

SEQ ID NO: 2730321 - RNA, 22 nt, Haemophilus influenzae Rd
uaugaagaaagaucuucggauu

SEQ ID NO: 2730322 - RNA, 23 nt, Haemophilus influenzae Rd
uaugaauaacuuuaauuuuccaa

SEQ ID NO: 2730323 - RNA, 18 nt, Haemophilus influenzae Rd
uaugaauuaccaauucca

SEQ ID NO: 2730324 - RNA, 17 nt, Haemophilus influenzae Rd
uaugaccaaauacaauu

SEQ ID NO: 2730325 - RNA, 22 nt, Haemophilus influenzae Rd
uaugaccaaauaccacacccuu

SEQ ID NO: 2730326 - RNA, 13 nt, Haemophilus influenzae Rd
uaugacuaauuaa

SEQ ID NO: 2730327 - RNA, 20 nt, Haemophilus influenzae Rd
uaugacuaauuaauuaccug

SEQ ID NO: 2730328 - RNA, 20 nt, Haemophilus influenzae Rd
uaugauaaccaucuauauuu

SEQ ID NO: 2730329 - RNA, 15 nt, Haemophilus influenzae Rd
uaugauauauaaaac

SEQ ID NO: 2730330 - RNA, 14 nt, Haemophilus influenzae Rd
uaugaucuucaauc

SEQ ID NO: 2730331 - RNA, 14 nt, Haemophilus influenzae Rd
uaugauguggcuuu

SEQ ID NO: 2730332 - RNA, 13 nt, Haemophilus influenzae Rd
uaugauuauagau

SEQ ID NO: 2730333 - RNA, 20 nt, Haemophilus influenzae Rd
uaugauucugugcaauauuu

SEQ ID NO: 2730334 - RNA, 19 nt, Haemophilus influenzae Rd
uaugauuuagaacaauauu

SEQ ID NO: 2730335 - RNA, 20 nt, Haemophilus influenzae Rd
uaugauuuagaacaauauuu

SEQ ID NO: 2730336 - RNA, 18 nt, Haemophilus influenzae Rd
uaugauuucuucaaagcu

SEQ ID NO: 2730337 - RNA, 12 nt, Haemophilus influenzae Rd
uaugauuuuaaa

SEQ ID NO: 2730338 - RNA, 19 nt, Haemophilus influenzae Rd
uaugcaaaguauuuuucua

SEQ ID NO: 2730339 - RNA, 13 nt, Haemophilus influenzae Rd
uaugcaaauacau

SEQ ID NO: 2730340 - RNA, 18 nt, Haemophilus influenzae Rd
uaugcaucacuugugcua

SEQ ID NO: 2730341 - RNA, 20 nt, Haemophilus influenzae Rd
uaugcaucagauuuuucgca

SEQ ID NO: 2730342 - RNA, 15 nt, Haemophilus influenzae Rd
uaugccaaggcuccc

SEQ ID NO: 2730343 - RNA, 18 nt, Haemophilus influenzae Rd
uaugccaaucacaaugag

SEQ ID NO: 2730344 - RNA, 16 nt, Haemophilus influenzae Rd
uaugcgcuucaucaaa

SEQ ID NO: 2730345 - RNA, 18 nt, Haemophilus influenzae Rd
uaugcgcuucaucaaauu

SEQ ID NO: 2730346 - RNA, 14 nt, Haemophilus influenzae Rd
uaugcgggcaaaaa

SEQ ID NO: 2730347 - RNA, 20 nt, Haemophilus influenzae Rd
uaugcguugaugcaacauuu

SEQ ID NO: 2730348 - RNA, 13 nt, Haemophilus influenzae Rd
uaugcuuaucauu

SEQ ID NO: 2730349 - RNA, 17 nt, Haemophilus influenzae Rd
uaugcuuucagauaacg

SEQ ID NO: 2730350 - RNA, 19 nt, Haemophilus influenzae Rd
uauggagggggauaacgac

SEQ ID NO: 2730351 - RNA, 23 nt, Haemophilus influenzae Rd
uauggcuugugcuauacaaaauu

SEQ ID NO: 2730352 - RNA, 12 nt, Haemophilus influenzae Rd
uauggggcugua

SEQ ID NO: 2730353 - RNA, 21 nt, Haemophilus influenzae Rd
uauggguguuuaaauuuuuaa

SEQ ID NO: 2730354 - RNA, 17 nt, Haemophilus influenzae Rd
uauggucgguauucaua

SEQ ID NO: 2730355 - RNA, 20 nt, Haemophilus influenzae Rd
uauguaguugugauuuucag

SEQ ID NO: 2730356 - RNA, 19 nt, Haemophilus influenzae Rd
uauguauaauuccuaaaau

SEQ ID NO: 2730357 - RNA, 20 nt, Haemophilus influenzae Rd
uauguauaauuccuaaaaua

SEQ ID NO: 2730358 - RNA, 17 nt, Haemophilus influenzae Rd
uaugugauguaauauua

SEQ ID NO: 2730359 - RNA, 22 nt, Haemophilus influenzae Rd
uauguggaucaugguaauuuaa

SEQ ID NO: 2730360 - RNA, 13 nt, Haemophilus influenzae Rd
uauguuauuaaaa

SEQ ID NO: 2730361 - RNA, 15 nt, Haemophilus influenzae Rd
uauguuauuaaaauu

SEQ ID NO: 2730362 - RNA, 16 nt, Haemophilus influenzae Rd
uauguucaacaaguaa

SEQ ID NO: 2730363 - RNA, 18 nt, Haemophilus influenzae Rd
uauguucaacaaguaaau

SEQ ID NO: 2730364 - RNA, 21 nt, Haemophilus influenzae Rd
uauguuuaccaccgauaaaca

SEQ ID NO: 2730365 - RNA, 18 nt, Haemophilus influenzae Rd
uauguuugcaucaaucau

SEQ ID NO: 2730366 - RNA, 23 nt, Haemophilus influenzae Rd
uauguuugcaucaaucauuaacu

SEQ ID NO: 2730367 - RNA, 20 nt, Haemophilus influenzae Rd
uauguuuugauaaccuauca

SEQ ID NO: 2730368 - RNA, 14 nt, Haemophilus influenzae Rd
uauguuuuguagau

SEQ ID NO: 2730369 - RNA, 13 nt, Haemophilus influenzae Rd
uauuaaaaacuaa

SEQ ID NO: 2730370 - RNA, 18 nt, Haemophilus influenzae Rd
uauuaaaaauauaaccgc

SEQ ID NO: 2730371 - RNA, 13 nt, Haemophilus influenzae Rd
uauuaaaauauuu

SEQ ID NO: 2730372 - RNA, 12 nt, Haemophilus influenzae Rd
uauuaaacaaaa

SEQ ID NO: 2730373 - RNA, 15 nt, Haemophilus influenzae Rd
uauuaaacaaaaacc

SEQ ID NO: 2730374 - RNA, 17 nt, Haemophilus influenzae Rd
uauuaaacaaaaaccau

SEQ ID NO: 2730375 - RNA, 16 nt, Haemophilus influenzae Rd
uauuaaagaaaauaca

SEQ ID NO: 2730376 - RNA, 21 nt, Haemophilus influenzae Rd
uauuaaagaaaauacauaauu

SEQ ID NO: 2730377 - RNA, 17 nt, Haemophilus influenzae Rd
uauuaaagaguuauaaa

SEQ ID NO: 2730378 - RNA, 11 nt, Haemophilus influenzae Rd
uauuaaauacc

SEQ ID NO: 2730379 - RNA, 21 nt, Haemophilus influenzae Rd
uauuaaauagcgaucugcacu

SEQ ID NO: 2730380 - RNA, 16 nt, Haemophilus influenzae Rd
uauuaaauuagacuaa

SEQ ID NO: 2730381 - RNA, 14 nt, Haemophilus influenzae Rd
uauuaaauuuuuaa

SEQ ID NO: 2730382 - RNA, 17 nt, Haemophilus influenzae Rd
uauuaaauuuuuaauuu

SEQ ID NO: 2730383 - RNA, 22 nt, Haemophilus influenzae Rd
uauuaaauuuuuaauuuucucg

SEQ ID NO: 2730384 - RNA, 17 nt, Haemophilus influenzae Rd
uauuaagccauuggaaa

SEQ ID NO: 2730385 - RNA, 18 nt, Haemophilus influenzae Rd
uauuaagcgugcuuugcu

SEQ ID NO: 2730386 - RNA, 18 nt, Haemophilus influenzae Rd
uauuaagguaauauguaa

SEQ ID NO: 2730387 - RNA, 13 nt, Haemophilus influenzae Rd
uauuaaguaaaua

SEQ ID NO: 2730388 - RNA, 20 nt, Haemophilus influenzae Rd
uauuaaguaaauauuuuuua

SEQ ID NO: 2730389 - RNA, 22 nt, Haemophilus influenzae Rd
uauuaaguauagcuuuuugcac

SEQ ID NO: 2730390 - RNA, 18 nt, Haemophilus influenzae Rd
uauuaagucuauuacuaa

SEQ ID NO: 2730391 - RNA, 13 nt, Haemophilus influenzae Rd
uauuaauaaaaau

SEQ ID NO: 2730392 - RNA, 16 nt, Haemophilus influenzae Rd
uauuaaugacaccuuu

SEQ ID NO: 2730393 - RNA, 23 nt, Haemophilus influenzae Rd
uauuaaugcggugcuuuaaguaa

SEQ ID NO: 2730394 - RNA, 20 nt, Haemophilus influenzae Rd
uauuaaugcuguuuaaaucu

SEQ ID NO: 2730395 - RNA, 16 nt, Haemophilus influenzae Rd
uauuaauuauaaaaua

SEQ ID NO: 2730396 - RNA, 17 nt, Haemophilus influenzae Rd
uauuaauuuaauucuaa

SEQ ID NO: 2730397 - RNA, 16 nt, Haemophilus influenzae Rd
uauuaauuuuaucuug

SEQ ID NO: 2730398 - RNA, 13 nt, Haemophilus influenzae Rd
uauuacaaacaaa

SEQ ID NO: 2730399 - RNA, 15 nt, Haemophilus influenzae Rd
uauuacaaacaaaaa

SEQ ID NO: 2730400 - RNA, 14 nt, Haemophilus influenzae Rd
uauuacauuaaaau

SEQ ID NO: 2730401 - RNA, 16 nt, Haemophilus influenzae Rd
uauuacauuaaaauca

SEQ ID NO: 2730402 - RNA, 17 nt, Haemophilus influenzae Rd
uauuaccgcguaaaaau

SEQ ID NO: 2730403 - RNA, 18 nt, Haemophilus influenzae Rd
uauuaccgcguaaaaauu

SEQ ID NO: 2730404 - RNA, 13 nt, Haemophilus influenzae Rd
uauuaccuaacca

SEQ ID NO: 2730405 - RNA, 16 nt, Haemophilus influenzae Rd
uauuaccuaaccaaag

SEQ ID NO: 2730406 - RNA, 21 nt, Haemophilus influenzae Rd
uauuacgauaguaaaaaauca

SEQ ID NO: 2730407 - RNA, 20 nt, Haemophilus influenzae Rd
uauuacgcuguccaauaauu

SEQ ID NO: 2730408 - RNA, 13 nt, Haemophilus influenzae Rd
uauuacuaaaauu

SEQ ID NO: 2730409 - RNA, 14 nt, Haemophilus influenzae Rd
uauuacucuuaauu

SEQ ID NO: 2730410 - RNA, 15 nt, Haemophilus influenzae Rd
uauuacuuaacauca

SEQ ID NO: 2730411 - RNA, 15 nt, Haemophilus influenzae Rd
uauuacuuauaagau

SEQ ID NO: 2730412 - RNA, 21 nt, Haemophilus influenzae Rd
uauuacuuauaagaugacuug

SEQ ID NO: 2730413 - RNA, 14 nt, Haemophilus influenzae Rd
uauuagacaauaaa

SEQ ID NO: 2730414 - RNA, 17 nt, Haemophilus influenzae Rd
uauuaguaaaauaauaa

SEQ ID NO: 2730415 - RNA, 13 nt, Haemophilus influenzae Rd
uauuaguaauaaa

SEQ ID NO: 2730416 - RNA, 19 nt, Haemophilus influenzae Rd
uauuaguauuuaagcugaa

SEQ ID NO: 2730417 - RNA, 20 nt, Haemophilus influenzae Rd
uauuaguuagcuaaaaaaac

SEQ ID NO: 2730418 - RNA, 16 nt, Haemophilus influenzae Rd
uauuaguuaguuuuuu

SEQ ID NO: 2730419 - RNA, 16 nt, Haemophilus influenzae Rd
uauuauaaaaauauuu

SEQ ID NO: 2730420 - RNA, 14 nt, Haemophilus influenzae Rd
uauuaucaauaauu

SEQ ID NO: 2730421 - RNA, 20 nt, Haemophilus influenzae Rd
uauuaucuccaagaauauuu

SEQ ID NO: 2730422 - RNA, 19 nt, Haemophilus influenzae Rd
uauuaugguuuugcuguaa

SEQ ID NO: 2730423 - RNA, 11 nt, Haemophilus influenzae Rd
uauuauuaaaa

SEQ ID NO: 2730424 - RNA, 12 nt, Haemophilus influenzae Rd
uauuauuaagua

SEQ ID NO: 2730425 - RNA, 20 nt, Haemophilus influenzae Rd
uauuauuaaguaauacauuu

SEQ ID NO: 2730426 - RNA, 19 nt, Haemophilus influenzae Rd
uauuauuggcuauugaaaa

SEQ ID NO: 2730427 - RNA, 14 nt, Haemophilus influenzae Rd
uauuauuuccucuu

SEQ ID NO: 2730428 - RNA, 21 nt, Haemophilus influenzae Rd
uauuauuuccucuucuuagau

SEQ ID NO: 2730429 - RNA, 22 nt, Haemophilus influenzae Rd
uauuauuucugacgcauugcag

SEQ ID NO: 2730430 - RNA, 13 nt, Haemophilus influenzae Rd
uauuauuugcaua

SEQ ID NO: 2730431 - RNA, 21 nt, Haemophilus influenzae Rd
uauuauuugcauaguuuucca

SEQ ID NO: 2730432 - RNA, 13 nt, Haemophilus influenzae Rd
uauucaaaacauu

SEQ ID NO: 2730433 - RNA, 19 nt, Haemophilus influenzae Rd
uauucaaaacauuaauuga

SEQ ID NO: 2730434 - RNA, 14 nt, Haemophilus influenzae Rd
uauucaaaauaaaa

SEQ ID NO: 2730435 - RNA, 19 nt, Haemophilus influenzae Rd
uauucaaaauaaaaccauc

SEQ ID NO: 2730436 - RNA, 19 nt, Haemophilus influenzae Rd
uauucaaacucuaauucca

SEQ ID NO: 2730437 - RNA, 14 nt, Haemophilus influenzae Rd
uauucaaauuucau

SEQ ID NO: 2730438 - RNA, 18 nt, Haemophilus influenzae Rd
uauucacucuuauucauu

SEQ ID NO: 2730439 - RNA, 14 nt, Haemophilus influenzae Rd
uauucagcaaaauc

SEQ ID NO: 2730440 - RNA, 15 nt, Haemophilus influenzae Rd
uauucagcaaaauca

SEQ ID NO: 2730441 - RNA, 14 nt, Haemophilus influenzae Rd
uauucaguaaacaa

SEQ ID NO: 2730442 - RNA, 17 nt, Haemophilus influenzae Rd
uauucagugcuuuuuca

SEQ ID NO: 2730443 - RNA, 17 nt, Haemophilus influenzae Rd
uauucauauaauucauu

SEQ ID NO: 2730444 - RNA, 23 nt, Haemophilus influenzae Rd
uauucauauccaaauugagaucu

SEQ ID NO: 2730445 - RNA, 19 nt, Haemophilus influenzae Rd
uauucaugaaucguuuuuu

SEQ ID NO: 2730446 - RNA, 14 nt, Haemophilus influenzae Rd
uauuccaaaaaaua

SEQ ID NO: 2730447 - RNA, 15 nt, Haemophilus influenzae Rd
uauuccaaaaaauaa

SEQ ID NO: 2730448 - RNA, 16 nt, Haemophilus influenzae Rd
uauuccaaauaucuuc

SEQ ID NO: 2730449 - RNA, 20 nt, Haemophilus influenzae Rd
uauuccaacgauuuugcaag

SEQ ID NO: 2730450 - RNA, 14 nt, Haemophilus influenzae Rd
uauuccaagguuuu

SEQ ID NO: 2730451 - RNA, 23 nt, Haemophilus influenzae Rd
uauuccaagguuuuuugcuaugu

SEQ ID NO: 2730452 - RNA, 17 nt, Haemophilus influenzae Rd
uauucccaaauuuuuug

SEQ ID NO: 2730453 - RNA, 18 nt, Haemophilus influenzae Rd
uauucccaaauuuuuugu

SEQ ID NO: 2730454 - RNA, 20 nt, Haemophilus influenzae Rd
uauucccccauuaaaagaag

SEQ ID NO: 2730455 - RNA, 15 nt, Haemophilus influenzae Rd
uauuccuuauucaaa

SEQ ID NO: 2730456 - RNA, 21 nt, Haemophilus influenzae Rd
uauuccuucaaucgcaucauu

SEQ ID NO: 2730457 - RNA, 22 nt, Haemophilus influenzae Rd
uauucgacaggaacauucacac

SEQ ID NO: 2730458 - RNA, 19 nt, Haemophilus influenzae Rd
uauucgcaccuucagccac

SEQ ID NO: 2730459 - RNA, 12 nt, Haemophilus influenzae Rd
uauucgccuuca

SEQ ID NO: 2730460 - RNA, 20 nt, Haemophilus influenzae Rd
uauucgcuuucauaaauuca

SEQ ID NO: 2730461 - RNA, 12 nt, Haemophilus influenzae Rd
uauucggaaaaa

SEQ ID NO: 2730462 - RNA, 22 nt, Haemophilus influenzae Rd
uauucgucuaaucgccaaucua

SEQ ID NO: 2730463 - RNA, 23 nt, Haemophilus influenzae Rd
uauucgucuaaucgccaaucuaa

SEQ ID NO: 2730464 - RNA, 14 nt, Haemophilus influenzae Rd
uauucuaaauuuau

SEQ ID NO: 2730465 - RNA, 14 nt, Haemophilus influenzae Rd
uauucuaacuauau

SEQ ID NO: 2730466 - RNA, 18 nt, Haemophilus influenzae Rd
uauucuaccgcauuuuua

SEQ ID NO: 2730467 - RNA, 20 nt, Haemophilus influenzae Rd
uauucuaccgcauuuuuaau

SEQ ID NO: 2730468 - RNA, 21 nt, Haemophilus influenzae Rd
uauucuaccgcauuuuuaaug

SEQ ID NO: 2730469 - RNA, 14 nt, Haemophilus influenzae Rd
uauucuauuuauaa

SEQ ID NO: 2730470 - RNA, 13 nt, Haemophilus influenzae Rd
uauucucauuuua

SEQ ID NO: 2730471 - RNA, 16 nt, Haemophilus influenzae Rd
uauucuccaaauauaa

SEQ ID NO: 2730472 - RNA, 23 nt, Haemophilus influenzae Rd
uauucuccaaauauaaaauaaaa

SEQ ID NO: 2730473 - RNA, 20 nt, Haemophilus influenzae Rd
uauucucuauuaauuuuaaa

SEQ ID NO: 2730474 - RNA, 14 nt, Haemophilus influenzae Rd
uauucucuguugcu

SEQ ID NO: 2730475 - RNA, 23 nt, Haemophilus influenzae Rd
uauucugaaaccacuaaaaacaa

SEQ ID NO: 2730476 - RNA, 12 nt, Haemophilus influenzae Rd
uauucugcacga

SEQ ID NO: 2730477 - RNA, 16 nt, Haemophilus influenzae Rd
uauucuggcaauauuu

SEQ ID NO: 2730478 - RNA, 15 nt, Haemophilus influenzae Rd
uauucuguaucaauu

SEQ ID NO: 2730479 - RNA, 16 nt, Haemophilus influenzae Rd
uauucuuuaaaacauu

SEQ ID NO: 2730480 - RNA, 17 nt, Haemophilus influenzae Rd
uauucuuuaaagagcaa

SEQ ID NO: 2730481 - RNA, 17 nt, Haemophilus influenzae Rd
uauucuuuaaauauuca

SEQ ID NO: 2730482 - RNA, 13 nt, Haemophilus influenzae Rd
uauucuuuucucc

SEQ ID NO: 2730483 - RNA, 21 nt, Haemophilus influenzae Rd
uauucuuuugaaugugagcca

SEQ ID NO: 2730484 - RNA, 13 nt, Haemophilus influenzae Rd
uauugaaaaguac

SEQ ID NO: 2730485 - RNA, 14 nt, Haemophilus influenzae Rd
uauugaaauaagau

SEQ ID NO: 2730486 - RNA, 12 nt, Haemophilus influenzae Rd
uauugaagaaag

SEQ ID NO: 2730487 - RNA, 11 nt, Haemophilus influenzae Rd
uauugaauaau

SEQ ID NO: 2730488 - RNA, 15 nt, Haemophilus influenzae Rd
uauugauuacccauu

SEQ ID NO: 2730489 - RNA, 21 nt, Haemophilus influenzae Rd
uauugauucaaugcuuccuuc

SEQ ID NO: 2730490 - RNA, 22 nt, Haemophilus influenzae Rd
uauugauucaaugcuuccuuca

SEQ ID NO: 2730491 - RNA, 13 nt, Haemophilus influenzae Rd
uauugauucaauu

SEQ ID NO: 2730492 - RNA, 12 nt, Haemophilus influenzae Rd
uauugauucuaa

SEQ ID NO: 2730493 - RNA, 14 nt, Haemophilus influenzae Rd
uauugauuucucug

SEQ ID NO: 2730494 - RNA, 20 nt, Haemophilus influenzae Rd
uauugauuucucugacguaa

SEQ ID NO: 2730495 - RNA, 18 nt, Haemophilus influenzae Rd
uauugcacaauagcuucc

SEQ ID NO: 2730496 - RNA, 16 nt, Haemophilus influenzae Rd
uauugcacuaauaaau

SEQ ID NO: 2730497 - RNA, 17 nt, Haemophilus influenzae Rd
uauugccaacuuagauu

SEQ ID NO: 2730498 - RNA, 17 nt, Haemophilus influenzae Rd
uauugccauaauaauca

SEQ ID NO: 2730499 - RNA, 22 nt, Haemophilus influenzae Rd
uauugcccgugaguaaaauaua

SEQ ID NO: 2730500 - RNA, 23 nt, Haemophilus influenzae Rd
uauugcccgugaguaaaauauag

SEQ ID NO: 2730501 - RNA, 19 nt, Haemophilus influenzae Rd
uauugccuaauaaaaaaua

SEQ ID NO: 2730502 - RNA, 20 nt, Haemophilus influenzae Rd
uauugccuaauaaaaaauaa

SEQ ID NO: 2730503 - RNA, 15 nt, Haemophilus influenzae Rd
uauugcucucccuug

SEQ ID NO: 2730504 - RNA, 23 nt, Haemophilus influenzae Rd
uauugcugucaaacgaaaaaaau

SEQ ID NO: 2730505 - RNA, 19 nt, Haemophilus influenzae Rd
uauugcuugcauucacaaa

SEQ ID NO: 2730506 - RNA, 16 nt, Haemophilus influenzae Rd
uauuggcaauuuccca

SEQ ID NO: 2730507 - RNA, 23 nt, Haemophilus influenzae Rd
uauugggcggaucgcuuguugua

SEQ ID NO: 2730508 - RNA, 15 nt, Haemophilus influenzae Rd
uauugguuauuuaaa

SEQ ID NO: 2730509 - RNA, 23 nt, Haemophilus influenzae Rd
uauuguacuucuuacguuuaaau

SEQ ID NO: 2730510 - RNA, 18 nt, Haemophilus influenzae Rd
uauuguaguaauaaaaag

SEQ ID NO: 2730511 - RNA, 18 nt, Haemophilus influenzae Rd
uauugugagauaugaaau

SEQ ID NO: 2730512 - RNA, 22 nt, Haemophilus influenzae Rd
uauuguuaaaacgccauucaca

SEQ ID NO: 2730513 - RNA, 16 nt, Haemophilus influenzae Rd
uauuguuauagaaaau

SEQ ID NO: 2730514 - RNA, 22 nt, Haemophilus influenzae Rd
uauuguuggcccaacagaaauc

SEQ ID NO: 2730515 - RNA, 18 nt, Haemophilus influenzae Rd
uauuuaaaccauuuuaau

SEQ ID NO: 2730516 - RNA, 19 nt, Haemophilus influenzae Rd
uauuuaaauacacuucuaa

SEQ ID NO: 2730517 - RNA, 18 nt, Haemophilus influenzae Rd
uauuuaacaaguuuagau

SEQ ID NO: 2730518 - RNA, 13 nt, Haemophilus influenzae Rd
uauuuaacuguau

SEQ ID NO: 2730519 - RNA, 15 nt, Haemophilus influenzae Rd
uauuuaagcuuuccu

SEQ ID NO: 2730520 - RNA, 23 nt, Haemophilus influenzae Rd
uauuuaagcuuuccuauucuaaa

SEQ ID NO: 2730521 - RNA, 22 nt, Haemophilus influenzae Rd
uauuuaaguguuuacuauuaau

SEQ ID NO: 2730522 - RNA, 15 nt, Haemophilus influenzae Rd
uauuuaauaaggcaa

SEQ ID NO: 2730523 - RNA, 16 nt, Haemophilus influenzae Rd
uauuuaauaauaucaa

SEQ ID NO: 2730524 - RNA, 17 nt, Haemophilus influenzae Rd
uauuuaauaauuuaaau

SEQ ID NO: 2730525 - RNA, 21 nt, Haemophilus influenzae Rd
uauuuaauaauuuaaauuuau

SEQ ID NO: 2730526 - RNA, 13 nt, Haemophilus influenzae Rd
uauuuaauacgaa

SEQ ID NO: 2730527 - RNA, 22 nt, Haemophilus influenzae Rd
uauuuaauacgaacuaaaagga

SEQ ID NO: 2730528 - RNA, 22 nt, Haemophilus influenzae Rd
uauuuaauguguagauaaaaua

SEQ ID NO: 2730529 - RNA, 19 nt, Haemophilus influenzae Rd
uauuuaauuucaaaaucac

SEQ ID NO: 2730530 - RNA, 14 nt, Haemophilus influenzae Rd
uauuuacaacugca

SEQ ID NO: 2730531 - RNA, 21 nt, Haemophilus influenzae Rd
uauuuacaagcugaaauugag

SEQ ID NO: 2730532 - RNA, 21 nt, Haemophilus influenzae Rd
uauuuaccgcuuucaauuaau

SEQ ID NO: 2730533 - RNA, 14 nt, Haemophilus influenzae Rd
uauuuacuaaauua

SEQ ID NO: 2730534 - RNA, 18 nt, Haemophilus influenzae Rd
uauuuacucuuuuuuaga

SEQ ID NO: 2730535 - RNA, 18 nt, Haemophilus influenzae Rd
uauuuacugauuuaaaaa

SEQ ID NO: 2730536 - RNA, 19 nt, Haemophilus influenzae Rd
uauuuacuguuuuuauauu

SEQ ID NO: 2730537 - RNA, 22 nt, Haemophilus influenzae Rd
uauuuacuguuuuuauauuuag

SEQ ID NO: 2730538 - RNA, 20 nt, Haemophilus influenzae Rd
uauuuacuuccuaaacuaca

SEQ ID NO: 2730539 - RNA, 16 nt, Haemophilus influenzae Rd
uauuuacuuuauaaau

SEQ ID NO: 2730540 - RNA, 14 nt, Haemophilus influenzae Rd
uauuuagaauuuuu

SEQ ID NO: 2730541 - RNA, 16 nt, Haemophilus influenzae Rd
uauuuagauacaaaau

SEQ ID NO: 2730542 - RNA, 20 nt, Haemophilus influenzae Rd
uauuuaggcuauuuuauaau

SEQ ID NO: 2730543 - RNA, 24 nt, Haemophilus influenzae Rd
uauuuaggcuauuuuauaauuaau

SEQ ID NO: 2730544 - RNA, 15 nt, Haemophilus influenzae Rd
uauuuauaaguaauc

SEQ ID NO: 2730545 - RNA, 21 nt, Haemophilus influenzae Rd
uauuuauaauccauucagccc

SEQ ID NO: 2730546 - RNA, 13 nt, Haemophilus influenzae Rd
uauuuauagcauu

SEQ ID NO: 2730547 - RNA, 15 nt, Haemophilus influenzae Rd
uauuuauauaaagcu

SEQ ID NO: 2730548 - RNA, 12 nt, Haemophilus influenzae Rd
uauuuauauaau

SEQ ID NO: 2730549 - RNA, 13 nt, Haemophilus influenzae Rd
uauuuauauaauu

SEQ ID NO: 2730550 - RNA, 22 nt, Haemophilus influenzae Rd
uauuuauauaauuuaacauaac

SEQ ID NO: 2730551 - RNA, 13 nt, Haemophilus influenzae Rd
uauuuauauuuuu

SEQ ID NO: 2730552 - RNA, 19 nt, Haemophilus influenzae Rd
uauuuauauuuuuguaagg

SEQ ID NO: 2730553 - RNA, 21 nt, Haemophilus influenzae Rd
uauuuauuccaucaauaccua

SEQ ID NO: 2730554 - RNA, 16 nt, Haemophilus influenzae Rd
uauuuauuuaauuucg

SEQ ID NO: 2730555 - RNA, 16 nt, Haemophilus influenzae Rd
uauuuauuucuauaga

SEQ ID NO: 2730556 - RNA, 19 nt, Haemophilus influenzae Rd
uauuuauuucuauagauuu

SEQ ID NO: 2730557 - RNA, 20 nt, Haemophilus influenzae Rd
uauuuauuugaaacaauaaa

SEQ ID NO: 2730558 - RNA, 12 nt, Haemophilus influenzae Rd
uauuuauuugcu

SEQ ID NO: 2730559 - RNA, 15 nt, Haemophilus influenzae Rd
uauuuauuugcuaaa

SEQ ID NO: 2730560 - RNA, 22 nt, Haemophilus influenzae Rd
uauuucacuggcucauuauuca

SEQ ID NO: 2730561 - RNA, 20 nt, Haemophilus influenzae Rd
uauuucacuucuaacuaaaa

SEQ ID NO: 2730562 - RNA, 12 nt, Haemophilus influenzae Rd
uauuucagcuug

SEQ ID NO: 2730563 - RNA, 20 nt, Haemophilus influenzae Rd
uauuucaguaacuuuaauaa

SEQ ID NO: 2730564 - RNA, 14 nt, Haemophilus influenzae Rd
uauuucccucaaaa

SEQ ID NO: 2730565 - RNA, 14 nt, Haemophilus influenzae Rd
uauuuccucuucuu

SEQ ID NO: 2730566 - RNA, 18 nt, Haemophilus influenzae Rd
uauuucgcccuuauacaa

SEQ ID NO: 2730567 - RNA, 21 nt, Haemophilus influenzae Rd
uauuucgcccuuauacaaaac

SEQ ID NO: 2730568 - RNA, 18 nt, Haemophilus influenzae Rd
uauuucgguuucaugauu

SEQ ID NO: 2730569 - RNA, 17 nt, Haemophilus influenzae Rd
uauuucguuguuuuaau

SEQ ID NO: 2730570 - RNA, 15 nt, Haemophilus influenzae Rd
uauuucuauagauuu

SEQ ID NO: 2730571 - RNA, 22 nt, Haemophilus influenzae Rd
uauuucuauagauuuauuuacu

SEQ ID NO: 2730572 - RNA, 21 nt, Haemophilus influenzae Rd
uauuucuauuguuuuuuucua

SEQ ID NO: 2730573 - RNA, 17 nt, Haemophilus influenzae Rd
uauuucucacuucuuua

SEQ ID NO: 2730574 - RNA, 14 nt, Haemophilus influenzae Rd
uauuucucuauaau

SEQ ID NO: 2730575 - RNA, 18 nt, Haemophilus influenzae Rd
uauuucugaagguuuucu

SEQ ID NO: 2730576 - RNA, 21 nt, Haemophilus influenzae Rd
uauuucugcaaauaaagaaga

SEQ ID NO: 2730577 - RNA, 23 nt, Haemophilus influenzae Rd
uauuucuguuacuaaaucgccca

SEQ ID NO: 2730578 - RNA, 12 nt, Haemophilus influenzae Rd
uauuucuucaau

SEQ ID NO: 2730579 - RNA, 23 nt, Haemophilus influenzae Rd
uauuucuuuucaaacacaaaaua

SEQ ID NO: 2730580 - RNA, 23 nt, Haemophilus influenzae Rd
uauuugaaguugccauagacauu

SEQ ID NO: 2730581 - RNA, 21 nt, Haemophilus influenzae Rd
uauuugagaaaaauguuaaua

SEQ ID NO: 2730582 - RNA, 21 nt, Haemophilus influenzae Rd
uauuugagcaagaugaauuaa

SEQ ID NO: 2730583 - RNA, 18 nt, Haemophilus influenzae Rd
uauuugcaaagauauaaa

SEQ ID NO: 2730584 - RNA, 21 nt, Haemophilus influenzae Rd
uauuugcaaagauauaaacug

SEQ ID NO: 2730585 - RNA, 12 nt, Haemophilus influenzae Rd
uauuugcaauaa

SEQ ID NO: 2730586 - RNA, 16 nt, Haemophilus influenzae Rd
uauuugcaauaaaauu

SEQ ID NO: 2730587 - RNA, 19 nt, Haemophilus influenzae Rd
uauuugcaccuuguaacca

SEQ ID NO: 2730588 - RNA, 14 nt, Haemophilus influenzae Rd
uauuugcauauaaa

SEQ ID NO: 2730589 - RNA, 18 nt, Haemophilus influenzae Rd
uauuugcgauaauuugca

SEQ ID NO: 2730590 - RNA, 24 nt, Haemophilus influenzae Rd
uauuugcuaguuuagguuuauguu

SEQ ID NO: 2730591 - RNA, 22 nt, Haemophilus influenzae Rd
uauuugcugcacgaguuugauu

SEQ ID NO: 2730592 - RNA, 19 nt, Haemophilus influenzae Rd
uauuuggaacaguaaauuu

SEQ ID NO: 2730593 - RNA, 21 nt, Haemophilus influenzae Rd
uauuuggaacaguaaauuuaa

SEQ ID NO: 2730594 - RNA, 22 nt, Haemophilus influenzae Rd
uauuuggaauugugcuaaauuu

SEQ ID NO: 2730595 - RNA, 19 nt, Haemophilus influenzae Rd
uauuuggauaacaaauugc

SEQ ID NO: 2730596 - RNA, 11 nt, Haemophilus influenzae Rd
uauuuggcauu

SEQ ID NO: 2730597 - RNA, 18 nt, Haemophilus influenzae Rd
uauuugucggaaaauaau

SEQ ID NO: 2730598 - RNA, 15 nt, Haemophilus influenzae Rd
uauuuguuuuuuagg

SEQ ID NO: 2730599 - RNA, 18 nt, Haemophilus influenzae Rd
uauuuuaaauaaaaaaua

SEQ ID NO: 2730600 - RNA, 19 nt, Haemophilus influenzae Rd
uauuuuaaauaaaaaauaa

SEQ ID NO: 2730601 - RNA, 17 nt, Haemophilus influenzae Rd
uauuuuaaauaaauaau

SEQ ID NO: 2730602 - RNA, 17 nt, Haemophilus influenzae Rd
uauuuuaauaaagauaa

SEQ ID NO: 2730603 - RNA, 18 nt, Haemophilus influenzae Rd
uauuuuaauaacgccuua

SEQ ID NO: 2730604 - RNA, 16 nt, Haemophilus influenzae Rd
uauuuuaaugaaagua

SEQ ID NO: 2730605 - RNA, 21 nt, Haemophilus influenzae Rd
uauuuuaaugcugaguaccaa

SEQ ID NO: 2730606 - RNA, 21 nt, Haemophilus influenzae Rd
uauuuuacggauuuauauauu

SEQ ID NO: 2730607 - RNA, 13 nt, Haemophilus influenzae Rd
uauuuuacuaaac

SEQ ID NO: 2730608 - RNA, 15 nt, Haemophilus influenzae Rd
uauuuuauaauuaau

SEQ ID NO: 2730609 - RNA, 13 nt, Haemophilus influenzae Rd
uauuuuauauauu

SEQ ID NO: 2730610 - RNA, 19 nt, Haemophilus influenzae Rd
uauuuuauauauuaaaaaa

SEQ ID NO: 2730611 - RNA, 19 nt, Haemophilus influenzae Rd
uauuuuaucaacuaaaaaa

SEQ ID NO: 2730612 - RNA, 18 nt, Haemophilus influenzae Rd
uauuuuaugaacucuguu

SEQ ID NO: 2730613 - RNA, 16 nt, Haemophilus influenzae Rd
uauuuuauugccaaua

SEQ ID NO: 2730614 - RNA, 14 nt, Haemophilus influenzae Rd
uauuuuauuugccu

SEQ ID NO: 2730615 - RNA, 20 nt, Haemophilus influenzae Rd
uauuuuccccuuguucuuca

SEQ ID NO: 2730616 - RNA, 22 nt, Haemophilus influenzae Rd
uauuuuccucgacauaaaaaca

SEQ ID NO: 2730617 - RNA, 14 nt, Haemophilus influenzae Rd
uauuuucuaaaaaa

SEQ ID NO: 2730618 - RNA, 18 nt, Haemophilus influenzae Rd
uauuuucuaaugaaauuu

SEQ ID NO: 2730619 - RNA, 14 nt, Haemophilus influenzae Rd
uauuuucuaauuuu

SEQ ID NO: 2730620 - RNA, 15 nt, Haemophilus influenzae Rd
uauuuucuuaauuuu

SEQ ID NO: 2730621 - RNA, 17 nt, Haemophilus influenzae Rd
uauuuucuuaauuuuau

SEQ ID NO: 2730622 - RNA, 20 nt, Haemophilus influenzae Rd
uauuuucuuaauuuuauuaa

SEQ ID NO: 2730623 - RNA, 18 nt, Haemophilus influenzae Rd
uauuuucuuuccaaccag

SEQ ID NO: 2730624 - RNA, 18 nt, Haemophilus influenzae Rd
uauuuugaauaauaaauu

SEQ ID NO: 2730625 - RNA, 21 nt, Haemophilus influenzae Rd
uauuuugauaacgcgccacuu

SEQ ID NO: 2730626 - RNA, 16 nt, Haemophilus influenzae Rd
uauuuugcagaauacu

SEQ ID NO: 2730627 - RNA, 15 nt, Haemophilus influenzae Rd
uauuuugguauuuuu

SEQ ID NO: 2730628 - RNA, 20 nt, Haemophilus influenzae Rd
uauuuuguggaauaucaauu

SEQ ID NO: 2730629 - RNA, 18 nt, Haemophilus influenzae Rd
uauuuuguguauuaagua

SEQ ID NO: 2730630 - RNA, 19 nt, Haemophilus influenzae Rd
uauuuuguguauuaaguaa

SEQ ID NO: 2730631 - RNA, 11 nt, Haemophilus influenzae Rd
uauuuuuacuc

SEQ ID NO: 2730632 - RNA, 14 nt, Haemophilus influenzae Rd
uauuuuuauaaauu

SEQ ID NO: 2730633 - RNA, 12 nt, Haemophilus influenzae Rd
uauuuuuaucaa

SEQ ID NO: 2730634 - RNA, 13 nt, Haemophilus influenzae Rd
uauuuuuaucaua

SEQ ID NO: 2730635 - RNA, 17 nt, Haemophilus influenzae Rd
uauuuuuauuaucaaaa

SEQ ID NO: 2730636 - RNA, 13 nt, Haemophilus influenzae Rd
uauuuuuauuuau

SEQ ID NO: 2730637 - RNA, 21 nt, Haemophilus influenzae Rd
uauuuuucaaggccauauuuu

SEQ ID NO: 2730638 - RNA, 13 nt, Haemophilus influenzae Rd
uauuuuucaauaa

SEQ ID NO: 2730639 - RNA, 18 nt, Haemophilus influenzae Rd
uauuuuuccacuguuauu

SEQ ID NO: 2730640 - RNA, 17 nt, Haemophilus influenzae Rd
uauuuuuccuuuucaua

SEQ ID NO: 2730641 - RNA, 21 nt, Haemophilus influenzae Rd
uauuuuugauauuaagccauu

SEQ ID NO: 2730642 - RNA, 21 nt, Haemophilus influenzae Rd
uauuuuugauccugaucuuuu

SEQ ID NO: 2730643 - RNA, 12 nt, Haemophilus influenzae Rd
uauuuuuuacua

SEQ ID NO: 2730644 - RNA, 21 nt, Haemophilus influenzae Rd
uauuuuuuauccuauuaauuu

SEQ ID NO: 2730645 - RNA, 21 nt, Haemophilus influenzae Rd
uauuuuuuauuacauuaaaau

SEQ ID NO: 2730646 - RNA, 22 nt, Haemophilus influenzae Rd
uauuuuuuauuacccuauucua

SEQ ID NO: 2730647 - RNA, 22 nt, Haemophilus influenzae Rd
uauuuuuucagccuauuuuuag

SEQ ID NO: 2730648 - RNA, 20 nt, Haemophilus influenzae Rd
uauuuuuucgaucuaaucca

SEQ ID NO: 2730649 - RNA, 14 nt, Haemophilus influenzae Rd
uauuuuuuggaaua

SEQ ID NO: 2730650 - RNA, 18 nt, Haemophilus influenzae Rd
uauuuuuuggaauauuau

SEQ ID NO: 2730651 - RNA, 12 nt, Haemophilus influenzae Rd
uauuuuuuuaau

SEQ ID NO: 2730652 - RNA, 13 nt, Haemophilus influenzae Rd
uauuuuuuuaauu

SEQ ID NO: 2730653 - RNA, 22 nt, Haemophilus influenzae Rd
uauuuuuuucuaacaucggcaa

SEQ ID NO: 2730654 - RNA, 21 nt, Haemophilus influenzae Rd
uauuuuuuuugaggcuaaacu

SEQ ID NO: 2730655 - RNA, 15 nt, Haemophilus influenzae Rd
ucaaaaaaauaagug

SEQ ID NO: 2730656 - RNA, 15 nt, Haemophilus influenzae Rd
ucaaaaaaauuuacc

SEQ ID NO: 2730657 - RNA, 17 nt, Haemophilus influenzae Rd
ucaaaaaccgcuuuuau

SEQ ID NO: 2730658 - RNA, 18 nt, Haemophilus influenzae Rd
ucaaaaacggauuuauuu

SEQ ID NO: 2730659 - RNA, 16 nt, Haemophilus influenzae Rd
ucaaaaauaaaaagua

SEQ ID NO: 2730660 - RNA, 16 nt, Haemophilus influenzae Rd
ucaaaaaucaaauuaa

SEQ ID NO: 2730661 - RNA, 19 nt, Haemophilus influenzae Rd
ucaaaaaucaaauuaauuu

SEQ ID NO: 2730662 - RNA, 12 nt, Haemophilus influenzae Rd
ucaaaaaugaaa

SEQ ID NO: 2730663 - RNA, 23 nt, Haemophilus influenzae Rd
ucaaaaaugaaagggaaauaaca

SEQ ID NO: 2730664 - RNA, 11 nt, Haemophilus influenzae Rd
ucaaaaaugcu

SEQ ID NO: 2730665 - RNA, 13 nt, Haemophilus influenzae Rd
ucaaaaauugaua

SEQ ID NO: 2730666 - RNA, 20 nt, Haemophilus influenzae Rd
ucaaaaauugauaccaagau

SEQ ID NO: 2730667 - RNA, 21 nt, Haemophilus influenzae Rd
ucaaaaauuucgcuauuuucu

SEQ ID NO: 2730668 - RNA, 13 nt, Haemophilus influenzae Rd
ucaaaaauuugaa

SEQ ID NO: 2730669 - RNA, 23 nt, Haemophilus influenzae Rd
ucaaaaauuugaauguaaaaaua

SEQ ID NO: 2730670 - RNA, 21 nt, Haemophilus influenzae Rd
ucaaaacaauggcugaaaaau

SEQ ID NO: 2730671 - RNA, 22 nt, Haemophilus influenzae Rd
ucaaaacaguuuucaaauuaac

SEQ ID NO: 2730672 - RNA, 11 nt, Haemophilus influenzae Rd
ucaaaaccaaa

SEQ ID NO: 2730673 - RNA, 19 nt, Haemophilus influenzae Rd
ucaaaacuaucaaaaucaa

SEQ ID NO: 2730674 - RNA, 15 nt, Haemophilus influenzae Rd
ucaaaacuugcuaca

SEQ ID NO: 2730675 - RNA, 20 nt, Haemophilus influenzae Rd
ucaaaacuuggcaauucaaa

SEQ ID NO: 2730676 - RNA, 22 nt, Haemophilus influenzae Rd
ucaaaagaaaagaugaaugaac

SEQ ID NO: 2730677 - RNA, 23 nt, Haemophilus influenzae Rd
ucaaaagaucauuuuuuuaaaua

SEQ ID NO: 2730678 - RNA, 17 nt, Haemophilus influenzae Rd
ucaaaaguauaaacuuu

SEQ ID NO: 2730679 - RNA, 18 nt, Haemophilus influenzae Rd
ucaaaauaaauaaaauau

SEQ ID NO: 2730680 - RNA, 20 nt, Haemophilus influenzae Rd
ucaaaauaaggucagcaaau

SEQ ID NO: 2730681 - RNA, 23 nt, Haemophilus influenzae Rd
ucaaaauaaguaucccaaauuaa

SEQ ID NO: 2730682 - RNA, 18 nt, Haemophilus influenzae Rd
ucaaaaucaaguuaaaaa

SEQ ID NO: 2730683 - RNA, 19 nt, Haemophilus influenzae Rd
ucaaaaucagcaaauuguu

SEQ ID NO: 2730684 - RNA, 17 nt, Haemophilus influenzae Rd
ucaaaaucagcuaauaa

SEQ ID NO: 2730685 - RNA, 15 nt, Haemophilus influenzae Rd
ucaaaauccauaauu

SEQ ID NO: 2730686 - RNA, 21 nt, Haemophilus influenzae Rd
ucaaaaugaaaacuaugcucu

SEQ ID NO: 2730687 - RNA, 21 nt, Haemophilus influenzae Rd
ucaaaauuacgcccuguucca

SEQ ID NO: 2730688 - RNA, 13 nt, Haemophilus influenzae Rd
ucaaaauucaaaa

SEQ ID NO: 2730689 - RNA, 19 nt, Haemophilus influenzae Rd
ucaaaauugaucgaaaaau

SEQ ID NO: 2730690 - RNA, 20 nt, Haemophilus influenzae Rd
ucaaaauugaugaaaauucu

SEQ ID NO: 2730691 - RNA, 18 nt, Haemophilus influenzae Rd
ucaaaauugcuuaaugga

SEQ ID NO: 2730692 - RNA, 12 nt, Haemophilus influenzae Rd
ucaaaauuugug

SEQ ID NO: 2730693 - RNA, 20 nt, Haemophilus influenzae Rd
ucaaacaauacaaauacuga

SEQ ID NO: 2730694 - RNA, 22 nt, Haemophilus influenzae Rd
ucaaacaauaugugcuuggcac

SEQ ID NO: 2730695 - RNA, 19 nt, Haemophilus influenzae Rd
ucaaacacaaaauaagggc

SEQ ID NO: 2730696 - RNA, 13 nt, Haemophilus influenzae Rd
ucaaacacaacau

SEQ ID NO: 2730697 - RNA, 15 nt, Haemophilus influenzae Rd
ucaaacacccaaucu

SEQ ID NO: 2730698 - RNA, 12 nt, Haemophilus influenzae Rd
ucaaacaccuaa

SEQ ID NO: 2730699 - RNA, 13 nt, Haemophilus influenzae Rd
ucaaaccaaccac

SEQ ID NO: 2730700 - RNA, 16 nt, Haemophilus influenzae Rd
ucaaacgacuuaauuu

SEQ ID NO: 2730701 - RNA, 18 nt, Haemophilus influenzae Rd
ucaaacgacuuaauuuua

SEQ ID NO: 2730702 - RNA, 17 nt, Haemophilus influenzae Rd
ucaaacgccguucaaaa

SEQ ID NO: 2730703 - RNA, 14 nt, Haemophilus influenzae Rd
ucaaacugaucaua

SEQ ID NO: 2730704 - RNA, 15 nt, Haemophilus influenzae Rd
ucaaacugaucauaa

SEQ ID NO: 2730705 - RNA, 15 nt, Haemophilus influenzae Rd
ucaaacugugcuucu

SEQ ID NO: 2730706 - RNA, 18 nt, Haemophilus influenzae Rd
ucaaagaagcguucaaaa

SEQ ID NO: 2730707 - RNA, 14 nt, Haemophilus influenzae Rd
ucaaagaauugauc

SEQ ID NO: 2730708 - RNA, 21 nt, Haemophilus influenzae Rd
ucaaagauguuccuacagaac

SEQ ID NO: 2730709 - RNA, 15 nt, Haemophilus influenzae Rd
ucaaagauuuuaaaa

SEQ ID NO: 2730710 - RNA, 16 nt, Haemophilus influenzae Rd
ucaaagcguuuuaaaa

SEQ ID NO: 2730711 - RNA, 17 nt, Haemophilus influenzae Rd
ucaaagcguuuuaaaau

SEQ ID NO: 2730712 - RNA, 14 nt, Haemophilus influenzae Rd
ucaaaggcuaauuc

SEQ ID NO: 2730713 - RNA, 15 nt, Haemophilus influenzae Rd
ucaaaggcuaauucu

SEQ ID NO: 2730714 - RNA, 19 nt, Haemophilus influenzae Rd
ucaaaggcuaauucuacac

SEQ ID NO: 2730715 - RNA, 21 nt, Haemophilus influenzae Rd
ucaaaggcucuaccuaaaaua

SEQ ID NO: 2730716 - RNA, 19 nt, Haemophilus influenzae Rd
ucaaaguaacguugcucuu

SEQ ID NO: 2730717 - RNA, 19 nt, Haemophilus influenzae Rd
ucaaagugcgguaaucuuu

SEQ ID NO: 2730718 - RNA, 21 nt, Haemophilus influenzae Rd
ucaaagugcgguaaucuuuca

SEQ ID NO: 2730719 - RNA, 23 nt, Haemophilus influenzae Rd
ucaaagugcgguaaucuuucacu

SEQ ID NO: 2730720 - RNA, 19 nt, Haemophilus influenzae Rd
ucaaagugcgguuaaauau

SEQ ID NO: 2730721 - RNA, 20 nt, Haemophilus influenzae Rd
ucaaaguuccuagaauuaaa

SEQ ID NO: 2730722 - RNA, 12 nt, Haemophilus influenzae Rd
ucaaauaaaaua

SEQ ID NO: 2730723 - RNA, 22 nt, Haemophilus influenzae Rd
ucaaauaaaauauuuuuuauuu

SEQ ID NO: 2730724 - RNA, 18 nt, Haemophilus influenzae Rd
ucaaauaacguuuuaagu

SEQ ID NO: 2730725 - RNA, 21 nt, Haemophilus influenzae Rd
ucaaauaauguguugauuucu

SEQ ID NO: 2730726 - RNA, 17 nt, Haemophilus influenzae Rd
ucaaauacaccaagcau

SEQ ID NO: 2730727 - RNA, 15 nt, Haemophilus influenzae Rd
ucaaauaccucaauu

SEQ ID NO: 2730728 - RNA, 14 nt, Haemophilus influenzae Rd
ucaaauauuuuccu

SEQ ID NO: 2730729 - RNA, 16 nt, Haemophilus influenzae Rd
ucaaaucaaauuuucc

SEQ ID NO: 2730730 - RNA, 23 nt, Haemophilus influenzae Rd
ucaaaucauuuuuugcaaacgca

SEQ ID NO: 2730731 - RNA, 19 nt, Haemophilus influenzae Rd
ucaaauccuuguuuuucaa

SEQ ID NO: 2730732 - RNA, 20 nt, Haemophilus influenzae Rd
ucaaauccuuguuuuucaaa

SEQ ID NO: 2730733 - RNA, 17 nt, Haemophilus influenzae Rd
ucaaaucuacuaaaaua

SEQ ID NO: 2730734 - RNA, 14 nt, Haemophilus influenzae Rd
ucaaaucuucagca

SEQ ID NO: 2730735 - RNA, 16 nt, Haemophilus influenzae Rd
ucaaaucuucagcagu

SEQ ID NO: 2730736 - RNA, 14 nt, Haemophilus influenzae Rd
ucaaaugaaaugca

SEQ ID NO: 2730737 - RNA, 18 nt, Haemophilus influenzae Rd
ucaaaugccgcuaauggu

SEQ ID NO: 2730738 - RNA, 20 nt, Haemophilus influenzae Rd
ucaaaugccgcuaaugguug

SEQ ID NO: 2730739 - RNA, 15 nt, Haemophilus influenzae Rd
ucaaaugcuuugacu

SEQ ID NO: 2730740 - RNA, 22 nt, Haemophilus influenzae Rd
ucaaaugugaccgcuuguuuau

SEQ ID NO: 2730741 - RNA, 23 nt, Haemophilus influenzae Rd
ucaaauuaaccgcacuuucauuc

SEQ ID NO: 2730742 - RNA, 13 nt, Haemophilus influenzae Rd
ucaaauuaauuua

SEQ ID NO: 2730743 - RNA, 13 nt, Haemophilus influenzae Rd
ucaaauucuaaaa

SEQ ID NO: 2730744 - RNA, 14 nt, Haemophilus influenzae Rd
ucaaauucuaaaac

SEQ ID NO: 2730745 - RNA, 16 nt, Haemophilus influenzae Rd
ucaaauucuaaaacaa

SEQ ID NO: 2730746 - RNA, 13 nt, Haemophilus influenzae Rd
ucaaauucuacau

SEQ ID NO: 2730747 - RNA, 17 nt, Haemophilus influenzae Rd
ucaaauucucuguuucu

SEQ ID NO: 2730748 - RNA, 13 nt, Haemophilus influenzae Rd
ucaaauucugcuu

SEQ ID NO: 2730749 - RNA, 15 nt, Haemophilus influenzae Rd
ucaaauucugcuugu

SEQ ID NO: 2730750 - RNA, 13 nt, Haemophilus influenzae Rd
ucaaauugaucaa

SEQ ID NO: 2730751 - RNA, 17 nt, Haemophilus influenzae Rd
ucaaauugaugcucugc

SEQ ID NO: 2730752 - RNA, 13 nt, Haemophilus influenzae Rd
ucaaauugauuaa

SEQ ID NO: 2730753 - RNA, 11 nt, Haemophilus influenzae Rd
ucaaauuucaa

SEQ ID NO: 2730754 - RNA, 16 nt, Haemophilus influenzae Rd
ucaaauuucauccuaa

SEQ ID NO: 2730755 - RNA, 16 nt, Haemophilus influenzae Rd
ucaaauuucuucacug

SEQ ID NO: 2730756 - RNA, 17 nt, Haemophilus influenzae Rd
ucaaauuugaucuuaga

SEQ ID NO: 2730757 - RNA, 13 nt, Haemophilus influenzae Rd
ucaaauuuuccuu

SEQ ID NO: 2730758 - RNA, 23 nt, Haemophilus influenzae Rd
ucaaauuuuccuucuauaucaga

SEQ ID NO: 2730759 - RNA, 23 nt, Haemophilus influenzae Rd
ucaaauuuuuguugauaaacaua

SEQ ID NO: 2730760 - RNA, 23 nt, Haemophilus influenzae Rd
ucaacaaaaaacaccuaaaaugg

SEQ ID NO: 2730761 - RNA, 15 nt, Haemophilus influenzae Rd
ucaacaaaaauacgu

SEQ ID NO: 2730762 - RNA, 23 nt, Haemophilus influenzae Rd
ucaacaaaaauacguuguuuuuc

SEQ ID NO: 2730763 - RNA, 23 nt, Haemophilus influenzae Rd
ucaacaaaugucauugauggcuc

SEQ ID NO: 2730764 - RNA, 19 nt, Haemophilus influenzae Rd
ucaacaacaucuuguuuua

SEQ ID NO: 2730765 - RNA, 15 nt, Haemophilus influenzae Rd
ucaacaacuaaauaa

SEQ ID NO: 2730766 - RNA, 19 nt, Haemophilus influenzae Rd
ucaacaagacucucgccuu

SEQ ID NO: 2730767 - RNA, 14 nt, Haemophilus influenzae Rd
ucaacaaucacuuc

SEQ ID NO: 2730768 - RNA, 18 nt, Haemophilus influenzae Rd
ucaacaauucauaaauaa

SEQ ID NO: 2730769 - RNA, 22 nt, Haemophilus influenzae Rd
ucaacacaccuauuuuuuccug

SEQ ID NO: 2730770 - RNA, 16 nt, Haemophilus influenzae Rd
ucaacaccgcaaaaau

SEQ ID NO: 2730771 - RNA, 21 nt, Haemophilus influenzae Rd
ucaacaccgcaaaaauacuaa

SEQ ID NO: 2730772 - RNA, 12 nt, Haemophilus influenzae Rd
ucaacaccuaau

SEQ ID NO: 2730773 - RNA, 16 nt, Haemophilus influenzae Rd
ucaacaccuaauauca

SEQ ID NO: 2730774 - RNA, 20 nt, Haemophilus influenzae Rd
ucaacagcuucuccuacauc

SEQ ID NO: 2730775 - RNA, 19 nt, Haemophilus influenzae Rd
ucaacaguaaauuuuucca

SEQ ID NO: 2730776 - RNA, 22 nt, Haemophilus influenzae Rd
ucaacaucaaaaccauuuuucg

SEQ ID NO: 2730777 - RNA, 20 nt, Haemophilus influenzae Rd
ucaacauucacuaacaaaua

SEQ ID NO: 2730778 - RNA, 15 nt, Haemophilus influenzae Rd
ucaacauuuuuugcu

SEQ ID NO: 2730779 - RNA, 15 nt, Haemophilus influenzae Rd
ucaaccacuucaaau

SEQ ID NO: 2730780 - RNA, 15 nt, Haemophilus influenzae Rd
ucaaccauaacaaga

SEQ ID NO: 2730781 - RNA, 20 nt, Haemophilus influenzae Rd
ucaaccauuuucucugcgau

SEQ ID NO: 2730782 - RNA, 13 nt, Haemophilus influenzae Rd
ucaacccauaauu

SEQ ID NO: 2730783 - RNA, 12 nt, Haemophilus influenzae Rd
ucaacccauuuu

SEQ ID NO: 2730784 - RNA, 22 nt, Haemophilus influenzae Rd
ucaacgcgccacgguaaaucug

SEQ ID NO: 2730785 - RNA, 14 nt, Haemophilus influenzae Rd
ucaacgcuuuucgu

SEQ ID NO: 2730786 - RNA, 19 nt, Haemophilus influenzae Rd
ucaacgguaacugauuuug

SEQ ID NO: 2730787 - RNA, 15 nt, Haemophilus influenzae Rd
ucaacguugggugug

SEQ ID NO: 2730788 - RNA, 13 nt, Haemophilus influenzae Rd
ucaacuaaaaaau

SEQ ID NO: 2730789 - RNA, 20 nt, Haemophilus influenzae Rd
ucaacuaacacgcgcugcuc

SEQ ID NO: 2730790 - RNA, 19 nt, Haemophilus influenzae Rd
ucaacuaauuuauuaaaaa

SEQ ID NO: 2730791 - RNA, 18 nt, Haemophilus influenzae Rd
ucaacugcaacaauuuca

SEQ ID NO: 2730792 - RNA, 17 nt, Haemophilus influenzae Rd
ucaacuggcuuaaauga

SEQ ID NO: 2730793 - RNA, 19 nt, Haemophilus influenzae Rd
ucaacuuccgcuaauacua

SEQ ID NO: 2730794 - RNA, 15 nt, Haemophilus influenzae Rd
ucaacuugccacagu

SEQ ID NO: 2730795 - RNA, 11 nt, Haemophilus influenzae Rd
ucaacuuggcu

SEQ ID NO: 2730796 - RNA, 17 nt, Haemophilus influenzae Rd
ucaagaauuccauugca

SEQ ID NO: 2730797 - RNA, 23 nt, Haemophilus influenzae Rd
ucaagacaaauuuguugcauuuc

SEQ ID NO: 2730798 - RNA, 18 nt, Haemophilus influenzae Rd
ucaagacugaauuuuaca

SEQ ID NO: 2730799 - RNA, 16 nt, Haemophilus influenzae Rd
ucaagaggauaacccu

SEQ ID NO: 2730800 - RNA, 14 nt, Haemophilus influenzae Rd
ucaagauaccaaua

SEQ ID NO: 2730801 - RNA, 15 nt, Haemophilus influenzae Rd
ucaagauaccaauaa

SEQ ID NO: 2730802 - RNA, 16 nt, Haemophilus influenzae Rd
ucaagaugauauuuaa

SEQ ID NO: 2730803 - RNA, 18 nt, Haemophilus influenzae Rd
ucaagaugauauuuaaua

SEQ ID NO: 2730804 - RNA, 13 nt, Haemophilus influenzae Rd
ucaagauuugcaa

SEQ ID NO: 2730805 - RNA, 23 nt, Haemophilus influenzae Rd
ucaagcacuuuauuuaauucacg

SEQ ID NO: 2730806 - RNA, 16 nt, Haemophilus influenzae Rd
ucaagcacuuuuccuu

SEQ ID NO: 2730807 - RNA, 10 nt, Haemophilus influenzae Rd
ucaagcccuc

SEQ ID NO: 2730808 - RNA, 18 nt, Haemophilus influenzae Rd
ucaagcugauuuaucauu

SEQ ID NO: 2730809 - RNA, 14 nt, Haemophilus influenzae Rd
ucaagcugguuuuc

SEQ ID NO: 2730810 - RNA, 17 nt, Haemophilus influenzae Rd
ucaagcuuugcaacaaa

SEQ ID NO: 2730811 - RNA, 22 nt, Haemophilus influenzae Rd
ucaagcuuugcaacaaagugcg

SEQ ID NO: 2730812 - RNA, 21 nt, Haemophilus influenzae Rd
ucaaggacugaguucugucau

SEQ ID NO: 2730813 - RNA, 19 nt, Haemophilus influenzae Rd
ucaaggccauauuuuccca

SEQ ID NO: 2730814 - RNA, 16 nt, Haemophilus influenzae Rd
ucaaggcuuuaauuuu

SEQ ID NO: 2730815 - RNA, 17 nt, Haemophilus influenzae Rd
ucaaguaacuuucacaa

SEQ ID NO: 2730816 - RNA, 20 nt, Haemophilus influenzae Rd
ucaaguaauacuuuuuauuu

SEQ ID NO: 2730817 - RNA, 23 nt, Haemophilus influenzae Rd
ucaagugauuauuucucuauaau

SEQ ID NO: 2730818 - RNA, 21 nt, Haemophilus influenzae Rd
ucaagugguuuauuuuuuacu

SEQ ID NO: 2730819 - RNA, 13 nt, Haemophilus influenzae Rd
ucaaguuaaaaaa

SEQ ID NO: 2730820 - RNA, 14 nt, Haemophilus influenzae Rd
ucaaguuacuuaau

SEQ ID NO: 2730821 - RNA, 16 nt, Haemophilus influenzae Rd
ucaaguuacuuaauuu

SEQ ID NO: 2730822 - RNA, 19 nt, Haemophilus influenzae Rd
ucaaguuuguggaguaauu

SEQ ID NO: 2730823 - RNA, 12 nt, Haemophilus influenzae Rd
ucaauaaaaaua

SEQ ID NO: 2730824 - RNA, 20 nt, Haemophilus influenzae Rd
ucaauaaacccuaaucguuc

SEQ ID NO: 2730825 - RNA, 12 nt, Haemophilus influenzae Rd
ucaauaaacucg

SEQ ID NO: 2730826 - RNA, 20 nt, Haemophilus influenzae Rd
ucaauaacacucauuguaaa

SEQ ID NO: 2730827 - RNA, 20 nt, Haemophilus influenzae Rd
ucaauaaggcuuuuuuaauu

SEQ ID NO: 2730828 - RNA, 19 nt, Haemophilus influenzae Rd
ucaauaauagccauauuau

SEQ ID NO: 2730829 - RNA, 13 nt, Haemophilus influenzae Rd
ucaauaauauuug

SEQ ID NO: 2730830 - RNA, 15 nt, Haemophilus influenzae Rd
ucaauaauuucaaua

SEQ ID NO: 2730831 - RNA, 13 nt, Haemophilus influenzae Rd
ucaauaauuuuca

SEQ ID NO: 2730832 - RNA, 16 nt, Haemophilus influenzae Rd
ucaauaccuaacguua

SEQ ID NO: 2730833 - RNA, 14 nt, Haemophilus influenzae Rd
ucaauacgccuaaa

SEQ ID NO: 2730834 - RNA, 16 nt, Haemophilus influenzae Rd
ucaauacguuuaauau

SEQ ID NO: 2730835 - RNA, 16 nt, Haemophilus influenzae Rd
ucaauacuuauauuau

SEQ ID NO: 2730836 - RNA, 16 nt, Haemophilus influenzae Rd
ucaauacuuuucccaa

SEQ ID NO: 2730837 - RNA, 16 nt, Haemophilus influenzae Rd
ucaauagccaauaaua

SEQ ID NO: 2730838 - RNA, 18 nt, Haemophilus influenzae Rd
ucaauauaaaaaauaacc

SEQ ID NO: 2730839 - RNA, 15 nt, Haemophilus influenzae Rd
ucaauauaaguugua

SEQ ID NO: 2730840 - RNA, 18 nt, Haemophilus influenzae Rd
ucaaucaagcauaaaucu

SEQ ID NO: 2730841 - RNA, 20 nt, Haemophilus influenzae Rd
ucaaucaagcauaaaucuuu

SEQ ID NO: 2730842 - RNA, 12 nt, Haemophilus influenzae Rd
ucaaucacagca

SEQ ID NO: 2730843 - RNA, 15 nt, Haemophilus influenzae Rd
ucaaucacuucucug

SEQ ID NO: 2730844 - RNA, 20 nt, Haemophilus influenzae Rd
ucaaucaggcuuucauuuuc

SEQ ID NO: 2730845 - RNA, 16 nt, Haemophilus influenzae Rd
ucaaucaucauuuauu

SEQ ID NO: 2730846 - RNA, 20 nt, Haemophilus influenzae Rd
ucaaucaucauuuauuaaaa

SEQ ID NO: 2730847 - RNA, 14 nt, Haemophilus influenzae Rd
ucaauccagaacga

SEQ ID NO: 2730848 - RNA, 15 nt, Haemophilus influenzae Rd
ucaauccaugccaua

SEQ ID NO: 2730849 - RNA, 16 nt, Haemophilus influenzae Rd
ucaaucgcaucauuca

SEQ ID NO: 2730850 - RNA, 20 nt, Haemophilus influenzae Rd
ucaaucuuuaaaacuauaaa

SEQ ID NO: 2730851 - RNA, 19 nt, Haemophilus influenzae Rd
ucaaucuuuacaacuggag

SEQ ID NO: 2730852 - RNA, 14 nt, Haemophilus influenzae Rd
ucaaugaaauauua

SEQ ID NO: 2730853 - RNA, 14 nt, Haemophilus influenzae Rd
ucaaugaauuaaaa

SEQ ID NO: 2730854 - RNA, 22 nt, Haemophilus influenzae Rd
ucaaugaguggucguuuugauu

SEQ ID NO: 2730855 - RNA, 14 nt, Haemophilus influenzae Rd
ucaaugcaacaaua

SEQ ID NO: 2730856 - RNA, 14 nt, Haemophilus influenzae Rd
ucaaugcagaaaua

SEQ ID NO: 2730857 - RNA, 16 nt, Haemophilus influenzae Rd
ucaauggcuuauugcu

SEQ ID NO: 2730858 - RNA, 22 nt, Haemophilus influenzae Rd
ucaaugguguguaaugucuuua

SEQ ID NO: 2730859 - RNA, 22 nt, Haemophilus influenzae Rd
ucaaugguuuauaacaaguuag

SEQ ID NO: 2730860 - RNA, 14 nt, Haemophilus influenzae Rd
ucaaugguuuuacu

SEQ ID NO: 2730861 - RNA, 15 nt, Haemophilus influenzae Rd
ucaaugucuuuuucu

SEQ ID NO: 2730862 - RNA, 23 nt, Haemophilus influenzae Rd
ucaaugucuuuuucuuacggauu

SEQ ID NO: 2730863 - RNA, 16 nt, Haemophilus influenzae Rd
ucaauguuaaguucau

SEQ ID NO: 2730864 - RNA, 16 nt, Haemophilus influenzae Rd
ucaauguucgauuuua

SEQ ID NO: 2730865 - RNA, 20 nt, Haemophilus influenzae Rd
ucaauguucgauuuuacuuu

SEQ ID NO: 2730866 - RNA, 22 nt, Haemophilus influenzae Rd
ucaauuaaagaaauuucauauu

SEQ ID NO: 2730867 - RNA, 16 nt, Haemophilus influenzae Rd
ucaauuaacuauuuaa

SEQ ID NO: 2730868 - RNA, 17 nt, Haemophilus influenzae Rd
ucaauuaacuauuuaag

SEQ ID NO: 2730869 - RNA, 23 nt, Haemophilus influenzae Rd
ucaauuagaugacuggcaaaaau

SEQ ID NO: 2730870 - RNA, 17 nt, Haemophilus influenzae Rd
ucaauuauuuauacuaa

SEQ ID NO: 2730871 - RNA, 22 nt, Haemophilus influenzae Rd
ucaauuccauaauaucuuucuu

SEQ ID NO: 2730872 - RNA, 17 nt, Haemophilus influenzae Rd
ucaauuccuucaaauuc

SEQ ID NO: 2730873 - RNA, 19 nt, Haemophilus influenzae Rd
ucaauuccuucaaauucua

SEQ ID NO: 2730874 - RNA, 13 nt, Haemophilus influenzae Rd
ucaauucuuccca

SEQ ID NO: 2730875 - RNA, 19 nt, Haemophilus influenzae Rd
ucaauucuuucacuuuuac

SEQ ID NO: 2730876 - RNA, 14 nt, Haemophilus influenzae Rd
ucaauugcaaaauc

SEQ ID NO: 2730877 - RNA, 23 nt, Haemophilus influenzae Rd
ucaauugccauaggauuauucac

SEQ ID NO: 2730878 - RNA, 20 nt, Haemophilus influenzae Rd
ucaauugggguaucgacagu

SEQ ID NO: 2730879 - RNA, 17 nt, Haemophilus influenzae Rd
ucaauuuaauaaucuua

SEQ ID NO: 2730880 - RNA, 21 nt, Haemophilus influenzae Rd
ucaauuuaauaaucuuaaaua

SEQ ID NO: 2730881 - RNA, 21 nt, Haemophilus influenzae Rd
ucaauuuacacauugccauau

SEQ ID NO: 2730882 - RNA, 10 nt, Haemophilus influenzae Rd
ucaauuucaa

SEQ ID NO: 2730883 - RNA, 18 nt, Haemophilus influenzae Rd
ucaauuucacggcggauu

SEQ ID NO: 2730884 - RNA, 18 nt, Haemophilus influenzae Rd
ucaauuugaccuugaagu

SEQ ID NO: 2730885 - RNA, 23 nt, Haemophilus influenzae Rd
ucaauuugaccuugaaguuugau

SEQ ID NO: 2730886 - RNA, 18 nt, Haemophilus influenzae Rd
ucaauuuggcucacaaga

SEQ ID NO: 2730887 - RNA, 21 nt, Haemophilus influenzae Rd
ucaauuugugcauaaacagcc

SEQ ID NO: 2730888 - RNA, 12 nt, Haemophilus influenzae Rd
ucaauuuuaaaa

SEQ ID NO: 2730889 - RNA, 15 nt, Haemophilus influenzae Rd
ucaauuuuaaaauuu

SEQ ID NO: 2730890 - RNA, 13 nt, Haemophilus influenzae Rd
ucaauuuuaauug

SEQ ID NO: 2730891 - RNA, 19 nt, Haemophilus influenzae Rd
ucaauuuuuuaucaaauaa

SEQ ID NO: 2730892 - RNA, 17 nt, Haemophilus influenzae Rd
ucaauuuuuucaaauaa

SEQ ID NO: 2730893 - RNA, 16 nt, Haemophilus influenzae Rd
ucaauuuuuucuccac

SEQ ID NO: 2730894 - RNA, 20 nt, Haemophilus influenzae Rd
ucacaaaacaacgaauaucc

SEQ ID NO: 2730895 - RNA, 15 nt, Haemophilus influenzae Rd
ucacaaaauggcaaa

SEQ ID NO: 2730896 - RNA, 13 nt, Haemophilus influenzae Rd
ucacaaauaauau

SEQ ID NO: 2730897 - RNA, 15 nt, Haemophilus influenzae Rd
ucacaaauaauauga

SEQ ID NO: 2730898 - RNA, 18 nt, Haemophilus influenzae Rd
ucacaaaucuaaaaauau

SEQ ID NO: 2730899 - RNA, 18 nt, Haemophilus influenzae Rd
ucacaacauauaaaucuc

SEQ ID NO: 2730900 - RNA, 19 nt, Haemophilus influenzae Rd
ucacaaccaccaauuaauu

SEQ ID NO: 2730901 - RNA, 23 nt, Haemophilus influenzae Rd
ucacaaggcucaucauuaugaaa

SEQ ID NO: 2730902 - RNA, 20 nt, Haemophilus influenzae Rd
ucacaaguuaaaacuugauu

SEQ ID NO: 2730903 - RNA, 14 nt, Haemophilus influenzae Rd
ucacaauaaaagca

SEQ ID NO: 2730904 - RNA, 12 nt, Haemophilus influenzae Rd
ucacaauaauag

SEQ ID NO: 2730905 - RNA, 16 nt, Haemophilus influenzae Rd
ucacaauaauuuucaa

SEQ ID NO: 2730906 - RNA, 17 nt, Haemophilus influenzae Rd
ucacaaucuaaagcgau

SEQ ID NO: 2730907 - RNA, 21 nt, Haemophilus influenzae Rd
ucacaauugauguaaaagaua

SEQ ID NO: 2730908 - RNA, 14 nt, Haemophilus influenzae Rd
ucacaauuuuuaac

SEQ ID NO: 2730909 - RNA, 16 nt, Haemophilus influenzae Rd
ucacaccauuuuuaau

SEQ ID NO: 2730910 - RNA, 16 nt, Haemophilus influenzae Rd
ucacaccgucuaaaaa

SEQ ID NO: 2730911 - RNA, 22 nt, Haemophilus influenzae Rd
ucacacguucauuacgugcaaa

SEQ ID NO: 2730912 - RNA, 17 nt, Haemophilus influenzae Rd
ucacagaaccuaaugca

SEQ ID NO: 2730913 - RNA, 14 nt, Haemophilus influenzae Rd
ucacagagaauaaa

SEQ ID NO: 2730914 - RNA, 17 nt, Haemophilus influenzae Rd
ucacagagccuuuuucu

SEQ ID NO: 2730915 - RNA, 20 nt, Haemophilus influenzae Rd
ucacagagccuuuuucuaau

SEQ ID NO: 2730916 - RNA, 20 nt, Haemophilus influenzae Rd
ucacagauuuuuuauuaauu

SEQ ID NO: 2730917 - RNA, 18 nt, Haemophilus influenzae Rd
ucacagcaagaacagcca

SEQ ID NO: 2730918 - RNA, 17 nt, Haemophilus influenzae Rd
ucacagccgcauuuuua

SEQ ID NO: 2730919 - RNA, 17 nt, Haemophilus influenzae Rd
ucacaggcccaucauuu

SEQ ID NO: 2730920 - RNA, 17 nt, Haemophilus influenzae Rd
ucacaguaccuacauuu

SEQ ID NO: 2730921 - RNA, 23 nt, Haemophilus influenzae Rd
ucacaguuggggcuaaaaauauu

SEQ ID NO: 2730922 - RNA, 16 nt, Haemophilus influenzae Rd
ucacauaaauuacaau

SEQ ID NO: 2730923 - RNA, 19 nt, Haemophilus influenzae Rd
ucacauaaauuacaaugua

SEQ ID NO: 2730924 - RNA, 13 nt, Haemophilus influenzae Rd
ucacauaauaaac

SEQ ID NO: 2730925 - RNA, 21 nt, Haemophilus influenzae Rd
ucacauaauaaacauacaucu

SEQ ID NO: 2730926 - RNA, 23 nt, Haemophilus influenzae Rd
ucacauauuguuucuucucuuua

SEQ ID NO: 2730927 - RNA, 18 nt, Haemophilus influenzae Rd
ucacaucagcaaucauuu

SEQ ID NO: 2730928 - RNA, 19 nt, Haemophilus influenzae Rd
ucacaucuugaccaucuaa

SEQ ID NO: 2730929 - RNA, 16 nt, Haemophilus influenzae Rd
ucacauucuuuuaaau

SEQ ID NO: 2730930 - RNA, 22 nt, Haemophilus influenzae Rd
ucacauugccauuuuucagcaa

SEQ ID NO: 2730931 - RNA, 13 nt, Haemophilus influenzae Rd
ucacauuguuucc

SEQ ID NO: 2730932 - RNA, 20 nt, Haemophilus influenzae Rd
ucacauuugagaugaaaaaa

SEQ ID NO: 2730933 - RNA, 15 nt, Haemophilus influenzae Rd
ucacauuuucaaauu

SEQ ID NO: 2730934 - RNA, 20 nt, Haemophilus influenzae Rd
ucacauuuuugucuuuguug

SEQ ID NO: 2730935 - RNA, 16 nt, Haemophilus influenzae Rd
ucaccaacaaauucua

SEQ ID NO: 2730936 - RNA, 13 nt, Haemophilus influenzae Rd
ucaccacaaaaua

SEQ ID NO: 2730937 - RNA, 15 nt, Haemophilus influenzae Rd
ucaccauaaucaaaa

SEQ ID NO: 2730938 - RNA, 12 nt, Haemophilus influenzae Rd
ucaccauuuccu

SEQ ID NO: 2730939 - RNA, 22 nt, Haemophilus influenzae Rd
ucacccaagauucuaaauauug

SEQ ID NO: 2730940 - RNA, 13 nt, Haemophilus influenzae Rd
ucacccacaaccc

SEQ ID NO: 2730941 - RNA, 18 nt, Haemophilus influenzae Rd
ucacccgcauaaccacua

SEQ ID NO: 2730942 - RNA, 17 nt, Haemophilus influenzae Rd
ucaccgcacuuaaucac

SEQ ID NO: 2730943 - RNA, 21 nt, Haemophilus influenzae Rd
ucaccgcacuuuuaucuugcu

SEQ ID NO: 2730944 - RNA, 16 nt, Haemophilus influenzae Rd
ucaccgcacuuuucuu

SEQ ID NO: 2730945 - RNA, 21 nt, Haemophilus influenzae Rd
ucaccgccaagcgcugcagua

SEQ ID NO: 2730946 - RNA, 17 nt, Haemophilus influenzae Rd
ucaccgggcgauaaaau

SEQ ID NO: 2730947 - RNA, 19 nt, Haemophilus influenzae Rd
ucaccuaaaucuuuaucaa

SEQ ID NO: 2730948 - RNA, 18 nt, Haemophilus influenzae Rd
ucaccucgugcuguuuuc

SEQ ID NO: 2730949 - RNA, 23 nt, Haemophilus influenzae Rd
ucaccucgugcuguuuucaauuu

SEQ ID NO: 2730950 - RNA, 14 nt, Haemophilus influenzae Rd
ucacgaaaaucacg

SEQ ID NO: 2730951 - RNA, 18 nt, Haemophilus influenzae Rd
ucacgacaaaguggagaa

SEQ ID NO: 2730952 - RNA, 23 nt, Haemophilus influenzae Rd
ucacgacccaccacuuaaaaaua

SEQ ID NO: 2730953 - RNA, 18 nt, Haemophilus influenzae Rd
ucacgauauugcacaaua

SEQ ID NO: 2730954 - RNA, 20 nt, Haemophilus influenzae Rd
ucacgaucauaaauuuuggu

SEQ ID NO: 2730955 - RNA, 21 nt, Haemophilus influenzae Rd
ucacgauuuuuuuauaaaaaa

SEQ ID NO: 2730956 - RNA, 22 nt, Haemophilus influenzae Rd
ucacgcacaccaccugaugcuu

SEQ ID NO: 2730957 - RNA, 15 nt, Haemophilus influenzae Rd
ucacgcccaaauacu

SEQ ID NO: 2730958 - RNA, 20 nt, Haemophilus influenzae Rd
ucacgcccaaauacuucacu

SEQ ID NO: 2730959 - RNA, 23 nt, Haemophilus influenzae Rd
ucacgcucaaucucuuuacuguu

SEQ ID NO: 2730960 - RNA, 15 nt, Haemophilus influenzae Rd
ucacgcucuuuuauc

SEQ ID NO: 2730961 - RNA, 19 nt, Haemophilus influenzae Rd
ucacgcugacuuaaugcaa

SEQ ID NO: 2730962 - RNA, 17 nt, Haemophilus influenzae Rd
ucacgggcaauucaguu

SEQ ID NO: 2730963 - RNA, 21 nt, Haemophilus influenzae Rd
ucacggguuggaagaauguuu

SEQ ID NO: 2730964 - RNA, 21 nt, Haemophilus influenzae Rd
ucacggguuugguaagcaaua

SEQ ID NO: 2730965 - RNA, 20 nt, Haemophilus influenzae Rd
ucacgguguuuuuuaauaaa

SEQ ID NO: 2730966 - RNA, 22 nt, Haemophilus influenzae Rd
ucacgguuauaccacauaaaug

SEQ ID NO: 2730967 - RNA, 23 nt, Haemophilus influenzae Rd
ucacgguuauaccacauaaaugu

SEQ ID NO: 2730968 - RNA, 14 nt, Haemophilus influenzae Rd
ucacgugaaucaca

SEQ ID NO: 2730969 - RNA, 14 nt, Haemophilus influenzae Rd
ucacguucaaaaau

SEQ ID NO: 2730970 - RNA, 12 nt, Haemophilus influenzae Rd
ucacuaaaaauc

SEQ ID NO: 2730971 - RNA, 13 nt, Haemophilus influenzae Rd
ucacuaaauaaau

SEQ ID NO: 2730972 - RNA, 14 nt, Haemophilus influenzae Rd
ucacuaaauaaaug

SEQ ID NO: 2730973 - RNA, 14 nt, Haemophilus influenzae Rd
ucacuaaauucuug

SEQ ID NO: 2730974 - RNA, 17 nt, Haemophilus influenzae Rd
ucacuaacuuuccuacu

SEQ ID NO: 2730975 - RNA, 17 nt, Haemophilus influenzae Rd
ucacuaauauaaagaua

SEQ ID NO: 2730976 - RNA, 18 nt, Haemophilus influenzae Rd
ucacuaauugcauuaaaa

SEQ ID NO: 2730977 - RNA, 14 nt, Haemophilus influenzae Rd
ucacuaauuugcuu

SEQ ID NO: 2730978 - RNA, 22 nt, Haemophilus influenzae Rd
ucacuacgauuuaauguauaaa

SEQ ID NO: 2730979 - RNA, 22 nt, Haemophilus influenzae Rd
ucacuacguguuaauaaccaag

SEQ ID NO: 2730980 - RNA, 23 nt, Haemophilus influenzae Rd
ucacuauuaccgcguaaaaauuc

SEQ ID NO: 2730981 - RNA, 15 nt, Haemophilus influenzae Rd
ucacuauuucaucuu

SEQ ID NO: 2730982 - RNA, 18 nt, Haemophilus influenzae Rd
ucacucuaccaucuaaag

SEQ ID NO: 2730983 - RNA, 14 nt, Haemophilus influenzae Rd
ucacugaaaguaag

SEQ ID NO: 2730984 - RNA, 14 nt, Haemophilus influenzae Rd
ucacugaauuucau

SEQ ID NO: 2730985 - RNA, 18 nt, Haemophilus influenzae Rd
ucacugacaucaagcaca

SEQ ID NO: 2730986 - RNA, 21 nt, Haemophilus influenzae Rd
ucacugacaucaagcacauca

SEQ ID NO: 2730987 - RNA, 22 nt, Haemophilus influenzae Rd
ucacugauauagcuagaaagca

SEQ ID NO: 2730988 - RNA, 12 nt, Haemophilus influenzae Rd
ucacugauuucc

SEQ ID NO: 2730989 - RNA, 11 nt, Haemophilus influenzae Rd
ucacugcaucu

SEQ ID NO: 2730990 - RNA, 21 nt, Haemophilus influenzae Rd
ucacugcaucuguugugaaug

SEQ ID NO: 2730991 - RNA, 18 nt, Haemophilus influenzae Rd
ucacugcggcaaaaucuu

SEQ ID NO: 2730992 - RNA, 22 nt, Haemophilus influenzae Rd
ucacuggcguaaaccucgccuu

SEQ ID NO: 2730993 - RNA, 15 nt, Haemophilus influenzae Rd
ucacuggcucauuau

SEQ ID NO: 2730994 - RNA, 15 nt, Haemophilus influenzae Rd
ucacuguaaauaaua

SEQ ID NO: 2730995 - RNA, 22 nt, Haemophilus influenzae Rd
ucacuucaggguuuucaucauu

SEQ ID NO: 2730996 - RNA, 22 nt, Haemophilus influenzae Rd
ucacuucaucuauauuauacuu

SEQ ID NO: 2730997 - RNA, 16 nt, Haemophilus influenzae Rd
ucacuucuaacuaaaa

SEQ ID NO: 2730998 - RNA, 12 nt, Haemophilus influenzae Rd
ucacuucuucaa

SEQ ID NO: 2730999 - RNA, 17 nt, Haemophilus influenzae Rd
ucacuugauaaaaauga

SEQ ID NO: 2731000 - RNA, 19 nt, Haemophilus influenzae Rd
ucacuuggcgaaaaucauc

SEQ ID NO: 2731001 - RNA, 21 nt, Haemophilus influenzae Rd
ucacuuggcguaaauccugcu

SEQ ID NO: 2731002 - RNA, 23 nt, Haemophilus influenzae Rd
ucacuugugguuauuugauuauc

SEQ ID NO: 2731003 - RNA, 17 nt, Haemophilus influenzae Rd
ucacuuucacauaaauu

SEQ ID NO: 2731004 - RNA, 15 nt, Haemophilus influenzae Rd
ucacuuucauccucu

SEQ ID NO: 2731005 - RNA, 17 nt, Haemophilus influenzae Rd
ucacuuucauccucucg

SEQ ID NO: 2731006 - RNA, 20 nt, Haemophilus influenzae Rd
ucacuuuguacaccaaaaua

SEQ ID NO: 2731007 - RNA, 23 nt, Haemophilus influenzae Rd
ucacuuuuccuuguuugcgcauu

SEQ ID NO: 2731008 - RNA, 20 nt, Haemophilus influenzae Rd
ucacuuuucgcaauuuuaac

SEQ ID NO: 2731009 - RNA, 19 nt, Haemophilus influenzae Rd
ucagaaaagacaucacugg

SEQ ID NO: 2731010 - RNA, 17 nt, Haemophilus influenzae Rd
ucagaaaauaaauaagg

SEQ ID NO: 2731011 - RNA, 18 nt, Haemophilus influenzae Rd
ucagaaagacuaauagcc

SEQ ID NO: 2731012 - RNA, 21 nt, Haemophilus influenzae Rd
ucagaaaguucuaauucauuu

SEQ ID NO: 2731013 - RNA, 16 nt, Haemophilus influenzae Rd
ucagaaauaucuucaa

SEQ ID NO: 2731014 - RNA, 18 nt, Haemophilus influenzae Rd
ucagaaauaucuucaauu

SEQ ID NO: 2731015 - RNA, 17 nt, Haemophilus influenzae Rd
ucagaaaugaccuucac

SEQ ID NO: 2731016 - RNA, 17 nt, Haemophilus influenzae Rd
ucagaacaagcauuuuu

SEQ ID NO: 2731017 - RNA, 22 nt, Haemophilus influenzae Rd
ucagaagucacauauuguuucu

SEQ ID NO: 2731018 - RNA, 11 nt, Haemophilus influenzae Rd
ucagaauaaag

SEQ ID NO: 2731019 - RNA, 17 nt, Haemophilus influenzae Rd
ucagaauaauuaacaaa

SEQ ID NO: 2731020 - RNA, 20 nt, Haemophilus influenzae Rd
ucagaauagccgcaaucaca

SEQ ID NO: 2731021 - RNA, 17 nt, Haemophilus influenzae Rd
ucagaauuucaucuguu

SEQ ID NO: 2731022 - RNA, 20 nt, Haemophilus influenzae Rd
ucagacaacgccagaaguug

SEQ ID NO: 2731023 - RNA, 15 nt, Haemophilus influenzae Rd
ucagacaaucugugu

SEQ ID NO: 2731024 - RNA, 19 nt, Haemophilus influenzae Rd
ucagacuagcaucaaaaua

SEQ ID NO: 2731025 - RNA, 20 nt, Haemophilus influenzae Rd
ucagacuagcaucaaaauaa

SEQ ID NO: 2731026 - RNA, 22 nt, Haemophilus influenzae Rd
ucagacugaauuugacauuccu

SEQ ID NO: 2731027 - RNA, 16 nt, Haemophilus influenzae Rd
ucagagccguuugcug

SEQ ID NO: 2731028 - RNA, 12 nt, Haemophilus influenzae Rd
ucagagcgaaua

SEQ ID NO: 2731029 - RNA, 16 nt, Haemophilus influenzae Rd
ucagagguucgaaucc

SEQ ID NO: 2731030 - RNA, 23 nt, Haemophilus influenzae Rd
ucagaguuaaaagucgcuacauu

SEQ ID NO: 2731031 - RNA, 15 nt, Haemophilus influenzae Rd
ucagauaacguaagu

SEQ ID NO: 2731032 - RNA, 23 nt, Haemophilus influenzae Rd
ucagauaacguaaguaaugaaaa

SEQ ID NO: 2731033 - RNA, 17 nt, Haemophilus influenzae Rd
ucagauaaucaaaaaug

SEQ ID NO: 2731034 - RNA, 12 nt, Haemophilus influenzae Rd
ucagauaaugau

SEQ ID NO: 2731035 - RNA, 23 nt, Haemophilus influenzae Rd
ucagauacuuucuaauuauuuca

SEQ ID NO: 2731036 - RNA, 19 nt, Haemophilus influenzae Rd
ucagauuauguucauuuuc

SEQ ID NO: 2731037 - RNA, 17 nt, Haemophilus influenzae Rd
ucagauuuauaaauagg

SEQ ID NO: 2731038 - RNA, 22 nt, Haemophilus influenzae Rd
ucagcaaaagacgaagaaacaa

SEQ ID NO: 2731039 - RNA, 16 nt, Haemophilus influenzae Rd
ucagcaaaaucacucg

SEQ ID NO: 2731040 - RNA, 13 nt, Haemophilus influenzae Rd
ucagcaaaaugcg

SEQ ID NO: 2731041 - RNA, 17 nt, Haemophilus influenzae Rd
ucagcaaauuaucugau

SEQ ID NO: 2731042 - RNA, 21 nt, Haemophilus influenzae Rd
ucagcaacgguguggaaagau

SEQ ID NO: 2731043 - RNA, 13 nt, Haemophilus influenzae Rd
ucagcaauuaauu

SEQ ID NO: 2731044 - RNA, 18 nt, Haemophilus influenzae Rd
ucagcaauuucuucagcu

SEQ ID NO: 2731045 - RNA, 21 nt, Haemophilus influenzae Rd
ucagcacgauaaccaucagcu

SEQ ID NO: 2731046 - RNA, 20 nt, Haemophilus influenzae Rd
ucagcacuaauuuguggaaa

SEQ ID NO: 2731047 - RNA, 18 nt, Haemophilus influenzae Rd
ucagcacuugcaucuaaa

SEQ ID NO: 2731048 - RNA, 23 nt, Haemophilus influenzae Rd
ucagcagauacaucuucuggguu

SEQ ID NO: 2731049 - RNA, 21 nt, Haemophilus influenzae Rd
ucagcauaaacaaaauaaacu

SEQ ID NO: 2731050 - RNA, 21 nt, Haemophilus influenzae Rd
ucagcauaaagagaauauuuc

SEQ ID NO: 2731051 - RNA, 16 nt, Haemophilus influenzae Rd
ucagcauaauguuugc

SEQ ID NO: 2731052 - RNA, 12 nt, Haemophilus influenzae Rd
ucagcauaccua

SEQ ID NO: 2731053 - RNA, 15 nt, Haemophilus influenzae Rd
ucagcauaccuagca

SEQ ID NO: 2731054 - RNA, 22 nt, Haemophilus influenzae Rd
ucagcauauugaaauuggaauc

SEQ ID NO: 2731055 - RNA, 12 nt, Haemophilus influenzae Rd
ucagcaucagaa

SEQ ID NO: 2731056 - RNA, 20 nt, Haemophilus influenzae Rd
ucagccaaauuuuucuuuuc

SEQ ID NO: 2731057 - RNA, 12 nt, Haemophilus influenzae Rd
ucagccuauuuu

SEQ ID NO: 2731058 - RNA, 20 nt, Haemophilus influenzae Rd
ucagccuauuuuuagaaaau

SEQ ID NO: 2731059 - RNA, 21 nt, Haemophilus influenzae Rd
ucagcgagagaauauuuagau

SEQ ID NO: 2731060 - RNA, 14 nt, Haemophilus influenzae Rd
ucagcgaguuugau

SEQ ID NO: 2731061 - RNA, 14 nt, Haemophilus influenzae Rd
ucagcgauuuuaac

SEQ ID NO: 2731062 - RNA, 22 nt, Haemophilus influenzae Rd
ucagcgcagcaauuaauaauaa

SEQ ID NO: 2731063 - RNA, 15 nt, Haemophilus influenzae Rd
ucagcgcauuuuuua

SEQ ID NO: 2731064 - RNA, 22 nt, Haemophilus influenzae Rd
ucagcgguuggcuuccagaaaa

SEQ ID NO: 2731065 - RNA, 16 nt, Haemophilus influenzae Rd
ucagcguugucaucag

SEQ ID NO: 2731066 - RNA, 19 nt, Haemophilus influenzae Rd
ucagcguugucaucagaaa

SEQ ID NO: 2731067 - RNA, 23 nt, Haemophilus influenzae Rd
ucagcuaaaauuaccccaauucc

SEQ ID NO: 2731068 - RNA, 18 nt, Haemophilus influenzae Rd
ucagcuaauucagcuaaa

SEQ ID NO: 2731069 - RNA, 19 nt, Haemophilus influenzae Rd
ucagcuacuuguaagaaua

SEQ ID NO: 2731070 - RNA, 22 nt, Haemophilus influenzae Rd
ucagcuacuuguaagaauaacc

SEQ ID NO: 2731071 - RNA, 20 nt, Haemophilus influenzae Rd
ucagcuccuacauuaaaaga

SEQ ID NO: 2731072 - RNA, 23 nt, Haemophilus influenzae Rd
ucagcugcucuuuaggaucacua

SEQ ID NO: 2731073 - RNA, 15 nt, Haemophilus influenzae Rd
ucagcuguugcaaug

SEQ ID NO: 2731074 - RNA, 23 nt, Haemophilus influenzae Rd
ucagcuuaucaaucaagaauucc

SEQ ID NO: 2731075 - RNA, 11 nt, Haemophilus influenzae Rd
ucagcuucaau

SEQ ID NO: 2731076 - RNA, 15 nt, Haemophilus influenzae Rd
ucagcuugugcucga

SEQ ID NO: 2731077 - RNA, 18 nt, Haemophilus influenzae Rd
ucagcuuguuuaaucaca

SEQ ID NO: 2731078 - RNA, 14 nt, Haemophilus influenzae Rd
ucaggauaaaacaa

SEQ ID NO: 2731079 - RNA, 16 nt, Haemophilus influenzae Rd
ucagggauuaagaaaa

SEQ ID NO: 2731080 - RNA, 22 nt, Haemophilus influenzae Rd
ucaggugcuauuuuauuuagaa

SEQ ID NO: 2731081 - RNA, 14 nt, Haemophilus influenzae Rd
ucaggugcuuuagc

SEQ ID NO: 2731082 - RNA, 19 nt, Haemophilus influenzae Rd
ucaggugggaaauaauuuu

SEQ ID NO: 2731083 - RNA, 22 nt, Haemophilus influenzae Rd
ucagguugcgguaaaucuacuu

SEQ ID NO: 2731084 - RNA, 15 nt, Haemophilus influenzae Rd
ucagguuuaauaauc

SEQ ID NO: 2731085 - RNA, 13 nt, Haemophilus influenzae Rd
ucaguaaacaagu

SEQ ID NO: 2731086 - RNA, 14 nt, Haemophilus influenzae Rd
ucaguaccagucac

SEQ ID NO: 2731087 - RNA, 22 nt, Haemophilus influenzae Rd
ucaguaccuuuaauuaaagcca

SEQ ID NO: 2731088 - RNA, 16 nt, Haemophilus influenzae Rd
ucaguacgcaccacuu

SEQ ID NO: 2731089 - RNA, 15 nt, Haemophilus influenzae Rd
ucaguaucuggcuca

SEQ ID NO: 2731090 - RNA, 20 nt, Haemophilus influenzae Rd
ucaguauuguuuuaugaaga

SEQ ID NO: 2731091 - RNA, 15 nt, Haemophilus influenzae Rd
ucaguauuuuuucga

SEQ ID NO: 2731092 - RNA, 21 nt, Haemophilus influenzae Rd
ucaguccgcauugaaaccuug

SEQ ID NO: 2731093 - RNA, 15 nt, Haemophilus influenzae Rd
ucagucgguagaacg

SEQ ID NO: 2731094 - RNA, 18 nt, Haemophilus influenzae Rd
ucagucuauuauaaauuu

SEQ ID NO: 2731095 - RNA, 15 nt, Haemophilus influenzae Rd
ucagugccuaaauuu

SEQ ID NO: 2731096 - RNA, 15 nt, Haemophilus influenzae Rd
ucagugcuuuuucaa

SEQ ID NO: 2731097 - RNA, 15 nt, Haemophilus influenzae Rd
ucaguguaauguuuu

SEQ ID NO: 2731098 - RNA, 13 nt, Haemophilus influenzae Rd
ucaguuaagaaaa

SEQ ID NO: 2731099 - RNA, 18 nt, Haemophilus influenzae Rd
ucaguuaauuagaauaac

SEQ ID NO: 2731100 - RNA, 16 nt, Haemophilus influenzae Rd
ucaguuaccauacauu

SEQ ID NO: 2731101 - RNA, 20 nt, Haemophilus influenzae Rd
ucaguuaucucccaaauccc

SEQ ID NO: 2731102 - RNA, 16 nt, Haemophilus influenzae Rd
ucaguucaauuuaaca

SEQ ID NO: 2731103 - RNA, 21 nt, Haemophilus influenzae Rd
ucaguuccugacccacaucau

SEQ ID NO: 2731104 - RNA, 21 nt, Haemophilus influenzae Rd
ucaguugaucgcaauguucac

SEQ ID NO: 2731105 - RNA, 13 nt, Haemophilus influenzae Rd
ucaguuucaagca

SEQ ID NO: 2731106 - RNA, 15 nt, Haemophilus influenzae Rd
ucaguuucaagcacu

SEQ ID NO: 2731107 - RNA, 13 nt, Haemophilus influenzae Rd
ucaguuuucauuu

SEQ ID NO: 2731108 - RNA, 15 nt, Haemophilus influenzae Rd
ucaguuuugcuuuuu

SEQ ID NO: 2731109 - RNA, 21 nt, Haemophilus influenzae Rd
ucaguuuugcuuuuuuaauuu

SEQ ID NO: 2731110 - RNA, 23 nt, Haemophilus influenzae Rd
ucaguuuugcuuuuuuaauuugg

SEQ ID NO: 2731111 - RNA, 14 nt, Haemophilus influenzae Rd
ucauaaaaacaaua

SEQ ID NO: 2731112 - RNA, 12 nt, Haemophilus influenzae Rd
ucauaaaauuuc

SEQ ID NO: 2731113 - RNA, 14 nt, Haemophilus influenzae Rd
ucauaaauucaucu

SEQ ID NO: 2731114 - RNA, 15 nt, Haemophilus influenzae Rd
ucauaaauugugaug

SEQ ID NO: 2731115 - RNA, 19 nt, Haemophilus influenzae Rd
ucauaaauuuccucagguu

SEQ ID NO: 2731116 - RNA, 21 nt, Haemophilus influenzae Rd
ucauaaauuuccucagguuca

SEQ ID NO: 2731117 - RNA, 21 nt, Haemophilus influenzae Rd
ucauaagcauuuugauaauuu

SEQ ID NO: 2731118 - RNA, 17 nt, Haemophilus influenzae Rd
ucauaaguaaaaccauu

SEQ ID NO: 2731119 - RNA, 23 nt, Haemophilus influenzae Rd
ucauaauaggcgcguaauaaaua

SEQ ID NO: 2731120 - RNA, 21 nt, Haemophilus influenzae Rd
ucauacaaucucuagauuuuu

SEQ ID NO: 2731121 - RNA, 15 nt, Haemophilus influenzae Rd
ucauacagaaaccag

SEQ ID NO: 2731122 - RNA, 18 nt, Haemophilus influenzae Rd
ucauaccaaggcauuuuu

SEQ ID NO: 2731123 - RNA, 20 nt, Haemophilus influenzae Rd
ucauacgaccuucaaccauu

SEQ ID NO: 2731124 - RNA, 19 nt, Haemophilus influenzae Rd
ucauacguucaacaaucac

SEQ ID NO: 2731125 - RNA, 19 nt, Haemophilus influenzae Rd
ucauacuaaauacauuuuu

SEQ ID NO: 2731126 - RNA, 19 nt, Haemophilus influenzae Rd
ucauagaaaccaauaauuu

SEQ ID NO: 2731127 - RNA, 15 nt, Haemophilus influenzae Rd
ucauagaaaucccuu

SEQ ID NO: 2731128 - RNA, 22 nt, Haemophilus influenzae Rd
ucauagaaccgucuuuaaauag

SEQ ID NO: 2731129 - RNA, 23 nt, Haemophilus influenzae Rd
ucauagaaccgucuuuaaauaga

SEQ ID NO: 2731130 - RNA, 22 nt, Haemophilus influenzae Rd
ucauagagacuuguaaauacca

SEQ ID NO: 2731131 - RNA, 13 nt, Haemophilus influenzae Rd
ucauagagccaau

SEQ ID NO: 2731132 - RNA, 17 nt, Haemophilus influenzae Rd
ucauagagccaauuacc

SEQ ID NO: 2731133 - RNA, 15 nt, Haemophilus influenzae Rd
ucauagauaaauaua

SEQ ID NO: 2731134 - RNA, 17 nt, Haemophilus influenzae Rd
ucauaggcuuuaacuaa

SEQ ID NO: 2731135 - RNA, 20 nt, Haemophilus influenzae Rd
ucauaguuggauuauuuaga

SEQ ID NO: 2731136 - RNA, 16 nt, Haemophilus influenzae Rd
ucauauaaauaagaau

SEQ ID NO: 2731137 - RNA, 16 nt, Haemophilus influenzae Rd
ucauauaaaucaaucc

SEQ ID NO: 2731138 - RNA, 18 nt, Haemophilus influenzae Rd
ucauauacaucucauaaa

SEQ ID NO: 2731139 - RNA, 20 nt, Haemophilus influenzae Rd
ucauauagggcucaaauuuu

SEQ ID NO: 2731140 - RNA, 14 nt, Haemophilus influenzae Rd
ucauauauaaauuu

SEQ ID NO: 2731141 - RNA, 17 nt, Haemophilus influenzae Rd
ucauauauucaacuaaa

SEQ ID NO: 2731142 - RNA, 18 nt, Haemophilus influenzae Rd
ucauauauucaacuaaag

SEQ ID NO: 2731143 - RNA, 21 nt, Haemophilus influenzae Rd
ucauauauucaacuaaaggca

SEQ ID NO: 2731144 - RNA, 21 nt, Haemophilus influenzae Rd
ucauauccaaauugagaucuu

SEQ ID NO: 2731145 - RNA, 22 nt, Haemophilus influenzae Rd
ucauauccaccacaauuaauga

SEQ ID NO: 2731146 - RNA, 14 nt, Haemophilus influenzae Rd
ucauaucuaacaua

SEQ ID NO: 2731147 - RNA, 15 nt, Haemophilus influenzae Rd
ucauaucuaacauag

SEQ ID NO: 2731148 - RNA, 21 nt, Haemophilus influenzae Rd
ucauaucugucauauaaccac

SEQ ID NO: 2731149 - RNA, 11 nt, Haemophilus influenzae Rd
ucauauuccca

SEQ ID NO: 2731150 - RNA, 19 nt, Haemophilus influenzae Rd
ucauauucccaaggcucca

SEQ ID NO: 2731151 - RNA, 14 nt, Haemophilus influenzae Rd
ucauauugauuuac

SEQ ID NO: 2731152 - RNA, 16 nt, Haemophilus influenzae Rd
ucauauugauuucucu

SEQ ID NO: 2731153 - RNA, 18 nt, Haemophilus influenzae Rd
ucauauuguuucaacaua

SEQ ID NO: 2731154 - RNA, 11 nt, Haemophilus influenzae Rd
ucauauuucug

SEQ ID NO: 2731155 - RNA, 19 nt, Haemophilus influenzae Rd
ucauauuucugcaaauaaa

SEQ ID NO: 2731156 - RNA, 14 nt, Haemophilus influenzae Rd
ucauauuucuguau

SEQ ID NO: 2731157 - RNA, 17 nt, Haemophilus influenzae Rd
ucauauuucuguauuau

SEQ ID NO: 2731158 - RNA, 17 nt, Haemophilus influenzae Rd
ucauauuuuaaauaauu

SEQ ID NO: 2731159 - RNA, 23 nt, Haemophilus influenzae Rd
ucaucaaaacaccuccagcaaaa

SEQ ID NO: 2731160 - RNA, 22 nt, Haemophilus influenzae Rd
ucaucaauaacacucauuguaa

SEQ ID NO: 2731161 - RNA, 14 nt, Haemophilus influenzae Rd
ucaucaauaucugc

SEQ ID NO: 2731162 - RNA, 16 nt, Haemophilus influenzae Rd
ucaucaaucuucucau

SEQ ID NO: 2731163 - RNA, 18 nt, Haemophilus influenzae Rd
ucaucaaugccauuuuuu

SEQ ID NO: 2731164 - RNA, 21 nt, Haemophilus influenzae Rd
ucaucaaugccauuuuuuaua

SEQ ID NO: 2731165 - RNA, 22 nt, Haemophilus influenzae Rd
ucaucaauggcaucgcuggcua

SEQ ID NO: 2731166 - RNA, 18 nt, Haemophilus influenzae Rd
ucaucaauuugugcauaa

SEQ ID NO: 2731167 - RNA, 20 nt, Haemophilus influenzae Rd
ucaucaauuugugcauaaac

SEQ ID NO: 2731168 - RNA, 14 nt, Haemophilus influenzae Rd
ucaucaauuuugac

SEQ ID NO: 2731169 - RNA, 14 nt, Haemophilus influenzae Rd
ucaucacaaaucuu

SEQ ID NO: 2731170 - RNA, 18 nt, Haemophilus influenzae Rd
ucaucacccaucaaaucu

SEQ ID NO: 2731171 - RNA, 20 nt, Haemophilus influenzae Rd
ucaucacccaucaaaucuuu

SEQ ID NO: 2731172 - RNA, 13 nt, Haemophilus influenzae Rd
ucaucagaaagug

SEQ ID NO: 2731173 - RNA, 18 nt, Haemophilus influenzae Rd
ucaucagaaauaucuuca

SEQ ID NO: 2731174 - RNA, 19 nt, Haemophilus influenzae Rd
ucaucagaaauaucuucaa

SEQ ID NO: 2731175 - RNA, 23 nt, Haemophilus influenzae Rd
ucaucagccgcuuuuugaucucu

SEQ ID NO: 2731176 - RNA, 23 nt, Haemophilus influenzae Rd
ucaucagcuuaucaaucaagaau

SEQ ID NO: 2731177 - RNA, 18 nt, Haemophilus influenzae Rd
ucaucauaauuuauucaa

SEQ ID NO: 2731178 - RNA, 15 nt, Haemophilus influenzae Rd
ucaucauauucacuu

SEQ ID NO: 2731179 - RNA, 13 nt, Haemophilus influenzae Rd
ucaucauuaugaa

SEQ ID NO: 2731180 - RNA, 17 nt, Haemophilus influenzae Rd
ucaucauuuuggcuuua

SEQ ID NO: 2731181 - RNA, 14 nt, Haemophilus influenzae Rd
ucauccaaucauca

SEQ ID NO: 2731182 - RNA, 20 nt, Haemophilus influenzae Rd
ucauccaauccuuuacggga

SEQ ID NO: 2731183 - RNA, 20 nt, Haemophilus influenzae Rd
ucauccauuggauuaagaau

SEQ ID NO: 2731184 - RNA, 16 nt, Haemophilus influenzae Rd
ucaucccaaucuucgu

SEQ ID NO: 2731185 - RNA, 15 nt, Haemophilus influenzae Rd
ucaucccagauuuua

SEQ ID NO: 2731186 - RNA, 14 nt, Haemophilus influenzae Rd
ucauccgcuucguu

SEQ ID NO: 2731187 - RNA, 22 nt, Haemophilus influenzae Rd
ucauccgcuucguuguaaucuu

SEQ ID NO: 2731188 - RNA, 21 nt, Haemophilus influenzae Rd
ucaucgaaaauuaagguugga

SEQ ID NO: 2731189 - RNA, 16 nt, Haemophilus influenzae Rd
ucaucgagaaauacga

SEQ ID NO: 2731190 - RNA, 20 nt, Haemophilus influenzae Rd
ucaucgaguuuuaucuucaa

SEQ ID NO: 2731191 - RNA, 14 nt, Haemophilus influenzae Rd
ucaucgauaaauuc

SEQ ID NO: 2731192 - RNA, 16 nt, Haemophilus influenzae Rd
ucaucgauaaauucaa

SEQ ID NO: 2731193 - RNA, 14 nt, Haemophilus influenzae Rd
ucaucgauguaaag

SEQ ID NO: 2731194 - RNA, 22 nt, Haemophilus influenzae Rd
ucaucgauguaaaguguuacaa

SEQ ID NO: 2731195 - RNA, 18 nt, Haemophilus influenzae Rd
ucaucgccuguuaagcca

SEQ ID NO: 2731196 - RNA, 14 nt, Haemophilus influenzae Rd
ucaucgcgcaaaau

SEQ ID NO: 2731197 - RNA, 14 nt, Haemophilus influenzae Rd
ucaucgcucaucgu

SEQ ID NO: 2731198 - RNA, 13 nt, Haemophilus influenzae Rd
ucaucgcuucuaa

SEQ ID NO: 2731199 - RNA, 17 nt, Haemophilus influenzae Rd
ucaucggacgaaucaca

SEQ ID NO: 2731200 - RNA, 19 nt, Haemophilus influenzae Rd
ucaucgguucuuuuaauuc

SEQ ID NO: 2731201 - RNA, 20 nt, Haemophilus influenzae Rd
ucaucguaauuaaacaaaau

SEQ ID NO: 2731202 - RNA, 16 nt, Haemophilus influenzae Rd
ucaucguuaauuaauu

SEQ ID NO: 2731203 - RNA, 12 nt, Haemophilus influenzae Rd
ucaucuaacaca

SEQ ID NO: 2731204 - RNA, 18 nt, Haemophilus influenzae Rd
ucaucuagauuucuaucc

SEQ ID NO: 2731205 - RNA, 15 nt, Haemophilus influenzae Rd
ucaucucaaauguga

SEQ ID NO: 2731206 - RNA, 21 nt, Haemophilus influenzae Rd
ucaucucgaccacaacagaga

SEQ ID NO: 2731207 - RNA, 18 nt, Haemophilus influenzae Rd
ucaucucuaaccuaaaau

SEQ ID NO: 2731208 - RNA, 21 nt, Haemophilus influenzae Rd
ucaucucuaaccuaaaauaga

SEQ ID NO: 2731209 - RNA, 17 nt, Haemophilus influenzae Rd
ucaucucuuguuuuucc

SEQ ID NO: 2731210 - RNA, 16 nt, Haemophilus influenzae Rd
ucaucugcauaacgau

SEQ ID NO: 2731211 - RNA, 14 nt, Haemophilus influenzae Rd
ucaucugcaucaca

SEQ ID NO: 2731212 - RNA, 11 nt, Haemophilus influenzae Rd
ucaucugcugg

SEQ ID NO: 2731213 - RNA, 16 nt, Haemophilus influenzae Rd
ucaucugcugguuuua

SEQ ID NO: 2731214 - RNA, 21 nt, Haemophilus influenzae Rd
ucaucuucagcauuuaaaauu

SEQ ID NO: 2731215 - RNA, 19 nt, Haemophilus influenzae Rd
ucaucuucaucugcaucac

SEQ ID NO: 2731216 - RNA, 23 nt, Haemophilus influenzae Rd
ucaucuucuuuugcccauucuaa

SEQ ID NO: 2731217 - RNA, 16 nt, Haemophilus influenzae Rd
ucaucuugauccauau

SEQ ID NO: 2731218 - RNA, 14 nt, Haemophilus influenzae Rd
ucaucuuuaaacau

SEQ ID NO: 2731219 - RNA, 14 nt, Haemophilus influenzae Rd
ucaucuuuacccac

SEQ ID NO: 2731220 - RNA, 16 nt, Haemophilus influenzae Rd
ucaucuuuuaaauaac

SEQ ID NO: 2731221 - RNA, 23 nt, Haemophilus influenzae Rd
ucaucuuuuuuaagauaaguggg

SEQ ID NO: 2731222 - RNA, 16 nt, Haemophilus influenzae Rd
ucaugaauaauuuugu

SEQ ID NO: 2731223 - RNA, 24 nt, Haemophilus influenzae Rd
ucaugaguuguuuuuucaguuguu

SEQ ID NO: 2731224 - RNA, 19 nt, Haemophilus influenzae Rd
ucaugauguaauucugcuu

SEQ ID NO: 2731225 - RNA, 18 nt, Haemophilus influenzae Rd
ucaugauuaacaaugauu

SEQ ID NO: 2731226 - RNA, 20 nt, Haemophilus influenzae Rd
ucaugccgcaaucaagcaaa

SEQ ID NO: 2731227 - RNA, 20 nt, Haemophilus influenzae Rd
ucauggcgaccauucucuaa

SEQ ID NO: 2731228 - RNA, 14 nt, Haemophilus influenzae Rd
ucaugguaauuuaa

SEQ ID NO: 2731229 - RNA, 17 nt, Haemophilus influenzae Rd
ucaugguaauuuaauua

SEQ ID NO: 2731230 - RNA, 17 nt, Haemophilus influenzae Rd
ucaugguuucaaccauu

SEQ ID NO: 2731231 - RNA, 21 nt, Haemophilus influenzae Rd
ucauguaaauaguuauuuauu

SEQ ID NO: 2731232 - RNA, 22 nt, Haemophilus influenzae Rd
ucaugugggcuuuacaaugagu

SEQ ID NO: 2731233 - RNA, 15 nt, Haemophilus influenzae Rd
ucauguguaggcaua

SEQ ID NO: 2731234 - RNA, 17 nt, Haemophilus influenzae Rd
ucauguucgaguuggcu

SEQ ID NO: 2731235 - RNA, 14 nt, Haemophilus influenzae Rd
ucauuaaaaaauaa

SEQ ID NO: 2731236 - RNA, 22 nt, Haemophilus influenzae Rd
ucauuaaaaccaauuuuuucau

SEQ ID NO: 2731237 - RNA, 13 nt, Haemophilus influenzae Rd
ucauuaaaaucug

SEQ ID NO: 2731238 - RNA, 12 nt, Haemophilus influenzae Rd
ucauuaaauaac

SEQ ID NO: 2731239 - RNA, 22 nt, Haemophilus influenzae Rd
ucauuaaauaacucaagcaacc

SEQ ID NO: 2731240 - RNA, 18 nt, Haemophilus influenzae Rd
ucauuaacgcuuaaauga

SEQ ID NO: 2731241 - RNA, 17 nt, Haemophilus influenzae Rd
ucauuaagccugcuaca

SEQ ID NO: 2731242 - RNA, 13 nt, Haemophilus influenzae Rd
ucauuaauacaca

SEQ ID NO: 2731243 - RNA, 18 nt, Haemophilus influenzae Rd
ucauuaauacagugcaga

SEQ ID NO: 2731244 - RNA, 19 nt, Haemophilus influenzae Rd
ucauuacacaaaauauucu

SEQ ID NO: 2731245 - RNA, 19 nt, Haemophilus influenzae Rd
ucauuacgugcaaauaaau

SEQ ID NO: 2731246 - RNA, 20 nt, Haemophilus influenzae Rd
ucauuacgugcaaauaaauu

SEQ ID NO: 2731247 - RNA, 19 nt, Haemophilus influenzae Rd
ucauuacuuuaaagccgua

SEQ ID NO: 2731248 - RNA, 14 nt, Haemophilus influenzae Rd
ucauuauauuccuu

SEQ ID NO: 2731249 - RNA, 21 nt, Haemophilus influenzae Rd
ucauuauauugugcauaguuu

SEQ ID NO: 2731250 - RNA, 13 nt, Haemophilus influenzae Rd
ucauuauauuuaa

SEQ ID NO: 2731251 - RNA, 15 nt, Haemophilus influenzae Rd
ucauuauauuuaaua

SEQ ID NO: 2731252 - RNA, 19 nt, Haemophilus influenzae Rd
ucauuauauuuaauacuuu

SEQ ID NO: 2731253 - RNA, 15 nt, Haemophilus influenzae Rd
ucauuauccaacauu

SEQ ID NO: 2731254 - RNA, 18 nt, Haemophilus influenzae Rd
ucauuauccaacauuaau

SEQ ID NO: 2731255 - RNA, 20 nt, Haemophilus influenzae Rd
ucauuauccaacauuaauaa

SEQ ID NO: 2731256 - RNA, 14 nt, Haemophilus influenzae Rd
ucauucaaauaauu

SEQ ID NO: 2731257 - RNA, 21 nt, Haemophilus influenzae Rd
ucauucaacaaaaaugccuuu

SEQ ID NO: 2731258 - RNA, 16 nt, Haemophilus influenzae Rd
ucauucaaugcagaaa

SEQ ID NO: 2731259 - RNA, 14 nt, Haemophilus influenzae Rd
ucauucacaucuug

SEQ ID NO: 2731260 - RNA, 22 nt, Haemophilus influenzae Rd
ucauuccauuuugcauauugaa

SEQ ID NO: 2731261 - RNA, 17 nt, Haemophilus influenzae Rd
ucauucgcaucauagca

SEQ ID NO: 2731262 - RNA, 19 nt, Haemophilus influenzae Rd
ucauucguauaaauauuuc

SEQ ID NO: 2731263 - RNA, 17 nt, Haemophilus influenzae Rd
ucauucuauuuuaaaaa

SEQ ID NO: 2731264 - RNA, 14 nt, Haemophilus influenzae Rd
ucauugaaggucau

SEQ ID NO: 2731265 - RNA, 19 nt, Haemophilus influenzae Rd
ucauugaaggucauacgau

SEQ ID NO: 2731266 - RNA, 18 nt, Haemophilus influenzae Rd
ucauugauggaauaaauu

SEQ ID NO: 2731267 - RNA, 16 nt, Haemophilus influenzae Rd
ucauugauggcucgaa

SEQ ID NO: 2731268 - RNA, 16 nt, Haemophilus influenzae Rd
ucauugcuccacuucu

SEQ ID NO: 2731269 - RNA, 21 nt, Haemophilus influenzae Rd
ucauugcucgacaaagauuuu

SEQ ID NO: 2731270 - RNA, 14 nt, Haemophilus influenzae Rd
ucauugcugcuuua

SEQ ID NO: 2731271 - RNA, 13 nt, Haemophilus influenzae Rd
ucauugcuugagu

SEQ ID NO: 2731272 - RNA, 18 nt, Haemophilus influenzae Rd
ucauuggcgguuuugcca

SEQ ID NO: 2731273 - RNA, 19 nt, Haemophilus influenzae Rd
ucauuggcgguuuugccaa

SEQ ID NO: 2731274 - RNA, 23 nt, Haemophilus influenzae Rd
ucauuggcgguuuugccaauacu

SEQ ID NO: 2731275 - RNA, 17 nt, Haemophilus influenzae Rd
ucauuggggaacggaag

SEQ ID NO: 2731276 - RNA, 14 nt, Haemophilus influenzae Rd
ucauugugaucaga

SEQ ID NO: 2731277 - RNA, 18 nt, Haemophilus influenzae Rd
ucauuguggaaacgugca

SEQ ID NO: 2731278 - RNA, 14 nt, Haemophilus influenzae Rd
ucauuguuaaauaa

SEQ ID NO: 2731279 - RNA, 17 nt, Haemophilus influenzae Rd
ucauuguuuccacacga

SEQ ID NO: 2731280 - RNA, 13 nt, Haemophilus influenzae Rd
ucauuuaaaauau

SEQ ID NO: 2731281 - RNA, 13 nt, Haemophilus influenzae Rd
ucauuuaauaauu

SEQ ID NO: 2731282 - RNA, 12 nt, Haemophilus influenzae Rd
ucauuuauaaaa

SEQ ID NO: 2731283 - RNA, 14 nt, Haemophilus influenzae Rd
ucauuuauauaaaa

SEQ ID NO: 2731284 - RNA, 22 nt, Haemophilus influenzae Rd
ucauuuauggaaauaaauccug

SEQ ID NO: 2731285 - RNA, 12 nt, Haemophilus influenzae Rd
ucauuuauuaaa

SEQ ID NO: 2731286 - RNA, 13 nt, Haemophilus influenzae Rd
ucauuuauuaaaa

SEQ ID NO: 2731287 - RNA, 16 nt, Haemophilus influenzae Rd
ucauuuauuaaaagua

SEQ ID NO: 2731288 - RNA, 21 nt, Haemophilus influenzae Rd
ucauuuauuaaaaguaaacaa

SEQ ID NO: 2731289 - RNA, 15 nt, Haemophilus influenzae Rd
ucauuucaauaucaa

SEQ ID NO: 2731290 - RNA, 20 nt, Haemophilus influenzae Rd
ucauuucucgggcugaaaua

SEQ ID NO: 2731291 - RNA, 22 nt, Haemophilus influenzae Rd
ucauuucucgggcugaaauacc

SEQ ID NO: 2731292 - RNA, 12 nt, Haemophilus influenzae Rd
ucauuucuuaau

SEQ ID NO: 2731293 - RNA, 21 nt, Haemophilus influenzae Rd
ucauuugacgauuaauaccaa

SEQ ID NO: 2731294 - RNA, 16 nt, Haemophilus influenzae Rd
ucauuugcaauaucua

SEQ ID NO: 2731295 - RNA, 14 nt, Haemophilus influenzae Rd
ucauuugcccauac

SEQ ID NO: 2731296 - RNA, 19 nt, Haemophilus influenzae Rd
ucauuugccgccaaaauga

SEQ ID NO: 2731297 - RNA, 20 nt, Haemophilus influenzae Rd
ucauuugccgccaaaaugag

SEQ ID NO: 2731298 - RNA, 20 nt, Haemophilus influenzae Rd
ucauuugcgccaauaauaaa

SEQ ID NO: 2731299 - RNA, 18 nt, Haemophilus influenzae Rd
ucauuugcucuaaaugug

SEQ ID NO: 2731300 - RNA, 19 nt, Haemophilus influenzae Rd
ucauuugcucuaaauguga

SEQ ID NO: 2731301 - RNA, 18 nt, Haemophilus influenzae Rd
ucauuugcuucuaucaga

SEQ ID NO: 2731302 - RNA, 16 nt, Haemophilus influenzae Rd
ucauuuggaucuaaaa

SEQ ID NO: 2731303 - RNA, 18 nt, Haemophilus influenzae Rd
ucauuuggaucuaaaaaa

SEQ ID NO: 2731304 - RNA, 22 nt, Haemophilus influenzae Rd
ucauuuguuagaucaguuuuac

SEQ ID NO: 2731305 - RNA, 19 nt, Haemophilus influenzae Rd
ucauuuguugguaaaucua

SEQ ID NO: 2731306 - RNA, 20 nt, Haemophilus influenzae Rd
ucauuuguugguaaaucuaa

SEQ ID NO: 2731307 - RNA, 11 nt, Haemophilus influenzae Rd
ucauuuuaaaa

SEQ ID NO: 2731308 - RNA, 19 nt, Haemophilus influenzae Rd
ucauuuuagaauccaaaau

SEQ ID NO: 2731309 - RNA, 21 nt, Haemophilus influenzae Rd
ucauuuuagguucaauaaugu

SEQ ID NO: 2731310 - RNA, 15 nt, Haemophilus influenzae Rd
ucauuuucaccaauu

SEQ ID NO: 2731311 - RNA, 13 nt, Haemophilus influenzae Rd
ucauuuucacucc

SEQ ID NO: 2731312 - RNA, 20 nt, Haemophilus influenzae Rd
ucauuuucgacauucgcaua

SEQ ID NO: 2731313 - RNA, 17 nt, Haemophilus influenzae Rd
ucauuuugagccauuuc

SEQ ID NO: 2731314 - RNA, 18 nt, Haemophilus influenzae Rd
ucauuuugcguuugagga

SEQ ID NO: 2731315 - RNA, 14 nt, Haemophilus influenzae Rd
ucauuuuggcuuua

SEQ ID NO: 2731316 - RNA, 20 nt, Haemophilus influenzae Rd
ucauuuuuacuuucuuucaa

SEQ ID NO: 2731317 - RNA, 22 nt, Haemophilus influenzae Rd
ucauuuuucgcaaaaucuugcu

SEQ ID NO: 2731318 - RNA, 14 nt, Haemophilus influenzae Rd
ucauuuuuugcaaa

SEQ ID NO: 2731319 - RNA, 16 nt, Haemophilus influenzae Rd
ucauuuuuuuaaauau

SEQ ID NO: 2731320 - RNA, 12 nt, Haemophilus influenzae Rd
uccaaaaaauaa

SEQ ID NO: 2731321 - RNA, 16 nt, Haemophilus influenzae Rd
uccaaaaaauaagggc

SEQ ID NO: 2731322 - RNA, 16 nt, Haemophilus influenzae Rd
uccaaaaaccaacgcc

SEQ ID NO: 2731323 - RNA, 11 nt, Haemophilus influenzae Rd
uccaaaaauau

SEQ ID NO: 2731324 - RNA, 20 nt, Haemophilus influenzae Rd
uccaaaacgugucacuuuac

SEQ ID NO: 2731325 - RNA, 12 nt, Haemophilus influenzae Rd
uccaaacauuuu

SEQ ID NO: 2731326 - RNA, 15 nt, Haemophilus influenzae Rd
uccaaacauuuuuau

SEQ ID NO: 2731327 - RNA, 17 nt, Haemophilus influenzae Rd
uccaaacauuuuuauuu

SEQ ID NO: 2731328 - RNA, 18 nt, Haemophilus influenzae Rd
uccaaacauuuuuauuuu

SEQ ID NO: 2731329 - RNA, 15 nt, Haemophilus influenzae Rd
uccaaacuaaaugcu

SEQ ID NO: 2731330 - RNA, 17 nt, Haemophilus influenzae Rd
uccaaacuggaauaaag

SEQ ID NO: 2731331 - RNA, 18 nt, Haemophilus influenzae Rd
uccaaagaauaauaagug

SEQ ID NO: 2731332 - RNA, 14 nt, Haemophilus influenzae Rd
uccaaagcaauuaa

SEQ ID NO: 2731333 - RNA, 12 nt, Haemophilus influenzae Rd
uccaaaguauaa

SEQ ID NO: 2731334 - RNA, 11 nt, Haemophilus influenzae Rd
uccaaauaaua

SEQ ID NO: 2731335 - RNA, 22 nt, Haemophilus influenzae Rd
uccaaauaauccuagaguaagu

SEQ ID NO: 2731336 - RNA, 15 nt, Haemophilus influenzae Rd
uccaaauauaaaaua

SEQ ID NO: 2731337 - RNA, 16 nt, Haemophilus influenzae Rd
uccaaauauaaaauaa

SEQ ID NO: 2731338 - RNA, 20 nt, Haemophilus influenzae Rd
uccaaauucauuuuuuauuu

SEQ ID NO: 2731339 - RNA, 15 nt, Haemophilus influenzae Rd
uccaaauuccaucaa

SEQ ID NO: 2731340 - RNA, 21 nt, Haemophilus influenzae Rd
uccaaauuccaucaauuaaug

SEQ ID NO: 2731341 - RNA, 14 nt, Haemophilus influenzae Rd
uccaaauucuuuaa

SEQ ID NO: 2731342 - RNA, 17 nt, Haemophilus influenzae Rd
uccaaauucuuuaaauu

SEQ ID NO: 2731343 - RNA, 22 nt, Haemophilus influenzae Rd
uccaaauucuuuaaauucaaua

SEQ ID NO: 2731344 - RNA, 21 nt, Haemophilus influenzae Rd
uccaaauuggguucgcaaaua

SEQ ID NO: 2731345 - RNA, 14 nt, Haemophilus influenzae Rd
uccaacaauuucac

SEQ ID NO: 2731346 - RNA, 15 nt, Haemophilus influenzae Rd
uccaacaauuucacu

SEQ ID NO: 2731347 - RNA, 16 nt, Haemophilus influenzae Rd
uccaacaauuucacug

SEQ ID NO: 2731348 - RNA, 19 nt, Haemophilus influenzae Rd
uccaacaauuucacugaaa

SEQ ID NO: 2731349 - RNA, 22 nt, Haemophilus influenzae Rd
uccaacaauuucacugaaagua

SEQ ID NO: 2731350 - RNA, 14 nt, Haemophilus influenzae Rd
uccaacauuaauaa

SEQ ID NO: 2731351 - RNA, 13 nt, Haemophilus influenzae Rd
uccaaccaauucc

SEQ ID NO: 2731352 - RNA, 14 nt, Haemophilus influenzae Rd
uccaacccagaaua

SEQ ID NO: 2731353 - RNA, 19 nt, Haemophilus influenzae Rd
uccaaccgauaaggaaaau

SEQ ID NO: 2731354 - RNA, 14 nt, Haemophilus influenzae Rd
uccaacguuuuaau

SEQ ID NO: 2731355 - RNA, 14 nt, Haemophilus influenzae Rd
uccaacuaugaaga

SEQ ID NO: 2731356 - RNA, 20 nt, Haemophilus influenzae Rd
uccaacuaugaagacuaaac

SEQ ID NO: 2731357 - RNA, 16 nt, Haemophilus influenzae Rd
uccaacucauuacaca

SEQ ID NO: 2731358 - RNA, 23 nt, Haemophilus influenzae Rd
uccaacucauuacacaaaauauu

SEQ ID NO: 2731359 - RNA, 17 nt, Haemophilus influenzae Rd
uccaagaauuuuaauaa

SEQ ID NO: 2731360 - RNA, 20 nt, Haemophilus influenzae Rd
uccaagcaaagaaauuuuaa

SEQ ID NO: 2731361 - RNA, 14 nt, Haemophilus influenzae Rd
uccaagcaagcaaa

SEQ ID NO: 2731362 - RNA, 15 nt, Haemophilus influenzae Rd
uccaagccauguuga

SEQ ID NO: 2731363 - RNA, 23 nt, Haemophilus influenzae Rd
uccaagcuggcuaacaaauaaug

SEQ ID NO: 2731364 - RNA, 12 nt, Haemophilus influenzae Rd
uccaaggcaauu

SEQ ID NO: 2731365 - RNA, 16 nt, Haemophilus influenzae Rd
uccaagguuuuaauuu

SEQ ID NO: 2731366 - RNA, 17 nt, Haemophilus influenzae Rd
uccaauacaaucagcug

SEQ ID NO: 2731367 - RNA, 20 nt, Haemophilus influenzae Rd
uccaaucagcaaaacuuuuu

SEQ ID NO: 2731368 - RNA, 18 nt, Haemophilus influenzae Rd
uccaaucauauuucugca

SEQ ID NO: 2731369 - RNA, 16 nt, Haemophilus influenzae Rd
uccaaucaucagaaua

SEQ ID NO: 2731370 - RNA, 23 nt, Haemophilus influenzae Rd
uccaaucaucagaauaauuaaca

SEQ ID NO: 2731371 - RNA, 16 nt, Haemophilus influenzae Rd
uccaaucaucauccca

SEQ ID NO: 2731372 - RNA, 19 nt, Haemophilus influenzae Rd
uccaaucaucaucccaauc

SEQ ID NO: 2731373 - RNA, 16 nt, Haemophilus influenzae Rd
uccaauccuaaaucug

SEQ ID NO: 2731374 - RNA, 17 nt, Haemophilus influenzae Rd
uccaaucuaauucuucc

SEQ ID NO: 2731375 - RNA, 17 nt, Haemophilus influenzae Rd
uccaaugugaccaaaua

SEQ ID NO: 2731376 - RNA, 15 nt, Haemophilus influenzae Rd
uccaauguugcaaua

SEQ ID NO: 2731377 - RNA, 16 nt, Haemophilus influenzae Rd
uccaauucuaguucuu

SEQ ID NO: 2731378 - RNA, 16 nt, Haemophilus influenzae Rd
uccaauucuuuuaaau

SEQ ID NO: 2731379 - RNA, 19 nt, Haemophilus influenzae Rd
uccaauucuuuuaaaugug

SEQ ID NO: 2731380 - RNA, 13 nt, Haemophilus influenzae Rd
uccacaaauaaua

SEQ ID NO: 2731381 - RNA, 13 nt, Haemophilus influenzae Rd
uccacaacaacca

SEQ ID NO: 2731382 - RNA, 22 nt, Haemophilus influenzae Rd
uccacaacuucggaagaaaaag

SEQ ID NO: 2731383 - RNA, 17 nt, Haemophilus influenzae Rd
uccacaagcaacaauau

SEQ ID NO: 2731384 - RNA, 20 nt, Haemophilus influenzae Rd
uccacaaucaaucuuuaaaa

SEQ ID NO: 2731385 - RNA, 15 nt, Haemophilus influenzae Rd
uccacaauucuuaaa

SEQ ID NO: 2731386 - RNA, 18 nt, Haemophilus influenzae Rd
uccacacuuuaaaaguuu

SEQ ID NO: 2731387 - RNA, 19 nt, Haemophilus influenzae Rd
uccacacuuuaauaguaaa

SEQ ID NO: 2731388 - RNA, 17 nt, Haemophilus influenzae Rd
uccacagaaacagaaau

SEQ ID NO: 2731389 - RNA, 16 nt, Haemophilus influenzae Rd
uccacagcaaaagaaa

SEQ ID NO: 2731390 - RNA, 16 nt, Haemophilus influenzae Rd
uccacaucacuuaauu

SEQ ID NO: 2731391 - RNA, 21 nt, Haemophilus influenzae Rd
uccacaucagguauaaagaug

SEQ ID NO: 2731392 - RNA, 16 nt, Haemophilus influenzae Rd
uccacaugauauauuu

SEQ ID NO: 2731393 - RNA, 21 nt, Haemophilus influenzae Rd
uccacauuuuuuguaauucgu

SEQ ID NO: 2731394 - RNA, 20 nt, Haemophilus influenzae Rd
uccaccacccuucuuucaaa

SEQ ID NO: 2731395 - RNA, 19 nt, Haemophilus influenzae Rd
uccaccgcacuuuggacaa

SEQ ID NO: 2731396 - RNA, 16 nt, Haemophilus influenzae Rd
uccaccuugaauaaug

SEQ ID NO: 2731397 - RNA, 21 nt, Haemophilus influenzae Rd
uccaccuugauugagaugcca

SEQ ID NO: 2731398 - RNA, 13 nt, Haemophilus influenzae Rd
uccacgagaaaag

SEQ ID NO: 2731399 - RNA, 18 nt, Haemophilus influenzae Rd
uccacgguauuuucuuau

SEQ ID NO: 2731400 - RNA, 20 nt, Haemophilus influenzae Rd
uccacguuguaagcaaaauc

SEQ ID NO: 2731401 - RNA, 18 nt, Haemophilus influenzae Rd
uccacuauaaaauacuau

SEQ ID NO: 2731402 - RNA, 17 nt, Haemophilus influenzae Rd
uccacuauucguaaugc

SEQ ID NO: 2731403 - RNA, 14 nt, Haemophilus influenzae Rd
uccacucuuuuaau

SEQ ID NO: 2731404 - RNA, 15 nt, Haemophilus influenzae Rd
uccacuucauaaauc

SEQ ID NO: 2731405 - RNA, 14 nt, Haemophilus influenzae Rd
uccacuucauccau

SEQ ID NO: 2731406 - RNA, 21 nt, Haemophilus influenzae Rd
uccacuucgggcgaaaccuuu

SEQ ID NO: 2731407 - RNA, 16 nt, Haemophilus influenzae Rd
uccacuucuuauggau

SEQ ID NO: 2731408 - RNA, 18 nt, Haemophilus influenzae Rd
uccacuucuucuuuaaac

SEQ ID NO: 2731409 - RNA, 18 nt, Haemophilus influenzae Rd
uccacuuuccguuuacua

SEQ ID NO: 2731410 - RNA, 15 nt, Haemophilus influenzae Rd
uccacuuugcucuaa

SEQ ID NO: 2731411 - RNA, 14 nt, Haemophilus influenzae Rd
uccacuuuuucauc

SEQ ID NO: 2731412 - RNA, 21 nt, Haemophilus influenzae Rd
uccagaacgaacaauuucuaa

SEQ ID NO: 2731413 - RNA, 22 nt, Haemophilus influenzae Rd
uccagaacgaacaauuucuaac

SEQ ID NO: 2731414 - RNA, 14 nt, Haemophilus influenzae Rd
uccagacgcauucu

SEQ ID NO: 2731415 - RNA, 14 nt, Haemophilus influenzae Rd
uccagauuaaaaau

SEQ ID NO: 2731416 - RNA, 16 nt, Haemophilus influenzae Rd
uccagauuaaaaauuc

SEQ ID NO: 2731417 - RNA, 21 nt, Haemophilus influenzae Rd
uccagcaugagcuucaaaauc

SEQ ID NO: 2731418 - RNA, 16 nt, Haemophilus influenzae Rd
uccagcguaaccaaug

SEQ ID NO: 2731419 - RNA, 14 nt, Haemophilus influenzae Rd
uccagcuacauuca

SEQ ID NO: 2731420 - RNA, 16 nt, Haemophilus influenzae Rd
uccagcuacauucauc

SEQ ID NO: 2731421 - RNA, 14 nt, Haemophilus influenzae Rd
uccaguaaagaauc

SEQ ID NO: 2731422 - RNA, 23 nt, Haemophilus influenzae Rd
uccaguaaugguuacuuuaucac

SEQ ID NO: 2731423 - RNA, 18 nt, Haemophilus influenzae Rd
uccagucaucauagucag

SEQ ID NO: 2731424 - RNA, 13 nt, Haemophilus influenzae Rd
uccaguucuccuu

SEQ ID NO: 2731425 - RNA, 15 nt, Haemophilus influenzae Rd
uccaguucuccuucu

SEQ ID NO: 2731426 - RNA, 20 nt, Haemophilus influenzae Rd
uccaguucuccuucuccauu

SEQ ID NO: 2731427 - RNA, 13 nt, Haemophilus influenzae Rd
uccaguuguucga

SEQ ID NO: 2731428 - RNA, 17 nt, Haemophilus influenzae Rd
uccauaaaagaccucuc

SEQ ID NO: 2731429 - RNA, 11 nt, Haemophilus influenzae Rd
uccauaacaac

SEQ ID NO: 2731430 - RNA, 15 nt, Haemophilus influenzae Rd
uccauaacaaccauu

SEQ ID NO: 2731431 - RNA, 19 nt, Haemophilus influenzae Rd
uccauaauaucuuucuucg

SEQ ID NO: 2731432 - RNA, 23 nt, Haemophilus influenzae Rd
uccauaauguucccuauaaauaa

SEQ ID NO: 2731433 - RNA, 20 nt, Haemophilus influenzae Rd
uccauaauuucagcaucaga

SEQ ID NO: 2731434 - RNA, 22 nt, Haemophilus influenzae Rd
uccauaauuucagcaucagaaa

SEQ ID NO: 2731435 - RNA, 16 nt, Haemophilus influenzae Rd
uccauacaguaaaaau

SEQ ID NO: 2731436 - RNA, 15 nt, Haemophilus influenzae Rd
uccauaccaaaaugu

SEQ ID NO: 2731437 - RNA, 16 nt, Haemophilus influenzae Rd
uccauacccuugcuuc

SEQ ID NO: 2731438 - RNA, 17 nt, Haemophilus influenzae Rd
uccauaucacauuuuau

SEQ ID NO: 2731439 - RNA, 14 nt, Haemophilus influenzae Rd
uccaucaaauccgc

SEQ ID NO: 2731440 - RNA, 20 nt, Haemophilus influenzae Rd
uccaucaauucuucccaauc

SEQ ID NO: 2731441 - RNA, 13 nt, Haemophilus influenzae Rd
uccaucaccuuca

SEQ ID NO: 2731442 - RNA, 15 nt, Haemophilus influenzae Rd
uccauccagaaaauu

SEQ ID NO: 2731443 - RNA, 14 nt, Haemophilus influenzae Rd
uccaugacagaauu

SEQ ID NO: 2731444 - RNA, 17 nt, Haemophilus influenzae Rd
uccaugaugaaauaauu

SEQ ID NO: 2731445 - RNA, 13 nt, Haemophilus influenzae Rd
uccaugccuaauu

SEQ ID NO: 2731446 - RNA, 15 nt, Haemophilus influenzae Rd
uccauuaagcacagg

SEQ ID NO: 2731447 - RNA, 17 nt, Haemophilus influenzae Rd
uccauuacguucauaua

SEQ ID NO: 2731448 - RNA, 15 nt, Haemophilus influenzae Rd
uccauucacuuucac

SEQ ID NO: 2731449 - RNA, 17 nt, Haemophilus influenzae Rd
uccauuccugcaagaaa

SEQ ID NO: 2731450 - RNA, 20 nt, Haemophilus influenzae Rd
uccauuccugcaagaaaaau

SEQ ID NO: 2731451 - RNA, 22 nt, Haemophilus influenzae Rd
uccauuccugcaagaaaaaugu

SEQ ID NO: 2731452 - RNA, 16 nt, Haemophilus influenzae Rd
uccauucuaaaaaaau

SEQ ID NO: 2731453 - RNA, 18 nt, Haemophilus influenzae Rd
uccauucuaguugcggug

SEQ ID NO: 2731454 - RNA, 17 nt, Haemophilus influenzae Rd
uccauugcaauuucagc

SEQ ID NO: 2731455 - RNA, 21 nt, Haemophilus influenzae Rd
uccauugcauccacuucaucc

SEQ ID NO: 2731456 - RNA, 22 nt, Haemophilus influenzae Rd
uccauugggaagcuggaaguaa

SEQ ID NO: 2731457 - RNA, 16 nt, Haemophilus influenzae Rd
uccauugguggguuca

SEQ ID NO: 2731458 - RNA, 15 nt, Haemophilus influenzae Rd
uccauuucaauaucu

SEQ ID NO: 2731459 - RNA, 20 nt, Haemophilus influenzae Rd
uccauuucaauaucuaagaa

SEQ ID NO: 2731460 - RNA, 16 nt, Haemophilus influenzae Rd
uccauuucaaucacug

SEQ ID NO: 2731461 - RNA, 17 nt, Haemophilus influenzae Rd
uccauuucaaucacuga

SEQ ID NO: 2731462 - RNA, 18 nt, Haemophilus influenzae Rd
uccauuuuuaaauggucu

SEQ ID NO: 2731463 - RNA, 15 nt, Haemophilus influenzae Rd
uccauuuuuaguaau

SEQ ID NO: 2731464 - RNA, 16 nt, Haemophilus influenzae Rd
uccauuuuuuucuauu

SEQ ID NO: 2731465 - RNA, 16 nt, Haemophilus influenzae Rd
ucccaaaagcaaauga

SEQ ID NO: 2731466 - RNA, 23 nt, Haemophilus influenzae Rd
ucccaaaaugcuugaauaaauga

SEQ ID NO: 2731467 - RNA, 13 nt, Haemophilus influenzae Rd
ucccaaggcucca

SEQ ID NO: 2731468 - RNA, 14 nt, Haemophilus influenzae Rd
ucccaaucuucguc

SEQ ID NO: 2731469 - RNA, 19 nt, Haemophilus influenzae Rd
ucccaaucuuguuuuaauu

SEQ ID NO: 2731470 - RNA, 22 nt, Haemophilus influenzae Rd
ucccaaugcaccaaaaauccuc

SEQ ID NO: 2731471 - RNA, 17 nt, Haemophilus influenzae Rd
ucccacuuguuuuuuca

SEQ ID NO: 2731472 - RNA, 16 nt, Haemophilus influenzae Rd
ucccagcguaaaaaug

SEQ ID NO: 2731473 - RNA, 19 nt, Haemophilus influenzae Rd
ucccagcguaaaaaugcug

SEQ ID NO: 2731474 - RNA, 22 nt, Haemophilus influenzae Rd
ucccauaccguauuuuuuuaau

SEQ ID NO: 2731475 - RNA, 23 nt, Haemophilus influenzae Rd
ucccauagcggauaaccaaaaua

SEQ ID NO: 2731476 - RNA, 23 nt, Haemophilus influenzae Rd
ucccauauacuugccaaaacgac

SEQ ID NO: 2731477 - RNA, 14 nt, Haemophilus influenzae Rd
ucccauauuuaaaa

SEQ ID NO: 2731478 - RNA, 22 nt, Haemophilus influenzae Rd
ucccaucuuuaagaguaaauuu

SEQ ID NO: 2731479 - RNA, 18 nt, Haemophilus influenzae Rd
ucccauucuuaaaucaua

SEQ ID NO: 2731480 - RNA, 21 nt, Haemophilus influenzae Rd
ucccauugcaaaauagaugua

SEQ ID NO: 2731481 - RNA, 17 nt, Haemophilus influenzae Rd
ucccauugugcaauuaa

SEQ ID NO: 2731482 - RNA, 15 nt, Haemophilus influenzae Rd
ucccauuuaaccccu

SEQ ID NO: 2731483 - RNA, 23 nt, Haemophilus influenzae Rd
ucccauuugaauuuuacuucuuc

SEQ ID NO: 2731484 - RNA, 20 nt, Haemophilus influenzae Rd
uccccaaguuugcacuucuu

SEQ ID NO: 2731485 - RNA, 16 nt, Haemophilus influenzae Rd
uccccaaugaugacga

SEQ ID NO: 2731486 - RNA, 22 nt, Haemophilus influenzae Rd
uccccauaaaccgccaaaaauu

SEQ ID NO: 2731487 - RNA, 19 nt, Haemophilus influenzae Rd
uccccauacaaguauuuuc

SEQ ID NO: 2731488 - RNA, 22 nt, Haemophilus influenzae Rd
uccccauacaaguauuuuccuu

SEQ ID NO: 2731489 - RNA, 14 nt, Haemophilus influenzae Rd
uccccauaucucug

SEQ ID NO: 2731490 - RNA, 18 nt, Haemophilus influenzae Rd
uccccauucuuuucgcaa

SEQ ID NO: 2731491 - RNA, 22 nt, Haemophilus influenzae Rd
ucccccaaucccucaaauacac

SEQ ID NO: 2731492 - RNA, 19 nt, Haemophilus influenzae Rd
ucccccccaauaaaaagau

SEQ ID NO: 2731493 - RNA, 18 nt, Haemophilus influenzae Rd
ucccccuuauuuuuuaau

SEQ ID NO: 2731494 - RNA, 19 nt, Haemophilus influenzae Rd
uccccgaugauuuuuacaa

SEQ ID NO: 2731495 - RNA, 14 nt, Haemophilus influenzae Rd
uccccguuaaauuu

SEQ ID NO: 2731496 - RNA, 21 nt, Haemophilus influenzae Rd
uccccucauguuuucgguuua

SEQ ID NO: 2731497 - RNA, 20 nt, Haemophilus influenzae Rd
uccccuugauuauuuuuuaa

SEQ ID NO: 2731498 - RNA, 21 nt, Haemophilus influenzae Rd
uccccuugauuauuuuuuaac

SEQ ID NO: 2731499 - RNA, 16 nt, Haemophilus influenzae Rd
uccccuuguucuaaag

SEQ ID NO: 2731500 - RNA, 17 nt, Haemophilus influenzae Rd
uccccuuguucuucaua

SEQ ID NO: 2731501 - RNA, 19 nt, Haemophilus influenzae Rd
uccccuuguucuucauaga

SEQ ID NO: 2731502 - RNA, 20 nt, Haemophilus influenzae Rd
ucccgcaacuuuugcaaaau

SEQ ID NO: 2731503 - RNA, 17 nt, Haemophilus influenzae Rd
ucccuaaaaucuucgcu

SEQ ID NO: 2731504 - RNA, 14 nt, Haemophilus influenzae Rd
ucccuauaaauaaa

SEQ ID NO: 2731505 - RNA, 20 nt, Haemophilus influenzae Rd
ucccuauacuccacuauaaa

SEQ ID NO: 2731506 - RNA, 16 nt, Haemophilus influenzae Rd
ucccucaaaauuauga

SEQ ID NO: 2731507 - RNA, 14 nt, Haemophilus influenzae Rd
ucccuugugucuac

SEQ ID NO: 2731508 - RNA, 14 nt, Haemophilus influenzae Rd
ucccuuuucuuauu

SEQ ID NO: 2731509 - RNA, 15 nt, Haemophilus influenzae Rd
uccgacauuuuacua

SEQ ID NO: 2731510 - RNA, 19 nt, Haemophilus influenzae Rd
uccgacuaaaaccaagaaa

SEQ ID NO: 2731511 - RNA, 16 nt, Haemophilus influenzae Rd
uccgagcucuuucauu

SEQ ID NO: 2731512 - RNA, 22 nt, Haemophilus influenzae Rd
uccgagcucuuucauuaaauua

SEQ ID NO: 2731513 - RNA, 13 nt, Haemophilus influenzae Rd
uccgauuuuaauu

SEQ ID NO: 2731514 - RNA, 21 nt, Haemophilus influenzae Rd
uccgcaacauaagcugcauca

SEQ ID NO: 2731515 - RNA, 13 nt, Haemophilus influenzae Rd
uccgcaauuaauc

SEQ ID NO: 2731516 - RNA, 16 nt, Haemophilus influenzae Rd
uccgcaauuaauccau

SEQ ID NO: 2731517 - RNA, 23 nt, Haemophilus influenzae Rd
uccgcacgcgugaugaaacaauc

SEQ ID NO: 2731518 - RNA, 22 nt, Haemophilus influenzae Rd
uccgcacguaguaaauuuucca

SEQ ID NO: 2731519 - RNA, 16 nt, Haemophilus influenzae Rd
uccgcauaaauaauaa

SEQ ID NO: 2731520 - RNA, 13 nt, Haemophilus influenzae Rd
uccgcauuuggug

SEQ ID NO: 2731521 - RNA, 23 nt, Haemophilus influenzae Rd
uccgccaagugcgguugaaaaau

SEQ ID NO: 2731522 - RNA, 13 nt, Haemophilus influenzae Rd
uccgccaaugcuu

SEQ ID NO: 2731523 - RNA, 18 nt, Haemophilus influenzae Rd
uccgccaaugcuuuuaau

SEQ ID NO: 2731524 - RNA, 17 nt, Haemophilus influenzae Rd
uccgccuacacgagaau

SEQ ID NO: 2731525 - RNA, 17 nt, Haemophilus influenzae Rd
uccgccuugagauguuu

SEQ ID NO: 2731526 - RNA, 14 nt, Haemophilus influenzae Rd
uccgcgacauuaag

SEQ ID NO: 2731527 - RNA, 13 nt, Haemophilus influenzae Rd
uccgcuaaaaaug

SEQ ID NO: 2731528 - RNA, 13 nt, Haemophilus influenzae Rd
uccgcugcucuac

SEQ ID NO: 2731529 - RNA, 20 nt, Haemophilus influenzae Rd
uccgcuuuuuucgcaccaau

SEQ ID NO: 2731530 - RNA, 14 nt, Haemophilus influenzae Rd
uccgguuggaaaag

SEQ ID NO: 2731531 - RNA, 18 nt, Haemophilus influenzae Rd
uccgguuggaaaagccuu

SEQ ID NO: 2731532 - RNA, 16 nt, Haemophilus influenzae Rd
uccguaaauucaaaua

SEQ ID NO: 2731533 - RNA, 21 nt, Haemophilus influenzae Rd
uccguauaagcuaaagcaauu

SEQ ID NO: 2731534 - RNA, 17 nt, Haemophilus influenzae Rd
uccguaucauuuaauaa

SEQ ID NO: 2731535 - RNA, 18 nt, Haemophilus influenzae Rd
uccguaucauuuaauaau

SEQ ID NO: 2731536 - RNA, 17 nt, Haemophilus influenzae Rd
uccgucaauaucccaac

SEQ ID NO: 2731537 - RNA, 13 nt, Haemophilus influenzae Rd
uccgugaacugag

SEQ ID NO: 2731538 - RNA, 23 nt, Haemophilus influenzae Rd
uccgugaacugaguuuucacgcu

SEQ ID NO: 2731539 - RNA, 18 nt, Haemophilus influenzae Rd
uccguuccacuuccugcu

SEQ ID NO: 2731540 - RNA, 12 nt, Haemophilus influenzae Rd
uccguucuaaag

SEQ ID NO: 2731541 - RNA, 18 nt, Haemophilus influenzae Rd
uccguuggcucaagccuu

SEQ ID NO: 2731542 - RNA, 14 nt, Haemophilus influenzae Rd
uccguuuuuuucac

SEQ ID NO: 2731543 - RNA, 16 nt, Haemophilus influenzae Rd
uccuaaaauacaaaua

SEQ ID NO: 2731544 - RNA, 14 nt, Haemophilus influenzae Rd
uccuaaacuacaac

SEQ ID NO: 2731545 - RNA, 12 nt, Haemophilus influenzae Rd
uccuaaauaaag

SEQ ID NO: 2731546 - RNA, 22 nt, Haemophilus influenzae Rd
uccuaaauaaagauuauuuaua

SEQ ID NO: 2731547 - RNA, 23 nt, Haemophilus influenzae Rd
uccuaacaauaauuugccaaauc

SEQ ID NO: 2731548 - RNA, 23 nt, Haemophilus influenzae Rd
uccuaaugcagcagcuucuucuu

SEQ ID NO: 2731549 - RNA, 19 nt, Haemophilus influenzae Rd
uccuaaugugcaaucagca

SEQ ID NO: 2731550 - RNA, 18 nt, Haemophilus influenzae Rd
uccuacacccauuacacc

SEQ ID NO: 2731551 - RNA, 14 nt, Haemophilus influenzae Rd
uccuacagaacccg

SEQ ID NO: 2731552 - RNA, 22 nt, Haemophilus influenzae Rd
uccuacagugacuaaaacaaca

SEQ ID NO: 2731553 - RNA, 15 nt, Haemophilus influenzae Rd
uccuacaucgccuug

SEQ ID NO: 2731554 - RNA, 12 nt, Haemophilus influenzae Rd
uccuacauuaaa

SEQ ID NO: 2731555 - RNA, 23 nt, Haemophilus influenzae Rd
uccuacguauuaucguagguuuu

SEQ ID NO: 2731556 - RNA, 14 nt, Haemophilus influenzae Rd
uccuacuacagccc

SEQ ID NO: 2731557 - RNA, 21 nt, Haemophilus influenzae Rd
uccuaggguucgaaucccuau

SEQ ID NO: 2731558 - RNA, 22 nt, Haemophilus influenzae Rd
uccuauaaaacaaauaagccca

SEQ ID NO: 2731559 - RNA, 12 nt, Haemophilus influenzae Rd
uccuauacuaau

SEQ ID NO: 2731560 - RNA, 13 nt, Haemophilus influenzae Rd
uccuauacuaauu

SEQ ID NO: 2731561 - RNA, 22 nt, Haemophilus influenzae Rd
uccuauuaauuuaauucuaaau

SEQ ID NO: 2731562 - RNA, 12 nt, Haemophilus influenzae Rd
uccuauucuaaa

SEQ ID NO: 2731563 - RNA, 13 nt, Haemophilus influenzae Rd
uccuauucuaaau

SEQ ID NO: 2731564 - RNA, 19 nt, Haemophilus influenzae Rd
uccucacucgcauaggugu

SEQ ID NO: 2731565 - RNA, 20 nt, Haemophilus influenzae Rd
uccucagauaaucuacaaaa

SEQ ID NO: 2731566 - RNA, 23 nt, Haemophilus influenzae Rd
uccucagauaaucuacaaaacau

SEQ ID NO: 2731567 - RNA, 14 nt, Haemophilus influenzae Rd
uccucagcaaaaga

SEQ ID NO: 2731568 - RNA, 18 nt, Haemophilus influenzae Rd
uccucagcaauuucuuca

SEQ ID NO: 2731569 - RNA, 19 nt, Haemophilus influenzae Rd
uccucagcaauuucuucag

SEQ ID NO: 2731570 - RNA, 11 nt, Haemophilus influenzae Rd
uccucccauuc

SEQ ID NO: 2731571 - RNA, 21 nt, Haemophilus influenzae Rd
uccucuaaauaaaaacgcccu

SEQ ID NO: 2731572 - RNA, 12 nt, Haemophilus influenzae Rd
uccucugcaggc

SEQ ID NO: 2731573 - RNA, 20 nt, Haemophilus influenzae Rd
uccucugcaggcauuuucaa

SEQ ID NO: 2731574 - RNA, 13 nt, Haemophilus influenzae Rd
uccucuuuaaaau

SEQ ID NO: 2731575 - RNA, 16 nt, Haemophilus influenzae Rd
uccucuuuuauguuuc

SEQ ID NO: 2731576 - RNA, 23 nt, Haemophilus influenzae Rd
uccugaaaguagauauuucucac

SEQ ID NO: 2731577 - RNA, 22 nt, Haemophilus influenzae Rd
uccugagaaagggauuuuaauu

SEQ ID NO: 2731578 - RNA, 22 nt, Haemophilus influenzae Rd
uccugaugaauuuaguacuucc

SEQ ID NO: 2731579 - RNA, 19 nt, Haemophilus influenzae Rd
uccugcaagaaaaauguuu

SEQ ID NO: 2731580 - RNA, 13 nt, Haemophilus influenzae Rd
uccugcaucagug

SEQ ID NO: 2731581 - RNA, 18 nt, Haemophilus influenzae Rd
uccuguauaauuuuucac

SEQ ID NO: 2731582 - RNA, 16 nt, Haemophilus influenzae Rd
uccuguuguuuuuuac

SEQ ID NO: 2731583 - RNA, 15 nt, Haemophilus influenzae Rd
uccuuaauuucauua

SEQ ID NO: 2731584 - RNA, 14 nt, Haemophilus influenzae Rd
uccuuauaauauga

SEQ ID NO: 2731585 - RNA, 21 nt, Haemophilus influenzae Rd
uccuuaucgguuggauuuuaa

SEQ ID NO: 2731586 - RNA, 13 nt, Haemophilus influenzae Rd
uccuuauucaaau

SEQ ID NO: 2731587 - RNA, 23 nt, Haemophilus influenzae Rd
uccuucaaacgccguucaaaauc

SEQ ID NO: 2731588 - RNA, 16 nt, Haemophilus influenzae Rd
uccuucaaauucuaca

SEQ ID NO: 2731589 - RNA, 20 nt, Haemophilus influenzae Rd
uccuucaaucgcaucauuca

SEQ ID NO: 2731590 - RNA, 14 nt, Haemophilus influenzae Rd
uccuuccaaaucca

SEQ ID NO: 2731591 - RNA, 18 nt, Haemophilus influenzae Rd
uccuuccaacaauuucac

SEQ ID NO: 2731592 - RNA, 17 nt, Haemophilus influenzae Rd
uccuucuauaucagaaa

SEQ ID NO: 2731593 - RNA, 22 nt, Haemophilus influenzae Rd
uccuucugccauaacgcuaucu

SEQ ID NO: 2731594 - RNA, 10 nt, Haemophilus influenzae Rd
uccuucuucg

SEQ ID NO: 2731595 - RNA, 21 nt, Haemophilus influenzae Rd
uccuucuucggcgaggcauuc

SEQ ID NO: 2731596 - RNA, 18 nt, Haemophilus influenzae Rd
uccuugaauaucaaggag

SEQ ID NO: 2731597 - RNA, 15 nt, Haemophilus influenzae Rd
uccuugcugauucac

SEQ ID NO: 2731598 - RNA, 24 nt, Haemophilus influenzae Rd
uccuuguagagcagggauuuucau

SEQ ID NO: 2731599 - RNA, 21 nt, Haemophilus influenzae Rd
uccuuuaaucugucacgagcu

SEQ ID NO: 2731600 - RNA, 15 nt, Haemophilus influenzae Rd
uccuuuacauuuaaa

SEQ ID NO: 2731601 - RNA, 16 nt, Haemophilus influenzae Rd
uccuuuacauuuaaac

SEQ ID NO: 2731602 - RNA, 14 nt, Haemophilus influenzae Rd
uccuuuagaaaacu

SEQ ID NO: 2731603 - RNA, 21 nt, Haemophilus influenzae Rd
uccuuuauuuugcaacuguuu

SEQ ID NO: 2731604 - RNA, 18 nt, Haemophilus influenzae Rd
uccuuugccuuuauggug

SEQ ID NO: 2731605 - RNA, 13 nt, Haemophilus influenzae Rd
uccuuugcugcca

SEQ ID NO: 2731606 - RNA, 13 nt, Haemophilus influenzae Rd
uccuuuuucuaac

SEQ ID NO: 2731607 - RNA, 21 nt, Haemophilus influenzae Rd
ucgaaaaaagagguuauauua

SEQ ID NO: 2731608 - RNA, 17 nt, Haemophilus influenzae Rd
ucgaaaaaguucuuucu

SEQ ID NO: 2731609 - RNA, 22 nt, Haemophilus influenzae Rd
ucgaaaaaguucuuucugucau

SEQ ID NO: 2731610 - RNA, 16 nt, Haemophilus influenzae Rd
ucgaaaauaacuucau

SEQ ID NO: 2731611 - RNA, 21 nt, Haemophilus influenzae Rd
ucgaaaauaacuucauccauu

SEQ ID NO: 2731612 - RNA, 23 nt, Haemophilus influenzae Rd
ucgaaaauaacuucauccauuuu

SEQ ID NO: 2731613 - RNA, 22 nt, Haemophilus influenzae Rd
ucgaaaucacaggcuucaauuu

SEQ ID NO: 2731614 - RNA, 21 nt, Haemophilus influenzae Rd
ucgaaaucauaaucugaaagu

SEQ ID NO: 2731615 - RNA, 21 nt, Haemophilus influenzae Rd
ucgaacacuguaaauaaacgu

SEQ ID NO: 2731616 - RNA, 14 nt, Haemophilus influenzae Rd
ucgaacaugaaguu

SEQ ID NO: 2731617 - RNA, 21 nt, Haemophilus influenzae Rd
ucgaacaugaaguuggagauu

SEQ ID NO: 2731618 - RNA, 17 nt, Haemophilus influenzae Rd
ucgaaggaaauccugcg

SEQ ID NO: 2731619 - RNA, 14 nt, Haemophilus influenzae Rd
ucgaaguaugaaaa

SEQ ID NO: 2731620 - RNA, 13 nt, Haemophilus influenzae Rd
ucgaaguuuugcu

SEQ ID NO: 2731621 - RNA, 16 nt, Haemophilus influenzae Rd
ucgaauaagguaacug

SEQ ID NO: 2731622 - RNA, 19 nt, Haemophilus influenzae Rd
ucgaauaauccuucuucgg

SEQ ID NO: 2731623 - RNA, 18 nt, Haemophilus influenzae Rd
ucgaauccuucacgaccc

SEQ ID NO: 2731624 - RNA, 23 nt, Haemophilus influenzae Rd
ucgaauuaaacgugauuuaccaa

SEQ ID NO: 2731625 - RNA, 16 nt, Haemophilus influenzae Rd
ucgaauuaaagaaaaa

SEQ ID NO: 2731626 - RNA, 18 nt, Haemophilus influenzae Rd
ucgaauucguuuuucaaa

SEQ ID NO: 2731627 - RNA, 15 nt, Haemophilus influenzae Rd
ucgacaauuucugca

SEQ ID NO: 2731628 - RNA, 16 nt, Haemophilus influenzae Rd
ucgacaauuuguccuu

SEQ ID NO: 2731629 - RNA, 22 nt, Haemophilus influenzae Rd
ucgaccguuuuuucuuuuuccu

SEQ ID NO: 2731630 - RNA, 21 nt, Haemophilus influenzae Rd
ucgacuuuuucaccauugauu

SEQ ID NO: 2731631 - RNA, 15 nt, Haemophilus influenzae Rd
ucgagaaacuuucaa

SEQ ID NO: 2731632 - RNA, 19 nt, Haemophilus influenzae Rd
ucgagaaacuuucaaaaua

SEQ ID NO: 2731633 - RNA, 16 nt, Haemophilus influenzae Rd
ucgagcuaaauccaga

SEQ ID NO: 2731634 - RNA, 23 nt, Haemophilus influenzae Rd
ucgaguaaaaauaaaaugccguu

SEQ ID NO: 2731635 - RNA, 19 nt, Haemophilus influenzae Rd
ucgaguaauuucauaucuu

SEQ ID NO: 2731636 - RNA, 19 nt, Haemophilus influenzae Rd
ucgaguuaauuauuuuaaa

SEQ ID NO: 2731637 - RNA, 14 nt, Haemophilus influenzae Rd
ucgaguuuuucaaa

SEQ ID NO: 2731638 - RNA, 21 nt, Haemophilus influenzae Rd
ucgauaaaagaagcuauuacu

SEQ ID NO: 2731639 - RNA, 19 nt, Haemophilus influenzae Rd
ucgauaaacauuuuuucaa

SEQ ID NO: 2731640 - RNA, 20 nt, Haemophilus influenzae Rd
ucgauaacaauuuuugcauu

SEQ ID NO: 2731641 - RNA, 23 nt, Haemophilus influenzae Rd
ucgauaagauugugcaauaacgu

SEQ ID NO: 2731642 - RNA, 18 nt, Haemophilus influenzae Rd
ucgauaauuuaacugaau

SEQ ID NO: 2731643 - RNA, 19 nt, Haemophilus influenzae Rd
ucgauacaagguacuugaa

SEQ ID NO: 2731644 - RNA, 17 nt, Haemophilus influenzae Rd
ucgauacuuucuugcug

SEQ ID NO: 2731645 - RNA, 13 nt, Haemophilus influenzae Rd
ucgauauuuauaa

SEQ ID NO: 2731646 - RNA, 12 nt, Haemophilus influenzae Rd
ucgaucauuuuu

SEQ ID NO: 2731647 - RNA, 15 nt, Haemophilus influenzae Rd
ucgaucauuuuuaac

SEQ ID NO: 2731648 - RNA, 19 nt, Haemophilus influenzae Rd
ucgaucucugccauacuga

SEQ ID NO: 2731649 - RNA, 15 nt, Haemophilus influenzae Rd
ucgaugugcauuuuu

SEQ ID NO: 2731650 - RNA, 13 nt, Haemophilus influenzae Rd
ucgauuacaaaaa

SEQ ID NO: 2731651 - RNA, 19 nt, Haemophilus influenzae Rd
ucgauuacaaaaacacucu

SEQ ID NO: 2731652 - RNA, 12 nt, Haemophilus influenzae Rd
ucgauuacucug

SEQ ID NO: 2731653 - RNA, 21 nt, Haemophilus influenzae Rd
ucgauucgccuugcuuuuaau

SEQ ID NO: 2731654 - RNA, 22 nt, Haemophilus influenzae Rd
ucgauugcaucuuggcauuuuu

SEQ ID NO: 2731655 - RNA, 14 nt, Haemophilus influenzae Rd
ucgauugcauuuuu

SEQ ID NO: 2731656 - RNA, 23 nt, Haemophilus influenzae Rd
ucgauugcauuuuuuauaaaugg

SEQ ID NO: 2731657 - RNA, 14 nt, Haemophilus influenzae Rd
ucgauuuaugauaa

SEQ ID NO: 2731658 - RNA, 14 nt, Haemophilus influenzae Rd
ucgauuucauacaa

SEQ ID NO: 2731659 - RNA, 14 nt, Haemophilus influenzae Rd
ucgcaaaagaauga

SEQ ID NO: 2731660 - RNA, 18 nt, Haemophilus influenzae Rd
ucgcaaaagaaugacgua

SEQ ID NO: 2731661 - RNA, 15 nt, Haemophilus influenzae Rd
ucgcaaaaucuugcu

SEQ ID NO: 2731662 - RNA, 17 nt, Haemophilus influenzae Rd
ucgcaacaaacauuaau

SEQ ID NO: 2731663 - RNA, 16 nt, Haemophilus influenzae Rd
ucgcaacuaaauucaa

SEQ ID NO: 2731664 - RNA, 18 nt, Haemophilus influenzae Rd
ucgcaagauagcaaaaua

SEQ ID NO: 2731665 - RNA, 10 nt, Haemophilus influenzae Rd
ucgcaauaaa

SEQ ID NO: 2731666 - RNA, 19 nt, Haemophilus influenzae Rd
ucgcaaucagcauauugaa

SEQ ID NO: 2731667 - RNA, 18 nt, Haemophilus influenzae Rd
ucgcaauuaauggcaauu

SEQ ID NO: 2731668 - RNA, 13 nt, Haemophilus influenzae Rd
ucgcaauuuuuug

SEQ ID NO: 2731669 - RNA, 23 nt, Haemophilus influenzae Rd
ucgcacccgcuuguuucaauaua

SEQ ID NO: 2731670 - RNA, 22 nt, Haemophilus influenzae Rd
ucgcacuguuauauaaacaauu

SEQ ID NO: 2731671 - RNA, 14 nt, Haemophilus influenzae Rd
ucgcacuuggcgaa

SEQ ID NO: 2731672 - RNA, 19 nt, Haemophilus influenzae Rd
ucgcagccuuguucugcag

SEQ ID NO: 2731673 - RNA, 13 nt, Haemophilus influenzae Rd
ucgcaggcuuuca

SEQ ID NO: 2731674 - RNA, 16 nt, Haemophilus influenzae Rd
ucgcaggugucacagc

SEQ ID NO: 2731675 - RNA, 20 nt, Haemophilus influenzae Rd
ucgcaguguuaaaugcagua

SEQ ID NO: 2731676 - RNA, 15 nt, Haemophilus influenzae Rd
ucgcaucaaagaauc

SEQ ID NO: 2731677 - RNA, 20 nt, Haemophilus influenzae Rd
ucgcaucaaaggcuaauucu

SEQ ID NO: 2731678 - RNA, 21 nt, Haemophilus influenzae Rd
ucgcaucaauaucgcccauuc

SEQ ID NO: 2731679 - RNA, 16 nt, Haemophilus influenzae Rd
ucgcaucaaucacagc

SEQ ID NO: 2731680 - RNA, 15 nt, Haemophilus influenzae Rd
ucgcaucgucuuuac

SEQ ID NO: 2731681 - RNA, 16 nt, Haemophilus influenzae Rd
ucgcaugcggaauaau

SEQ ID NO: 2731682 - RNA, 20 nt, Haemophilus influenzae Rd
ucgcauugauucuuuaugaa

SEQ ID NO: 2731683 - RNA, 14 nt, Haemophilus influenzae Rd
ucgcauuuuaacuc

SEQ ID NO: 2731684 - RNA, 21 nt, Haemophilus influenzae Rd
ucgccaaaucucaaaaucagc

SEQ ID NO: 2731685 - RNA, 14 nt, Haemophilus influenzae Rd
ucgccaacuugaau

SEQ ID NO: 2731686 - RNA, 17 nt, Haemophilus influenzae Rd
ucgccaagaauaaaaug

SEQ ID NO: 2731687 - RNA, 17 nt, Haemophilus influenzae Rd
ucgccaauaaaauguua

SEQ ID NO: 2731688 - RNA, 22 nt, Haemophilus influenzae Rd
ucgccaauagguugcaaaucga

SEQ ID NO: 2731689 - RNA, 15 nt, Haemophilus influenzae Rd
ucgccaccuuuuacc

SEQ ID NO: 2731690 - RNA, 15 nt, Haemophilus influenzae Rd
ucgccagcaccacgu

SEQ ID NO: 2731691 - RNA, 16 nt, Haemophilus influenzae Rd
ucgccaguuuagaaag

SEQ ID NO: 2731692 - RNA, 20 nt, Haemophilus influenzae Rd
ucgccauaauaaaaauuaaa

SEQ ID NO: 2731693 - RNA, 14 nt, Haemophilus influenzae Rd
ucgccaucaucagc

SEQ ID NO: 2731694 - RNA, 23 nt, Haemophilus influenzae Rd
ucgccauuuaagccuuuguagcc

SEQ ID NO: 2731695 - RNA, 21 nt, Haemophilus influenzae Rd
ucgccauuuugaggaauaaau

SEQ ID NO: 2731696 - RNA, 16 nt, Haemophilus influenzae Rd
ucgccauuuuuaaaaa

SEQ ID NO: 2731697 - RNA, 14 nt, Haemophilus influenzae Rd
ucgccauuuuucaa

SEQ ID NO: 2731698 - RNA, 18 nt, Haemophilus influenzae Rd
ucgccauuuuucaaaauu

SEQ ID NO: 2731699 - RNA, 14 nt, Haemophilus influenzae Rd
ucgccccaaaagcu

SEQ ID NO: 2731700 - RNA, 16 nt, Haemophilus influenzae Rd
ucgcccguauuuugca

SEQ ID NO: 2731701 - RNA, 22 nt, Haemophilus influenzae Rd
ucgccgacuuuuacaucauugu

SEQ ID NO: 2731702 - RNA, 20 nt, Haemophilus influenzae Rd
ucgccgaguaaauucaccaa

SEQ ID NO: 2731703 - RNA, 22 nt, Haemophilus influenzae Rd
ucgccgaguaaauucaccaauu

SEQ ID NO: 2731704 - RNA, 16 nt, Haemophilus influenzae Rd
ucgccguuaguuugua

SEQ ID NO: 2731705 - RNA, 18 nt, Haemophilus influenzae Rd
ucgccguuaguuuguauu

SEQ ID NO: 2731706 - RNA, 22 nt, Haemophilus influenzae Rd
ucgccuaauucaauaucugcac

SEQ ID NO: 2731707 - RNA, 13 nt, Haemophilus influenzae Rd
ucgccugacugcc

SEQ ID NO: 2731708 - RNA, 16 nt, Haemophilus influenzae Rd
ucgccugauuucgcuu

SEQ ID NO: 2731709 - RNA, 22 nt, Haemophilus influenzae Rd
ucgccuuaccgcauuuuuaauu

SEQ ID NO: 2731710 - RNA, 21 nt, Haemophilus influenzae Rd
ucgccuuguaauugauuuuca

SEQ ID NO: 2731711 - RNA, 22 nt, Haemophilus influenzae Rd
ucgccuuuuugaagguuaggga

SEQ ID NO: 2731712 - RNA, 18 nt, Haemophilus influenzae Rd
ucgcgccaccaucuacac

SEQ ID NO: 2731713 - RNA, 13 nt, Haemophilus influenzae Rd
ucgcgugauuuag

SEQ ID NO: 2731714 - RNA, 23 nt, Haemophilus influenzae Rd
ucgcgugauuuagggaaguuaug

SEQ ID NO: 2731715 - RNA, 14 nt, Haemophilus influenzae Rd
ucgcguuguucaau

SEQ ID NO: 2731716 - RNA, 16 nt, Haemophilus influenzae Rd
ucgcuaauuuuuuucc

SEQ ID NO: 2731717 - RNA, 15 nt, Haemophilus influenzae Rd
ucgcuacguuagaga

SEQ ID NO: 2731718 - RNA, 16 nt, Haemophilus influenzae Rd
ucgcuauguuuaaaua

SEQ ID NO: 2731719 - RNA, 13 nt, Haemophilus influenzae Rd
ucgcuauuuaaua

SEQ ID NO: 2731720 - RNA, 15 nt, Haemophilus influenzae Rd
ucgcuauuuucuaau

SEQ ID NO: 2731721 - RNA, 12 nt, Haemophilus influenzae Rd
ucgcuauuuuga

SEQ ID NO: 2731722 - RNA, 13 nt, Haemophilus influenzae Rd
ucgcuauuuuucg

SEQ ID NO: 2731723 - RNA, 19 nt, Haemophilus influenzae Rd
ucgcucaucguaucaauuu

SEQ ID NO: 2731724 - RNA, 18 nt, Haemophilus influenzae Rd
ucgcuccaaucaucaucc

SEQ ID NO: 2731725 - RNA, 20 nt, Haemophilus influenzae Rd
ucgcuccaaucaucauccca

SEQ ID NO: 2731726 - RNA, 17 nt, Haemophilus influenzae Rd
ucgcuccccuucauaag

SEQ ID NO: 2731727 - RNA, 21 nt, Haemophilus influenzae Rd
ucgcucuaacaauauuucacu

SEQ ID NO: 2731728 - RNA, 20 nt, Haemophilus influenzae Rd
ucgcucuaguuuuaagguug

SEQ ID NO: 2731729 - RNA, 20 nt, Haemophilus influenzae Rd
ucgcucuucagcuucuucau

SEQ ID NO: 2731730 - RNA, 15 nt, Haemophilus influenzae Rd
ucgcugaaauuaaua

SEQ ID NO: 2731731 - RNA, 18 nt, Haemophilus influenzae Rd
ucgcugcagcugcugcuu

SEQ ID NO: 2731732 - RNA, 16 nt, Haemophilus influenzae Rd
ucgcugcgaugugacc

SEQ ID NO: 2731733 - RNA, 17 nt, Haemophilus influenzae Rd
ucgcugggauuuuguca

SEQ ID NO: 2731734 - RNA, 21 nt, Haemophilus influenzae Rd
ucgcuuaaaaauccgccacuu

SEQ ID NO: 2731735 - RNA, 21 nt, Haemophilus influenzae Rd
ucgcuucaucaucgcccgcuu

SEQ ID NO: 2731736 - RNA, 21 nt, Haemophilus influenzae Rd
ucgcuucugcuugguaauaau

SEQ ID NO: 2731737 - RNA, 12 nt, Haemophilus influenzae Rd
ucgcuucuuuua

SEQ ID NO: 2731738 - RNA, 18 nt, Haemophilus influenzae Rd
ucgcuuuaucuucuucuu

SEQ ID NO: 2731739 - RNA, 13 nt, Haemophilus influenzae Rd
ucgcuuuucccuc

SEQ ID NO: 2731740 - RNA, 18 nt, Haemophilus influenzae Rd
ucgcuuuucccucuuuuu

SEQ ID NO: 2731741 - RNA, 12 nt, Haemophilus influenzae Rd
ucgcuuuuuccu

SEQ ID NO: 2731742 - RNA, 13 nt, Haemophilus influenzae Rd
ucgcuuuuuccuc

SEQ ID NO: 2731743 - RNA, 17 nt, Haemophilus influenzae Rd
ucgcuuuuuuaucuaaa

SEQ ID NO: 2731744 - RNA, 22 nt, Haemophilus influenzae Rd
ucggaaaaaauuuguucaagau

SEQ ID NO: 2731745 - RNA, 14 nt, Haemophilus influenzae Rd
ucggaaaauaauau

SEQ ID NO: 2731746 - RNA, 20 nt, Haemophilus influenzae Rd
ucggaaaauaauauugagua

SEQ ID NO: 2731747 - RNA, 19 nt, Haemophilus influenzae Rd
ucggaacagcagacauuaa

SEQ ID NO: 2731748 - RNA, 20 nt, Haemophilus influenzae Rd
ucggaacgccuaaacacaua

SEQ ID NO: 2731749 - RNA, 14 nt, Haemophilus influenzae Rd
ucggaauauucaac

SEQ ID NO: 2731750 - RNA, 19 nt, Haemophilus influenzae Rd
ucggaauguuuuaaagaau

SEQ ID NO: 2731751 - RNA, 16 nt, Haemophilus influenzae Rd
ucggacgaaucacaac

SEQ ID NO: 2731752 - RNA, 16 nt, Haemophilus influenzae Rd
ucggagcauuuuggua

SEQ ID NO: 2731753 - RNA, 21 nt, Haemophilus influenzae Rd
ucggaugacggaauacaucac

SEQ ID NO: 2731754 - RNA, 19 nt, Haemophilus influenzae Rd
ucggauuccuuuguuagau

SEQ ID NO: 2731755 - RNA, 17 nt, Haemophilus influenzae Rd
ucggauuucuuuauucu

SEQ ID NO: 2731756 - RNA, 12 nt, Haemophilus influenzae Rd
ucggcacaagac

SEQ ID NO: 2731757 - RNA, 19 nt, Haemophilus influenzae Rd
ucggcaguacucgaaaagg

SEQ ID NO: 2731758 - RNA, 16 nt, Haemophilus influenzae Rd
ucggcgaugguaaaau

SEQ ID NO: 2731759 - RNA, 15 nt, Haemophilus influenzae Rd
ucggcgauuuauucg

SEQ ID NO: 2731760 - RNA, 13 nt, Haemophilus influenzae Rd
ucggcuucaguau

SEQ ID NO: 2731761 - RNA, 19 nt, Haemophilus influenzae Rd
ucggcuuccauuaauacuu

SEQ ID NO: 2731762 - RNA, 20 nt, Haemophilus influenzae Rd
ucgggauaaggcagaaauga

SEQ ID NO: 2731763 - RNA, 21 nt, Haemophilus influenzae Rd
ucgggauaaggcagaaaugaa

SEQ ID NO: 2731764 - RNA, 17 nt, Haemophilus influenzae Rd
ucgggcaaacgcucuuu

SEQ ID NO: 2731765 - RNA, 17 nt, Haemophilus influenzae Rd
ucgggcaccauuuaaac

SEQ ID NO: 2731766 - RNA, 13 nt, Haemophilus influenzae Rd
ucgguaaaaauca

SEQ ID NO: 2731767 - RNA, 23 nt, Haemophilus influenzae Rd
ucgguagagcaggggauugaaaa

SEQ ID NO: 2731768 - RNA, 21 nt, Haemophilus influenzae Rd
ucgguauucauaucaaugcca

SEQ ID NO: 2731769 - RNA, 17 nt, Haemophilus influenzae Rd
ucggugaagacaucaua

SEQ ID NO: 2731770 - RNA, 22 nt, Haemophilus influenzae Rd
ucggugcaacaauaucauugac

SEQ ID NO: 2731771 - RNA, 15 nt, Haemophilus influenzae Rd
ucgguuucaugauug

SEQ ID NO: 2731772 - RNA, 11 nt, Haemophilus influenzae Rd
ucgguuuugcg

SEQ ID NO: 2731773 - RNA, 13 nt, Haemophilus influenzae Rd
ucguaaagaucau

SEQ ID NO: 2731774 - RNA, 13 nt, Haemophilus influenzae Rd
ucguaagaacgac

SEQ ID NO: 2731775 - RNA, 19 nt, Haemophilus influenzae Rd
ucguaauaacauucaguuu

SEQ ID NO: 2731776 - RNA, 14 nt, Haemophilus influenzae Rd
ucguaauuaaaauc

SEQ ID NO: 2731777 - RNA, 15 nt, Haemophilus influenzae Rd
ucguaauuuuaaaac

SEQ ID NO: 2731778 - RNA, 13 nt, Haemophilus influenzae Rd
ucguagaaauaag

SEQ ID NO: 2731779 - RNA, 15 nt, Haemophilus influenzae Rd
ucguagaaauaaguu

SEQ ID NO: 2731780 - RNA, 20 nt, Haemophilus influenzae Rd
ucguagaaaucaaaaaugcu

SEQ ID NO: 2731781 - RNA, 19 nt, Haemophilus influenzae Rd
ucguagaguuuuuucacuu

SEQ ID NO: 2731782 - RNA, 15 nt, Haemophilus influenzae Rd
ucguaguaagcugau

SEQ ID NO: 2731783 - RNA, 22 nt, Haemophilus influenzae Rd
ucguaguaagcugauucuucau

SEQ ID NO: 2731784 - RNA, 18 nt, Haemophilus influenzae Rd
ucguagucuuucaauguu

SEQ ID NO: 2731785 - RNA, 14 nt, Haemophilus influenzae Rd
ucguauaaauauuu

SEQ ID NO: 2731786 - RNA, 13 nt, Haemophilus influenzae Rd
ucguaucaauuuu

SEQ ID NO: 2731787 - RNA, 17 nt, Haemophilus influenzae Rd
ucguauccguuccacuu

SEQ ID NO: 2731788 - RNA, 19 nt, Haemophilus influenzae Rd
ucguauucccaaauuuuuu

SEQ ID NO: 2731789 - RNA, 19 nt, Haemophilus influenzae Rd
ucguauucucauuuuagac

SEQ ID NO: 2731790 - RNA, 21 nt, Haemophilus influenzae Rd
ucguauuuuugucccaaaaua

SEQ ID NO: 2731791 - RNA, 14 nt, Haemophilus influenzae Rd
ucgucaaaaucauu

SEQ ID NO: 2731792 - RNA, 18 nt, Haemophilus influenzae Rd
ucgucaaaggaacagaca

SEQ ID NO: 2731793 - RNA, 15 nt, Haemophilus influenzae Rd
ucgucaaauuuaaau

SEQ ID NO: 2731794 - RNA, 13 nt, Haemophilus influenzae Rd
ucgucaucaucaa

SEQ ID NO: 2731795 - RNA, 14 nt, Haemophilus influenzae Rd
ucgucaucuucauu

SEQ ID NO: 2731796 - RNA, 18 nt, Haemophilus influenzae Rd
ucguccuucaaauucuuu

SEQ ID NO: 2731797 - RNA, 14 nt, Haemophilus influenzae Rd
ucgucuaaaucuuu

SEQ ID NO: 2731798 - RNA, 21 nt, Haemophilus influenzae Rd
ucgucuaaaucuuuccagaag

SEQ ID NO: 2731799 - RNA, 16 nt, Haemophilus influenzae Rd
ucgucuaucuaagaua

SEQ ID NO: 2731800 - RNA, 12 nt, Haemophilus influenzae Rd
ucgucuauuuau

SEQ ID NO: 2731801 - RNA, 18 nt, Haemophilus influenzae Rd
ucgucugcacgaauaauu

SEQ ID NO: 2731802 - RNA, 16 nt, Haemophilus influenzae Rd
ucgucuggcacaucaa

SEQ ID NO: 2731803 - RNA, 17 nt, Haemophilus influenzae Rd
ucgugaaagaauaaucc

SEQ ID NO: 2731804 - RNA, 14 nt, Haemophilus influenzae Rd
ucgugagcuuguug

SEQ ID NO: 2731805 - RNA, 20 nt, Haemophilus influenzae Rd
ucgugauccgcaauaauuaa

SEQ ID NO: 2731806 - RNA, 15 nt, Haemophilus influenzae Rd
ucgugaucugcauca

SEQ ID NO: 2731807 - RNA, 22 nt, Haemophilus influenzae Rd
ucgugcuguuuucaauuuuaaa

SEQ ID NO: 2731808 - RNA, 14 nt, Haemophilus influenzae Rd
ucguggaauuucau

SEQ ID NO: 2731809 - RNA, 16 nt, Haemophilus influenzae Rd
ucguggauuggcaaug

SEQ ID NO: 2731810 - RNA, 18 nt, Haemophilus influenzae Rd
ucguguauuuuuaucuaa

SEQ ID NO: 2731811 - RNA, 15 nt, Haemophilus influenzae Rd
ucgugugaaauuacu

SEQ ID NO: 2731812 - RNA, 19 nt, Haemophilus influenzae Rd
ucguuaaaccaaauaauga

SEQ ID NO: 2731813 - RNA, 14 nt, Haemophilus influenzae Rd
ucguuaauaaaucc

SEQ ID NO: 2731814 - RNA, 15 nt, Haemophilus influenzae Rd
ucguuaauaaaucca

SEQ ID NO: 2731815 - RNA, 12 nt, Haemophilus influenzae Rd
ucguuaauauua

SEQ ID NO: 2731816 - RNA, 19 nt, Haemophilus influenzae Rd
ucguuagcuuucauacgcg

SEQ ID NO: 2731817 - RNA, 14 nt, Haemophilus influenzae Rd
ucguuauuaugaaa

SEQ ID NO: 2731818 - RNA, 21 nt, Haemophilus influenzae Rd
ucguuauucaucacaacuugc

SEQ ID NO: 2731819 - RNA, 13 nt, Haemophilus influenzae Rd
ucguuauuuuuug

SEQ ID NO: 2731820 - RNA, 21 nt, Haemophilus influenzae Rd
ucguucaacccauuuuccauu

SEQ ID NO: 2731821 - RNA, 17 nt, Haemophilus influenzae Rd
ucguucguuauuuugau

SEQ ID NO: 2731822 - RNA, 12 nt, Haemophilus influenzae Rd
ucguucuaaaau

SEQ ID NO: 2731823 - RNA, 19 nt, Haemophilus influenzae Rd
ucguucuuaccccaacaaa

SEQ ID NO: 2731824 - RNA, 14 nt, Haemophilus influenzae Rd
ucguucuugaugau

SEQ ID NO: 2731825 - RNA, 14 nt, Haemophilus influenzae Rd
ucguucuuuuucca

SEQ ID NO: 2731826 - RNA, 15 nt, Haemophilus influenzae Rd
ucguugaucagcaau

SEQ ID NO: 2731827 - RNA, 18 nt, Haemophilus influenzae Rd
ucguugguauuuacuaaa

SEQ ID NO: 2731828 - RNA, 14 nt, Haemophilus influenzae Rd
ucguuguuuuaaua

SEQ ID NO: 2731829 - RNA, 13 nt, Haemophilus influenzae Rd
ucguuuacaucac

SEQ ID NO: 2731830 - RNA, 11 nt, Haemophilus influenzae Rd
ucguuuacuau

SEQ ID NO: 2731831 - RNA, 24 nt, Haemophilus influenzae Rd
ucguuucaucgagaaauacgacau

SEQ ID NO: 2731832 - RNA, 15 nt, Haemophilus influenzae Rd
ucguuuguuugaaaa

SEQ ID NO: 2731833 - RNA, 20 nt, Haemophilus influenzae Rd
ucguuuugauuuaggcauug

SEQ ID NO: 2731834 - RNA, 13 nt, Haemophilus influenzae Rd
ucuaaaaaacccg

SEQ ID NO: 2731835 - RNA, 23 nt, Haemophilus influenzae Rd
ucuaaaaaacccgcuuuuaacaa

SEQ ID NO: 2731836 - RNA, 15 nt, Haemophilus influenzae Rd
ucuaaaaaagaguaa

SEQ ID NO: 2731837 - RNA, 20 nt, Haemophilus influenzae Rd
ucuaaaaaagaguaaauauu

SEQ ID NO: 2731838 - RNA, 18 nt, Haemophilus influenzae Rd
ucuaaaaagauuugauuu

SEQ ID NO: 2731839 - RNA, 22 nt, Haemophilus influenzae Rd
ucuaaaaauaggcugaaaaaau

SEQ ID NO: 2731840 - RNA, 19 nt, Haemophilus influenzae Rd
ucuaaaaauggcccugaaa

SEQ ID NO: 2731841 - RNA, 14 nt, Haemophilus influenzae Rd
ucuaaaaccaauaa

SEQ ID NO: 2731842 - RNA, 12 nt, Haemophilus influenzae Rd
ucuaaaagcugu

SEQ ID NO: 2731843 - RNA, 17 nt, Haemophilus influenzae Rd
ucuaaaauaauaucaca

SEQ ID NO: 2731844 - RNA, 12 nt, Haemophilus influenzae Rd
ucuaaaauaauc

SEQ ID NO: 2731845 - RNA, 15 nt, Haemophilus influenzae Rd
ucuaaaaucacuuuu

SEQ ID NO: 2731846 - RNA, 18 nt, Haemophilus influenzae Rd
ucuaaaccuuguaaagca

SEQ ID NO: 2731847 - RNA, 22 nt, Haemophilus influenzae Rd
ucuaaagauuuauguugaauuu

SEQ ID NO: 2731848 - RNA, 15 nt, Haemophilus influenzae Rd
ucuaaaggcaauucc

SEQ ID NO: 2731849 - RNA, 18 nt, Haemophilus influenzae Rd
ucuaaaggcuaaauaacc

SEQ ID NO: 2731850 - RNA, 22 nt, Haemophilus influenzae Rd
ucuaaaggcugagguucaaaac

SEQ ID NO: 2731851 - RNA, 19 nt, Haemophilus influenzae Rd
ucuaaagugcgguuaauuu

SEQ ID NO: 2731852 - RNA, 14 nt, Haemophilus influenzae Rd
ucuaaauaaaaacg

SEQ ID NO: 2731853 - RNA, 15 nt, Haemophilus influenzae Rd
ucuaaauauuuuuca

SEQ ID NO: 2731854 - RNA, 18 nt, Haemophilus influenzae Rd
ucuaaaucuuuccagaag

SEQ ID NO: 2731855 - RNA, 15 nt, Haemophilus influenzae Rd
ucuaaaugaauaaaa

SEQ ID NO: 2731856 - RNA, 21 nt, Haemophilus influenzae Rd
ucuaaaugacgugcuaauucu

SEQ ID NO: 2731857 - RNA, 16 nt, Haemophilus influenzae Rd
ucuaaaugugauuucc

SEQ ID NO: 2731858 - RNA, 17 nt, Haemophilus influenzae Rd
ucuaaaugugcccagcg

SEQ ID NO: 2731859 - RNA, 13 nt, Haemophilus influenzae Rd
ucuaaauuaauuu

SEQ ID NO: 2731860 - RNA, 23 nt, Haemophilus influenzae Rd
ucuaaauuaucguuuacuuaaaa

SEQ ID NO: 2731861 - RNA, 21 nt, Haemophilus influenzae Rd
ucuaaauuucgcucaauaauu

SEQ ID NO: 2731862 - RNA, 22 nt, Haemophilus influenzae Rd
ucuaacaaaugauuagaaguaa

SEQ ID NO: 2731863 - RNA, 17 nt, Haemophilus influenzae Rd
ucuaacaauauuucacu

SEQ ID NO: 2731864 - RNA, 14 nt, Haemophilus influenzae Rd
ucuaacaucucuug

SEQ ID NO: 2731865 - RNA, 14 nt, Haemophilus influenzae Rd
ucuaacauuuuuuu

SEQ ID NO: 2731866 - RNA, 17 nt, Haemophilus influenzae Rd
ucuaaccgcacucuuuc

SEQ ID NO: 2731867 - RNA, 19 nt, Haemophilus influenzae Rd
ucuaaccgcacucuuucaa

SEQ ID NO: 2731868 - RNA, 20 nt, Haemophilus influenzae Rd
ucuaaccgcacuuuuuaaua

SEQ ID NO: 2731869 - RNA, 23 nt, Haemophilus influenzae Rd
ucuaaccgcacuuuuuaauaaaa

SEQ ID NO: 2731870 - RNA, 14 nt, Haemophilus influenzae Rd
ucuaaccuaaaaua

SEQ ID NO: 2731871 - RNA, 23 nt, Haemophilus influenzae Rd
ucuaacgcaaacuacaacuuuuu

SEQ ID NO: 2731872 - RNA, 16 nt, Haemophilus influenzae Rd
ucuaacgcauucaaau

SEQ ID NO: 2731873 - RNA, 17 nt, Haemophilus influenzae Rd
ucuaagauaaauuuaaa

SEQ ID NO: 2731874 - RNA, 19 nt, Haemophilus influenzae Rd
ucuaagauacccauuucga

SEQ ID NO: 2731875 - RNA, 19 nt, Haemophilus influenzae Rd
ucuaagauuuuaguauuuu

SEQ ID NO: 2731876 - RNA, 23 nt, Haemophilus influenzae Rd
ucuaaggcuuguuguucaaaauu

SEQ ID NO: 2731877 - RNA, 18 nt, Haemophilus influenzae Rd
ucuaagguauaaauaauu

SEQ ID NO: 2731878 - RNA, 20 nt, Haemophilus influenzae Rd
ucuaagguuaugccaaugcu

SEQ ID NO: 2731879 - RNA, 16 nt, Haemophilus influenzae Rd
ucuaaguauucaugau

SEQ ID NO: 2731880 - RNA, 22 nt, Haemophilus influenzae Rd
ucuaaguauucaugauguaauu

SEQ ID NO: 2731881 - RNA, 14 nt, Haemophilus influenzae Rd
ucuaauaaaauaua

SEQ ID NO: 2731882 - RNA, 22 nt, Haemophilus influenzae Rd
ucuaauaaagugcgguaaaauu

SEQ ID NO: 2731883 - RNA, 19 nt, Haemophilus influenzae Rd
ucuaauaagauguuugagu

SEQ ID NO: 2731884 - RNA, 23 nt, Haemophilus influenzae Rd
ucuaauaauaagauuuuuggcug

SEQ ID NO: 2731885 - RNA, 14 nt, Haemophilus influenzae Rd
ucuaauaauccucu

SEQ ID NO: 2731886 - RNA, 17 nt, Haemophilus influenzae Rd
ucuaauacgucuaauuu

SEQ ID NO: 2731887 - RNA, 16 nt, Haemophilus influenzae Rd
ucuaauccuaaaaugc

SEQ ID NO: 2731888 - RNA, 21 nt, Haemophilus influenzae Rd
ucuaauccuaaaaugcucgcu

SEQ ID NO: 2731889 - RNA, 17 nt, Haemophilus influenzae Rd
ucuaaucgccaaucuaa

SEQ ID NO: 2731890 - RNA, 23 nt, Haemophilus influenzae Rd
ucuaaucgggcuuuaucauaacu

SEQ ID NO: 2731891 - RNA, 15 nt, Haemophilus influenzae Rd
ucuaaucuuaaaaaa

SEQ ID NO: 2731892 - RNA, 23 nt, Haemophilus influenzae Rd
ucuaaugaaauuucuugcucuaa

SEQ ID NO: 2731893 - RNA, 19 nt, Haemophilus influenzae Rd
ucuaaugccgcaaauacuu

SEQ ID NO: 2731894 - RNA, 14 nt, Haemophilus influenzae Rd
ucuaauguuaauuu

SEQ ID NO: 2731895 - RNA, 17 nt, Haemophilus influenzae Rd
ucuaauguuaauuuuaa

SEQ ID NO: 2731896 - RNA, 18 nt, Haemophilus influenzae Rd
ucuaauguuaauuuuaaa

SEQ ID NO: 2731897 - RNA, 16 nt, Haemophilus influenzae Rd
ucuaauucaaagcgau

SEQ ID NO: 2731898 - RNA, 22 nt, Haemophilus influenzae Rd
ucuaauuccccuucaaauauaa

SEQ ID NO: 2731899 - RNA, 13 nt, Haemophilus influenzae Rd
ucuaauucggcuu

SEQ ID NO: 2731900 - RNA, 12 nt, Haemophilus influenzae Rd
ucuaauucuucc

SEQ ID NO: 2731901 - RNA, 13 nt, Haemophilus influenzae Rd
ucuaauucuucca

SEQ ID NO: 2731902 - RNA, 14 nt, Haemophilus influenzae Rd
ucuaauucuuccaa

SEQ ID NO: 2731903 - RNA, 23 nt, Haemophilus influenzae Rd
ucuaauugauggcgugaaauauu

SEQ ID NO: 2731904 - RNA, 15 nt, Haemophilus influenzae Rd
ucuaauugauucaaa

SEQ ID NO: 2731905 - RNA, 16 nt, Haemophilus influenzae Rd
ucuaauugauucaaau

SEQ ID NO: 2731906 - RNA, 17 nt, Haemophilus influenzae Rd
ucuaauugcugcucugc

SEQ ID NO: 2731907 - RNA, 23 nt, Haemophilus influenzae Rd
ucuaauuggacaagaaauaauaa

SEQ ID NO: 2731908 - RNA, 21 nt, Haemophilus influenzae Rd
ucuaauuuauuucaucaaucu

SEQ ID NO: 2731909 - RNA, 18 nt, Haemophilus influenzae Rd
ucuaauuugccaaguaca

SEQ ID NO: 2731910 - RNA, 20 nt, Haemophilus influenzae Rd
ucuaauuugccaucacucaa

SEQ ID NO: 2731911 - RNA, 19 nt, Haemophilus influenzae Rd
ucuaauuuucacauaauaa

SEQ ID NO: 2731912 - RNA, 14 nt, Haemophilus influenzae Rd
ucuaauuuugccau

SEQ ID NO: 2731913 - RNA, 16 nt, Haemophilus influenzae Rd
ucuaauuuuucacuga

SEQ ID NO: 2731914 - RNA, 19 nt, Haemophilus influenzae Rd
ucuaauuuuuuauucaaaa

SEQ ID NO: 2731915 - RNA, 21 nt, Haemophilus influenzae Rd
ucuaauuuuuuauucaaaauu

SEQ ID NO: 2731916 - RNA, 13 nt, Haemophilus influenzae Rd
ucuacaaaacaua

SEQ ID NO: 2731917 - RNA, 13 nt, Haemophilus influenzae Rd
ucuacaccuucug

SEQ ID NO: 2731918 - RNA, 21 nt, Haemophilus influenzae Rd
ucuacaucaguaccuuuaauu

SEQ ID NO: 2731919 - RNA, 19 nt, Haemophilus influenzae Rd
ucuacauuuacaucuaaaa

SEQ ID NO: 2731920 - RNA, 14 nt, Haemophilus influenzae Rd
ucuacauuuuuagu

SEQ ID NO: 2731921 - RNA, 15 nt, Haemophilus influenzae Rd
ucuaccaacugagcu

SEQ ID NO: 2731922 - RNA, 15 nt, Haemophilus influenzae Rd
ucuacccacacaccu

SEQ ID NO: 2731923 - RNA, 15 nt, Haemophilus influenzae Rd
ucuaccgacugagcu

SEQ ID NO: 2731924 - RNA, 17 nt, Haemophilus influenzae Rd
ucuacgacauuuuuaac

SEQ ID NO: 2731925 - RNA, 15 nt, Haemophilus influenzae Rd
ucuacgccuaaugca

SEQ ID NO: 2731926 - RNA, 21 nt, Haemophilus influenzae Rd
ucuacggcaauuggauaaaac

SEQ ID NO: 2731927 - RNA, 22 nt, Haemophilus influenzae Rd
ucuacguaaggaucuuuuucuu

SEQ ID NO: 2731928 - RNA, 17 nt, Haemophilus influenzae Rd
ucuacguaauuuaauuu

SEQ ID NO: 2731929 - RNA, 13 nt, Haemophilus influenzae Rd
ucuacuaaaauaa

SEQ ID NO: 2731930 - RNA, 22 nt, Haemophilus influenzae Rd
ucuacucguagaguuuuuucac

SEQ ID NO: 2731931 - RNA, 16 nt, Haemophilus influenzae Rd
ucuacucguuuacuau

SEQ ID NO: 2731932 - RNA, 19 nt, Haemophilus influenzae Rd
ucuacugcuucauaaaaac

SEQ ID NO: 2731933 - RNA, 16 nt, Haemophilus influenzae Rd
ucuacuguuaauuugc

SEQ ID NO: 2731934 - RNA, 20 nt, Haemophilus influenzae Rd
ucuacuuccgauuuuaauug

SEQ ID NO: 2731935 - RNA, 19 nt, Haemophilus influenzae Rd
ucuacuuguguuuuagaaa

SEQ ID NO: 2731936 - RNA, 14 nt, Haemophilus influenzae Rd
ucuacuuguucaaa

SEQ ID NO: 2731937 - RNA, 18 nt, Haemophilus influenzae Rd
ucuacuuguucaaaaauu

SEQ ID NO: 2731938 - RNA, 15 nt, Haemophilus influenzae Rd
ucuacuuucaggauu

SEQ ID NO: 2731939 - RNA, 22 nt, Haemophilus influenzae Rd
ucuacuuugcgccuguacugca

SEQ ID NO: 2731940 - RNA, 23 nt, Haemophilus influenzae Rd
ucuacuuuuuuugcgcuuucaau

SEQ ID NO: 2731941 - RNA, 21 nt, Haemophilus influenzae Rd
ucuagaaaauaaccaauauaa

SEQ ID NO: 2731942 - RNA, 17 nt, Haemophilus influenzae Rd
ucuagacaaaaccugca

SEQ ID NO: 2731943 - RNA, 19 nt, Haemophilus influenzae Rd
ucuagagauuguaugaaaa

SEQ ID NO: 2731944 - RNA, 13 nt, Haemophilus influenzae Rd
ucuagcacaaaga

SEQ ID NO: 2731945 - RNA, 14 nt, Haemophilus influenzae Rd
ucuagcgguaaacc

SEQ ID NO: 2731946 - RNA, 16 nt, Haemophilus influenzae Rd
ucuagcuuaacaacaa

SEQ ID NO: 2731947 - RNA, 16 nt, Haemophilus influenzae Rd
ucuagcuuaccuuaau

SEQ ID NO: 2731948 - RNA, 22 nt, Haemophilus influenzae Rd
ucuagcuucaucagccgcuuuu

SEQ ID NO: 2731949 - RNA, 14 nt, Haemophilus influenzae Rd
ucuaguaaaacuaa

SEQ ID NO: 2731950 - RNA, 18 nt, Haemophilus influenzae Rd
ucuaguaacuguucgguu

SEQ ID NO: 2731951 - RNA, 19 nt, Haemophilus influenzae Rd
ucuaguccuaacacuuuac

SEQ ID NO: 2731952 - RNA, 12 nt, Haemophilus influenzae Rd
ucuaguucuucc

SEQ ID NO: 2731953 - RNA, 21 nt, Haemophilus influenzae Rd
ucuaguucuuccccucauguu

SEQ ID NO: 2731954 - RNA, 18 nt, Haemophilus influenzae Rd
ucuauaagaaaauuaucu

SEQ ID NO: 2731955 - RNA, 23 nt, Haemophilus influenzae Rd
ucuauaauuucgccauuuuuucc

SEQ ID NO: 2731956 - RNA, 12 nt, Haemophilus influenzae Rd
ucuauagauuua

SEQ ID NO: 2731957 - RNA, 13 nt, Haemophilus influenzae Rd
ucuauaucagaaa

SEQ ID NO: 2731958 - RNA, 15 nt, Haemophilus influenzae Rd
ucuauaucagaaaag

SEQ ID NO: 2731959 - RNA, 18 nt, Haemophilus influenzae Rd
ucuauaucagaaaagaca

SEQ ID NO: 2731960 - RNA, 14 nt, Haemophilus influenzae Rd
ucuauaucuuuaaa

SEQ ID NO: 2731961 - RNA, 22 nt, Haemophilus influenzae Rd
ucuauaucuuuaaauucuacgu

SEQ ID NO: 2731962 - RNA, 21 nt, Haemophilus influenzae Rd
ucuauauucguuaaauaaugc

SEQ ID NO: 2731963 - RNA, 17 nt, Haemophilus influenzae Rd
ucuauauuuugaauaau

SEQ ID NO: 2731964 - RNA, 19 nt, Haemophilus influenzae Rd
ucuauauuuugaauaauaa

SEQ ID NO: 2731965 - RNA, 22 nt, Haemophilus influenzae Rd
ucuaucccaacagaaaauuuga

SEQ ID NO: 2731966 - RNA, 16 nt, Haemophilus influenzae Rd
ucuaucgcauuuuaca

SEQ ID NO: 2731967 - RNA, 14 nt, Haemophilus influenzae Rd
ucuaucuaaaauau

SEQ ID NO: 2731968 - RNA, 16 nt, Haemophilus influenzae Rd
ucuaucuaaaauauaa

SEQ ID NO: 2731969 - RNA, 21 nt, Haemophilus influenzae Rd
ucuaucuuguaauuuuuucuc

SEQ ID NO: 2731970 - RNA, 17 nt, Haemophilus influenzae Rd
ucuaugccaaucacaau

SEQ ID NO: 2731971 - RNA, 14 nt, Haemophilus influenzae Rd
ucuauuaaaauauu

SEQ ID NO: 2731972 - RNA, 15 nt, Haemophilus influenzae Rd
ucuauuacuaaaauu

SEQ ID NO: 2731973 - RNA, 14 nt, Haemophilus influenzae Rd
ucuauuauaaauuu

SEQ ID NO: 2731974 - RNA, 15 nt, Haemophilus influenzae Rd
ucuauuauaaauuug

SEQ ID NO: 2731975 - RNA, 12 nt, Haemophilus influenzae Rd
ucuauuccuuuc

SEQ ID NO: 2731976 - RNA, 17 nt, Haemophilus influenzae Rd
ucuauugagauuuaauu

SEQ ID NO: 2731977 - RNA, 22 nt, Haemophilus influenzae Rd
ucuauugagauuuaauuuauuu

SEQ ID NO: 2731978 - RNA, 14 nt, Haemophilus influenzae Rd
ucuauugauucuaa

SEQ ID NO: 2731979 - RNA, 22 nt, Haemophilus influenzae Rd
ucuauuuaaagcucguauaaua

SEQ ID NO: 2731980 - RNA, 15 nt, Haemophilus influenzae Rd
ucuauuuauuuucac

SEQ ID NO: 2731981 - RNA, 15 nt, Haemophilus influenzae Rd
ucuauuucuuugagu

SEQ ID NO: 2731982 - RNA, 22 nt, Haemophilus influenzae Rd
ucuauuucuuugaguaaaaaau

SEQ ID NO: 2731983 - RNA, 20 nt, Haemophilus influenzae Rd
ucuauuugucggaaaauaau

SEQ ID NO: 2731984 - RNA, 14 nt, Haemophilus influenzae Rd
ucuauuuuaaaaau

SEQ ID NO: 2731985 - RNA, 15 nt, Haemophilus influenzae Rd
ucuauuuuaaaaauu

SEQ ID NO: 2731986 - RNA, 15 nt, Haemophilus influenzae Rd
ucuauuuuauuaauu

SEQ ID NO: 2731987 - RNA, 16 nt, Haemophilus influenzae Rd
ucuauuuuauuaauuu

SEQ ID NO: 2731988 - RNA, 15 nt, Haemophilus influenzae Rd
ucuauuuuuucugca

SEQ ID NO: 2731989 - RNA, 22 nt, Haemophilus influenzae Rd
ucuauuuuuucugcaaagucuu

SEQ ID NO: 2731990 - RNA, 15 nt, Haemophilus influenzae Rd
ucucaaaaaucaacc

SEQ ID NO: 2731991 - RNA, 16 nt, Haemophilus influenzae Rd
ucucaaaugaaaugca

SEQ ID NO: 2731992 - RNA, 11 nt, Haemophilus influenzae Rd
ucucaaauuuu

SEQ ID NO: 2731993 - RNA, 15 nt, Haemophilus influenzae Rd
ucucaaauuuuucac

SEQ ID NO: 2731994 - RNA, 13 nt, Haemophilus influenzae Rd
ucucacaauaauu

SEQ ID NO: 2731995 - RNA, 22 nt, Haemophilus influenzae Rd
ucucagaauuuauucccccauu

SEQ ID NO: 2731996 - RNA, 12 nt, Haemophilus influenzae Rd
ucucagcuuucu

SEQ ID NO: 2731997 - RNA, 21 nt, Haemophilus influenzae Rd
ucucaggaaagggauuuuuua

SEQ ID NO: 2731998 - RNA, 16 nt, Haemophilus influenzae Rd
ucucaggaaauuucaa

SEQ ID NO: 2731999 - RNA, 23 nt, Haemophilus influenzae Rd
ucucaguaacgauguugcaaccu

SEQ ID NO: 2732000 - RNA, 20 nt, Haemophilus influenzae Rd
ucucauaaaguauacuuuuc

SEQ ID NO: 2732001 - RNA, 12 nt, Haemophilus influenzae Rd
ucucauaauaga

SEQ ID NO: 2732002 - RNA, 23 nt, Haemophilus influenzae Rd
ucucauuuugcucaugauuauaa

SEQ ID NO: 2732003 - RNA, 17 nt, Haemophilus influenzae Rd
ucuccaaauauaaaaua

SEQ ID NO: 2732004 - RNA, 22 nt, Haemophilus influenzae Rd
ucuccaaauauaaaauaaaauu

SEQ ID NO: 2732005 - RNA, 14 nt, Haemophilus influenzae Rd
ucuccauaauauug

SEQ ID NO: 2732006 - RNA, 16 nt, Haemophilus influenzae Rd
ucuccauuaagcacag

SEQ ID NO: 2732007 - RNA, 16 nt, Haemophilus influenzae Rd
ucucccucaacccaua

SEQ ID NO: 2732008 - RNA, 14 nt, Haemophilus influenzae Rd
ucuccguaaaaauc

SEQ ID NO: 2732009 - RNA, 16 nt, Haemophilus influenzae Rd
ucuccuaauagacagg

SEQ ID NO: 2732010 - RNA, 16 nt, Haemophilus influenzae Rd
ucuccuugguuuucuu

SEQ ID NO: 2732011 - RNA, 15 nt, Haemophilus influenzae Rd
ucucgaguaucaaaa

SEQ ID NO: 2732012 - RNA, 16 nt, Haemophilus influenzae Rd
ucucgaguaucaaaac

SEQ ID NO: 2732013 - RNA, 20 nt, Haemophilus influenzae Rd
ucucgaguaucaaaacuugc

SEQ ID NO: 2732014 - RNA, 16 nt, Haemophilus influenzae Rd
ucucgccaaaucucaa

SEQ ID NO: 2732015 - RNA, 20 nt, Haemophilus influenzae Rd
ucucggcuaaaaucugugca

SEQ ID NO: 2732016 - RNA, 18 nt, Haemophilus influenzae Rd
ucucgggcugaaauaccu

SEQ ID NO: 2732017 - RNA, 18 nt, Haemophilus influenzae Rd
ucucgguuugcuuuacca

SEQ ID NO: 2732018 - RNA, 16 nt, Haemophilus influenzae Rd
ucucguaugcugagau

SEQ ID NO: 2732019 - RNA, 23 nt, Haemophilus influenzae Rd
ucucgucaggcaauguauucaaa

SEQ ID NO: 2732020 - RNA, 17 nt, Haemophilus influenzae Rd
ucucguccgcauuuggu

SEQ ID NO: 2732021 - RNA, 16 nt, Haemophilus influenzae Rd
ucucuaaccuaaaaua

SEQ ID NO: 2732022 - RNA, 12 nt, Haemophilus influenzae Rd
ucucuacuaauu

SEQ ID NO: 2732023 - RNA, 19 nt, Haemophilus influenzae Rd
ucucuauucaucuaaaaaa

SEQ ID NO: 2732024 - RNA, 21 nt, Haemophilus influenzae Rd
ucucuauucaucuaaaaaacu

SEQ ID NO: 2732025 - RNA, 16 nt, Haemophilus influenzae Rd
ucucuauugcuuuuac

SEQ ID NO: 2732026 - RNA, 17 nt, Haemophilus influenzae Rd
ucucuauugcuuuuacc

SEQ ID NO: 2732027 - RNA, 14 nt, Haemophilus influenzae Rd
ucucugacuucuag

SEQ ID NO: 2732028 - RNA, 16 nt, Haemophilus influenzae Rd
ucucugcaucguugcu

SEQ ID NO: 2732029 - RNA, 22 nt, Haemophilus influenzae Rd
ucucugcccauaagaaaauaga

SEQ ID NO: 2732030 - RNA, 13 nt, Haemophilus influenzae Rd
ucucuguugcuca

SEQ ID NO: 2732031 - RNA, 12 nt, Haemophilus influenzae Rd
ucucuguuuuau

SEQ ID NO: 2732032 - RNA, 14 nt, Haemophilus influenzae Rd
ucucuucuaaaaau

SEQ ID NO: 2732033 - RNA, 15 nt, Haemophilus influenzae Rd
ucucuuguuuuucca

SEQ ID NO: 2732034 - RNA, 22 nt, Haemophilus influenzae Rd
ucucuuguuuuuccaauucuuu

SEQ ID NO: 2732035 - RNA, 16 nt, Haemophilus influenzae Rd
ucucuuucuauuugaa

SEQ ID NO: 2732036 - RNA, 16 nt, Haemophilus influenzae Rd
ucucuuucuuaaaaua

SEQ ID NO: 2732037 - RNA, 13 nt, Haemophilus influenzae Rd
ucucuuuuuauuu

SEQ ID NO: 2732038 - RNA, 22 nt, Haemophilus influenzae Rd
ucugaaaaucaaaagaaauuaa

SEQ ID NO: 2732039 - RNA, 17 nt, Haemophilus influenzae Rd
ucugaaaccacuaaaaa

SEQ ID NO: 2732040 - RNA, 17 nt, Haemophilus influenzae Rd
ucugaaagauauuauua

SEQ ID NO: 2732041 - RNA, 19 nt, Haemophilus influenzae Rd
ucugaacuuuguucauuuu

SEQ ID NO: 2732042 - RNA, 17 nt, Haemophilus influenzae Rd
ucugaauaaauuuuuua

SEQ ID NO: 2732043 - RNA, 20 nt, Haemophilus influenzae Rd
ucugaauccaaugcacuugu

SEQ ID NO: 2732044 - RNA, 21 nt, Haemophilus influenzae Rd
ucugaaugaucgaguaaaaau

SEQ ID NO: 2732045 - RNA, 20 nt, Haemophilus influenzae Rd
ucugacacuaaccaagcguu

SEQ ID NO: 2732046 - RNA, 15 nt, Haemophilus influenzae Rd
ucugaccccaaaaag

SEQ ID NO: 2732047 - RNA, 19 nt, Haemophilus influenzae Rd
ucugagcaaauuacccaaa

SEQ ID NO: 2732048 - RNA, 18 nt, Haemophilus influenzae Rd
ucugagguuuuauuacaa

SEQ ID NO: 2732049 - RNA, 13 nt, Haemophilus influenzae Rd
ucugauaauuuuu

SEQ ID NO: 2732050 - RNA, 14 nt, Haemophilus influenzae Rd
ucugauaauuuuuc

SEQ ID NO: 2732051 - RNA, 15 nt, Haemophilus influenzae Rd
ucugauaauuuuuca

SEQ ID NO: 2732052 - RNA, 16 nt, Haemophilus influenzae Rd
ucugauaauuuuucac

SEQ ID NO: 2732053 - RNA, 23 nt, Haemophilus influenzae Rd
ucugauccgugaacugaguuuuc

SEQ ID NO: 2732054 - RNA, 21 nt, Haemophilus influenzae Rd
ucugauguagcuugaauauuu

SEQ ID NO: 2732055 - RNA, 16 nt, Haemophilus influenzae Rd
ucugauuauucucuau

SEQ ID NO: 2732056 - RNA, 22 nt, Haemophilus influenzae Rd
ucugauuauucucuauuaauuu

SEQ ID NO: 2732057 - RNA, 17 nt, Haemophilus influenzae Rd
ucugauugagaaaaugu

SEQ ID NO: 2732058 - RNA, 14 nt, Haemophilus influenzae Rd
ucugcaaaacuugg

SEQ ID NO: 2732059 - RNA, 15 nt, Haemophilus influenzae Rd
ucugcaacaucaccg

SEQ ID NO: 2732060 - RNA, 16 nt, Haemophilus influenzae Rd
ucugcaccccaaaagc

SEQ ID NO: 2732061 - RNA, 21 nt, Haemophilus influenzae Rd
ucugcaccuuaaaggcugaau

SEQ ID NO: 2732062 - RNA, 19 nt, Haemophilus influenzae Rd
ucugcacgggaaauccagc

SEQ ID NO: 2732063 - RNA, 18 nt, Haemophilus influenzae Rd
ucugcagaaaaauguuca

SEQ ID NO: 2732064 - RNA, 18 nt, Haemophilus influenzae Rd
ucugcaggaaaaauaaau

SEQ ID NO: 2732065 - RNA, 16 nt, Haemophilus influenzae Rd
ucugcaguuucugguu

SEQ ID NO: 2732066 - RNA, 15 nt, Haemophilus influenzae Rd
ucugcauaaaauaau

SEQ ID NO: 2732067 - RNA, 16 nt, Haemophilus influenzae Rd
ucugcauaaaauaauu

SEQ ID NO: 2732068 - RNA, 19 nt, Haemophilus influenzae Rd
ucugcauaacuuaaauuuu

SEQ ID NO: 2732069 - RNA, 18 nt, Haemophilus influenzae Rd
ucugcauucuaaaaguuu

SEQ ID NO: 2732070 - RNA, 16 nt, Haemophilus influenzae Rd
ucugcauuugauuuca

SEQ ID NO: 2732071 - RNA, 21 nt, Haemophilus influenzae Rd
ucugccauaacgcuaucuuuu

SEQ ID NO: 2732072 - RNA, 23 nt, Haemophilus influenzae Rd
ucugccuaauaagcuaucgucaa

SEQ ID NO: 2732073 - RNA, 17 nt, Haemophilus influenzae Rd
ucugcgccuaaaauauu

SEQ ID NO: 2732074 - RNA, 19 nt, Haemophilus influenzae Rd
ucugcgccuaaaauauuuu

SEQ ID NO: 2732075 - RNA, 17 nt, Haemophilus influenzae Rd
ucugcgccuaauccaaa

SEQ ID NO: 2732076 - RNA, 20 nt, Haemophilus influenzae Rd
ucugcgcuaaauaagcugaa

SEQ ID NO: 2732077 - RNA, 16 nt, Haemophilus influenzae Rd
ucugcggucaucucuu

SEQ ID NO: 2732078 - RNA, 23 nt, Haemophilus influenzae Rd
ucugcguuuggcacaacaucaga

SEQ ID NO: 2732079 - RNA, 18 nt, Haemophilus influenzae Rd
ucugcuaaucguuuaauu

SEQ ID NO: 2732080 - RNA, 22 nt, Haemophilus influenzae Rd
ucugcuaaucguuuaauuucau

SEQ ID NO: 2732081 - RNA, 12 nt, Haemophilus influenzae Rd
ucugcucucauu

SEQ ID NO: 2732082 - RNA, 20 nt, Haemophilus influenzae Rd
ucugcucugcaccauccauc

SEQ ID NO: 2732083 - RNA, 17 nt, Haemophilus influenzae Rd
ucugcugauaccaauaa

SEQ ID NO: 2732084 - RNA, 14 nt, Haemophilus influenzae Rd
ucugcuggcucuac

SEQ ID NO: 2732085 - RNA, 22 nt, Haemophilus influenzae Rd
ucugcuuaguuccaccacccuu

SEQ ID NO: 2732086 - RNA, 23 nt, Haemophilus influenzae Rd
ucugcuuguucgcguuguucaau

SEQ ID NO: 2732087 - RNA, 19 nt, Haemophilus influenzae Rd
ucugcuuuuucuugcucau

SEQ ID NO: 2732088 - RNA, 22 nt, Haemophilus influenzae Rd
ucugcuuuuuuacugcuugguu

SEQ ID NO: 2732089 - RNA, 15 nt, Haemophilus influenzae Rd
ucuggacaagccauu

SEQ ID NO: 2732090 - RNA, 16 nt, Haemophilus influenzae Rd
ucuggauuaucuguaa

SEQ ID NO: 2732091 - RNA, 20 nt, Haemophilus influenzae Rd
ucuggauuaucuuguugcca

SEQ ID NO: 2732092 - RNA, 18 nt, Haemophilus influenzae Rd
ucuggcaaaucuuucgcu

SEQ ID NO: 2732093 - RNA, 21 nt, Haemophilus influenzae Rd
ucuggcacaucaaauucuaaa

SEQ ID NO: 2732094 - RNA, 19 nt, Haemophilus influenzae Rd
ucuggcucaauguuaaguu

SEQ ID NO: 2732095 - RNA, 22 nt, Haemophilus influenzae Rd
ucuggcucuaaaucuaauuuug

SEQ ID NO: 2732096 - RNA, 17 nt, Haemophilus influenzae Rd
ucugguggaagguaauu

SEQ ID NO: 2732097 - RNA, 17 nt, Haemophilus influenzae Rd
ucuguaaaacauuucau

SEQ ID NO: 2732098 - RNA, 21 nt, Haemophilus influenzae Rd
ucuguaaacuaaaucuugcuu

SEQ ID NO: 2732099 - RNA, 15 nt, Haemophilus influenzae Rd
ucuguaaauaugccu

SEQ ID NO: 2732100 - RNA, 21 nt, Haemophilus influenzae Rd
ucuguaagcagcuaacaaaau

SEQ ID NO: 2732101 - RNA, 14 nt, Haemophilus influenzae Rd
ucuguaaugccacc

SEQ ID NO: 2732102 - RNA, 14 nt, Haemophilus influenzae Rd
ucuguaauugguau

SEQ ID NO: 2732103 - RNA, 16 nt, Haemophilus influenzae Rd
ucuguauaccaaccau

SEQ ID NO: 2732104 - RNA, 16 nt, Haemophilus influenzae Rd
ucuguaugacuauuua

SEQ ID NO: 2732105 - RNA, 22 nt, Haemophilus influenzae Rd
ucuguaugacuauuuagaaauu

SEQ ID NO: 2732106 - RNA, 16 nt, Haemophilus influenzae Rd
ucuguauuaucuaauu

SEQ ID NO: 2732107 - RNA, 21 nt, Haemophilus influenzae Rd
ucuguauuuuuuauuuaauua

SEQ ID NO: 2732108 - RNA, 16 nt, Haemophilus influenzae Rd
ucugucacgagcuaaa

SEQ ID NO: 2732109 - RNA, 19 nt, Haemophilus influenzae Rd
ucugucacgagcuaaaaaa

SEQ ID NO: 2732110 - RNA, 21 nt, Haemophilus influenzae Rd
ucugucauaaccgugcucaau

SEQ ID NO: 2732111 - RNA, 15 nt, Haemophilus influenzae Rd
ucugucgcuuuuucc

SEQ ID NO: 2732112 - RNA, 23 nt, Haemophilus influenzae Rd
ucugucgcuuuuuccucagcaaa

SEQ ID NO: 2732113 - RNA, 14 nt, Haemophilus influenzae Rd
ucugugauauauau

SEQ ID NO: 2732114 - RNA, 17 nt, Haemophilus influenzae Rd
ucugugauauauaucac

SEQ ID NO: 2732115 - RNA, 14 nt, Haemophilus influenzae Rd
ucugugcaauauuu

SEQ ID NO: 2732116 - RNA, 18 nt, Haemophilus influenzae Rd
ucuguguuagaaagccuu

SEQ ID NO: 2732117 - RNA, 12 nt, Haemophilus influenzae Rd
ucuguguuuugu

SEQ ID NO: 2732118 - RNA, 19 nt, Haemophilus influenzae Rd
ucuguuaaacgcauauuuu

SEQ ID NO: 2732119 - RNA, 19 nt, Haemophilus influenzae Rd
ucuguuccugcauuauaac

SEQ ID NO: 2732120 - RNA, 19 nt, Haemophilus influenzae Rd
ucuguugcaaauuuuucau

SEQ ID NO: 2732121 - RNA, 22 nt, Haemophilus influenzae Rd
ucuguugcucagccaguuuucu

SEQ ID NO: 2732122 - RNA, 22 nt, Haemophilus influenzae Rd
ucuguugggauagauuuuuuac

SEQ ID NO: 2732123 - RNA, 13 nt, Haemophilus influenzae Rd
ucuguuuaaaaac

SEQ ID NO: 2732124 - RNA, 13 nt, Haemophilus influenzae Rd
ucuuaaaaaagau

SEQ ID NO: 2732125 - RNA, 14 nt, Haemophilus influenzae Rd
ucuuaaaaaagaug

SEQ ID NO: 2732126 - RNA, 13 nt, Haemophilus influenzae Rd
ucuuaaaaaauca

SEQ ID NO: 2732127 - RNA, 17 nt, Haemophilus influenzae Rd
ucuuaaagaauuucuuu

SEQ ID NO: 2732128 - RNA, 14 nt, Haemophilus influenzae Rd
ucuuaaaucauaaa

SEQ ID NO: 2732129 - RNA, 18 nt, Haemophilus influenzae Rd
ucuuaaaugggaaacuga

SEQ ID NO: 2732130 - RNA, 15 nt, Haemophilus influenzae Rd
ucuuaaauucauaau

SEQ ID NO: 2732131 - RNA, 20 nt, Haemophilus influenzae Rd
ucuuaaauucgcuuccagua

SEQ ID NO: 2732132 - RNA, 22 nt, Haemophilus influenzae Rd
ucuuaauauaggauuuuaaugu

SEQ ID NO: 2732133 - RNA, 15 nt, Haemophilus influenzae Rd
ucuuaauuuuauuaa

SEQ ID NO: 2732134 - RNA, 17 nt, Haemophilus influenzae Rd
ucuuaauuuuauuaauu

SEQ ID NO: 2732135 - RNA, 22 nt, Haemophilus influenzae Rd
ucuuaauuuuauuaauucuacu

SEQ ID NO: 2732136 - RNA, 15 nt, Haemophilus influenzae Rd
ucuuacagauucauu

SEQ ID NO: 2732137 - RNA, 18 nt, Haemophilus influenzae Rd
ucuuaccaaaaggucuua

SEQ ID NO: 2732138 - RNA, 21 nt, Haemophilus influenzae Rd
ucuuaccccaacaaacacgca

SEQ ID NO: 2732139 - RNA, 15 nt, Haemophilus influenzae Rd
ucuuaccuuuuucua

SEQ ID NO: 2732140 - RNA, 22 nt, Haemophilus influenzae Rd
ucuuacggauuuuugaacguuu

SEQ ID NO: 2732141 - RNA, 13 nt, Haemophilus influenzae Rd
ucuuagauuucua

SEQ ID NO: 2732142 - RNA, 15 nt, Haemophilus influenzae Rd
ucuuagauuucuaau

SEQ ID NO: 2732143 - RNA, 18 nt, Haemophilus influenzae Rd
ucuuaggguauuucgguu

SEQ ID NO: 2732144 - RNA, 19 nt, Haemophilus influenzae Rd
ucuuaguauuuuauuuaag

SEQ ID NO: 2732145 - RNA, 12 nt, Haemophilus influenzae Rd
ucuuauaauuac

SEQ ID NO: 2732146 - RNA, 23 nt, Haemophilus influenzae Rd
ucuuauaauuacagaaucauuuu

SEQ ID NO: 2732147 - RNA, 22 nt, Haemophilus influenzae Rd
ucuuauauauaaaauauauaau

SEQ ID NO: 2732148 - RNA, 12 nt, Haemophilus influenzae Rd
ucuuauauucuu

SEQ ID NO: 2732149 - RNA, 20 nt, Haemophilus influenzae Rd
ucuuauccguuacauuauuu

SEQ ID NO: 2732150 - RNA, 22 nt, Haemophilus influenzae Rd
ucuuaugaaaaaaaauuuauag

SEQ ID NO: 2732151 - RNA, 14 nt, Haemophilus influenzae Rd
ucuuauuaagguaa

SEQ ID NO: 2732152 - RNA, 17 nt, Haemophilus influenzae Rd
ucuuauucaaacucuaa

SEQ ID NO: 2732153 - RNA, 13 nt, Haemophilus influenzae Rd
ucuuauuucaaua

SEQ ID NO: 2732154 - RNA, 20 nt, Haemophilus influenzae Rd
ucuucaaaauaguaaaaauu

SEQ ID NO: 2732155 - RNA, 22 nt, Haemophilus influenzae Rd
ucuucaauaacaacuggaauuu

SEQ ID NO: 2732156 - RNA, 23 nt, Haemophilus influenzae Rd
ucuucaaucaucauuuauuaaaa

SEQ ID NO: 2732157 - RNA, 21 nt, Haemophilus influenzae Rd
ucuucaauuaccuuagccaaa

SEQ ID NO: 2732158 - RNA, 19 nt, Haemophilus influenzae Rd
ucuucaccucgugcuguuu

SEQ ID NO: 2732159 - RNA, 16 nt, Haemophilus influenzae Rd
ucuucacuacuugaac

SEQ ID NO: 2732160 - RNA, 17 nt, Haemophilus influenzae Rd
ucuucagacuagcauca

SEQ ID NO: 2732161 - RNA, 19 nt, Haemophilus influenzae Rd
ucuucagcacuugcaucua

SEQ ID NO: 2732162 - RNA, 17 nt, Haemophilus influenzae Rd
ucuucagcuuguuuaau

SEQ ID NO: 2732163 - RNA, 13 nt, Haemophilus influenzae Rd
ucuucaggugcaa

SEQ ID NO: 2732164 - RNA, 22 nt, Haemophilus influenzae Rd
ucuucaguacgcaccacuucgc

SEQ ID NO: 2732165 - RNA, 13 nt, Haemophilus influenzae Rd
ucuucauaaaaaa

SEQ ID NO: 2732166 - RNA, 16 nt, Haemophilus influenzae Rd
ucuucaucaaaaugaa

SEQ ID NO: 2732167 - RNA, 23 nt, Haemophilus influenzae Rd
ucuucaucaauaacacucauugu

SEQ ID NO: 2732168 - RNA, 13 nt, Haemophilus influenzae Rd
ucuucaucugcau

SEQ ID NO: 2732169 - RNA, 20 nt, Haemophilus influenzae Rd
ucuucaucuucuuuugccca

SEQ ID NO: 2732170 - RNA, 14 nt, Haemophilus influenzae Rd
ucuucaucuuuaaa

SEQ ID NO: 2732171 - RNA, 18 nt, Haemophilus influenzae Rd
ucuucaugauuuuccaaa

SEQ ID NO: 2732172 - RNA, 15 nt, Haemophilus influenzae Rd
ucuucauuaaacuga

SEQ ID NO: 2732173 - RNA, 16 nt, Haemophilus influenzae Rd
ucuucauuccauuuug

SEQ ID NO: 2732174 - RNA, 19 nt, Haemophilus influenzae Rd
ucuuccaaagaaucaucuu

SEQ ID NO: 2732175 - RNA, 16 nt, Haemophilus influenzae Rd
ucuuccaauaauucuu

SEQ ID NO: 2732176 - RNA, 23 nt, Haemophilus influenzae Rd
ucuuccaauacaaucagcugcuc

SEQ ID NO: 2732177 - RNA, 12 nt, Haemophilus influenzae Rd
ucuuccaaugug

SEQ ID NO: 2732178 - RNA, 14 nt, Haemophilus influenzae Rd
ucuucccagaaugg

SEQ ID NO: 2732179 - RNA, 22 nt, Haemophilus influenzae Rd
ucuucccagcguaaaaaugcug

SEQ ID NO: 2732180 - RNA, 17 nt, Haemophilus influenzae Rd
ucuucccccaaaaaguu

SEQ ID NO: 2732181 - RNA, 22 nt, Haemophilus influenzae Rd
ucuuccccucauguuuucgguu

SEQ ID NO: 2732182 - RNA, 19 nt, Haemophilus influenzae Rd
ucuucgauaaaaucuugcu

SEQ ID NO: 2732183 - RNA, 21 nt, Haemophilus influenzae Rd
ucuucgaugugcauuuuucau

SEQ ID NO: 2732184 - RNA, 20 nt, Haemophilus influenzae Rd
ucuucgauuaguuuaucaga

SEQ ID NO: 2732185 - RNA, 23 nt, Haemophilus influenzae Rd
ucuucgauuuuucuaaaaucaca

SEQ ID NO: 2732186 - RNA, 21 nt, Haemophilus influenzae Rd
ucuucgcgagaauuaccacaa

SEQ ID NO: 2732187 - RNA, 19 nt, Haemophilus influenzae Rd
ucuucgcuccaaucaucau

SEQ ID NO: 2732188 - RNA, 16 nt, Haemophilus influenzae Rd
ucuucgugcugaagag

SEQ ID NO: 2732189 - RNA, 16 nt, Haemophilus influenzae Rd
ucuucuaaagcgauaa

SEQ ID NO: 2732190 - RNA, 15 nt, Haemophilus influenzae Rd
ucuucuaauucuucc

SEQ ID NO: 2732191 - RNA, 21 nt, Haemophilus influenzae Rd
ucuucuacggucgcaccaccu

SEQ ID NO: 2732192 - RNA, 15 nt, Haemophilus influenzae Rd
ucuucuacuguuaau

SEQ ID NO: 2732193 - RNA, 13 nt, Haemophilus influenzae Rd
ucuucuauugaua

SEQ ID NO: 2732194 - RNA, 14 nt, Haemophilus influenzae Rd
ucuucucguuuuuu

SEQ ID NO: 2732195 - RNA, 18 nt, Haemophilus influenzae Rd
ucuucugaucaauuuaau

SEQ ID NO: 2732196 - RNA, 18 nt, Haemophilus influenzae Rd
ucuucugcggucaucucu

SEQ ID NO: 2732197 - RNA, 20 nt, Haemophilus influenzae Rd
ucuucugcggucaucucuug

SEQ ID NO: 2732198 - RNA, 23 nt, Haemophilus influenzae Rd
ucuucugcggucaucucuuguuu

SEQ ID NO: 2732199 - RNA, 16 nt, Haemophilus influenzae Rd
ucuucugggucuuuuu

SEQ ID NO: 2732200 - RNA, 21 nt, Haemophilus influenzae Rd
ucuucugguggaagcuucaua

SEQ ID NO: 2732201 - RNA, 17 nt, Haemophilus influenzae Rd
ucuucuucauccacaua

SEQ ID NO: 2732202 - RNA, 11 nt, Haemophilus influenzae Rd
ucuucuuccca

SEQ ID NO: 2732203 - RNA, 23 nt, Haemophilus influenzae Rd
ucuucuucgcuccaaucaucauc

SEQ ID NO: 2732204 - RNA, 20 nt, Haemophilus influenzae Rd
ucuucuuggcaauauuuaau

SEQ ID NO: 2732205 - RNA, 17 nt, Haemophilus influenzae Rd
ucuucuuguucaaauaa

SEQ ID NO: 2732206 - RNA, 23 nt, Haemophilus influenzae Rd
ucuucuuuaaacaccaaauauuc

SEQ ID NO: 2732207 - RNA, 16 nt, Haemophilus influenzae Rd
ucuucuuuaauuucuu

SEQ ID NO: 2732208 - RNA, 19 nt, Haemophilus influenzae Rd
ucuucuuuaauuucuucaa

SEQ ID NO: 2732209 - RNA, 21 nt, Haemophilus influenzae Rd
ucuucuuuugcccauucuaau

SEQ ID NO: 2732210 - RNA, 15 nt, Haemophilus influenzae Rd
ucuucuuuuuucuca

SEQ ID NO: 2732211 - RNA, 18 nt, Haemophilus influenzae Rd
ucuugacauaauuucaca

SEQ ID NO: 2732212 - RNA, 21 nt, Haemophilus influenzae Rd
ucuugacauaauuucacaauu

SEQ ID NO: 2732213 - RNA, 16 nt, Haemophilus influenzae Rd
ucuugaccaaauucca

SEQ ID NO: 2732214 - RNA, 16 nt, Haemophilus influenzae Rd
ucuugaccugcagcca

SEQ ID NO: 2732215 - RNA, 22 nt, Haemophilus influenzae Rd
ucuugauaauagcguccuacua

SEQ ID NO: 2732216 - RNA, 16 nt, Haemophilus influenzae Rd
ucuugaugauaaucuu

SEQ ID NO: 2732217 - RNA, 20 nt, Haemophilus influenzae Rd
ucuugaugauaaucuuccca

SEQ ID NO: 2732218 - RNA, 21 nt, Haemophilus influenzae Rd
ucuugauuauuuaauuucaaa

SEQ ID NO: 2732219 - RNA, 21 nt, Haemophilus influenzae Rd
ucuugcaacuuuuuuaggauu

SEQ ID NO: 2732220 - RNA, 23 nt, Haemophilus influenzae Rd
ucuugcaacuuuuuuaggauugc

SEQ ID NO: 2732221 - RNA, 18 nt, Haemophilus influenzae Rd
ucuugcacggcaguaucu

SEQ ID NO: 2732222 - RNA, 18 nt, Haemophilus influenzae Rd
ucuugcauaaaccaacua

SEQ ID NO: 2732223 - RNA, 22 nt, Haemophilus influenzae Rd
ucuugcccgcaccgcuucuuug

SEQ ID NO: 2732224 - RNA, 16 nt, Haemophilus influenzae Rd
ucuugcuaaaaagaaa

SEQ ID NO: 2732225 - RNA, 17 nt, Haemophilus influenzae Rd
ucuugcuaaaaagaaau

SEQ ID NO: 2732226 - RNA, 21 nt, Haemophilus influenzae Rd
ucuugcuguugguuaaaaaua

SEQ ID NO: 2732227 - RNA, 14 nt, Haemophilus influenzae Rd
ucuugcuuuuuaau

SEQ ID NO: 2732228 - RNA, 17 nt, Haemophilus influenzae Rd
ucuugcuuuuuuaauca

SEQ ID NO: 2732229 - RNA, 13 nt, Haemophilus influenzae Rd
ucuuggauuuucu

SEQ ID NO: 2732230 - RNA, 23 nt, Haemophilus influenzae Rd
ucuuggauuuuuucuaauccaga

SEQ ID NO: 2732231 - RNA, 15 nt, Haemophilus influenzae Rd
ucuuggcaauauuua

SEQ ID NO: 2732232 - RNA, 18 nt, Haemophilus influenzae Rd
ucuuggcucauuuuaaag

SEQ ID NO: 2732233 - RNA, 15 nt, Haemophilus influenzae Rd
ucuugggauuuugcc

SEQ ID NO: 2732234 - RNA, 18 nt, Haemophilus influenzae Rd
ucuugguuuaaauuuuaa

SEQ ID NO: 2732235 - RNA, 21 nt, Haemophilus influenzae Rd
ucuuguaaacugcuuucaaaa

SEQ ID NO: 2732236 - RNA, 16 nt, Haemophilus influenzae Rd
ucuuguaacuauaacu

SEQ ID NO: 2732237 - RNA, 22 nt, Haemophilus influenzae Rd
ucuuguaagccaaauaaugcau

SEQ ID NO: 2732238 - RNA, 16 nt, Haemophilus influenzae Rd
ucuuguggugcaaccu

SEQ ID NO: 2732239 - RNA, 20 nt, Haemophilus influenzae Rd
ucuuguuggaucuuccaaua

SEQ ID NO: 2732240 - RNA, 16 nt, Haemophilus influenzae Rd
ucuuguuuaaauucag

SEQ ID NO: 2732241 - RNA, 19 nt, Haemophilus influenzae Rd
ucuuguuuaaauucaggcu

SEQ ID NO: 2732242 - RNA, 14 nt, Haemophilus influenzae Rd
ucuuguuuaauauu

SEQ ID NO: 2732243 - RNA, 15 nt, Haemophilus influenzae Rd
ucuuguuuaauauuu

SEQ ID NO: 2732244 - RNA, 16 nt, Haemophilus influenzae Rd
ucuuguuuaauauuuu

SEQ ID NO: 2732245 - RNA, 22 nt, Haemophilus influenzae Rd
ucuuguuuaauauuuuuuucaa

SEQ ID NO: 2732246 - RNA, 21 nt, Haemophilus influenzae Rd
ucuuuaaaauuauaauauuua

SEQ ID NO: 2732247 - RNA, 22 nt, Haemophilus influenzae Rd
ucuuuaaacaucgcuucaucau

SEQ ID NO: 2732248 - RNA, 16 nt, Haemophilus influenzae Rd
ucuuuaaauauucaau

SEQ ID NO: 2732249 - RNA, 15 nt, Haemophilus influenzae Rd
ucuuuaaauuuugcu

SEQ ID NO: 2732250 - RNA, 15 nt, Haemophilus influenzae Rd
ucuuuaacaaaauca

SEQ ID NO: 2732251 - RNA, 16 nt, Haemophilus influenzae Rd
ucuuuaacaaauucac

SEQ ID NO: 2732252 - RNA, 19 nt, Haemophilus influenzae Rd
ucuuuaacaggaauuugcu

SEQ ID NO: 2732253 - RNA, 22 nt, Haemophilus influenzae Rd
ucuuuaacuugcucugguugag

SEQ ID NO: 2732254 - RNA, 13 nt, Haemophilus influenzae Rd
ucuuuaaucguua

SEQ ID NO: 2732255 - RNA, 15 nt, Haemophilus influenzae Rd
ucuuuaauuaaaaua

SEQ ID NO: 2732256 - RNA, 16 nt, Haemophilus influenzae Rd
ucuuuaauuaaaauau

SEQ ID NO: 2732257 - RNA, 22 nt, Haemophilus influenzae Rd
ucuuuaauuaaaauauuuuuag

SEQ ID NO: 2732258 - RNA, 13 nt, Haemophilus influenzae Rd
ucuuuacaaauuu

SEQ ID NO: 2732259 - RNA, 12 nt, Haemophilus influenzae Rd
ucuuuaccaaaa

SEQ ID NO: 2732260 - RNA, 16 nt, Haemophilus influenzae Rd
ucuuuaccaaaaaauu

SEQ ID NO: 2732261 - RNA, 17 nt, Haemophilus influenzae Rd
ucuuuacccauugucau

SEQ ID NO: 2732262 - RNA, 23 nt, Haemophilus influenzae Rd
ucuuuaccuugcauuucuuuaau

SEQ ID NO: 2732263 - RNA, 19 nt, Haemophilus influenzae Rd
ucuuuacgacuaaaacgaa

SEQ ID NO: 2732264 - RNA, 14 nt, Haemophilus influenzae Rd
ucuuuagaaaguuu

SEQ ID NO: 2732265 - RNA, 18 nt, Haemophilus influenzae Rd
ucuuuagaaaguuuugca

SEQ ID NO: 2732266 - RNA, 19 nt, Haemophilus influenzae Rd
ucuuuagcuauuaaauuag

SEQ ID NO: 2732267 - RNA, 18 nt, Haemophilus influenzae Rd
ucuuuaggaucacuaauu

SEQ ID NO: 2732268 - RNA, 20 nt, Haemophilus influenzae Rd
ucuuuaggauuguugauuuu

SEQ ID NO: 2732269 - RNA, 16 nt, Haemophilus influenzae Rd
ucuuuauaaauaacau

SEQ ID NO: 2732270 - RNA, 14 nt, Haemophilus influenzae Rd
ucuuuauaacauaa

SEQ ID NO: 2732271 - RNA, 17 nt, Haemophilus influenzae Rd
ucuuuauaagaaaguuu

SEQ ID NO: 2732272 - RNA, 18 nt, Haemophilus influenzae Rd
ucuuuauaagaaaguuuc

SEQ ID NO: 2732273 - RNA, 17 nt, Haemophilus influenzae Rd
ucuuuauagccuauaau

SEQ ID NO: 2732274 - RNA, 14 nt, Haemophilus influenzae Rd
ucuuuaucauuuaa

SEQ ID NO: 2732275 - RNA, 23 nt, Haemophilus influenzae Rd
ucuuuaucuauugauucuaaaaa

SEQ ID NO: 2732276 - RNA, 17 nt, Haemophilus influenzae Rd
ucuuuaucugauuuaau

SEQ ID NO: 2732277 - RNA, 23 nt, Haemophilus influenzae Rd
ucuuuaucugauuuaaucauuac

SEQ ID NO: 2732278 - RNA, 17 nt, Haemophilus influenzae Rd
ucuuuaugaauuaccaa

SEQ ID NO: 2732279 - RNA, 14 nt, Haemophilus influenzae Rd
ucuuuauucugaaa

SEQ ID NO: 2732280 - RNA, 16 nt, Haemophilus influenzae Rd
ucuuuauuugagccaa

SEQ ID NO: 2732281 - RNA, 21 nt, Haemophilus influenzae Rd
ucuuuauuugagccaauaacu

SEQ ID NO: 2732282 - RNA, 20 nt, Haemophilus influenzae Rd
ucuuuauuuuuucaucauuu

SEQ ID NO: 2732283 - RNA, 14 nt, Haemophilus influenzae Rd
ucuuucaaaaauca

SEQ ID NO: 2732284 - RNA, 23 nt, Haemophilus influenzae Rd
ucuuucaaaaaucaaauuaauuu

SEQ ID NO: 2732285 - RNA, 17 nt, Haemophilus influenzae Rd
ucuuucaaguuugcaau

SEQ ID NO: 2732286 - RNA, 13 nt, Haemophilus influenzae Rd
ucuuucaauaauu

SEQ ID NO: 2732287 - RNA, 12 nt, Haemophilus influenzae Rd
ucuuucaauguu

SEQ ID NO: 2732288 - RNA, 22 nt, Haemophilus influenzae Rd
ucuuucacgauaauaguaucag

SEQ ID NO: 2732289 - RNA, 23 nt, Haemophilus influenzae Rd
ucuuucaguuuugcuuuuuuaau

SEQ ID NO: 2732290 - RNA, 12 nt, Haemophilus influenzae Rd
ucuuucauuuga

SEQ ID NO: 2732291 - RNA, 15 nt, Haemophilus influenzae Rd
ucuuuccauuuuuuu

SEQ ID NO: 2732292 - RNA, 16 nt, Haemophilus influenzae Rd
ucuuucgcagccacuu

SEQ ID NO: 2732293 - RNA, 23 nt, Haemophilus influenzae Rd
ucuuucuaguaaaacuaauacuu

SEQ ID NO: 2732294 - RNA, 15 nt, Haemophilus influenzae Rd
ucuuucuauuugaau

SEQ ID NO: 2732295 - RNA, 24 nt, Haemophilus influenzae Rd
ucuuugaauuguuuguauaagcca

SEQ ID NO: 2732296 - RNA, 20 nt, Haemophilus influenzae Rd
ucuuugacuaaaguaaauuu

SEQ ID NO: 2732297 - RNA, 13 nt, Haemophilus influenzae Rd
ucuuugacuaaau

SEQ ID NO: 2732298 - RNA, 16 nt, Haemophilus influenzae Rd
ucuuugacuaaaucau

SEQ ID NO: 2732299 - RNA, 17 nt, Haemophilus influenzae Rd
ucuuugacuaaaucaug

SEQ ID NO: 2732300 - RNA, 13 nt, Haemophilus influenzae Rd
ucuuugauauaaa

SEQ ID NO: 2732301 - RNA, 23 nt, Haemophilus influenzae Rd
ucuuugaugaagcuaaacuuuag

SEQ ID NO: 2732302 - RNA, 23 nt, Haemophilus influenzae Rd
ucuuugccacaggauaaaaacca

SEQ ID NO: 2732303 - RNA, 19 nt, Haemophilus influenzae Rd
ucuuuguuaccuuuuccaa

SEQ ID NO: 2732304 - RNA, 17 nt, Haemophilus influenzae Rd
ucuuuguucacaucaaa

SEQ ID NO: 2732305 - RNA, 15 nt, Haemophilus influenzae Rd
ucuuuguugaugauu

SEQ ID NO: 2732306 - RNA, 14 nt, Haemophilus influenzae Rd
ucuuuuaauaagau

SEQ ID NO: 2732307 - RNA, 21 nt, Haemophilus influenzae Rd
ucuuuuaauaagauaauaaau

SEQ ID NO: 2732308 - RNA, 15 nt, Haemophilus influenzae Rd
ucuuuuaaugcuucu

SEQ ID NO: 2732309 - RNA, 14 nt, Haemophilus influenzae Rd
ucuuuuaauuuuua

SEQ ID NO: 2732310 - RNA, 19 nt, Haemophilus influenzae Rd
ucuuuuauagacuucaagu

SEQ ID NO: 2732311 - RNA, 22 nt, Haemophilus influenzae Rd
ucuuuuaucgagaaaauuaaaa

SEQ ID NO: 2732312 - RNA, 19 nt, Haemophilus influenzae Rd
ucuuuuauuaacaaaaaga

SEQ ID NO: 2732313 - RNA, 16 nt, Haemophilus influenzae Rd
ucuuuucuaacgcuuu

SEQ ID NO: 2732314 - RNA, 13 nt, Haemophilus influenzae Rd
ucuuuucuauaau

SEQ ID NO: 2732315 - RNA, 13 nt, Haemophilus influenzae Rd
ucuuuucuucuaa

SEQ ID NO: 2732316 - RNA, 19 nt, Haemophilus influenzae Rd
ucuuuugauaagcuugcgu

SEQ ID NO: 2732317 - RNA, 14 nt, Haemophilus influenzae Rd
ucuuuugcacuuug

SEQ ID NO: 2732318 - RNA, 18 nt, Haemophilus influenzae Rd
ucuuuuggcauuugcaua

SEQ ID NO: 2732319 - RNA, 15 nt, Haemophilus influenzae Rd
ucuuuuggguuaaau

SEQ ID NO: 2732320 - RNA, 17 nt, Haemophilus influenzae Rd
ucuuuugguaaauacug

SEQ ID NO: 2732321 - RNA, 16 nt, Haemophilus influenzae Rd
ucuuuugguaauaaau

SEQ ID NO: 2732322 - RNA, 23 nt, Haemophilus influenzae Rd
ucuuuugguaauaaaucaaaaga

SEQ ID NO: 2732323 - RNA, 17 nt, Haemophilus influenzae Rd
ucuuuuguuacuuucca

SEQ ID NO: 2732324 - RNA, 16 nt, Haemophilus influenzae Rd
ucuuuuguuuuaaccg

SEQ ID NO: 2732325 - RNA, 18 nt, Haemophilus influenzae Rd
ucuuuuuaaauauuuaaa

SEQ ID NO: 2732326 - RNA, 12 nt, Haemophilus influenzae Rd
ucuuuuuaauuu

SEQ ID NO: 2732327 - RNA, 13 nt, Haemophilus influenzae Rd
ucuuuuuauaaaa

SEQ ID NO: 2732328 - RNA, 13 nt, Haemophilus influenzae Rd
ucuuuuuauguuu

SEQ ID NO: 2732329 - RNA, 20 nt, Haemophilus influenzae Rd
ucuuuuuauuagacaauaaa

SEQ ID NO: 2732330 - RNA, 15 nt, Haemophilus influenzae Rd
ucuuuuuauuuuacu

SEQ ID NO: 2732331 - RNA, 15 nt, Haemophilus influenzae Rd
ucuuuuucacuauua

SEQ ID NO: 2732332 - RNA, 13 nt, Haemophilus influenzae Rd
ucuuuuucagaag

SEQ ID NO: 2732333 - RNA, 17 nt, Haemophilus influenzae Rd
ucuuuuuguaauuuuug

SEQ ID NO: 2732334 - RNA, 14 nt, Haemophilus influenzae Rd
ucuuuuuguuaaua

SEQ ID NO: 2732335 - RNA, 19 nt, Haemophilus influenzae Rd
ucuuuuuguuaauaaaaga

SEQ ID NO: 2732336 - RNA, 20 nt, Haemophilus influenzae Rd
ucuuuuuguuaauaaaagaa

SEQ ID NO: 2732337 - RNA, 14 nt, Haemophilus influenzae Rd
ucuuuuuuaagaua

SEQ ID NO: 2732338 - RNA, 16 nt, Haemophilus influenzae Rd
ucuuuuuuuauauuuu

SEQ ID NO: 2732339 - RNA, 12 nt, Haemophilus influenzae Rd
ucuuuuuuucau

SEQ ID NO: 2732340 - RNA, 13 nt, Haemophilus influenzae Rd
ucuuuuuuucaua

SEQ ID NO: 2732341 - RNA, 13 nt, Haemophilus influenzae Rd
ugaaaaaaacugu

SEQ ID NO: 2732342 - RNA, 17 nt, Haemophilus influenzae Rd
ugaaaaaaagaaaacca

SEQ ID NO: 2732343 - RNA, 19 nt, Haemophilus influenzae Rd
ugaaaaaaagaaaaccaaa

SEQ ID NO: 2732344 - RNA, 22 nt, Haemophilus influenzae Rd
ugaaaaaaagugcgguugaaau

SEQ ID NO: 2732345 - RNA, 22 nt, Haemophilus influenzae Rd
ugaaaaaacguaauagauaaag

SEQ ID NO: 2732346 - RNA, 15 nt, Haemophilus influenzae Rd
ugaaaaaagugcgau

SEQ ID NO: 2732347 - RNA, 20 nt, Haemophilus influenzae Rd
ugaaaaaauaucgcacuuuu

SEQ ID NO: 2732348 - RNA, 15 nt, Haemophilus influenzae Rd
ugaaaaagcuaaaaa

SEQ ID NO: 2732349 - RNA, 20 nt, Haemophilus influenzae Rd
ugaaaaagcuaaaaaaacag

SEQ ID NO: 2732350 - RNA, 21 nt, Haemophilus influenzae Rd
ugaaaaagcuaaaaaaacagg

SEQ ID NO: 2732351 - RNA, 15 nt, Haemophilus influenzae Rd
ugaaaaaguuagacu

SEQ ID NO: 2732352 - RNA, 23 nt, Haemophilus influenzae Rd
ugaaaaaguuagacuaugaaauc

SEQ ID NO: 2732353 - RNA, 13 nt, Haemophilus influenzae Rd
ugaaaaauaucac

SEQ ID NO: 2732354 - RNA, 19 nt, Haemophilus influenzae Rd
ugaaaaauggacagaauaa

SEQ ID NO: 2732355 - RNA, 20 nt, Haemophilus influenzae Rd
ugaaaaauggacagaauaac

SEQ ID NO: 2732356 - RNA, 14 nt, Haemophilus influenzae Rd
ugaaaaauuaucaa

SEQ ID NO: 2732357 - RNA, 17 nt, Haemophilus influenzae Rd
ugaaaaauuaucaaaag

SEQ ID NO: 2732358 - RNA, 14 nt, Haemophilus influenzae Rd
ugaaaaauucaaag

SEQ ID NO: 2732359 - RNA, 20 nt, Haemophilus influenzae Rd
ugaaaacagcggucaaaaua

SEQ ID NO: 2732360 - RNA, 14 nt, Haemophilus influenzae Rd
ugaaaagaaaacuu

SEQ ID NO: 2732361 - RNA, 22 nt, Haemophilus influenzae Rd
ugaaaagaaaguauuaaauaua

SEQ ID NO: 2732362 - RNA, 12 nt, Haemophilus influenzae Rd
ugaaaagaaaua

SEQ ID NO: 2732363 - RNA, 15 nt, Haemophilus influenzae Rd
ugaaaagaauuucau

SEQ ID NO: 2732364 - RNA, 16 nt, Haemophilus influenzae Rd
ugaaaagcugauauaa

SEQ ID NO: 2732365 - RNA, 21 nt, Haemophilus influenzae Rd
ugaaaagcugauauaaaaaug

SEQ ID NO: 2732366 - RNA, 16 nt, Haemophilus influenzae Rd
ugaaaaguaaaugaua

SEQ ID NO: 2732367 - RNA, 20 nt, Haemophilus influenzae Rd
ugaaaagugcgguaaaaauu

SEQ ID NO: 2732368 - RNA, 23 nt, Haemophilus influenzae Rd
ugaaaagugcgguaaaaauuucu

SEQ ID NO: 2732369 - RNA, 15 nt, Haemophilus influenzae Rd
ugaaaauaaccgcac

SEQ ID NO: 2732370 - RNA, 18 nt, Haemophilus influenzae Rd
ugaaaauguaaauuggca

SEQ ID NO: 2732371 - RNA, 18 nt, Haemophilus influenzae Rd
ugaaaauucauuauuacu

SEQ ID NO: 2732372 - RNA, 21 nt, Haemophilus influenzae Rd
ugaaaauucucaggaaauuuc

SEQ ID NO: 2732373 - RNA, 17 nt, Haemophilus influenzae Rd
ugaaaauugcaaaggca

SEQ ID NO: 2732374 - RNA, 19 nt, Haemophilus influenzae Rd
ugaaacaagcuguagcaag

SEQ ID NO: 2732375 - RNA, 14 nt, Haemophilus influenzae Rd
ugaaacagcuaaaa

SEQ ID NO: 2732376 - RNA, 15 nt, Haemophilus influenzae Rd
ugaaaccaaauccuu

SEQ ID NO: 2732377 - RNA, 17 nt, Haemophilus influenzae Rd
ugaaaccaaauccuuuu

SEQ ID NO: 2732378 - RNA, 14 nt, Haemophilus influenzae Rd
ugaaaccuaaacuu

SEQ ID NO: 2732379 - RNA, 19 nt, Haemophilus influenzae Rd
ugaaaccugaguaaauaaa

SEQ ID NO: 2732380 - RNA, 19 nt, Haemophilus influenzae Rd
ugaaacuguuuuggcauuu

SEQ ID NO: 2732381 - RNA, 22 nt, Haemophilus influenzae Rd
ugaaacuguuuuggcauuuuca

SEQ ID NO: 2732382 - RNA, 20 nt, Haemophilus influenzae Rd
ugaaacuugguguaauuuga

SEQ ID NO: 2732383 - RNA, 14 nt, Haemophilus influenzae Rd
ugaaagaaaaagau

SEQ ID NO: 2732384 - RNA, 13 nt, Haemophilus influenzae Rd
ugaaagaaauuuu

SEQ ID NO: 2732385 - RNA, 14 nt, Haemophilus influenzae Rd
ugaaagaagaaaaa

SEQ ID NO: 2732386 - RNA, 20 nt, Haemophilus influenzae Rd
ugaaagaauaauccccuaaa

SEQ ID NO: 2732387 - RNA, 23 nt, Haemophilus influenzae Rd
ugaaagacccaccgcaaaagcca

SEQ ID NO: 2732388 - RNA, 15 nt, Haemophilus influenzae Rd
ugaaagacgaaucau

SEQ ID NO: 2732389 - RNA, 15 nt, Haemophilus influenzae Rd
ugaaagacugcuacu

SEQ ID NO: 2732390 - RNA, 14 nt, Haemophilus influenzae Rd
ugaaagauaaauua

SEQ ID NO: 2732391 - RNA, 23 nt, Haemophilus influenzae Rd
ugaaagcgaaaucgcacucacaa

SEQ ID NO: 2732392 - RNA, 20 nt, Haemophilus influenzae Rd
ugaaagcuauuucggcagua

SEQ ID NO: 2732393 - RNA, 22 nt, Haemophilus influenzae Rd
ugaaagcuauuucggcaguacu

SEQ ID NO: 2732394 - RNA, 23 nt, Haemophilus influenzae Rd
ugaaagggaaauaacaaaaacaa

SEQ ID NO: 2732395 - RNA, 17 nt, Haemophilus influenzae Rd
ugaaagggaaauuuauu

SEQ ID NO: 2732396 - RNA, 16 nt, Haemophilus influenzae Rd
ugaaaguauuaaauuu

SEQ ID NO: 2732397 - RNA, 21 nt, Haemophilus influenzae Rd
ugaaaguuugcuuagugaaaa

SEQ ID NO: 2732398 - RNA, 15 nt, Haemophilus influenzae Rd
ugaaauaaaauauau

SEQ ID NO: 2732399 - RNA, 16 nt, Haemophilus influenzae Rd
ugaaauaaagaaagga

SEQ ID NO: 2732400 - RNA, 13 nt, Haemophilus influenzae Rd
ugaaauaagauuu

SEQ ID NO: 2732401 - RNA, 21 nt, Haemophilus influenzae Rd
ugaaauaauucauguuuuuua

SEQ ID NO: 2732402 - RNA, 17 nt, Haemophilus influenzae Rd
ugaaauacaaagcacua

SEQ ID NO: 2732403 - RNA, 23 nt, Haemophilus influenzae Rd
ugaaauagacuacuuaaaauuca

SEQ ID NO: 2732404 - RNA, 22 nt, Haemophilus influenzae Rd
ugaaauauuccaacgauuuugc

SEQ ID NO: 2732405 - RNA, 11 nt, Haemophilus influenzae Rd
ugaaauauuuu

SEQ ID NO: 2732406 - RNA, 13 nt, Haemophilus influenzae Rd
ugaaaucaaaaug

SEQ ID NO: 2732407 - RNA, 23 nt, Haemophilus influenzae Rd
ugaaaucaaaauggguaaggaaa

SEQ ID NO: 2732408 - RNA, 17 nt, Haemophilus influenzae Rd
ugaaaucauuacacaga

SEQ ID NO: 2732409 - RNA, 16 nt, Haemophilus influenzae Rd
ugaaaucccuuagaaa

SEQ ID NO: 2732410 - RNA, 17 nt, Haemophilus influenzae Rd
ugaaaucccuuagaaaa

SEQ ID NO: 2732411 - RNA, 21 nt, Haemophilus influenzae Rd
ugaaaugaaguaauaaucuuc

SEQ ID NO: 2732412 - RNA, 23 nt, Haemophilus influenzae Rd
ugaaaugcccguuacuuuuauug

SEQ ID NO: 2732413 - RNA, 13 nt, Haemophilus influenzae Rd
ugaaaugcucuaa

SEQ ID NO: 2732414 - RNA, 21 nt, Haemophilus influenzae Rd
ugaaauuaauaagaaagaauc

SEQ ID NO: 2732415 - RNA, 15 nt, Haemophilus influenzae Rd
ugaaauuaauaagcc

SEQ ID NO: 2732416 - RNA, 20 nt, Haemophilus influenzae Rd
ugaaauuacucaucugaauu

SEQ ID NO: 2732417 - RNA, 23 nt, Haemophilus influenzae Rd
ugaaauuacucaucugaauuuaa

SEQ ID NO: 2732418 - RNA, 16 nt, Haemophilus influenzae Rd
ugaaauuagacaaaaa

SEQ ID NO: 2732419 - RNA, 20 nt, Haemophilus influenzae Rd
ugaaauuagguuauuuuuuc

SEQ ID NO: 2732420 - RNA, 22 nt, Haemophilus influenzae Rd
ugaaauuagguuauuuuuucaa

SEQ ID NO: 2732421 - RNA, 23 nt, Haemophilus influenzae Rd
ugaaauuagguuauuuuuucaau

SEQ ID NO: 2732422 - RNA, 16 nt, Haemophilus influenzae Rd
ugaaauucuaaaaaaa

SEQ ID NO: 2732423 - RNA, 12 nt, Haemophilus influenzae Rd
ugaaauuuaaua

SEQ ID NO: 2732424 - RNA, 20 nt, Haemophilus influenzae Rd
ugaaauuuaucuaaaaguaa

SEQ ID NO: 2732425 - RNA, 17 nt, Haemophilus influenzae Rd
ugaaauuucaccgcauu

SEQ ID NO: 2732426 - RNA, 15 nt, Haemophilus influenzae Rd
ugaaauuuccugaga

SEQ ID NO: 2732427 - RNA, 22 nt, Haemophilus influenzae Rd
ugaaauuuccugagaauuuuca

SEQ ID NO: 2732428 - RNA, 17 nt, Haemophilus influenzae Rd
ugaaauuucuuuaauug

SEQ ID NO: 2732429 - RNA, 15 nt, Haemophilus influenzae Rd
ugaaauuugaauaua

SEQ ID NO: 2732430 - RNA, 14 nt, Haemophilus influenzae Rd
ugaaauuugaaugc

SEQ ID NO: 2732431 - RNA, 16 nt, Haemophilus influenzae Rd
ugaaauuuuaauuuag

SEQ ID NO: 2732432 - RNA, 22 nt, Haemophilus influenzae Rd
ugaaauuuuuaucuaaauuaau

SEQ ID NO: 2732433 - RNA, 13 nt, Haemophilus influenzae Rd
ugaaauuuuucau

SEQ ID NO: 2732434 - RNA, 22 nt, Haemophilus influenzae Rd
ugaaauuuuucaucuuuuuaua

SEQ ID NO: 2732435 - RNA, 16 nt, Haemophilus influenzae Rd
ugaacauaagcaacau

SEQ ID NO: 2732436 - RNA, 14 nt, Haemophilus influenzae Rd
ugaaccaaaucuaa

SEQ ID NO: 2732437 - RNA, 20 nt, Haemophilus influenzae Rd
ugaaccaaaucuaacauuuc

SEQ ID NO: 2732438 - RNA, 20 nt, Haemophilus influenzae Rd
ugaaccaacccaauuuaccu

SEQ ID NO: 2732439 - RNA, 14 nt, Haemophilus influenzae Rd
ugaaccauaaacaa

SEQ ID NO: 2732440 - RNA, 22 nt, Haemophilus influenzae Rd
ugaaccauaaacaauauaacca

SEQ ID NO: 2732441 - RNA, 13 nt, Haemophilus influenzae Rd
ugaaccuauuaga

SEQ ID NO: 2732442 - RNA, 17 nt, Haemophilus influenzae Rd
ugaaccuucacagauuu

SEQ ID NO: 2732443 - RNA, 21 nt, Haemophilus influenzae Rd
ugaaccuucacagauuucaau

SEQ ID NO: 2732444 - RNA, 15 nt, Haemophilus influenzae Rd
ugaacgaguaaauua

SEQ ID NO: 2732445 - RNA, 13 nt, Haemophilus influenzae Rd
ugaacgcaaauac

SEQ ID NO: 2732446 - RNA, 17 nt, Haemophilus influenzae Rd
ugaacgcgcgccaauaa

SEQ ID NO: 2732447 - RNA, 15 nt, Haemophilus influenzae Rd
ugaacuaauaucacu

SEQ ID NO: 2732448 - RNA, 15 nt, Haemophilus influenzae Rd
ugaacucaauuccuu

SEQ ID NO: 2732449 - RNA, 20 nt, Haemophilus influenzae Rd
ugaacucacaauugauguaa

SEQ ID NO: 2732450 - RNA, 14 nt, Haemophilus influenzae Rd
ugaacuguaauuuc

SEQ ID NO: 2732451 - RNA, 16 nt, Haemophilus influenzae Rd
ugaacuguaauuucgg

SEQ ID NO: 2732452 - RNA, 14 nt, Haemophilus influenzae Rd
ugaacugugagauu

SEQ ID NO: 2732453 - RNA, 21 nt, Haemophilus influenzae Rd
ugaacuuugugccauuucuaa

SEQ ID NO: 2732454 - RNA, 22 nt, Haemophilus influenzae Rd
ugaacuuuuaacugcuuuaaua

SEQ ID NO: 2732455 - RNA, 19 nt, Haemophilus influenzae Rd
ugaacuuuuuuauaaucuu

SEQ ID NO: 2732456 - RNA, 14 nt, Haemophilus influenzae Rd
ugaagaaaauuucu

SEQ ID NO: 2732457 - RNA, 17 nt, Haemophilus influenzae Rd
ugaagaaaauuucugcu

SEQ ID NO: 2732458 - RNA, 19 nt, Haemophilus influenzae Rd
ugaagaaaauuucugcugc

SEQ ID NO: 2732459 - RNA, 17 nt, Haemophilus influenzae Rd
ugaagaaauggcgacca

SEQ ID NO: 2732460 - RNA, 15 nt, Haemophilus influenzae Rd
ugaagaacaagggga

SEQ ID NO: 2732461 - RNA, 14 nt, Haemophilus influenzae Rd
ugaagaacguaaau

SEQ ID NO: 2732462 - RNA, 17 nt, Haemophilus influenzae Rd
ugaagaacguaaauuau

SEQ ID NO: 2732463 - RNA, 12 nt, Haemophilus influenzae Rd
ugaagacaucau

SEQ ID NO: 2732464 - RNA, 15 nt, Haemophilus influenzae Rd
ugaagacaucauaua

SEQ ID NO: 2732465 - RNA, 16 nt, Haemophilus influenzae Rd
ugaagacaucauauau

SEQ ID NO: 2732466 - RNA, 15 nt, Haemophilus influenzae Rd
ugaagaguuaagccg

SEQ ID NO: 2732467 - RNA, 15 nt, Haemophilus influenzae Rd
ugaagaugaagcuaa

SEQ ID NO: 2732468 - RNA, 14 nt, Haemophilus influenzae Rd
ugaagauuaaaugu

SEQ ID NO: 2732469 - RNA, 15 nt, Haemophilus influenzae Rd
ugaagcccacccuac

SEQ ID NO: 2732470 - RNA, 22 nt, Haemophilus influenzae Rd
ugaagccucugcagggaaaaau

SEQ ID NO: 2732471 - RNA, 11 nt, Haemophilus influenzae Rd
ugaagccugac

SEQ ID NO: 2732472 - RNA, 18 nt, Haemophilus influenzae Rd
ugaagcuaagaaaaucca

SEQ ID NO: 2732473 - RNA, 21 nt, Haemophilus influenzae Rd
ugaagcuccaguaagcauauu

SEQ ID NO: 2732474 - RNA, 14 nt, Haemophilus influenzae Rd
ugaagguuucgcau

SEQ ID NO: 2732475 - RNA, 14 nt, Haemophilus influenzae Rd
ugaaguaaaaaaau

SEQ ID NO: 2732476 - RNA, 14 nt, Haemophilus influenzae Rd
ugaaguaaauauuu

SEQ ID NO: 2732477 - RNA, 14 nt, Haemophilus influenzae Rd
ugaaguaauaaucu

SEQ ID NO: 2732478 - RNA, 15 nt, Haemophilus influenzae Rd
ugaaguaauaaucuu

SEQ ID NO: 2732479 - RNA, 21 nt, Haemophilus influenzae Rd
ugaaguaauaaucuucuuccc

SEQ ID NO: 2732480 - RNA, 18 nt, Haemophilus influenzae Rd
ugaaguacauucaagccu

SEQ ID NO: 2732481 - RNA, 21 nt, Haemophilus influenzae Rd
ugaagugaaagauaaauuaca

SEQ ID NO: 2732482 - RNA, 18 nt, Haemophilus influenzae Rd
ugaaguuauaguauauuu

SEQ ID NO: 2732483 - RNA, 16 nt, Haemophilus influenzae Rd
ugaaguuaucaauaaa

SEQ ID NO: 2732484 - RNA, 16 nt, Haemophilus influenzae Rd
ugaaguuuucauuaaa

SEQ ID NO: 2732485 - RNA, 18 nt, Haemophilus influenzae Rd
ugaaguuuucauuaaaga

SEQ ID NO: 2732486 - RNA, 22 nt, Haemophilus influenzae Rd
ugaauaaaagagagcuucucuu

SEQ ID NO: 2732487 - RNA, 17 nt, Haemophilus influenzae Rd
ugaauaaaaucaauaau

SEQ ID NO: 2732488 - RNA, 11 nt, Haemophilus influenzae Rd
ugaauaaaauu

SEQ ID NO: 2732489 - RNA, 12 nt, Haemophilus influenzae Rd
ugaauaaauauu

SEQ ID NO: 2732490 - RNA, 13 nt, Haemophilus influenzae Rd
ugaauaaauauuc

SEQ ID NO: 2732491 - RNA, 19 nt, Haemophilus influenzae Rd
ugaauaacuacauaaacuu

SEQ ID NO: 2732492 - RNA, 23 nt, Haemophilus influenzae Rd
ugaauaauuuccaacacauuauc

SEQ ID NO: 2732493 - RNA, 15 nt, Haemophilus influenzae Rd
ugaauaauuuuuaua

SEQ ID NO: 2732494 - RNA, 16 nt, Haemophilus influenzae Rd
ugaauaauuuuuauaa

SEQ ID NO: 2732495 - RNA, 14 nt, Haemophilus influenzae Rd
ugaauacacuuuaa

SEQ ID NO: 2732496 - RNA, 18 nt, Haemophilus influenzae Rd
ugaauaccugauuucgca

SEQ ID NO: 2732497 - RNA, 16 nt, Haemophilus influenzae Rd
ugaauacgaucugcau

SEQ ID NO: 2732498 - RNA, 15 nt, Haemophilus influenzae Rd
ugaauauaagaaauc

SEQ ID NO: 2732499 - RNA, 21 nt, Haemophilus influenzae Rd
ugaauauaagaaaucucuuuc

SEQ ID NO: 2732500 - RNA, 14 nt, Haemophilus influenzae Rd
ugaauauaauaaaa

SEQ ID NO: 2732501 - RNA, 21 nt, Haemophilus influenzae Rd
ugaauaugaucuuuaauuaaa

SEQ ID NO: 2732502 - RNA, 22 nt, Haemophilus influenzae Rd
ugaauaugaucuuuaauuaaaa

SEQ ID NO: 2732503 - RNA, 22 nt, Haemophilus influenzae Rd
ugaaucacaacauauaaaucuc

SEQ ID NO: 2732504 - RNA, 23 nt, Haemophilus influenzae Rd
ugaaucauuucaucuacaccaaa

SEQ ID NO: 2732505 - RNA, 21 nt, Haemophilus influenzae Rd
ugaauccaacguauuuauacc

SEQ ID NO: 2732506 - RNA, 18 nt, Haemophilus influenzae Rd
ugaaucguuuguaaaagu

SEQ ID NO: 2732507 - RNA, 16 nt, Haemophilus influenzae Rd
ugaaucguuuguucug

SEQ ID NO: 2732508 - RNA, 18 nt, Haemophilus influenzae Rd
ugaaucguuuuuuccagu

SEQ ID NO: 2732509 - RNA, 12 nt, Haemophilus influenzae Rd
ugaaucucagca

SEQ ID NO: 2732510 - RNA, 17 nt, Haemophilus influenzae Rd
ugaaucucagcaagcug

SEQ ID NO: 2732511 - RNA, 19 nt, Haemophilus influenzae Rd
ugaaucucauaccaaggca

SEQ ID NO: 2732512 - RNA, 22 nt, Haemophilus influenzae Rd
ugaaugacuuucacuacagguu

SEQ ID NO: 2732513 - RNA, 13 nt, Haemophilus influenzae Rd
ugaaugaugagua

SEQ ID NO: 2732514 - RNA, 15 nt, Haemophilus influenzae Rd
ugaaugaugaguaga

SEQ ID NO: 2732515 - RNA, 19 nt, Haemophilus influenzae Rd
ugaaugcauuggcugaauu

SEQ ID NO: 2732516 - RNA, 20 nt, Haemophilus influenzae Rd
ugaaugcauuggcugaauuu

SEQ ID NO: 2732517 - RNA, 22 nt, Haemophilus influenzae Rd
ugaaugcauuggcugaauuuaa

SEQ ID NO: 2732518 - RNA, 23 nt, Haemophilus influenzae Rd
ugaaugcauuggcugaauuuaau

SEQ ID NO: 2732519 - RNA, 18 nt, Haemophilus influenzae Rd
ugaaugcgagcaucggua

SEQ ID NO: 2732520 - RNA, 22 nt, Haemophilus influenzae Rd
ugaauggcgucugcaauuagaa

SEQ ID NO: 2732521 - RNA, 20 nt, Haemophilus influenzae Rd
ugaauggcuaucugcuuuuc

SEQ ID NO: 2732522 - RNA, 16 nt, Haemophilus influenzae Rd
ugaauggguuaguaag

SEQ ID NO: 2732523 - RNA, 20 nt, Haemophilus influenzae Rd
ugaaugucuuaaagauaaaa

SEQ ID NO: 2732524 - RNA, 19 nt, Haemophilus influenzae Rd
ugaaugugaucaugguugu

SEQ ID NO: 2732525 - RNA, 21 nt, Haemophilus influenzae Rd
ugaaugugcgguagauuuuca

SEQ ID NO: 2732526 - RNA, 14 nt, Haemophilus influenzae Rd
ugaauuaaaaguag

SEQ ID NO: 2732527 - RNA, 17 nt, Haemophilus influenzae Rd
ugaauuaacguuauaaa

SEQ ID NO: 2732528 - RNA, 11 nt, Haemophilus influenzae Rd
ugaauuaauac

SEQ ID NO: 2732529 - RNA, 16 nt, Haemophilus influenzae Rd
ugaauuaccacaucau

SEQ ID NO: 2732530 - RNA, 20 nt, Haemophilus influenzae Rd
ugaauuaccacaucauuauu

SEQ ID NO: 2732531 - RNA, 21 nt, Haemophilus influenzae Rd
ugaauuauugucuuuucuaua

SEQ ID NO: 2732532 - RNA, 23 nt, Haemophilus influenzae Rd
ugaauuauugucuuuucuauaau

SEQ ID NO: 2732533 - RNA, 20 nt, Haemophilus influenzae Rd
ugaauucucaauugcagauu

SEQ ID NO: 2732534 - RNA, 17 nt, Haemophilus influenzae Rd
ugaauugauaaaggcau

SEQ ID NO: 2732535 - RNA, 15 nt, Haemophilus influenzae Rd
ugaauugcuccuccu

SEQ ID NO: 2732536 - RNA, 13 nt, Haemophilus influenzae Rd
ugaauugcuuuaa

SEQ ID NO: 2732537 - RNA, 19 nt, Haemophilus influenzae Rd
ugaauuggaaguuuuuccg

SEQ ID NO: 2732538 - RNA, 22 nt, Haemophilus influenzae Rd
ugaauuuauauuaauuuugaua

SEQ ID NO: 2732539 - RNA, 18 nt, Haemophilus influenzae Rd
ugaauuuuaaccgcacuu

SEQ ID NO: 2732540 - RNA, 22 nt, Haemophilus influenzae Rd
ugaauuuuacagguguaguuag

SEQ ID NO: 2732541 - RNA, 18 nt, Haemophilus influenzae Rd
ugaauuuucaaugguuua

SEQ ID NO: 2732542 - RNA, 15 nt, Haemophilus influenzae Rd
ugaauuuuguaccaa

SEQ ID NO: 2732543 - RNA, 15 nt, Haemophilus influenzae Rd
ugacaaacggaaaau

SEQ ID NO: 2732544 - RNA, 18 nt, Haemophilus influenzae Rd
ugacaaagucgguuuuua

SEQ ID NO: 2732545 - RNA, 23 nt, Haemophilus influenzae Rd
ugacaaagucgguuuuuaauuca

SEQ ID NO: 2732546 - RNA, 14 nt, Haemophilus influenzae Rd
ugacaaaucugccu

SEQ ID NO: 2732547 - RNA, 23 nt, Haemophilus influenzae Rd
ugacaacgcucacuuaauugacg

SEQ ID NO: 2732548 - RNA, 11 nt, Haemophilus influenzae Rd
ugacaauuucu

SEQ ID NO: 2732549 - RNA, 16 nt, Haemophilus influenzae Rd
ugacacccaaauuaaa

SEQ ID NO: 2732550 - RNA, 14 nt, Haemophilus influenzae Rd
ugacagauagcaua

SEQ ID NO: 2732551 - RNA, 21 nt, Haemophilus influenzae Rd
ugacagauagcauaaguuaau

SEQ ID NO: 2732552 - RNA, 16 nt, Haemophilus influenzae Rd
ugacauauaauauuaa

SEQ ID NO: 2732553 - RNA, 14 nt, Haemophilus influenzae Rd
ugacauauucuguu

SEQ ID NO: 2732554 - RNA, 17 nt, Haemophilus influenzae Rd
ugacauauuuucuaaaa

SEQ ID NO: 2732555 - RNA, 18 nt, Haemophilus influenzae Rd
ugacaucaagcacaucau

SEQ ID NO: 2732556 - RNA, 12 nt, Haemophilus influenzae Rd
ugacaugacagu

SEQ ID NO: 2732557 - RNA, 20 nt, Haemophilus influenzae Rd
ugacauuaaagcaauugcua

SEQ ID NO: 2732558 - RNA, 14 nt, Haemophilus influenzae Rd
ugacauuggauuaa

SEQ ID NO: 2732559 - RNA, 18 nt, Haemophilus influenzae Rd
ugacauuggauuaaucaa

SEQ ID NO: 2732560 - RNA, 16 nt, Haemophilus influenzae Rd
ugacauuguaaaguga

SEQ ID NO: 2732561 - RNA, 12 nt, Haemophilus influenzae Rd
ugaccaacacca

SEQ ID NO: 2732562 - RNA, 17 nt, Haemophilus influenzae Rd
ugaccaaguaaaccaaa

SEQ ID NO: 2732563 - RNA, 19 nt, Haemophilus influenzae Rd
ugaccaccgccaauacaaa

SEQ ID NO: 2732564 - RNA, 14 nt, Haemophilus influenzae Rd
ugaccacuuucaau

SEQ ID NO: 2732565 - RNA, 17 nt, Haemophilus influenzae Rd
ugaccagagccaaauac

SEQ ID NO: 2732566 - RNA, 14 nt, Haemophilus influenzae Rd
ugaccauuaaucac

SEQ ID NO: 2732567 - RNA, 13 nt, Haemophilus influenzae Rd
ugaccccaaaaag

SEQ ID NO: 2732568 - RNA, 18 nt, Haemophilus influenzae Rd
ugaccgcuguuuucauua

SEQ ID NO: 2732569 - RNA, 23 nt, Haemophilus influenzae Rd
ugaccgcuuguuuauuauuuccu

SEQ ID NO: 2732570 - RNA, 14 nt, Haemophilus influenzae Rd
ugaccuucaauugu

SEQ ID NO: 2732571 - RNA, 16 nt, Haemophilus influenzae Rd
ugaccuucauaaacuu

SEQ ID NO: 2732572 - RNA, 13 nt, Haemophilus influenzae Rd
ugaccuuuuaaug

SEQ ID NO: 2732573 - RNA, 14 nt, Haemophilus influenzae Rd
ugaccuuuucgaau

SEQ ID NO: 2732574 - RNA, 13 nt, Haemophilus influenzae Rd
ugacgaaauaaau

SEQ ID NO: 2732575 - RNA, 15 nt, Haemophilus influenzae Rd
ugacgaaaugaaauu

SEQ ID NO: 2732576 - RNA, 14 nt, Haemophilus influenzae Rd
ugacgauaauauuu

SEQ ID NO: 2732577 - RNA, 19 nt, Haemophilus influenzae Rd
ugacgauaauauuuuugcc

SEQ ID NO: 2732578 - RNA, 16 nt, Haemophilus influenzae Rd
ugacgcauugcaggga

SEQ ID NO: 2732579 - RNA, 23 nt, Haemophilus influenzae Rd
ugacgccauccaaaacuaauaaa

SEQ ID NO: 2732580 - RNA, 22 nt, Haemophilus influenzae Rd
ugacgcgcacauacuucuucug

SEQ ID NO: 2732581 - RNA, 20 nt, Haemophilus influenzae Rd
ugacggcuucagaaaauaaa

SEQ ID NO: 2732582 - RNA, 20 nt, Haemophilus influenzae Rd
ugacgguucaguuucaagca

SEQ ID NO: 2732583 - RNA, 14 nt, Haemophilus influenzae Rd
ugacguaauuuacg

SEQ ID NO: 2732584 - RNA, 16 nt, Haemophilus influenzae Rd
ugacguacaauuucaa

SEQ ID NO: 2732585 - RNA, 19 nt, Haemophilus influenzae Rd
ugacguguaaaucuaaaau

SEQ ID NO: 2732586 - RNA, 20 nt, Haemophilus influenzae Rd
ugacguguaaaucuaaaaua

SEQ ID NO: 2732587 - RNA, 15 nt, Haemophilus influenzae Rd
ugacguuguucuucu

SEQ ID NO: 2732588 - RNA, 21 nt, Haemophilus influenzae Rd
ugacguuuauuuuuauauguu

SEQ ID NO: 2732589 - RNA, 15 nt, Haemophilus influenzae Rd
ugacuaaaacaacag

SEQ ID NO: 2732590 - RNA, 15 nt, Haemophilus influenzae Rd
ugacuaaacaaauaa

SEQ ID NO: 2732591 - RNA, 16 nt, Haemophilus influenzae Rd
ugacuaaaguaaauuu

SEQ ID NO: 2732592 - RNA, 16 nt, Haemophilus influenzae Rd
ugacuaaucguccaau

SEQ ID NO: 2732593 - RNA, 20 nt, Haemophilus influenzae Rd
ugacuagauauaaaaacuau

SEQ ID NO: 2732594 - RNA, 13 nt, Haemophilus influenzae Rd
ugacuauuacaau

SEQ ID NO: 2732595 - RNA, 22 nt, Haemophilus influenzae Rd
ugacugcaauuaucaagcugau

SEQ ID NO: 2732596 - RNA, 13 nt, Haemophilus influenzae Rd
ugacuggcaaaaa

SEQ ID NO: 2732597 - RNA, 23 nt, Haemophilus influenzae Rd
ugacuuaaauucggaauauucaa

SEQ ID NO: 2732598 - RNA, 22 nt, Haemophilus influenzae Rd
ugacuuauuaucuucuaaaaga

SEQ ID NO: 2732599 - RNA, 18 nt, Haemophilus influenzae Rd
ugacuucuguaugacuau

SEQ ID NO: 2732600 - RNA, 15 nt, Haemophilus influenzae Rd
ugacuuguuuuaaaa

SEQ ID NO: 2732601 - RNA, 20 nt, Haemophilus influenzae Rd
ugacuuucgaguaauagauu

SEQ ID NO: 2732602 - RNA, 20 nt, Haemophilus influenzae Rd
ugacuuucuaacuuuuaauu

SEQ ID NO: 2732603 - RNA, 16 nt, Haemophilus influenzae Rd
ugagaaaguaauggaa

SEQ ID NO: 2732604 - RNA, 19 nt, Haemophilus influenzae Rd
ugagaaugggcauaaagcc

SEQ ID NO: 2732605 - RNA, 15 nt, Haemophilus influenzae Rd
ugagaauuaauuuau

SEQ ID NO: 2732606 - RNA, 23 nt, Haemophilus influenzae Rd
ugagaauuaauuuauaaauuauu

SEQ ID NO: 2732607 - RNA, 13 nt, Haemophilus influenzae Rd
ugagaauuuucaa

SEQ ID NO: 2732608 - RNA, 17 nt, Haemophilus influenzae Rd
ugagaauuuuuucuuca

SEQ ID NO: 2732609 - RNA, 13 nt, Haemophilus influenzae Rd
ugagauaaauaaa

SEQ ID NO: 2732610 - RNA, 19 nt, Haemophilus influenzae Rd
ugagauaaauaaauucauu

SEQ ID NO: 2732611 - RNA, 12 nt, Haemophilus influenzae Rd
ugagauaaaugg

SEQ ID NO: 2732612 - RNA, 13 nt, Haemophilus influenzae Rd
ugagaugccauuu

SEQ ID NO: 2732613 - RNA, 14 nt, Haemophilus influenzae Rd
ugagauuauuucua

SEQ ID NO: 2732614 - RNA, 16 nt, Haemophilus influenzae Rd
ugagauuuaauuuauu

SEQ ID NO: 2732615 - RNA, 20 nt, Haemophilus influenzae Rd
ugagcaaauuacccaaauga

SEQ ID NO: 2732616 - RNA, 13 nt, Haemophilus influenzae Rd
ugagcaagaacuu

SEQ ID NO: 2732617 - RNA, 16 nt, Haemophilus influenzae Rd
ugagcaagaugaauua

SEQ ID NO: 2732618 - RNA, 21 nt, Haemophilus influenzae Rd
ugagcaauauaaucuuuuaca

SEQ ID NO: 2732619 - RNA, 17 nt, Haemophilus influenzae Rd
ugagcacuucuguaccu

SEQ ID NO: 2732620 - RNA, 17 nt, Haemophilus influenzae Rd
ugagcauaacguauuuu

SEQ ID NO: 2732621 - RNA, 19 nt, Haemophilus influenzae Rd
ugagcaucuacccaauaaa

SEQ ID NO: 2732622 - RNA, 16 nt, Haemophilus influenzae Rd
ugagcauuuuuuauua

SEQ ID NO: 2732623 - RNA, 17 nt, Haemophilus influenzae Rd
ugagcauuuuuuauuaa

SEQ ID NO: 2732624 - RNA, 20 nt, Haemophilus influenzae Rd
ugagcauuuuuuauuaaaaa

SEQ ID NO: 2732625 - RNA, 19 nt, Haemophilus influenzae Rd
ugagccaacucgaacauga

SEQ ID NO: 2732626 - RNA, 21 nt, Haemophilus influenzae Rd
ugagccguuauauuuccuucu

SEQ ID NO: 2732627 - RNA, 17 nt, Haemophilus influenzae Rd
ugagccuucaaaauuug

SEQ ID NO: 2732628 - RNA, 19 nt, Haemophilus influenzae Rd
ugagcgauagccaaagguu

SEQ ID NO: 2732629 - RNA, 17 nt, Haemophilus influenzae Rd
ugagcggugaauucuuu

SEQ ID NO: 2732630 - RNA, 18 nt, Haemophilus influenzae Rd
ugagcguuuaacugcuuu

SEQ ID NO: 2732631 - RNA, 15 nt, Haemophilus influenzae Rd
ugagcugcugcaaga

SEQ ID NO: 2732632 - RNA, 21 nt, Haemophilus influenzae Rd
ugagcugucuaauuuuuuauu

SEQ ID NO: 2732633 - RNA, 14 nt, Haemophilus influenzae Rd
ugagcuugauuuuc

SEQ ID NO: 2732634 - RNA, 18 nt, Haemophilus influenzae Rd
ugagcuuguuggaaaaau

SEQ ID NO: 2732635 - RNA, 22 nt, Haemophilus influenzae Rd
ugagcuuguuggaaaaaugcug

SEQ ID NO: 2732636 - RNA, 24 nt, Haemophilus influenzae Rd
ugaggaauaaauugaauaucuaaa

SEQ ID NO: 2732637 - RNA, 20 nt, Haemophilus influenzae Rd
ugaggcguuuuucuuaaauu

SEQ ID NO: 2732638 - RNA, 13 nt, Haemophilus influenzae Rd
ugaggcuaauaau

SEQ ID NO: 2732639 - RNA, 19 nt, Haemophilus influenzae Rd
ugagguauuguccuucauu

SEQ ID NO: 2732640 - RNA, 19 nt, Haemophilus influenzae Rd
ugagguuccccuaaaaaau

SEQ ID NO: 2732641 - RNA, 14 nt, Haemophilus influenzae Rd
ugagguuugccauc

SEQ ID NO: 2732642 - RNA, 17 nt, Haemophilus influenzae Rd
ugagguuuuauuacaaa

SEQ ID NO: 2732643 - RNA, 13 nt, Haemophilus influenzae Rd
ugaguaaaauacg

SEQ ID NO: 2732644 - RNA, 17 nt, Haemophilus influenzae Rd
ugaguaaaccacaauac

SEQ ID NO: 2732645 - RNA, 23 nt, Haemophilus influenzae Rd
ugaguaaaccacaauacuuauca

SEQ ID NO: 2732646 - RNA, 13 nt, Haemophilus influenzae Rd
ugaguaaauaaac

SEQ ID NO: 2732647 - RNA, 21 nt, Haemophilus influenzae Rd
ugaguaaugcuugggaaucug

SEQ ID NO: 2732648 - RNA, 13 nt, Haemophilus influenzae Rd
ugaguauaaauuu

SEQ ID NO: 2732649 - RNA, 12 nt, Haemophilus influenzae Rd
ugaguauaguca

SEQ ID NO: 2732650 - RNA, 20 nt, Haemophilus influenzae Rd
ugaguauagucauucaaugc

SEQ ID NO: 2732651 - RNA, 15 nt, Haemophilus influenzae Rd
ugaguaucuuuuaau

SEQ ID NO: 2732652 - RNA, 18 nt, Haemophilus influenzae Rd
ugaguaucuuuuaauuca

SEQ ID NO: 2732653 - RNA, 20 nt, Haemophilus influenzae Rd
ugaguccgauccauacagua

SEQ ID NO: 2732654 - RNA, 23 nt, Haemophilus influenzae Rd
ugaguccgauccauacaguaaaa

SEQ ID NO: 2732655 - RNA, 23 nt, Haemophilus influenzae Rd
ugagucggggauuuuuuauauga

SEQ ID NO: 2732656 - RNA, 18 nt, Haemophilus influenzae Rd
ugagucucaaauuuuuca

SEQ ID NO: 2732657 - RNA, 15 nt, Haemophilus influenzae Rd
ugagucuugcuuuuu

SEQ ID NO: 2732658 - RNA, 19 nt, Haemophilus influenzae Rd
ugagucuugcuuuuuaauu

SEQ ID NO: 2732659 - RNA, 21 nt, Haemophilus influenzae Rd
ugagucuugcuuuuuaauuga

SEQ ID NO: 2732660 - RNA, 16 nt, Haemophilus influenzae Rd
ugaguuauuuuuaauc

SEQ ID NO: 2732661 - RNA, 21 nt, Haemophilus influenzae Rd
ugaguucaacgacaauuaaag

SEQ ID NO: 2732662 - RNA, 18 nt, Haemophilus influenzae Rd
ugaguucucguugcaucu

SEQ ID NO: 2732663 - RNA, 19 nt, Haemophilus influenzae Rd
ugaguugauuuuaaaauau

SEQ ID NO: 2732664 - RNA, 18 nt, Haemophilus influenzae Rd
ugaguuuagucuuuuuaa

SEQ ID NO: 2732665 - RNA, 13 nt, Haemophilus influenzae Rd
ugaguuuggaaua

SEQ ID NO: 2732666 - RNA, 14 nt, Haemophilus influenzae Rd
ugauaaaaaagaaa

SEQ ID NO: 2732667 - RNA, 19 nt, Haemophilus influenzae Rd
ugauaaaaaccgcugucau

SEQ ID NO: 2732668 - RNA, 16 nt, Haemophilus influenzae Rd
ugauaaacauaaccug

SEQ ID NO: 2732669 - RNA, 19 nt, Haemophilus influenzae Rd
ugauaaauagcuauaacgc

SEQ ID NO: 2732670 - RNA, 13 nt, Haemophilus influenzae Rd
ugauaaauucuua

SEQ ID NO: 2732671 - RNA, 17 nt, Haemophilus influenzae Rd
ugauaaauuucuaaccg

SEQ ID NO: 2732672 - RNA, 22 nt, Haemophilus influenzae Rd
ugauaaccuuuagacaacaacu

SEQ ID NO: 2732673 - RNA, 17 nt, Haemophilus influenzae Rd
ugauaacucuaaagcgg

SEQ ID NO: 2732674 - RNA, 22 nt, Haemophilus influenzae Rd
ugauaagaacggcgauuuugcg

SEQ ID NO: 2732675 - RNA, 20 nt, Haemophilus influenzae Rd
ugauaagauguuucacuaaa

SEQ ID NO: 2732676 - RNA, 22 nt, Haemophilus influenzae Rd
ugauaagccacucuaaguuuaa

SEQ ID NO: 2732677 - RNA, 18 nt, Haemophilus influenzae Rd
ugauaagcccgaacagaa

SEQ ID NO: 2732678 - RNA, 16 nt, Haemophilus influenzae Rd
ugauaaguagaaaaau

SEQ ID NO: 2732679 - RNA, 14 nt, Haemophilus influenzae Rd
ugauaaguauaacu

SEQ ID NO: 2732680 - RNA, 21 nt, Haemophilus influenzae Rd
ugauaaguuuugucugaaauu

SEQ ID NO: 2732681 - RNA, 18 nt, Haemophilus influenzae Rd
ugauaaucauugaaaugu

SEQ ID NO: 2732682 - RNA, 14 nt, Haemophilus influenzae Rd
ugauaaucuaaaaa

SEQ ID NO: 2732683 - RNA, 15 nt, Haemophilus influenzae Rd
ugauaaucuaaaaaa

SEQ ID NO: 2732684 - RNA, 17 nt, Haemophilus influenzae Rd
ugauaaucuaaaaaacc

SEQ ID NO: 2732685 - RNA, 16 nt, Haemophilus influenzae Rd
ugauaauuaacaauau

SEQ ID NO: 2732686 - RNA, 18 nt, Haemophilus influenzae Rd
ugauaauuggaguggaca

SEQ ID NO: 2732687 - RNA, 13 nt, Haemophilus influenzae Rd
ugauacaaucggu

SEQ ID NO: 2732688 - RNA, 20 nt, Haemophilus influenzae Rd
ugauacaaucgguuaaaagu

SEQ ID NO: 2732689 - RNA, 21 nt, Haemophilus influenzae Rd
ugauacauuucuaaaauaaua

SEQ ID NO: 2732690 - RNA, 21 nt, Haemophilus influenzae Rd
ugauaccaagauaauaaaguu

SEQ ID NO: 2732691 - RNA, 15 nt, Haemophilus influenzae Rd
ugauaccaagcauau

SEQ ID NO: 2732692 - RNA, 18 nt, Haemophilus influenzae Rd
ugauaccaagcauauuug

SEQ ID NO: 2732693 - RNA, 23 nt, Haemophilus influenzae Rd
ugauaccaagcauauuugcugca

SEQ ID NO: 2732694 - RNA, 14 nt, Haemophilus influenzae Rd
ugauaccaaugauu

SEQ ID NO: 2732695 - RNA, 14 nt, Haemophilus influenzae Rd
ugauacuaacucaa

SEQ ID NO: 2732696 - RNA, 17 nt, Haemophilus influenzae Rd
ugauacuaacucaaaau

SEQ ID NO: 2732697 - RNA, 16 nt, Haemophilus influenzae Rd
ugauacugccaaccuu

SEQ ID NO: 2732698 - RNA, 14 nt, Haemophilus influenzae Rd
ugauagaaccaaua

SEQ ID NO: 2732699 - RNA, 21 nt, Haemophilus influenzae Rd
ugauagaaccaauauugggaa

SEQ ID NO: 2732700 - RNA, 14 nt, Haemophilus influenzae Rd
ugauagaugaauua

SEQ ID NO: 2732701 - RNA, 23 nt, Haemophilus influenzae Rd
ugauagcugccgaauagauuuaa

SEQ ID NO: 2732702 - RNA, 22 nt, Haemophilus influenzae Rd
ugauagguauaaauggcaucug

SEQ ID NO: 2732703 - RNA, 19 nt, Haemophilus influenzae Rd
ugauagugccaaucaagau

SEQ ID NO: 2732704 - RNA, 13 nt, Haemophilus influenzae Rd
ugauauaaaaaug

SEQ ID NO: 2732705 - RNA, 22 nt, Haemophilus influenzae Rd
ugauauaaauggguuuuaucuu

SEQ ID NO: 2732706 - RNA, 20 nt, Haemophilus influenzae Rd
ugauauaaguucuaaauaaa

SEQ ID NO: 2732707 - RNA, 22 nt, Haemophilus influenzae Rd
ugauauaaguucuaaauaaacu

SEQ ID NO: 2732708 - RNA, 23 nt, Haemophilus influenzae Rd
ugauauauaucacagauuuuuaa

SEQ ID NO: 2732709 - RNA, 18 nt, Haemophilus influenzae Rd
ugauauaugauuauaaau

SEQ ID NO: 2732710 - RNA, 18 nt, Haemophilus influenzae Rd
ugauaugccaaggcuccc

SEQ ID NO: 2732711 - RNA, 13 nt, Haemophilus influenzae Rd
ugauauuaagcca

SEQ ID NO: 2732712 - RNA, 13 nt, Haemophilus influenzae Rd
ugauauucaauuu

SEQ ID NO: 2732713 - RNA, 18 nt, Haemophilus influenzae Rd
ugauauuccauaguucac

SEQ ID NO: 2732714 - RNA, 19 nt, Haemophilus influenzae Rd
ugauauuccauaguucacu

SEQ ID NO: 2732715 - RNA, 21 nt, Haemophilus influenzae Rd
ugauauuccauaguucacuaa

SEQ ID NO: 2732716 - RNA, 22 nt, Haemophilus influenzae Rd
ugauauuccauaguucacuaaa

SEQ ID NO: 2732717 - RNA, 16 nt, Haemophilus influenzae Rd
ugauauuguuuuaauu

SEQ ID NO: 2732718 - RNA, 23 nt, Haemophilus influenzae Rd
ugauauuucaauuuaagcccugc

SEQ ID NO: 2732719 - RNA, 15 nt, Haemophilus influenzae Rd
ugauauuucacuaaa

SEQ ID NO: 2732720 - RNA, 12 nt, Haemophilus influenzae Rd
ugauauuuuuca

SEQ ID NO: 2732721 - RNA, 13 nt, Haemophilus influenzae Rd
ugaucaaaauuau

SEQ ID NO: 2732722 - RNA, 20 nt, Haemophilus influenzae Rd
ugaucacuucauaaauugug

SEQ ID NO: 2732723 - RNA, 22 nt, Haemophilus influenzae Rd
ugaucacuucauaaauugugau

SEQ ID NO: 2732724 - RNA, 20 nt, Haemophilus influenzae Rd
ugaucauaauccacuaaaaa

SEQ ID NO: 2732725 - RNA, 13 nt, Haemophilus influenzae Rd
ugaucauccauuu

SEQ ID NO: 2732726 - RNA, 22 nt, Haemophilus influenzae Rd
ugaucauggcucagauugaacg

SEQ ID NO: 2732727 - RNA, 13 nt, Haemophilus influenzae Rd
ugauccacacuuc

SEQ ID NO: 2732728 - RNA, 21 nt, Haemophilus influenzae Rd
ugauccacgguauuuucuuau

SEQ ID NO: 2732729 - RNA, 12 nt, Haemophilus influenzae Rd
ugauccacuuac

SEQ ID NO: 2732730 - RNA, 22 nt, Haemophilus influenzae Rd
ugauccauaauggcaauuuuau

SEQ ID NO: 2732731 - RNA, 16 nt, Haemophilus influenzae Rd
ugauccauauauugaa

SEQ ID NO: 2732732 - RNA, 16 nt, Haemophilus influenzae Rd
ugauccauuaauaacu

SEQ ID NO: 2732733 - RNA, 19 nt, Haemophilus influenzae Rd
ugaucccagcauaaauaaa

SEQ ID NO: 2732734 - RNA, 22 nt, Haemophilus influenzae Rd
ugauccuuuauugauccuagau

SEQ ID NO: 2732735 - RNA, 17 nt, Haemophilus influenzae Rd
ugaucgaccauugcacg

SEQ ID NO: 2732736 - RNA, 19 nt, Haemophilus influenzae Rd
ugaucgccaucuucuucug

SEQ ID NO: 2732737 - RNA, 21 nt, Haemophilus influenzae Rd
ugaucggacuuuuuucuuaaa

SEQ ID NO: 2732738 - RNA, 16 nt, Haemophilus influenzae Rd
ugaucguuaauaucau

SEQ ID NO: 2732739 - RNA, 21 nt, Haemophilus influenzae Rd
ugaucuaacguuuauauugaa

SEQ ID NO: 2732740 - RNA, 16 nt, Haemophilus influenzae Rd
ugaucuaauuugccaa

SEQ ID NO: 2732741 - RNA, 22 nt, Haemophilus influenzae Rd
ugaucuaauuugccaaguacaa

SEQ ID NO: 2732742 - RNA, 18 nt, Haemophilus influenzae Rd
ugaucuccgcgacauuaa

SEQ ID NO: 2732743 - RNA, 20 nt, Haemophilus influenzae Rd
ugaucugaccccaaaaaguu

SEQ ID NO: 2732744 - RNA, 24 nt, Haemophilus influenzae Rd
ugaucugcacuccaaaaguuggau

SEQ ID NO: 2732745 - RNA, 12 nt, Haemophilus influenzae Rd
ugaucugcauca

SEQ ID NO: 2732746 - RNA, 15 nt, Haemophilus influenzae Rd
ugaugaaaauuaucu

SEQ ID NO: 2732747 - RNA, 14 nt, Haemophilus influenzae Rd
ugaugaaugcuuuu

SEQ ID NO: 2732748 - RNA, 21 nt, Haemophilus influenzae Rd
ugaugaauuuaguacuuccgc

SEQ ID NO: 2732749 - RNA, 15 nt, Haemophilus influenzae Rd
ugaugaguucuguca

SEQ ID NO: 2732750 - RNA, 16 nt, Haemophilus influenzae Rd
ugaugauaauuuuuac

SEQ ID NO: 2732751 - RNA, 16 nt, Haemophilus influenzae Rd
ugaugauuguuauugu

SEQ ID NO: 2732752 - RNA, 19 nt, Haemophilus influenzae Rd
ugaugauuguuauugugau

SEQ ID NO: 2732753 - RNA, 15 nt, Haemophilus influenzae Rd
ugaugauuuucauuc

SEQ ID NO: 2732754 - RNA, 18 nt, Haemophilus influenzae Rd
ugaugauuuucauuccuu

SEQ ID NO: 2732755 - RNA, 14 nt, Haemophilus influenzae Rd
ugaugcaggaaagg

SEQ ID NO: 2732756 - RNA, 17 nt, Haemophilus influenzae Rd
ugaugcgaaaauggcua

SEQ ID NO: 2732757 - RNA, 19 nt, Haemophilus influenzae Rd
ugaugcgguuuauuuaaua

SEQ ID NO: 2732758 - RNA, 15 nt, Haemophilus influenzae Rd
ugaugcucugcauaa

SEQ ID NO: 2732759 - RNA, 16 nt, Haemophilus influenzae Rd
ugauggaauuuauacg

SEQ ID NO: 2732760 - RNA, 20 nt, Haemophilus influenzae Rd
ugauggacuuauaaauuuaa

SEQ ID NO: 2732761 - RNA, 16 nt, Haemophilus influenzae Rd
ugauguaaauuuucag

SEQ ID NO: 2732762 - RNA, 20 nt, Haemophilus influenzae Rd
ugauguaccaauuuguacca

SEQ ID NO: 2732763 - RNA, 20 nt, Haemophilus influenzae Rd
ugaugucagugaauuuagcc

SEQ ID NO: 2732764 - RNA, 17 nt, Haemophilus influenzae Rd
ugauguggcuuuugguc

SEQ ID NO: 2732765 - RNA, 14 nt, Haemophilus influenzae Rd
ugauguuaugcuua

SEQ ID NO: 2732766 - RNA, 19 nt, Haemophilus influenzae Rd
ugauguuaugcuuaucauu

SEQ ID NO: 2732767 - RNA, 20 nt, Haemophilus influenzae Rd
ugauguuuuaacaaaagcua

SEQ ID NO: 2732768 - RNA, 19 nt, Haemophilus influenzae Rd
ugauuaaaaugguuuaaau

SEQ ID NO: 2732769 - RNA, 20 nt, Haemophilus influenzae Rd
ugauuaaaaugguuuaaaua

SEQ ID NO: 2732770 - RNA, 17 nt, Haemophilus influenzae Rd
ugauuaacaaugauuaa

SEQ ID NO: 2732771 - RNA, 20 nt, Haemophilus influenzae Rd
ugauuaacuauucaaaugaa

SEQ ID NO: 2732772 - RNA, 15 nt, Haemophilus influenzae Rd
ugauuaaguauaacu

SEQ ID NO: 2732773 - RNA, 16 nt, Haemophilus influenzae Rd
ugauuaaguuaaaagu

SEQ ID NO: 2732774 - RNA, 18 nt, Haemophilus influenzae Rd
ugauuaaguuaaaagugu

SEQ ID NO: 2732775 - RNA, 22 nt, Haemophilus influenzae Rd
ugauuaaguuaaaaguguauaa

SEQ ID NO: 2732776 - RNA, 16 nt, Haemophilus influenzae Rd
ugauuaauaucacugc

SEQ ID NO: 2732777 - RNA, 17 nt, Haemophilus influenzae Rd
ugauuaauuaaauuacc

SEQ ID NO: 2732778 - RNA, 18 nt, Haemophilus influenzae Rd
ugauuaauuaaauuacca

SEQ ID NO: 2732779 - RNA, 21 nt, Haemophilus influenzae Rd
ugauuaauuuuaucuaugaaa

SEQ ID NO: 2732780 - RNA, 20 nt, Haemophilus influenzae Rd
ugauuaccgguuacuuggau

SEQ ID NO: 2732781 - RNA, 14 nt, Haemophilus influenzae Rd
ugauuacuuaaagu

SEQ ID NO: 2732782 - RNA, 18 nt, Haemophilus influenzae Rd
ugauuauccacuaaaaaa

SEQ ID NO: 2732783 - RNA, 15 nt, Haemophilus influenzae Rd
ugauuaucuaaauuu

SEQ ID NO: 2732784 - RNA, 18 nt, Haemophilus influenzae Rd
ugauuaucuaaauuucgc

SEQ ID NO: 2732785 - RNA, 20 nt, Haemophilus influenzae Rd
ugauuaucuagcacaaagac

SEQ ID NO: 2732786 - RNA, 22 nt, Haemophilus influenzae Rd
ugauuaugaccuuuuuuuagaa

SEQ ID NO: 2732787 - RNA, 14 nt, Haemophilus influenzae Rd
ugauuauuuaagcu

SEQ ID NO: 2732788 - RNA, 18 nt, Haemophilus influenzae Rd
ugauuauuuaauuucaaa

SEQ ID NO: 2732789 - RNA, 19 nt, Haemophilus influenzae Rd
ugauuauuuaauuucaaaa

SEQ ID NO: 2732790 - RNA, 22 nt, Haemophilus influenzae Rd
ugauuauuucucuauaauuacc

SEQ ID NO: 2732791 - RNA, 14 nt, Haemophilus influenzae Rd
ugauucaaugcuuc

SEQ ID NO: 2732792 - RNA, 19 nt, Haemophilus influenzae Rd
ugauucaaugcuuccuuca

SEQ ID NO: 2732793 - RNA, 15 nt, Haemophilus influenzae Rd
ugauuccaaacugga

SEQ ID NO: 2732794 - RNA, 15 nt, Haemophilus influenzae Rd
ugauucgauaaauua

SEQ ID NO: 2732795 - RNA, 14 nt, Haemophilus influenzae Rd
ugauucgccaaaaa

SEQ ID NO: 2732796 - RNA, 17 nt, Haemophilus influenzae Rd
ugauucgccaaaaauug

SEQ ID NO: 2732797 - RNA, 16 nt, Haemophilus influenzae Rd
ugauucuaaaaacucc

SEQ ID NO: 2732798 - RNA, 16 nt, Haemophilus influenzae Rd
ugauucuaaugccauu

SEQ ID NO: 2732799 - RNA, 21 nt, Haemophilus influenzae Rd
ugauucugugcaauauuuccu

SEQ ID NO: 2732800 - RNA, 20 nt, Haemophilus influenzae Rd
ugauucuuuaugaauuacca

SEQ ID NO: 2732801 - RNA, 14 nt, Haemophilus influenzae Rd
ugauugaccaauga

SEQ ID NO: 2732802 - RNA, 21 nt, Haemophilus influenzae Rd
ugauugacgaaaaauuaacca

SEQ ID NO: 2732803 - RNA, 22 nt, Haemophilus influenzae Rd
ugauugagaugccauuucgcuu

SEQ ID NO: 2732804 - RNA, 21 nt, Haemophilus influenzae Rd
ugauugaugcgaaaauggcua

SEQ ID NO: 2732805 - RNA, 14 nt, Haemophilus influenzae Rd
ugauugcaccuaau

SEQ ID NO: 2732806 - RNA, 17 nt, Haemophilus influenzae Rd
ugauugcaccuaauucu

SEQ ID NO: 2732807 - RNA, 21 nt, Haemophilus influenzae Rd
ugauugcgcauuuaauacuga

SEQ ID NO: 2732808 - RNA, 15 nt, Haemophilus influenzae Rd
ugauugcuaaauaaa

SEQ ID NO: 2732809 - RNA, 17 nt, Haemophilus influenzae Rd
ugauugcuuuaacugaa

SEQ ID NO: 2732810 - RNA, 18 nt, Haemophilus influenzae Rd
ugauugguucauagcuga

SEQ ID NO: 2732811 - RNA, 14 nt, Haemophilus influenzae Rd
ugauuguaaaaguc

SEQ ID NO: 2732812 - RNA, 20 nt, Haemophilus influenzae Rd
ugauuguccaaagaauaaua

SEQ ID NO: 2732813 - RNA, 13 nt, Haemophilus influenzae Rd
ugauuguugcuug

SEQ ID NO: 2732814 - RNA, 12 nt, Haemophilus influenzae Rd
ugauuuaaaaaa

SEQ ID NO: 2732815 - RNA, 23 nt, Haemophilus influenzae Rd
ugauuuaaaaaaacguuaaauuu

SEQ ID NO: 2732816 - RNA, 13 nt, Haemophilus influenzae Rd
ugauuuaaaaccg

SEQ ID NO: 2732817 - RNA, 19 nt, Haemophilus influenzae Rd
ugauuuagaacaauauuua

SEQ ID NO: 2732818 - RNA, 21 nt, Haemophilus influenzae Rd
ugauuuagaacaauauuuaua

SEQ ID NO: 2732819 - RNA, 15 nt, Haemophilus influenzae Rd
ugauuuagccaguaa

SEQ ID NO: 2732820 - RNA, 22 nt, Haemophilus influenzae Rd
ugauuuagccaguaauuuuaca

SEQ ID NO: 2732821 - RNA, 17 nt, Haemophilus influenzae Rd
ugauuuaguccuaaaaa

SEQ ID NO: 2732822 - RNA, 11 nt, Haemophilus influenzae Rd
ugauuuauacg

SEQ ID NO: 2732823 - RNA, 14 nt, Haemophilus influenzae Rd
ugauuuaucauaau

SEQ ID NO: 2732824 - RNA, 18 nt, Haemophilus influenzae Rd
ugauuuaucgccucuuua

SEQ ID NO: 2732825 - RNA, 18 nt, Haemophilus influenzae Rd
ugauuucagaacaugacu

SEQ ID NO: 2732826 - RNA, 18 nt, Haemophilus influenzae Rd
ugauuucauuuucuaaua

SEQ ID NO: 2732827 - RNA, 15 nt, Haemophilus influenzae Rd
ugauuucuaaacucg

SEQ ID NO: 2732828 - RNA, 22 nt, Haemophilus influenzae Rd
ugauuucuauguuauuaaaauu

SEQ ID NO: 2732829 - RNA, 12 nt, Haemophilus influenzae Rd
ugauuucuucaa

SEQ ID NO: 2732830 - RNA, 13 nt, Haemophilus influenzae Rd
ugauuugcauaaa

SEQ ID NO: 2732831 - RNA, 20 nt, Haemophilus influenzae Rd
ugauuugcuuggaauaaauu

SEQ ID NO: 2732832 - RNA, 18 nt, Haemophilus influenzae Rd
ugauuuuaaaauaaauuu

SEQ ID NO: 2732833 - RNA, 21 nt, Haemophilus influenzae Rd
ugauuuuaaagccauuuugcu

SEQ ID NO: 2732834 - RNA, 16 nt, Haemophilus influenzae Rd
ugauuuuaaaguaaau

SEQ ID NO: 2732835 - RNA, 13 nt, Haemophilus influenzae Rd
ugauuuuaaauau

SEQ ID NO: 2732836 - RNA, 15 nt, Haemophilus influenzae Rd
ugauuuuagaaaaau

SEQ ID NO: 2732837 - RNA, 22 nt, Haemophilus influenzae Rd
ugauuuuaguuucuaauucuuc

SEQ ID NO: 2732838 - RNA, 23 nt, Haemophilus influenzae Rd
ugauuuuaguuucuaauucuucc

SEQ ID NO: 2732839 - RNA, 19 nt, Haemophilus influenzae Rd
ugauuuuccugaugaauuu

SEQ ID NO: 2732840 - RNA, 13 nt, Haemophilus influenzae Rd
ugauuuucuuauu

SEQ ID NO: 2732841 - RNA, 19 nt, Haemophilus influenzae Rd
ugauuuugagauagagcuu

SEQ ID NO: 2732842 - RNA, 19 nt, Haemophilus influenzae Rd
ugauuuugcuuugccuuuu

SEQ ID NO: 2732843 - RNA, 15 nt, Haemophilus influenzae Rd
ugauuuuguuuucuu

SEQ ID NO: 2732844 - RNA, 15 nt, Haemophilus influenzae Rd
ugauuuuuacaaguu

SEQ ID NO: 2732845 - RNA, 20 nt, Haemophilus influenzae Rd
ugauuuuuacaaguuaaagc

SEQ ID NO: 2732846 - RNA, 21 nt, Haemophilus influenzae Rd
ugauuuuuacaaguuaaagca

SEQ ID NO: 2732847 - RNA, 15 nt, Haemophilus influenzae Rd
ugauuuuuacaccgc

SEQ ID NO: 2732848 - RNA, 18 nt, Haemophilus influenzae Rd
ugauuuuuacaccgccuu

SEQ ID NO: 2732849 - RNA, 13 nt, Haemophilus influenzae Rd
ugauuuuuuuaua

SEQ ID NO: 2732850 - RNA, 17 nt, Haemophilus influenzae Rd
ugauuuuuuuauuuguu

SEQ ID NO: 2732851 - RNA, 12 nt, Haemophilus influenzae Rd
ugcaaaaauauc

SEQ ID NO: 2732852 - RNA, 15 nt, Haemophilus influenzae Rd
ugcaaaaguaaauaa

SEQ ID NO: 2732853 - RNA, 22 nt, Haemophilus influenzae Rd
ugcaaaauagauguaaccuuuc

SEQ ID NO: 2732854 - RNA, 16 nt, Haemophilus influenzae Rd
ugcaaaaucuaaauuu

SEQ ID NO: 2732855 - RNA, 15 nt, Haemophilus influenzae Rd
ugcaaaaugaacagu

SEQ ID NO: 2732856 - RNA, 20 nt, Haemophilus influenzae Rd
ugcaaaccaaaucacaauaa

SEQ ID NO: 2732857 - RNA, 22 nt, Haemophilus influenzae Rd
ugcaaaccaacacccacaucaa

SEQ ID NO: 2732858 - RNA, 15 nt, Haemophilus influenzae Rd
ugcaaaccauuuauc

SEQ ID NO: 2732859 - RNA, 15 nt, Haemophilus influenzae Rd
ugcaaacgagacauu

SEQ ID NO: 2732860 - RNA, 16 nt, Haemophilus influenzae Rd
ugcaaagccuucaccu

SEQ ID NO: 2732861 - RNA, 22 nt, Haemophilus influenzae Rd
ugcaaagcuaccuacuaaugaa

SEQ ID NO: 2732862 - RNA, 21 nt, Haemophilus influenzae Rd
ugcaaaggcaggacguuuuaa

SEQ ID NO: 2732863 - RNA, 15 nt, Haemophilus influenzae Rd
ugcaaaguauuuuuc

SEQ ID NO: 2732864 - RNA, 21 nt, Haemophilus influenzae Rd
ugcaaagugcgguaagaaaau

SEQ ID NO: 2732865 - RNA, 20 nt, Haemophilus influenzae Rd
ugcaaaguuaccauuuauuc

SEQ ID NO: 2732866 - RNA, 12 nt, Haemophilus influenzae Rd
ugcaaaguuaua

SEQ ID NO: 2732867 - RNA, 16 nt, Haemophilus influenzae Rd
ugcaaaguuauaaagc

SEQ ID NO: 2732868 - RNA, 19 nt, Haemophilus influenzae Rd
ugcaaauaaagaagaaaau

SEQ ID NO: 2732869 - RNA, 23 nt, Haemophilus influenzae Rd
ugcaaauaaagaagaaaaucuuu

SEQ ID NO: 2732870 - RNA, 13 nt, Haemophilus influenzae Rd
ugcaaauaaauuu

SEQ ID NO: 2732871 - RNA, 13 nt, Haemophilus influenzae Rd
ugcaaauaaucuc

SEQ ID NO: 2732872 - RNA, 19 nt, Haemophilus influenzae Rd
ugcaaauaaucucuucuaa

SEQ ID NO: 2732873 - RNA, 13 nt, Haemophilus influenzae Rd
ugcaaauacauau

SEQ ID NO: 2732874 - RNA, 19 nt, Haemophilus influenzae Rd
ugcaaaucgagguuuucca

SEQ ID NO: 2732875 - RNA, 14 nt, Haemophilus influenzae Rd
ugcaaaugaaacuu

SEQ ID NO: 2732876 - RNA, 15 nt, Haemophilus influenzae Rd
ugcaaaugaaacuuu

SEQ ID NO: 2732877 - RNA, 19 nt, Haemophilus influenzae Rd
ugcaaaugguguuuuauga

SEQ ID NO: 2732878 - RNA, 16 nt, Haemophilus influenzae Rd
ugcaaauuaacgguuu

SEQ ID NO: 2732879 - RNA, 19 nt, Haemophilus influenzae Rd
ugcaaauuuucagcuugug

SEQ ID NO: 2732880 - RNA, 13 nt, Haemophilus influenzae Rd
ugcaaauuuuuca

SEQ ID NO: 2732881 - RNA, 16 nt, Haemophilus influenzae Rd
ugcaaauuuuucauuc

SEQ ID NO: 2732882 - RNA, 22 nt, Haemophilus influenzae Rd
ugcaacaaagugcggcaaaaaa

SEQ ID NO: 2732883 - RNA, 23 nt, Haemophilus influenzae Rd
ugcaacaaguacgauugcaauaa

SEQ ID NO: 2732884 - RNA, 13 nt, Haemophilus influenzae Rd
ugcaaccaaacaa

SEQ ID NO: 2732885 - RNA, 14 nt, Haemophilus influenzae Rd
ugcaaccaaacaaa

SEQ ID NO: 2732886 - RNA, 15 nt, Haemophilus influenzae Rd
ugcaacgcugccaau

SEQ ID NO: 2732887 - RNA, 14 nt, Haemophilus influenzae Rd
ugcaacgugugcca

SEQ ID NO: 2732888 - RNA, 16 nt, Haemophilus influenzae Rd
ugcaacuucagcagca

SEQ ID NO: 2732889 - RNA, 11 nt, Haemophilus influenzae Rd
ugcaagaaauu

SEQ ID NO: 2732890 - RNA, 18 nt, Haemophilus influenzae Rd
ugcaagcacauuaaucau

SEQ ID NO: 2732891 - RNA, 21 nt, Haemophilus influenzae Rd
ugcaagggauuugaaaauccc

SEQ ID NO: 2732892 - RNA, 15 nt, Haemophilus influenzae Rd
ugcaagguuuccaag

SEQ ID NO: 2732893 - RNA, 19 nt, Haemophilus influenzae Rd
ugcaagugcgguaaaauuu

SEQ ID NO: 2732894 - RNA, 20 nt, Haemophilus influenzae Rd
ugcaagugcgguaaaauuuu

SEQ ID NO: 2732895 - RNA, 12 nt, Haemophilus influenzae Rd
ugcaauaaagcu

SEQ ID NO: 2732896 - RNA, 18 nt, Haemophilus influenzae Rd
ugcaauaaauucguacaa

SEQ ID NO: 2732897 - RNA, 18 nt, Haemophilus influenzae Rd
ugcaauaaccguacauuc

SEQ ID NO: 2732898 - RNA, 21 nt, Haemophilus influenzae Rd
ugcaauaagugcgguaaaaaa

SEQ ID NO: 2732899 - RNA, 17 nt, Haemophilus influenzae Rd
ugcaauaaucacaguac

SEQ ID NO: 2732900 - RNA, 23 nt, Haemophilus influenzae Rd
ugcaauaauuuuacguuucauuu

SEQ ID NO: 2732901 - RNA, 14 nt, Haemophilus influenzae Rd
ugcaauaucaaucc

SEQ ID NO: 2732902 - RNA, 13 nt, Haemophilus influenzae Rd
ugcaauaucuauu

SEQ ID NO: 2732903 - RNA, 17 nt, Haemophilus influenzae Rd
ugcaauaucuauuggaa

SEQ ID NO: 2732904 - RNA, 16 nt, Haemophilus influenzae Rd
ugcaauauuauucagc

SEQ ID NO: 2732905 - RNA, 20 nt, Haemophilus influenzae Rd
ugcaauauuuccucuaaaua

SEQ ID NO: 2732906 - RNA, 17 nt, Haemophilus influenzae Rd
ugcaaucagcaacauua

SEQ ID NO: 2732907 - RNA, 24 nt, Haemophilus influenzae Rd
ugcaaugcagaacgagugacuuua

SEQ ID NO: 2732908 - RNA, 14 nt, Haemophilus influenzae Rd
ugcaauuaauucuu

SEQ ID NO: 2732909 - RNA, 15 nt, Haemophilus influenzae Rd
ugcaauuaauucuuu

SEQ ID NO: 2732910 - RNA, 19 nt, Haemophilus influenzae Rd
ugcaauucccuuuacauuu

SEQ ID NO: 2732911 - RNA, 17 nt, Haemophilus influenzae Rd
ugcaauucgccugcuug

SEQ ID NO: 2732912 - RNA, 19 nt, Haemophilus influenzae Rd
ugcaauuggcaauauuaag

SEQ ID NO: 2732913 - RNA, 19 nt, Haemophilus influenzae Rd
ugcaauuguugcaccaaua

SEQ ID NO: 2732914 - RNA, 17 nt, Haemophilus influenzae Rd
ugcaauuuuuaauucuu

SEQ ID NO: 2732915 - RNA, 18 nt, Haemophilus influenzae Rd
ugcacaacgaucacgaaa

SEQ ID NO: 2732916 - RNA, 20 nt, Haemophilus influenzae Rd
ugcacaacgaucacgaaaac

SEQ ID NO: 2732917 - RNA, 17 nt, Haemophilus influenzae Rd
ugcacaauuacuucuua

SEQ ID NO: 2732918 - RNA, 23 nt, Haemophilus influenzae Rd
ugcacaauuacuucuuacaacaa

SEQ ID NO: 2732919 - RNA, 20 nt, Haemophilus influenzae Rd
ugcacaauuuggcgcauuaa

SEQ ID NO: 2732920 - RNA, 15 nt, Haemophilus influenzae Rd
ugcacagaaaggaca

SEQ ID NO: 2732921 - RNA, 20 nt, Haemophilus influenzae Rd
ugcacagaaaggacagccag

SEQ ID NO: 2732922 - RNA, 19 nt, Haemophilus influenzae Rd
ugcacauccugauugcuuu

SEQ ID NO: 2732923 - RNA, 16 nt, Haemophilus influenzae Rd
ugcacauuaauuugug

SEQ ID NO: 2732924 - RNA, 11 nt, Haemophilus influenzae Rd
ugcacauuuuu

SEQ ID NO: 2732925 - RNA, 16 nt, Haemophilus influenzae Rd
ugcaccaauaauugau

SEQ ID NO: 2732926 - RNA, 19 nt, Haemophilus influenzae Rd
ugcaccagugguugcgauu

SEQ ID NO: 2732927 - RNA, 16 nt, Haemophilus influenzae Rd
ugcacccgccgcaccu

SEQ ID NO: 2732928 - RNA, 16 nt, Haemophilus influenzae Rd
ugcaccuaagucagga

SEQ ID NO: 2732929 - RNA, 22 nt, Haemophilus influenzae Rd
ugcaccuucaacauuuuuugcu

SEQ ID NO: 2732930 - RNA, 15 nt, Haemophilus influenzae Rd
ugcaccuuuaaaucg

SEQ ID NO: 2732931 - RNA, 19 nt, Haemophilus influenzae Rd
ugcaccuuuauuugcaccu

SEQ ID NO: 2732932 - RNA, 20 nt, Haemophilus influenzae Rd
ugcacgaauaauuaaaucuu

SEQ ID NO: 2732933 - RNA, 21 nt, Haemophilus influenzae Rd
ugcacgaauaauuaaaucuuc

SEQ ID NO: 2732934 - RNA, 14 nt, Haemophilus influenzae Rd
ugcacgaccaccca

SEQ ID NO: 2732935 - RNA, 22 nt, Haemophilus influenzae Rd
ugcacgaccacccauuaaauag

SEQ ID NO: 2732936 - RNA, 15 nt, Haemophilus influenzae Rd
ugcacgggaaaucca

SEQ ID NO: 2732937 - RNA, 16 nt, Haemophilus influenzae Rd
ugcacgguguuuucuu

SEQ ID NO: 2732938 - RNA, 18 nt, Haemophilus influenzae Rd
ugcacguaaaguuggcaa

SEQ ID NO: 2732939 - RNA, 16 nt, Haemophilus influenzae Rd
ugcacgugagacuaaa

SEQ ID NO: 2732940 - RNA, 14 nt, Haemophilus influenzae Rd
ugcacguucuucag

SEQ ID NO: 2732941 - RNA, 23 nt, Haemophilus influenzae Rd
ugcacuaacacacgaucaccaag

SEQ ID NO: 2732942 - RNA, 17 nt, Haemophilus influenzae Rd
ugcacuauauacauuaa

SEQ ID NO: 2732943 - RNA, 17 nt, Haemophilus influenzae Rd
ugcacucgcucuaacaa

SEQ ID NO: 2732944 - RNA, 20 nt, Haemophilus influenzae Rd
ugcacugcaaugauaagaug

SEQ ID NO: 2732945 - RNA, 19 nt, Haemophilus influenzae Rd
ugcacugguucuggguauu

SEQ ID NO: 2732946 - RNA, 23 nt, Haemophilus influenzae Rd
ugcacugguucuggguauugauu

SEQ ID NO: 2732947 - RNA, 17 nt, Haemophilus influenzae Rd
ugcacuuggguaaauau

SEQ ID NO: 2732948 - RNA, 20 nt, Haemophilus influenzae Rd
ugcacuuggguaaauauaaa

SEQ ID NO: 2732949 - RNA, 11 nt, Haemophilus influenzae Rd
ugcacuuuaaa

SEQ ID NO: 2732950 - RNA, 20 nt, Haemophilus influenzae Rd
ugcacuuuaaagaaauaaau

SEQ ID NO: 2732951 - RNA, 20 nt, Haemophilus influenzae Rd
ugcacuuucucgagcuaaau

SEQ ID NO: 2732952 - RNA, 11 nt, Haemophilus influenzae Rd
ugcagaaaaau

SEQ ID NO: 2732953 - RNA, 16 nt, Haemophilus influenzae Rd
ugcagaaauacuuuua

SEQ ID NO: 2732954 - RNA, 22 nt, Haemophilus influenzae Rd
ugcagaacccgcuugcuuacau

SEQ ID NO: 2732955 - RNA, 20 nt, Haemophilus influenzae Rd
ugcagacuagugaaauauuu

SEQ ID NO: 2732956 - RNA, 15 nt, Haemophilus influenzae Rd
ugcagagaagaaaua

SEQ ID NO: 2732957 - RNA, 20 nt, Haemophilus influenzae Rd
ugcagaucgcuauuuaauaa

SEQ ID NO: 2732958 - RNA, 16 nt, Haemophilus influenzae Rd
ugcagauuaaauauuu

SEQ ID NO: 2732959 - RNA, 15 nt, Haemophilus influenzae Rd
ugcagauuaauuaua

SEQ ID NO: 2732960 - RNA, 17 nt, Haemophilus influenzae Rd
ugcagauuaauuauauu

SEQ ID NO: 2732961 - RNA, 15 nt, Haemophilus influenzae Rd
ugcagauugcugaca

SEQ ID NO: 2732962 - RNA, 22 nt, Haemophilus influenzae Rd
ugcagauugcugacaaauuugu

SEQ ID NO: 2732963 - RNA, 20 nt, Haemophilus influenzae Rd
ugcagauuuuuuauuuauua

SEQ ID NO: 2732964 - RNA, 16 nt, Haemophilus influenzae Rd
ugcagcagcuucuucu

SEQ ID NO: 2732965 - RNA, 15 nt, Haemophilus influenzae Rd
ugcagccauaauauu

SEQ ID NO: 2732966 - RNA, 17 nt, Haemophilus influenzae Rd
ugcagccauaauauuua

SEQ ID NO: 2732967 - RNA, 22 nt, Haemophilus influenzae Rd
ugcagccaucgcugaaauuaau

SEQ ID NO: 2732968 - RNA, 23 nt, Haemophilus influenzae Rd
ugcagcuggaguucguuauaagc

SEQ ID NO: 2732969 - RNA, 18 nt, Haemophilus influenzae Rd
ugcagcuugcgccauuga

SEQ ID NO: 2732970 - RNA, 19 nt, Haemophilus influenzae Rd
ugcaggggcuuuuaaugau

SEQ ID NO: 2732971 - RNA, 20 nt, Haemophilus influenzae Rd
ugcagguuuugcaaauacag

SEQ ID NO: 2732972 - RNA, 20 nt, Haemophilus influenzae Rd
ugcaguaacgcgauaaaucg

SEQ ID NO: 2732973 - RNA, 14 nt, Haemophilus influenzae Rd
ugcaguaacuucug

SEQ ID NO: 2732974 - RNA, 18 nt, Haemophilus influenzae Rd
ugcaguauaaaccgcauu

SEQ ID NO: 2732975 - RNA, 16 nt, Haemophilus influenzae Rd
ugcagugcauuaaugc

SEQ ID NO: 2732976 - RNA, 21 nt, Haemophilus influenzae Rd
ugcaguuuugugguaauuuau

SEQ ID NO: 2732977 - RNA, 13 nt, Haemophilus influenzae Rd
ugcauaaacaaau

SEQ ID NO: 2732978 - RNA, 19 nt, Haemophilus influenzae Rd
ugcauaacuuaaauuuuua

SEQ ID NO: 2732979 - RNA, 18 nt, Haemophilus influenzae Rd
ugcauaauggcuuaauaa

SEQ ID NO: 2732980 - RNA, 20 nt, Haemophilus influenzae Rd
ugcauacgugccgccacaga

SEQ ID NO: 2732981 - RNA, 12 nt, Haemophilus influenzae Rd
ugcauagccaag

SEQ ID NO: 2732982 - RNA, 20 nt, Haemophilus influenzae Rd
ugcauagccaagugcuuuac

SEQ ID NO: 2732983 - RNA, 14 nt, Haemophilus influenzae Rd
ugcauagccucuaa

SEQ ID NO: 2732984 - RNA, 14 nt, Haemophilus influenzae Rd
ugcauaguuuuaug

SEQ ID NO: 2732985 - RNA, 21 nt, Haemophilus influenzae Rd
ugcauaguuuuccauuuuuga

SEQ ID NO: 2732986 - RNA, 13 nt, Haemophilus influenzae Rd
ugcauauaaaaaa

SEQ ID NO: 2732987 - RNA, 18 nt, Haemophilus influenzae Rd
ugcauauccgcugcaaau

SEQ ID NO: 2732988 - RNA, 14 nt, Haemophilus influenzae Rd
ugcauauucauaaa

SEQ ID NO: 2732989 - RNA, 13 nt, Haemophilus influenzae Rd
ugcaucaauaauu

SEQ ID NO: 2732990 - RNA, 13 nt, Haemophilus influenzae Rd
ugcaucaauauug

SEQ ID NO: 2732991 - RNA, 23 nt, Haemophilus influenzae Rd
ugcaucagaaaguucuaauucau

SEQ ID NO: 2732992 - RNA, 18 nt, Haemophilus influenzae Rd
ugcaucagauuuuucgca

SEQ ID NO: 2732993 - RNA, 14 nt, Haemophilus influenzae Rd
ugcaucauuaauac

SEQ ID NO: 2732994 - RNA, 19 nt, Haemophilus influenzae Rd
ugcaucauuuacagaaccg

SEQ ID NO: 2732995 - RNA, 14 nt, Haemophilus influenzae Rd
ugcauccacuucau

SEQ ID NO: 2732996 - RNA, 16 nt, Haemophilus influenzae Rd
ugcaucgugaccuaau

SEQ ID NO: 2732997 - RNA, 13 nt, Haemophilus influenzae Rd
ugcaucuaaaaau

SEQ ID NO: 2732998 - RNA, 22 nt, Haemophilus influenzae Rd
ugcaucuaaaaauaauuuuacu

SEQ ID NO: 2732999 - RNA, 12 nt, Haemophilus influenzae Rd
ugcaucuguugu

SEQ ID NO: 2733000 - RNA, 18 nt, Haemophilus influenzae Rd
ugcaucuuguuuaucgaa

SEQ ID NO: 2733001 - RNA, 20 nt, Haemophilus influenzae Rd
ugcaugaaauguagcacgau

SEQ ID NO: 2733002 - RNA, 19 nt, Haemophilus influenzae Rd
ugcauguuuacuuaaaucu

SEQ ID NO: 2733003 - RNA, 20 nt, Haemophilus influenzae Rd
ugcauguuuacuuaaaucuu

SEQ ID NO: 2733004 - RNA, 23 nt, Haemophilus influenzae Rd
ugcauuaaaaaacauuaauuuac

SEQ ID NO: 2733005 - RNA, 13 nt, Haemophilus influenzae Rd
ugcauuaaaucaa

SEQ ID NO: 2733006 - RNA, 16 nt, Haemophilus influenzae Rd
ugcauuaaaucaaauu

SEQ ID NO: 2733007 - RNA, 21 nt, Haemophilus influenzae Rd
ugcauuaauaaucuaauccaa

SEQ ID NO: 2733008 - RNA, 15 nt, Haemophilus influenzae Rd
ugcauucacuucuaa

SEQ ID NO: 2733009 - RNA, 21 nt, Haemophilus influenzae Rd
ugcauuccuaaaaucgcacuu

SEQ ID NO: 2733010 - RNA, 16 nt, Haemophilus influenzae Rd
ugcauugaauuuuucu

SEQ ID NO: 2733011 - RNA, 15 nt, Haemophilus influenzae Rd
ugcauugaugacugc

SEQ ID NO: 2733012 - RNA, 16 nt, Haemophilus influenzae Rd
ugcauugccuaaauac

SEQ ID NO: 2733013 - RNA, 22 nt, Haemophilus influenzae Rd
ugcauuggaaugguauaaaaaa

SEQ ID NO: 2733014 - RNA, 12 nt, Haemophilus influenzae Rd
ugcauuggcaag

SEQ ID NO: 2733015 - RNA, 23 nt, Haemophilus influenzae Rd
ugcauuggcuagagcuaauucug

SEQ ID NO: 2733016 - RNA, 17 nt, Haemophilus influenzae Rd
ugcauuuaguuauugac

SEQ ID NO: 2733017 - RNA, 13 nt, Haemophilus influenzae Rd
ugcauuucuaaau

SEQ ID NO: 2733018 - RNA, 13 nt, Haemophilus influenzae Rd
ugcauuuuggaua

SEQ ID NO: 2733019 - RNA, 12 nt, Haemophilus influenzae Rd
ugcauuuuuaac

SEQ ID NO: 2733020 - RNA, 13 nt, Haemophilus influenzae Rd
ugcauuuuuauaa

SEQ ID NO: 2733021 - RNA, 19 nt, Haemophilus influenzae Rd
ugcauuuuuauaaaguaag

SEQ ID NO: 2733022 - RNA, 22 nt, Haemophilus influenzae Rd
ugcauuuuuauaaaguaagcca

SEQ ID NO: 2733023 - RNA, 14 nt, Haemophilus influenzae Rd
ugcauuuuuuauaa

SEQ ID NO: 2733024 - RNA, 16 nt, Haemophilus influenzae Rd
ugcauuuuuuauaaau

SEQ ID NO: 2733025 - RNA, 21 nt, Haemophilus influenzae Rd
ugccaaagcauuaaguuuuua

SEQ ID NO: 2733026 - RNA, 20 nt, Haemophilus influenzae Rd
ugccaaagugcgguauuuuu

SEQ ID NO: 2733027 - RNA, 17 nt, Haemophilus influenzae Rd
ugccaacaccuaagaac

SEQ ID NO: 2733028 - RNA, 15 nt, Haemophilus influenzae Rd
ugccaaccacccaaa

SEQ ID NO: 2733029 - RNA, 18 nt, Haemophilus influenzae Rd
ugccaaccacccaaauau

SEQ ID NO: 2733030 - RNA, 13 nt, Haemophilus influenzae Rd
ugccaaggcuccc

SEQ ID NO: 2733031 - RNA, 13 nt, Haemophilus influenzae Rd
ugccaaguaaauc

SEQ ID NO: 2733032 - RNA, 18 nt, Haemophilus influenzae Rd
ugccaaguaaaucggcug

SEQ ID NO: 2733033 - RNA, 17 nt, Haemophilus influenzae Rd
ugccaauaugaacauua

SEQ ID NO: 2733034 - RNA, 18 nt, Haemophilus influenzae Rd
ugccaauaugaacauuau

SEQ ID NO: 2733035 - RNA, 15 nt, Haemophilus influenzae Rd
ugccaaucaagauaa

SEQ ID NO: 2733036 - RNA, 17 nt, Haemophilus influenzae Rd
ugccaauccauaaaaua

SEQ ID NO: 2733037 - RNA, 17 nt, Haemophilus influenzae Rd
ugccaauccauuuuuaa

SEQ ID NO: 2733038 - RNA, 17 nt, Haemophilus influenzae Rd
ugccaauuuuucggauu

SEQ ID NO: 2733039 - RNA, 15 nt, Haemophilus influenzae Rd
ugccacaaagcaaau

SEQ ID NO: 2733040 - RNA, 17 nt, Haemophilus influenzae Rd
ugccacaggauaaaaac

SEQ ID NO: 2733041 - RNA, 12 nt, Haemophilus influenzae Rd
ugccacaucauc

SEQ ID NO: 2733042 - RNA, 16 nt, Haemophilus influenzae Rd
ugccaccauggcaccg

SEQ ID NO: 2733043 - RNA, 17 nt, Haemophilus influenzae Rd
ugccacgaauaagcacu

SEQ ID NO: 2733044 - RNA, 17 nt, Haemophilus influenzae Rd
ugccacgaggucaaucu

SEQ ID NO: 2733045 - RNA, 15 nt, Haemophilus influenzae Rd
ugccacgguuucuug

SEQ ID NO: 2733046 - RNA, 15 nt, Haemophilus influenzae Rd
ugccacuaaggguua

SEQ ID NO: 2733047 - RNA, 19 nt, Haemophilus influenzae Rd
ugccacuucagcuaauaaa

SEQ ID NO: 2733048 - RNA, 17 nt, Haemophilus influenzae Rd
ugccacuuccacuucug

SEQ ID NO: 2733049 - RNA, 15 nt, Haemophilus influenzae Rd
ugccaguaacuuucu

SEQ ID NO: 2733050 - RNA, 17 nt, Haemophilus influenzae Rd
ugccauaggacaggcua

SEQ ID NO: 2733051 - RNA, 23 nt, Haemophilus influenzae Rd
ugccaucacagucuuuuaacaca

SEQ ID NO: 2733052 - RNA, 17 nt, Haemophilus influenzae Rd
ugccaucacauccacaa

SEQ ID NO: 2733053 - RNA, 16 nt, Haemophilus influenzae Rd
ugccaucaccaagaau

SEQ ID NO: 2733054 - RNA, 12 nt, Haemophilus influenzae Rd
ugccaucacuca

SEQ ID NO: 2733055 - RNA, 15 nt, Haemophilus influenzae Rd
ugccauguacauuaa

SEQ ID NO: 2733056 - RNA, 16 nt, Haemophilus influenzae Rd
ugccauguacauuaau

SEQ ID NO: 2733057 - RNA, 12 nt, Haemophilus influenzae Rd
ugccauuacaag

SEQ ID NO: 2733058 - RNA, 18 nt, Haemophilus influenzae Rd
ugccauuauccacaacag

SEQ ID NO: 2733059 - RNA, 13 nt, Haemophilus influenzae Rd
ugccauugcuaaa

SEQ ID NO: 2733060 - RNA, 16 nt, Haemophilus influenzae Rd
ugccauugcuaaauuu

SEQ ID NO: 2733061 - RNA, 16 nt, Haemophilus influenzae Rd
ugccauuguuaaaugu

SEQ ID NO: 2733062 - RNA, 17 nt, Haemophilus influenzae Rd
ugccauuucgcuugagu

SEQ ID NO: 2733063 - RNA, 20 nt, Haemophilus influenzae Rd
ugccauuuuuuggaguuguu

SEQ ID NO: 2733064 - RNA, 17 nt, Haemophilus influenzae Rd
ugcccaauaaaaguaau

SEQ ID NO: 2733065 - RNA, 15 nt, Haemophilus influenzae Rd
ugcccaauauaacaa

SEQ ID NO: 2733066 - RNA, 13 nt, Haemophilus influenzae Rd
ugcccacauagcu

SEQ ID NO: 2733067 - RNA, 18 nt, Haemophilus influenzae Rd
ugcccagcaauuuauugu

SEQ ID NO: 2733068 - RNA, 21 nt, Haemophilus influenzae Rd
ugcccagcaauuuauuguagc

SEQ ID NO: 2733069 - RNA, 19 nt, Haemophilus influenzae Rd
ugcccaucuugccaaugcc

SEQ ID NO: 2733070 - RNA, 14 nt, Haemophilus influenzae Rd
ugccccagcaagaa

SEQ ID NO: 2733071 - RNA, 20 nt, Haemophilus influenzae Rd
ugcccgcagcaauuaaaaag

SEQ ID NO: 2733072 - RNA, 18 nt, Haemophilus influenzae Rd
ugcccgcuacaaauaagc

SEQ ID NO: 2733073 - RNA, 19 nt, Haemophilus influenzae Rd
ugcccgugaguaaaauaua

SEQ ID NO: 2733074 - RNA, 16 nt, Haemophilus influenzae Rd
ugcccuagugcaacca

SEQ ID NO: 2733075 - RNA, 23 nt, Haemophilus influenzae Rd
ugcccuagugcaaccacacaagc

SEQ ID NO: 2733076 - RNA, 16 nt, Haemophilus influenzae Rd
ugcccuuucgcuuaca

SEQ ID NO: 2733077 - RNA, 19 nt, Haemophilus influenzae Rd
ugcccuuucucaaauauuu

SEQ ID NO: 2733078 - RNA, 16 nt, Haemophilus influenzae Rd
ugccgaaccugaaauu

SEQ ID NO: 2733079 - RNA, 16 nt, Haemophilus influenzae Rd
ugccgaagccuaaauc

SEQ ID NO: 2733080 - RNA, 18 nt, Haemophilus influenzae Rd
ugccgaagccuaaaucuu

SEQ ID NO: 2733081 - RNA, 20 nt, Haemophilus influenzae Rd
ugccgcagguucgccacugg

SEQ ID NO: 2733082 - RNA, 23 nt, Haemophilus influenzae Rd
ugccgcagguucgccacuggugc

SEQ ID NO: 2733083 - RNA, 14 nt, Haemophilus influenzae Rd
ugccgccaauccag

SEQ ID NO: 2733084 - RNA, 15 nt, Haemophilus influenzae Rd
ugccgccuuuuaaua

SEQ ID NO: 2733085 - RNA, 17 nt, Haemophilus influenzae Rd
ugccgccuuuuaauaaa

SEQ ID NO: 2733086 - RNA, 14 nt, Haemophilus influenzae Rd
ugccgcuaaugguu

SEQ ID NO: 2733087 - RNA, 15 nt, Haemophilus influenzae Rd
ugccgcugcaacaaa

SEQ ID NO: 2733088 - RNA, 20 nt, Haemophilus influenzae Rd
ugccguguaauacugauaaa

SEQ ID NO: 2733089 - RNA, 16 nt, Haemophilus influenzae Rd
ugccguucaaaacaau

SEQ ID NO: 2733090 - RNA, 21 nt, Haemophilus influenzae Rd
ugccguuuaccauaucuucca

SEQ ID NO: 2733091 - RNA, 22 nt, Haemophilus influenzae Rd
ugccuaaaaagaaguauuauuu

SEQ ID NO: 2733092 - RNA, 13 nt, Haemophilus influenzae Rd
ugccuaaaaccug

SEQ ID NO: 2733093 - RNA, 12 nt, Haemophilus influenzae Rd
ugccuaauucac

SEQ ID NO: 2733094 - RNA, 16 nt, Haemophilus influenzae Rd
ugccuauuuauuuauu

SEQ ID NO: 2733095 - RNA, 17 nt, Haemophilus influenzae Rd
ugccuauuuauuuauug

SEQ ID NO: 2733096 - RNA, 18 nt, Haemophilus influenzae Rd
ugccucuguauuuuucau

SEQ ID NO: 2733097 - RNA, 13 nt, Haemophilus influenzae Rd
ugccucuucauug

SEQ ID NO: 2733098 - RNA, 16 nt, Haemophilus influenzae Rd
ugccucuuuccuuauu

SEQ ID NO: 2733099 - RNA, 13 nt, Haemophilus influenzae Rd
ugccucuuuuuuc

SEQ ID NO: 2733100 - RNA, 17 nt, Haemophilus influenzae Rd
ugccuuauauuucacug

SEQ ID NO: 2733101 - RNA, 19 nt, Haemophilus influenzae Rd
ugccuucaaugggcaucca

SEQ ID NO: 2733102 - RNA, 15 nt, Haemophilus influenzae Rd
ugccuucauauaaua

SEQ ID NO: 2733103 - RNA, 16 nt, Haemophilus influenzae Rd
ugccuucauauaauaa

SEQ ID NO: 2733104 - RNA, 17 nt, Haemophilus influenzae Rd
ugccuucauauaauaaa

SEQ ID NO: 2733105 - RNA, 20 nt, Haemophilus influenzae Rd
ugccuugaugcucugcauaa

SEQ ID NO: 2733106 - RNA, 13 nt, Haemophilus influenzae Rd
ugccuugcaaaaa

SEQ ID NO: 2733107 - RNA, 19 nt, Haemophilus influenzae Rd
ugccuugguaagaaagaua

SEQ ID NO: 2733108 - RNA, 14 nt, Haemophilus influenzae Rd
ugccuugugcauaa

SEQ ID NO: 2733109 - RNA, 21 nt, Haemophilus influenzae Rd
ugccuuuauggugugcaauaa

SEQ ID NO: 2733110 - RNA, 15 nt, Haemophilus influenzae Rd
ugccuuuuucuucuu

SEQ ID NO: 2733111 - RNA, 21 nt, Haemophilus influenzae Rd
ugccuuuuucuucuuucauuu

SEQ ID NO: 2733112 - RNA, 23 nt, Haemophilus influenzae Rd
ugcgaacaaggguuccugcauca

SEQ ID NO: 2733113 - RNA, 15 nt, Haemophilus influenzae Rd
ugcgaauuuuuauuu

SEQ ID NO: 2733114 - RNA, 16 nt, Haemophilus influenzae Rd
ugcgacaccaccagcu

SEQ ID NO: 2733115 - RNA, 19 nt, Haemophilus influenzae Rd
ugcgacaggggcuucuaau

SEQ ID NO: 2733116 - RNA, 16 nt, Haemophilus influenzae Rd
ugcgaccucgccauuu

SEQ ID NO: 2733117 - RNA, 21 nt, Haemophilus influenzae Rd
ugcgaccucgccauuuuucaa

SEQ ID NO: 2733118 - RNA, 13 nt, Haemophilus influenzae Rd
ugcgauaaaauca

SEQ ID NO: 2733119 - RNA, 20 nt, Haemophilus influenzae Rd
ugcgauaauuugcaucauuu

SEQ ID NO: 2733120 - RNA, 16 nt, Haemophilus influenzae Rd
ugcgauauuuuuucag

SEQ ID NO: 2733121 - RNA, 16 nt, Haemophilus influenzae Rd
ugcgaucacugcaccg

SEQ ID NO: 2733122 - RNA, 17 nt, Haemophilus influenzae Rd
ugcgaucuuuuguuacu

SEQ ID NO: 2733123 - RNA, 19 nt, Haemophilus influenzae Rd
ugcgaugacaaaaaauauc

SEQ ID NO: 2733124 - RNA, 19 nt, Haemophilus influenzae Rd
ugcgaugauaaaguccaua

SEQ ID NO: 2733125 - RNA, 18 nt, Haemophilus influenzae Rd
ugcgauuaacaauaaugu

SEQ ID NO: 2733126 - RNA, 12 nt, Haemophilus influenzae Rd
ugcgauuuccaa

SEQ ID NO: 2733127 - RNA, 17 nt, Haemophilus influenzae Rd
ugcgauuuccaagcugg

SEQ ID NO: 2733128 - RNA, 19 nt, Haemophilus influenzae Rd
ugcgauuuuugcacgaauu

SEQ ID NO: 2733129 - RNA, 19 nt, Haemophilus influenzae Rd
ugcgcauauacuucuuuag

SEQ ID NO: 2733130 - RNA, 16 nt, Haemophilus influenzae Rd
ugcgccauuucccaua

SEQ ID NO: 2733131 - RNA, 16 nt, Haemophilus influenzae Rd
ugcgccauuuuuaaaa

SEQ ID NO: 2733132 - RNA, 22 nt, Haemophilus influenzae Rd
ugcgccgauaacaccgcuaaua

SEQ ID NO: 2733133 - RNA, 16 nt, Haemophilus influenzae Rd
ugcgccuaaaauauuu

SEQ ID NO: 2733134 - RNA, 17 nt, Haemophilus influenzae Rd
ugcgccuaauuggaaaa

SEQ ID NO: 2733135 - RNA, 19 nt, Haemophilus influenzae Rd
ugcgccuagcgcuguuacu

SEQ ID NO: 2733136 - RNA, 16 nt, Haemophilus influenzae Rd
ugcgcggugauuuagc

SEQ ID NO: 2733137 - RNA, 13 nt, Haemophilus influenzae Rd
ugcgcugaccaau

SEQ ID NO: 2733138 - RNA, 13 nt, Haemophilus influenzae Rd
ugcgcuuuuaauu

SEQ ID NO: 2733139 - RNA, 15 nt, Haemophilus influenzae Rd
ugcggauuucacuag

SEQ ID NO: 2733140 - RNA, 17 nt, Haemophilus influenzae Rd
ugcggcagaauuucguc

SEQ ID NO: 2733141 - RNA, 18 nt, Haemophilus influenzae Rd
ugcgggaauagcucaguu

SEQ ID NO: 2733142 - RNA, 19 nt, Haemophilus influenzae Rd
ugcgggaauagcucaguug

SEQ ID NO: 2733143 - RNA, 13 nt, Haemophilus influenzae Rd
ugcgggcaaaaac

SEQ ID NO: 2733144 - RNA, 19 nt, Haemophilus influenzae Rd
ugcgggucuuguuccaaca

SEQ ID NO: 2733145 - RNA, 16 nt, Haemophilus influenzae Rd
ugcgguaaaaaaaagc

SEQ ID NO: 2733146 - RNA, 17 nt, Haemophilus influenzae Rd
ugcgguaaaauuuuucu

SEQ ID NO: 2733147 - RNA, 19 nt, Haemophilus influenzae Rd
ugcgguaaaauuuuucuca

SEQ ID NO: 2733148 - RNA, 18 nt, Haemophilus influenzae Rd
ugcgguaaauuuuaaaau

SEQ ID NO: 2733149 - RNA, 23 nt, Haemophilus influenzae Rd
ugcgguaauuauagagaaauaau

SEQ ID NO: 2733150 - RNA, 23 nt, Haemophilus influenzae Rd
ugcgguauuuuuuuauuuacuuu

SEQ ID NO: 2733151 - RNA, 14 nt, Haemophilus influenzae Rd
ugcggucaacauaa

SEQ ID NO: 2733152 - RNA, 15 nt, Haemophilus influenzae Rd
ugcggucauuuuuca

SEQ ID NO: 2733153 - RNA, 16 nt, Haemophilus influenzae Rd
ugcggucauuuuucac

SEQ ID NO: 2733154 - RNA, 20 nt, Haemophilus influenzae Rd
ugcggugacuuuuugugcca

SEQ ID NO: 2733155 - RNA, 14 nt, Haemophilus influenzae Rd
ugcggugauuuuac

SEQ ID NO: 2733156 - RNA, 12 nt, Haemophilus influenzae Rd
ugcggugcaauu

SEQ ID NO: 2733157 - RNA, 13 nt, Haemophilus influenzae Rd
ugcgguuaaaauu

SEQ ID NO: 2733158 - RNA, 19 nt, Haemophilus influenzae Rd
ugcgguuaaaauuuaauaa

SEQ ID NO: 2733159 - RNA, 15 nt, Haemophilus influenzae Rd
ugcgguuaaauauuu

SEQ ID NO: 2733160 - RNA, 21 nt, Haemophilus influenzae Rd
ugcgguuaauuuuuuguucau

SEQ ID NO: 2733161 - RNA, 20 nt, Haemophilus influenzae Rd
ugcgguucuucuuuuaauaa

SEQ ID NO: 2733162 - RNA, 19 nt, Haemophilus influenzae Rd
ugcgguugaaauuuaauaa

SEQ ID NO: 2733163 - RNA, 15 nt, Haemophilus influenzae Rd
ugcgguugaaauuuc

SEQ ID NO: 2733164 - RNA, 20 nt, Haemophilus influenzae Rd
ugcgguugaauuucuuuuuc

SEQ ID NO: 2733165 - RNA, 13 nt, Haemophilus influenzae Rd
ugcguaauaagua

SEQ ID NO: 2733166 - RNA, 18 nt, Haemophilus influenzae Rd
ugcguagccuagugcuaa

SEQ ID NO: 2733167 - RNA, 18 nt, Haemophilus influenzae Rd
ugcguauccgcugcuaau

SEQ ID NO: 2733168 - RNA, 17 nt, Haemophilus influenzae Rd
ugcgugaauaucuguca

SEQ ID NO: 2733169 - RNA, 16 nt, Haemophilus influenzae Rd
ugcguguguuuguaaa

SEQ ID NO: 2733170 - RNA, 22 nt, Haemophilus influenzae Rd
ugcguguuacgcccuacaaugc

SEQ ID NO: 2733171 - RNA, 18 nt, Haemophilus influenzae Rd
ugcguuaaaucaaaacca

SEQ ID NO: 2733172 - RNA, 17 nt, Haemophilus influenzae Rd
ugcguucaagccuuugc

SEQ ID NO: 2733173 - RNA, 16 nt, Haemophilus influenzae Rd
ugcguucaauaugcaa

SEQ ID NO: 2733174 - RNA, 18 nt, Haemophilus influenzae Rd
ugcguucacucacuuuaa

SEQ ID NO: 2733175 - RNA, 17 nt, Haemophilus influenzae Rd
ugcguucgauaacaauu

SEQ ID NO: 2733176 - RNA, 21 nt, Haemophilus influenzae Rd
ugcguucgauaacaauuuuug

SEQ ID NO: 2733177 - RNA, 20 nt, Haemophilus influenzae Rd
ugcguugcgguuaaaauugc

SEQ ID NO: 2733178 - RNA, 17 nt, Haemophilus influenzae Rd
ugcguuucaaaugcuuu

SEQ ID NO: 2733179 - RNA, 17 nt, Haemophilus influenzae Rd
ugcguuugguucaucau

SEQ ID NO: 2733180 - RNA, 18 nt, Haemophilus influenzae Rd
ugcguuugguucaucauu

SEQ ID NO: 2733181 - RNA, 22 nt, Haemophilus influenzae Rd
ugcguuugguucaucauuugcu

SEQ ID NO: 2733182 - RNA, 13 nt, Haemophilus influenzae Rd
ugcguuuuuuaau

SEQ ID NO: 2733183 - RNA, 10 nt, Haemophilus influenzae Rd
ugcuaaaauu

SEQ ID NO: 2733184 - RNA, 12 nt, Haemophilus influenzae Rd
ugcuaaaccaau

SEQ ID NO: 2733185 - RNA, 19 nt, Haemophilus influenzae Rd
ugcuaaaccagcaagauaa

SEQ ID NO: 2733186 - RNA, 17 nt, Haemophilus influenzae Rd
ugcuaaaccugcaaguu

SEQ ID NO: 2733187 - RNA, 23 nt, Haemophilus influenzae Rd
ugcuaaacguucuuggaaaucuu

SEQ ID NO: 2733188 - RNA, 21 nt, Haemophilus influenzae Rd
ugcuaaaggguuuacuuuaau

SEQ ID NO: 2733189 - RNA, 17 nt, Haemophilus influenzae Rd
ugcuaaaucaccuaaau

SEQ ID NO: 2733190 - RNA, 20 nt, Haemophilus influenzae Rd
ugcuaaaucaccuaaaucuu

SEQ ID NO: 2733191 - RNA, 15 nt, Haemophilus influenzae Rd
ugcuaaauuuauuac

SEQ ID NO: 2733192 - RNA, 17 nt, Haemophilus influenzae Rd
ugcuaagauugcaagug

SEQ ID NO: 2733193 - RNA, 15 nt, Haemophilus influenzae Rd
ugcuaauaaucuauu

SEQ ID NO: 2733194 - RNA, 20 nt, Haemophilus influenzae Rd
ugcuaauagaacuguuauuu

SEQ ID NO: 2733195 - RNA, 20 nt, Haemophilus influenzae Rd
ugcuaaucguuuaauuucau

SEQ ID NO: 2733196 - RNA, 19 nt, Haemophilus influenzae Rd
ugcuaaugcggcgaauagc

SEQ ID NO: 2733197 - RNA, 19 nt, Haemophilus influenzae Rd
ugcuaauucugcuaaaucu

SEQ ID NO: 2733198 - RNA, 20 nt, Haemophilus influenzae Rd
ugcuaauucugcuaaaucug

SEQ ID NO: 2733199 - RNA, 14 nt, Haemophilus influenzae Rd
ugcuaccauuuauc

SEQ ID NO: 2733200 - RNA, 14 nt, Haemophilus influenzae Rd
ugcuacuuuugacg

SEQ ID NO: 2733201 - RNA, 15 nt, Haemophilus influenzae Rd
ugcuagccaauaauc

SEQ ID NO: 2733202 - RNA, 16 nt, Haemophilus influenzae Rd
ugcuagccaauaaucu

SEQ ID NO: 2733203 - RNA, 14 nt, Haemophilus influenzae Rd
ugcuaguacuuguu

SEQ ID NO: 2733204 - RNA, 21 nt, Haemophilus influenzae Rd
ugcuaguucuucaaauugcaa

SEQ ID NO: 2733205 - RNA, 19 nt, Haemophilus influenzae Rd
ugcuauccuuuguugucgu

SEQ ID NO: 2733206 - RNA, 21 nt, Haemophilus influenzae Rd
ugcuaucuuaccuuuuucuac

SEQ ID NO: 2733207 - RNA, 12 nt, Haemophilus influenzae Rd
ugcuaugcccaa

SEQ ID NO: 2733208 - RNA, 13 nt, Haemophilus influenzae Rd
ugcuauucucucg

SEQ ID NO: 2733209 - RNA, 15 nt, Haemophilus influenzae Rd
ugcuauucuuuagau

SEQ ID NO: 2733210 - RNA, 17 nt, Haemophilus influenzae Rd
ugcuauuuuauuuagaa

SEQ ID NO: 2733211 - RNA, 23 nt, Haemophilus influenzae Rd
ugcucaauagcggcaugaauauc

SEQ ID NO: 2733212 - RNA, 19 nt, Haemophilus influenzae Rd
ugcucaauccaaguauuuu

SEQ ID NO: 2733213 - RNA, 22 nt, Haemophilus influenzae Rd
ugcucacgccgugauaacaacu

SEQ ID NO: 2733214 - RNA, 19 nt, Haemophilus influenzae Rd
ugcucacgggcagaaugaa

SEQ ID NO: 2733215 - RNA, 14 nt, Haemophilus influenzae Rd
ugcucacuucgcuu

SEQ ID NO: 2733216 - RNA, 17 nt, Haemophilus influenzae Rd
ugcucagccaguuuucu

SEQ ID NO: 2733217 - RNA, 20 nt, Haemophilus influenzae Rd
ugcucagcgguuggcuucca

SEQ ID NO: 2733218 - RNA, 15 nt, Haemophilus influenzae Rd
ugcucaugauuauaa

SEQ ID NO: 2733219 - RNA, 17 nt, Haemophilus influenzae Rd
ugcucaugauuauaaac

SEQ ID NO: 2733220 - RNA, 18 nt, Haemophilus influenzae Rd
ugcuccuacuuuuacaaa

SEQ ID NO: 2733221 - RNA, 15 nt, Haemophilus influenzae Rd
ugcucgauuuuuaaa

SEQ ID NO: 2733222 - RNA, 16 nt, Haemophilus influenzae Rd
ugcucgauuuuuaaaa

SEQ ID NO: 2733223 - RNA, 22 nt, Haemophilus influenzae Rd
ugcucgauuuuuaaaagcaccg

SEQ ID NO: 2733224 - RNA, 20 nt, Haemophilus influenzae Rd
ugcucgugauuaucuaaauu

SEQ ID NO: 2733225 - RNA, 19 nt, Haemophilus influenzae Rd
ugcucgugugccaucaguu

SEQ ID NO: 2733226 - RNA, 13 nt, Haemophilus influenzae Rd
ugcucuaaaagcu

SEQ ID NO: 2733227 - RNA, 14 nt, Haemophilus influenzae Rd
ugcucuaaaagcug

SEQ ID NO: 2733228 - RNA, 13 nt, Haemophilus influenzae Rd
ugcucuaaaugug

SEQ ID NO: 2733229 - RNA, 13 nt, Haemophilus influenzae Rd
ugcucuaauucag

SEQ ID NO: 2733230 - RNA, 17 nt, Haemophilus influenzae Rd
ugcucuaccaacugagc

SEQ ID NO: 2733231 - RNA, 19 nt, Haemophilus influenzae Rd
ugcucuaccaacugagcua

SEQ ID NO: 2733232 - RNA, 15 nt, Haemophilus influenzae Rd
ugcucucuuuuaauc

SEQ ID NO: 2733233 - RNA, 17 nt, Haemophilus influenzae Rd
ugcucugcauaaaagcc

SEQ ID NO: 2733234 - RNA, 12 nt, Haemophilus influenzae Rd
ugcucugccacg

SEQ ID NO: 2733235 - RNA, 20 nt, Haemophilus influenzae Rd
ugcucugcguucaagccuuu

SEQ ID NO: 2733236 - RNA, 23 nt, Haemophilus influenzae Rd
ugcucugguggaagguaauuuaa

SEQ ID NO: 2733237 - RNA, 18 nt, Haemophilus influenzae Rd
ugcucugguugagcaaug

SEQ ID NO: 2733238 - RNA, 13 nt, Haemophilus influenzae Rd
ugcucuguauuuu

SEQ ID NO: 2733239 - RNA, 13 nt, Haemophilus influenzae Rd
ugcucuuuaacaa

SEQ ID NO: 2733240 - RNA, 16 nt, Haemophilus influenzae Rd
ugcucuuuaacaauau

SEQ ID NO: 2733241 - RNA, 23 nt, Haemophilus influenzae Rd
ugcugaaaaugggcgggcaaacc

SEQ ID NO: 2733242 - RNA, 23 nt, Haemophilus influenzae Rd
ugcugaaauauugggcucugcau

SEQ ID NO: 2733243 - RNA, 13 nt, Haemophilus influenzae Rd
ugcugaaugugcg

SEQ ID NO: 2733244 - RNA, 20 nt, Haemophilus influenzae Rd
ugcugacgguucaguuucaa

SEQ ID NO: 2733245 - RNA, 17 nt, Haemophilus influenzae Rd
ugcugagugcaagccac

SEQ ID NO: 2733246 - RNA, 11 nt, Haemophilus influenzae Rd
ugcugauaaag

SEQ ID NO: 2733247 - RNA, 12 nt, Haemophilus influenzae Rd
ugcugauaaauu

SEQ ID NO: 2733248 - RNA, 14 nt, Haemophilus influenzae Rd
ugcugauuauuggg

SEQ ID NO: 2733249 - RNA, 16 nt, Haemophilus influenzae Rd
ugcugauuauugggcu

SEQ ID NO: 2733250 - RNA, 19 nt, Haemophilus influenzae Rd
ugcugauucacgaucacuu

SEQ ID NO: 2733251 - RNA, 22 nt, Haemophilus influenzae Rd
ugcugcaagauuugcugcugcu

SEQ ID NO: 2733252 - RNA, 17 nt, Haemophilus influenzae Rd
ugcugcaguacuuucac

SEQ ID NO: 2733253 - RNA, 18 nt, Haemophilus influenzae Rd
ugcugcaguuacugccuc

SEQ ID NO: 2733254 - RNA, 20 nt, Haemophilus influenzae Rd
ugcugccacuucagcuaaua

SEQ ID NO: 2733255 - RNA, 22 nt, Haemophilus influenzae Rd
ugcugccacuucagcuaauaaa

SEQ ID NO: 2733256 - RNA, 14 nt, Haemophilus influenzae Rd
ugcugcuguuuuac

SEQ ID NO: 2733257 - RNA, 23 nt, Haemophilus influenzae Rd
ugcugcuuuaacaauuacugcaa

SEQ ID NO: 2733258 - RNA, 15 nt, Haemophilus influenzae Rd
ugcugcuuuaauuuc

SEQ ID NO: 2733259 - RNA, 12 nt, Haemophilus influenzae Rd
ugcuggaaaaau

SEQ ID NO: 2733260 - RNA, 19 nt, Haemophilus influenzae Rd
ugcuggaucuucagcauuu

SEQ ID NO: 2733261 - RNA, 22 nt, Haemophilus influenzae Rd
ugcuggauucaguugauagaca

SEQ ID NO: 2733262 - RNA, 21 nt, Haemophilus influenzae Rd
ugcuggguaagaagugaaauu

SEQ ID NO: 2733263 - RNA, 16 nt, Haemophilus influenzae Rd
ugcugguguggagaaa

SEQ ID NO: 2733264 - RNA, 14 nt, Haemophilus influenzae Rd
ugcuguaacguuaa

SEQ ID NO: 2733265 - RNA, 14 nt, Haemophilus influenzae Rd
ugcuguacacacac

SEQ ID NO: 2733266 - RNA, 15 nt, Haemophilus influenzae Rd
ugcuguacacacacc

SEQ ID NO: 2733267 - RNA, 19 nt, Haemophilus influenzae Rd
ugcuguacacacaccaucc

SEQ ID NO: 2733268 - RNA, 20 nt, Haemophilus influenzae Rd
ugcuguagaaauuaauaaug

SEQ ID NO: 2733269 - RNA, 15 nt, Haemophilus influenzae Rd
ugcuguagcauagau

SEQ ID NO: 2733270 - RNA, 15 nt, Haemophilus influenzae Rd
ugcuguugcagcugg

SEQ ID NO: 2733271 - RNA, 16 nt, Haemophilus influenzae Rd
ugcuguugguuaaaaa

SEQ ID NO: 2733272 - RNA, 17 nt, Haemophilus influenzae Rd
ugcuguugguuaaaaau

SEQ ID NO: 2733273 - RNA, 19 nt, Haemophilus influenzae Rd
ugcuguugguuaaaaauag

SEQ ID NO: 2733274 - RNA, 17 nt, Haemophilus influenzae Rd
ugcuguugguuuuccac

SEQ ID NO: 2733275 - RNA, 21 nt, Haemophilus influenzae Rd
ugcuguuuagugugucccccc

SEQ ID NO: 2733276 - RNA, 14 nt, Haemophilus influenzae Rd
ugcuguuucuaauu

SEQ ID NO: 2733277 - RNA, 17 nt, Haemophilus influenzae Rd
ugcuuaaauugacuugc

SEQ ID NO: 2733278 - RNA, 16 nt, Haemophilus influenzae Rd
ugcuuaacauuaauaa

SEQ ID NO: 2733279 - RNA, 17 nt, Haemophilus influenzae Rd
ugcuuaacauuaauaaa

SEQ ID NO: 2733280 - RNA, 23 nt, Haemophilus influenzae Rd
ugcuuaacauuaauaaaccaaca

SEQ ID NO: 2733281 - RNA, 16 nt, Haemophilus influenzae Rd
ugcuuaacugaaaauu

SEQ ID NO: 2733282 - RNA, 21 nt, Haemophilus influenzae Rd
ugcuuaagugcgguauuuuua

SEQ ID NO: 2733283 - RNA, 17 nt, Haemophilus influenzae Rd
ugcuuaaucggcacaag

SEQ ID NO: 2733284 - RNA, 18 nt, Haemophilus influenzae Rd
ugcuuaaucggcacaaga

SEQ ID NO: 2733285 - RNA, 12 nt, Haemophilus influenzae Rd
ugcuuaauggac

SEQ ID NO: 2733286 - RNA, 17 nt, Haemophilus influenzae Rd
ugcuuagugaaaagaaa

SEQ ID NO: 2733287 - RNA, 16 nt, Haemophilus influenzae Rd
ugcuuauaaaacagag

SEQ ID NO: 2733288 - RNA, 20 nt, Haemophilus influenzae Rd
ugcuucagcguugucaucag

SEQ ID NO: 2733289 - RNA, 19 nt, Haemophilus influenzae Rd
ugcuuccauuuggaauacu

SEQ ID NO: 2733290 - RNA, 17 nt, Haemophilus influenzae Rd
ugcuucuaauuuuaaaa

SEQ ID NO: 2733291 - RNA, 20 nt, Haemophilus influenzae Rd
ugcuucuaauuuuaaaacau

SEQ ID NO: 2733292 - RNA, 23 nt, Haemophilus influenzae Rd
ugcuugagcugucuaauuuuuua

SEQ ID NO: 2733293 - RNA, 22 nt, Haemophilus influenzae Rd
ugcuugauaaccuucaaugguu

SEQ ID NO: 2733294 - RNA, 21 nt, Haemophilus influenzae Rd
ugcuugcgccgaauaaaaagg

SEQ ID NO: 2733295 - RNA, 21 nt, Haemophilus influenzae Rd
ugcuugcgcuugugcuggagu

SEQ ID NO: 2733296 - RNA, 16 nt, Haemophilus influenzae Rd
ugcuugcguaguuaag

SEQ ID NO: 2733297 - RNA, 18 nt, Haemophilus influenzae Rd
ugcuugggcaauuaauag

SEQ ID NO: 2733298 - RNA, 17 nt, Haemophilus influenzae Rd
ugcuuggucaaguuaua

SEQ ID NO: 2733299 - RNA, 22 nt, Haemophilus influenzae Rd
ugcuugguuuuauauucauuua

SEQ ID NO: 2733300 - RNA, 13 nt, Haemophilus influenzae Rd
ugcuuguaaaaac

SEQ ID NO: 2733301 - RNA, 18 nt, Haemophilus influenzae Rd
ugcuuguucagcaacauc

SEQ ID NO: 2733302 - RNA, 17 nt, Haemophilus influenzae Rd
ugcuuguucaugugggc

SEQ ID NO: 2733303 - RNA, 13 nt, Haemophilus influenzae Rd
ugcuuguuuuaaa

SEQ ID NO: 2733304 - RNA, 12 nt, Haemophilus influenzae Rd
ugcuuuaaauug

SEQ ID NO: 2733305 - RNA, 14 nt, Haemophilus influenzae Rd
ugcuuuaaauuguu

SEQ ID NO: 2733306 - RNA, 13 nt, Haemophilus influenzae Rd
ugcuuuaacaauu

SEQ ID NO: 2733307 - RNA, 13 nt, Haemophilus influenzae Rd
ugcuuuaacccau

SEQ ID NO: 2733308 - RNA, 22 nt, Haemophilus influenzae Rd
ugcuuuaacccauuuauuuaaa

SEQ ID NO: 2733309 - RNA, 16 nt, Haemophilus influenzae Rd
ugcuuuaaguaaaagu

SEQ ID NO: 2733310 - RNA, 13 nt, Haemophilus influenzae Rd
ugcuuuaaucauu

SEQ ID NO: 2733311 - RNA, 19 nt, Haemophilus influenzae Rd
ugcuuuaauuucauucaac

SEQ ID NO: 2733312 - RNA, 22 nt, Haemophilus influenzae Rd
ugcuuuaccuguugcauuagaa

SEQ ID NO: 2733313 - RNA, 15 nt, Haemophilus influenzae Rd
ugcuuuauuuggcau

SEQ ID NO: 2733314 - RNA, 20 nt, Haemophilus influenzae Rd
ugcuuuauuuggcauuugaa

SEQ ID NO: 2733315 - RNA, 14 nt, Haemophilus influenzae Rd
ugcuuucagauuca

SEQ ID NO: 2733316 - RNA, 18 nt, Haemophilus influenzae Rd
ugcuuucauagaugauuc

SEQ ID NO: 2733317 - RNA, 15 nt, Haemophilus influenzae Rd
ugcuuucuuauucag

SEQ ID NO: 2733318 - RNA, 12 nt, Haemophilus influenzae Rd
ugcuuucuucca

SEQ ID NO: 2733319 - RNA, 13 nt, Haemophilus influenzae Rd
ugcuuucuuccaa

SEQ ID NO: 2733320 - RNA, 20 nt, Haemophilus influenzae Rd
ugcuuugcugccacuucagc

SEQ ID NO: 2733321 - RNA, 16 nt, Haemophilus influenzae Rd
ugcuuuuaaauuuuua

SEQ ID NO: 2733322 - RNA, 23 nt, Haemophilus influenzae Rd
ugcuuuuaauaauguauuucuaa

SEQ ID NO: 2733323 - RNA, 12 nt, Haemophilus influenzae Rd
ugcuuuuucauc

SEQ ID NO: 2733324 - RNA, 17 nt, Haemophilus influenzae Rd
ugcuuuuuuaaucaauu

SEQ ID NO: 2733325 - RNA, 14 nt, Haemophilus influenzae Rd
ugcuuuuuucaaug

SEQ ID NO: 2733326 - RNA, 17 nt, Haemophilus influenzae Rd
uggaaaauaaaaugaca

SEQ ID NO: 2733327 - RNA, 20 nt, Haemophilus influenzae Rd
uggaaaccauugaugaaaug

SEQ ID NO: 2733328 - RNA, 23 nt, Haemophilus influenzae Rd
uggaaaccugcaaggauauuucc

SEQ ID NO: 2733329 - RNA, 23 nt, Haemophilus influenzae Rd
uggaaacgguuaauaaauucuug

SEQ ID NO: 2733330 - RNA, 15 nt, Haemophilus influenzae Rd
uggaaacgugcaauu

SEQ ID NO: 2733331 - RNA, 14 nt, Haemophilus influenzae Rd
uggaaauaaauccu

SEQ ID NO: 2733332 - RNA, 18 nt, Haemophilus influenzae Rd
uggaaauaauauucaaaa

SEQ ID NO: 2733333 - RNA, 19 nt, Haemophilus influenzae Rd
uggaaauaauauucaaaac

SEQ ID NO: 2733334 - RNA, 12 nt, Haemophilus influenzae Rd
uggaaaugagua

SEQ ID NO: 2733335 - RNA, 13 nt, Haemophilus influenzae Rd
uggaaaugcuuaa

SEQ ID NO: 2733336 - RNA, 19 nt, Haemophilus influenzae Rd
uggaaaugcuuaaucggca

SEQ ID NO: 2733337 - RNA, 12 nt, Haemophilus influenzae Rd
uggaaauguuua

SEQ ID NO: 2733338 - RNA, 16 nt, Haemophilus influenzae Rd
uggaaauguuuaauua

SEQ ID NO: 2733339 - RNA, 14 nt, Haemophilus influenzae Rd
uggaaauucuucaa

SEQ ID NO: 2733340 - RNA, 18 nt, Haemophilus influenzae Rd
uggaaauuuaagugagua

SEQ ID NO: 2733341 - RNA, 20 nt, Haemophilus influenzae Rd
uggaacgauuaaaaaugcuu

SEQ ID NO: 2733342 - RNA, 21 nt, Haemophilus influenzae Rd
uggaacuggaccuaaucccau

SEQ ID NO: 2733343 - RNA, 12 nt, Haemophilus influenzae Rd
uggaacuucuaa

SEQ ID NO: 2733344 - RNA, 23 nt, Haemophilus influenzae Rd
uggaacuuguuuuccaaacauuu

SEQ ID NO: 2733345 - RNA, 17 nt, Haemophilus influenzae Rd
uggaagaaaagcauuaa

SEQ ID NO: 2733346 - RNA, 17 nt, Haemophilus influenzae Rd
uggaagaucaguuacca

SEQ ID NO: 2733347 - RNA, 16 nt, Haemophilus influenzae Rd
uggaauaaaagucagu

SEQ ID NO: 2733348 - RNA, 23 nt, Haemophilus influenzae Rd
uggaauaaaagucaguaaaccaa

SEQ ID NO: 2733349 - RNA, 22 nt, Haemophilus influenzae Rd
uggaauaaagcaaccaaugcaa

SEQ ID NO: 2733350 - RNA, 18 nt, Haemophilus influenzae Rd
uggaauaccagaggaaua

SEQ ID NO: 2733351 - RNA, 20 nt, Haemophilus influenzae Rd
uggaauauggaaaugcuuaa

SEQ ID NO: 2733352 - RNA, 14 nt, Haemophilus influenzae Rd
uggaauauuuuucu

SEQ ID NO: 2733353 - RNA, 16 nt, Haemophilus influenzae Rd
uggaaugagcauaauc

SEQ ID NO: 2733354 - RNA, 20 nt, Haemophilus influenzae Rd
uggaauggauguaaugagca

SEQ ID NO: 2733355 - RNA, 15 nt, Haemophilus influenzae Rd
uggaauggcaaaauu

SEQ ID NO: 2733356 - RNA, 22 nt, Haemophilus influenzae Rd
uggaaugguaguggcaauccaa

SEQ ID NO: 2733357 - RNA, 12 nt, Haemophilus influenzae Rd
uggaauguaaaa

SEQ ID NO: 2733358 - RNA, 11 nt, Haemophilus influenzae Rd
uggaauuugua

SEQ ID NO: 2733359 - RNA, 18 nt, Haemophilus influenzae Rd
uggacagaauaacuagca

SEQ ID NO: 2733360 - RNA, 19 nt, Haemophilus influenzae Rd
uggacauuguuguuuaaua

SEQ ID NO: 2733361 - RNA, 15 nt, Haemophilus influenzae Rd
uggacugaaggugcg

SEQ ID NO: 2733362 - RNA, 18 nt, Haemophilus influenzae Rd
uggagaaacauuuuuccc

SEQ ID NO: 2733363 - RNA, 20 nt, Haemophilus influenzae Rd
uggagaaaugucguaagaac

SEQ ID NO: 2733364 - RNA, 23 nt, Haemophilus influenzae Rd
uggagaacuucaaauuguacuuu

SEQ ID NO: 2733365 - RNA, 19 nt, Haemophilus influenzae Rd
uggagauaaauaaaguuau

SEQ ID NO: 2733366 - RNA, 19 nt, Haemophilus influenzae Rd
uggaggauuaauuacgccu

SEQ ID NO: 2733367 - RNA, 21 nt, Haemophilus influenzae Rd
uggaguuauuucuuuaaaugg

SEQ ID NO: 2733368 - RNA, 17 nt, Haemophilus influenzae Rd
uggaguucuugaauaca

SEQ ID NO: 2733369 - RNA, 19 nt, Haemophilus influenzae Rd
uggauaauguucuuuuaaa

SEQ ID NO: 2733370 - RNA, 19 nt, Haemophilus influenzae Rd
uggauaauucaucaaaauu

SEQ ID NO: 2733371 - RNA, 15 nt, Haemophilus influenzae Rd
uggauacacaaauug

SEQ ID NO: 2733372 - RNA, 15 nt, Haemophilus influenzae Rd
uggauauagaaauca

SEQ ID NO: 2733373 - RNA, 16 nt, Haemophilus influenzae Rd
uggauauagaaaucau

SEQ ID NO: 2733374 - RNA, 16 nt, Haemophilus influenzae Rd
uggaucacccauuaaa

SEQ ID NO: 2733375 - RNA, 14 nt, Haemophilus influenzae Rd
uggaucuaaaaaau

SEQ ID NO: 2733376 - RNA, 16 nt, Haemophilus influenzae Rd
uggaucuucagcauuu

SEQ ID NO: 2733377 - RNA, 21 nt, Haemophilus influenzae Rd
uggaucuuccaauaauucuuu

SEQ ID NO: 2733378 - RNA, 14 nt, Haemophilus influenzae Rd
uggaugaaaucaaa

SEQ ID NO: 2733379 - RNA, 18 nt, Haemophilus influenzae Rd
uggaugcccaagugcgau

SEQ ID NO: 2733380 - RNA, 19 nt, Haemophilus influenzae Rd
uggauggagagaauagcua

SEQ ID NO: 2733381 - RNA, 16 nt, Haemophilus influenzae Rd
uggauguaaugagcac

SEQ ID NO: 2733382 - RNA, 15 nt, Haemophilus influenzae Rd
uggauuaaacaacca

SEQ ID NO: 2733383 - RNA, 22 nt, Haemophilus influenzae Rd
uggauuaauuggcgaaggcaaa

SEQ ID NO: 2733384 - RNA, 15 nt, Haemophilus influenzae Rd
uggauuagagccauc

SEQ ID NO: 2733385 - RNA, 23 nt, Haemophilus influenzae Rd
uggauucauuaaguuuucuacag

SEQ ID NO: 2733386 - RNA, 16 nt, Haemophilus influenzae Rd
uggauuccaucauugu

SEQ ID NO: 2733387 - RNA, 16 nt, Haemophilus influenzae Rd
uggauuggauuuugaa

SEQ ID NO: 2733388 - RNA, 12 nt, Haemophilus influenzae Rd
uggauuggcaau

SEQ ID NO: 2733389 - RNA, 18 nt, Haemophilus influenzae Rd
uggauuuguugugaaaac

SEQ ID NO: 2733390 - RNA, 13 nt, Haemophilus influenzae Rd
uggcaaaagauca

SEQ ID NO: 2733391 - RNA, 17 nt, Haemophilus influenzae Rd
uggcaaacaaaauaaau

SEQ ID NO: 2733392 - RNA, 17 nt, Haemophilus influenzae Rd
uggcaaacucuugugcc

SEQ ID NO: 2733393 - RNA, 15 nt, Haemophilus influenzae Rd
uggcaaagaauacac

SEQ ID NO: 2733394 - RNA, 13 nt, Haemophilus influenzae Rd
uggcaacccacuu

SEQ ID NO: 2733395 - RNA, 16 nt, Haemophilus influenzae Rd
uggcaacgccaauaaa

SEQ ID NO: 2733396 - RNA, 19 nt, Haemophilus influenzae Rd
uggcaaggucgugcucuac

SEQ ID NO: 2733397 - RNA, 22 nt, Haemophilus influenzae Rd
uggcaauaauguugcugauugc

SEQ ID NO: 2733398 - RNA, 19 nt, Haemophilus influenzae Rd
uggcaauaugcacuaacac

SEQ ID NO: 2733399 - RNA, 12 nt, Haemophilus influenzae Rd
uggcaauauuaa

SEQ ID NO: 2733400 - RNA, 20 nt, Haemophilus influenzae Rd
uggcaaucacaguuuuauuu

SEQ ID NO: 2733401 - RNA, 17 nt, Haemophilus influenzae Rd
uggcaaucguucuaaaa

SEQ ID NO: 2733402 - RNA, 18 nt, Haemophilus influenzae Rd
uggcaaucguucuaaaau

SEQ ID NO: 2733403 - RNA, 15 nt, Haemophilus influenzae Rd
uggcaaugaauaaac

SEQ ID NO: 2733404 - RNA, 20 nt, Haemophilus influenzae Rd
uggcaauuacgacauucuuu

SEQ ID NO: 2733405 - RNA, 22 nt, Haemophilus influenzae Rd
uggcaauuacgacauucuuuag

SEQ ID NO: 2733406 - RNA, 19 nt, Haemophilus influenzae Rd
uggcaauucgugaagugau

SEQ ID NO: 2733407 - RNA, 21 nt, Haemophilus influenzae Rd
uggcacaucaaauucuaaaac

SEQ ID NO: 2733408 - RNA, 20 nt, Haemophilus influenzae Rd
uggcacuaaagcaauauuua

SEQ ID NO: 2733409 - RNA, 18 nt, Haemophilus influenzae Rd
uggcacuggaaauggcua

SEQ ID NO: 2733410 - RNA, 14 nt, Haemophilus influenzae Rd
uggcaguuuggaaa

SEQ ID NO: 2733411 - RNA, 16 nt, Haemophilus influenzae Rd
uggcaguuuggaaaga

SEQ ID NO: 2733412 - RNA, 14 nt, Haemophilus influenzae Rd
uggcauaauuuggu

SEQ ID NO: 2733413 - RNA, 12 nt, Haemophilus influenzae Rd
uggcauacuuaa

SEQ ID NO: 2733414 - RNA, 15 nt, Haemophilus influenzae Rd
uggcauagaaacaac

SEQ ID NO: 2733415 - RNA, 19 nt, Haemophilus influenzae Rd
uggcauaucagcaucaauu

SEQ ID NO: 2733416 - RNA, 23 nt, Haemophilus influenzae Rd
uggcaucaaaacguucuaagaau

SEQ ID NO: 2733417 - RNA, 22 nt, Haemophilus influenzae Rd
uggcauuagcguaguauggcaa

SEQ ID NO: 2733418 - RNA, 13 nt, Haemophilus influenzae Rd
uggcauuugcaua

SEQ ID NO: 2733419 - RNA, 15 nt, Haemophilus influenzae Rd
uggcauuuucaaucc

SEQ ID NO: 2733420 - RNA, 17 nt, Haemophilus influenzae Rd
uggcauuuuguaagcaa

SEQ ID NO: 2733421 - RNA, 23 nt, Haemophilus influenzae Rd
uggcauuuuguaagcaacacaga

SEQ ID NO: 2733422 - RNA, 23 nt, Haemophilus influenzae Rd
uggcccugaaagucgauucaaau

SEQ ID NO: 2733423 - RNA, 16 nt, Haemophilus influenzae Rd
uggcgaaaaucaucau

SEQ ID NO: 2733424 - RNA, 16 nt, Haemophilus influenzae Rd
uggcgaaggcaaauca

SEQ ID NO: 2733425 - RNA, 23 nt, Haemophilus influenzae Rd
uggcgaccgcccucuugcacaau

SEQ ID NO: 2733426 - RNA, 19 nt, Haemophilus influenzae Rd
uggcgcacccgaaaggauu

SEQ ID NO: 2733427 - RNA, 18 nt, Haemophilus influenzae Rd
uggcguaaucguagaaau

SEQ ID NO: 2733428 - RNA, 19 nt, Haemophilus influenzae Rd
uggcguaaugccaucacca

SEQ ID NO: 2733429 - RNA, 17 nt, Haemophilus influenzae Rd
uggcguuuuuuauaaac

SEQ ID NO: 2733430 - RNA, 19 nt, Haemophilus influenzae Rd
uggcuaaaccgauuuugac

SEQ ID NO: 2733431 - RNA, 13 nt, Haemophilus influenzae Rd
uggcuaaauucac

SEQ ID NO: 2733432 - RNA, 13 nt, Haemophilus influenzae Rd
uggcuaacaaaua

SEQ ID NO: 2733433 - RNA, 17 nt, Haemophilus influenzae Rd
uggcuaacaaauaaugc

SEQ ID NO: 2733434 - RNA, 15 nt, Haemophilus influenzae Rd
uggcuaacaccauug

SEQ ID NO: 2733435 - RNA, 22 nt, Haemophilus influenzae Rd
uggcuauuaugaggaauuuguu

SEQ ID NO: 2733436 - RNA, 20 nt, Haemophilus influenzae Rd
uggcuauugaaaauuauugu

SEQ ID NO: 2733437 - RNA, 14 nt, Haemophilus influenzae Rd
uggcucaaguauuc

SEQ ID NO: 2733438 - RNA, 14 nt, Haemophilus influenzae Rd
uggcucauuuuaaa

SEQ ID NO: 2733439 - RNA, 19 nt, Haemophilus influenzae Rd
uggcucuaaauuaauuuac

SEQ ID NO: 2733440 - RNA, 17 nt, Haemophilus influenzae Rd
uggcucuucuuguucaa

SEQ ID NO: 2733441 - RNA, 16 nt, Haemophilus influenzae Rd
uggcugaaauucuaaa

SEQ ID NO: 2733442 - RNA, 18 nt, Haemophilus influenzae Rd
uggcugaaauucuaaaaa

SEQ ID NO: 2733443 - RNA, 19 nt, Haemophilus influenzae Rd
uggcugaaauucuaaaaaa

SEQ ID NO: 2733444 - RNA, 16 nt, Haemophilus influenzae Rd
uggcugagagaagaaa

SEQ ID NO: 2733445 - RNA, 23 nt, Haemophilus influenzae Rd
uggcugggauuucaaacaauaug

SEQ ID NO: 2733446 - RNA, 16 nt, Haemophilus influenzae Rd
uggcuguguaaaacau

SEQ ID NO: 2733447 - RNA, 14 nt, Haemophilus influenzae Rd
uggcuguuguuuug

SEQ ID NO: 2733448 - RNA, 16 nt, Haemophilus influenzae Rd
uggcuucaucuuuuaa

SEQ ID NO: 2733449 - RNA, 12 nt, Haemophilus influenzae Rd
uggcuuccaaca

SEQ ID NO: 2733450 - RNA, 14 nt, Haemophilus influenzae Rd
uggcuuccaacaua

SEQ ID NO: 2733451 - RNA, 14 nt, Haemophilus influenzae Rd
uggcuugaaaauau

SEQ ID NO: 2733452 - RNA, 16 nt, Haemophilus influenzae Rd
uggcuuuaaagguuua

SEQ ID NO: 2733453 - RNA, 18 nt, Haemophilus influenzae Rd
uggcuuuucucaaaacau

SEQ ID NO: 2733454 - RNA, 17 nt, Haemophilus influenzae Rd
uggcuuuucugauaauu

SEQ ID NO: 2733455 - RNA, 21 nt, Haemophilus influenzae Rd
ugggaaauggcuuuucaauuu

SEQ ID NO: 2733456 - RNA, 17 nt, Haemophilus influenzae Rd
ugggaauaauuuuggau

SEQ ID NO: 2733457 - RNA, 19 nt, Haemophilus influenzae Rd
ugggacuggacuccaaggc

SEQ ID NO: 2733458 - RNA, 19 nt, Haemophilus influenzae Rd
ugggagaacuuuuaaaaca

SEQ ID NO: 2733459 - RNA, 14 nt, Haemophilus influenzae Rd
ugggauaaacauuu

SEQ ID NO: 2733460 - RNA, 16 nt, Haemophilus influenzae Rd
ugggauagauuuuuua

SEQ ID NO: 2733461 - RNA, 16 nt, Haemophilus influenzae Rd
ugggauauuccaaggu

SEQ ID NO: 2733462 - RNA, 16 nt, Haemophilus influenzae Rd
ugggaugaaaucaaaa

SEQ ID NO: 2733463 - RNA, 21 nt, Haemophilus influenzae Rd
ugggcaagucccuguucaaau

SEQ ID NO: 2733464 - RNA, 23 nt, Haemophilus influenzae Rd
ugggcauccaaaguacacaagaa

SEQ ID NO: 2733465 - RNA, 23 nt, Haemophilus influenzae Rd
ugggccacgagcgugaaguuuuu

SEQ ID NO: 2733466 - RNA, 14 nt, Haemophilus influenzae Rd
ugggccucuuuauc

SEQ ID NO: 2733467 - RNA, 17 nt, Haemophilus influenzae Rd
ugggcggcuuguugaaa

SEQ ID NO: 2733468 - RNA, 21 nt, Haemophilus influenzae Rd
ugggcuaacauugcaucagcc

SEQ ID NO: 2733469 - RNA, 15 nt, Haemophilus influenzae Rd
ugggcugaagcccac

SEQ ID NO: 2733470 - RNA, 14 nt, Haemophilus influenzae Rd
uggggaaaaauauu

SEQ ID NO: 2733471 - RNA, 19 nt, Haemophilus influenzae Rd
uggggaaaaauauuaaaga

SEQ ID NO: 2733472 - RNA, 16 nt, Haemophilus influenzae Rd
uggggaaguaauauuu

SEQ ID NO: 2733473 - RNA, 17 nt, Haemophilus influenzae Rd
uggggaaguaauauuuc

SEQ ID NO: 2733474 - RNA, 19 nt, Haemophilus influenzae Rd
uggggcuuuuuuuuauuca

SEQ ID NO: 2733475 - RNA, 17 nt, Haemophilus influenzae Rd
ugggucguuagcucagu

SEQ ID NO: 2733476 - RNA, 12 nt, Haemophilus influenzae Rd
uggguuaaaagc

SEQ ID NO: 2733477 - RNA, 18 nt, Haemophilus influenzae Rd
uggguuaaaagccaauau

SEQ ID NO: 2733478 - RNA, 12 nt, Haemophilus influenzae Rd
uggguuguggug

SEQ ID NO: 2733479 - RNA, 13 nt, Haemophilus influenzae Rd
ugguaaaauccgc

SEQ ID NO: 2733480 - RNA, 13 nt, Haemophilus influenzae Rd
ugguaaauacugu

SEQ ID NO: 2733481 - RNA, 16 nt, Haemophilus influenzae Rd
ugguaaauacuguuga

SEQ ID NO: 2733482 - RNA, 12 nt, Haemophilus influenzae Rd
ugguaaauauug

SEQ ID NO: 2733483 - RNA, 13 nt, Haemophilus influenzae Rd
ugguaaauuuuaa

SEQ ID NO: 2733484 - RNA, 14 nt, Haemophilus influenzae Rd
ugguaauaaaucaa

SEQ ID NO: 2733485 - RNA, 20 nt, Haemophilus influenzae Rd
ugguaauaaaucaaaagaau

SEQ ID NO: 2733486 - RNA, 21 nt, Haemophilus influenzae Rd
ugguaauaaaucaaaagaauu

SEQ ID NO: 2733487 - RNA, 14 nt, Haemophilus influenzae Rd
ugguaauaaucaau

SEQ ID NO: 2733488 - RNA, 15 nt, Haemophilus influenzae Rd
ugguaauaaucaauu

SEQ ID NO: 2733489 - RNA, 20 nt, Haemophilus influenzae Rd
ugguaaugcacguucuaaug

SEQ ID NO: 2733490 - RNA, 18 nt, Haemophilus influenzae Rd
ugguaauugcccaauaaa

SEQ ID NO: 2733491 - RNA, 20 nt, Haemophilus influenzae Rd
ugguaauuugcgucuuaaau

SEQ ID NO: 2733492 - RNA, 16 nt, Haemophilus influenzae Rd
ugguaauuuuggcgaa

SEQ ID NO: 2733493 - RNA, 13 nt, Haemophilus influenzae Rd
ugguacaaauuua

SEQ ID NO: 2733494 - RNA, 21 nt, Haemophilus influenzae Rd
ugguacauguugggcuaaaaa

SEQ ID NO: 2733495 - RNA, 15 nt, Haemophilus influenzae Rd
ugguacgagaaaaau

SEQ ID NO: 2733496 - RNA, 23 nt, Haemophilus influenzae Rd
ugguaguggcaauccaacagcuu

SEQ ID NO: 2733497 - RNA, 17 nt, Haemophilus influenzae Rd
ugguaugguuuuccaaa

SEQ ID NO: 2733498 - RNA, 19 nt, Haemophilus influenzae Rd
ugguaugguuuuccaaaaa

SEQ ID NO: 2733499 - RNA, 17 nt, Haemophilus influenzae Rd
ugguauuuacuaaauuc

SEQ ID NO: 2733500 - RNA, 22 nt, Haemophilus influenzae Rd
ugguauuuacuaaauucuuuug

SEQ ID NO: 2733501 - RNA, 24 nt, Haemophilus influenzae Rd
uggucaaagauguuccuacagaac

SEQ ID NO: 2733502 - RNA, 20 nt, Haemophilus influenzae Rd
uggucaauuagcaaagaauu

SEQ ID NO: 2733503 - RNA, 20 nt, Haemophilus influenzae Rd
uggucacgauuuuuuuauaa

SEQ ID NO: 2733504 - RNA, 16 nt, Haemophilus influenzae Rd
uggucgcaacaaacau

SEQ ID NO: 2733505 - RNA, 14 nt, Haemophilus influenzae Rd
uggucuguuucuuc

SEQ ID NO: 2733506 - RNA, 16 nt, Haemophilus influenzae Rd
uggucuguuucuucua

SEQ ID NO: 2733507 - RNA, 21 nt, Haemophilus influenzae Rd
uggugaaaucaacaauccauu

SEQ ID NO: 2733508 - RNA, 22 nt, Haemophilus influenzae Rd
uggugacgagaacuuuugaauu

SEQ ID NO: 2733509 - RNA, 22 nt, Haemophilus influenzae Rd
uggugacuugcgcauccguacu

SEQ ID NO: 2733510 - RNA, 21 nt, Haemophilus influenzae Rd
uggugauuuuaguuucuaauu

SEQ ID NO: 2733511 - RNA, 23 nt, Haemophilus influenzae Rd
uggugcaacgacaaucacuggca

SEQ ID NO: 2733512 - RNA, 23 nt, Haemophilus influenzae Rd
uggugcauguuuacuuaaaucuu

SEQ ID NO: 2733513 - RNA, 17 nt, Haemophilus influenzae Rd
uggugcgaccucgccau

SEQ ID NO: 2733514 - RNA, 21 nt, Haemophilus influenzae Rd
ugguggaagcuucauauaauc

SEQ ID NO: 2733515 - RNA, 15 nt, Haemophilus influenzae Rd
ugguggauuauaaac

SEQ ID NO: 2733516 - RNA, 19 nt, Haemophilus influenzae Rd
ugguguggagaaagaaauc

SEQ ID NO: 2733517 - RNA, 18 nt, Haemophilus influenzae Rd
ugguuaaaaauagccuca

SEQ ID NO: 2733518 - RNA, 13 nt, Haemophilus influenzae Rd
ugguuaaaauauu

SEQ ID NO: 2733519 - RNA, 23 nt, Haemophilus influenzae Rd
ugguucaauuuuaauugguuuug

SEQ ID NO: 2733520 - RNA, 11 nt, Haemophilus influenzae Rd
ugguucacgau

SEQ ID NO: 2733521 - RNA, 17 nt, Haemophilus influenzae Rd
ugguucagauuucuucg

SEQ ID NO: 2733522 - RNA, 13 nt, Haemophilus influenzae Rd
ugguucauagcug

SEQ ID NO: 2733523 - RNA, 16 nt, Haemophilus influenzae Rd
ugguucauaugcgauc

SEQ ID NO: 2733524 - RNA, 21 nt, Haemophilus influenzae Rd
ugguucauaugcgaucacugc

SEQ ID NO: 2733525 - RNA, 14 nt, Haemophilus influenzae Rd
ugguucauuauuaa

SEQ ID NO: 2733526 - RNA, 14 nt, Haemophilus influenzae Rd
ugguucauuuguug

SEQ ID NO: 2733527 - RNA, 19 nt, Haemophilus influenzae Rd
ugguucgagaaacuuucaa

SEQ ID NO: 2733528 - RNA, 20 nt, Haemophilus influenzae Rd
ugguucgagaaacuuucaaa

SEQ ID NO: 2733529 - RNA, 24 nt, Haemophilus influenzae Rd
ugguucgauuucaucuucauucca

SEQ ID NO: 2733530 - RNA, 23 nt, Haemophilus influenzae Rd
ugguucgcauaucgauaauuuaa

SEQ ID NO: 2733531 - RNA, 11 nt, Haemophilus influenzae Rd
ugguucugcag

SEQ ID NO: 2733532 - RNA, 16 nt, Haemophilus influenzae Rd
ugguugaguucuugca

SEQ ID NO: 2733533 - RNA, 20 nt, Haemophilus influenzae Rd
ugguugcauaaaaucuucua

SEQ ID NO: 2733534 - RNA, 19 nt, Haemophilus influenzae Rd
ugguuguaaauuuucaaua

SEQ ID NO: 2733535 - RNA, 15 nt, Haemophilus influenzae Rd
ugguuguaauaauga

SEQ ID NO: 2733536 - RNA, 15 nt, Haemophilus influenzae Rd
ugguuuaaauuuuaa

SEQ ID NO: 2733537 - RNA, 18 nt, Haemophilus influenzae Rd
ugguuuaaauuuuaaaaa

SEQ ID NO: 2733538 - RNA, 20 nt, Haemophilus influenzae Rd
ugguuuaguuuacuuuugau

SEQ ID NO: 2733539 - RNA, 16 nt, Haemophilus influenzae Rd
ugguuuauaacaaguu

SEQ ID NO: 2733540 - RNA, 19 nt, Haemophilus influenzae Rd
ugguuuaugccauagcucc

SEQ ID NO: 2733541 - RNA, 13 nt, Haemophilus influenzae Rd
ugguuucuguugc

SEQ ID NO: 2733542 - RNA, 19 nt, Haemophilus influenzae Rd
ugguuugacauauuuucua

SEQ ID NO: 2733543 - RNA, 21 nt, Haemophilus influenzae Rd
ugguuuucuugccaaaauuca

SEQ ID NO: 2733544 - RNA, 22 nt, Haemophilus influenzae Rd
uguaaaaaauccucaaaaacaa

SEQ ID NO: 2733545 - RNA, 19 nt, Haemophilus influenzae Rd
uguaaaaaaucuuuaagug

SEQ ID NO: 2733546 - RNA, 15 nt, Haemophilus influenzae Rd
uguaaaacauuucau

SEQ ID NO: 2733547 - RNA, 16 nt, Haemophilus influenzae Rd
uguaaaaccgcaucca

SEQ ID NO: 2733548 - RNA, 16 nt, Haemophilus influenzae Rd
uguaaaagauaaaaca

SEQ ID NO: 2733549 - RNA, 23 nt, Haemophilus influenzae Rd
uguaaaagugcgguugauuuucc

SEQ ID NO: 2733550 - RNA, 18 nt, Haemophilus influenzae Rd
uguaaaaucucuauugcu

SEQ ID NO: 2733551 - RNA, 14 nt, Haemophilus influenzae Rd
uguaaacaaaaaua

SEQ ID NO: 2733552 - RNA, 17 nt, Haemophilus influenzae Rd
uguaaacaagauucuga

SEQ ID NO: 2733553 - RNA, 23 nt, Haemophilus influenzae Rd
uguaaacaagauucugaaagaua

SEQ ID NO: 2733554 - RNA, 21 nt, Haemophilus influenzae Rd
uguaaaccaaauuucuugcua

SEQ ID NO: 2733555 - RNA, 16 nt, Haemophilus influenzae Rd
uguaaacugcuuucaa

SEQ ID NO: 2733556 - RNA, 24 nt, Haemophilus influenzae Rd
uguaaagcccacaugaacaagcac

SEQ ID NO: 2733557 - RNA, 23 nt, Haemophilus influenzae Rd
uguaaauggcguuuugcgugauu

SEQ ID NO: 2733558 - RNA, 22 nt, Haemophilus influenzae Rd
uguaaauugacggcuucagaaa

SEQ ID NO: 2733559 - RNA, 17 nt, Haemophilus influenzae Rd
uguaacaguauauccug

SEQ ID NO: 2733560 - RNA, 21 nt, Haemophilus influenzae Rd
uguaaccaagcuguaccagcg

SEQ ID NO: 2733561 - RNA, 22 nt, Haemophilus influenzae Rd
uguaagacgcauuacgccuuca

SEQ ID NO: 2733562 - RNA, 19 nt, Haemophilus influenzae Rd
uguaagcagcuaacaaaau

SEQ ID NO: 2733563 - RNA, 19 nt, Haemophilus influenzae Rd
uguaagccaaauaaugcau

SEQ ID NO: 2733564 - RNA, 17 nt, Haemophilus influenzae Rd
uguaaggcgagaucuug

SEQ ID NO: 2733565 - RNA, 18 nt, Haemophilus influenzae Rd
uguaaguagcguaaaccu

SEQ ID NO: 2733566 - RNA, 15 nt, Haemophilus influenzae Rd
uguaauaaaaaauac

SEQ ID NO: 2733567 - RNA, 21 nt, Haemophilus influenzae Rd
uguaauaaauuuuauuauguu

SEQ ID NO: 2733568 - RNA, 18 nt, Haemophilus influenzae Rd
uguaauauaugaaaaaua

SEQ ID NO: 2733569 - RNA, 19 nt, Haemophilus influenzae Rd
uguaauauaugaaaaauaa

SEQ ID NO: 2733570 - RNA, 14 nt, Haemophilus influenzae Rd
uguaauccugcauu

SEQ ID NO: 2733571 - RNA, 21 nt, Haemophilus influenzae Rd
uguaauccuuuuguuuuauca

SEQ ID NO: 2733572 - RNA, 23 nt, Haemophilus influenzae Rd
uguaauccuuuuguuuuaucaga

SEQ ID NO: 2733573 - RNA, 23 nt, Haemophilus influenzae Rd
uguaaucuacagggcuuaguccu

SEQ ID NO: 2733574 - RNA, 16 nt, Haemophilus influenzae Rd
uguaaugcaaaccauu

SEQ ID NO: 2733575 - RNA, 18 nt, Haemophilus influenzae Rd
uguaaugcuugaacaaaa

SEQ ID NO: 2733576 - RNA, 19 nt, Haemophilus influenzae Rd
uguaauguuuuaauacuuu

SEQ ID NO: 2733577 - RNA, 12 nt, Haemophilus influenzae Rd
uguaauucugcu

SEQ ID NO: 2733578 - RNA, 14 nt, Haemophilus influenzae Rd
uguaauugauuuuc

SEQ ID NO: 2733579 - RNA, 21 nt, Haemophilus influenzae Rd
uguaauugcgcccccccagcg

SEQ ID NO: 2733580 - RNA, 13 nt, Haemophilus influenzae Rd
uguaauuguugaa

SEQ ID NO: 2733581 - RNA, 23 nt, Haemophilus influenzae Rd
uguaauuuuaccuguaauccuuu

SEQ ID NO: 2733582 - RNA, 15 nt, Haemophilus influenzae Rd
uguaauuuuuucucu

SEQ ID NO: 2733583 - RNA, 14 nt, Haemophilus influenzae Rd
uguacaagugcuac

SEQ ID NO: 2733584 - RNA, 14 nt, Haemophilus influenzae Rd
uguacacaaugcua

SEQ ID NO: 2733585 - RNA, 12 nt, Haemophilus influenzae Rd
uguacacacacc

SEQ ID NO: 2733586 - RNA, 17 nt, Haemophilus influenzae Rd
uguacaccaaaauaacc

SEQ ID NO: 2733587 - RNA, 17 nt, Haemophilus influenzae Rd
uguaccauacuugccac

SEQ ID NO: 2733588 - RNA, 17 nt, Haemophilus influenzae Rd
uguacgccacauacauc

SEQ ID NO: 2733589 - RNA, 19 nt, Haemophilus influenzae Rd
uguacgccaugccaagcua

SEQ ID NO: 2733590 - RNA, 17 nt, Haemophilus influenzae Rd
uguacuaacgaacaagc

SEQ ID NO: 2733591 - RNA, 14 nt, Haemophilus influenzae Rd
uguacuagauaacu

SEQ ID NO: 2733592 - RNA, 16 nt, Haemophilus influenzae Rd
uguacuagauaacuag

SEQ ID NO: 2733593 - RNA, 23 nt, Haemophilus influenzae Rd
uguacuauuuuauaaucuuuaaa

SEQ ID NO: 2733594 - RNA, 13 nt, Haemophilus influenzae Rd
uguacucaauaag

SEQ ID NO: 2733595 - RNA, 14 nt, Haemophilus influenzae Rd
uguacucaauaagg

SEQ ID NO: 2733596 - RNA, 19 nt, Haemophilus influenzae Rd
uguagaaaggcaauauuuu

SEQ ID NO: 2733597 - RNA, 23 nt, Haemophilus influenzae Rd
uguagagcucaauuauuuauacu

SEQ ID NO: 2733598 - RNA, 19 nt, Haemophilus influenzae Rd
uguagauaaaauauucaaa

SEQ ID NO: 2733599 - RNA, 20 nt, Haemophilus influenzae Rd
uguagauaaaauauucaaac

SEQ ID NO: 2733600 - RNA, 23 nt, Haemophilus influenzae Rd
uguagaucagccccuuaauuauu

SEQ ID NO: 2733601 - RNA, 22 nt, Haemophilus influenzae Rd
uguagauuaucugaggauuaaa

SEQ ID NO: 2733602 - RNA, 23 nt, Haemophilus influenzae Rd
uguagcaauaaacagaaauauug

SEQ ID NO: 2733603 - RNA, 16 nt, Haemophilus influenzae Rd
uguagccuguuucaca

SEQ ID NO: 2733604 - RNA, 15 nt, Haemophilus influenzae Rd
uguagcugaaacuaa

SEQ ID NO: 2733605 - RNA, 17 nt, Haemophilus influenzae Rd
uguagcuugaauauuug

SEQ ID NO: 2733606 - RNA, 23 nt, Haemophilus influenzae Rd
uguagcuugaauauuugggaaau

SEQ ID NO: 2733607 - RNA, 14 nt, Haemophilus influenzae Rd
uguaggcaaaaaca

SEQ ID NO: 2733608 - RNA, 15 nt, Haemophilus influenzae Rd
uguaggcaaaaacac

SEQ ID NO: 2733609 - RNA, 23 nt, Haemophilus influenzae Rd
uguaggcaaaaacacucucagaa

SEQ ID NO: 2733610 - RNA, 23 nt, Haemophilus influenzae Rd
uguaguuagaccaucuaaaccug

SEQ ID NO: 2733611 - RNA, 19 nt, Haemophilus influenzae Rd
uguaguugugauuuucagc

SEQ ID NO: 2733612 - RNA, 18 nt, Haemophilus influenzae Rd
uguaguuuaggaaguaaa

SEQ ID NO: 2733613 - RNA, 22 nt, Haemophilus influenzae Rd
uguaguuuaggaaguaaauagu

SEQ ID NO: 2733614 - RNA, 12 nt, Haemophilus influenzae Rd
uguauaaauauu

SEQ ID NO: 2733615 - RNA, 18 nt, Haemophilus influenzae Rd
uguauaagauuaaugaua

SEQ ID NO: 2733616 - RNA, 22 nt, Haemophilus influenzae Rd
uguauaagauuaaugauaaguu

SEQ ID NO: 2733617 - RNA, 18 nt, Haemophilus influenzae Rd
uguauaauuccuaaaaua

SEQ ID NO: 2733618 - RNA, 20 nt, Haemophilus influenzae Rd
uguauaauuccuaaaauaca

SEQ ID NO: 2733619 - RNA, 15 nt, Haemophilus influenzae Rd
uguauaccaaccauu

SEQ ID NO: 2733620 - RNA, 21 nt, Haemophilus influenzae Rd
uguauaguauagcuuugcuuu

SEQ ID NO: 2733621 - RNA, 14 nt, Haemophilus influenzae Rd
uguauauauuuucc

SEQ ID NO: 2733622 - RNA, 12 nt, Haemophilus influenzae Rd
uguauccacaaa

SEQ ID NO: 2733623 - RNA, 18 nt, Haemophilus influenzae Rd
uguaucuaaauauauuuu

SEQ ID NO: 2733624 - RNA, 16 nt, Haemophilus influenzae Rd
uguauguuggcgaauu

SEQ ID NO: 2733625 - RNA, 23 nt, Haemophilus influenzae Rd
uguauuaaagguuauuucuugcc

SEQ ID NO: 2733626 - RNA, 16 nt, Haemophilus influenzae Rd
uguauuaaguaaauau

SEQ ID NO: 2733627 - RNA, 18 nt, Haemophilus influenzae Rd
uguauuaaguaaauauuu

SEQ ID NO: 2733628 - RNA, 22 nt, Haemophilus influenzae Rd
uguauuaaguaaauauuuuuua

SEQ ID NO: 2733629 - RNA, 20 nt, Haemophilus influenzae Rd
uguauuagguaaauuugguu

SEQ ID NO: 2733630 - RNA, 14 nt, Haemophilus influenzae Rd
uguauuaucuaauu

SEQ ID NO: 2733631 - RNA, 17 nt, Haemophilus influenzae Rd
uguauuaucuaauuauu

SEQ ID NO: 2733632 - RNA, 15 nt, Haemophilus influenzae Rd
uguauucgugaaucg

SEQ ID NO: 2733633 - RNA, 22 nt, Haemophilus influenzae Rd
uguauuucgucuuaauuuuuua

SEQ ID NO: 2733634 - RNA, 18 nt, Haemophilus influenzae Rd
uguauuuuucauaucuuc

SEQ ID NO: 2733635 - RNA, 14 nt, Haemophilus influenzae Rd
ugucaaaauugaug

SEQ ID NO: 2733636 - RNA, 17 nt, Haemophilus influenzae Rd
ugucaaacgaaaaaaau

SEQ ID NO: 2733637 - RNA, 23 nt, Haemophilus influenzae Rd
ugucaaacgaaaaaaauaaaaaa

SEQ ID NO: 2733638 - RNA, 15 nt, Haemophilus influenzae Rd
ugucaaaugugaccg

SEQ ID NO: 2733639 - RNA, 23 nt, Haemophilus influenzae Rd
ugucaaauuaauuaaucaauaag

SEQ ID NO: 2733640 - RNA, 14 nt, Haemophilus influenzae Rd
ugucacaauauuug

SEQ ID NO: 2733641 - RNA, 15 nt, Haemophilus influenzae Rd
ugucacauuuuguca

SEQ ID NO: 2733642 - RNA, 20 nt, Haemophilus influenzae Rd
ugucaccucguaaaauauua

SEQ ID NO: 2733643 - RNA, 17 nt, Haemophilus influenzae Rd
ugucacgagcuaaaaaa

SEQ ID NO: 2733644 - RNA, 14 nt, Haemophilus influenzae Rd
ugucagaaaagauu

SEQ ID NO: 2733645 - RNA, 14 nt, Haemophilus influenzae Rd
ugucagauuuauaa

SEQ ID NO: 2733646 - RNA, 15 nt, Haemophilus influenzae Rd
ugucagauuuauaaa

SEQ ID NO: 2733647 - RNA, 21 nt, Haemophilus influenzae Rd
ugucaucuaauuguucuucug

SEQ ID NO: 2733648 - RNA, 18 nt, Haemophilus influenzae Rd
ugucauuaaaaaauaauu

SEQ ID NO: 2733649 - RNA, 20 nt, Haemophilus influenzae Rd
ugucauuaaaaaauaauucc

SEQ ID NO: 2733650 - RNA, 17 nt, Haemophilus influenzae Rd
ugucauuaaaccaaaag

SEQ ID NO: 2733651 - RNA, 20 nt, Haemophilus influenzae Rd
ugucauuaaaccaaaagauc

SEQ ID NO: 2733652 - RNA, 19 nt, Haemophilus influenzae Rd
ugucauugccauuucugca

SEQ ID NO: 2733653 - RNA, 22 nt, Haemophilus influenzae Rd
ugucauuuauggaaauaaaucc

SEQ ID NO: 2733654 - RNA, 17 nt, Haemophilus influenzae Rd
uguccaaaaaugccuac

SEQ ID NO: 2733655 - RNA, 22 nt, Haemophilus influenzae Rd
uguccaauaauuaaacuuucaa

SEQ ID NO: 2733656 - RNA, 16 nt, Haemophilus influenzae Rd
uguccacuuuuggaaa

SEQ ID NO: 2733657 - RNA, 14 nt, Haemophilus influenzae Rd
uguccauaacuguc

SEQ ID NO: 2733658 - RNA, 18 nt, Haemophilus influenzae Rd
ugucccgcauauaaaaua

SEQ ID NO: 2733659 - RNA, 14 nt, Haemophilus influenzae Rd
uguccgaaaaaacu

SEQ ID NO: 2733660 - RNA, 17 nt, Haemophilus influenzae Rd
uguccgauaguggcacc

SEQ ID NO: 2733661 - RNA, 15 nt, Haemophilus influenzae Rd
uguccuuuaucaagc

SEQ ID NO: 2733662 - RNA, 18 nt, Haemophilus influenzae Rd
ugucgcacguuuacuuuu

SEQ ID NO: 2733663 - RNA, 13 nt, Haemophilus influenzae Rd
ugucgcagucugu

SEQ ID NO: 2733664 - RNA, 17 nt, Haemophilus influenzae Rd
ugucgccauuuaagccu

SEQ ID NO: 2733665 - RNA, 18 nt, Haemophilus influenzae Rd
ugucgcuaauaccgcgua

SEQ ID NO: 2733666 - RNA, 14 nt, Haemophilus influenzae Rd
ugucgcuuucuuau

SEQ ID NO: 2733667 - RNA, 14 nt, Haemophilus influenzae Rd
ugucggaaaauaau

SEQ ID NO: 2733668 - RNA, 12 nt, Haemophilus influenzae Rd
ugucguaauaac

SEQ ID NO: 2733669 - RNA, 22 nt, Haemophilus influenzae Rd
ugucguaauaacauucaguuuu

SEQ ID NO: 2733670 - RNA, 15 nt, Haemophilus influenzae Rd
ugucgugaaagaaua

SEQ ID NO: 2733671 - RNA, 15 nt, Haemophilus influenzae Rd
ugucuaaguaauucg

SEQ ID NO: 2733672 - RNA, 14 nt, Haemophilus influenzae Rd
ugucucauuuugcu

SEQ ID NO: 2733673 - RNA, 21 nt, Haemophilus influenzae Rd
ugucuucgugcugaagaguua

SEQ ID NO: 2733674 - RNA, 22 nt, Haemophilus influenzae Rd
ugucuugaguaccgcuaauaau

SEQ ID NO: 2733675 - RNA, 14 nt, Haemophilus influenzae Rd
ugucuuuuucuuac

SEQ ID NO: 2733676 - RNA, 14 nt, Haemophilus influenzae Rd
ugugaaaaaacgua

SEQ ID NO: 2733677 - RNA, 16 nt, Haemophilus influenzae Rd
ugugaaauaaaauaua

SEQ ID NO: 2733678 - RNA, 19 nt, Haemophilus influenzae Rd
ugugaaauauucuuggaga

SEQ ID NO: 2733679 - RNA, 11 nt, Haemophilus influenzae Rd
ugugaaauucc

SEQ ID NO: 2733680 - RNA, 19 nt, Haemophilus influenzae Rd
ugugaacuuugugccauuu

SEQ ID NO: 2733681 - RNA, 14 nt, Haemophilus influenzae Rd
ugugaaguuuuuua

SEQ ID NO: 2733682 - RNA, 18 nt, Haemophilus influenzae Rd
ugugaaguuuuuuaaguu

SEQ ID NO: 2733683 - RNA, 23 nt, Haemophilus influenzae Rd
ugugaaguuuuuuaaguuuccaa

SEQ ID NO: 2733684 - RNA, 13 nt, Haemophilus influenzae Rd
ugugaaugcaaua

SEQ ID NO: 2733685 - RNA, 16 nt, Haemophilus influenzae Rd
ugugaaugcaauauuc

SEQ ID NO: 2733686 - RNA, 14 nt, Haemophilus influenzae Rd
ugugaccaaauaau

SEQ ID NO: 2733687 - RNA, 23 nt, Haemophilus influenzae Rd
ugugaccaaauaaucgugaguuu

SEQ ID NO: 2733688 - RNA, 16 nt, Haemophilus influenzae Rd
ugugaguaaaauacga

SEQ ID NO: 2733689 - RNA, 20 nt, Haemophilus influenzae Rd
ugugaguaaaccacaauacu

SEQ ID NO: 2733690 - RNA, 20 nt, Haemophilus influenzae Rd
ugugagucuugcuuuuuaau

SEQ ID NO: 2733691 - RNA, 18 nt, Haemophilus influenzae Rd
ugugauaaauguguuaaa

SEQ ID NO: 2733692 - RNA, 19 nt, Haemophilus influenzae Rd
ugugauaacuaugccuucu

SEQ ID NO: 2733693 - RNA, 17 nt, Haemophilus influenzae Rd
ugugauaccgauaaaac

SEQ ID NO: 2733694 - RNA, 19 nt, Haemophilus influenzae Rd
ugugauaccgauaaaaccu

SEQ ID NO: 2733695 - RNA, 20 nt, Haemophilus influenzae Rd
ugugaugggaaacugaacga

SEQ ID NO: 2733696 - RNA, 15 nt, Haemophilus influenzae Rd
ugugauguucuaaau

SEQ ID NO: 2733697 - RNA, 12 nt, Haemophilus influenzae Rd
ugugauuaaaau

SEQ ID NO: 2733698 - RNA, 14 nt, Haemophilus influenzae Rd
ugugauuucaauuc

SEQ ID NO: 2733699 - RNA, 17 nt, Haemophilus influenzae Rd
ugugauuuuagaaaaau

SEQ ID NO: 2733700 - RNA, 17 nt, Haemophilus influenzae Rd
ugugcaagcauuucaag

SEQ ID NO: 2733701 - RNA, 12 nt, Haemophilus influenzae Rd
ugugcaauuuga

SEQ ID NO: 2733702 - RNA, 21 nt, Haemophilus influenzae Rd
ugugcacccgccgcaccuaaa

SEQ ID NO: 2733703 - RNA, 12 nt, Haemophilus influenzae Rd
ugugcaccuuca

SEQ ID NO: 2733704 - RNA, 22 nt, Haemophilus influenzae Rd
ugugcauuaaaucaaauuuagg

SEQ ID NO: 2733705 - RNA, 15 nt, Haemophilus influenzae Rd
ugugcauuugggaau

SEQ ID NO: 2733706 - RNA, 17 nt, Haemophilus influenzae Rd
ugugccaaauucauucu

SEQ ID NO: 2733707 - RNA, 18 nt, Haemophilus influenzae Rd
ugugccaauccauaaaau

SEQ ID NO: 2733708 - RNA, 17 nt, Haemophilus influenzae Rd
ugugccauguacauuaa

SEQ ID NO: 2733709 - RNA, 23 nt, Haemophilus influenzae Rd
ugugcgauuuucucuugcagaac

SEQ ID NO: 2733710 - RNA, 19 nt, Haemophilus influenzae Rd
ugugcuaaauuuuuuugca

SEQ ID NO: 2733711 - RNA, 14 nt, Haemophilus influenzae Rd
ugugcuauacaaaa

SEQ ID NO: 2733712 - RNA, 18 nt, Haemophilus influenzae Rd
ugugcucaaguuuuauuu

SEQ ID NO: 2733713 - RNA, 12 nt, Haemophilus influenzae Rd
ugugcucccccc

SEQ ID NO: 2733714 - RNA, 18 nt, Haemophilus influenzae Rd
ugugcuugaugucaguga

SEQ ID NO: 2733715 - RNA, 16 nt, Haemophilus influenzae Rd
ugugcuugcuuuaauu

SEQ ID NO: 2733716 - RNA, 17 nt, Haemophilus influenzae Rd
uguggaaacgugcaauu

SEQ ID NO: 2733717 - RNA, 13 nt, Haemophilus influenzae Rd
uguggauuuugua

SEQ ID NO: 2733718 - RNA, 11 nt, Haemophilus influenzae Rd
uguggcaaaau

SEQ ID NO: 2733719 - RNA, 19 nt, Haemophilus influenzae Rd
uguggcgugagauccuuua

SEQ ID NO: 2733720 - RNA, 15 nt, Haemophilus influenzae Rd
uguggcuucaucuaa

SEQ ID NO: 2733721 - RNA, 21 nt, Haemophilus influenzae Rd
uguggcuuuucagcuaaaauu

SEQ ID NO: 2733722 - RNA, 23 nt, Haemophilus influenzae Rd
uguggcuuuugucgcuaacugau

SEQ ID NO: 2733723 - RNA, 13 nt, Haemophilus influenzae Rd
ugugggcuuuaca

SEQ ID NO: 2733724 - RNA, 18 nt, Haemophilus influenzae Rd
ugugggugcugcaacugg

SEQ ID NO: 2733725 - RNA, 23 nt, Haemophilus influenzae Rd
uguggguuccagguuguuuuucu

SEQ ID NO: 2733726 - RNA, 21 nt, Haemophilus influenzae Rd
ugugguaaagcuacaucaaca

SEQ ID NO: 2733727 - RNA, 15 nt, Haemophilus influenzae Rd
uguggugaccgauaa

SEQ ID NO: 2733728 - RNA, 18 nt, Haemophilus influenzae Rd
uguggugccguuugugcu

SEQ ID NO: 2733729 - RNA, 21 nt, Haemophilus influenzae Rd
uguguaacagcucuguaaaac

SEQ ID NO: 2733730 - RNA, 15 nt, Haemophilus influenzae Rd
uguguagauaaaaua

SEQ ID NO: 2733731 - RNA, 14 nt, Haemophilus influenzae Rd
uguguaggcauauc

SEQ ID NO: 2733732 - RNA, 12 nt, Haemophilus influenzae Rd
uguguggaaaaa

SEQ ID NO: 2733733 - RNA, 23 nt, Haemophilus influenzae Rd
uguguggaaaaauguaauucugg

SEQ ID NO: 2733734 - RNA, 20 nt, Haemophilus influenzae Rd
uguguuucaacaaaaauacg

SEQ ID NO: 2733735 - RNA, 14 nt, Haemophilus influenzae Rd
uguguuucagcuuc

SEQ ID NO: 2733736 - RNA, 17 nt, Haemophilus influenzae Rd
uguguuuuggauagcau

SEQ ID NO: 2733737 - RNA, 19 nt, Haemophilus influenzae Rd
uguguuuuuaauuagagag

SEQ ID NO: 2733738 - RNA, 13 nt, Haemophilus influenzae Rd
uguguuuuucaaa

SEQ ID NO: 2733739 - RNA, 14 nt, Haemophilus influenzae Rd
uguguuuuucaaaa

SEQ ID NO: 2733740 - RNA, 15 nt, Haemophilus influenzae Rd
uguguuuuucaaaaa

SEQ ID NO: 2733741 - RNA, 14 nt, Haemophilus influenzae Rd
uguuaaaugaaaag

SEQ ID NO: 2733742 - RNA, 21 nt, Haemophilus influenzae Rd
uguuaaaugcaguauaaaccg

SEQ ID NO: 2733743 - RNA, 15 nt, Haemophilus influenzae Rd
uguuaaauguuaaug

SEQ ID NO: 2733744 - RNA, 20 nt, Haemophilus influenzae Rd
uguuaaauugaacugaauua

SEQ ID NO: 2733745 - RNA, 20 nt, Haemophilus influenzae Rd
uguuaaguucaucauaaauu

SEQ ID NO: 2733746 - RNA, 14 nt, Haemophilus influenzae Rd
uguuaauaaaccuu

SEQ ID NO: 2733747 - RNA, 15 nt, Haemophilus influenzae Rd
uguuaauaaacgccu

SEQ ID NO: 2733748 - RNA, 13 nt, Haemophilus influenzae Rd
uguuaauaagccc

SEQ ID NO: 2733749 - RNA, 20 nt, Haemophilus influenzae Rd
uguuaauaagcccaacuuaa

SEQ ID NO: 2733750 - RNA, 16 nt, Haemophilus influenzae Rd
uguuaauagaauauaa

SEQ ID NO: 2733751 - RNA, 14 nt, Haemophilus influenzae Rd
uguuaauuaucaaa

SEQ ID NO: 2733752 - RNA, 15 nt, Haemophilus influenzae Rd
uguuaauuuuaaauu

SEQ ID NO: 2733753 - RNA, 16 nt, Haemophilus influenzae Rd
uguuaauuuuaaauuu

SEQ ID NO: 2733754 - RNA, 15 nt, Haemophilus influenzae Rd
uguuacaucuucaaa

SEQ ID NO: 2733755 - RNA, 14 nt, Haemophilus influenzae Rd
uguuaccaauaacu

SEQ ID NO: 2733756 - RNA, 19 nt, Haemophilus influenzae Rd
uguuaccaauaacuaaaaa

SEQ ID NO: 2733757 - RNA, 13 nt, Haemophilus influenzae Rd
uguuaccuaauuc

SEQ ID NO: 2733758 - RNA, 21 nt, Haemophilus influenzae Rd
uguuacuaaaauaauuuuuug

SEQ ID NO: 2733759 - RNA, 17 nt, Haemophilus influenzae Rd
uguuacuucuuucacaa

SEQ ID NO: 2733760 - RNA, 20 nt, Haemophilus influenzae Rd
uguuagaaagccuuuuaaaa

SEQ ID NO: 2733761 - RNA, 19 nt, Haemophilus influenzae Rd
uguuagaaauacauuauua

SEQ ID NO: 2733762 - RNA, 20 nt, Haemophilus influenzae Rd
uguuagaucaguuuuacguu

SEQ ID NO: 2733763 - RNA, 14 nt, Haemophilus influenzae Rd
uguuauauugaacg

SEQ ID NO: 2733764 - RNA, 14 nt, Haemophilus influenzae Rd
uguuauuaaaauua

SEQ ID NO: 2733765 - RNA, 23 nt, Haemophilus influenzae Rd
uguuauuaaaauuaauaaauauu

SEQ ID NO: 2733766 - RNA, 16 nt, Haemophilus influenzae Rd
uguuauuggaaaauuc

SEQ ID NO: 2733767 - RNA, 15 nt, Haemophilus influenzae Rd
uguucaaauaaugug

SEQ ID NO: 2733768 - RNA, 20 nt, Haemophilus influenzae Rd
uguucaaccacuucagcaga

SEQ ID NO: 2733769 - RNA, 18 nt, Haemophilus influenzae Rd
uguucaaguaaaugcgcu

SEQ ID NO: 2733770 - RNA, 15 nt, Haemophilus influenzae Rd
uguucaauaauauua

SEQ ID NO: 2733771 - RNA, 14 nt, Haemophilus influenzae Rd
uguucacaucaaaa

SEQ ID NO: 2733772 - RNA, 19 nt, Haemophilus influenzae Rd
uguucacugcggcaaaauc

SEQ ID NO: 2733773 - RNA, 21 nt, Haemophilus influenzae Rd
uguucagccaauuuuucaaaa

SEQ ID NO: 2733774 - RNA, 18 nt, Haemophilus influenzae Rd
uguucagccacuucuuca

SEQ ID NO: 2733775 - RNA, 24 nt, Haemophilus influenzae Rd
uguucaggugucaucacucguugg

SEQ ID NO: 2733776 - RNA, 19 nt, Haemophilus influenzae Rd
uguucaguaucuggcucaa

SEQ ID NO: 2733777 - RNA, 23 nt, Haemophilus influenzae Rd
uguucaguaucuggcucaauguu

SEQ ID NO: 2733778 - RNA, 20 nt, Haemophilus influenzae Rd
uguucaugugggcuuuacaa

SEQ ID NO: 2733779 - RNA, 14 nt, Haemophilus influenzae Rd
uguucauuuuaaaa

SEQ ID NO: 2733780 - RNA, 19 nt, Haemophilus influenzae Rd
uguucauuuuuacuuucuu

SEQ ID NO: 2733781 - RNA, 20 nt, Haemophilus influenzae Rd
uguucauuuuuacuuucuuu

SEQ ID NO: 2733782 - RNA, 13 nt, Haemophilus influenzae Rd
uguucauuuuuau

SEQ ID NO: 2733783 - RNA, 13 nt, Haemophilus influenzae Rd
uguuccacauuau

SEQ ID NO: 2733784 - RNA, 20 nt, Haemophilus influenzae Rd
uguuccaccacucacuggcu

SEQ ID NO: 2733785 - RNA, 17 nt, Haemophilus influenzae Rd
uguuccaggaaaauuuu

SEQ ID NO: 2733786 - RNA, 19 nt, Haemophilus influenzae Rd
uguucgacaauuuguccuu

SEQ ID NO: 2733787 - RNA, 19 nt, Haemophilus influenzae Rd
uguucgcugguuaaauuaa

SEQ ID NO: 2733788 - RNA, 17 nt, Haemophilus influenzae Rd
uguucgguuaaagaagc

SEQ ID NO: 2733789 - RNA, 16 nt, Haemophilus influenzae Rd
uguucguuuguuugaa

SEQ ID NO: 2733790 - RNA, 19 nt, Haemophilus influenzae Rd
uguucuaagaaaguuuuau

SEQ ID NO: 2733791 - RNA, 16 nt, Haemophilus influenzae Rd
uguucuaagguauaaa

SEQ ID NO: 2733792 - RNA, 22 nt, Haemophilus influenzae Rd
uguucucacuaacuuuccuacu

SEQ ID NO: 2733793 - RNA, 20 nt, Haemophilus influenzae Rd
uguucuccauuaagcacagg

SEQ ID NO: 2733794 - RNA, 15 nt, Haemophilus influenzae Rd
uguucugacacuucc

SEQ ID NO: 2733795 - RNA, 16 nt, Haemophilus influenzae Rd
uguucugcaucaauaa

SEQ ID NO: 2733796 - RNA, 13 nt, Haemophilus influenzae Rd
uguucugcauuag

SEQ ID NO: 2733797 - RNA, 15 nt, Haemophilus influenzae Rd
uguucuguuccugca

SEQ ID NO: 2733798 - RNA, 19 nt, Haemophilus influenzae Rd
uguucuguuccugcauuau

SEQ ID NO: 2733799 - RNA, 23 nt, Haemophilus influenzae Rd
uguucuucggguuuauguaaaua

SEQ ID NO: 2733800 - RNA, 17 nt, Haemophilus influenzae Rd
uguucuucuaauguagu

SEQ ID NO: 2733801 - RNA, 20 nt, Haemophilus influenzae Rd
uguucuuuauaagaaaguuu

SEQ ID NO: 2733802 - RNA, 16 nt, Haemophilus influenzae Rd
uguugaaaagaauaau

SEQ ID NO: 2733803 - RNA, 18 nt, Haemophilus influenzae Rd
uguugauauucaauuuau

SEQ ID NO: 2733804 - RNA, 13 nt, Haemophilus influenzae Rd
uguugcaaauuuu

SEQ ID NO: 2733805 - RNA, 16 nt, Haemophilus influenzae Rd
uguugcaaauuuuuca

SEQ ID NO: 2733806 - RNA, 18 nt, Haemophilus influenzae Rd
uguugccauaaauuugga

SEQ ID NO: 2733807 - RNA, 14 nt, Haemophilus influenzae Rd
uguugccaucaacg

SEQ ID NO: 2733808 - RNA, 17 nt, Haemophilus influenzae Rd
uguugccauuguuaaau

SEQ ID NO: 2733809 - RNA, 16 nt, Haemophilus influenzae Rd
uguugcccuagugcaa

SEQ ID NO: 2733810 - RNA, 14 nt, Haemophilus influenzae Rd
uguugcgauuucca

SEQ ID NO: 2733811 - RNA, 23 nt, Haemophilus influenzae Rd
uguugcggcuuggaguagugcau

SEQ ID NO: 2733812 - RNA, 21 nt, Haemophilus influenzae Rd
uguugcucagccaguuuucua

SEQ ID NO: 2733813 - RNA, 15 nt, Haemophilus influenzae Rd
uguugcuucaauugu

SEQ ID NO: 2733814 - RNA, 22 nt, Haemophilus influenzae Rd
uguuggaaugaucgaccauugc

SEQ ID NO: 2733815 - RNA, 13 nt, Haemophilus influenzae Rd
uguuggaucuucc

SEQ ID NO: 2733816 - RNA, 18 nt, Haemophilus influenzae Rd
uguuggcccaacagaaau

SEQ ID NO: 2733817 - RNA, 15 nt, Haemophilus influenzae Rd
uguugguaauucagc

SEQ ID NO: 2733818 - RNA, 18 nt, Haemophilus influenzae Rd
uguugguuaaaaauagcc

SEQ ID NO: 2733819 - RNA, 18 nt, Haemophilus influenzae Rd
uguuguaauccauuuuga

SEQ ID NO: 2733820 - RNA, 15 nt, Haemophilus influenzae Rd
uguuguacuuuagaa

SEQ ID NO: 2733821 - RNA, 17 nt, Haemophilus influenzae Rd
uguuguggaucguaaau

SEQ ID NO: 2733822 - RNA, 22 nt, Haemophilus influenzae Rd
uguuguggcaucucaaggcgau

SEQ ID NO: 2733823 - RNA, 13 nt, Haemophilus influenzae Rd
uguuguuauucua

SEQ ID NO: 2733824 - RNA, 20 nt, Haemophilus influenzae Rd
uguuguuccaccuugaauaa

SEQ ID NO: 2733825 - RNA, 21 nt, Haemophilus influenzae Rd
uguuguuccaccuugaauaau

SEQ ID NO: 2733826 - RNA, 16 nt, Haemophilus influenzae Rd
uguuguucuaacauuu

SEQ ID NO: 2733827 - RNA, 14 nt, Haemophilus influenzae Rd
uguuguuuaauaag

SEQ ID NO: 2733828 - RNA, 12 nt, Haemophilus influenzae Rd
uguuuaaaauua

SEQ ID NO: 2733829 - RNA, 17 nt, Haemophilus influenzae Rd
uguuuaaaguaagaauu

SEQ ID NO: 2733830 - RNA, 19 nt, Haemophilus influenzae Rd
uguuuaaauuuuuaauaaa

SEQ ID NO: 2733831 - RNA, 20 nt, Haemophilus influenzae Rd
uguuuaauauuuuuuucaaa

SEQ ID NO: 2733832 - RNA, 16 nt, Haemophilus influenzae Rd
uguuuaauccaaacua

SEQ ID NO: 2733833 - RNA, 17 nt, Haemophilus influenzae Rd
uguuuaauccaaacuaa

SEQ ID NO: 2733834 - RNA, 19 nt, Haemophilus influenzae Rd
uguuuaauuauagaaaaga

SEQ ID NO: 2733835 - RNA, 21 nt, Haemophilus influenzae Rd
uguuuaauuggaaauaauauu

SEQ ID NO: 2733836 - RNA, 20 nt, Haemophilus influenzae Rd
uguuuaccaccgauaaacac

SEQ ID NO: 2733837 - RNA, 21 nt, Haemophilus influenzae Rd
uguuuaccaccgauaaacacu

SEQ ID NO: 2733838 - RNA, 22 nt, Haemophilus influenzae Rd
uguuuacgcuaauuuaagaaaa

SEQ ID NO: 2733839 - RNA, 22 nt, Haemophilus influenzae Rd
uguuuacggaugcaauccacua

SEQ ID NO: 2733840 - RNA, 16 nt, Haemophilus influenzae Rd
uguuuacuuaaaucuu

SEQ ID NO: 2733841 - RNA, 18 nt, Haemophilus influenzae Rd
uguuuacuuuuauaaaga

SEQ ID NO: 2733842 - RNA, 16 nt, Haemophilus influenzae Rd
uguuuagauuuuacuu

SEQ ID NO: 2733843 - RNA, 23 nt, Haemophilus influenzae Rd
uguuuagcaaggcguucaauauu

SEQ ID NO: 2733844 - RNA, 16 nt, Haemophilus influenzae Rd
uguuuaugucuaaacu

SEQ ID NO: 2733845 - RNA, 13 nt, Haemophilus influenzae Rd
uguuuauuauuuc

SEQ ID NO: 2733846 - RNA, 16 nt, Haemophilus influenzae Rd
uguuucaacaaaaaua

SEQ ID NO: 2733847 - RNA, 18 nt, Haemophilus influenzae Rd
uguuucaaugucuuuuuc

SEQ ID NO: 2733848 - RNA, 14 nt, Haemophilus influenzae Rd
uguuucacuaaaaa

SEQ ID NO: 2733849 - RNA, 16 nt, Haemophilus influenzae Rd
uguuucacuaaaaaua

SEQ ID NO: 2733850 - RNA, 16 nt, Haemophilus influenzae Rd
uguuucaguuuuauua

SEQ ID NO: 2733851 - RNA, 18 nt, Haemophilus influenzae Rd
uguuucauaaaaaaugcu

SEQ ID NO: 2733852 - RNA, 20 nt, Haemophilus influenzae Rd
uguuucauaagauaacaaga

SEQ ID NO: 2733853 - RNA, 12 nt, Haemophilus influenzae Rd
uguuucaucauu

SEQ ID NO: 2733854 - RNA, 18 nt, Haemophilus influenzae Rd
uguuuccaaguauuuucu

SEQ ID NO: 2733855 - RNA, 21 nt, Haemophilus influenzae Rd
uguuuccaaguauuuucuggu

SEQ ID NO: 2733856 - RNA, 13 nt, Haemophilus influenzae Rd
uguuuccacacga

SEQ ID NO: 2733857 - RNA, 17 nt, Haemophilus influenzae Rd
uguuuccguguuuuaau

SEQ ID NO: 2733858 - RNA, 14 nt, Haemophilus influenzae Rd
uguuucgauaaaaa

SEQ ID NO: 2733859 - RNA, 18 nt, Haemophilus influenzae Rd
uguuucgcacaauucuca

SEQ ID NO: 2733860 - RNA, 18 nt, Haemophilus influenzae Rd
uguuucgcaguguuaaau

SEQ ID NO: 2733861 - RNA, 23 nt, Haemophilus influenzae Rd
uguuucuaauucggcuucaguau

SEQ ID NO: 2733862 - RNA, 18 nt, Haemophilus influenzae Rd
uguuucuaauuuuucacu

SEQ ID NO: 2733863 - RNA, 20 nt, Haemophilus influenzae Rd
uguuucugucauuuauggaa

SEQ ID NO: 2733864 - RNA, 19 nt, Haemophilus influenzae Rd
uguuugaacuauauccaaa

SEQ ID NO: 2733865 - RNA, 19 nt, Haemophilus influenzae Rd
uguuugauaaauaucuugc

SEQ ID NO: 2733866 - RNA, 19 nt, Haemophilus influenzae Rd
uguuugccaucuaaaaaac

SEQ ID NO: 2733867 - RNA, 15 nt, Haemophilus influenzae Rd
uguuugcgcauuauc

SEQ ID NO: 2733868 - RNA, 17 nt, Haemophilus influenzae Rd
uguuuggaaugguagug

SEQ ID NO: 2733869 - RNA, 21 nt, Haemophilus influenzae Rd
uguuuggcaaauagcaaaacc

SEQ ID NO: 2733870 - RNA, 16 nt, Haemophilus influenzae Rd
uguuuggcaauggcug

SEQ ID NO: 2733871 - RNA, 23 nt, Haemophilus influenzae Rd
uguuugggauaagcaaucuugcc

SEQ ID NO: 2733872 - RNA, 24 nt, Haemophilus influenzae Rd
uguuugucgcaggugucacagcaa

SEQ ID NO: 2733873 - RNA, 18 nt, Haemophilus influenzae Rd
uguuuguuaugaaauugc

SEQ ID NO: 2733874 - RNA, 23 nt, Haemophilus influenzae Rd
uguuuguuccacuucauaaaucc

SEQ ID NO: 2733875 - RNA, 13 nt, Haemophilus influenzae Rd
uguuuuaaaaugg

SEQ ID NO: 2733876 - RNA, 22 nt, Haemophilus influenzae Rd
uguuuuaaaauggaaauuugag

SEQ ID NO: 2733877 - RNA, 14 nt, Haemophilus influenzae Rd
uguuuuaaaauuug

SEQ ID NO: 2733878 - RNA, 13 nt, Haemophilus influenzae Rd
uguuuuaaaucuu

SEQ ID NO: 2733879 - RNA, 13 nt, Haemophilus influenzae Rd
uguuuuaccuucu

SEQ ID NO: 2733880 - RNA, 17 nt, Haemophilus influenzae Rd
uguuuuacgccauucuu

SEQ ID NO: 2733881 - RNA, 15 nt, Haemophilus influenzae Rd
uguuuuacuucaucc

SEQ ID NO: 2733882 - RNA, 11 nt, Haemophilus influenzae Rd
uguuuuauaca

SEQ ID NO: 2733883 - RNA, 14 nt, Haemophilus influenzae Rd
uguuuuauagccuu

SEQ ID NO: 2733884 - RNA, 21 nt, Haemophilus influenzae Rd
uguuuuaucagaaugauuauc

SEQ ID NO: 2733885 - RNA, 15 nt, Haemophilus influenzae Rd
uguuuucaauuuuaa

SEQ ID NO: 2733886 - RNA, 16 nt, Haemophilus influenzae Rd
uguuuucaauuuuaaa

SEQ ID NO: 2733887 - RNA, 19 nt, Haemophilus influenzae Rd
uguuuucaauuuuaaaauu

SEQ ID NO: 2733888 - RNA, 11 nt, Haemophilus influenzae Rd
uguuuucuuga

SEQ ID NO: 2733889 - RNA, 13 nt, Haemophilus influenzae Rd
uguuuucuuuugc

SEQ ID NO: 2733890 - RNA, 20 nt, Haemophilus influenzae Rd
uguuuugagugagauaaaug

SEQ ID NO: 2733891 - RNA, 20 nt, Haemophilus influenzae Rd
uguuuugauugagauuuaau

SEQ ID NO: 2733892 - RNA, 23 nt, Haemophilus influenzae Rd
uguuuugcaauaaaguugagaau

SEQ ID NO: 2733893 - RNA, 17 nt, Haemophilus influenzae Rd
uguuuuggcauuuucaa

SEQ ID NO: 2733894 - RNA, 16 nt, Haemophilus influenzae Rd
uguuuuguucaucuaa

SEQ ID NO: 2733895 - RNA, 22 nt, Haemophilus influenzae Rd
uguuuuucauucuauuuuaaaa

SEQ ID NO: 2733896 - RNA, 22 nt, Haemophilus influenzae Rd
uguuuuuccaauucuuuuaaau

SEQ ID NO: 2733897 - RNA, 18 nt, Haemophilus influenzae Rd
uguuuuucgaucucugcc

SEQ ID NO: 2733898 - RNA, 18 nt, Haemophilus influenzae Rd
uguuuuucuaccgcacuu

SEQ ID NO: 2733899 - RNA, 23 nt, Haemophilus influenzae Rd
uguuuuucugggaagaaaauauc

SEQ ID NO: 2733900 - RNA, 12 nt, Haemophilus influenzae Rd
uguuuuucuucc

SEQ ID NO: 2733901 - RNA, 22 nt, Haemophilus influenzae Rd
uguuuuuguucugccuaauaag

SEQ ID NO: 2733902 - RNA, 18 nt, Haemophilus influenzae Rd
uguuuuuuaauaucuucc

SEQ ID NO: 2733903 - RNA, 21 nt, Haemophilus influenzae Rd
uguuuuuuacgaacuaauaag

SEQ ID NO: 2733904 - RNA, 20 nt, Haemophilus influenzae Rd
uguuuuuucauauuuuaaau

SEQ ID NO: 2733905 - RNA, 13 nt, Haemophilus influenzae Rd
uguuuuuuuaggu

SEQ ID NO: 2733906 - RNA, 13 nt, Haemophilus influenzae Rd
uguuuuuuuauua

SEQ ID NO: 2733907 - RNA, 13 nt, Haemophilus influenzae Rd
uguuuuuuuucuu

SEQ ID NO: 2733908 - RNA, 16 nt, Haemophilus influenzae Rd
uuaaaaaaagcaauau

SEQ ID NO: 2733909 - RNA, 12 nt, Haemophilus influenzae Rd
uuaaaaaaauag

SEQ ID NO: 2733910 - RNA, 15 nt, Haemophilus influenzae Rd
uuaaaaaaauaguua

SEQ ID NO: 2733911 - RNA, 23 nt, Haemophilus influenzae Rd
uuaaaaaaauaguuaaucgaaaa

SEQ ID NO: 2733912 - RNA, 20 nt, Haemophilus influenzae Rd
uuaaaaaacauuaauuuacg

SEQ ID NO: 2733913 - RNA, 23 nt, Haemophilus influenzae Rd
uuaaaaaagaugaggcguuuuuc

SEQ ID NO: 2733914 - RNA, 18 nt, Haemophilus influenzae Rd
uuaaaaaagugaaagacg

SEQ ID NO: 2733915 - RNA, 20 nt, Haemophilus influenzae Rd
uuaaaaaaucagauacauuu

SEQ ID NO: 2733916 - RNA, 19 nt, Haemophilus influenzae Rd
uuaaaaaccccgcuaauuu

SEQ ID NO: 2733917 - RNA, 20 nt, Haemophilus influenzae Rd
uuaaaaaccgacuuugucaa

SEQ ID NO: 2733918 - RNA, 17 nt, Haemophilus influenzae Rd
uuaaaaacuaaccgcac

SEQ ID NO: 2733919 - RNA, 13 nt, Haemophilus influenzae Rd
uuaaaaagcucca

SEQ ID NO: 2733920 - RNA, 17 nt, Haemophilus influenzae Rd
uuaaaaauaaguucauc

SEQ ID NO: 2733921 - RNA, 22 nt, Haemophilus influenzae Rd
uuaaaaauaaguucaucaacug

SEQ ID NO: 2733922 - RNA, 18 nt, Haemophilus influenzae Rd
uuaaaaauauaaccgcac

SEQ ID NO: 2733923 - RNA, 20 nt, Haemophilus influenzae Rd
uuaaaaauccgccacuuuga

SEQ ID NO: 2733924 - RNA, 15 nt, Haemophilus influenzae Rd
uuaaaacaaaaggcc

SEQ ID NO: 2733925 - RNA, 11 nt, Haemophilus influenzae Rd
uuaaaacauga

SEQ ID NO: 2733926 - RNA, 11 nt, Haemophilus influenzae Rd
uuaaaacauuc

SEQ ID NO: 2733927 - RNA, 22 nt, Haemophilus influenzae Rd
uuaaaaccguaagucccagcaa

SEQ ID NO: 2733928 - RNA, 16 nt, Haemophilus influenzae Rd
uuaaaaccgucacaaa

SEQ ID NO: 2733929 - RNA, 13 nt, Haemophilus influenzae Rd
uuaaaacuauaaa

SEQ ID NO: 2733930 - RNA, 21 nt, Haemophilus influenzae Rd
uuaaaacugugcccgcagcaa

SEQ ID NO: 2733931 - RNA, 17 nt, Haemophilus influenzae Rd
uuaaaagcaaggcgaau

SEQ ID NO: 2733932 - RNA, 15 nt, Haemophilus influenzae Rd
uuaaaagcaccuaaa

SEQ ID NO: 2733933 - RNA, 15 nt, Haemophilus influenzae Rd
uuaaaagccaauaug

SEQ ID NO: 2733934 - RNA, 22 nt, Haemophilus influenzae Rd
uuaaaaggcuuucuaacacaga

SEQ ID NO: 2733935 - RNA, 15 nt, Haemophilus influenzae Rd
uuaaaaguaaaaaua

SEQ ID NO: 2733936 - RNA, 22 nt, Haemophilus influenzae Rd
uuaaaaguaaaaauaaaaacau

SEQ ID NO: 2733937 - RNA, 14 nt, Haemophilus influenzae Rd
uuaaaaguaaacaa

SEQ ID NO: 2733938 - RNA, 19 nt, Haemophilus influenzae Rd
uuaaaagucuguuuaaaaa

SEQ ID NO: 2733939 - RNA, 17 nt, Haemophilus influenzae Rd
uuaaaauagaaugaaaa

SEQ ID NO: 2733940 - RNA, 18 nt, Haemophilus influenzae Rd
uuaaaauccaaccgauaa

SEQ ID NO: 2733941 - RNA, 17 nt, Haemophilus influenzae Rd
uuaaaaugaacaaaaaa

SEQ ID NO: 2733942 - RNA, 12 nt, Haemophilus influenzae Rd
uuaaaaugguuu

SEQ ID NO: 2733943 - RNA, 17 nt, Haemophilus influenzae Rd
uuaaaaugguuuaaaua

SEQ ID NO: 2733944 - RNA, 18 nt, Haemophilus influenzae Rd
uuaaaaugguuuaaauaa

SEQ ID NO: 2733945 - RNA, 13 nt, Haemophilus influenzae Rd
uuaaaauuaguaa

SEQ ID NO: 2733946 - RNA, 14 nt, Haemophilus influenzae Rd
uuaaaauuuaauaa

SEQ ID NO: 2733947 - RNA, 13 nt, Haemophilus influenzae Rd
uuaaaauuuauuu

SEQ ID NO: 2733948 - RNA, 22 nt, Haemophilus influenzae Rd
uuaaacaccaauucaaagauuu

SEQ ID NO: 2733949 - RNA, 15 nt, Haemophilus influenzae Rd
uuaaacagcaaaagu

SEQ ID NO: 2733950 - RNA, 17 nt, Haemophilus influenzae Rd
uuaaacagccaaacaaa

SEQ ID NO: 2733951 - RNA, 13 nt, Haemophilus influenzae Rd
uuaaacaucgcag

SEQ ID NO: 2733952 - RNA, 13 nt, Haemophilus influenzae Rd
uuaaaccaaauaa

SEQ ID NO: 2733953 - RNA, 21 nt, Haemophilus influenzae Rd
uuaaaccaaauugauucauuu

SEQ ID NO: 2733954 - RNA, 18 nt, Haemophilus influenzae Rd
uuaaaccaacaacugcac

SEQ ID NO: 2733955 - RNA, 14 nt, Haemophilus influenzae Rd
uuaaaccacguugu

SEQ ID NO: 2733956 - RNA, 20 nt, Haemophilus influenzae Rd
uuaaaccgucauuuauaaaa

SEQ ID NO: 2733957 - RNA, 15 nt, Haemophilus influenzae Rd
uuaaaccuuauugca

SEQ ID NO: 2733958 - RNA, 17 nt, Haemophilus influenzae Rd
uuaaacgauaaaagggu

SEQ ID NO: 2733959 - RNA, 18 nt, Haemophilus influenzae Rd
uuaaacgcuccucugcau

SEQ ID NO: 2733960 - RNA, 17 nt, Haemophilus influenzae Rd
uuaaacguugugcauca

SEQ ID NO: 2733961 - RNA, 13 nt, Haemophilus influenzae Rd
uuaaacuaaauaa

SEQ ID NO: 2733962 - RNA, 15 nt, Haemophilus influenzae Rd
uuaaacucacuaaau

SEQ ID NO: 2733963 - RNA, 21 nt, Haemophilus influenzae Rd
uuaaacucauccguucaauaa

SEQ ID NO: 2733964 - RNA, 16 nt, Haemophilus influenzae Rd
uuaaacucgaaggaaa

SEQ ID NO: 2733965 - RNA, 18 nt, Haemophilus influenzae Rd
uuaaacuggaugaaauca

SEQ ID NO: 2733966 - RNA, 16 nt, Haemophilus influenzae Rd
uuaaacuguauuaaag

SEQ ID NO: 2733967 - RNA, 15 nt, Haemophilus influenzae Rd
uuaaacuugaauaau

SEQ ID NO: 2733968 - RNA, 15 nt, Haemophilus influenzae Rd
uuaaacuuucaauuu

SEQ ID NO: 2733969 - RNA, 14 nt, Haemophilus influenzae Rd
uuaaagaaaauauu

SEQ ID NO: 2733970 - RNA, 13 nt, Haemophilus influenzae Rd
uuaaagaacaucu

SEQ ID NO: 2733971 - RNA, 19 nt, Haemophilus influenzae Rd
uuaaagaauuucuuucgcu

SEQ ID NO: 2733972 - RNA, 22 nt, Haemophilus influenzae Rd
uuaaagagaucacuguaaauaa

SEQ ID NO: 2733973 - RNA, 23 nt, Haemophilus influenzae Rd
uuaaagaguucguccaaaaucuc

SEQ ID NO: 2733974 - RNA, 22 nt, Haemophilus influenzae Rd
uuaaagcacccaucacauuuuc

SEQ ID NO: 2733975 - RNA, 21 nt, Haemophilus influenzae Rd
uuaaagccacauaauaagaaa

SEQ ID NO: 2733976 - RNA, 16 nt, Haemophilus influenzae Rd
uuaaagccauuuugcu

SEQ ID NO: 2733977 - RNA, 20 nt, Haemophilus influenzae Rd
uuaaagccauuuugcucaaa

SEQ ID NO: 2733978 - RNA, 19 nt, Haemophilus influenzae Rd
uuaaagccguagucugcua

SEQ ID NO: 2733979 - RNA, 18 nt, Haemophilus influenzae Rd
uuaaagccuugauuauca

SEQ ID NO: 2733980 - RNA, 14 nt, Haemophilus influenzae Rd
uuaaagcugaauaa

SEQ ID NO: 2733981 - RNA, 18 nt, Haemophilus influenzae Rd
uuaaagcugaauaaauaa

SEQ ID NO: 2733982 - RNA, 15 nt, Haemophilus influenzae Rd
uuaaagcuucauuug

SEQ ID NO: 2733983 - RNA, 15 nt, Haemophilus influenzae Rd
uuaaaggcaguauaa

SEQ ID NO: 2733984 - RNA, 18 nt, Haemophilus influenzae Rd
uuaaaggcaguauaaccu

SEQ ID NO: 2733985 - RNA, 18 nt, Haemophilus influenzae Rd
uuaaaggcggauuuauua

SEQ ID NO: 2733986 - RNA, 20 nt, Haemophilus influenzae Rd
uuaaaguaaauuuuaaaauc

SEQ ID NO: 2733987 - RNA, 17 nt, Haemophilus influenzae Rd
uuaaagucagauuuccu

SEQ ID NO: 2733988 - RNA, 12 nt, Haemophilus influenzae Rd
uuaaagugcaga

SEQ ID NO: 2733989 - RNA, 14 nt, Haemophilus influenzae Rd
uuaaagugcagauu

SEQ ID NO: 2733990 - RNA, 15 nt, Haemophilus influenzae Rd
uuaaaguuaucaaac

SEQ ID NO: 2733991 - RNA, 16 nt, Haemophilus influenzae Rd
uuaaaguugcugaaua

SEQ ID NO: 2733992 - RNA, 14 nt, Haemophilus influenzae Rd
uuaaauaaaaaaua

SEQ ID NO: 2733993 - RNA, 15 nt, Haemophilus influenzae Rd
uuaaauaaaaaauaa

SEQ ID NO: 2733994 - RNA, 12 nt, Haemophilus influenzae Rd
uuaaauaaaaua

SEQ ID NO: 2733995 - RNA, 15 nt, Haemophilus influenzae Rd
uuaaauaaaauaaca

SEQ ID NO: 2733996 - RNA, 18 nt, Haemophilus influenzae Rd
uuaaauaaaauaacaaaa

SEQ ID NO: 2733997 - RNA, 20 nt, Haemophilus influenzae Rd
uuaaauaaaauaacaaaaaa

SEQ ID NO: 2733998 - RNA, 12 nt, Haemophilus influenzae Rd
uuaaauaaacac

SEQ ID NO: 2733999 - RNA, 19 nt, Haemophilus influenzae Rd
uuaaauaaacauuaugaaa

SEQ ID NO: 2734000 - RNA, 19 nt, Haemophilus influenzae Rd
uuaaauaaaccgcaucaaa

SEQ ID NO: 2734001 - RNA, 14 nt, Haemophilus influenzae Rd
uuaaauaaauaaua

SEQ ID NO: 2734002 - RNA, 14 nt, Haemophilus influenzae Rd
uuaaauaaccaacu

SEQ ID NO: 2734003 - RNA, 21 nt, Haemophilus influenzae Rd
uuaaauaagcuagaggcugaa

SEQ ID NO: 2734004 - RNA, 20 nt, Haemophilus influenzae Rd
uuaaauaaggaucuuguaaa

SEQ ID NO: 2734005 - RNA, 20 nt, Haemophilus influenzae Rd
uuaaauaauaaauccaaaua

SEQ ID NO: 2734006 - RNA, 17 nt, Haemophilus influenzae Rd
uuaaauaauuaaaaaua

SEQ ID NO: 2734007 - RNA, 20 nt, Haemophilus influenzae Rd
uuaaauacacuucuaaaaua

SEQ ID NO: 2734008 - RNA, 16 nt, Haemophilus influenzae Rd
uuaaauauaaugaaaa

SEQ ID NO: 2734009 - RNA, 18 nt, Haemophilus influenzae Rd
uuaaauauaaugaaaaca

SEQ ID NO: 2734010 - RNA, 17 nt, Haemophilus influenzae Rd
uuaaauauaauuuagca

SEQ ID NO: 2734011 - RNA, 22 nt, Haemophilus influenzae Rd
uuaaauauaggguaaauaaaaa

SEQ ID NO: 2734012 - RNA, 20 nt, Haemophilus influenzae Rd
uuaaauaugauaaaugcaau

SEQ ID NO: 2734013 - RNA, 18 nt, Haemophilus influenzae Rd
uuaaauauuuaaaaagaa

SEQ ID NO: 2734014 - RNA, 19 nt, Haemophilus influenzae Rd
uuaaauauuuucauuuaug

SEQ ID NO: 2734015 - RNA, 17 nt, Haemophilus influenzae Rd
uuaaauauuuuuacaaa

SEQ ID NO: 2734016 - RNA, 18 nt, Haemophilus influenzae Rd
uuaaauauuuuuacaaaa

SEQ ID NO: 2734017 - RNA, 12 nt, Haemophilus influenzae Rd
uuaaaucaaaaa

SEQ ID NO: 2734018 - RNA, 15 nt, Haemophilus influenzae Rd
uuaaaucaaacaaaa

SEQ ID NO: 2734019 - RNA, 17 nt, Haemophilus influenzae Rd
uuaaaucaauuaacuau

SEQ ID NO: 2734020 - RNA, 18 nt, Haemophilus influenzae Rd
uuaaaucacaauuaauuu

SEQ ID NO: 2734021 - RNA, 22 nt, Haemophilus influenzae Rd
uuaaaucacccgcauaaccacu

SEQ ID NO: 2734022 - RNA, 21 nt, Haemophilus influenzae Rd
uuaaauccaucaauucuuccc

SEQ ID NO: 2734023 - RNA, 16 nt, Haemophilus influenzae Rd
uuaaaucgauuacucu

SEQ ID NO: 2734024 - RNA, 20 nt, Haemophilus influenzae Rd
uuaaaucgauuacucugcua

SEQ ID NO: 2734025 - RNA, 14 nt, Haemophilus influenzae Rd
uuaaaugaaaagca

SEQ ID NO: 2734026 - RNA, 21 nt, Haemophilus influenzae Rd
uuaaaugaccaaguaaaccaa

SEQ ID NO: 2734027 - RNA, 15 nt, Haemophilus influenzae Rd
uuaaaugcaguauaa

SEQ ID NO: 2734028 - RNA, 18 nt, Haemophilus influenzae Rd
uuaaauggcauuuauaaa

SEQ ID NO: 2734029 - RNA, 19 nt, Haemophilus influenzae Rd
uuaaauguauuuuccaugc

SEQ ID NO: 2734030 - RNA, 13 nt, Haemophilus influenzae Rd
uuaaauuaaaacc

SEQ ID NO: 2734031 - RNA, 23 nt, Haemophilus influenzae Rd
uuaaauuaaggacuaaacuuuua

SEQ ID NO: 2734032 - RNA, 21 nt, Haemophilus influenzae Rd
uuaaauuacauucccaaauaa

SEQ ID NO: 2734033 - RNA, 21 nt, Haemophilus influenzae Rd
uuaaauuauagauaaauauca

SEQ ID NO: 2734034 - RNA, 16 nt, Haemophilus influenzae Rd
uuaaauuauauuuucc

SEQ ID NO: 2734035 - RNA, 17 nt, Haemophilus influenzae Rd
uuaaauuauauuuuccu

SEQ ID NO: 2734036 - RNA, 21 nt, Haemophilus influenzae Rd
uuaaauucaucagaaaguggu

SEQ ID NO: 2734037 - RNA, 20 nt, Haemophilus influenzae Rd
uuaaauucauuuaaaauaua

SEQ ID NO: 2734038 - RNA, 14 nt, Haemophilus influenzae Rd
uuaaauugaaaaaa

SEQ ID NO: 2734039 - RNA, 16 nt, Haemophilus influenzae Rd
uuaaauugaaaaaaua

SEQ ID NO: 2734040 - RNA, 15 nt, Haemophilus influenzae Rd
uuaaauuguaacuau

SEQ ID NO: 2734041 - RNA, 21 nt, Haemophilus influenzae Rd
uuaaauuuaugcuguuuuaua

SEQ ID NO: 2734042 - RNA, 21 nt, Haemophilus influenzae Rd
uuaaauuuggcaauccugcuu

SEQ ID NO: 2734043 - RNA, 12 nt, Haemophilus influenzae Rd
uuaaauuuuccu

SEQ ID NO: 2734044 - RNA, 20 nt, Haemophilus influenzae Rd
uuaaauuuugcuuuaaauca

SEQ ID NO: 2734045 - RNA, 12 nt, Haemophilus influenzae Rd
uuaaauuuuuaa

SEQ ID NO: 2734046 - RNA, 18 nt, Haemophilus influenzae Rd
uuaaauuuuuaauuuucu

SEQ ID NO: 2734047 - RNA, 16 nt, Haemophilus influenzae Rd
uuaacaaaacagacug

SEQ ID NO: 2734048 - RNA, 17 nt, Haemophilus influenzae Rd
uuaacaaauaauuauua

SEQ ID NO: 2734049 - RNA, 15 nt, Haemophilus influenzae Rd
uuaacaaauacaucu

SEQ ID NO: 2734050 - RNA, 22 nt, Haemophilus influenzae Rd
uuaacaaauucacugucuucca

SEQ ID NO: 2734051 - RNA, 15 nt, Haemophilus influenzae Rd
uuaacaaugaaauua

SEQ ID NO: 2734052 - RNA, 20 nt, Haemophilus influenzae Rd
uuaacacauccguuaagaaa

SEQ ID NO: 2734053 - RNA, 21 nt, Haemophilus influenzae Rd
uuaacaucaucaucgcaucug

SEQ ID NO: 2734054 - RNA, 18 nt, Haemophilus influenzae Rd
uuaacaucaugaaaugca

SEQ ID NO: 2734055 - RNA, 16 nt, Haemophilus influenzae Rd
uuaacaucuuaguauu

SEQ ID NO: 2734056 - RNA, 21 nt, Haemophilus influenzae Rd
uuaacauugucauaccccaaa

SEQ ID NO: 2734057 - RNA, 19 nt, Haemophilus influenzae Rd
uuaaccaacauaaacauug

SEQ ID NO: 2734058 - RNA, 15 nt, Haemophilus influenzae Rd
uuaaccacuaaaaaa

SEQ ID NO: 2734059 - RNA, 18 nt, Haemophilus influenzae Rd
uuaaccacuaaaaaagcc

SEQ ID NO: 2734060 - RNA, 14 nt, Haemophilus influenzae Rd
uuaaccauaaaaaa

SEQ ID NO: 2734061 - RNA, 23 nt, Haemophilus influenzae Rd
uuaacccaggaguaaccacaaaa

SEQ ID NO: 2734062 - RNA, 20 nt, Haemophilus influenzae Rd
uuaaccgcacuuuagaaaau

SEQ ID NO: 2734063 - RNA, 16 nt, Haemophilus influenzae Rd
uuaaccgcacuuucau

SEQ ID NO: 2734064 - RNA, 18 nt, Haemophilus influenzae Rd
uuaaccgcacuuuuauua

SEQ ID NO: 2734065 - RNA, 19 nt, Haemophilus influenzae Rd
uuaaccgcacuuuuuguuu

SEQ ID NO: 2734066 - RNA, 16 nt, Haemophilus influenzae Rd
uuaaccguuauaacgu

SEQ ID NO: 2734067 - RNA, 19 nt, Haemophilus influenzae Rd
uuaaccugauuaaucaaaa

SEQ ID NO: 2734068 - RNA, 20 nt, Haemophilus influenzae Rd
uuaaccugauuaaucaaaaa

SEQ ID NO: 2734069 - RNA, 22 nt, Haemophilus influenzae Rd
uuaaccugauuaaucaaaaauu

SEQ ID NO: 2734070 - RNA, 21 nt, Haemophilus influenzae Rd
uuaacgcgcuacaauauuuau

SEQ ID NO: 2734071 - RNA, 20 nt, Haemophilus influenzae Rd
uuaacgggcuuaaacuuuuu

SEQ ID NO: 2734072 - RNA, 13 nt, Haemophilus influenzae Rd
uuaacguaaaaac

SEQ ID NO: 2734073 - RNA, 22 nt, Haemophilus influenzae Rd
uuaacgugcauuuuuaugauua

SEQ ID NO: 2734074 - RNA, 20 nt, Haemophilus influenzae Rd
uuaacuaaaccauuuaauaa

SEQ ID NO: 2734075 - RNA, 22 nt, Haemophilus influenzae Rd
uuaacuaaaccauuuaauaaaa

SEQ ID NO: 2734076 - RNA, 14 nt, Haemophilus influenzae Rd
uuaacuauucaaau

SEQ ID NO: 2734077 - RNA, 17 nt, Haemophilus influenzae Rd
uuaacuauuuuuuauuu

SEQ ID NO: 2734078 - RNA, 18 nt, Haemophilus influenzae Rd
uuaacucggcuuuuucaa

SEQ ID NO: 2734079 - RNA, 24 nt, Haemophilus influenzae Rd
uuaacuggcguuucuaccacgaua

SEQ ID NO: 2734080 - RNA, 18 nt, Haemophilus influenzae Rd
uuaacuuaucuaaaaaga

SEQ ID NO: 2734081 - RNA, 19 nt, Haemophilus influenzae Rd
uuaacuuaucuaaaaagau

SEQ ID NO: 2734082 - RNA, 16 nt, Haemophilus influenzae Rd
uuaacuucaaccacuu

SEQ ID NO: 2734083 - RNA, 17 nt, Haemophilus influenzae Rd
uuaacuugcaaucacgc

SEQ ID NO: 2734084 - RNA, 13 nt, Haemophilus influenzae Rd
uuaacuuucaaca

SEQ ID NO: 2734085 - RNA, 11 nt, Haemophilus influenzae Rd
uuaagaaaaaa

SEQ ID NO: 2734086 - RNA, 23 nt, Haemophilus influenzae Rd
uuaagaaagguugguugaauuaa

SEQ ID NO: 2734087 - RNA, 14 nt, Haemophilus influenzae Rd
uuaagaccaauucu

SEQ ID NO: 2734088 - RNA, 14 nt, Haemophilus influenzae Rd
uuaagauggcuauu

SEQ ID NO: 2734089 - RNA, 19 nt, Haemophilus influenzae Rd
uuaagcaauaaacaaagaa

SEQ ID NO: 2734090 - RNA, 13 nt, Haemophilus influenzae Rd
uuaagcaccauca

SEQ ID NO: 2734091 - RNA, 20 nt, Haemophilus influenzae Rd
uuaagcaccaucauagauaa

SEQ ID NO: 2734092 - RNA, 20 nt, Haemophilus influenzae Rd
uuaagcauuguccacagcaa

SEQ ID NO: 2734093 - RNA, 17 nt, Haemophilus influenzae Rd
uuaagccaucacugcca

SEQ ID NO: 2734094 - RNA, 22 nt, Haemophilus influenzae Rd
uuaagcccguuaauuaagcagc

SEQ ID NO: 2734095 - RNA, 19 nt, Haemophilus influenzae Rd
uuaagccuuuguagccauu

SEQ ID NO: 2734096 - RNA, 16 nt, Haemophilus influenzae Rd
uuaagcgugcuuugcu

SEQ ID NO: 2734097 - RNA, 19 nt, Haemophilus influenzae Rd
uuaagcuggcguucugucu

SEQ ID NO: 2734098 - RNA, 20 nt, Haemophilus influenzae Rd
uuaaggaaagccccauuucu

SEQ ID NO: 2734099 - RNA, 19 nt, Haemophilus influenzae Rd
uuaagguuaaauucacugu

SEQ ID NO: 2734100 - RNA, 19 nt, Haemophilus influenzae Rd
uuaagguuguuggcaaacu

SEQ ID NO: 2734101 - RNA, 13 nt, Haemophilus influenzae Rd
uuaagguuucuuc

SEQ ID NO: 2734102 - RNA, 12 nt, Haemophilus influenzae Rd
uuaagguuuuuu

SEQ ID NO: 2734103 - RNA, 16 nt, Haemophilus influenzae Rd
uuaaguaaaaguaaaa

SEQ ID NO: 2734104 - RNA, 14 nt, Haemophilus influenzae Rd
uuaaguaaauauuu

SEQ ID NO: 2734105 - RNA, 15 nt, Haemophilus influenzae Rd
uuaaguaauacauuu

SEQ ID NO: 2734106 - RNA, 18 nt, Haemophilus influenzae Rd
uuaaguaguauuuuauuu

SEQ ID NO: 2734107 - RNA, 18 nt, Haemophilus influenzae Rd
uuaaguaguguuuuauuu

SEQ ID NO: 2734108 - RNA, 15 nt, Haemophilus influenzae Rd
uuaaguauagcuuuu

SEQ ID NO: 2734109 - RNA, 19 nt, Haemophilus influenzae Rd
uuaaguaugccauaaaaua

SEQ ID NO: 2734110 - RNA, 20 nt, Haemophilus influenzae Rd
uuaagucagcauaaacaaaa

SEQ ID NO: 2734111 - RNA, 17 nt, Haemophilus influenzae Rd
uuaagucgauaaagaau

SEQ ID NO: 2734112 - RNA, 20 nt, Haemophilus influenzae Rd
uuaagugcaucaaccgauaa

SEQ ID NO: 2734113 - RNA, 19 nt, Haemophilus influenzae Rd
uuaagugcgguugaaaauu

SEQ ID NO: 2734114 - RNA, 18 nt, Haemophilus influenzae Rd
uuaaguucaacaccuaaa

SEQ ID NO: 2734115 - RNA, 15 nt, Haemophilus influenzae Rd
uuaaguuuccaagug

SEQ ID NO: 2734116 - RNA, 19 nt, Haemophilus influenzae Rd
uuaaguuugagcaaaucaa

SEQ ID NO: 2734117 - RNA, 18 nt, Haemophilus influenzae Rd
uuaaguuuucuacagaaa

SEQ ID NO: 2734118 - RNA, 17 nt, Haemophilus influenzae Rd
uuaauaaaaaaucugug

SEQ ID NO: 2734119 - RNA, 20 nt, Haemophilus influenzae Rd
uuaauaaaauguuuauauuu

SEQ ID NO: 2734120 - RNA, 13 nt, Haemophilus influenzae Rd
uuaauaaacauau

SEQ ID NO: 2734121 - RNA, 17 nt, Haemophilus influenzae Rd
uuaauaaacauauugau

SEQ ID NO: 2734122 - RNA, 12 nt, Haemophilus influenzae Rd
uuaauaaaccaa

SEQ ID NO: 2734123 - RNA, 18 nt, Haemophilus influenzae Rd
uuaauaaaccaacauaca

SEQ ID NO: 2734124 - RNA, 20 nt, Haemophilus influenzae Rd
uuaauaaaccaacauacauu

SEQ ID NO: 2734125 - RNA, 17 nt, Haemophilus influenzae Rd
uuaauaaaguaaaauau

SEQ ID NO: 2734126 - RNA, 18 nt, Haemophilus influenzae Rd
uuaauaaaguaaaauauu

SEQ ID NO: 2734127 - RNA, 19 nt, Haemophilus influenzae Rd
uuaauaaaguaaaauauug

SEQ ID NO: 2734128 - RNA, 21 nt, Haemophilus influenzae Rd
uuaauaaagucgguucauuug

SEQ ID NO: 2734129 - RNA, 13 nt, Haemophilus influenzae Rd
uuaauaaauauua

SEQ ID NO: 2734130 - RNA, 14 nt, Haemophilus influenzae Rd
uuaauaaauauuga

SEQ ID NO: 2734131 - RNA, 19 nt, Haemophilus influenzae Rd
uuaauaaauauugauuacc

SEQ ID NO: 2734132 - RNA, 19 nt, Haemophilus influenzae Rd
uuaauaacauagaaaucac

SEQ ID NO: 2734133 - RNA, 13 nt, Haemophilus influenzae Rd
uuaauaacgugua

SEQ ID NO: 2734134 - RNA, 15 nt, Haemophilus influenzae Rd
uuaauaacugaauaa

SEQ ID NO: 2734135 - RNA, 16 nt, Haemophilus influenzae Rd
uuaauaacugaauaau

SEQ ID NO: 2734136 - RNA, 17 nt, Haemophilus influenzae Rd
uuaauaagccauuuucu

SEQ ID NO: 2734137 - RNA, 18 nt, Haemophilus influenzae Rd
uuaauaagcccaacuuaa

SEQ ID NO: 2734138 - RNA, 19 nt, Haemophilus influenzae Rd
uuaauaagccuugcauaau

SEQ ID NO: 2734139 - RNA, 15 nt, Haemophilus influenzae Rd
uuaauaaucacaauu

SEQ ID NO: 2734140 - RNA, 17 nt, Haemophilus influenzae Rd
uuaauaaucuuaaauaa

SEQ ID NO: 2734141 - RNA, 15 nt, Haemophilus influenzae Rd
uuaauaauggauuaa

SEQ ID NO: 2734142 - RNA, 23 nt, Haemophilus influenzae Rd
uuaauaauguauuucuaacaaau

SEQ ID NO: 2734143 - RNA, 12 nt, Haemophilus influenzae Rd
uuaauaauuuaa

SEQ ID NO: 2734144 - RNA, 15 nt, Haemophilus influenzae Rd
uuaauaccauacaua

SEQ ID NO: 2734145 - RNA, 17 nt, Haemophilus influenzae Rd
uuaauacgaacuaaaag

SEQ ID NO: 2734146 - RNA, 18 nt, Haemophilus influenzae Rd
uuaauacgccaagauaac

SEQ ID NO: 2734147 - RNA, 18 nt, Haemophilus influenzae Rd
uuaauacguuguuguucu

SEQ ID NO: 2734148 - RNA, 20 nt, Haemophilus influenzae Rd
uuaauacugcugaauaaacc

SEQ ID NO: 2734149 - RNA, 21 nt, Haemophilus influenzae Rd
uuaauacuuggugcaauaaaa

SEQ ID NO: 2734150 - RNA, 15 nt, Haemophilus influenzae Rd
uuaauacuuucagcu

SEQ ID NO: 2734151 - RNA, 14 nt, Haemophilus influenzae Rd
uuaauagaauauaa

SEQ ID NO: 2734152 - RNA, 16 nt, Haemophilus influenzae Rd
uuaauagagaauaauu

SEQ ID NO: 2734153 - RNA, 14 nt, Haemophilus influenzae Rd
uuaauagcauugua

SEQ ID NO: 2734154 - RNA, 22 nt, Haemophilus influenzae Rd
uuaauagcgugcauuccuaaaa

SEQ ID NO: 2734155 - RNA, 18 nt, Haemophilus influenzae Rd
uuaauagcugggcaaaau

SEQ ID NO: 2734156 - RNA, 17 nt, Haemophilus influenzae Rd
uuaauaguaaacuuuua

SEQ ID NO: 2734157 - RNA, 23 nt, Haemophilus influenzae Rd
uuaauaguugagcuaaagugcgg

SEQ ID NO: 2734158 - RNA, 22 nt, Haemophilus influenzae Rd
uuaauauaaaggauuuuaucau

SEQ ID NO: 2734159 - RNA, 17 nt, Haemophilus influenzae Rd
uuaauauaccccaaacu

SEQ ID NO: 2734160 - RNA, 20 nt, Haemophilus influenzae Rd
uuaauaucaugcaauucccu

SEQ ID NO: 2734161 - RNA, 11 nt, Haemophilus influenzae Rd
uuaauaugcau

SEQ ID NO: 2734162 - RNA, 20 nt, Haemophilus influenzae Rd
uuaauaugccaaauaaaauu

SEQ ID NO: 2734163 - RNA, 17 nt, Haemophilus influenzae Rd
uuaauauuuuuuucaaa

SEQ ID NO: 2734164 - RNA, 14 nt, Haemophilus influenzae Rd
uuaaucaaauaaaa

SEQ ID NO: 2734165 - RNA, 19 nt, Haemophilus influenzae Rd
uuaaucaaauaaaauauuu

SEQ ID NO: 2734166 - RNA, 13 nt, Haemophilus influenzae Rd
uuaaucaauaaga

SEQ ID NO: 2734167 - RNA, 12 nt, Haemophilus influenzae Rd
uuaaucaauuug

SEQ ID NO: 2734168 - RNA, 21 nt, Haemophilus influenzae Rd
uuaaucacacuugcaccacca

SEQ ID NO: 2734169 - RNA, 13 nt, Haemophilus influenzae Rd
uuaaucauuuuca

SEQ ID NO: 2734170 - RNA, 15 nt, Haemophilus influenzae Rd
uuaaucauuuucacu

SEQ ID NO: 2734171 - RNA, 18 nt, Haemophilus influenzae Rd
uuaaucauuuuuuaacuu

SEQ ID NO: 2734172 - RNA, 22 nt, Haemophilus influenzae Rd
uuaauccaucgcaagauaagau

SEQ ID NO: 2734173 - RNA, 16 nt, Haemophilus influenzae Rd
uuaauccguuggucga

SEQ ID NO: 2734174 - RNA, 14 nt, Haemophilus influenzae Rd
uuaauccugucauc

SEQ ID NO: 2734175 - RNA, 12 nt, Haemophilus influenzae Rd
uuaaucgaucaa

SEQ ID NO: 2734176 - RNA, 17 nt, Haemophilus influenzae Rd
uuaaucgcccuuuuguu

SEQ ID NO: 2734177 - RNA, 16 nt, Haemophilus influenzae Rd
uuaaucugcaccuuaa

SEQ ID NO: 2734178 - RNA, 12 nt, Haemophilus influenzae Rd
uuaaucugucac

SEQ ID NO: 2734179 - RNA, 14 nt, Haemophilus influenzae Rd
uuaaucuuaaagaa

SEQ ID NO: 2734180 - RNA, 21 nt, Haemophilus influenzae Rd
uuaaucuuaaagaauuucuuu

SEQ ID NO: 2734181 - RNA, 15 nt, Haemophilus influenzae Rd
uuaaugaaaguaaca

SEQ ID NO: 2734182 - RNA, 22 nt, Haemophilus influenzae Rd
uuaaugaaccaaaucuaacauu

SEQ ID NO: 2734183 - RNA, 22 nt, Haemophilus influenzae Rd
uuaaugaacuuucuacgacauu

SEQ ID NO: 2734184 - RNA, 23 nt, Haemophilus influenzae Rd
uuaaugaacuuucuacgacauuu

SEQ ID NO: 2734185 - RNA, 14 nt, Haemophilus influenzae Rd
uuaaugacauuaaa

SEQ ID NO: 2734186 - RNA, 16 nt, Haemophilus influenzae Rd
uuaaugcaaaaucuuu

SEQ ID NO: 2734187 - RNA, 18 nt, Haemophilus influenzae Rd
uuaaugccccuaauuauu

SEQ ID NO: 2734188 - RNA, 20 nt, Haemophilus influenzae Rd
uuaaugccccuaauuauuua

SEQ ID NO: 2734189 - RNA, 14 nt, Haemophilus influenzae Rd
uuaaugccugaucu

SEQ ID NO: 2734190 - RNA, 21 nt, Haemophilus influenzae Rd
uuaaugcggugcuuuaaguaa

SEQ ID NO: 2734191 - RNA, 15 nt, Haemophilus influenzae Rd
uuaaugcgugcuagu

SEQ ID NO: 2734192 - RNA, 16 nt, Haemophilus influenzae Rd
uuaaugcuaaaccaau

SEQ ID NO: 2734193 - RNA, 23 nt, Haemophilus influenzae Rd
uuaaugggggaauaaauucugag

SEQ ID NO: 2734194 - RNA, 19 nt, Haemophilus influenzae Rd
uuaauggguuaaaagccaa

SEQ ID NO: 2734195 - RNA, 22 nt, Haemophilus influenzae Rd
uuaaugguauugugauuacucu

SEQ ID NO: 2734196 - RNA, 18 nt, Haemophilus influenzae Rd
uuaauguaaacaaaaaua

SEQ ID NO: 2734197 - RNA, 16 nt, Haemophilus influenzae Rd
uuaauguaguaaaucc

SEQ ID NO: 2734198 - RNA, 14 nt, Haemophilus influenzae Rd
uuaauuaaauacaa

SEQ ID NO: 2734199 - RNA, 22 nt, Haemophilus influenzae Rd
uuaauuaaauaugauaaaugca

SEQ ID NO: 2734200 - RNA, 16 nt, Haemophilus influenzae Rd
uuaauuaacgcucaaa

SEQ ID NO: 2734201 - RNA, 13 nt, Haemophilus influenzae Rd
uuaauuaaucuuu

SEQ ID NO: 2734202 - RNA, 15 nt, Haemophilus influenzae Rd
uuaauuaauugcucu

SEQ ID NO: 2734203 - RNA, 18 nt, Haemophilus influenzae Rd
uuaauuacucacuauaac

SEQ ID NO: 2734204 - RNA, 16 nt, Haemophilus influenzae Rd
uuaauuagaauaacaa

SEQ ID NO: 2734205 - RNA, 20 nt, Haemophilus influenzae Rd
uuaauuagaauaacaacaaa

SEQ ID NO: 2734206 - RNA, 17 nt, Haemophilus influenzae Rd
uuaauuaucaaaaagaa

SEQ ID NO: 2734207 - RNA, 22 nt, Haemophilus influenzae Rd
uuaauuauuuuaaauaaauaau

SEQ ID NO: 2734208 - RNA, 16 nt, Haemophilus influenzae Rd
uuaauuauuuuacuuu

SEQ ID NO: 2734209 - RNA, 22 nt, Haemophilus influenzae Rd
uuaauucacuacgauuuaaugu

SEQ ID NO: 2734210 - RNA, 20 nt, Haemophilus influenzae Rd
uuaauucagggauuaagaaa

SEQ ID NO: 2734211 - RNA, 21 nt, Haemophilus influenzae Rd
uuaauucagggauuaagaaaa

SEQ ID NO: 2734212 - RNA, 15 nt, Haemophilus influenzae Rd
uuaauucgaucagca

SEQ ID NO: 2734213 - RNA, 18 nt, Haemophilus influenzae Rd
uuaauucgcugauuuauu

SEQ ID NO: 2734214 - RNA, 23 nt, Haemophilus influenzae Rd
uuaauucuaaauucucaagaaua

SEQ ID NO: 2734215 - RNA, 23 nt, Haemophilus influenzae Rd
uuaauucuucgaugcuuuuucau

SEQ ID NO: 2734216 - RNA, 17 nt, Haemophilus influenzae Rd
uuaauugaaagauuaau

SEQ ID NO: 2734217 - RNA, 20 nt, Haemophilus influenzae Rd
uuaauugacaauuaauauaa

SEQ ID NO: 2734218 - RNA, 20 nt, Haemophilus influenzae Rd
uuaauuggaaauaauauuca

SEQ ID NO: 2734219 - RNA, 21 nt, Haemophilus influenzae Rd
uuaauuggaaauaauauucaa

SEQ ID NO: 2734220 - RNA, 12 nt, Haemophilus influenzae Rd
uuaauuuaaaua

SEQ ID NO: 2734221 - RNA, 22 nt, Haemophilus influenzae Rd
uuaauuuaacagguacuuuuac

SEQ ID NO: 2734222 - RNA, 12 nt, Haemophilus influenzae Rd
uuaauuuaauuc

SEQ ID NO: 2734223 - RNA, 19 nt, Haemophilus influenzae Rd
uuaauuuagagccauacua

SEQ ID NO: 2734224 - RNA, 18 nt, Haemophilus influenzae Rd
uuaauuuagauaaaaauu

SEQ ID NO: 2734225 - RNA, 21 nt, Haemophilus influenzae Rd
uuaauuuauuuucuaauaaga

SEQ ID NO: 2734226 - RNA, 15 nt, Haemophilus influenzae Rd
uuaauuucacauuau

SEQ ID NO: 2734227 - RNA, 19 nt, Haemophilus influenzae Rd
uuaauuucauucaacaauu

SEQ ID NO: 2734228 - RNA, 21 nt, Haemophilus influenzae Rd
uuaauuucgccagaacuuuuu

SEQ ID NO: 2734229 - RNA, 13 nt, Haemophilus influenzae Rd
uuaauuucgcuuu

SEQ ID NO: 2734230 - RNA, 16 nt, Haemophilus influenzae Rd
uuaauuucuuaauuaa

SEQ ID NO: 2734231 - RNA, 17 nt, Haemophilus influenzae Rd
uuaauuucuuuuccuug

SEQ ID NO: 2734232 - RNA, 15 nt, Haemophilus influenzae Rd
uuaauuuuauagaaa

SEQ ID NO: 2734233 - RNA, 15 nt, Haemophilus influenzae Rd
uuaauuuuuaaagaa

SEQ ID NO: 2734234 - RNA, 12 nt, Haemophilus influenzae Rd
uuaauuuuuccg

SEQ ID NO: 2734235 - RNA, 11 nt, Haemophilus influenzae Rd
uuaauuuuucg

SEQ ID NO: 2734236 - RNA, 17 nt, Haemophilus influenzae Rd
uuaauuuuuuauaaaau

SEQ ID NO: 2734237 - RNA, 21 nt, Haemophilus influenzae Rd
uuaauuuuuuauaaaauuuca

SEQ ID NO: 2734238 - RNA, 14 nt, Haemophilus influenzae Rd
uuacaaaaaaguac

SEQ ID NO: 2734239 - RNA, 13 nt, Haemophilus influenzae Rd
uuacaaaaaguac

SEQ ID NO: 2734240 - RNA, 13 nt, Haemophilus influenzae Rd
uuacaaaaccaau

SEQ ID NO: 2734241 - RNA, 14 nt, Haemophilus influenzae Rd
uuacaaaauauacg

SEQ ID NO: 2734242 - RNA, 21 nt, Haemophilus influenzae Rd
uuacaaauagcuguaagauaa

SEQ ID NO: 2734243 - RNA, 23 nt, Haemophilus influenzae Rd
uuacaacgccaucuuuaaagugu

SEQ ID NO: 2734244 - RNA, 15 nt, Haemophilus influenzae Rd
uuacaacucuaaauu

SEQ ID NO: 2734245 - RNA, 21 nt, Haemophilus influenzae Rd
uuacaauccuaacuuuucuuc

SEQ ID NO: 2734246 - RNA, 15 nt, Haemophilus influenzae Rd
uuacacaaaauauuc

SEQ ID NO: 2734247 - RNA, 18 nt, Haemophilus influenzae Rd
uuacacagaugccauuaa

SEQ ID NO: 2734248 - RNA, 19 nt, Haemophilus influenzae Rd
uuacacagaugccauuaaa

SEQ ID NO: 2734249 - RNA, 16 nt, Haemophilus influenzae Rd
uuacaccguccaaggu

SEQ ID NO: 2734250 - RNA, 15 nt, Haemophilus influenzae Rd
uuacaccuaacauau

SEQ ID NO: 2734251 - RNA, 14 nt, Haemophilus influenzae Rd
uuacacgagcaaug

SEQ ID NO: 2734252 - RNA, 14 nt, Haemophilus influenzae Rd
uuacagaaauauua

SEQ ID NO: 2734253 - RNA, 15 nt, Haemophilus influenzae Rd
uuacagaacaaaaua

SEQ ID NO: 2734254 - RNA, 16 nt, Haemophilus influenzae Rd
uuacagaacaaaauaa

SEQ ID NO: 2734255 - RNA, 18 nt, Haemophilus influenzae Rd
uuacagaacaaaauaauu

SEQ ID NO: 2734256 - RNA, 23 nt, Haemophilus influenzae Rd
uuacagaaccgccguauugaaua

SEQ ID NO: 2734257 - RNA, 13 nt, Haemophilus influenzae Rd
uuacagcaaaagc

SEQ ID NO: 2734258 - RNA, 18 nt, Haemophilus influenzae Rd
uuacagguuugacauuca

SEQ ID NO: 2734259 - RNA, 18 nt, Haemophilus influenzae Rd
uuacaguuugcgugaaua

SEQ ID NO: 2734260 - RNA, 23 nt, Haemophilus influenzae Rd
uuacauaaauucucgccauaaua

SEQ ID NO: 2734261 - RNA, 20 nt, Haemophilus influenzae Rd
uuacauagauugaaaaguaa

SEQ ID NO: 2734262 - RNA, 15 nt, Haemophilus influenzae Rd
uuacauauaaagauu

SEQ ID NO: 2734263 - RNA, 16 nt, Haemophilus influenzae Rd
uuacaucgaauuguuu

SEQ ID NO: 2734264 - RNA, 16 nt, Haemophilus influenzae Rd
uuacaucuacaauuug

SEQ ID NO: 2734265 - RNA, 14 nt, Haemophilus influenzae Rd
uuacaucuucaaaa

SEQ ID NO: 2734266 - RNA, 21 nt, Haemophilus influenzae Rd
uuacaucuucaaaaacauaau

SEQ ID NO: 2734267 - RNA, 24 nt, Haemophilus influenzae Rd
uuacauuaagugcguguauauauu

SEQ ID NO: 2734268 - RNA, 16 nt, Haemophilus influenzae Rd
uuacauuauuuaauuu

SEQ ID NO: 2734269 - RNA, 13 nt, Haemophilus influenzae Rd
uuacauugcuuaa

SEQ ID NO: 2734270 - RNA, 11 nt, Haemophilus influenzae Rd
uuacauuuaaa

SEQ ID NO: 2734271 - RNA, 22 nt, Haemophilus influenzae Rd
uuacauuuggcaaaauaaucag

SEQ ID NO: 2734272 - RNA, 21 nt, Haemophilus influenzae Rd
uuaccaaccgaauauaugguu

SEQ ID NO: 2734273 - RNA, 17 nt, Haemophilus influenzae Rd
uuaccaaccgguaaaau

SEQ ID NO: 2734274 - RNA, 22 nt, Haemophilus influenzae Rd
uuaccaaccgguaaaauuaaug

SEQ ID NO: 2734275 - RNA, 18 nt, Haemophilus influenzae Rd
uuaccacccaaaauuuca

SEQ ID NO: 2734276 - RNA, 22 nt, Haemophilus influenzae Rd
uuaccacgaguauauugcauaa

SEQ ID NO: 2734277 - RNA, 12 nt, Haemophilus influenzae Rd
uuaccauaaaac

SEQ ID NO: 2734278 - RNA, 21 nt, Haemophilus influenzae Rd
uuaccaucacguuaucaaaga

SEQ ID NO: 2734279 - RNA, 17 nt, Haemophilus influenzae Rd
uuaccaugccauuuccu

SEQ ID NO: 2734280 - RNA, 17 nt, Haemophilus influenzae Rd
uuaccauuacauaaaac

SEQ ID NO: 2734281 - RNA, 13 nt, Haemophilus influenzae Rd
uuaccauugcguu

SEQ ID NO: 2734282 - RNA, 18 nt, Haemophilus influenzae Rd
uuacccacuucauauaaa

SEQ ID NO: 2734283 - RNA, 19 nt, Haemophilus influenzae Rd
uuaccccaacaaacacgca

SEQ ID NO: 2734284 - RNA, 23 nt, Haemophilus influenzae Rd
uuacccuauuacuuuccauaaua

SEQ ID NO: 2734285 - RNA, 21 nt, Haemophilus influenzae Rd
uuaccgcacuuuaccauuaca

SEQ ID NO: 2734286 - RNA, 21 nt, Haemophilus influenzae Rd
uuaccgcacuuuauaguugua

SEQ ID NO: 2734287 - RNA, 15 nt, Haemophilus influenzae Rd
uuaccgcacuuuuuu

SEQ ID NO: 2734288 - RNA, 17 nt, Haemophilus influenzae Rd
uuaccgcucgccaauaa

SEQ ID NO: 2734289 - RNA, 14 nt, Haemophilus influenzae Rd
uuaccgcuucuucc

SEQ ID NO: 2734290 - RNA, 16 nt, Haemophilus influenzae Rd
uuaccgcuucuuccug

SEQ ID NO: 2734291 - RNA, 23 nt, Haemophilus influenzae Rd
uuaccgucaugggauaaacauuu

SEQ ID NO: 2734292 - RNA, 19 nt, Haemophilus influenzae Rd
uuaccugauucauugcauu

SEQ ID NO: 2734293 - RNA, 16 nt, Haemophilus influenzae Rd
uuaccugugaaaacac

SEQ ID NO: 2734294 - RNA, 16 nt, Haemophilus influenzae Rd
uuaccuguugcauuag

SEQ ID NO: 2734295 - RNA, 19 nt, Haemophilus influenzae Rd
uuaccuucagcacuuaaug

SEQ ID NO: 2734296 - RNA, 21 nt, Haemophilus influenzae Rd
uuaccuugcauuucuuuaaua

SEQ ID NO: 2734297 - RNA, 14 nt, Haemophilus influenzae Rd
uuacgaaaacuuuc

SEQ ID NO: 2734298 - RNA, 13 nt, Haemophilus influenzae Rd
uuacgaagaaucc

SEQ ID NO: 2734299 - RNA, 17 nt, Haemophilus influenzae Rd
uuacgaagaauccacau

SEQ ID NO: 2734300 - RNA, 15 nt, Haemophilus influenzae Rd
uuacgaccuuuacuu

SEQ ID NO: 2734301 - RNA, 21 nt, Haemophilus influenzae Rd
uuacgcgcagcaccaaagaaa

SEQ ID NO: 2734302 - RNA, 14 nt, Haemophilus influenzae Rd
uuacgcuuuacuac

SEQ ID NO: 2734303 - RNA, 17 nt, Haemophilus influenzae Rd
uuacggauaauuucccu

SEQ ID NO: 2734304 - RNA, 13 nt, Haemophilus influenzae Rd
uuacguaauaagu

SEQ ID NO: 2734305 - RNA, 20 nt, Haemophilus influenzae Rd
uuacguagaaaacaauaaaa

SEQ ID NO: 2734306 - RNA, 19 nt, Haemophilus influenzae Rd
uuacgugauuuaguugggu

SEQ ID NO: 2734307 - RNA, 17 nt, Haemophilus influenzae Rd
uuacgugcgaauuuuua

SEQ ID NO: 2734308 - RNA, 18 nt, Haemophilus influenzae Rd
uuacgugugcgauucauc

SEQ ID NO: 2734309 - RNA, 16 nt, Haemophilus influenzae Rd
uuacguucauaaggug

SEQ ID NO: 2734310 - RNA, 16 nt, Haemophilus influenzae Rd
uuacguuucauuuuug

SEQ ID NO: 2734311 - RNA, 18 nt, Haemophilus influenzae Rd
uuacguuucauuuuugca

SEQ ID NO: 2734312 - RNA, 22 nt, Haemophilus influenzae Rd
uuacuaaaugugacauuguaaa

SEQ ID NO: 2734313 - RNA, 13 nt, Haemophilus influenzae Rd
uuacuaaugccgc

SEQ ID NO: 2734314 - RNA, 14 nt, Haemophilus influenzae Rd
uuacuaauuaaaag

SEQ ID NO: 2734315 - RNA, 17 nt, Haemophilus influenzae Rd
uuacuauuaaugcucua

SEQ ID NO: 2734316 - RNA, 15 nt, Haemophilus influenzae Rd
uuacuauucuucaau

SEQ ID NO: 2734317 - RNA, 14 nt, Haemophilus influenzae Rd
uuacucacaacaaa

SEQ ID NO: 2734318 - RNA, 16 nt, Haemophilus influenzae Rd
uuacucacuauaacuu

SEQ ID NO: 2734319 - RNA, 23 nt, Haemophilus influenzae Rd
uuacuccuagcagcaauagauaa

SEQ ID NO: 2734320 - RNA, 15 nt, Haemophilus influenzae Rd
uuacugcaacgcuuu

SEQ ID NO: 2734321 - RNA, 23 nt, Haemophilus influenzae Rd
uuacugucaccucguaaaauauu

SEQ ID NO: 2734322 - RNA, 18 nt, Haemophilus influenzae Rd
uuacugucgaaccaaguu

SEQ ID NO: 2734323 - RNA, 20 nt, Haemophilus influenzae Rd
uuacuguucaaauaagcguu

SEQ ID NO: 2734324 - RNA, 17 nt, Haemophilus influenzae Rd
uuacuguuuuuauauuu

SEQ ID NO: 2734325 - RNA, 16 nt, Haemophilus influenzae Rd
uuacuuagauauauua

SEQ ID NO: 2734326 - RNA, 14 nt, Haemophilus influenzae Rd
uuacuucaucaaaa

SEQ ID NO: 2734327 - RNA, 14 nt, Haemophilus influenzae Rd
uuacuucuacuucu

SEQ ID NO: 2734328 - RNA, 20 nt, Haemophilus influenzae Rd
uuacuuggaauaucaucuag

SEQ ID NO: 2734329 - RNA, 17 nt, Haemophilus influenzae Rd
uuacuuuauaaaugauu

SEQ ID NO: 2734330 - RNA, 19 nt, Haemophilus influenzae Rd
uuacuuuauacuaaaagua

SEQ ID NO: 2734331 - RNA, 21 nt, Haemophilus influenzae Rd
uuacuuuuagauaaauuucaa

SEQ ID NO: 2734332 - RNA, 19 nt, Haemophilus influenzae Rd
uuacuuuucgauagaacaa

SEQ ID NO: 2734333 - RNA, 14 nt, Haemophilus influenzae Rd
uuacuuuucuucac

SEQ ID NO: 2734334 - RNA, 22 nt, Haemophilus influenzae Rd
uuacuuuuuaauaaaucaagca

SEQ ID NO: 2734335 - RNA, 13 nt, Haemophilus influenzae Rd
uuacuuuuuuaag

SEQ ID NO: 2734336 - RNA, 15 nt, Haemophilus influenzae Rd
uuacuuuuuuaagua

SEQ ID NO: 2734337 - RNA, 16 nt, Haemophilus influenzae Rd
uuagaaaguaaacaau

SEQ ID NO: 2734338 - RNA, 22 nt, Haemophilus influenzae Rd
uuagaacaauacucuuaacaaa

SEQ ID NO: 2734339 - RNA, 17 nt, Haemophilus influenzae Rd
uuagaacaauauuuaua

SEQ ID NO: 2734340 - RNA, 16 nt, Haemophilus influenzae Rd
uuagaacuuagccuuu

SEQ ID NO: 2734341 - RNA, 22 nt, Haemophilus influenzae Rd
uuagaauauaacaccaaacaga

SEQ ID NO: 2734342 - RNA, 23 nt, Haemophilus influenzae Rd
uuagaaucgcccacgaaaagcac

SEQ ID NO: 2734343 - RNA, 17 nt, Haemophilus influenzae Rd
uuagaaucguuagcuuu

SEQ ID NO: 2734344 - RNA, 13 nt, Haemophilus influenzae Rd
uuagacaaaaaug

SEQ ID NO: 2734345 - RNA, 18 nt, Haemophilus influenzae Rd
uuagacaacaacuuuucu

SEQ ID NO: 2734346 - RNA, 22 nt, Haemophilus influenzae Rd
uuagacaacaacuuuucuaaac

SEQ ID NO: 2734347 - RNA, 17 nt, Haemophilus influenzae Rd
uuagacaauaaaacaca

SEQ ID NO: 2734348 - RNA, 19 nt, Haemophilus influenzae Rd
uuagacagacuauuucugu

SEQ ID NO: 2734349 - RNA, 20 nt, Haemophilus influenzae Rd
uuagacggugaaaauuuacu

SEQ ID NO: 2734350 - RNA, 20 nt, Haemophilus influenzae Rd
uuagagagaaaaaucgucaa

SEQ ID NO: 2734351 - RNA, 21 nt, Haemophilus influenzae Rd
uuagagagaaaaaucgucaaa

SEQ ID NO: 2734352 - RNA, 16 nt, Haemophilus influenzae Rd
uuagagccaucaauug

SEQ ID NO: 2734353 - RNA, 17 nt, Haemophilus influenzae Rd
uuagagggauaaaaauc

SEQ ID NO: 2734354 - RNA, 15 nt, Haemophilus influenzae Rd
uuagauaaaaauuuc

SEQ ID NO: 2734355 - RNA, 20 nt, Haemophilus influenzae Rd
uuagauaaauuucaauuaaa

SEQ ID NO: 2734356 - RNA, 19 nt, Haemophilus influenzae Rd
uuagauacuuuacguaaag

SEQ ID NO: 2734357 - RNA, 15 nt, Haemophilus influenzae Rd
uuagaucagaaaacg

SEQ ID NO: 2734358 - RNA, 19 nt, Haemophilus influenzae Rd
uuagaugcuguaaaucuuu

SEQ ID NO: 2734359 - RNA, 23 nt, Haemophilus influenzae Rd
uuagauuauggcugacuagauaa

SEQ ID NO: 2734360 - RNA, 20 nt, Haemophilus influenzae Rd
uuagauugaacguuuaacuu

SEQ ID NO: 2734361 - RNA, 14 nt, Haemophilus influenzae Rd
uuagauuugaaccu

SEQ ID NO: 2734362 - RNA, 23 nt, Haemophilus influenzae Rd
uuagauuuucuuauuauacauuu

SEQ ID NO: 2734363 - RNA, 20 nt, Haemophilus influenzae Rd
uuagcaacugcugaacgcua

SEQ ID NO: 2734364 - RNA, 20 nt, Haemophilus influenzae Rd
uuagcaaggcguucaauauu

SEQ ID NO: 2734365 - RNA, 22 nt, Haemophilus influenzae Rd
uuagcagguuuuuuauuucuca

SEQ ID NO: 2734366 - RNA, 18 nt, Haemophilus influenzae Rd
uuagccacgaaagcuuca

SEQ ID NO: 2734367 - RNA, 14 nt, Haemophilus influenzae Rd
uuagcccaccaauu

SEQ ID NO: 2734368 - RNA, 19 nt, Haemophilus influenzae Rd
uuagccuagauauuucuag

SEQ ID NO: 2734369 - RNA, 16 nt, Haemophilus influenzae Rd
uuagccuguucuucca

SEQ ID NO: 2734370 - RNA, 20 nt, Haemophilus influenzae Rd
uuagccuguucuuccaccgc

SEQ ID NO: 2734371 - RNA, 21 nt, Haemophilus influenzae Rd
uuagccuguucuuccaccgcu

SEQ ID NO: 2734372 - RNA, 21 nt, Haemophilus influenzae Rd
uuagcgaguucuuggauaauu

SEQ ID NO: 2734373 - RNA, 10 nt, Haemophilus influenzae Rd
uuagcgauua

SEQ ID NO: 2734374 - RNA, 12 nt, Haemophilus influenzae Rd
uuagcguaaaca

SEQ ID NO: 2734375 - RNA, 17 nt, Haemophilus influenzae Rd
uuagcguaaacauuuug

SEQ ID NO: 2734376 - RNA, 18 nt, Haemophilus influenzae Rd
uuagcguacagaccauug

SEQ ID NO: 2734377 - RNA, 19 nt, Haemophilus influenzae Rd
uuagcgugaauauauuauu

SEQ ID NO: 2734378 - RNA, 15 nt, Haemophilus influenzae Rd
uuagcuaaaaaaacu

SEQ ID NO: 2734379 - RNA, 14 nt, Haemophilus influenzae Rd
uuagcuaaugcaaa

SEQ ID NO: 2734380 - RNA, 19 nt, Haemophilus influenzae Rd
uuagcuauuaaauuagacu

SEQ ID NO: 2734381 - RNA, 20 nt, Haemophilus influenzae Rd
uuagcucagucgguagagca

SEQ ID NO: 2734382 - RNA, 23 nt, Haemophilus influenzae Rd
uuagcuccuaaauuaggcauuug

SEQ ID NO: 2734383 - RNA, 21 nt, Haemophilus influenzae Rd
uuagcucguugccauaaaaaa

SEQ ID NO: 2734384 - RNA, 16 nt, Haemophilus influenzae Rd
uuagcugguuuauuua

SEQ ID NO: 2734385 - RNA, 12 nt, Haemophilus influenzae Rd
uuagcuuucaua

SEQ ID NO: 2734386 - RNA, 20 nt, Haemophilus influenzae Rd
uuaggaauaucuuugacuaa

SEQ ID NO: 2734387 - RNA, 19 nt, Haemophilus influenzae Rd
uuaggacaauauuuacucu

SEQ ID NO: 2734388 - RNA, 23 nt, Haemophilus influenzae Rd
uuaggagaagauuuauauuccau

SEQ ID NO: 2734389 - RNA, 21 nt, Haemophilus influenzae Rd
uuaggcgacgcugcaaaauga

SEQ ID NO: 2734390 - RNA, 21 nt, Haemophilus influenzae Rd
uuaggcuauuuuauaauuaau

SEQ ID NO: 2734391 - RNA, 16 nt, Haemophilus influenzae Rd
uuaggguaauuuuuuc

SEQ ID NO: 2734392 - RNA, 13 nt, Haemophilus influenzae Rd
uuagguaaaaauc

SEQ ID NO: 2734393 - RNA, 13 nt, Haemophilus influenzae Rd
uuagguuuaaaag

SEQ ID NO: 2734394 - RNA, 17 nt, Haemophilus influenzae Rd
uuagguuucaauuuacc

SEQ ID NO: 2734395 - RNA, 21 nt, Haemophilus influenzae Rd
uuaguaguuagaauuuuaacu

SEQ ID NO: 2734396 - RNA, 16 nt, Haemophilus influenzae Rd
uuaguauaaacaucag

SEQ ID NO: 2734397 - RNA, 18 nt, Haemophilus influenzae Rd
uuaguaucuuccauuaau

SEQ ID NO: 2734398 - RNA, 16 nt, Haemophilus influenzae Rd
uuaguauuuuugaaug

SEQ ID NO: 2734399 - RNA, 21 nt, Haemophilus influenzae Rd
uuagucauaaaaaagugcggu

SEQ ID NO: 2734400 - RNA, 13 nt, Haemophilus influenzae Rd
uuagucauacaga

SEQ ID NO: 2734401 - RNA, 23 nt, Haemophilus influenzae Rd
uuaguccuuaaacaaauguaucu

SEQ ID NO: 2734402 - RNA, 14 nt, Haemophilus influenzae Rd
uuaguccuuuagaa

SEQ ID NO: 2734403 - RNA, 17 nt, Haemophilus influenzae Rd
uuagucgucuauuuauu

SEQ ID NO: 2734404 - RNA, 18 nt, Haemophilus influenzae Rd
uuagucuuuuuaauuuaa

SEQ ID NO: 2734405 - RNA, 13 nt, Haemophilus influenzae Rd
uuagugaaaagaa

SEQ ID NO: 2734406 - RNA, 21 nt, Haemophilus influenzae Rd
uuagugaaaagaaaacuuaua

SEQ ID NO: 2734407 - RNA, 18 nt, Haemophilus influenzae Rd
uuagugcuguauauuuuu

SEQ ID NO: 2734408 - RNA, 19 nt, Haemophilus influenzae Rd
uuagugguuucagaauaaa

SEQ ID NO: 2734409 - RNA, 15 nt, Haemophilus influenzae Rd
uuagugguuugcaaa

SEQ ID NO: 2734410 - RNA, 21 nt, Haemophilus influenzae Rd
uuaguuagcuaaaaaaacuag

SEQ ID NO: 2734411 - RNA, 20 nt, Haemophilus influenzae Rd
uuaguucaaggacugaguuc

SEQ ID NO: 2734412 - RNA, 14 nt, Haemophilus influenzae Rd
uuaguucuggucag

SEQ ID NO: 2734413 - RNA, 16 nt, Haemophilus influenzae Rd
uuaguugguaaagauu

SEQ ID NO: 2734414 - RNA, 19 nt, Haemophilus influenzae Rd
uuaguuguuucaccauuuc

SEQ ID NO: 2734415 - RNA, 23 nt, Haemophilus influenzae Rd
uuaguuguuucaccauuuccuuu

SEQ ID NO: 2734416 - RNA, 18 nt, Haemophilus influenzae Rd
uuaguuuaagggcuaagu

SEQ ID NO: 2734417 - RNA, 19 nt, Haemophilus influenzae Rd
uuaguuucuaauucuucca

SEQ ID NO: 2734418 - RNA, 18 nt, Haemophilus influenzae Rd
uuaguuuuuuuauaaaaa

SEQ ID NO: 2734419 - RNA, 12 nt, Haemophilus influenzae Rd
uuauaaaaaaac

SEQ ID NO: 2734420 - RNA, 21 nt, Haemophilus influenzae Rd
uuauaaaaaaacaaguucuua

SEQ ID NO: 2734421 - RNA, 13 nt, Haemophilus influenzae Rd
uuauaaaaauauu

SEQ ID NO: 2734422 - RNA, 14 nt, Haemophilus influenzae Rd
uuauaaaaauauuu

SEQ ID NO: 2734423 - RNA, 17 nt, Haemophilus influenzae Rd
uuauaaaaauauuuuaa

SEQ ID NO: 2734424 - RNA, 15 nt, Haemophilus influenzae Rd
uuauaaaauagccua

SEQ ID NO: 2734425 - RNA, 11 nt, Haemophilus influenzae Rd
uuauaaaccag

SEQ ID NO: 2734426 - RNA, 18 nt, Haemophilus influenzae Rd
uuauaaaccaguuaaauc

SEQ ID NO: 2734427 - RNA, 12 nt, Haemophilus influenzae Rd
uuauaaauuacc

SEQ ID NO: 2734428 - RNA, 15 nt, Haemophilus influenzae Rd
uuauaaauuaccuug

SEQ ID NO: 2734429 - RNA, 11 nt, Haemophilus influenzae Rd
uuauaacauaa

SEQ ID NO: 2734430 - RNA, 22 nt, Haemophilus influenzae Rd
uuauaaccaguuauucuucaga

SEQ ID NO: 2734431 - RNA, 16 nt, Haemophilus influenzae Rd
uuauaacguuuaaaaa

SEQ ID NO: 2734432 - RNA, 21 nt, Haemophilus influenzae Rd
uuauaagauaagggcguagau

SEQ ID NO: 2734433 - RNA, 14 nt, Haemophilus influenzae Rd
uuauaagaugacuu

SEQ ID NO: 2734434 - RNA, 13 nt, Haemophilus influenzae Rd
uuauaagcuauuu

SEQ ID NO: 2734435 - RNA, 17 nt, Haemophilus influenzae Rd
uuauaagugccaacaau

SEQ ID NO: 2734436 - RNA, 16 nt, Haemophilus influenzae Rd
uuauaaguuuuuugcc

SEQ ID NO: 2734437 - RNA, 18 nt, Haemophilus influenzae Rd
uuauaaguuuuuugccaa

SEQ ID NO: 2734438 - RNA, 14 nt, Haemophilus influenzae Rd
uuauaauagacuga

SEQ ID NO: 2734439 - RNA, 16 nt, Haemophilus influenzae Rd
uuauaaugucaucuag

SEQ ID NO: 2734440 - RNA, 13 nt, Haemophilus influenzae Rd
uuauaauuaaauu

SEQ ID NO: 2734441 - RNA, 14 nt, Haemophilus influenzae Rd
uuauaauuaaauuc

SEQ ID NO: 2734442 - RNA, 21 nt, Haemophilus influenzae Rd
uuauaauuaaauucauuuaaa

SEQ ID NO: 2734443 - RNA, 18 nt, Haemophilus influenzae Rd
uuauaauuaauaaaaaau

SEQ ID NO: 2734444 - RNA, 13 nt, Haemophilus influenzae Rd
uuauacaaaaaag

SEQ ID NO: 2734445 - RNA, 13 nt, Haemophilus influenzae Rd
uuauacaacaaaa

SEQ ID NO: 2734446 - RNA, 17 nt, Haemophilus influenzae Rd
uuauacauuuaaccaaa

SEQ ID NO: 2734447 - RNA, 19 nt, Haemophilus influenzae Rd
uuauacauuuaaccaaaac

SEQ ID NO: 2734448 - RNA, 14 nt, Haemophilus influenzae Rd
uuauaccacauaaa

SEQ ID NO: 2734449 - RNA, 20 nt, Haemophilus influenzae Rd
uuauacgaguaaaaaaucua

SEQ ID NO: 2734450 - RNA, 16 nt, Haemophilus influenzae Rd
uuauacgcauaauaaa

SEQ ID NO: 2734451 - RNA, 19 nt, Haemophilus influenzae Rd
uuauacugccuuuaaagaa

SEQ ID NO: 2734452 - RNA, 18 nt, Haemophilus influenzae Rd
uuauacuuaaucaaauaa

SEQ ID NO: 2734453 - RNA, 15 nt, Haemophilus influenzae Rd
uuauagaaaagacaa

SEQ ID NO: 2734454 - RNA, 18 nt, Haemophilus influenzae Rd
uuauagaaaagacaauaa

SEQ ID NO: 2734455 - RNA, 19 nt, Haemophilus influenzae Rd
uuauagaaaagacaauaau

SEQ ID NO: 2734456 - RNA, 20 nt, Haemophilus influenzae Rd
uuauagaaaagacaauaauu

SEQ ID NO: 2734457 - RNA, 13 nt, Haemophilus influenzae Rd
uuauagaaaauau

SEQ ID NO: 2734458 - RNA, 17 nt, Haemophilus influenzae Rd
uuauagacuucaaguga

SEQ ID NO: 2734459 - RNA, 19 nt, Haemophilus influenzae Rd
uuauagagaaauaaucacu

SEQ ID NO: 2734460 - RNA, 16 nt, Haemophilus influenzae Rd
uuauagauaaauauca

SEQ ID NO: 2734461 - RNA, 21 nt, Haemophilus influenzae Rd
uuauagauaaauaucaaaauu

SEQ ID NO: 2734462 - RNA, 16 nt, Haemophilus influenzae Rd
uuauagcauuuaaaua

SEQ ID NO: 2734463 - RNA, 21 nt, Haemophilus influenzae Rd
uuauagccuauaauuaaaguu

SEQ ID NO: 2734464 - RNA, 18 nt, Haemophilus influenzae Rd
uuauaggauuaacguaag

SEQ ID NO: 2734465 - RNA, 15 nt, Haemophilus influenzae Rd
uuauaguauauuuau

SEQ ID NO: 2734466 - RNA, 13 nt, Haemophilus influenzae Rd
uuauaguuuuauu

SEQ ID NO: 2734467 - RNA, 23 nt, Haemophilus influenzae Rd
uuauauaaagcucuaauugaaau

SEQ ID NO: 2734468 - RNA, 15 nt, Haemophilus influenzae Rd
uuauauacuuccaca

SEQ ID NO: 2734469 - RNA, 14 nt, Haemophilus influenzae Rd
uuauauauaaaaua

SEQ ID NO: 2734470 - RNA, 19 nt, Haemophilus influenzae Rd
uuauauaugauaaaaauaa

SEQ ID NO: 2734471 - RNA, 21 nt, Haemophilus influenzae Rd
uuauauguaaaauuuuuaucu

SEQ ID NO: 2734472 - RNA, 18 nt, Haemophilus influenzae Rd
uuauauguuccuuuuugg

SEQ ID NO: 2734473 - RNA, 15 nt, Haemophilus influenzae Rd
uuauauucauuuaaa

SEQ ID NO: 2734474 - RNA, 22 nt, Haemophilus influenzae Rd
uuauauuccauuauuuaucauc

SEQ ID NO: 2734475 - RNA, 18 nt, Haemophilus influenzae Rd
uuauauuccuuauucaaa

SEQ ID NO: 2734476 - RNA, 20 nt, Haemophilus influenzae Rd
uuauauuccuuauucaaaua

SEQ ID NO: 2734477 - RNA, 20 nt, Haemophilus influenzae Rd
uuauauuguugcacauuaau

SEQ ID NO: 2734478 - RNA, 21 nt, Haemophilus influenzae Rd
uuauauuuccaucaaaagauc

SEQ ID NO: 2734479 - RNA, 22 nt, Haemophilus influenzae Rd
uuauauuuuccuguuaauucuu

SEQ ID NO: 2734480 - RNA, 13 nt, Haemophilus influenzae Rd
uuauauuuucuua

SEQ ID NO: 2734481 - RNA, 18 nt, Haemophilus influenzae Rd
uuauauuuuuaauuuaua

SEQ ID NO: 2734482 - RNA, 15 nt, Haemophilus influenzae Rd
uuaucaaaaaacgaa

SEQ ID NO: 2734483 - RNA, 14 nt, Haemophilus influenzae Rd
uuaucaaaaagaaa

SEQ ID NO: 2734484 - RNA, 12 nt, Haemophilus influenzae Rd
uuaucaaagaaa

SEQ ID NO: 2734485 - RNA, 16 nt, Haemophilus influenzae Rd
uuaucaaagaaacugu

SEQ ID NO: 2734486 - RNA, 19 nt, Haemophilus influenzae Rd
uuaucaaagaaacugucua

SEQ ID NO: 2734487 - RNA, 13 nt, Haemophilus influenzae Rd
uuaucaacaucaa

SEQ ID NO: 2734488 - RNA, 23 nt, Haemophilus influenzae Rd
uuaucaaggcuuuaauuuuaucu

SEQ ID NO: 2734489 - RNA, 13 nt, Haemophilus influenzae Rd
uuaucaauaacug

SEQ ID NO: 2734490 - RNA, 15 nt, Haemophilus influenzae Rd
uuaucaauaacugau

SEQ ID NO: 2734491 - RNA, 17 nt, Haemophilus influenzae Rd
uuaucaauaacugauuu

SEQ ID NO: 2734492 - RNA, 14 nt, Haemophilus influenzae Rd
uuaucaauagauaa

SEQ ID NO: 2734493 - RNA, 22 nt, Haemophilus influenzae Rd
uuaucaaucaagcauaaaucuu

SEQ ID NO: 2734494 - RNA, 14 nt, Haemophilus influenzae Rd
uuaucaauguuugu

SEQ ID NO: 2734495 - RNA, 17 nt, Haemophilus influenzae Rd
uuaucaauguuugugcg

SEQ ID NO: 2734496 - RNA, 17 nt, Haemophilus influenzae Rd
uuaucacaaguuaaaac

SEQ ID NO: 2734497 - RNA, 14 nt, Haemophilus influenzae Rd
uuaucaucaauauc

SEQ ID NO: 2734498 - RNA, 12 nt, Haemophilus influenzae Rd
uuaucaucauuu

SEQ ID NO: 2734499 - RNA, 22 nt, Haemophilus influenzae Rd
uuaucaucauuuuuauuuaaug

SEQ ID NO: 2734500 - RNA, 16 nt, Haemophilus influenzae Rd
uuaucaucugcauaac

SEQ ID NO: 2734501 - RNA, 19 nt, Haemophilus influenzae Rd
uuaucaucuguaaaccauu

SEQ ID NO: 2734502 - RNA, 14 nt, Haemophilus influenzae Rd
uuauccaacauuaa

SEQ ID NO: 2734503 - RNA, 20 nt, Haemophilus influenzae Rd
uuauccaaccuacauuaauc

SEQ ID NO: 2734504 - RNA, 15 nt, Haemophilus influenzae Rd
uuauccacuaaaaaa

SEQ ID NO: 2734505 - RNA, 19 nt, Haemophilus influenzae Rd
uuauccaugaugaaauaau

SEQ ID NO: 2734506 - RNA, 22 nt, Haemophilus influenzae Rd
uuauccaugaugaaauaauuca

SEQ ID NO: 2734507 - RNA, 19 nt, Haemophilus influenzae Rd
uuauccguuacauuauuua

SEQ ID NO: 2734508 - RNA, 22 nt, Haemophilus influenzae Rd
uuauccugccuugcauucgguu

SEQ ID NO: 2734509 - RNA, 20 nt, Haemophilus influenzae Rd
uuaucgaucacuucugcaua

SEQ ID NO: 2734510 - RNA, 16 nt, Haemophilus influenzae Rd
uuaucgcaaucacgaa

SEQ ID NO: 2734511 - RNA, 20 nt, Haemophilus influenzae Rd
uuaucgguuggauuuuaacc

SEQ ID NO: 2734512 - RNA, 13 nt, Haemophilus influenzae Rd
uuaucuaaaaaag

SEQ ID NO: 2734513 - RNA, 19 nt, Haemophilus influenzae Rd
uuaucuaaaccuuguaaag

SEQ ID NO: 2734514 - RNA, 16 nt, Haemophilus influenzae Rd
uuaucuaacuaaaaua

SEQ ID NO: 2734515 - RNA, 18 nt, Haemophilus influenzae Rd
uuaucuaauagauuuugu

SEQ ID NO: 2734516 - RNA, 12 nt, Haemophilus influenzae Rd
uuaucuagacaa

SEQ ID NO: 2734517 - RNA, 16 nt, Haemophilus influenzae Rd
uuaucuagacaaaacc

SEQ ID NO: 2734518 - RNA, 18 nt, Haemophilus influenzae Rd
uuaucuagacaaaaccug

SEQ ID NO: 2734519 - RNA, 22 nt, Haemophilus influenzae Rd
uuaucuauuggauaaauuauuc

SEQ ID NO: 2734520 - RNA, 16 nt, Haemophilus influenzae Rd
uuaucucgaauaucga

SEQ ID NO: 2734521 - RNA, 19 nt, Haemophilus influenzae Rd
uuaucucggcuaaaaucug

SEQ ID NO: 2734522 - RNA, 20 nt, Haemophilus influenzae Rd
uuaucucggcuaaaaucugu

SEQ ID NO: 2734523 - RNA, 20 nt, Haemophilus influenzae Rd
uuaucucuuucuuaaaauac

SEQ ID NO: 2734524 - RNA, 23 nt, Haemophilus influenzae Rd
uuaucuguauaaaugacauauaa

SEQ ID NO: 2734525 - RNA, 13 nt, Haemophilus influenzae Rd
uuaucuuaaaaaa

SEQ ID NO: 2734526 - RNA, 22 nt, Haemophilus influenzae Rd
uuaugaaaaaaagaaaaccaaa

SEQ ID NO: 2734527 - RNA, 15 nt, Haemophilus influenzae Rd
uuaugaaaucuugaa

SEQ ID NO: 2734528 - RNA, 23 nt, Haemophilus influenzae Rd
uuaugaaauuagguuauuuuuuc

SEQ ID NO: 2734529 - RNA, 13 nt, Haemophilus influenzae Rd
uuaugaaauugcu

SEQ ID NO: 2734530 - RNA, 16 nt, Haemophilus influenzae Rd
uuaugagcaaauacaa

SEQ ID NO: 2734531 - RNA, 17 nt, Haemophilus influenzae Rd
uuaugaggaauuuguug

SEQ ID NO: 2734532 - RNA, 15 nt, Haemophilus influenzae Rd
uuaugccguauuuuu

SEQ ID NO: 2734533 - RNA, 18 nt, Haemophilus influenzae Rd
uuaugccuacuuuuuauu

SEQ ID NO: 2734534 - RNA, 17 nt, Haemophilus influenzae Rd
uuaugcguuuuuaauuu

SEQ ID NO: 2734535 - RNA, 21 nt, Haemophilus influenzae Rd
uuaugcuaaaggguuuacuuu

SEQ ID NO: 2734536 - RNA, 18 nt, Haemophilus influenzae Rd
uuauggcuuucaauuuca

SEQ ID NO: 2734537 - RNA, 18 nt, Haemophilus influenzae Rd
uuaugguaaauauuguau

SEQ ID NO: 2734538 - RNA, 13 nt, Haemophilus influenzae Rd
uuaugguaacuag

SEQ ID NO: 2734539 - RNA, 13 nt, Haemophilus influenzae Rd
uuauggugugcaa

SEQ ID NO: 2734540 - RNA, 13 nt, Haemophilus influenzae Rd
uuaugguuuugcu

SEQ ID NO: 2734541 - RNA, 18 nt, Haemophilus influenzae Rd
uuauguucuggauuguug

SEQ ID NO: 2734542 - RNA, 19 nt, Haemophilus influenzae Rd
uuauguugcccauauuauu

SEQ ID NO: 2734543 - RNA, 21 nt, Haemophilus influenzae Rd
uuauguuuacggaugcaaucc

SEQ ID NO: 2734544 - RNA, 13 nt, Haemophilus influenzae Rd
uuauguuucucuc

SEQ ID NO: 2734545 - RNA, 22 nt, Haemophilus influenzae Rd
uuauguuucucucuauucaucu

SEQ ID NO: 2734546 - RNA, 12 nt, Haemophilus influenzae Rd
uuauuaaaaaag

SEQ ID NO: 2734547 - RNA, 15 nt, Haemophilus influenzae Rd
uuauuaaauccaaaa

SEQ ID NO: 2734548 - RNA, 11 nt, Haemophilus influenzae Rd
uuauuaacaaa

SEQ ID NO: 2734549 - RNA, 13 nt, Haemophilus influenzae Rd
uuauuaagucuau

SEQ ID NO: 2734550 - RNA, 20 nt, Haemophilus influenzae Rd
uuauuaagugaccauuggug

SEQ ID NO: 2734551 - RNA, 13 nt, Haemophilus influenzae Rd
uuauuaauaaacu

SEQ ID NO: 2734552 - RNA, 21 nt, Haemophilus influenzae Rd
uuauuacccuauucuaaauuu

SEQ ID NO: 2734553 - RNA, 15 nt, Haemophilus influenzae Rd
uuauuaccuacuaau

SEQ ID NO: 2734554 - RNA, 15 nt, Haemophilus influenzae Rd
uuauuaguaaaauaa

SEQ ID NO: 2734555 - RNA, 18 nt, Haemophilus influenzae Rd
uuauuagugauauuguuu

SEQ ID NO: 2734556 - RNA, 23 nt, Haemophilus influenzae Rd
uuauuauaaaaauauuuuaauaa

SEQ ID NO: 2734557 - RNA, 13 nt, Haemophilus influenzae Rd
uuauuauacauuu

SEQ ID NO: 2734558 - RNA, 20 nt, Haemophilus influenzae Rd
uuauuaucaacaguaaauuu

SEQ ID NO: 2734559 - RNA, 14 nt, Haemophilus influenzae Rd
uuauuaucuaaauc

SEQ ID NO: 2734560 - RNA, 14 nt, Haemophilus influenzae Rd
uuauuauuaaaucc

SEQ ID NO: 2734561 - RNA, 22 nt, Haemophilus influenzae Rd
uuauuauuacccguuugaagua

SEQ ID NO: 2734562 - RNA, 17 nt, Haemophilus influenzae Rd
uuauucaauaauauauu

SEQ ID NO: 2734563 - RNA, 23 nt, Haemophilus influenzae Rd
uuauucacgcucguuaaaucacg

SEQ ID NO: 2734564 - RNA, 20 nt, Haemophilus influenzae Rd
uuauucauaaauuccuuuuu

SEQ ID NO: 2734565 - RNA, 15 nt, Haemophilus influenzae Rd
uuauucauauccaaa

SEQ ID NO: 2734566 - RNA, 16 nt, Haemophilus influenzae Rd
uuauucccccauuaaa

SEQ ID NO: 2734567 - RNA, 20 nt, Haemophilus influenzae Rd
uuauucccccauuaaaagaa

SEQ ID NO: 2734568 - RNA, 20 nt, Haemophilus influenzae Rd
uuauucgcaccacgauauuu

SEQ ID NO: 2734569 - RNA, 21 nt, Haemophilus influenzae Rd
uuauucuaauuaacugaaaau

SEQ ID NO: 2734570 - RNA, 18 nt, Haemophilus influenzae Rd
uuauucuauaucugauac

SEQ ID NO: 2734571 - RNA, 21 nt, Haemophilus influenzae Rd
uuauucuccaaauauaaaaua

SEQ ID NO: 2734572 - RNA, 22 nt, Haemophilus influenzae Rd
uuauucuccaaauauaaaauaa

SEQ ID NO: 2734573 - RNA, 16 nt, Haemophilus influenzae Rd
uuauucuucaucuucu

SEQ ID NO: 2734574 - RNA, 17 nt, Haemophilus influenzae Rd
uuauugaagaguaaaac

SEQ ID NO: 2734575 - RNA, 23 nt, Haemophilus influenzae Rd
uuauugccaaagugcgguauuuu

SEQ ID NO: 2734576 - RNA, 22 nt, Haemophilus influenzae Rd
uuauugccauauaccaauaauu

SEQ ID NO: 2734577 - RNA, 12 nt, Haemophilus influenzae Rd
uuauugccuaau

SEQ ID NO: 2734578 - RNA, 21 nt, Haemophilus influenzae Rd
uuauugccuaauaaaaaauaa

SEQ ID NO: 2734579 - RNA, 16 nt, Haemophilus influenzae Rd
uuauugcggguuuuau

SEQ ID NO: 2734580 - RNA, 18 nt, Haemophilus influenzae Rd
uuauugcggguuuuauuu

SEQ ID NO: 2734581 - RNA, 22 nt, Haemophilus influenzae Rd
uuauuggaaaauucaaaucuug

SEQ ID NO: 2734582 - RNA, 21 nt, Haemophilus influenzae Rd
uuauuggacugcauauucaua

SEQ ID NO: 2734583 - RNA, 23 nt, Haemophilus influenzae Rd
uuauuggacugcauauucauaaa

SEQ ID NO: 2734584 - RNA, 21 nt, Haemophilus influenzae Rd
uuauuggauugaaucaauuuu

SEQ ID NO: 2734585 - RNA, 16 nt, Haemophilus influenzae Rd
uuauuggcuauugaaa

SEQ ID NO: 2734586 - RNA, 14 nt, Haemophilus influenzae Rd
uuauuguagccuag

SEQ ID NO: 2734587 - RNA, 21 nt, Haemophilus influenzae Rd
uuauuguagccuaguauuuuu

SEQ ID NO: 2734588 - RNA, 22 nt, Haemophilus influenzae Rd
uuauugugagauaugaaauaaa

SEQ ID NO: 2734589 - RNA, 12 nt, Haemophilus influenzae Rd
uuauugugaugg

SEQ ID NO: 2734590 - RNA, 20 nt, Haemophilus influenzae Rd
uuauuuaaacuugaauaaua

SEQ ID NO: 2734591 - RNA, 22 nt, Haemophilus influenzae Rd
uuauuuaacaaugaaauuauug

SEQ ID NO: 2734592 - RNA, 22 nt, Haemophilus influenzae Rd
uuauuuaagcuauuguuauaga

SEQ ID NO: 2734593 - RNA, 23 nt, Haemophilus influenzae Rd
uuauuuaagcuuuccuauucuaa

SEQ ID NO: 2734594 - RNA, 14 nt, Haemophilus influenzae Rd
uuauuuaauaacaa

SEQ ID NO: 2734595 - RNA, 13 nt, Haemophilus influenzae Rd
uuauuuaauaaua

SEQ ID NO: 2734596 - RNA, 15 nt, Haemophilus influenzae Rd
uuauuuaauaauauc

SEQ ID NO: 2734597 - RNA, 16 nt, Haemophilus influenzae Rd
uuauuuaauaauauca

SEQ ID NO: 2734598 - RNA, 15 nt, Haemophilus influenzae Rd
uuauuuaauacgaac

SEQ ID NO: 2734599 - RNA, 23 nt, Haemophilus influenzae Rd
uuauuuaauacgaacuaaaagga

SEQ ID NO: 2734600 - RNA, 13 nt, Haemophilus influenzae Rd
uuauuuacuuuau

SEQ ID NO: 2734601 - RNA, 16 nt, Haemophilus influenzae Rd
uuauuuacuuuauaaa

SEQ ID NO: 2734602 - RNA, 14 nt, Haemophilus influenzae Rd
uuauuuagauauaa

SEQ ID NO: 2734603 - RNA, 17 nt, Haemophilus influenzae Rd
uuauuuagauauaaaaa

SEQ ID NO: 2734604 - RNA, 19 nt, Haemophilus influenzae Rd
uuauuuagauauaaaaauc

SEQ ID NO: 2734605 - RNA, 18 nt, Haemophilus influenzae Rd
uuauuuaggggccuuuuu

SEQ ID NO: 2734606 - RNA, 23 nt, Haemophilus influenzae Rd
uuauuuaggggccuuuuuuaucu

SEQ ID NO: 2734607 - RNA, 16 nt, Haemophilus influenzae Rd
uuauuuaguuuaacuu

SEQ ID NO: 2734608 - RNA, 20 nt, Haemophilus influenzae Rd
uuauuuauagcauuuaaaua

SEQ ID NO: 2734609 - RNA, 22 nt, Haemophilus influenzae Rd
uuauuuauuugcuaaaauuacc

SEQ ID NO: 2734610 - RNA, 14 nt, Haemophilus influenzae Rd
uuauuucaauauaa

SEQ ID NO: 2734611 - RNA, 22 nt, Haemophilus influenzae Rd
uuauuucucauuuaaccguaau

SEQ ID NO: 2734612 - RNA, 13 nt, Haemophilus influenzae Rd
uuauuucuguuac

SEQ ID NO: 2734613 - RNA, 19 nt, Haemophilus influenzae Rd
uuauuugaaacaauaaaac

SEQ ID NO: 2734614 - RNA, 14 nt, Haemophilus influenzae Rd
uuauuugacuuaaa

SEQ ID NO: 2734615 - RNA, 17 nt, Haemophilus influenzae Rd
uuauuugacuuaaauga

SEQ ID NO: 2734616 - RNA, 16 nt, Haemophilus influenzae Rd
uuauuugacuuauucc

SEQ ID NO: 2734617 - RNA, 12 nt, Haemophilus influenzae Rd
uuauuugcaaua

SEQ ID NO: 2734618 - RNA, 17 nt, Haemophilus influenzae Rd
uuauuugcaauaaaauu

SEQ ID NO: 2734619 - RNA, 19 nt, Haemophilus influenzae Rd
uuauuugcauaguuuucca

SEQ ID NO: 2734620 - RNA, 16 nt, Haemophilus influenzae Rd
uuauuugcuaaaauua

SEQ ID NO: 2734621 - RNA, 18 nt, Haemophilus influenzae Rd
uuauuuggcaaaugauaa

SEQ ID NO: 2734622 - RNA, 18 nt, Haemophilus influenzae Rd
uuauuuggcauagaaaag

SEQ ID NO: 2734623 - RNA, 13 nt, Haemophilus influenzae Rd
uuauuuuaaaauc

SEQ ID NO: 2734624 - RNA, 14 nt, Haemophilus influenzae Rd
uuauuuuaaaauca

SEQ ID NO: 2734625 - RNA, 11 nt, Haemophilus influenzae Rd
uuauuuuaaau

SEQ ID NO: 2734626 - RNA, 14 nt, Haemophilus influenzae Rd
uuauuuuaaauaaa

SEQ ID NO: 2734627 - RNA, 22 nt, Haemophilus influenzae Rd
uuauuuuaaauaaauaauagua

SEQ ID NO: 2734628 - RNA, 14 nt, Haemophilus influenzae Rd
uuauuuuauauauu

SEQ ID NO: 2734629 - RNA, 19 nt, Haemophilus influenzae Rd
uuauuuuaucuauuggaua

SEQ ID NO: 2734630 - RNA, 12 nt, Haemophilus influenzae Rd
uuauuuuaugaa

SEQ ID NO: 2734631 - RNA, 11 nt, Haemophilus influenzae Rd
uuauuuuauuc

SEQ ID NO: 2734632 - RNA, 13 nt, Haemophilus influenzae Rd
uuauuuugaacaa

SEQ ID NO: 2734633 - RNA, 19 nt, Haemophilus influenzae Rd
uuauuuuguguauuaagua

SEQ ID NO: 2734634 - RNA, 21 nt, Haemophilus influenzae Rd
uuauuuuguguuugaaaagaa

SEQ ID NO: 2734635 - RNA, 18 nt, Haemophilus influenzae Rd
uuauuuuguugcagcuuu

SEQ ID NO: 2734636 - RNA, 22 nt, Haemophilus influenzae Rd
uuauuuuuaaucaaauaaaaua

SEQ ID NO: 2734637 - RNA, 12 nt, Haemophilus influenzae Rd
uuauuuuuauca

SEQ ID NO: 2734638 - RNA, 16 nt, Haemophilus influenzae Rd
uuauuuuuccacuguu

SEQ ID NO: 2734639 - RNA, 13 nt, Haemophilus influenzae Rd
uuauuuuuccuuu

SEQ ID NO: 2734640 - RNA, 19 nt, Haemophilus influenzae Rd
uuauuuuucucauaauaga

SEQ ID NO: 2734641 - RNA, 15 nt, Haemophilus influenzae Rd
uuauuuuuuaacgua

SEQ ID NO: 2734642 - RNA, 16 nt, Haemophilus influenzae Rd
uuauuuuuuaagcuuu

SEQ ID NO: 2734643 - RNA, 13 nt, Haemophilus influenzae Rd
uuauuuuuuaucc

SEQ ID NO: 2734644 - RNA, 14 nt, Haemophilus influenzae Rd
uuauuuuuuaugau

SEQ ID NO: 2734645 - RNA, 12 nt, Haemophilus influenzae Rd
uuauuuuuucaa

SEQ ID NO: 2734646 - RNA, 17 nt, Haemophilus influenzae Rd
uucaaaaaauguaucca

SEQ ID NO: 2734647 - RNA, 18 nt, Haemophilus influenzae Rd
uucaaaaagaacggucaa

SEQ ID NO: 2734648 - RNA, 24 nt, Haemophilus influenzae Rd
uucaaaaauauuauguucucucac

SEQ ID NO: 2734649 - RNA, 16 nt, Haemophilus influenzae Rd
uucaaaaaucaaauua

SEQ ID NO: 2734650 - RNA, 23 nt, Haemophilus influenzae Rd
uucaaaaauuugaauguaaaaau

SEQ ID NO: 2734651 - RNA, 14 nt, Haemophilus influenzae Rd
uucaaaaauuuuug

SEQ ID NO: 2734652 - RNA, 16 nt, Haemophilus influenzae Rd
uucaaaaauuuuugca

SEQ ID NO: 2734653 - RNA, 22 nt, Haemophilus influenzae Rd
uucaaaacaauggcugaaaaau

SEQ ID NO: 2734654 - RNA, 12 nt, Haemophilus influenzae Rd
uucaaaaccaaa

SEQ ID NO: 2734655 - RNA, 17 nt, Haemophilus influenzae Rd
uucaaaaccaaauuuuc

SEQ ID NO: 2734656 - RNA, 23 nt, Haemophilus influenzae Rd
uucaaaacguucuacuuguucaa

SEQ ID NO: 2734657 - RNA, 17 nt, Haemophilus influenzae Rd
uucaaaacuaucaaaau

SEQ ID NO: 2734658 - RNA, 19 nt, Haemophilus influenzae Rd
uucaaaacuaucaaaauca

SEQ ID NO: 2734659 - RNA, 21 nt, Haemophilus influenzae Rd
uucaaaacuaucaaaaucaaa

SEQ ID NO: 2734660 - RNA, 20 nt, Haemophilus influenzae Rd
uucaaaaucagcuaauaaca

SEQ ID NO: 2734661 - RNA, 16 nt, Haemophilus influenzae Rd
uucaaaauccauaauu

SEQ ID NO: 2734662 - RNA, 11 nt, Haemophilus influenzae Rd
uucaaacacaa

SEQ ID NO: 2734663 - RNA, 15 nt, Haemophilus influenzae Rd
uucaaacacaaaaua

SEQ ID NO: 2734664 - RNA, 16 nt, Haemophilus influenzae Rd
uucaaacacaaaauaa

SEQ ID NO: 2734665 - RNA, 15 nt, Haemophilus influenzae Rd
uucaaacaucacgcc

SEQ ID NO: 2734666 - RNA, 18 nt, Haemophilus influenzae Rd
uucaaacgcguuaaauca

SEQ ID NO: 2734667 - RNA, 16 nt, Haemophilus influenzae Rd
uucaaagauuuuaaaa

SEQ ID NO: 2734668 - RNA, 17 nt, Haemophilus influenzae Rd
uucaaagauuuuaaaau

SEQ ID NO: 2734669 - RNA, 22 nt, Haemophilus influenzae Rd
uucaccgcacuuuuaucucuaa

SEQ ID NO: 2734670 - RNA, 14 nt, Haemophilus influenzae Rd
uucaccguuuuucc

SEQ ID NO: 2734671 - RNA, 15 nt, Haemophilus influenzae Rd
uucaccguuuuuccu

SEQ ID NO: 2734672 - RNA, 18 nt, Haemophilus influenzae Rd
uucaccugaagaauacaa

SEQ ID NO: 2734673 - RNA, 17 nt, Haemophilus influenzae Rd
uucaccuugaucuacag

SEQ ID NO: 2734674 - RNA, 19 nt, Haemophilus influenzae Rd
uucacgaucacggcgcaau

SEQ ID NO: 2734675 - RNA, 17 nt, Haemophilus influenzae Rd
uucacgauuucuaucac

SEQ ID NO: 2734676 - RNA, 13 nt, Haemophilus influenzae Rd
uucacgauuugca

SEQ ID NO: 2734677 - RNA, 20 nt, Haemophilus influenzae Rd
uucacgcuaaggcaaaaaaa

SEQ ID NO: 2734678 - RNA, 15 nt, Haemophilus influenzae Rd
uucacggcauaguaa

SEQ ID NO: 2734679 - RNA, 15 nt, Haemophilus influenzae Rd
uucacgguacgcugc

SEQ ID NO: 2734680 - RNA, 20 nt, Haemophilus influenzae Rd
uucacgguuauaccacauaa

SEQ ID NO: 2734681 - RNA, 22 nt, Haemophilus influenzae Rd
uucacguaaaaucauuguuucc

SEQ ID NO: 2734682 - RNA, 17 nt, Haemophilus influenzae Rd
uucacguaguuaaacca

SEQ ID NO: 2734683 - RNA, 19 nt, Haemophilus influenzae Rd
uucacguaguuaaaccaaa

SEQ ID NO: 2734684 - RNA, 17 nt, Haemophilus influenzae Rd
uucacguguuuuuucac

SEQ ID NO: 2734685 - RNA, 20 nt, Haemophilus influenzae Rd
uucacguguuuuuucaccuu

SEQ ID NO: 2734686 - RNA, 13 nt, Haemophilus influenzae Rd
uucacuaaagaac

SEQ ID NO: 2734687 - RNA, 20 nt, Haemophilus influenzae Rd
uucacuaauugcucugcuuu

SEQ ID NO: 2734688 - RNA, 17 nt, Haemophilus influenzae Rd
uucacuacuugaacuaa

SEQ ID NO: 2734689 - RNA, 14 nt, Haemophilus influenzae Rd
uucacuauuucauc

SEQ ID NO: 2734690 - RNA, 16 nt, Haemophilus influenzae Rd
uucacucaauucaaag

SEQ ID NO: 2734691 - RNA, 15 nt, Haemophilus influenzae Rd
uucacucuuauucau

SEQ ID NO: 2734692 - RNA, 13 nt, Haemophilus influenzae Rd
uucacugaauaca

SEQ ID NO: 2734693 - RNA, 14 nt, Haemophilus influenzae Rd
uucacugauuucac

SEQ ID NO: 2734694 - RNA, 19 nt, Haemophilus influenzae Rd
uucacuucuaaaaccaaua

SEQ ID NO: 2734695 - RNA, 12 nt, Haemophilus influenzae Rd
uucacuuucaca

SEQ ID NO: 2734696 - RNA, 13 nt, Haemophilus influenzae Rd
uucagaaccuguc

SEQ ID NO: 2734697 - RNA, 18 nt, Haemophilus influenzae Rd
uucagaacugcuuucuuc

SEQ ID NO: 2734698 - RNA, 20 nt, Haemophilus influenzae Rd
uucagaagauaaaagugcgg

SEQ ID NO: 2734699 - RNA, 19 nt, Haemophilus influenzae Rd
uucagaauuaguaaagaaa

SEQ ID NO: 2734700 - RNA, 17 nt, Haemophilus influenzae Rd
uucagacaaaacuuauc

SEQ ID NO: 2734701 - RNA, 17 nt, Haemophilus influenzae Rd
uucagauaaucaaaaau

SEQ ID NO: 2734702 - RNA, 22 nt, Haemophilus influenzae Rd
uucagauucaauaauagccaua

SEQ ID NO: 2734703 - RNA, 13 nt, Haemophilus influenzae Rd
uucagcaacauca

SEQ ID NO: 2734704 - RNA, 18 nt, Haemophilus influenzae Rd
uucagcaacaucauaagg

SEQ ID NO: 2734705 - RNA, 15 nt, Haemophilus influenzae Rd
uucagcaaguucugc

SEQ ID NO: 2734706 - RNA, 15 nt, Haemophilus influenzae Rd
uucagcaauuucucu

SEQ ID NO: 2734707 - RNA, 13 nt, Haemophilus influenzae Rd
uucagcacuugca

SEQ ID NO: 2734708 - RNA, 22 nt, Haemophilus influenzae Rd
uucagcagcaaaaucuucuucu

SEQ ID NO: 2734709 - RNA, 22 nt, Haemophilus influenzae Rd
uucagcauaauguuugcgagua

SEQ ID NO: 2734710 - RNA, 12 nt, Haemophilus influenzae Rd
uucagcaucaga

SEQ ID NO: 2734711 - RNA, 14 nt, Haemophilus influenzae Rd
uucagcauuuacca

SEQ ID NO: 2734712 - RNA, 16 nt, Haemophilus influenzae Rd
uucagccaauuuuuca

SEQ ID NO: 2734713 - RNA, 14 nt, Haemophilus influenzae Rd
uucagccacuaauu

SEQ ID NO: 2734714 - RNA, 15 nt, Haemophilus influenzae Rd
uucagccauuccaau

SEQ ID NO: 2734715 - RNA, 14 nt, Haemophilus influenzae Rd
uucagcgauuuuaa

SEQ ID NO: 2734716 - RNA, 17 nt, Haemophilus influenzae Rd
uucagcguuuucaacuu

SEQ ID NO: 2734717 - RNA, 14 nt, Haemophilus influenzae Rd
uucagcuaauaaag

SEQ ID NO: 2734718 - RNA, 16 nt, Haemophilus influenzae Rd
uucagcugcaauauca

SEQ ID NO: 2734719 - RNA, 17 nt, Haemophilus influenzae Rd
uucagcuuaaauacuaa

SEQ ID NO: 2734720 - RNA, 12 nt, Haemophilus influenzae Rd
uucagcuucaau

SEQ ID NO: 2734721 - RNA, 14 nt, Haemophilus influenzae Rd
uucagcuucuucau

SEQ ID NO: 2734722 - RNA, 15 nt, Haemophilus influenzae Rd
uucagcuucuucauc

SEQ ID NO: 2734723 - RNA, 15 nt, Haemophilus influenzae Rd
uucaggagaaucaga

SEQ ID NO: 2734724 - RNA, 17 nt, Haemophilus influenzae Rd
uucaggauaaaacaaug

SEQ ID NO: 2734725 - RNA, 20 nt, Haemophilus influenzae Rd
uucaggauagagaaacuaau

SEQ ID NO: 2734726 - RNA, 18 nt, Haemophilus influenzae Rd
uucagggauuaagaaaau

SEQ ID NO: 2734727 - RNA, 22 nt, Haemophilus influenzae Rd
uucagggcgaaguaaaaaguca

SEQ ID NO: 2734728 - RNA, 23 nt, Haemophilus influenzae Rd
uucaggugcuauuuuauuuagaa

SEQ ID NO: 2734729 - RNA, 20 nt, Haemophilus influenzae Rd
uucagguugcgguaaaucua

SEQ ID NO: 2734730 - RNA, 21 nt, Haemophilus influenzae Rd
uucaguaaacaaguauaaaaa

SEQ ID NO: 2734731 - RNA, 17 nt, Haemophilus influenzae Rd
uucaguaagaaaccaac

SEQ ID NO: 2734732 - RNA, 12 nt, Haemophilus influenzae Rd
uucaguaauaag

SEQ ID NO: 2734733 - RNA, 17 nt, Haemophilus influenzae Rd
uucaguaucaauaccaa

SEQ ID NO: 2734734 - RNA, 23 nt, Haemophilus influenzae Rd
uucaguaucacgcacaccaccug

SEQ ID NO: 2734735 - RNA, 19 nt, Haemophilus influenzae Rd
uucaguauccgccaaugcu

SEQ ID NO: 2734736 - RNA, 20 nt, Haemophilus influenzae Rd
uucaguaucuggcucaaugu

SEQ ID NO: 2734737 - RNA, 19 nt, Haemophilus influenzae Rd
uucaguccgccuuuuugcu

SEQ ID NO: 2734738 - RNA, 16 nt, Haemophilus influenzae Rd
uucagugcuuuuucaa

SEQ ID NO: 2734739 - RNA, 20 nt, Haemophilus influenzae Rd
uucagugguaaucauuaagc

SEQ ID NO: 2734740 - RNA, 21 nt, Haemophilus influenzae Rd
uucaguugauagacaauauaa

SEQ ID NO: 2734741 - RNA, 23 nt, Haemophilus influenzae Rd
uucaguugcuucgccagcagugc

SEQ ID NO: 2734742 - RNA, 11 nt, Haemophilus influenzae Rd
uucaguuucac

SEQ ID NO: 2734743 - RNA, 23 nt, Haemophilus influenzae Rd
uucaguuuucauuuuuuggugca

SEQ ID NO: 2734744 - RNA, 15 nt, Haemophilus influenzae Rd
uucaguuuugcuuuu

SEQ ID NO: 2734745 - RNA, 12 nt, Haemophilus influenzae Rd
uucauaaaaauu

SEQ ID NO: 2734746 - RNA, 16 nt, Haemophilus influenzae Rd
uucauaaaaauugauc

SEQ ID NO: 2734747 - RNA, 23 nt, Haemophilus influenzae Rd
uucauaaaaggcaaagcaaaauc

SEQ ID NO: 2734748 - RNA, 13 nt, Haemophilus influenzae Rd
uucauaaauaauu

SEQ ID NO: 2734749 - RNA, 14 nt, Haemophilus influenzae Rd
uucauaaauaucaa

SEQ ID NO: 2734750 - RNA, 14 nt, Haemophilus influenzae Rd
uucauaaauucauc

SEQ ID NO: 2734751 - RNA, 22 nt, Haemophilus influenzae Rd
uucauaagauaacaagaaaaau

SEQ ID NO: 2734752 - RNA, 20 nt, Haemophilus influenzae Rd
uucauaagcucgaaguuuug

SEQ ID NO: 2734753 - RNA, 18 nt, Haemophilus influenzae Rd
uucauaauccguuaaauu

SEQ ID NO: 2734754 - RNA, 13 nt, Haemophilus influenzae Rd
uucauaccgauaa

SEQ ID NO: 2734755 - RNA, 19 nt, Haemophilus influenzae Rd
uucauagaaaccaauaauu

SEQ ID NO: 2734756 - RNA, 22 nt, Haemophilus influenzae Rd
uucauagaaaccaauaauuuca

SEQ ID NO: 2734757 - RNA, 15 nt, Haemophilus influenzae Rd
uucauaguuuggcuc

SEQ ID NO: 2734758 - RNA, 17 nt, Haemophilus influenzae Rd
uucauauaaauaagaau

SEQ ID NO: 2734759 - RNA, 19 nt, Haemophilus influenzae Rd
uucauauaaucuccauaau

SEQ ID NO: 2734760 - RNA, 22 nt, Haemophilus influenzae Rd
uucauauaaucuccauaauauu

SEQ ID NO: 2734761 - RNA, 18 nt, Haemophilus influenzae Rd
uucauauaauucauuagc

SEQ ID NO: 2734762 - RNA, 18 nt, Haemophilus influenzae Rd
uucauaucucacaauaau

SEQ ID NO: 2734763 - RNA, 21 nt, Haemophilus influenzae Rd
uucauaugcgaucacugcacc

SEQ ID NO: 2734764 - RNA, 20 nt, Haemophilus influenzae Rd
uucauauucccaaggcucca

SEQ ID NO: 2734765 - RNA, 21 nt, Haemophilus influenzae Rd
uucauauuugaaguugccaua

SEQ ID NO: 2734766 - RNA, 16 nt, Haemophilus influenzae Rd
uucauauuuuaaauaa

SEQ ID NO: 2734767 - RNA, 13 nt, Haemophilus influenzae Rd
uucaucaaaauga

SEQ ID NO: 2734768 - RNA, 15 nt, Haemophilus influenzae Rd
uucaucaaaaugaaa

SEQ ID NO: 2734769 - RNA, 20 nt, Haemophilus influenzae Rd
uucaucaagcucaaaaguau

SEQ ID NO: 2734770 - RNA, 19 nt, Haemophilus influenzae Rd
uucaucaauaacacucauu

SEQ ID NO: 2734771 - RNA, 13 nt, Haemophilus influenzae Rd
uucaucaauuucu

SEQ ID NO: 2734772 - RNA, 22 nt, Haemophilus influenzae Rd
uucaucacaaaucuucuugaaa

SEQ ID NO: 2734773 - RNA, 18 nt, Haemophilus influenzae Rd
uucaucaggcauugcgcc

SEQ ID NO: 2734774 - RNA, 18 nt, Haemophilus influenzae Rd
uucaucauaauuuauuca

SEQ ID NO: 2734775 - RNA, 17 nt, Haemophilus influenzae Rd
uuccccuuguucuucau

SEQ ID NO: 2734776 - RNA, 15 nt, Haemophilus influenzae Rd
uucccgcauuuauca

SEQ ID NO: 2734777 - RNA, 16 nt, Haemophilus influenzae Rd
uucccuauaaauaaac

SEQ ID NO: 2734778 - RNA, 19 nt, Haemophilus influenzae Rd
uucccugauagguaauaau

SEQ ID NO: 2734779 - RNA, 16 nt, Haemophilus influenzae Rd
uuccgacauuuuacua

SEQ ID NO: 2734780 - RNA, 20 nt, Haemophilus influenzae Rd
uuccgacuaaaaccaagaaa

SEQ ID NO: 2734781 - RNA, 15 nt, Haemophilus influenzae Rd
uuccgauuaauauac

SEQ ID NO: 2734782 - RNA, 14 nt, Haemophilus influenzae Rd
uuccgauuuuaauu

SEQ ID NO: 2734783 - RNA, 17 nt, Haemophilus influenzae Rd
uuccgcaauuucugcca

SEQ ID NO: 2734784 - RNA, 23 nt, Haemophilus influenzae Rd
uuccgcacuuuuuauucaaaucg

SEQ ID NO: 2734785 - RNA, 12 nt, Haemophilus influenzae Rd
uuccgcuuguuu

SEQ ID NO: 2734786 - RNA, 16 nt, Haemophilus influenzae Rd
uuccgcuuuaauaauc

SEQ ID NO: 2734787 - RNA, 15 nt, Haemophilus influenzae Rd
uuccgugacaucauc

SEQ ID NO: 2734788 - RNA, 18 nt, Haemophilus influenzae Rd
uuccguuaaaaguuuuuu

SEQ ID NO: 2734789 - RNA, 21 nt, Haemophilus influenzae Rd
uuccguuaaaaguuuuuuacg

SEQ ID NO: 2734790 - RNA, 18 nt, Haemophilus influenzae Rd
uuccguucuaaagauuua

SEQ ID NO: 2734791 - RNA, 15 nt, Haemophilus influenzae Rd
uuccguuguuuuugg

SEQ ID NO: 2734792 - RNA, 13 nt, Haemophilus influenzae Rd
uuccguuuacuac

SEQ ID NO: 2734793 - RNA, 16 nt, Haemophilus influenzae Rd
uuccuaaaauacaaau

SEQ ID NO: 2734794 - RNA, 20 nt, Haemophilus influenzae Rd
uuccuaaaaucgcacuuugu

SEQ ID NO: 2734795 - RNA, 21 nt, Haemophilus influenzae Rd
uuccuacuauaggaauaucau

SEQ ID NO: 2734796 - RNA, 14 nt, Haemophilus influenzae Rd
uuccuaugaauaag

SEQ ID NO: 2734797 - RNA, 19 nt, Haemophilus influenzae Rd
uuccuaugccuuuugucac

SEQ ID NO: 2734798 - RNA, 15 nt, Haemophilus influenzae Rd
uuccuauucuaaaua

SEQ ID NO: 2734799 - RNA, 13 nt, Haemophilus influenzae Rd
uuccucagcaaaa

SEQ ID NO: 2734800 - RNA, 18 nt, Haemophilus influenzae Rd
uuccucagcaaaagacga

SEQ ID NO: 2734801 - RNA, 14 nt, Haemophilus influenzae Rd
uuccugaauaacua

SEQ ID NO: 2734802 - RNA, 15 nt, Haemophilus influenzae Rd
uuccugaauaacuac

SEQ ID NO: 2734803 - RNA, 19 nt, Haemophilus influenzae Rd
uuccugacccacaucauca

SEQ ID NO: 2734804 - RNA, 14 nt, Haemophilus influenzae Rd
uuccugcaaacaua

SEQ ID NO: 2734805 - RNA, 19 nt, Haemophilus influenzae Rd
uuccugcaagaaaaauguu

SEQ ID NO: 2734806 - RNA, 14 nt, Haemophilus influenzae Rd
uuccuguuaauucu

SEQ ID NO: 2734807 - RNA, 13 nt, Haemophilus influenzae Rd
uuccuguuugagc

SEQ ID NO: 2734808 - RNA, 13 nt, Haemophilus influenzae Rd
uuccuuauucaaa

SEQ ID NO: 2734809 - RNA, 14 nt, Haemophilus influenzae Rd
uuccuuauucaaau

SEQ ID NO: 2734810 - RNA, 19 nt, Haemophilus influenzae Rd
uuccuuauucgcugcaaaa

SEQ ID NO: 2734811 - RNA, 20 nt, Haemophilus influenzae Rd
uuccuuauucgcugcaaaau

SEQ ID NO: 2734812 - RNA, 19 nt, Haemophilus influenzae Rd
uuccuuauuuuacuucaac

SEQ ID NO: 2734813 - RNA, 22 nt, Haemophilus influenzae Rd
uuccuucaaucgcaucauucaa

SEQ ID NO: 2734814 - RNA, 11 nt, Haemophilus influenzae Rd
uuccuucaucg

SEQ ID NO: 2734815 - RNA, 17 nt, Haemophilus influenzae Rd
uuccuucaucgucuucu

SEQ ID NO: 2734816 - RNA, 22 nt, Haemophilus influenzae Rd
uuccuucggcauauaagauuuu

SEQ ID NO: 2734817 - RNA, 11 nt, Haemophilus influenzae Rd
uuccuuucacc

SEQ ID NO: 2734818 - RNA, 17 nt, Haemophilus influenzae Rd
uuccuuucgcugcaaau

SEQ ID NO: 2734819 - RNA, 18 nt, Haemophilus influenzae Rd
uuccuuugagccuucaaa

SEQ ID NO: 2734820 - RNA, 21 nt, Haemophilus influenzae Rd
uuccuuuggcuugaaaauauu

SEQ ID NO: 2734821 - RNA, 22 nt, Haemophilus influenzae Rd
uuccuuuggcuugaaaauauuc

SEQ ID NO: 2734822 - RNA, 17 nt, Haemophilus influenzae Rd
uuccuuuucauaaaaau

SEQ ID NO: 2734823 - RNA, 16 nt, Haemophilus influenzae Rd
uucgaaaauaacuuca

SEQ ID NO: 2734824 - RNA, 18 nt, Haemophilus influenzae Rd
uucgaaaauaacuucauc

SEQ ID NO: 2734825 - RNA, 13 nt, Haemophilus influenzae Rd
uucgaacccguau

SEQ ID NO: 2734826 - RNA, 13 nt, Haemophilus influenzae Rd
uucgacaauuugu

SEQ ID NO: 2734827 - RNA, 21 nt, Haemophilus influenzae Rd
uucgacaggaacauucacacc

SEQ ID NO: 2734828 - RNA, 22 nt, Haemophilus influenzae Rd
uucgaccaagucagcucaagca

SEQ ID NO: 2734829 - RNA, 12 nt, Haemophilus influenzae Rd
uucgagcgugaa

SEQ ID NO: 2734830 - RNA, 23 nt, Haemophilus influenzae Rd
uucgaguuugucaugacuauuac

SEQ ID NO: 2734831 - RNA, 19 nt, Haemophilus influenzae Rd
uucgauaacaauuuuugca

SEQ ID NO: 2734832 - RNA, 19 nt, Haemophilus influenzae Rd
uucgauggaaaugaguaaa

SEQ ID NO: 2734833 - RNA, 18 nt, Haemophilus influenzae Rd
uucgauggauuuauugcg

SEQ ID NO: 2734834 - RNA, 18 nt, Haemophilus influenzae Rd
uucgaugugcauuuuuca

SEQ ID NO: 2734835 - RNA, 16 nt, Haemophilus influenzae Rd
uucgauugcauuuuuu

SEQ ID NO: 2734836 - RNA, 14 nt, Haemophilus influenzae Rd
uucgauuucaucuu

SEQ ID NO: 2734837 - RNA, 15 nt, Haemophilus influenzae Rd
uucgauuuuucuaaa

SEQ ID NO: 2734838 - RNA, 18 nt, Haemophilus influenzae Rd
uucgcaaaaucuugcuga

SEQ ID NO: 2734839 - RNA, 12 nt, Haemophilus influenzae Rd
uucgcaaauaac

SEQ ID NO: 2734840 - RNA, 18 nt, Haemophilus influenzae Rd
uucgcaagauagcaaaau

SEQ ID NO: 2734841 - RNA, 20 nt, Haemophilus influenzae Rd
uucgcaagauagcaaaauau

SEQ ID NO: 2734842 - RNA, 21 nt, Haemophilus influenzae Rd
uucgcaauaucgcgugagcga

SEQ ID NO: 2734843 - RNA, 13 nt, Haemophilus influenzae Rd
uucgcacguuuuu

SEQ ID NO: 2734844 - RNA, 19 nt, Haemophilus influenzae Rd
uucgcaguguuaaaugcag

SEQ ID NO: 2734845 - RNA, 21 nt, Haemophilus influenzae Rd
uucgcaguguuaaaugcagua

SEQ ID NO: 2734846 - RNA, 15 nt, Haemophilus influenzae Rd
uucgcaucaaucaca

SEQ ID NO: 2734847 - RNA, 19 nt, Haemophilus influenzae Rd
uucgcaucaaucacagcac

SEQ ID NO: 2734848 - RNA, 20 nt, Haemophilus influenzae Rd
uucgccaacguaagcaccaa

SEQ ID NO: 2734849 - RNA, 14 nt, Haemophilus influenzae Rd
uucgccaccuuuua

SEQ ID NO: 2734850 - RNA, 18 nt, Haemophilus influenzae Rd
uucgccaccuuuuaccaa

SEQ ID NO: 2734851 - RNA, 18 nt, Haemophilus influenzae Rd
uucgccccaaacaggaau

SEQ ID NO: 2734852 - RNA, 19 nt, Haemophilus influenzae Rd
uucgccgaguaaauucacc

SEQ ID NO: 2734853 - RNA, 15 nt, Haemophilus influenzae Rd
uucgccuaaugccuu

SEQ ID NO: 2734854 - RNA, 16 nt, Haemophilus influenzae Rd
uucgccugauuucgcu

SEQ ID NO: 2734855 - RNA, 23 nt, Haemophilus influenzae Rd
uucgccuuagccuguucuuccac

SEQ ID NO: 2734856 - RNA, 17 nt, Haemophilus influenzae Rd
uucgcgccaccuccaau

SEQ ID NO: 2734857 - RNA, 15 nt, Haemophilus influenzae Rd
uucgcggacuuuuuu

SEQ ID NO: 2734858 - RNA, 15 nt, Haemophilus influenzae Rd
uucgcguuguucaau

SEQ ID NO: 2734859 - RNA, 16 nt, Haemophilus influenzae Rd
uucgcguuguucaauu

SEQ ID NO: 2734860 - RNA, 18 nt, Haemophilus influenzae Rd
uucgcguuuauuuaacaa

SEQ ID NO: 2734861 - RNA, 19 nt, Haemophilus influenzae Rd
uucgcguuuauuuaacaau

SEQ ID NO: 2734862 - RNA, 16 nt, Haemophilus influenzae Rd
uucgcuauuuucuaau

SEQ ID NO: 2734863 - RNA, 18 nt, Haemophilus influenzae Rd
uucgcucaauaauuuuca

SEQ ID NO: 2734864 - RNA, 14 nt, Haemophilus influenzae Rd
uucgcuccaaucau

SEQ ID NO: 2734865 - RNA, 16 nt, Haemophilus influenzae Rd
uucgcuccaaucauca

SEQ ID NO: 2734866 - RNA, 22 nt, Haemophilus influenzae Rd
uucgcucguuguagcccaaucu

SEQ ID NO: 2734867 - RNA, 17 nt, Haemophilus influenzae Rd
uucgcugcagcugcugc

SEQ ID NO: 2734868 - RNA, 16 nt, Haemophilus influenzae Rd
uucgcuuacaaaauau

SEQ ID NO: 2734869 - RNA, 18 nt, Haemophilus influenzae Rd
uucgcuuacaaaauauac

SEQ ID NO: 2734870 - RNA, 22 nt, Haemophilus influenzae Rd
uucgcuucugcuugguaauaau

SEQ ID NO: 2734871 - RNA, 14 nt, Haemophilus influenzae Rd
uucgcuuucauaaa

SEQ ID NO: 2734872 - RNA, 22 nt, Haemophilus influenzae Rd
uucggagggaucgcauuaucaa

SEQ ID NO: 2734873 - RNA, 16 nt, Haemophilus influenzae Rd
uucggauuaagugcgg

SEQ ID NO: 2734874 - RNA, 17 nt, Haemophilus influenzae Rd
uucggcuaaaacagaag

SEQ ID NO: 2734875 - RNA, 20 nt, Haemophilus influenzae Rd
uucgggaugugaauauccaa

SEQ ID NO: 2734876 - RNA, 21 nt, Haemophilus influenzae Rd
uucgggaugugaauauccaaa

SEQ ID NO: 2734877 - RNA, 21 nt, Haemophilus influenzae Rd
uucgguugcgccgccuugcuc

SEQ ID NO: 2734878 - RNA, 23 nt, Haemophilus influenzae Rd
uucguaguaagcugauucuucau

SEQ ID NO: 2734879 - RNA, 18 nt, Haemophilus influenzae Rd
uucguauuucguaugcca

SEQ ID NO: 2734880 - RNA, 23 nt, Haemophilus influenzae Rd
uucugcaauuaaacuaauuccga

SEQ ID NO: 2734881 - RNA, 22 nt, Haemophilus influenzae Rd
uucugcacgauggcccuccgua

SEQ ID NO: 2734882 - RNA, 21 nt, Haemophilus influenzae Rd
uucugcagcaagaucaauaua

SEQ ID NO: 2734883 - RNA, 20 nt, Haemophilus influenzae Rd
uucugcagcguuugcugccu

SEQ ID NO: 2734884 - RNA, 20 nt, Haemophilus influenzae Rd
uucugcaguuuuuuguuuuu

SEQ ID NO: 2734885 - RNA, 18 nt, Haemophilus influenzae Rd
uucugccgcgccacaagc

SEQ ID NO: 2734886 - RNA, 21 nt, Haemophilus influenzae Rd
uucugccgcugcaacaaauaa

SEQ ID NO: 2734887 - RNA, 24 nt, Haemophilus influenzae Rd
uucugccucuguauuuuucauauc

SEQ ID NO: 2734888 - RNA, 17 nt, Haemophilus influenzae Rd
uucugcgcgcaauccaa

SEQ ID NO: 2734889 - RNA, 18 nt, Haemophilus influenzae Rd
uucugcgcuaaauaagcu

SEQ ID NO: 2734890 - RNA, 12 nt, Haemophilus influenzae Rd
uucugcuacuug

SEQ ID NO: 2734891 - RNA, 16 nt, Haemophilus influenzae Rd
uucugcuccacaaaaa

SEQ ID NO: 2734892 - RNA, 20 nt, Haemophilus influenzae Rd
uucugcucuuucaaauaauu

SEQ ID NO: 2734893 - RNA, 19 nt, Haemophilus influenzae Rd
uucugcuugguaauaauca

SEQ ID NO: 2734894 - RNA, 19 nt, Haemophilus influenzae Rd
uucugcuuuacguuuugcu

SEQ ID NO: 2734895 - RNA, 15 nt, Haemophilus influenzae Rd
uucuggaaauucgua

SEQ ID NO: 2734896 - RNA, 22 nt, Haemophilus influenzae Rd
uucuggauuguuguaauccauu

SEQ ID NO: 2734897 - RNA, 14 nt, Haemophilus influenzae Rd
uucuggcuguuuug

SEQ ID NO: 2734898 - RNA, 19 nt, Haemophilus influenzae Rd
uucugguaucggucuugcu

SEQ ID NO: 2734899 - RNA, 19 nt, Haemophilus influenzae Rd
uucuguaaauaugccuuau

SEQ ID NO: 2734900 - RNA, 17 nt, Haemophilus influenzae Rd
uucuguauaccaaccau

SEQ ID NO: 2734901 - RNA, 18 nt, Haemophilus influenzae Rd
uucuguauuaucuaauua

SEQ ID NO: 2734902 - RNA, 21 nt, Haemophilus influenzae Rd
uucuguauuaucuaauuauuu

SEQ ID NO: 2734903 - RNA, 22 nt, Haemophilus influenzae Rd
uucugugcaauauuuccucuaa

SEQ ID NO: 2734904 - RNA, 14 nt, Haemophilus influenzae Rd
uucuguguuuuguc

SEQ ID NO: 2734905 - RNA, 22 nt, Haemophilus influenzae Rd
uucuguugaaugcuauucucuc

SEQ ID NO: 2734906 - RNA, 17 nt, Haemophilus influenzae Rd
uucuguugggaauaauu

SEQ ID NO: 2734907 - RNA, 15 nt, Haemophilus influenzae Rd
uucuguuuuuccauu

SEQ ID NO: 2734908 - RNA, 14 nt, Haemophilus influenzae Rd
uucuuaaaauaccc

SEQ ID NO: 2734909 - RNA, 18 nt, Haemophilus influenzae Rd
uucuuaagguuuauagau

SEQ ID NO: 2734910 - RNA, 20 nt, Haemophilus influenzae Rd
uucuuaauauaggauuuuaa

SEQ ID NO: 2734911 - RNA, 18 nt, Haemophilus influenzae Rd
uucuuaauuuuauuaauu

SEQ ID NO: 2734912 - RNA, 18 nt, Haemophilus influenzae Rd
uucuuacaacaaauugug

SEQ ID NO: 2734913 - RNA, 16 nt, Haemophilus influenzae Rd
uucuuaccccaacaaa

SEQ ID NO: 2734914 - RNA, 20 nt, Haemophilus influenzae Rd
uucuuagauuucuaauaaca

SEQ ID NO: 2734915 - RNA, 23 nt, Haemophilus influenzae Rd
uucuuagcuucaucuucaucaau

SEQ ID NO: 2734916 - RNA, 22 nt, Haemophilus influenzae Rd
uucuuauagauaaaauguugaa

SEQ ID NO: 2734917 - RNA, 16 nt, Haemophilus influenzae Rd
uucuuauauauaaaau

SEQ ID NO: 2734918 - RNA, 14 nt, Haemophilus influenzae Rd
uucuucaauaacaa

SEQ ID NO: 2734919 - RNA, 13 nt, Haemophilus influenzae Rd
uucuucaauaauu

SEQ ID NO: 2734920 - RNA, 16 nt, Haemophilus influenzae Rd
uucuucaauacguuua

SEQ ID NO: 2734921 - RNA, 20 nt, Haemophilus influenzae Rd
uucuucaauacguuuaauau

SEQ ID NO: 2734922 - RNA, 18 nt, Haemophilus influenzae Rd
uucuucacugcaucuguu

SEQ ID NO: 2734923 - RNA, 20 nt, Haemophilus influenzae Rd
uucuucagauuuuauaucaa

SEQ ID NO: 2734924 - RNA, 14 nt, Haemophilus influenzae Rd
uucuucaucgcuua

SEQ ID NO: 2734925 - RNA, 13 nt, Haemophilus influenzae Rd
uucuucccaaccu

SEQ ID NO: 2734926 - RNA, 23 nt, Haemophilus influenzae Rd
uucuucccaaccuaauuguucag

SEQ ID NO: 2734927 - RNA, 14 nt, Haemophilus influenzae Rd
uucuuccuguuuau

SEQ ID NO: 2734928 - RNA, 19 nt, Haemophilus influenzae Rd
uucuuccuugguuaauccu

SEQ ID NO: 2734929 - RNA, 21 nt, Haemophilus influenzae Rd
uucuucgaaaauaacuucauc

SEQ ID NO: 2734930 - RNA, 17 nt, Haemophilus influenzae Rd
uucuucgaugcuuuuuc

SEQ ID NO: 2734931 - RNA, 18 nt, Haemophilus influenzae Rd
uucuucgauuuuucuaaa

SEQ ID NO: 2734932 - RNA, 22 nt, Haemophilus influenzae Rd
uucuucgccuuagccuguucuu

SEQ ID NO: 2734933 - RNA, 17 nt, Haemophilus influenzae Rd
uucuucggcgaggcauu

SEQ ID NO: 2734934 - RNA, 21 nt, Haemophilus influenzae Rd
uucuucuaguuuuccuuucuu

SEQ ID NO: 2734935 - RNA, 17 nt, Haemophilus influenzae Rd
uucuucugauagaggaa

SEQ ID NO: 2734936 - RNA, 15 nt, Haemophilus influenzae Rd
uucuucugcaggaaa

SEQ ID NO: 2734937 - RNA, 23 nt, Haemophilus influenzae Rd
uucuucugcggucaucucuuguu

SEQ ID NO: 2734938 - RNA, 13 nt, Haemophilus influenzae Rd
uucuugaauacaa

SEQ ID NO: 2734939 - RNA, 21 nt, Haemophilus influenzae Rd
uucuugaaugucuuaaagaua

SEQ ID NO: 2734940 - RNA, 20 nt, Haemophilus influenzae Rd
uucuugaccuuucaauaauu

SEQ ID NO: 2734941 - RNA, 14 nt, Haemophilus influenzae Rd
uucuugaucuuuga

SEQ ID NO: 2734942 - RNA, 15 nt, Haemophilus influenzae Rd
uucuugauuauuuaa

SEQ ID NO: 2734943 - RNA, 21 nt, Haemophilus influenzae Rd
uucuugauuauuuaauuucaa

SEQ ID NO: 2734944 - RNA, 17 nt, Haemophilus influenzae Rd
uucuugccaaaauucau

SEQ ID NO: 2734945 - RNA, 11 nt, Haemophilus influenzae Rd
uucuugccaua

SEQ ID NO: 2734946 - RNA, 22 nt, Haemophilus influenzae Rd
uucuugcccgcaccgcuucuuu

SEQ ID NO: 2734947 - RNA, 20 nt, Haemophilus influenzae Rd
uucuugcguaaccaaagaaa

SEQ ID NO: 2734948 - RNA, 19 nt, Haemophilus influenzae Rd
uucuugcguuucaaaugcu

SEQ ID NO: 2734949 - RNA, 15 nt, Haemophilus influenzae Rd
uucuugcuaaaaaga

SEQ ID NO: 2734950 - RNA, 16 nt, Haemophilus influenzae Rd
uucuugcuaaaaagaa

SEQ ID NO: 2734951 - RNA, 16 nt, Haemophilus influenzae Rd
uucuugcuaaaauauc

SEQ ID NO: 2734952 - RNA, 17 nt, Haemophilus influenzae Rd
uucuugcucuaauuuua

SEQ ID NO: 2734953 - RNA, 21 nt, Haemophilus influenzae Rd
uucuugcuguugguuaaaaau

SEQ ID NO: 2734954 - RNA, 18 nt, Haemophilus influenzae Rd
uucuuggaaaucuuggcu

SEQ ID NO: 2734955 - RNA, 21 nt, Haemophilus influenzae Rd
uucuuggaacaucauuuucaa

SEQ ID NO: 2734956 - RNA, 15 nt, Haemophilus influenzae Rd
uucuuggauaauuuc

SEQ ID NO: 2734957 - RNA, 23 nt, Haemophilus influenzae Rd
uucuuguaaugcuguaaugauca

SEQ ID NO: 2734958 - RNA, 17 nt, Haemophilus influenzae Rd
uucuugugcaaaauaac

SEQ ID NO: 2734959 - RNA, 16 nt, Haemophilus influenzae Rd
uucuuuaacuugcucu

SEQ ID NO: 2734960 - RNA, 13 nt, Haemophilus influenzae Rd
uucuuuaauagcg

SEQ ID NO: 2734961 - RNA, 15 nt, Haemophilus influenzae Rd
uucuuuauuaaacaa

SEQ ID NO: 2734962 - RNA, 20 nt, Haemophilus influenzae Rd
uucuuuauuaaacaaaaacc

SEQ ID NO: 2734963 - RNA, 20 nt, Haemophilus influenzae Rd
uucuuuauucguuugcaaug

SEQ ID NO: 2734964 - RNA, 12 nt, Haemophilus influenzae Rd
uucuuucauuug

SEQ ID NO: 2734965 - RNA, 14 nt, Haemophilus influenzae Rd
uucuuuccaaccag

SEQ ID NO: 2734966 - RNA, 15 nt, Haemophilus influenzae Rd
uucuuuccauuuuuu

SEQ ID NO: 2734967 - RNA, 18 nt, Haemophilus influenzae Rd
uucuuugaguaaaaaauc

SEQ ID NO: 2734968 - RNA, 18 nt, Haemophilus influenzae Rd
uucuuugauauaaauugu

SEQ ID NO: 2734969 - RNA, 13 nt, Haemophilus influenzae Rd
uucuuuuaaaaga

SEQ ID NO: 2734970 - RNA, 13 nt, Haemophilus influenzae Rd
uucuuuuaauaag

SEQ ID NO: 2734971 - RNA, 14 nt, Haemophilus influenzae Rd
uucuuuuaauaaua

SEQ ID NO: 2734972 - RNA, 21 nt, Haemophilus influenzae Rd
uucuuuuaaugcuucugccgc

SEQ ID NO: 2734973 - RNA, 21 nt, Haemophilus influenzae Rd
uucuuuuagugguucagauuu

SEQ ID NO: 2734974 - RNA, 23 nt, Haemophilus influenzae Rd
uucuuuuauaaccaguuauucuu

SEQ ID NO: 2734975 - RNA, 16 nt, Haemophilus influenzae Rd
uucuuuugcuaguaag

SEQ ID NO: 2734976 - RNA, 11 nt, Haemophilus influenzae Rd
uucuuuuucaa

SEQ ID NO: 2734977 - RNA, 15 nt, Haemophilus influenzae Rd
uucuuuuuugcuuau

SEQ ID NO: 2734978 - RNA, 13 nt, Haemophilus influenzae Rd
uucuuuuuuucuu

SEQ ID NO: 2734979 - RNA, 21 nt, Haemophilus influenzae Rd
uugaaaaaaucuuccaauaca

SEQ ID NO: 2734980 - RNA, 22 nt, Haemophilus influenzae Rd
uugaaaaauuauugcauuuuua

SEQ ID NO: 2734981 - RNA, 20 nt, Haemophilus influenzae Rd
uugaaaacgucgauccauug

SEQ ID NO: 2734982 - RNA, 11 nt, Haemophilus influenzae Rd
uugaaaaguac

SEQ ID NO: 2734983 - RNA, 19 nt, Haemophilus influenzae Rd
uugaaaauaagcauaaaag

SEQ ID NO: 2734984 - RNA, 18 nt, Haemophilus influenzae Rd
uugaaaauuuaauuguuu

SEQ ID NO: 2734985 - RNA, 16 nt, Haemophilus influenzae Rd
uugauacauuucuaaa

SEQ ID NO: 2734986 - RNA, 19 nt, Haemophilus influenzae Rd
uugauacauuucuaaaaua

SEQ ID NO: 2734987 - RNA, 20 nt, Haemophilus influenzae Rd
uugauacauuucuaaaauaa

SEQ ID NO: 2734988 - RNA, 17 nt, Haemophilus influenzae Rd
uugauacggcaaacuaa

SEQ ID NO: 2734989 - RNA, 18 nt, Haemophilus influenzae Rd
uugauagacaauauaauu

SEQ ID NO: 2734990 - RNA, 19 nt, Haemophilus influenzae Rd
uugauagcugccgaauaga

SEQ ID NO: 2734991 - RNA, 22 nt, Haemophilus influenzae Rd
uugauagguauaaauggcaucu

SEQ ID NO: 2734992 - RNA, 20 nt, Haemophilus influenzae Rd
uugauauaaauuguuuuucc

SEQ ID NO: 2734993 - RNA, 22 nt, Haemophilus influenzae Rd
uugauauaccauucuuucaaua

SEQ ID NO: 2734994 - RNA, 16 nt, Haemophilus influenzae Rd
uugauauuaagccauu

SEQ ID NO: 2734995 - RNA, 23 nt, Haemophilus influenzae Rd
uugauauucaaggagcuuuauua

SEQ ID NO: 2734996 - RNA, 13 nt, Haemophilus influenzae Rd
uugauauucaauu

SEQ ID NO: 2734997 - RNA, 18 nt, Haemophilus influenzae Rd
uugauauuuggauaacaa

SEQ ID NO: 2734998 - RNA, 12 nt, Haemophilus influenzae Rd
uugaucaucucg

SEQ ID NO: 2734999 - RNA, 13 nt, Haemophilus influenzae Rd
uugauccacaaau

SEQ ID NO: 2735000 - RNA, 20 nt, Haemophilus influenzae Rd
uugauccauauauugaacau

SEQ ID NO: 2735001 - RNA, 16 nt, Haemophilus influenzae Rd
uugaucgaaugauuca

SEQ ID NO: 2735002 - RNA, 16 nt, Haemophilus influenzae Rd
uugaucgguuuuauua

SEQ ID NO: 2735003 - RNA, 18 nt, Haemophilus influenzae Rd
uugaucguauugcauaaa

SEQ ID NO: 2735004 - RNA, 19 nt, Haemophilus influenzae Rd
uugaucuccgcgacauuaa

SEQ ID NO: 2735005 - RNA, 15 nt, Haemophilus influenzae Rd
uugaucucuuucuau

SEQ ID NO: 2735006 - RNA, 11 nt, Haemophilus influenzae Rd
uugaucugcac

SEQ ID NO: 2735007 - RNA, 23 nt, Haemophilus influenzae Rd
uugaucuuagacaaauuaaauua

SEQ ID NO: 2735008 - RNA, 18 nt, Haemophilus influenzae Rd
uugaugaaaauuaucugc

SEQ ID NO: 2735009 - RNA, 19 nt, Haemophilus influenzae Rd
uugaugauuaacuauucaa

SEQ ID NO: 2735010 - RNA, 19 nt, Haemophilus influenzae Rd
uugaugauuccaaaguuua

SEQ ID NO: 2735011 - RNA, 17 nt, Haemophilus influenzae Rd
uugaugauuugcauaaa

SEQ ID NO: 2735012 - RNA, 19 nt, Haemophilus influenzae Rd
uugaugauuugcauaaaac

SEQ ID NO: 2735013 - RNA, 21 nt, Haemophilus influenzae Rd
uugaugcacaacgaucacgaa

SEQ ID NO: 2735014 - RNA, 22 nt, Haemophilus influenzae Rd
uugauguaaaaacucgaauaga

SEQ ID NO: 2735015 - RNA, 18 nt, Haemophilus influenzae Rd
uugauguaaaagauaaaa

SEQ ID NO: 2735016 - RNA, 21 nt, Haemophilus influenzae Rd
uugauguuuuugaaguaaaaa

SEQ ID NO: 2735017 - RNA, 23 nt, Haemophilus influenzae Rd
uugauguuuuugaaguaaaaaaa

SEQ ID NO: 2735018 - RNA, 18 nt, Haemophilus influenzae Rd
uugauuaaguauaacuaa

SEQ ID NO: 2735019 - RNA, 21 nt, Haemophilus influenzae Rd
uugauuaagucgauaaagaau

SEQ ID NO: 2735020 - RNA, 19 nt, Haemophilus influenzae Rd
uugauuacccauuaauggu

SEQ ID NO: 2735021 - RNA, 17 nt, Haemophilus influenzae Rd
uugauuagcuaauauaa

SEQ ID NO: 2735022 - RNA, 18 nt, Haemophilus influenzae Rd
uugauuauuuaauuucaa

SEQ ID NO: 2735023 - RNA, 19 nt, Haemophilus influenzae Rd
uugauuccgauuuuacgau

SEQ ID NO: 2735024 - RNA, 17 nt, Haemophilus influenzae Rd
uugauugcgaauauuaa

SEQ ID NO: 2735025 - RNA, 19 nt, Haemophilus influenzae Rd
uugauuuaaauugaaaaaa

SEQ ID NO: 2735026 - RNA, 23 nt, Haemophilus influenzae Rd
uugauuuaacucggcuuuuucaa

SEQ ID NO: 2735027 - RNA, 15 nt, Haemophilus influenzae Rd
uugauuuacauuaau

SEQ ID NO: 2735028 - RNA, 21 nt, Haemophilus influenzae Rd
uugauuuacauuaauuuuucc

SEQ ID NO: 2735029 - RNA, 23 nt, Haemophilus influenzae Rd
uugauuuagccaguaauuuuaca

SEQ ID NO: 2735030 - RNA, 21 nt, Haemophilus influenzae Rd
uugauuucagaacaugacuua

SEQ ID NO: 2735031 - RNA, 23 nt, Haemophilus influenzae Rd
uugauuuuaaaacacgaaaaaaa

SEQ ID NO: 2735032 - RNA, 16 nt, Haemophilus influenzae Rd
uugauuuuaaaauauc

SEQ ID NO: 2735033 - RNA, 19 nt, Haemophilus influenzae Rd
uugauuuuaaaauaucaaa

SEQ ID NO: 2735034 - RNA, 12 nt, Haemophilus influenzae Rd
uugauuuuaaag

SEQ ID NO: 2735035 - RNA, 15 nt, Haemophilus influenzae Rd
uugauuuuaauguaa

SEQ ID NO: 2735036 - RNA, 16 nt, Haemophilus influenzae Rd
uugauuuuauuuacuu

SEQ ID NO: 2735037 - RNA, 19 nt, Haemophilus influenzae Rd
uugauuuucagaaaguguu

SEQ ID NO: 2735038 - RNA, 14 nt, Haemophilus influenzae Rd
uugauuuugguucg

SEQ ID NO: 2735039 - RNA, 13 nt, Haemophilus influenzae Rd
uugauuuugucua

SEQ ID NO: 2735040 - RNA, 12 nt, Haemophilus influenzae Rd
uugauuuuuaua

SEQ ID NO: 2735041 - RNA, 14 nt, Haemophilus influenzae Rd
uugauuuuuaugua

SEQ ID NO: 2735042 - RNA, 23 nt, Haemophilus influenzae Rd
uugcaaaaacccucaagaaacug

SEQ ID NO: 2735043 - RNA, 12 nt, Haemophilus influenzae Rd
uugcaaaccaaa

SEQ ID NO: 2735044 - RNA, 23 nt, Haemophilus influenzae Rd
uugcaaaccaaaucacaauaagc

SEQ ID NO: 2735045 - RNA, 14 nt, Haemophilus influenzae Rd
uugcaacuaauagc

SEQ ID NO: 2735046 - RNA, 16 nt, Haemophilus influenzae Rd
uugcaacuucgccuug

SEQ ID NO: 2735047 - RNA, 19 nt, Haemophilus influenzae Rd
uugcaagcuaccuuguggc

SEQ ID NO: 2735048 - RNA, 19 nt, Haemophilus influenzae Rd
uugcaagggauuugaaaau

SEQ ID NO: 2735049 - RNA, 14 nt, Haemophilus influenzae Rd
uugcaagugagcua

SEQ ID NO: 2735050 - RNA, 23 nt, Haemophilus influenzae Rd
uugcaagugagcuaagcauuuca

SEQ ID NO: 2735051 - RNA, 17 nt, Haemophilus influenzae Rd
uugcaagugcaguuuca

SEQ ID NO: 2735052 - RNA, 12 nt, Haemophilus influenzae Rd
uugcaauaacca

SEQ ID NO: 2735053 - RNA, 15 nt, Haemophilus influenzae Rd
uugcaauggcuuuua

SEQ ID NO: 2735054 - RNA, 15 nt, Haemophilus influenzae Rd
uugcacaauuuggcg

SEQ ID NO: 2735055 - RNA, 22 nt, Haemophilus influenzae Rd
uugcacaauuuggcgcauuaaa

SEQ ID NO: 2735056 - RNA, 20 nt, Haemophilus influenzae Rd
uugcaccaucguuaaaccaa

SEQ ID NO: 2735057 - RNA, 21 nt, Haemophilus influenzae Rd
uugcacccgccauaaaacaca

SEQ ID NO: 2735058 - RNA, 11 nt, Haemophilus influenzae Rd
uugcaccuucu

SEQ ID NO: 2735059 - RNA, 17 nt, Haemophilus influenzae Rd
uugcaccuuguaaccaa

SEQ ID NO: 2735060 - RNA, 17 nt, Haemophilus influenzae Rd
uugcacgagcaauaaua

SEQ ID NO: 2735061 - RNA, 23 nt, Haemophilus influenzae Rd
uugcacggcgcguaaaucagaac

SEQ ID NO: 2735062 - RNA, 15 nt, Haemophilus influenzae Rd
uugcacugcuaauuc

SEQ ID NO: 2735063 - RNA, 13 nt, Haemophilus influenzae Rd
uugcacuuucuau

SEQ ID NO: 2735064 - RNA, 18 nt, Haemophilus influenzae Rd
uugcacuuucuauacuau

SEQ ID NO: 2735065 - RNA, 11 nt, Haemophilus influenzae Rd
uugcagcccaa

SEQ ID NO: 2735066 - RNA, 17 nt, Haemophilus influenzae Rd
uugcagggauauugccu

SEQ ID NO: 2735067 - RNA, 20 nt, Haemophilus influenzae Rd
uugcagggauuucaauaaau

SEQ ID NO: 2735068 - RNA, 17 nt, Haemophilus influenzae Rd
uugcauaaaccaacuau

SEQ ID NO: 2735069 - RNA, 17 nt, Haemophilus influenzae Rd
uugcauagccucuaaga

SEQ ID NO: 2735070 - RNA, 12 nt, Haemophilus influenzae Rd
uugcauaguuuu

SEQ ID NO: 2735071 - RNA, 15 nt, Haemophilus influenzae Rd
uugcauauugaacuu

SEQ ID NO: 2735072 - RNA, 23 nt, Haemophilus influenzae Rd
uugcaucagccaccuuaacaaag

SEQ ID NO: 2735073 - RNA, 19 nt, Haemophilus influenzae Rd
uugcaucagguacgucuuu

SEQ ID NO: 2735074 - RNA, 16 nt, Haemophilus influenzae Rd
uugcauccacuucauc

SEQ ID NO: 2735075 - RNA, 21 nt, Haemophilus influenzae Rd
uugcaucgugaccuaauauga

SEQ ID NO: 2735076 - RNA, 14 nt, Haemophilus influenzae Rd
uugcaucuucuauu

SEQ ID NO: 2735077 - RNA, 18 nt, Haemophilus influenzae Rd
uugcaucuuggcauuuuu

SEQ ID NO: 2735078 - RNA, 21 nt, Haemophilus influenzae Rd
uugcaucuuggcauuuuugcu

SEQ ID NO: 2735079 - RNA, 23 nt, Haemophilus influenzae Rd
uugcauuaaagcgagaauaguua

SEQ ID NO: 2735080 - RNA, 16 nt, Haemophilus influenzae Rd
uugcauugaguuuuuc

SEQ ID NO: 2735081 - RNA, 22 nt, Haemophilus influenzae Rd
uugcauuggaaugguauaaaaa

SEQ ID NO: 2735082 - RNA, 13 nt, Haemophilus influenzae Rd
uugcauuuacaua

SEQ ID NO: 2735083 - RNA, 15 nt, Haemophilus influenzae Rd
uugcauuucuaaaua

SEQ ID NO: 2735084 - RNA, 17 nt, Haemophilus influenzae Rd
uugcauuucuaaauaaa

SEQ ID NO: 2735085 - RNA, 16 nt, Haemophilus influenzae Rd
uugcauuuucuuccaa

SEQ ID NO: 2735086 - RNA, 16 nt, Haemophilus influenzae Rd
uugcauuuuggaaaau

SEQ ID NO: 2735087 - RNA, 20 nt, Haemophilus influenzae Rd
uugcauuuuggaaaauagaa

SEQ ID NO: 2735088 - RNA, 14 nt, Haemophilus influenzae Rd
uugcauuuuuuaua

SEQ ID NO: 2735089 - RNA, 12 nt, Haemophilus influenzae Rd
uugccaaaaaag

SEQ ID NO: 2735090 - RNA, 21 nt, Haemophilus influenzae Rd
uuggaucuuguggaucuaaau

SEQ ID NO: 2735091 - RNA, 14 nt, Haemophilus influenzae Rd
uuggaugaaaucaa

SEQ ID NO: 2735092 - RNA, 15 nt, Haemophilus influenzae Rd
uuggauuuuaaccag

SEQ ID NO: 2735093 - RNA, 17 nt, Haemophilus influenzae Rd
uuggcaaaaaauacauu

SEQ ID NO: 2735094 - RNA, 17 nt, Haemophilus influenzae Rd
uuggcaaaaguaagcaa

SEQ ID NO: 2735095 - RNA, 14 nt, Haemophilus influenzae Rd
uuggcaaaauaauc

SEQ ID NO: 2735096 - RNA, 21 nt, Haemophilus influenzae Rd
uuggcaaaugggugcuuguuc

SEQ ID NO: 2735097 - RNA, 16 nt, Haemophilus influenzae Rd
uuggcaagaagugcgg

SEQ ID NO: 2735098 - RNA, 19 nt, Haemophilus influenzae Rd
uuggcaauauuuaauauau

SEQ ID NO: 2735099 - RNA, 16 nt, Haemophilus influenzae Rd
uuggcacaacaucaga

SEQ ID NO: 2735100 - RNA, 20 nt, Haemophilus influenzae Rd
uuggcgaaccuucacuuaaa

SEQ ID NO: 2735101 - RNA, 22 nt, Haemophilus influenzae Rd
uuggcgaaccuucacuuaaauu

SEQ ID NO: 2735102 - RNA, 18 nt, Haemophilus influenzae Rd
uuggcgacaaugcguaau

SEQ ID NO: 2735103 - RNA, 17 nt, Haemophilus influenzae Rd
uuggcgaguaaauuuag

SEQ ID NO: 2735104 - RNA, 23 nt, Haemophilus influenzae Rd
uuggcuaaaccgauuuugacuuu

SEQ ID NO: 2735105 - RNA, 23 nt, Haemophilus influenzae Rd
uuggcuauuaugaggaauuuguu

SEQ ID NO: 2735106 - RNA, 16 nt, Haemophilus influenzae Rd
uuggcugaaauucuaa

SEQ ID NO: 2735107 - RNA, 17 nt, Haemophilus influenzae Rd
uuggcugaaauucuaaa

SEQ ID NO: 2735108 - RNA, 16 nt, Haemophilus influenzae Rd
uuggcuuacagcaaaa

SEQ ID NO: 2735109 - RNA, 17 nt, Haemophilus influenzae Rd
uuggcuuacagcaaaag

SEQ ID NO: 2735110 - RNA, 14 nt, Haemophilus influenzae Rd
uugggauuauuuuu

SEQ ID NO: 2735111 - RNA, 19 nt, Haemophilus influenzae Rd
uugggauuuuuuauuuugu

SEQ ID NO: 2735112 - RNA, 23 nt, Haemophilus influenzae Rd
uugggcaagucccuguucaaauu

SEQ ID NO: 2735113 - RNA, 18 nt, Haemophilus influenzae Rd
uugggcgacguuuuaagu

SEQ ID NO: 2735114 - RNA, 14 nt, Haemophilus influenzae Rd
uugggcguaauguu

SEQ ID NO: 2735115 - RNA, 13 nt, Haemophilus influenzae Rd
uugggcuaaaaau

SEQ ID NO: 2735116 - RNA, 21 nt, Haemophilus influenzae Rd
uugggcuuuuucaaucgccuc

SEQ ID NO: 2735117 - RNA, 14 nt, Haemophilus influenzae Rd
uuggguaaucaaau

SEQ ID NO: 2735118 - RNA, 19 nt, Haemophilus influenzae Rd
uugggucguuagcucaguc

SEQ ID NO: 2735119 - RNA, 15 nt, Haemophilus influenzae Rd
uuggguugugguguc

SEQ ID NO: 2735120 - RNA, 23 nt, Haemophilus influenzae Rd
uuggguuguuacguuucacuaca

SEQ ID NO: 2735121 - RNA, 17 nt, Haemophilus influenzae Rd
uugguaaacauuuguac

SEQ ID NO: 2735122 - RNA, 19 nt, Haemophilus influenzae Rd
uugguaaagccaacuuuuu

SEQ ID NO: 2735123 - RNA, 12 nt, Haemophilus influenzae Rd
uugguaaauacu

SEQ ID NO: 2735124 - RNA, 15 nt, Haemophilus influenzae Rd
uugguaaaucuaaca

SEQ ID NO: 2735125 - RNA, 14 nt, Haemophilus influenzae Rd
uugguaaucaaauu

SEQ ID NO: 2735126 - RNA, 23 nt, Haemophilus influenzae Rd
uugguaaucaaauucuguguaau

SEQ ID NO: 2735127 - RNA, 22 nt, Haemophilus influenzae Rd
uugguaauuugcgucuuaaauu

SEQ ID NO: 2735128 - RNA, 13 nt, Haemophilus influenzae Rd
uugguaauuuggc

SEQ ID NO: 2735129 - RNA, 20 nt, Haemophilus influenzae Rd
uugguacauguugggcuaaa

SEQ ID NO: 2735130 - RNA, 20 nt, Haemophilus influenzae Rd
uugguacgagaaaaaucuuu

SEQ ID NO: 2735131 - RNA, 13 nt, Haemophilus influenzae Rd
uugguacgccagu

SEQ ID NO: 2735132 - RNA, 16 nt, Haemophilus influenzae Rd
uugguagccuuuauga

SEQ ID NO: 2735133 - RNA, 15 nt, Haemophilus influenzae Rd
uugguagcuaaaaau

SEQ ID NO: 2735134 - RNA, 19 nt, Haemophilus influenzae Rd
uugguagcuaaaaauaauu

SEQ ID NO: 2735135 - RNA, 15 nt, Haemophilus influenzae Rd
uugguaguuuuucac

SEQ ID NO: 2735136 - RNA, 14 nt, Haemophilus influenzae Rd
uugguauaaauaau

SEQ ID NO: 2735137 - RNA, 23 nt, Haemophilus influenzae Rd
uuggucaauauauucuugguucg

SEQ ID NO: 2735138 - RNA, 20 nt, Haemophilus influenzae Rd
uuggucaauuagcaaagaau

SEQ ID NO: 2735139 - RNA, 21 nt, Haemophilus influenzae Rd
uuggucacgcuguaaacaaga

SEQ ID NO: 2735140 - RNA, 23 nt, Haemophilus influenzae Rd
uuggucgaagguucgaauccuuc

SEQ ID NO: 2735141 - RNA, 16 nt, Haemophilus influenzae Rd
uuggucgcaacaaaca

SEQ ID NO: 2735142 - RNA, 21 nt, Haemophilus influenzae Rd
uuggucgcaacaaacauuaau

SEQ ID NO: 2735143 - RNA, 15 nt, Haemophilus influenzae Rd
uuggucggaauguaa

SEQ ID NO: 2735144 - RNA, 20 nt, Haemophilus influenzae Rd
uuggugaucaccgaaauaac

SEQ ID NO: 2735145 - RNA, 23 nt, Haemophilus influenzae Rd
uuggugcaacgacaaucacuggc

SEQ ID NO: 2735146 - RNA, 23 nt, Haemophilus influenzae Rd
uuggugcgucuuuuaacauuaca

SEQ ID NO: 2735147 - RNA, 23 nt, Haemophilus influenzae Rd
uuggugguaagccguguucuagu

SEQ ID NO: 2735148 - RNA, 15 nt, Haemophilus influenzae Rd
uugguguaauuugau

SEQ ID NO: 2735149 - RNA, 15 nt, Haemophilus influenzae Rd
uugguuaaaaauagc

SEQ ID NO: 2735150 - RNA, 16 nt, Haemophilus influenzae Rd
uugguuaauguaaaca

SEQ ID NO: 2735151 - RNA, 15 nt, Haemophilus influenzae Rd
uugguucgauaaaca

SEQ ID NO: 2735152 - RNA, 17 nt, Haemophilus influenzae Rd
uugguucugcaguuucu

SEQ ID NO: 2735153 - RNA, 20 nt, Haemophilus influenzae Rd
uugguuuguuaaaugaaaag

SEQ ID NO: 2735154 - RNA, 22 nt, Haemophilus influenzae Rd
uugguuuuguaagcgauaaaua

SEQ ID NO: 2735155 - RNA, 23 nt, Haemophilus influenzae Rd
uuguaaaagugcgguugauuuuc

SEQ ID NO: 2735156 - RNA, 15 nt, Haemophilus influenzae Rd
uuguaaaauauccac

SEQ ID NO: 2735157 - RNA, 17 nt, Haemophilus influenzae Rd
uuguaaaauauccacau

SEQ ID NO: 2735158 - RNA, 16 nt, Haemophilus influenzae Rd
uuguaaaaucucuauu

SEQ ID NO: 2735159 - RNA, 20 nt, Haemophilus influenzae Rd
uuguaaacuuuccucaaguu

SEQ ID NO: 2735160 - RNA, 15 nt, Haemophilus influenzae Rd
uuguaaagcaccaua

SEQ ID NO: 2735161 - RNA, 14 nt, Haemophilus influenzae Rd
uuguaaauugguuu

SEQ ID NO: 2735162 - RNA, 16 nt, Haemophilus influenzae Rd
uuguaagauuuugccu

SEQ ID NO: 2735163 - RNA, 14 nt, Haemophilus influenzae Rd
uuguaagcaaaauc

SEQ ID NO: 2735164 - RNA, 18 nt, Haemophilus influenzae Rd
uuguaaguuguaaauugc

SEQ ID NO: 2735165 - RNA, 23 nt, Haemophilus influenzae Rd
uuguaauaaauuuuauuauguuu

SEQ ID NO: 2735166 - RNA, 14 nt, Haemophilus influenzae Rd
uuguaauaaugaau

SEQ ID NO: 2735167 - RNA, 15 nt, Haemophilus influenzae Rd
uuguaauccugcauu

SEQ ID NO: 2735168 - RNA, 16 nt, Haemophilus influenzae Rd
uuguaaucuucauacu

SEQ ID NO: 2735169 - RNA, 22 nt, Haemophilus influenzae Rd
uuguaaugcaaaccauuuaucc

SEQ ID NO: 2735170 - RNA, 19 nt, Haemophilus influenzae Rd
uuguaaugcuuuuagugcu

SEQ ID NO: 2735171 - RNA, 20 nt, Haemophilus influenzae Rd
uuguaaugucgugaaagaau

SEQ ID NO: 2735172 - RNA, 15 nt, Haemophilus influenzae Rd
uuguaauugauuuuc

SEQ ID NO: 2735173 - RNA, 18 nt, Haemophilus influenzae Rd
uuguaauugauuuucaga

SEQ ID NO: 2735174 - RNA, 20 nt, Haemophilus influenzae Rd
uuguaauugauuuucagaaa

SEQ ID NO: 2735175 - RNA, 22 nt, Haemophilus influenzae Rd
uuguaauugauuuucagaaagu

SEQ ID NO: 2735176 - RNA, 12 nt, Haemophilus influenzae Rd
uuguaauuucau

SEQ ID NO: 2735177 - RNA, 14 nt, Haemophilus influenzae Rd
uuguacaucccaua

SEQ ID NO: 2735178 - RNA, 16 nt, Haemophilus influenzae Rd
uuguacaucccauaua

SEQ ID NO: 2735179 - RNA, 14 nt, Haemophilus influenzae Rd
uuguacgccacaua

SEQ ID NO: 2735180 - RNA, 18 nt, Haemophilus influenzae Rd
uuguacuauuuuauaauc

SEQ ID NO: 2735181 - RNA, 13 nt, Haemophilus influenzae Rd
uuguacuucagug

SEQ ID NO: 2735182 - RNA, 22 nt, Haemophilus influenzae Rd
uuguagaaaagaccaugccugu

SEQ ID NO: 2735183 - RNA, 19 nt, Haemophilus influenzae Rd
uuguagagcagggauuuuc

SEQ ID NO: 2735184 - RNA, 15 nt, Haemophilus influenzae Rd
uuguaggauguucaa

SEQ ID NO: 2735185 - RNA, 22 nt, Haemophilus influenzae Rd
uuguauagaacgguuaugaaaa

SEQ ID NO: 2735186 - RNA, 22 nt, Haemophilus influenzae Rd
uuguauguuggcgaauuugguu

SEQ ID NO: 2735187 - RNA, 18 nt, Haemophilus influenzae Rd
uuguauuugcgauaauuu

SEQ ID NO: 2735188 - RNA, 13 nt, Haemophilus influenzae Rd
uugucagauuuac

SEQ ID NO: 2735189 - RNA, 13 nt, Haemophilus influenzae Rd
uugucaucagaaa

SEQ ID NO: 2735190 - RNA, 19 nt, Haemophilus influenzae Rd
uugucauuaaaaaauaauu

SEQ ID NO: 2735191 - RNA, 20 nt, Haemophilus influenzae Rd
uugucauugccauuucugca

SEQ ID NO: 2735192 - RNA, 15 nt, Haemophilus influenzae Rd
uuguccaugaaaaac

SEQ ID NO: 2735193 - RNA, 23 nt, Haemophilus influenzae Rd
uugucccaaaauauuuucaaaua

SEQ ID NO: 2735194 - RNA, 13 nt, Haemophilus influenzae Rd
uuguccgccauca

SEQ ID NO: 2735195 - RNA, 17 nt, Haemophilus influenzae Rd
uuuaaaauagaaugaaa

SEQ ID NO: 2735196 - RNA, 12 nt, Haemophilus influenzae Rd
uuuaaaauaguu

SEQ ID NO: 2735197 - RNA, 17 nt, Haemophilus influenzae Rd
uuuaaaauaguuuuuau

SEQ ID NO: 2735198 - RNA, 19 nt, Haemophilus influenzae Rd
uuuaaaauauauauuaucg

SEQ ID NO: 2735199 - RNA, 16 nt, Haemophilus influenzae Rd
uuuaaaaugaacaaaa

SEQ ID NO: 2735200 - RNA, 12 nt, Haemophilus influenzae Rd
uuuaaaauuacc

SEQ ID NO: 2735201 - RNA, 14 nt, Haemophilus influenzae Rd
uuuaaaauuauaau

SEQ ID NO: 2735202 - RNA, 14 nt, Haemophilus influenzae Rd
uuuaaaauuuauuu

SEQ ID NO: 2735203 - RNA, 19 nt, Haemophilus influenzae Rd
uuuaaacuggguuuuauuu

SEQ ID NO: 2735204 - RNA, 20 nt, Haemophilus influenzae Rd
uuuaaacuugaauaauaacg

SEQ ID NO: 2735205 - RNA, 21 nt, Haemophilus influenzae Rd
uuuaaagaacaucuugccauu

SEQ ID NO: 2735206 - RNA, 21 nt, Haemophilus influenzae Rd
uuuaaagagaucacuguaaau

SEQ ID NO: 2735207 - RNA, 19 nt, Haemophilus influenzae Rd
uuuaaagccauuuugcuca

SEQ ID NO: 2735208 - RNA, 13 nt, Haemophilus influenzae Rd
uuuaaauaaaaua

SEQ ID NO: 2735209 - RNA, 14 nt, Haemophilus influenzae Rd
uuuaaauaaaauaa

SEQ ID NO: 2735210 - RNA, 17 nt, Haemophilus influenzae Rd
uuuaaauaaauaauagu

SEQ ID NO: 2735211 - RNA, 16 nt, Haemophilus influenzae Rd
uuuaaauaaccaauau

SEQ ID NO: 2735212 - RNA, 17 nt, Haemophilus influenzae Rd
uuuaaauaauuaaaaau

SEQ ID NO: 2735213 - RNA, 19 nt, Haemophilus influenzae Rd
uuuaaauaauuaaaaauaa

SEQ ID NO: 2735214 - RNA, 13 nt, Haemophilus influenzae Rd
uuuaaauauaauu

SEQ ID NO: 2735215 - RNA, 12 nt, Haemophilus influenzae Rd
uuuaaauauuua

SEQ ID NO: 2735216 - RNA, 12 nt, Haemophilus influenzae Rd
uuuaaauauuuu

SEQ ID NO: 2735217 - RNA, 13 nt, Haemophilus influenzae Rd
uuuaaauuaaaaa

SEQ ID NO: 2735218 - RNA, 19 nt, Haemophilus influenzae Rd
uuuaaauuacauucccaaa

SEQ ID NO: 2735219 - RNA, 21 nt, Haemophilus influenzae Rd
uuuaaauuacauucccaaaua

SEQ ID NO: 2735220 - RNA, 21 nt, Haemophilus influenzae Rd
uuuaaauuagcucaauagauu

SEQ ID NO: 2735221 - RNA, 17 nt, Haemophilus influenzae Rd
uuuaaauucuucgaaaa

SEQ ID NO: 2735222 - RNA, 17 nt, Haemophilus influenzae Rd
uuuaaauugaaaaaaua

SEQ ID NO: 2735223 - RNA, 17 nt, Haemophilus influenzae Rd
uuuaacaggaauuugcu

SEQ ID NO: 2735224 - RNA, 12 nt, Haemophilus influenzae Rd
uuuaacauaauu

SEQ ID NO: 2735225 - RNA, 22 nt, Haemophilus influenzae Rd
uuuaaccacuugucauuaaaaa

SEQ ID NO: 2735226 - RNA, 22 nt, Haemophilus influenzae Rd
uuuaaccaguuuguguuuauuu

SEQ ID NO: 2735227 - RNA, 22 nt, Haemophilus influenzae Rd
uuuaaccgcacuuuuaauuaau

SEQ ID NO: 2735228 - RNA, 23 nt, Haemophilus influenzae Rd
uuuaaccgcacuuuuuaauaaaa

SEQ ID NO: 2735229 - RNA, 19 nt, Haemophilus influenzae Rd
uuuaacuuaaucauuuuuu

SEQ ID NO: 2735230 - RNA, 16 nt, Haemophilus influenzae Rd
uuuaacuuuuuuauuu

SEQ ID NO: 2735231 - RNA, 21 nt, Haemophilus influenzae Rd
uuuaacuuuuuuauuuguuaa

SEQ ID NO: 2735232 - RNA, 20 nt, Haemophilus influenzae Rd
uuuaagaaaaaauauaaaac

SEQ ID NO: 2735233 - RNA, 16 nt, Haemophilus influenzae Rd
uuuaagauagcacuug

SEQ ID NO: 2735234 - RNA, 15 nt, Haemophilus influenzae Rd
uuuaagcuacaguga

SEQ ID NO: 2735235 - RNA, 15 nt, Haemophilus influenzae Rd
uuuaagcuauuguua

SEQ ID NO: 2735236 - RNA, 16 nt, Haemophilus influenzae Rd
uuuaagcugaaauuua

SEQ ID NO: 2735237 - RNA, 14 nt, Haemophilus influenzae Rd
uuuaagcuuuucua

SEQ ID NO: 2735238 - RNA, 16 nt, Haemophilus influenzae Rd
uuuaaggaaacguaaa

SEQ ID NO: 2735239 - RNA, 23 nt, Haemophilus influenzae Rd
uuuaagggcuaaguucuauaauu

SEQ ID NO: 2735240 - RNA, 14 nt, Haemophilus influenzae Rd
uuuaagguuuuuuc

SEQ ID NO: 2735241 - RNA, 18 nt, Haemophilus influenzae Rd
uuuaaguaguguuuuauu

SEQ ID NO: 2735242 - RNA, 20 nt, Haemophilus influenzae Rd
uuuaaguguuuacuauuaau

SEQ ID NO: 2735243 - RNA, 22 nt, Haemophilus influenzae Rd
uuuaaguugggcgacguuuuaa

SEQ ID NO: 2735244 - RNA, 16 nt, Haemophilus influenzae Rd
uuuaaguuuucaccaa

SEQ ID NO: 2735245 - RNA, 12 nt, Haemophilus influenzae Rd
uuuaauaaaaac

SEQ ID NO: 2735246 - RNA, 13 nt, Haemophilus influenzae Rd
uuuaauaaaacca

SEQ ID NO: 2735247 - RNA, 17 nt, Haemophilus influenzae Rd
uuuaauaaaaccauauu

SEQ ID NO: 2735248 - RNA, 15 nt, Haemophilus influenzae Rd
uuuaauaaaauguaa

SEQ ID NO: 2735249 - RNA, 19 nt, Haemophilus influenzae Rd
uuuaauaaaauguaagagu

SEQ ID NO: 2735250 - RNA, 18 nt, Haemophilus influenzae Rd
uuuaauaaacggauugca

SEQ ID NO: 2735251 - RNA, 22 nt, Haemophilus influenzae Rd
uuuaauaacauagaaaucacua

SEQ ID NO: 2735252 - RNA, 16 nt, Haemophilus influenzae Rd
uuuaauaagaauuuua

SEQ ID NO: 2735253 - RNA, 19 nt, Haemophilus influenzae Rd
uuuaauaagaauuuuaauc

SEQ ID NO: 2735254 - RNA, 17 nt, Haemophilus influenzae Rd
uuuaauaagauuuuuaa

SEQ ID NO: 2735255 - RNA, 17 nt, Haemophilus influenzae Rd
uuuaauaaggcaaaacc

SEQ ID NO: 2735256 - RNA, 15 nt, Haemophilus influenzae Rd
uuuaauaauagaacg

SEQ ID NO: 2735257 - RNA, 18 nt, Haemophilus influenzae Rd
uuuaauaaucuuaaauaa

SEQ ID NO: 2735258 - RNA, 20 nt, Haemophilus influenzae Rd
uuuaauaaucuuaaauaauu

SEQ ID NO: 2735259 - RNA, 18 nt, Haemophilus influenzae Rd
uuuaauaauuuaaauuua

SEQ ID NO: 2735260 - RNA, 19 nt, Haemophilus influenzae Rd
uuuaauacaaucuguccau

SEQ ID NO: 2735261 - RNA, 22 nt, Haemophilus influenzae Rd
uuuaauacgugauaaugccucu

SEQ ID NO: 2735262 - RNA, 20 nt, Haemophilus influenzae Rd
uuuaauaucuucuaauaaaa

SEQ ID NO: 2735263 - RNA, 22 nt, Haemophilus influenzae Rd
uuuaauaucuucuaauaaaaua

SEQ ID NO: 2735264 - RNA, 16 nt, Haemophilus influenzae Rd
uuuaauauuuuuuuca

SEQ ID NO: 2735265 - RNA, 17 nt, Haemophilus influenzae Rd
uuuaaucaaauaaaaua

SEQ ID NO: 2735266 - RNA, 14 nt, Haemophilus influenzae Rd
uuuaaucauaaaaa

SEQ ID NO: 2735267 - RNA, 16 nt, Haemophilus influenzae Rd
uuuaauccaaacuaaa

SEQ ID NO: 2735268 - RNA, 19 nt, Haemophilus influenzae Rd
uuuaauccguuaauuucau

SEQ ID NO: 2735269 - RNA, 16 nt, Haemophilus influenzae Rd
uuuaauccugucaucu

SEQ ID NO: 2735270 - RNA, 21 nt, Haemophilus influenzae Rd
uuuaaucuuaaagaauuucuu

SEQ ID NO: 2735271 - RNA, 16 nt, Haemophilus influenzae Rd
uuuaaucuugagguaa

SEQ ID NO: 2735272 - RNA, 15 nt, Haemophilus influenzae Rd
uuuaaugaaacuugg

SEQ ID NO: 2735273 - RNA, 13 nt, Haemophilus influenzae Rd
uuuaaugaaagua

SEQ ID NO: 2735274 - RNA, 14 nt, Haemophilus influenzae Rd
uuuaaugaaaguaa

SEQ ID NO: 2735275 - RNA, 17 nt, Haemophilus influenzae Rd
uuuaaugauaaauuuua

SEQ ID NO: 2735276 - RNA, 18 nt, Haemophilus influenzae Rd
uuuaaugauaaauuuuau

SEQ ID NO: 2735277 - RNA, 21 nt, Haemophilus influenzae Rd
uuuaaugauaaucuaaaaaac

SEQ ID NO: 2735278 - RNA, 23 nt, Haemophilus influenzae Rd
uuuaauggauuccaucauuguga

SEQ ID NO: 2735279 - RNA, 20 nt, Haemophilus influenzae Rd
uuuaaugggugauccauaau

SEQ ID NO: 2735280 - RNA, 13 nt, Haemophilus influenzae Rd
uuuaauguaauaa

SEQ ID NO: 2735281 - RNA, 18 nt, Haemophilus influenzae Rd
uuuaauguaauaaaaaau

SEQ ID NO: 2735282 - RNA, 13 nt, Haemophilus influenzae Rd
uuuaauuaaaaua

SEQ ID NO: 2735283 - RNA, 15 nt, Haemophilus influenzae Rd
uuuaauuaaagccac

SEQ ID NO: 2735284 - RNA, 20 nt, Haemophilus influenzae Rd
uuuaauuaaagccacauaau

SEQ ID NO: 2735285 - RNA, 15 nt, Haemophilus influenzae Rd
uuuaauuaaauacaa

SEQ ID NO: 2735286 - RNA, 20 nt, Haemophilus influenzae Rd
uuuaauucagggauuaagaa

SEQ ID NO: 2735287 - RNA, 21 nt, Haemophilus influenzae Rd
uuuaauucaggugggaaauaa

SEQ ID NO: 2735288 - RNA, 14 nt, Haemophilus influenzae Rd
uuuaauuccaacua

SEQ ID NO: 2735289 - RNA, 21 nt, Haemophilus influenzae Rd
uuuaauucgugcaaauuuuuu

SEQ ID NO: 2735290 - RNA, 23 nt, Haemophilus influenzae Rd
uuuaauucgugcaaauuuuuuca

SEQ ID NO: 2735291 - RNA, 13 nt, Haemophilus influenzae Rd
uuuaauucuaaau

SEQ ID NO: 2735292 - RNA, 20 nt, Haemophilus influenzae Rd
uuuaauucugcccuuuuuca

SEQ ID NO: 2735293 - RNA, 20 nt, Haemophilus influenzae Rd
uuuaauucuucgauuaguuu

SEQ ID NO: 2735294 - RNA, 17 nt, Haemophilus influenzae Rd
uuuaauuggaaauaaua

SEQ ID NO: 2735295 - RNA, 15 nt, Haemophilus influenzae Rd
uuuaauugugcaauu

SEQ ID NO: 2735296 - RNA, 16 nt, Haemophilus influenzae Rd
uuuaauuuauuuucua

SEQ ID NO: 2735297 - RNA, 21 nt, Haemophilus influenzae Rd
uuuaauuuauuuucuaauaag

SEQ ID NO: 2735298 - RNA, 15 nt, Haemophilus influenzae Rd
uuuaauuucuucaac

SEQ ID NO: 2735299 - RNA, 13 nt, Haemophilus influenzae Rd
uuuaauuuuauag

SEQ ID NO: 2735300 - RNA, 22 nt, Haemophilus influenzae Rd
uuuauaaugcaaccaaacaaaa

SEQ ID NO: 2735301 - RNA, 15 nt, Haemophilus influenzae Rd
uuuauaauuaauaaa

SEQ ID NO: 2735302 - RNA, 21 nt, Haemophilus influenzae Rd
uuuauacacuuuuaacuuaau

SEQ ID NO: 2735303 - RNA, 22 nt, Haemophilus influenzae Rd
uuuauacaguuagaacaacaau

SEQ ID NO: 2735304 - RNA, 20 nt, Haemophilus influenzae Rd
uuuauaccagaagucagcaa

SEQ ID NO: 2735305 - RNA, 17 nt, Haemophilus influenzae Rd
uuuauagaaaugguuac

SEQ ID NO: 2735306 - RNA, 20 nt, Haemophilus influenzae Rd
uuuauagaaaugguuaccua

SEQ ID NO: 2735307 - RNA, 16 nt, Haemophilus influenzae Rd
uuuauagcauuuaaau

SEQ ID NO: 2735308 - RNA, 20 nt, Haemophilus influenzae Rd
uuuauagcauuuaaauauua

SEQ ID NO: 2735309 - RNA, 16 nt, Haemophilus influenzae Rd
uuuauagccuauaauu

SEQ ID NO: 2735310 - RNA, 21 nt, Haemophilus influenzae Rd
uuuauagcuaagcaguuuauu

SEQ ID NO: 2735311 - RNA, 12 nt, Haemophilus influenzae Rd
uuuauaguuuuu

SEQ ID NO: 2735312 - RNA, 13 nt, Haemophilus influenzae Rd
uuuauauaccauu

SEQ ID NO: 2735313 - RNA, 20 nt, Haemophilus influenzae Rd
uuuauaugcaaauaaucucu

SEQ ID NO: 2735314 - RNA, 21 nt, Haemophilus influenzae Rd
uuuauauucuggcaauauuuc

SEQ ID NO: 2735315 - RNA, 13 nt, Haemophilus influenzae Rd
uuuauauuuauaa

SEQ ID NO: 2735316 - RNA, 18 nt, Haemophilus influenzae Rd
uuuauauuuuuucuuaaa

SEQ ID NO: 2735317 - RNA, 19 nt, Haemophilus influenzae Rd
uuuauauuuuuucuuaaau

SEQ ID NO: 2735318 - RNA, 23 nt, Haemophilus influenzae Rd
uuuaucaaaaaucuuauuucaau

SEQ ID NO: 2735319 - RNA, 14 nt, Haemophilus influenzae Rd
uuuaucaaauaacg

SEQ ID NO: 2735320 - RNA, 15 nt, Haemophilus influenzae Rd
uuuaucaacuaaaaa

SEQ ID NO: 2735321 - RNA, 16 nt, Haemophilus influenzae Rd
uuuaucaacuaaaaaa

SEQ ID NO: 2735322 - RNA, 19 nt, Haemophilus influenzae Rd
uuuaucaacuaaaaaauag

SEQ ID NO: 2735323 - RNA, 16 nt, Haemophilus influenzae Rd
uuuaucaagcacaauc

SEQ ID NO: 2735324 - RNA, 17 nt, Haemophilus influenzae Rd
uuuaucaagcacaauca

SEQ ID NO: 2735325 - RNA, 21 nt, Haemophilus influenzae Rd
uuuaucaaucaagcauaaauc

SEQ ID NO: 2735326 - RNA, 10 nt, Haemophilus influenzae Rd
uuuaucaucu

SEQ ID NO: 2735327 - RNA, 20 nt, Haemophilus influenzae Rd
uuuaucauuuaacuugcaau

SEQ ID NO: 2735328 - RNA, 15 nt, Haemophilus influenzae Rd
uuuauccaaaauuaa

SEQ ID NO: 2735329 - RNA, 17 nt, Haemophilus influenzae Rd
uuuauccacaugauaua

SEQ ID NO: 2735330 - RNA, 14 nt, Haemophilus influenzae Rd
uuuauccaucaaac

SEQ ID NO: 2735331 - RNA, 19 nt, Haemophilus influenzae Rd
uuuauccaugacuaaucca

SEQ ID NO: 2735332 - RNA, 15 nt, Haemophilus influenzae Rd
uuuauccccaauuaa

SEQ ID NO: 2735333 - RNA, 13 nt, Haemophilus influenzae Rd
uuuauccccuaca

SEQ ID NO: 2735334 - RNA, 17 nt, Haemophilus influenzae Rd
uuuauccccuacaguga

SEQ ID NO: 2735335 - RNA, 15 nt, Haemophilus influenzae Rd
uuuaucgagaaaauu

SEQ ID NO: 2735336 - RNA, 16 nt, Haemophilus influenzae Rd
uuuaucgagauuucuu

SEQ ID NO: 2735337 - RNA, 18 nt, Haemophilus influenzae Rd
uuuaucgagauuucuuug

SEQ ID NO: 2735338 - RNA, 19 nt, Haemophilus influenzae Rd
uuuaucgaggacaaucugc

SEQ ID NO: 2735339 - RNA, 23 nt, Haemophilus influenzae Rd
uuuaucggcaaauacguauaauu

SEQ ID NO: 2735340 - RNA, 23 nt, Haemophilus influenzae Rd
uuuaucgguuauuacuucaccaa

SEQ ID NO: 2735341 - RNA, 15 nt, Haemophilus influenzae Rd
uuuaucgucugcacg

SEQ ID NO: 2735342 - RNA, 13 nt, Haemophilus influenzae Rd
uuuaucuaaaaaa

SEQ ID NO: 2735343 - RNA, 14 nt, Haemophilus influenzae Rd
uuuaucuaaaagua

SEQ ID NO: 2735344 - RNA, 20 nt, Haemophilus influenzae Rd
uuuaucuaccacaucaaauu

SEQ ID NO: 2735345 - RNA, 22 nt, Haemophilus influenzae Rd
uuuaucuaccacaucaaauuua

SEQ ID NO: 2735346 - RNA, 19 nt, Haemophilus influenzae Rd
uuuaucuauugauucuaaa

SEQ ID NO: 2735347 - RNA, 15 nt, Haemophilus influenzae Rd
uuuaucucggcuaaa

SEQ ID NO: 2735348 - RNA, 22 nt, Haemophilus influenzae Rd
uuuaucucggcuaaaaucugug

SEQ ID NO: 2735349 - RNA, 14 nt, Haemophilus influenzae Rd
uuuaucucuuucuu

SEQ ID NO: 2735350 - RNA, 17 nt, Haemophilus influenzae Rd
uuuaucucuuucuuaaa

SEQ ID NO: 2735351 - RNA, 18 nt, Haemophilus influenzae Rd
uuuaucuucaaaauagua

SEQ ID NO: 2735352 - RNA, 13 nt, Haemophilus influenzae Rd
uuuaucuugcuca

SEQ ID NO: 2735353 - RNA, 16 nt, Haemophilus influenzae Rd
uuuaucuuuaaagaau

SEQ ID NO: 2735354 - RNA, 11 nt, Haemophilus influenzae Rd
uuuaucuuuua

SEQ ID NO: 2735355 - RNA, 18 nt, Haemophilus influenzae Rd
uuuaucuuuuacaucaau

SEQ ID NO: 2735356 - RNA, 19 nt, Haemophilus influenzae Rd
uuuaucuuuuacaucaauu

SEQ ID NO: 2735357 - RNA, 16 nt, Haemophilus influenzae Rd
uuuaugaccaaauaca

SEQ ID NO: 2735358 - RNA, 14 nt, Haemophilus influenzae Rd
uuuaugacuauuuu

SEQ ID NO: 2735359 - RNA, 16 nt, Haemophilus influenzae Rd
uuuaugacuauuuuuu

SEQ ID NO: 2735360 - RNA, 12 nt, Haemophilus influenzae Rd
uuuaugauuaaa

SEQ ID NO: 2735361 - RNA, 11 nt, Haemophilus influenzae Rd
uuuaugcuuua

SEQ ID NO: 2735362 - RNA, 23 nt, Haemophilus influenzae Rd
uuuauggcuugugcuauacaaaa

SEQ ID NO: 2735363 - RNA, 19 nt, Haemophilus influenzae Rd
uuuauguugaauuuucacc

SEQ ID NO: 2735364 - RNA, 12 nt, Haemophilus influenzae Rd
uuuauuaaaaaa

SEQ ID NO: 2735365 - RNA, 20 nt, Haemophilus influenzae Rd
uuuauuaaaaguaaacaauu

SEQ ID NO: 2735366 - RNA, 15 nt, Haemophilus influenzae Rd
uuuauuaagauauaa

SEQ ID NO: 2735367 - RNA, 16 nt, Haemophilus influenzae Rd
uuuauuaauuauaaaa

SEQ ID NO: 2735368 - RNA, 14 nt, Haemophilus influenzae Rd
uuuauuacaaacaa

SEQ ID NO: 2735369 - RNA, 15 nt, Haemophilus influenzae Rd
uuuauuacauuaaaa

SEQ ID NO: 2735370 - RNA, 18 nt, Haemophilus influenzae Rd
uuuauuacccuauucuaa

SEQ ID NO: 2735371 - RNA, 20 nt, Haemophilus influenzae Rd
uuuauuacccuauucuaaau

SEQ ID NO: 2735372 - RNA, 23 nt, Haemophilus influenzae Rd
uuuauuacccuauucuaaauuua

SEQ ID NO: 2735373 - RNA, 15 nt, Haemophilus influenzae Rd
uuuauuagaaauaua

SEQ ID NO: 2735374 - RNA, 22 nt, Haemophilus influenzae Rd
uuuauuagaaauauauuuguuu

SEQ ID NO: 2735375 - RNA, 15 nt, Haemophilus influenzae Rd
uuuauuagaauauaa

SEQ ID NO: 2735376 - RNA, 20 nt, Haemophilus influenzae Rd
uuuauuagauggaaaacuua

SEQ ID NO: 2735377 - RNA, 16 nt, Haemophilus influenzae Rd
uuuauuaguaaaauaa

SEQ ID NO: 2735378 - RNA, 21 nt, Haemophilus influenzae Rd
uuuauuaguaaaauaauaagc

SEQ ID NO: 2735379 - RNA, 16 nt, Haemophilus influenzae Rd
uuuauuauauaaaaaa

SEQ ID NO: 2735380 - RNA, 15 nt, Haemophilus influenzae Rd
uuuauuaucaaaaaa

SEQ ID NO: 2735381 - RNA, 19 nt, Haemophilus influenzae Rd
uuuauuaucaacaguaaau

SEQ ID NO: 2735382 - RNA, 12 nt, Haemophilus influenzae Rd
uuuauuaugcua

SEQ ID NO: 2735383 - RNA, 13 nt, Haemophilus influenzae Rd
uuuauucaaaaua

SEQ ID NO: 2735384 - RNA, 22 nt, Haemophilus influenzae Rd
uuuauucaaaucgaucacuuaa

SEQ ID NO: 2735385 - RNA, 22 nt, Haemophilus influenzae Rd
uuuauucaguaaacaaguauaa

SEQ ID NO: 2735386 - RNA, 20 nt, Haemophilus influenzae Rd
uuuauucugaaaccacuaaa

SEQ ID NO: 2735387 - RNA, 22 nt, Haemophilus influenzae Rd
uuuauucugaaaccacuaaaaa

SEQ ID NO: 2735388 - RNA, 15 nt, Haemophilus influenzae Rd
uuuauugaaauuuua

SEQ ID NO: 2735389 - RNA, 15 nt, Haemophilus influenzae Rd
uuuauugaagaguaa

SEQ ID NO: 2735390 - RNA, 21 nt, Haemophilus influenzae Rd
uuuauugaccgcuucauuaaa

SEQ ID NO: 2735391 - RNA, 12 nt, Haemophilus influenzae Rd
uuuauuuaacaa

SEQ ID NO: 2735392 - RNA, 14 nt, Haemophilus influenzae Rd
uuuauuuaacaaua

SEQ ID NO: 2735393 - RNA, 14 nt, Haemophilus influenzae Rd
uuuauuuaauaaca

SEQ ID NO: 2735394 - RNA, 20 nt, Haemophilus influenzae Rd
uuuauuuacccaagccaauu

SEQ ID NO: 2735395 - RNA, 20 nt, Haemophilus influenzae Rd
uuuauuuacugauuuaaaaa

SEQ ID NO: 2735396 - RNA, 15 nt, Haemophilus influenzae Rd
uuuauuuagaaagua

SEQ ID NO: 2735397 - RNA, 18 nt, Haemophilus influenzae Rd
uuuauuuagaauuuuuau

SEQ ID NO: 2735398 - RNA, 21 nt, Haemophilus influenzae Rd
uuuauuucaauauaaucaauu

SEQ ID NO: 2735399 - RNA, 19 nt, Haemophilus influenzae Rd
uuuauuucccucaaaauua

SEQ ID NO: 2735400 - RNA, 12 nt, Haemophilus influenzae Rd
uuuauuucuaua

SEQ ID NO: 2735401 - RNA, 21 nt, Haemophilus influenzae Rd
uuuauuucuauagauuuauuu

SEQ ID NO: 2735402 - RNA, 13 nt, Haemophilus influenzae Rd
uuuauuucugaag

SEQ ID NO: 2735403 - RNA, 21 nt, Haemophilus influenzae Rd
uuuauuugcggacaguauauu

SEQ ID NO: 2735404 - RNA, 12 nt, Haemophilus influenzae Rd
uuuauuuggcau

SEQ ID NO: 2735405 - RNA, 22 nt, Haemophilus influenzae Rd
uuuauuugucagauuuacccaa

SEQ ID NO: 2735406 - RNA, 15 nt, Haemophilus influenzae Rd
uuucucgcucuaguu

SEQ ID NO: 2735407 - RNA, 12 nt, Haemophilus influenzae Rd
uuucugaacacu

SEQ ID NO: 2735408 - RNA, 16 nt, Haemophilus influenzae Rd
uuucugaacuaaaaua

SEQ ID NO: 2735409 - RNA, 17 nt, Haemophilus influenzae Rd
uuucugaauaaauuuuu

SEQ ID NO: 2735410 - RNA, 22 nt, Haemophilus influenzae Rd
uuucugacacccaaauuaaaaa

SEQ ID NO: 2735411 - RNA, 14 nt, Haemophilus influenzae Rd
uuucugcaauuuua

SEQ ID NO: 2735412 - RNA, 15 nt, Haemophilus influenzae Rd
uuucugcaguuucug

SEQ ID NO: 2735413 - RNA, 21 nt, Haemophilus influenzae Rd
uuucugcguuuggcacaacau

SEQ ID NO: 2735414 - RNA, 16 nt, Haemophilus influenzae Rd
uuucuggcucugcuga

SEQ ID NO: 2735415 - RNA, 16 nt, Haemophilus influenzae Rd
uuucuggguuuuaaaa

SEQ ID NO: 2735416 - RNA, 22 nt, Haemophilus influenzae Rd
uuucuggguuuuaaaauaguua

SEQ ID NO: 2735417 - RNA, 16 nt, Haemophilus influenzae Rd
uuucuguuaaaucuac

SEQ ID NO: 2735418 - RNA, 17 nt, Haemophilus influenzae Rd
uuucuguugauuuauca

SEQ ID NO: 2735419 - RNA, 16 nt, Haemophilus influenzae Rd
uuucuguuuuuccauu

SEQ ID NO: 2735420 - RNA, 12 nt, Haemophilus influenzae Rd
uuucuuaaaaua

SEQ ID NO: 2735421 - RNA, 13 nt, Haemophilus influenzae Rd
uuucuuaaaauac

SEQ ID NO: 2735422 - RNA, 13 nt, Haemophilus influenzae Rd
uuucuuaaauaua

SEQ ID NO: 2735423 - RNA, 23 nt, Haemophilus influenzae Rd
uuucuuagcuucaucuucaucaa

SEQ ID NO: 2735424 - RNA, 13 nt, Haemophilus influenzae Rd
uuucuuauagaua

SEQ ID NO: 2735425 - RNA, 17 nt, Haemophilus influenzae Rd
uuucuuauauucaaauu

SEQ ID NO: 2735426 - RNA, 15 nt, Haemophilus influenzae Rd
uuucuuaugaaaaaa

SEQ ID NO: 2735427 - RNA, 22 nt, Haemophilus influenzae Rd
uuucuuauuauacauuuaacca

SEQ ID NO: 2735428 - RNA, 12 nt, Haemophilus influenzae Rd
uuucuuccauuu

SEQ ID NO: 2735429 - RNA, 16 nt, Haemophilus influenzae Rd
uuucuuccauuucaau

SEQ ID NO: 2735430 - RNA, 24 nt, Haemophilus influenzae Rd
uuucuucguuaaaguugcugaaua

SEQ ID NO: 2735431 - RNA, 13 nt, Haemophilus influenzae Rd
uuucuugaccuuc

SEQ ID NO: 2735432 - RNA, 17 nt, Haemophilus influenzae Rd
uuucuugaccuucaauu

SEQ ID NO: 2735433 - RNA, 14 nt, Haemophilus influenzae Rd
uuucuugagcagac

SEQ ID NO: 2735434 - RNA, 17 nt, Haemophilus influenzae Rd
uuucuugccaaaauuca

SEQ ID NO: 2735435 - RNA, 17 nt, Haemophilus influenzae Rd
uuucuugcccaauauaa

SEQ ID NO: 2735436 - RNA, 17 nt, Haemophilus influenzae Rd
uuucuugcuaaaaagaa

SEQ ID NO: 2735437 - RNA, 22 nt, Haemophilus influenzae Rd
uuucuugcuaaaaagaaauaaa

SEQ ID NO: 2735438 - RNA, 15 nt, Haemophilus influenzae Rd
uuucuugcuauucuu

SEQ ID NO: 2735439 - RNA, 16 nt, Haemophilus influenzae Rd
uuucuuuaaaaaauaa

SEQ ID NO: 2735440 - RNA, 23 nt, Haemophilus influenzae Rd
uuucuuuaaaauuauaauauuua

SEQ ID NO: 2735441 - RNA, 14 nt, Haemophilus influenzae Rd
uuucuuuauuucau

SEQ ID NO: 2735442 - RNA, 17 nt, Haemophilus influenzae Rd
uuucuuugaguaaaaaa

SEQ ID NO: 2735443 - RNA, 14 nt, Haemophilus influenzae Rd
uuucuuuuccuugc

SEQ ID NO: 2735444 - RNA, 17 nt, Haemophilus influenzae Rd
uuucuuuucuucuaauu

SEQ ID NO: 2735445 - RNA, 13 nt, Haemophilus influenzae Rd
uuucuuuuuccug

SEQ ID NO: 2735446 - RNA, 14 nt, Haemophilus influenzae Rd
uuucuuuuuuucuu

SEQ ID NO: 2735447 - RNA, 17 nt, Haemophilus influenzae Rd
uuugaaaaauuaucaaa

SEQ ID NO: 2735448 - RNA, 22 nt, Haemophilus influenzae Rd
uuugaaaagaauuucaucgcau

SEQ ID NO: 2735449 - RNA, 15 nt, Haemophilus influenzae Rd
uuugaaaaucucuau

SEQ ID NO: 2735450 - RNA, 21 nt, Haemophilus influenzae Rd
uuugaacccauuaaccaacau

SEQ ID NO: 2735451 - RNA, 20 nt, Haemophilus influenzae Rd
uuugaaggcaaaauugaagc

SEQ ID NO: 2735452 - RNA, 14 nt, Haemophilus influenzae Rd
uuugaaguaaaaaa

SEQ ID NO: 2735453 - RNA, 18 nt, Haemophilus influenzae Rd
uuugaaguacauucaagc

SEQ ID NO: 2735454 - RNA, 11 nt, Haemophilus influenzae Rd
uuugaauaauu

SEQ ID NO: 2735455 - RNA, 15 nt, Haemophilus influenzae Rd
uuugaauaucuacgc

SEQ ID NO: 2735456 - RNA, 16 nt, Haemophilus influenzae Rd
uuugaaucuaaaacua

SEQ ID NO: 2735457 - RNA, 19 nt, Haemophilus influenzae Rd
uuugaaugaaauucaguga

SEQ ID NO: 2735458 - RNA, 17 nt, Haemophilus influenzae Rd
uuugaauuaaaacuuga

SEQ ID NO: 2735459 - RNA, 17 nt, Haemophilus influenzae Rd
uuugacccgcuuuuaau

SEQ ID NO: 2735460 - RNA, 15 nt, Haemophilus influenzae Rd
uuugaccgacaagau

SEQ ID NO: 2735461 - RNA, 19 nt, Haemophilus influenzae Rd
uuugaccgcggaaaauauc

SEQ ID NO: 2735462 - RNA, 22 nt, Haemophilus influenzae Rd
uuugacgagauuuuuugaauaa

SEQ ID NO: 2735463 - RNA, 17 nt, Haemophilus influenzae Rd
uuugacgauaauauuuu

SEQ ID NO: 2735464 - RNA, 23 nt, Haemophilus influenzae Rd
uuugacgauaauauuuuugccaa

SEQ ID NO: 2735465 - RNA, 21 nt, Haemophilus influenzae Rd
uuugacgcagcaucugccacu

SEQ ID NO: 2735466 - RNA, 21 nt, Haemophilus influenzae Rd
uuugacuaaaucaugaauaau

SEQ ID NO: 2735467 - RNA, 23 nt, Haemophilus influenzae Rd
uuugacuaaaucaugaauaauuu

SEQ ID NO: 2735468 - RNA, 23 nt, Haemophilus influenzae Rd
uuugacuucccagccuuguaauu

SEQ ID NO: 2735469 - RNA, 18 nt, Haemophilus influenzae Rd
uuugagauuuuauuucgc

SEQ ID NO: 2735470 - RNA, 20 nt, Haemophilus influenzae Rd
uuugagccguuauauuuccu

SEQ ID NO: 2735471 - RNA, 19 nt, Haemophilus influenzae Rd
uuugaggaucacacaaaau

SEQ ID NO: 2735472 - RNA, 14 nt, Haemophilus influenzae Rd
uuugaggcuaauaa

SEQ ID NO: 2735473 - RNA, 17 nt, Haemophilus influenzae Rd
uuugagguaauuuguua

SEQ ID NO: 2735474 - RNA, 17 nt, Haemophilus influenzae Rd
uuugaguaaaaaaucua

SEQ ID NO: 2735475 - RNA, 17 nt, Haemophilus influenzae Rd
uuugaguuauuuuuaau

SEQ ID NO: 2735476 - RNA, 14 nt, Haemophilus influenzae Rd
uuugauaaaaacac

SEQ ID NO: 2735477 - RNA, 20 nt, Haemophilus influenzae Rd
uuugauaaaguuuuuucaau

SEQ ID NO: 2735478 - RNA, 23 nt, Haemophilus influenzae Rd
uuugauacuaacucaaaauacuc

SEQ ID NO: 2735479 - RNA, 13 nt, Haemophilus influenzae Rd
uuugauaugccac

SEQ ID NO: 2735480 - RNA, 18 nt, Haemophilus influenzae Rd
uuugauccacacuucauc

SEQ ID NO: 2735481 - RNA, 17 nt, Haemophilus influenzae Rd
uuugaugcucagaaaga

SEQ ID NO: 2735482 - RNA, 16 nt, Haemophilus influenzae Rd
uuugauggucauugcu

SEQ ID NO: 2735483 - RNA, 16 nt, Haemophilus influenzae Rd
uuugauuacaguacaa

SEQ ID NO: 2735484 - RNA, 14 nt, Haemophilus influenzae Rd
uuugauuaccacga

SEQ ID NO: 2735485 - RNA, 21 nt, Haemophilus influenzae Rd
uuugauuaccacgaguauauu

SEQ ID NO: 2735486 - RNA, 12 nt, Haemophilus influenzae Rd
uuugauuuaauu

SEQ ID NO: 2735487 - RNA, 17 nt, Haemophilus influenzae Rd
uuugauuuaguccuaaa

SEQ ID NO: 2735488 - RNA, 20 nt, Haemophilus influenzae Rd
uuugauuucagaacaugacu

SEQ ID NO: 2735489 - RNA, 15 nt, Haemophilus influenzae Rd
uuugauuuucuuauu

SEQ ID NO: 2735490 - RNA, 15 nt, Haemophilus influenzae Rd
uuugcaaaauugcuu

SEQ ID NO: 2735491 - RNA, 18 nt, Haemophilus influenzae Rd
uuugcaaaccaaaucaca

SEQ ID NO: 2735492 - RNA, 14 nt, Haemophilus influenzae Rd
uuugcaaauacagu

SEQ ID NO: 2735493 - RNA, 13 nt, Haemophilus influenzae Rd
uuugcaacauaug

SEQ ID NO: 2735494 - RNA, 18 nt, Haemophilus influenzae Rd
uuugcaagccaauagauu

SEQ ID NO: 2735495 - RNA, 17 nt, Haemophilus influenzae Rd
uuugcaaggcucgcgau

SEQ ID NO: 2735496 - RNA, 20 nt, Haemophilus influenzae Rd
uuugcaagguuuccaagaau

SEQ ID NO: 2735497 - RNA, 17 nt, Haemophilus influenzae Rd
uuugcaauccagugcau

SEQ ID NO: 2735498 - RNA, 21 nt, Haemophilus influenzae Rd
uuugcaccacguucuuuuaau

SEQ ID NO: 2735499 - RNA, 19 nt, Haemophilus influenzae Rd
uuugcacccgccauaaaac

SEQ ID NO: 2735500 - RNA, 22 nt, Haemophilus influenzae Rd
uuugcacccgccauaaaacaca

SEQ ID NO: 2735501 - RNA, 18 nt, Haemophilus influenzae Rd
uuugccaaauccacaacc

SEQ ID NO: 2735502 - RNA, 20 nt, Haemophilus influenzae Rd
uuugccaacaccuaagaacu

SEQ ID NO: 2735503 - RNA, 23 nt, Haemophilus influenzae Rd
uuugccaauuuuuucugaauaaa

SEQ ID NO: 2735504 - RNA, 21 nt, Haemophilus influenzae Rd
uuugccacaggauaaaaacca

SEQ ID NO: 2735505 - RNA, 13 nt, Haemophilus influenzae Rd
uuugccaucacga

SEQ ID NO: 2735506 - RNA, 13 nt, Haemophilus influenzae Rd
uuugcccaauucu

SEQ ID NO: 2735507 - RNA, 13 nt, Haemophilus influenzae Rd
uuugcccacauag

SEQ ID NO: 2735508 - RNA, 15 nt, Haemophilus influenzae Rd
uuugccccaauauuu

SEQ ID NO: 2735509 - RNA, 16 nt, Haemophilus influenzae Rd
uuugccgccaaaauga

SEQ ID NO: 2735510 - RNA, 16 nt, Haemophilus influenzae Rd
uuugcgauaauuugca

SEQ ID NO: 2735511 - RNA, 16 nt, Haemophilus influenzae Rd
uuugcgaugauaaagu

SEQ ID NO: 2735512 - RNA, 14 nt, Haemophilus influenzae Rd
uuuuaaaaucaucu

SEQ ID NO: 2735513 - RNA, 13 nt, Haemophilus influenzae Rd
uuuuaaaaucucu

SEQ ID NO: 2735514 - RNA, 18 nt, Haemophilus influenzae Rd
uuuuaaaaucucucaaaa

SEQ ID NO: 2735515 - RNA, 18 nt, Haemophilus influenzae Rd
uuuuaaaaucuuuggauu

SEQ ID NO: 2735516 - RNA, 20 nt, Haemophilus influenzae Rd
uuuuaaaauggaaauuugag

SEQ ID NO: 2735517 - RNA, 23 nt, Haemophilus influenzae Rd
uuuuaaaauguaaaaauuggaaa

SEQ ID NO: 2735518 - RNA, 16 nt, Haemophilus influenzae Rd
uuuuaaacaauauauu

SEQ ID NO: 2735519 - RNA, 21 nt, Haemophilus influenzae Rd
uuuuaaacagcaaaagugcuu

SEQ ID NO: 2735520 - RNA, 12 nt, Haemophilus influenzae Rd
uuuuaaagaguu

SEQ ID NO: 2735521 - RNA, 11 nt, Haemophilus influenzae Rd
uuuuaaauaaa

SEQ ID NO: 2735522 - RNA, 13 nt, Haemophilus influenzae Rd
uuuuaaauaaaaa

SEQ ID NO: 2735523 - RNA, 23 nt, Haemophilus influenzae Rd
uuuuaaauacagcucaaaaugcu

SEQ ID NO: 2735524 - RNA, 12 nt, Haemophilus influenzae Rd
uuuuaaauauuu

SEQ ID NO: 2735525 - RNA, 20 nt, Haemophilus influenzae Rd
uuuuaaauauuuuuacaaaa

SEQ ID NO: 2735526 - RNA, 17 nt, Haemophilus influenzae Rd
uuuuaaaucccaaucuc

SEQ ID NO: 2735527 - RNA, 13 nt, Haemophilus influenzae Rd
uuuuaaauuuucu

SEQ ID NO: 2735528 - RNA, 14 nt, Haemophilus influenzae Rd
uuuuaacaaaagcu

SEQ ID NO: 2735529 - RNA, 19 nt, Haemophilus influenzae Rd
uuuuaaccgcacuuuuaau

SEQ ID NO: 2735530 - RNA, 20 nt, Haemophilus influenzae Rd
uuuuaaccgcacuuuuaauu

SEQ ID NO: 2735531 - RNA, 22 nt, Haemophilus influenzae Rd
uuuuaaccgcacuuuuauuauu

SEQ ID NO: 2735532 - RNA, 23 nt, Haemophilus influenzae Rd
uuuuaaccgcacuuuuuaauaaa

SEQ ID NO: 2735533 - RNA, 22 nt, Haemophilus influenzae Rd
uuuuaacgcgcuacaauauuua

SEQ ID NO: 2735534 - RNA, 17 nt, Haemophilus influenzae Rd
uuuuaaggaaacguaaa

SEQ ID NO: 2735535 - RNA, 18 nt, Haemophilus influenzae Rd
uuuuaaggaaacguaaaa

SEQ ID NO: 2735536 - RNA, 21 nt, Haemophilus influenzae Rd
uuuuaaggaaacguaaaauau

SEQ ID NO: 2735537 - RNA, 17 nt, Haemophilus influenzae Rd
uuuuaagguuuuuuccg

SEQ ID NO: 2735538 - RNA, 16 nt, Haemophilus influenzae Rd
uuuuaaguaguauuuu

SEQ ID NO: 2735539 - RNA, 17 nt, Haemophilus influenzae Rd
uuuuaaguaguauuuua

SEQ ID NO: 2735540 - RNA, 19 nt, Haemophilus influenzae Rd
uuuuaagucgcuaauuuuu

SEQ ID NO: 2735541 - RNA, 23 nt, Haemophilus influenzae Rd
uuuuaagugcgguugauuuuuga

SEQ ID NO: 2735542 - RNA, 23 nt, Haemophilus influenzae Rd
uuuuaaguuucacucuaccaucu

SEQ ID NO: 2735543 - RNA, 19 nt, Haemophilus influenzae Rd
uuuuaaucaaauaaaauau

SEQ ID NO: 2735544 - RNA, 22 nt, Haemophilus influenzae Rd
uuuuaaucgcacuuaaaagauu

SEQ ID NO: 2735545 - RNA, 19 nt, Haemophilus influenzae Rd
uuuuaaugcuuacaaaauu

SEQ ID NO: 2735546 - RNA, 17 nt, Haemophilus influenzae Rd
uuuuaaugggauuuuua

SEQ ID NO: 2735547 - RNA, 18 nt, Haemophilus influenzae Rd
uuuuaauuaaauacaaaa

SEQ ID NO: 2735548 - RNA, 15 nt, Haemophilus influenzae Rd
uuuuaauuaucuaaa

SEQ ID NO: 2735549 - RNA, 13 nt, Haemophilus influenzae Rd
uuuuaauugguuu

SEQ ID NO: 2735550 - RNA, 20 nt, Haemophilus influenzae Rd
uuuuaauugguuuugugcuu

SEQ ID NO: 2735551 - RNA, 13 nt, Haemophilus influenzae Rd
uuuuaauuuaaau

SEQ ID NO: 2735552 - RNA, 17 nt, Haemophilus influenzae Rd
uuuuaauuuuauagaaa

SEQ ID NO: 2735553 - RNA, 13 nt, Haemophilus influenzae Rd
uuuuaauuuuuua

SEQ ID NO: 2735554 - RNA, 15 nt, Haemophilus influenzae Rd
uuuuacaaaaaguac

SEQ ID NO: 2735555 - RNA, 19 nt, Haemophilus influenzae Rd
uuuuacaacauuaccuucu

SEQ ID NO: 2735556 - RNA, 14 nt, Haemophilus influenzae Rd
uuuuacauauaaaa

SEQ ID NO: 2735557 - RNA, 16 nt, Haemophilus influenzae Rd
uuuuaccaagaaauaa

SEQ ID NO: 2735558 - RNA, 17 nt, Haemophilus influenzae Rd
uuuuaccaagaaauaag

SEQ ID NO: 2735559 - RNA, 13 nt, Haemophilus influenzae Rd
uuuuaccauaucc

SEQ ID NO: 2735560 - RNA, 16 nt, Haemophilus influenzae Rd
uuuuaccauauccauu

SEQ ID NO: 2735561 - RNA, 23 nt, Haemophilus influenzae Rd
uuuuaccgcacuuuucaacaaaa

SEQ ID NO: 2735562 - RNA, 22 nt, Haemophilus influenzae Rd
uuuuaccgcacuuuuuuuauau

SEQ ID NO: 2735563 - RNA, 20 nt, Haemophilus influenzae Rd
uuuuaccgccgaaauuccca

SEQ ID NO: 2735564 - RNA, 15 nt, Haemophilus influenzae Rd
uuuuacgacuaauuu

SEQ ID NO: 2735565 - RNA, 22 nt, Haemophilus influenzae Rd
uuuuacgacuaauuuuuuaauu

SEQ ID NO: 2735566 - RNA, 23 nt, Haemophilus influenzae Rd
uuuuacgagaaagguguaauucc

SEQ ID NO: 2735567 - RNA, 16 nt, Haemophilus influenzae Rd
uuuuacgauauuuuua

SEQ ID NO: 2735568 - RNA, 23 nt, Haemophilus influenzae Rd
uuuuacgccauucuuuauucguu

SEQ ID NO: 2735569 - RNA, 23 nt, Haemophilus influenzae Rd
uuuuacgccuccauuaguuguuu

SEQ ID NO: 2735570 - RNA, 21 nt, Haemophilus influenzae Rd
uuuuacgcgcugauucuaaug

SEQ ID NO: 2735571 - RNA, 21 nt, Haemophilus influenzae Rd
uuuuacgcuguucuucuaaug

SEQ ID NO: 2735572 - RNA, 22 nt, Haemophilus influenzae Rd
uuuuacgcuuggaaauguuuaa

SEQ ID NO: 2735573 - RNA, 16 nt, Haemophilus influenzae Rd
uuuuacggauuuauau

SEQ ID NO: 2735574 - RNA, 16 nt, Haemophilus influenzae Rd
uuuuacgugcgaauuu

SEQ ID NO: 2735575 - RNA, 14 nt, Haemophilus influenzae Rd
uuuuacguuucauu

SEQ ID NO: 2735576 - RNA, 21 nt, Haemophilus influenzae Rd
uuuuacuaaaugcuguagaaa

SEQ ID NO: 2735577 - RNA, 23 nt, Haemophilus influenzae Rd
uuuuacuaaaugcuguagaaauu

SEQ ID NO: 2735578 - RNA, 21 nt, Haemophilus influenzae Rd
uuuuacucguccaaauucauu

SEQ ID NO: 2735579 - RNA, 14 nt, Haemophilus influenzae Rd
uuuuacuucaucaa

SEQ ID NO: 2735580 - RNA, 21 nt, Haemophilus influenzae Rd
uuuuacuuggaauaucaucua

SEQ ID NO: 2735581 - RNA, 18 nt, Haemophilus influenzae Rd
uuuuacuuuuacuuaaag

SEQ ID NO: 2735582 - RNA, 23 nt, Haemophilus influenzae Rd
uuuuagaaagcuggcgaccuuug

SEQ ID NO: 2735583 - RNA, 17 nt, Haemophilus influenzae Rd
uuuuagaauccaaaauu

SEQ ID NO: 2735584 - RNA, 20 nt, Haemophilus influenzae Rd
uuuuagacggucaaauucag

SEQ ID NO: 2735585 - RNA, 18 nt, Haemophilus influenzae Rd
uuuuagagcuuuuugcgc

SEQ ID NO: 2735586 - RNA, 14 nt, Haemophilus influenzae Rd
uuuuagcuaccaau

SEQ ID NO: 2735587 - RNA, 17 nt, Haemophilus influenzae Rd
uuuuagcugauuuuuua

SEQ ID NO: 2735588 - RNA, 20 nt, Haemophilus influenzae Rd
uuuuagcugauuuuuuaaag

SEQ ID NO: 2735589 - RNA, 22 nt, Haemophilus influenzae Rd
uuuuagcugauuuuuuaaagua

SEQ ID NO: 2735590 - RNA, 23 nt, Haemophilus influenzae Rd
uuuuagcugauuuuuuaaaguaa

SEQ ID NO: 2735591 - RNA, 22 nt, Haemophilus influenzae Rd
uuuuagcugucucauuuugcuc

SEQ ID NO: 2735592 - RNA, 17 nt, Haemophilus influenzae Rd
uuuuagggaagauuaau

SEQ ID NO: 2735593 - RNA, 21 nt, Haemophilus influenzae Rd
uuuuaggugcuuuuaaauuuu

SEQ ID NO: 2735594 - RNA, 17 nt, Haemophilus influenzae Rd
uuuuagguucaauaaug

SEQ ID NO: 2735595 - RNA, 21 nt, Haemophilus influenzae Rd
uuuuagugguuucagaauaaa

SEQ ID NO: 2735596 - RNA, 22 nt, Haemophilus influenzae Rd
uuuuaguuaucuguauaaauga

SEQ ID NO: 2735597 - RNA, 15 nt, Haemophilus influenzae Rd
uuuuaguuucuaauu

SEQ ID NO: 2735598 - RNA, 13 nt, Haemophilus influenzae Rd
uuuuaguuuguuu

SEQ ID NO: 2735599 - RNA, 19 nt, Haemophilus influenzae Rd
uuuuaguuuuuuuauaaaa

SEQ ID NO: 2735600 - RNA, 11 nt, Haemophilus influenzae Rd
uuuuauaaaaa

SEQ ID NO: 2735601 - RNA, 13 nt, Haemophilus influenzae Rd
uuuuauaaaaaaa

SEQ ID NO: 2735602 - RNA, 15 nt, Haemophilus influenzae Rd
uuuuauaaaaaaaca

SEQ ID NO: 2735603 - RNA, 17 nt, Haemophilus influenzae Rd
uuuuauaaagaucaaug

SEQ ID NO: 2735604 - RNA, 20 nt, Haemophilus influenzae Rd
uuuuauaaccaguuauucuu

SEQ ID NO: 2735605 - RNA, 18 nt, Haemophilus influenzae Rd
uuuuauaagcuauuuacu

SEQ ID NO: 2735606 - RNA, 14 nt, Haemophilus influenzae Rd
uuuuauaauuaaau

SEQ ID NO: 2735607 - RNA, 15 nt, Haemophilus influenzae Rd
uuuuauaauuuugau

SEQ ID NO: 2735608 - RNA, 17 nt, Haemophilus influenzae Rd
uuuuauacuuacucaau

SEQ ID NO: 2735609 - RNA, 22 nt, Haemophilus influenzae Rd
uuuuauagugauuauuuacaau

SEQ ID NO: 2735610 - RNA, 13 nt, Haemophilus influenzae Rd
uuuuauauuuuuu

SEQ ID NO: 2735611 - RNA, 22 nt, Haemophilus influenzae Rd
uuuuauauuuuuuacuauucuu

SEQ ID NO: 2735612 - RNA, 19 nt, Haemophilus influenzae Rd
uuuuaucaaguaauacuuu

SEQ ID NO: 2735613 - RNA, 14 nt, Haemophilus influenzae Rd
uuuuaucaauaacu

SEQ ID NO: 2735614 - RNA, 23 nt, Haemophilus influenzae Rd
uuuuaucauugcuccacuucuua

SEQ ID NO: 2735615 - RNA, 13 nt, Haemophilus influenzae Rd
uuuuauccaaccu

SEQ ID NO: 2735616 - RNA, 13 nt, Haemophilus influenzae Rd
uuuucuagcaaua

SEQ ID NO: 2735617 - RNA, 13 nt, Haemophilus influenzae Rd
uuuucuauuuaaa

SEQ ID NO: 2735618 - RNA, 14 nt, Haemophilus influenzae Rd
uuuucucaaaacau

SEQ ID NO: 2735619 - RNA, 15 nt, Haemophilus influenzae Rd
uuuucucaaaacauc

SEQ ID NO: 2735620 - RNA, 21 nt, Haemophilus influenzae Rd
uuuucucaaaacaucuuuaau

SEQ ID NO: 2735621 - RNA, 14 nt, Haemophilus influenzae Rd
uuuucucaccacca

SEQ ID NO: 2735622 - RNA, 19 nt, Haemophilus influenzae Rd
uuuucucgugccuauuuau

SEQ ID NO: 2735623 - RNA, 15 nt, Haemophilus influenzae Rd
uuuucucgugugaaa

SEQ ID NO: 2735624 - RNA, 21 nt, Haemophilus influenzae Rd
uuuucucguucguuuaaauua

SEQ ID NO: 2735625 - RNA, 13 nt, Haemophilus influenzae Rd
uuuucucucgcca

SEQ ID NO: 2735626 - RNA, 22 nt, Haemophilus influenzae Rd
uuuucucugcgauuucuuuugg

SEQ ID NO: 2735627 - RNA, 17 nt, Haemophilus influenzae Rd
uuuucucuguuuuaucu

SEQ ID NO: 2735628 - RNA, 17 nt, Haemophilus influenzae Rd
uuuucugaacuaaaaua

SEQ ID NO: 2735629 - RNA, 20 nt, Haemophilus influenzae Rd
uuuucugaauaaauuuuuua

SEQ ID NO: 2735630 - RNA, 13 nt, Haemophilus influenzae Rd
uuuucugauaacu

SEQ ID NO: 2735631 - RNA, 21 nt, Haemophilus influenzae Rd
uuuucugcauuugauuucaga

SEQ ID NO: 2735632 - RNA, 21 nt, Haemophilus influenzae Rd
uuuucugcgccguacugcuca

SEQ ID NO: 2735633 - RNA, 21 nt, Haemophilus influenzae Rd
uuuucugcgcgcaauccaacg

SEQ ID NO: 2735634 - RNA, 16 nt, Haemophilus influenzae Rd
uuuucugcucuucauc

SEQ ID NO: 2735635 - RNA, 21 nt, Haemophilus influenzae Rd
uuuucugucacuucgcagaca

SEQ ID NO: 2735636 - RNA, 22 nt, Haemophilus influenzae Rd
uuuucuuaauuuuauuaauucu

SEQ ID NO: 2735637 - RNA, 18 nt, Haemophilus influenzae Rd
uuuucuuagauaaaaacc

SEQ ID NO: 2735638 - RNA, 12 nt, Haemophilus influenzae Rd
uuuucuuaugaa

SEQ ID NO: 2735639 - RNA, 15 nt, Haemophilus influenzae Rd
uuuucuuauuucuuu

SEQ ID NO: 2735640 - RNA, 11 nt, Haemophilus influenzae Rd
uuuucuucaau

SEQ ID NO: 2735641 - RNA, 15 nt, Haemophilus influenzae Rd
uuuucuucagcauca

SEQ ID NO: 2735642 - RNA, 16 nt, Haemophilus influenzae Rd
uuuucuucagcaucaa

SEQ ID NO: 2735643 - RNA, 17 nt, Haemophilus influenzae Rd
uuuucuucagcaucaac

SEQ ID NO: 2735644 - RNA, 15 nt, Haemophilus influenzae Rd
uuuucuugcuaaaaa

SEQ ID NO: 2735645 - RNA, 13 nt, Haemophilus influenzae Rd
uuuugaaucucau

SEQ ID NO: 2735646 - RNA, 17 nt, Haemophilus influenzae Rd
uuuugaaugguuguucu

SEQ ID NO: 2735647 - RNA, 18 nt, Haemophilus influenzae Rd
uuuugacgagauuuuuug

SEQ ID NO: 2735648 - RNA, 19 nt, Haemophilus influenzae Rd
uuuugacgcagcaucugcc

SEQ ID NO: 2735649 - RNA, 16 nt, Haemophilus influenzae Rd
uuuugagauaaauuuu

SEQ ID NO: 2735650 - RNA, 19 nt, Haemophilus influenzae Rd
uuuugaggggaauuuuuua

SEQ ID NO: 2735651 - RNA, 21 nt, Haemophilus influenzae Rd
uuuugagugcuguacacacac

SEQ ID NO: 2735652 - RNA, 17 nt, Haemophilus influenzae Rd
uuuugauaaaaaagaaa

SEQ ID NO: 2735653 - RNA, 15 nt, Haemophilus influenzae Rd
uuuugauaugccacc

SEQ ID NO: 2735654 - RNA, 16 nt, Haemophilus influenzae Rd
uuuugaucucuuucua

SEQ ID NO: 2735655 - RNA, 17 nt, Haemophilus influenzae Rd
uuuugaucucuuucuau

SEQ ID NO: 2735656 - RNA, 14 nt, Haemophilus influenzae Rd
uuuugaucugcacu

SEQ ID NO: 2735657 - RNA, 22 nt, Haemophilus influenzae Rd
uuuugaugaaaguugaauauuu

SEQ ID NO: 2735658 - RNA, 13 nt, Haemophilus influenzae Rd
uuuugcaaaccaa

SEQ ID NO: 2735659 - RNA, 14 nt, Haemophilus influenzae Rd
uuuugcaagguuuc

SEQ ID NO: 2735660 - RNA, 21 nt, Haemophilus influenzae Rd
uuuugcaauaaaguugagaau

SEQ ID NO: 2735661 - RNA, 17 nt, Haemophilus influenzae Rd
uuuugcacgaauuucag

SEQ ID NO: 2735662 - RNA, 19 nt, Haemophilus influenzae Rd
uuuugcagaauacugagau

SEQ ID NO: 2735663 - RNA, 16 nt, Haemophilus influenzae Rd
uuuugcauauugaacu

SEQ ID NO: 2735664 - RNA, 13 nt, Haemophilus influenzae Rd
uuuugcaugauau

SEQ ID NO: 2735665 - RNA, 20 nt, Haemophilus influenzae Rd
uuuugcauguuauucuccuu

SEQ ID NO: 2735666 - RNA, 18 nt, Haemophilus influenzae Rd
uuuugccaaaauucuguu

SEQ ID NO: 2735667 - RNA, 23 nt, Haemophilus influenzae Rd
uuuugccuuagcgugaauauauu

SEQ ID NO: 2735668 - RNA, 21 nt, Haemophilus influenzae Rd
uuuugcgcugaccaauuucgc

SEQ ID NO: 2735669 - RNA, 12 nt, Haemophilus influenzae Rd
uuuugcucuuua

SEQ ID NO: 2735670 - RNA, 16 nt, Haemophilus influenzae Rd
uuuugcuuguaaaaac

SEQ ID NO: 2735671 - RNA, 12 nt, Haemophilus influenzae Rd
uuuugcuuugcc

SEQ ID NO: 2735672 - RNA, 15 nt, Haemophilus influenzae Rd
uuuugcuuuucccuu

SEQ ID NO: 2735673 - RNA, 20 nt, Haemophilus influenzae Rd
uuuuggauaaaguauucaua

SEQ ID NO: 2735674 - RNA, 15 nt, Haemophilus influenzae Rd
uuuuggauagcaucu

SEQ ID NO: 2735675 - RNA, 13 nt, Haemophilus influenzae Rd
uuuuggcauuuuc

SEQ ID NO: 2735676 - RNA, 22 nt, Haemophilus influenzae Rd
uuuuggcgaaccuuucauauaa

SEQ ID NO: 2735677 - RNA, 21 nt, Haemophilus influenzae Rd
uuuuggcuucaucuuuuaaca

SEQ ID NO: 2735678 - RNA, 23 nt, Haemophilus influenzae Rd
uuuugguaauaaaucaaaagaau

SEQ ID NO: 2735679 - RNA, 23 nt, Haemophilus influenzae Rd
uuuuggugcauguuuacuuaaau

SEQ ID NO: 2735680 - RNA, 17 nt, Haemophilus influenzae Rd
uuuugguggauuauaaa

SEQ ID NO: 2735681 - RNA, 21 nt, Haemophilus influenzae Rd
uuuuguaagcauuaaaaauuu

SEQ ID NO: 2735682 - RNA, 22 nt, Haemophilus influenzae Rd
uuuugucaccaaauacauuuuu

SEQ ID NO: 2735683 - RNA, 18 nt, Haemophilus influenzae Rd
uuuugucccaaaauauuu

SEQ ID NO: 2735684 - RNA, 23 nt, Haemophilus influenzae Rd
uuuugucccaaaauauuuucaaa

SEQ ID NO: 2735685 - RNA, 17 nt, Haemophilus influenzae Rd
uuuuguccgaaaaaacu

SEQ ID NO: 2735686 - RNA, 16 nt, Haemophilus influenzae Rd
uuuuguccgugccaaa

SEQ ID NO: 2735687 - RNA, 14 nt, Haemophilus influenzae Rd
uuuugucugaaauu

SEQ ID NO: 2735688 - RNA, 16 nt, Haemophilus influenzae Rd
uuuugucugaaauuuu

SEQ ID NO: 2735689 - RNA, 17 nt, Haemophilus influenzae Rd
uuuugucugaaauuuug

SEQ ID NO: 2735690 - RNA, 23 nt, Haemophilus influenzae Rd
uuuuguggcaaucguucuaaaau

SEQ ID NO: 2735691 - RNA, 14 nt, Haemophilus influenzae Rd
uuuuguuauuaaau

SEQ ID NO: 2735692 - RNA, 13 nt, Haemophilus influenzae Rd
uuuuguucaucua

SEQ ID NO: 2735693 - RNA, 16 nt, Haemophilus influenzae Rd
uuuuguucauuuuaaa

SEQ ID NO: 2735694 - RNA, 12 nt, Haemophilus influenzae Rd
uuuuuaaaauag

SEQ ID NO: 2735695 - RNA, 13 nt, Haemophilus influenzae Rd
uuuuuaaauauuu

SEQ ID NO: 2735696 - RNA, 12 nt, Haemophilus influenzae Rd
uuuuuaaaucaa

SEQ ID NO: 2735697 - RNA, 23 nt, Haemophilus influenzae Rd
uuuuuaaggaaacguaaaauauc

SEQ ID NO: 2735698 - RNA, 19 nt, Haemophilus influenzae Rd
uuuuuaaguaguauuuuau

SEQ ID NO: 2735699 - RNA, 17 nt, Haemophilus influenzae Rd
uuuuuaaguaguguuuu

SEQ ID NO: 2735700 - RNA, 23 nt, Haemophilus influenzae Rd
uuuuuaaguucuacccauucaaa

SEQ ID NO: 2735701 - RNA, 21 nt, Haemophilus influenzae Rd
uuuuuaauaaaguaaaauauu

SEQ ID NO: 2735702 - RNA, 22 nt, Haemophilus influenzae Rd
uuuuuaauacgaaaaauuacuu

SEQ ID NO: 2735703 - RNA, 21 nt, Haemophilus influenzae Rd
uuuuuaaucaaauaaaauauu

SEQ ID NO: 2735704 - RNA, 19 nt, Haemophilus influenzae Rd
uuuuuaaucaauuaaagaa

SEQ ID NO: 2735705 - RNA, 22 nt, Haemophilus influenzae Rd
uuuuuaauuagagagaaaaauc

SEQ ID NO: 2735706 - RNA, 13 nt, Haemophilus influenzae Rd
uuuuuaauuuaaa

SEQ ID NO: 2735707 - RNA, 17 nt, Haemophilus influenzae Rd
uuuuuacaaaaaaguac

SEQ ID NO: 2735708 - RNA, 23 nt, Haemophilus influenzae Rd
uuuuuacaaggacaauaauaagc

SEQ ID NO: 2735709 - RNA, 14 nt, Haemophilus influenzae Rd
uuuuuacagauaaa

SEQ ID NO: 2735710 - RNA, 11 nt, Haemophilus influenzae Rd
uuuuuacauua

SEQ ID NO: 2735711 - RNA, 13 nt, Haemophilus influenzae Rd
uuuuuacauuaag

SEQ ID NO: 2735712 - RNA, 21 nt, Haemophilus influenzae Rd
uuuuuaccccacccauuucac

SEQ ID NO: 2735713 - RNA, 17 nt, Haemophilus influenzae Rd
uuuuuacggauacgaau

SEQ ID NO: 2735714 - RNA, 23 nt, Haemophilus influenzae Rd
uuuuuacuaauucaagcaaauau

SEQ ID NO: 2735715 - RNA, 19 nt, Haemophilus influenzae Rd
uuuuuacugcuucauaaau

SEQ ID NO: 2735716 - RNA, 12 nt, Haemophilus influenzae Rd
uuuuuagaaaau

SEQ ID NO: 2735717 - RNA, 13 nt, Haemophilus influenzae Rd
uuuuuagaauuaa

SEQ ID NO: 2735718 - RNA, 18 nt, Haemophilus influenzae Rd
uuuuuagacggucaaauu

SEQ ID NO: 2735719 - RNA, 19 nt, Haemophilus influenzae Rd
uuuuuaggugcuuuuugcu

SEQ ID NO: 2735720 - RNA, 23 nt, Haemophilus influenzae Rd
uuuuuaguuuuugcauagccacu

SEQ ID NO: 2735721 - RNA, 11 nt, Human
aaaaaaaaacc

SEQ ID NO: 2735722 - RNA, 12 nt, Human
aaaaaaaaauac

SEQ ID NO: 2735723 - RNA, 13 nt, Human
aaaaaaaaauacu

SEQ ID NO: 2735724 - RNA, 13 nt, Human
aaaaaaagccaaa

SEQ ID NO: 2735725 - RNA, 12 nt, Human
aaaaaaagcuuu

SEQ ID NO: 2735726 - RNA, 21 nt, Human
aaaaaaauauauauuguauua

SEQ ID NO: 2735727 - RNA, 22 nt, Human
aaaaaaccugagccccaaaagg

SEQ ID NO: 2735728 - RNA, 15 nt, Human
aaaaaagaaacauuu

SEQ ID NO: 2735729 - RNA, 14 nt, Human
aaaaaaggaaggaa

SEQ ID NO: 2735730 - RNA, 13 nt, Human
aaaaaauaaaaau

SEQ ID NO: 2735731 - RNA, 16 nt, Human
aaaaaauaacaaugaa

SEQ ID NO: 2735732 - RNA, 18 nt, Human
aaaaacaaagaaauuaug

SEQ ID NO: 2735733 - RNA, 14 nt, Human
aaaaacauuucaaa

SEQ ID NO: 2735734 - RNA, 17 nt, Human
aaaaaccccacaaucua

SEQ ID NO: 2735735 - RNA, 19 nt, Human
aaaaacuauuaacaacuug

SEQ ID NO: 2735736 - RNA, 17 nt, Human
aaaaagauugagagaau

SEQ ID NO: 2735737 - RNA, 18 nt, Human
aaaaagcaucauggcuau

SEQ ID NO: 2735738 - RNA, 19 nt, Human
aaaaagcauuguaacuuau

SEQ ID NO: 2735739 - RNA, 13 nt, Human
aaaaagccaaaaa

SEQ ID NO: 2735740 - RNA, 11 nt, Human
aaaaaggaagg

SEQ ID NO: 2735741 - RNA, 13 nt, Human
aaaaaggugacca

SEQ ID NO: 2735742 - RNA, 14 nt, Human
aaaaauaaaaaaca

SEQ ID NO: 2735743 - RNA, 14 nt, Human
aaaaauaaaaaaga

SEQ ID NO: 2735744 - RNA, 15 nt, Human
aaaaauaaaaaagau

SEQ ID NO: 2735745 - RNA, 14 nt, Human
aaaaauaacaauga

SEQ ID NO: 2735746 - RNA, 13 nt, Human
aaaaauacaaaaa

SEQ ID NO: 2735747 - RNA, 14 nt, Human
aaaaauacaaaaau

SEQ ID NO: 2735748 - RNA, 21 nt, Human
aaaaauagcagcuuuagccaa

SEQ ID NO: 2735749 - RNA, 17 nt, Human
aaaaauccuacuuucau

SEQ ID NO: 2735750 - RNA, 21 nt, Human
aaaaaucucaauauuucagau

SEQ ID NO: 2735751 - RNA, 17 nt, Human
aaaaaugcauauacuuu

SEQ ID NO: 2735752 - RNA, 18 nt, Human
aaaaauggaacauaaaau

SEQ ID NO: 2735753 - RNA, 13 nt, Human
aaaaaugguuuaa

SEQ ID NO: 2735754 - RNA, 18 nt, Human
aaaaaugguuuaaauggu

SEQ ID NO: 2735755 - RNA, 15 nt, Human
aaaacaaacaaacaa

SEQ ID NO: 2735756 - RNA, 20 nt, Human
aaaacaagcacuaaacaaag

SEQ ID NO: 2735757 - RNA, 18 nt, Human
aaaacacagcaaggguga

SEQ ID NO: 2735758 - RNA, 13 nt, Human
aaaacaggguugu

SEQ ID NO: 2735759 - RNA, 14 nt, Human
aaaaccacuggaaa

SEQ ID NO: 2735760 - RNA, 11 nt, Human
aaaacccuuuc

SEQ ID NO: 2735761 - RNA, 18 nt, Human
aaaaccuaagcaaacuua

SEQ ID NO: 2735762 - RNA, 12 nt, Human
aaaaccugagcc

SEQ ID NO: 2735763 - RNA, 14 nt, Human
aaaacgaaaagucu

SEQ ID NO: 2735764 - RNA, 14 nt, Human
aaaacguauugcau

SEQ ID NO: 2735765 - RNA, 19 nt, Human
aaaacguauugcauuuaau

SEQ ID NO: 2735766 - RNA, 19 nt, Human
aaaacuaagaaauaugcac

SEQ ID NO: 2735767 - RNA, 18 nt, Human
aaaacuguaaauuuauua

SEQ ID NO: 2735768 - RNA, 14 nt, Human
aaaacugugccuug

SEQ ID NO: 2735769 - RNA, 13 nt, Human
aaaacuuaaguag

SEQ ID NO: 2735770 - RNA, 20 nt, Human
aaaacuuauccuccaugaau

SEQ ID NO: 2735771 - RNA, 14 nt, Human
aaaacuucagacau

SEQ ID NO: 2735772 - RNA, 18 nt, Human
aaaacuuucuuuucugga

SEQ ID NO: 2735773 - RNA, 11 nt, Human
aaaagaaaaag

SEQ ID NO: 2735774 - RNA, 17 nt, Human
aaaagaaaaagauugag

SEQ ID NO: 2735775 - RNA, 14 nt, Human
aaaagaaacauuug

SEQ ID NO: 2735776 - RNA, 15 nt, Human
aaaagaaacauuugg

SEQ ID NO: 2735777 - RNA, 12 nt, Human
aaaagaaagaaa

SEQ ID NO: 2735778 - RNA, 17 nt, Human
aaaagaaugauuaugaa

SEQ ID NO: 2735779 - RNA, 19 nt, Human
aaaagaaugauuaugaauu

SEQ ID NO: 2735780 - RNA, 15 nt, Human
aaaagacaaggaaaa

SEQ ID NO: 2735781 - RNA, 18 nt, Human
aaaagacaaggaaaaaau

SEQ ID NO: 2735782 - RNA, 14 nt, Human
aaaagacagugaaa

SEQ ID NO: 2735783 - RNA, 19 nt, Human
aaaagacagugaaagaaaa

SEQ ID NO: 2735784 - RNA, 20 nt, Human
aaaagacagugaaagaaaau

SEQ ID NO: 2735785 - RNA, 18 nt, Human
aaaagacuccaaagaaau

SEQ ID NO: 2735786 - RNA, 21 nt, Human
aaaagacuccaaagaaaugua

SEQ ID NO: 2735787 - RNA, 19 nt, Human
aaaagacuuuuuuuuauac

SEQ ID NO: 2735788 - RNA, 14 nt, Human
aaaagagucuuaau

SEQ ID NO: 2735789 - RNA, 18 nt, Human
aaaagauauaagugcugu

SEQ ID NO: 2735790 - RNA, 20 nt, Human
aaaagauuaugaucucagaa

SEQ ID NO: 2735791 - RNA, 22 nt, Human
aaaagauuaugaucucagaaau

SEQ ID NO: 2735792 - RNA, 14 nt, Human
aaaagauugagaga

SEQ ID NO: 2735793 - RNA, 19 nt, Human
aaaagauugagagaauuug

SEQ ID NO: 2735794 - RNA, 21 nt, Human
aaaagcauuguaacuuaugaa

SEQ ID NO: 2735795 - RNA, 14 nt, Human
aaaagcuauaaaau

SEQ ID NO: 2735796 - RNA, 16 nt, Human
aaaagcuauaaaauga

SEQ ID NO: 2735797 - RNA, 15 nt, Human
aaaagcuccauuuuu

SEQ ID NO: 2735798 - RNA, 16 nt, Human
aaaagcuccauuuuua

SEQ ID NO: 2735799 - RNA, 19 nt, Human
aaaagcuuugaacccuggg

SEQ ID NO: 2735800 - RNA, 13 nt, Human
aaaagcuuuuuuu

SEQ ID NO: 2735801 - RNA, 14 nt, Human
aaaaggaagaaauu

SEQ ID NO: 2735802 - RNA, 14 nt, Human
aaaaggaagcaggg

SEQ ID NO: 2735803 - RNA, 23 nt, Human
aaaagggacugagaaauuuauaa

SEQ ID NO: 2735804 - RNA, 17 nt, Human
aaaaguauaaauaaaau

SEQ ID NO: 2735805 - RNA, 19 nt, Human
aaaaguauaaauaaaauga

SEQ ID NO: 2735806 - RNA, 13 nt, Human
aaaaguauauuca

SEQ ID NO: 2735807 - RNA, 14 nt, Human
aaaaguauccaagg

SEQ ID NO: 2735808 - RNA, 19 nt, Human
aaaagucaaucuuaucaua

SEQ ID NO: 2735809 - RNA, 13 nt, Human
aaaaguucugcag

SEQ ID NO: 2735810 - RNA, 18 nt, Human
aaaaguucugcagauaaa

SEQ ID NO: 2735811 - RNA, 17 nt, Human
aaaaguugcuauuugaa

SEQ ID NO: 2735812 - RNA, 22 nt, Human
aaaaguuuuuuauuaugcauua

SEQ ID NO: 2735813 - RNA, 17 nt, Human
aaaauaaaaauaaauuu

SEQ ID NO: 2735814 - RNA, 14 nt, Human
aaaauaaaaugaag

SEQ ID NO: 2735815 - RNA, 16 nt, Human
aaaauaacaauaaaag

SEQ ID NO: 2735816 - RNA, 13 nt, Human
aaaauaacaauga

SEQ ID NO: 2735817 - RNA, 15 nt, Human
aaaauaacaaugaaa

SEQ ID NO: 2735818 - RNA, 17 nt, Human
aaaauaacaaugaaagu

SEQ ID NO: 2735819 - RNA, 13 nt, Human
aaaauaagcaggc

SEQ ID NO: 2735820 - RNA, 16 nt, Human
aaaauaauccucaguu

SEQ ID NO: 2735821 - RNA, 15 nt, Human
aaaauacaaaaaaaa

SEQ ID NO: 2735822 - RNA, 20 nt, Human
aaaauaccaugccauuuaaa

SEQ ID NO: 2735823 - RNA, 22 nt, Human
aaagaugacggaugccuagagu

SEQ ID NO: 2735824 - RNA, 22 nt, Human
aaagauggggucuguaaaaucu

SEQ ID NO: 2735825 - RNA, 18 nt, Human
aaagaugugaauaggcug

SEQ ID NO: 2735826 - RNA, 22 nt, Human
aaagauuaugaucucagaaauu

SEQ ID NO: 2735827 - RNA, 23 nt, Human
aaagauucaaugccccugaauuu

SEQ ID NO: 2735828 - RNA, 23 nt, Human
aaagauuggauacgcaucagaca

SEQ ID NO: 2735829 - RNA, 21 nt, Human
aaagauuugauguauguaaua

SEQ ID NO: 2735830 - RNA, 22 nt, Human
aaagcaacuggauacuagaucu

SEQ ID NO: 2735831 - RNA, 14 nt, Human
aaagcaauguggua

SEQ ID NO: 2735832 - RNA, 18 nt, Human
aaagcacuuauuuauugu

SEQ ID NO: 2735833 - RNA, 10 nt, Human
aaagcaggau

SEQ ID NO: 2735834 - RNA, 16 nt, Human
aaagcagggacuugaa

SEQ ID NO: 2735835 - RNA, 20 nt, Human
aaagcagggacuugaaccca

SEQ ID NO: 2735836 - RNA, 21 nt, Human
aaagcaguugagacaagaaaa

SEQ ID NO: 2735837 - RNA, 22 nt, Human
aaagcaucacaugaacuuguaa

SEQ ID NO: 2735838 - RNA, 19 nt, Human
aaagcaucauggcuaucug

SEQ ID NO: 2735839 - RNA, 15 nt, Human
aaagcauuauuauuu

SEQ ID NO: 2735840 - RNA, 18 nt, Human
aaagcauuauuauuugcu

SEQ ID NO: 2735841 - RNA, 13 nt, Human
aaagccaaaaacc

SEQ ID NO: 2735842 - RNA, 23 nt, Human
aaagcccagcuugaaaccuucac

SEQ ID NO: 2735843 - RNA, 16 nt, Human
aaagcccuuaggaaga

SEQ ID NO: 2735844 - RNA, 23 nt, Human
aaagccucuggccgucacacgua

SEQ ID NO: 2735845 - RNA, 22 nt, Human
aaagccuucauugccuuaacug

SEQ ID NO: 2735846 - RNA, 16 nt, Human
aaagcuacuuauugua

SEQ ID NO: 2735847 - RNA, 22 nt, Human
aaagcucuuuacuuuccccuug

SEQ ID NO: 2735848 - RNA, 13 nt, Human
aaagcugaaaugg

SEQ ID NO: 2735849 - RNA, 21 nt, Human
aaagcugaaauggacuuuugu

SEQ ID NO: 2735850 - RNA, 13 nt, Human
aaaggaagaaauu

SEQ ID NO: 2735851 - RNA, 22 nt, Human
aaaggaauguguaagucuuuaa

SEQ ID NO: 2735852 - RNA, 13 nt, Human
aaaggaauuuaaa

SEQ ID NO: 2735853 - RNA, 14 nt, Human
aaaggaauuuaaaa

SEQ ID NO: 2735854 - RNA, 21 nt, Human
aaaggacaccauuuuggcaag

SEQ ID NO: 2735855 - RNA, 24 nt, Human
aaaggagcaagucagaauagaaau

SEQ ID NO: 2735856 - RNA, 18 nt, Human
aaaggcacacagcaaguc

SEQ ID NO: 2735857 - RNA, 18 nt, Human
aaaggcauucucugaaga

SEQ ID NO: 2735858 - RNA, 14 nt, Human
aaaggccugucccu

SEQ ID NO: 2735859 - RNA, 24 nt, Human
aaaggccugucccugcagacauga

SEQ ID NO: 2735860 - RNA, 23 nt, Human
aaaggcuuugcccugcugcccuc

SEQ ID NO: 2735861 - RNA, 18 nt, Human
aaagggacugagaaauuu

SEQ ID NO: 2735862 - RNA, 22 nt, Human
aaagggagauucagacuguuuu

SEQ ID NO: 2735863 - RNA, 12 nt, Human
aaagggauggca

SEQ ID NO: 2735864 - RNA, 19 nt, Human
aaagggauggcaagaugug

SEQ ID NO: 2735865 - RNA, 22 nt, Human
aaagggcauggguuuuauuaua

SEQ ID NO: 2735866 - RNA, 22 nt, Human
aaagggucucccucuguugcca

SEQ ID NO: 2735867 - RNA, 12 nt, Human
aaagguaaauca

SEQ ID NO: 2735868 - RNA, 15 nt, Human
aaagguacuucaaau

SEQ ID NO: 2735869 - RNA, 18 nt, Human
aaagguauuuuaaucacc

SEQ ID NO: 2735870 - RNA, 17 nt, Human
aaaguaacccuacaaaa

SEQ ID NO: 2735871 - RNA, 20 nt, Human
aaaguaacucauuuguuaaa

SEQ ID NO: 2735872 - RNA, 17 nt, Human
aaaguacaagagcuuaa

SEQ ID NO: 2735873 - RNA, 15 nt, Human
aaaguacuuaaaacu

SEQ ID NO: 2735874 - RNA, 15 nt, Human
aaaguaggauuuuga

SEQ ID NO: 2735875 - RNA, 17 nt, Human
aaagucaaucuuaucau

SEQ ID NO: 2735876 - RNA, 15 nt, Human
aaaguccugggauua

SEQ ID NO: 2735877 - RNA, 20 nt, Human
aaagucucuggaauuugaaa

SEQ ID NO: 2735878 - RNA, 22 nt, Human
aaagucucuggaauuugaaaca

SEQ ID NO: 2735879 - RNA, 19 nt, Human
aaagucuugccuugcugaa

SEQ ID NO: 2735880 - RNA, 19 nt, Human
aaagugacaagcucacaga

SEQ ID NO: 2735881 - RNA, 18 nt, Human
aaaguguuugaaagcuuu

SEQ ID NO: 2735882 - RNA, 19 nt, Human
aaaguucuagugaccgaga

SEQ ID NO: 2735883 - RNA, 18 nt, Human
aaaguugauuaagaaagg

SEQ ID NO: 2735884 - RNA, 20 nt, Human
aaaguugauuaagaaaggaa

SEQ ID NO: 2735885 - RNA, 22 nt, Human
aaaguugauuuaaggccaggca

SEQ ID NO: 2735886 - RNA, 17 nt, Human
aaaguugauuuuaagaa

SEQ ID NO: 2735887 - RNA, 22 nt, Human
aaaguugguaaaccuuuuauau

SEQ ID NO: 2735888 - RNA, 10 nt, Human
aaaguuuuuu

SEQ ID NO: 2735889 - RNA, 14 nt, Human
aaauaaaaacaaag

SEQ ID NO: 2735890 - RNA, 13 nt, Human
aaauaaaaauaau

SEQ ID NO: 2735891 - RNA, 13 nt, Human
aaauaaaagauug

SEQ ID NO: 2735892 - RNA, 23 nt, Human
aaauaaaccuuuuuggacacaca

SEQ ID NO: 2735893 - RNA, 11 nt, Human
aaauaaauaaa

SEQ ID NO: 2735894 - RNA, 14 nt, Human
aaauaaauaaauaa

SEQ ID NO: 2735895 - RNA, 16 nt, Human
aaauaaauaaauaaau

SEQ ID NO: 2735896 - RNA, 14 nt, Human
aaauaaauauccuu

SEQ ID NO: 2735897 - RNA, 19 nt, Human
aaauaaaucuaucaaaauu

SEQ ID NO: 2735898 - RNA, 12 nt, Human
aaauaaauuauu

SEQ ID NO: 2735899 - RNA, 13 nt, Human
aaauaaauuauua

SEQ ID NO: 2735900 - RNA, 18 nt, Human
aaauaaauuauuauuuaa

SEQ ID NO: 2735901 - RNA, 19 nt, Human
aaauaaauuauuauuuaaa

SEQ ID NO: 2735902 - RNA, 14 nt, Human
aaauaaauuugguu

SEQ ID NO: 2735903 - RNA, 16 nt, Human
aaauaacaaugaaagu

SEQ ID NO: 2735904 - RNA, 14 nt, Human
aaauaacgauaaaa

SEQ ID NO: 2735905 - RNA, 15 nt, Human
aaauaacgauaaaag

SEQ ID NO: 2735906 - RNA, 17 nt, Human
aaauaacgauaaaagac

SEQ ID NO: 2735907 - RNA, 18 nt, Human
aaauaacgauaaaagaca

SEQ ID NO: 2735908 - RNA, 15 nt, Human
aaauaaguauuuaua

SEQ ID NO: 2735909 - RNA, 22 nt, Human
aaauaaucauucuuauuucaug

SEQ ID NO: 2735910 - RNA, 13 nt, Human
aaauaaugaaaua

SEQ ID NO: 2735911 - RNA, 15 nt, Human
aaauaauuuuuauau

SEQ ID NO: 2735912 - RNA, 20 nt, Human
aaauaauuuuuauauuugaa

SEQ ID NO: 2735913 - RNA, 15 nt, Human
aaauacaaaaauuag

SEQ ID NO: 2735914 - RNA, 20 nt, Human
aaauacacuguuaucuucac

SEQ ID NO: 2735915 - RNA, 17 nt, Human
aaauaccaugccauuua

SEQ ID NO: 2735916 - RNA, 16 nt, Human
aaauagaaauggggaa

SEQ ID NO: 2735917 - RNA, 23 nt, Human
aaauagaauuugagcaucaguga

SEQ ID NO: 2735918 - RNA, 14 nt, Human
aaauagagaaauau

SEQ ID NO: 2735919 - RNA, 11 nt, Human
aaauagcagcu

SEQ ID NO: 2735920 - RNA, 15 nt, Human
aaauaggguuguacu

SEQ ID NO: 2735921 - RNA, 18 nt, Human
aaauagugauuuccacag

SEQ ID NO: 2735922 - RNA, 15 nt, Human
aaauaguugcuguca

SEQ ID NO: 2735923 - RNA, 22 nt, Human
aaauaguugcugucauccacuu

SEQ ID NO: 2735924 - RNA, 23 nt, Human
aaauaguugcugucauccacuuu

SEQ ID NO: 2735925 - RNA, 13 nt, Human
aaauauaaagcaa

SEQ ID NO: 2735926 - RNA, 15 nt, Human
aaauauaaagcaaga

SEQ ID NO: 2735927 - RNA, 16 nt, Human
aaauauaaauaaaaau

SEQ ID NO: 2735928 - RNA, 17 nt, Human
aaauauaaauaaaaaua

SEQ ID NO: 2735929 - RNA, 18 nt, Human
aaauauaaauaaaaauaa

SEQ ID NO: 2735930 - RNA, 18 nt, Human
aaauauauuuaagauaau

SEQ ID NO: 2735931 - RNA, 19 nt, Human
aaauaugccccauucaaca

SEQ ID NO: 2735932 - RNA, 21 nt, Human
aaauauuauguuaaaacuggg

SEQ ID NO: 2735933 - RNA, 16 nt, Human
aaauauuccuuaagau

SEQ ID NO: 2735934 - RNA, 23 nt, Human
aaauauugacuuuuuauggcacu

SEQ ID NO: 2735935 - RNA, 13 nt, Human
aaauauuuauuua

SEQ ID NO: 2735936 - RNA, 14 nt, Human
aaauauuuuuucuu

SEQ ID NO: 2735937 - RNA, 19 nt, Human
aaaucaacuuaaggguagg

SEQ ID NO: 2735938 - RNA, 15 nt, Human
aaaucacaaacucau

SEQ ID NO: 2735939 - RNA, 17 nt, Human
aaaucacaaacucaucc

SEQ ID NO: 2735940 - RNA, 19 nt, Human
aaaucagaguuuucaugua

SEQ ID NO: 2735941 - RNA, 22 nt, Human
aaaucaggguuaguauugucca

SEQ ID NO: 2735942 - RNA, 14 nt, Human
aaaucauaagauau

SEQ ID NO: 2735943 - RNA, 17 nt, Human
aaaucauaagauauuuu

SEQ ID NO: 2735944 - RNA, 20 nt, Human
aaaucauaagauauuuuuca

SEQ ID NO: 2735945 - RNA, 19 nt, Human
aaaucaugauauagcuuug

SEQ ID NO: 2735946 - RNA, 16 nt, Human
aaauccacacugagcu

SEQ ID NO: 2735947 - RNA, 17 nt, Human
aaauccuacuuucauaa

SEQ ID NO: 2735948 - RNA, 21 nt, Human
aaauccuuuacuguuagucau

SEQ ID NO: 2735949 - RNA, 17 nt, Human
aaaucuaaaaaacgaaa

SEQ ID NO: 2735950 - RNA, 13 nt, Human
aaaucuaucaaaa

SEQ ID NO: 2735951 - RNA, 18 nt, Human
aaaucuauuuauuaauau

SEQ ID NO: 2735952 - RNA, 21 nt, Human
aaaucuauuuauuaauauuua

SEQ ID NO: 2735953 - RNA, 18 nt, Human
aaaucuuauaauuuaaaa

SEQ ID NO: 2735954 - RNA, 14 nt, Human
aaaugaaaaaauau

SEQ ID NO: 2735955 - RNA, 16 nt, Human
aaaugaaaaaauauau

SEQ ID NO: 2735956 - RNA, 12 nt, Human
aaaugaaagcag

SEQ ID NO: 2735957 - RNA, 15 nt, Human
aaaugaaaugacugu

SEQ ID NO: 2735958 - RNA, 19 nt, Human
aaaugaauaucuauuaaua

SEQ ID NO: 2735959 - RNA, 20 nt, Human
aaaugaauaucuauuaauau

SEQ ID NO: 2735960 - RNA, 23 nt, Human
aaaugaauaucuauuaauauaug

SEQ ID NO: 2735961 - RNA, 23 nt, Human
aaaugacgguguuaauuuugcua

SEQ ID NO: 2735962 - RNA, 13 nt, Human
aaaugacuaaaaa

SEQ ID NO: 2735963 - RNA, 18 nt, Human
aaaugacuaaaaaacaaa

SEQ ID NO: 2735964 - RNA, 21 nt, Human
aaaugacuuuucuccucucag

SEQ ID NO: 2735965 - RNA, 17 nt, Human
aaaugagaaaucuaaaa

SEQ ID NO: 2735966 - RNA, 13 nt, Human
aaaugauguuuca

SEQ ID NO: 2735967 - RNA, 18 nt, Human
aacgaggauugggaaaaa

SEQ ID NO: 2735968 - RNA, 18 nt, Human
aacgauaaaagacaguga

SEQ ID NO: 2735969 - RNA, 19 nt, Human
aacgauaaaagacagugaa

SEQ ID NO: 2735970 - RNA, 24 nt, Human
aacguauugcauuuaauuuauuga

SEQ ID NO: 2735971 - RNA, 13 nt, Human
aacguggcccaga

SEQ ID NO: 2735972 - RNA, 17 nt, Human
aacguguauauuuuuua

SEQ ID NO: 2735973 - RNA, 11 nt, Human
aacuaaaugac

SEQ ID NO: 2735974 - RNA, 14 nt, Human
aacuaagauuugua

SEQ ID NO: 2735975 - RNA, 14 nt, Human
aacuaggcugagca

SEQ ID NO: 2735976 - RNA, 15 nt, Human
aacuaggcugagcaa

SEQ ID NO: 2735977 - RNA, 17 nt, Human
aacuaggugcauauuua

SEQ ID NO: 2735978 - RNA, 13 nt, Human
aacuauaaaacua

SEQ ID NO: 2735979 - RNA, 19 nt, Human
aacuauauuaucaugcaaa

SEQ ID NO: 2735980 - RNA, 19 nt, Human
aacuauggaaaaaaaggaa

SEQ ID NO: 2735981 - RNA, 15 nt, Human
aacuauuuguaaagu

SEQ ID NO: 2735982 - RNA, 14 nt, Human
aacucaaauacgug

SEQ ID NO: 2735983 - RNA, 19 nt, Human
aacucaauaaguuuauuuc

SEQ ID NO: 2735984 - RNA, 12 nt, Human
aacucagaaauu

SEQ ID NO: 2735985 - RNA, 17 nt, Human
aacucagaggcagugac

SEQ ID NO: 2735986 - RNA, 18 nt, Human
aacucagggagcauuuau

SEQ ID NO: 2735987 - RNA, 14 nt, Human
aacucaguuuuaac

SEQ ID NO: 2735988 - RNA, 16 nt, Human
aacucaucauaaaaua

SEQ ID NO: 2735989 - RNA, 20 nt, Human
aacucaucauaaaauaaagu

SEQ ID NO: 2735990 - RNA, 15 nt, Human
aacucaucuagguaa

SEQ ID NO: 2735991 - RNA, 19 nt, Human
aacucaugacggaagaguu

SEQ ID NO: 2735992 - RNA, 13 nt, Human
aacucauuucuag

SEQ ID NO: 2735993 - RNA, 15 nt, Human
aacucauuucuagca

SEQ ID NO: 2735994 - RNA, 13 nt, Human
aacucccuaguuc

SEQ ID NO: 2735995 - RNA, 13 nt, Human
aacucccugcccc

SEQ ID NO: 2735996 - RNA, 15 nt, Human
aacucccuuucaaca

SEQ ID NO: 2735997 - RNA, 12 nt, Human
aacuccugaccu

SEQ ID NO: 2735998 - RNA, 18 nt, Human
aacuccuguuucacuugg

SEQ ID NO: 2735999 - RNA, 21 nt, Human
aacuccuguuucacuugguuc

SEQ ID NO: 2736000 - RNA, 15 nt, Human
aacuccuugauuuua

SEQ ID NO: 2736001 - RNA, 16 nt, Human
aacuccuugauuuuag

SEQ ID NO: 2736002 - RNA, 18 nt, Human
aacucuauaauguguuca

SEQ ID NO: 2736003 - RNA, 21 nt, Human
aacucucuuauugccucacuu

SEQ ID NO: 2736004 - RNA, 22 nt, Human
aacucucuuauugccucacuuc

SEQ ID NO: 2736005 - RNA, 16 nt, Human
aacucuuaaucaaaua

SEQ ID NO: 2736006 - RNA, 19 nt, Human
aacucuuaaucaaauagca

SEQ ID NO: 2736007 - RNA, 17 nt, Human
aacugaaacaaaauuag

SEQ ID NO: 2736008 - RNA, 21 nt, Human
aacugacuauucuugauguaa

SEQ ID NO: 2736009 - RNA, 12 nt, Human
aacugagaugug

SEQ ID NO: 2736010 - RNA, 21 nt, Human
aacugauuuaucuauuuaaau

SEQ ID NO: 2736011 - RNA, 14 nt, Human
aacugcacugucaa

SEQ ID NO: 2736012 - RNA, 23 nt, Human
aacugcagcgaguacuucccgcu

SEQ ID NO: 2736013 - RNA, 17 nt, Human
aacugccagcaacgcag

SEQ ID NO: 2736014 - RNA, 20 nt, Human
aacugccagcaacgcaggcc

SEQ ID NO: 2736015 - RNA, 22 nt, Human
aacugcccacucugcaagaaga

SEQ ID NO: 2736016 - RNA, 23 nt, Human
aacugccuucuucggaaagaaga

SEQ ID NO: 2736017 - RNA, 13 nt, Human
aacugccuuuggc

SEQ ID NO: 2736018 - RNA, 15 nt, Human
aacugcuacaaauac

SEQ ID NO: 2736019 - RNA, 15 nt, Human
aacugcucauaugau

SEQ ID NO: 2736020 - RNA, 13 nt, Human
aacugcuggauuc

SEQ ID NO: 2736021 - RNA, 14 nt, Human
aacugcuggauuca

SEQ ID NO: 2736022 - RNA, 16 nt, Human
aacugcuggauucaag

SEQ ID NO: 2736023 - RNA, 21 nt, Human
aacuggagccacgacguaaca

SEQ ID NO: 2736024 - RNA, 18 nt, Human
aacuggagccccaucagc

SEQ ID NO: 2736025 - RNA, 15 nt, Human
aacuuacauucuuaa

SEQ ID NO: 2736026 - RNA, 21 nt, Human
aacuuauccuccaugaauauc

SEQ ID NO: 2736027 - RNA, 13 nt, Human
aacuucagcgguu

SEQ ID NO: 2736028 - RNA, 14 nt, Human
aacuucagcgguuu

SEQ ID NO: 2736029 - RNA, 19 nt, Human
aacuucagcgguuuauaua

SEQ ID NO: 2736030 - RNA, 16 nt, Human
aacuucccugaaaaau

SEQ ID NO: 2736031 - RNA, 20 nt, Human
aacuuccuuggacucauuuu

SEQ ID NO: 2736032 - RNA, 14 nt, Human
aacuucuauuuuua

SEQ ID NO: 2736033 - RNA, 21 nt, Human
aacuuguaaaggaauuuaaaa

SEQ ID NO: 2736034 - RNA, 14 nt, Human
aacuuuauuuugug

SEQ ID NO: 2736035 - RNA, 22 nt, Human
aacuuucuuuucuggaauguaa

SEQ ID NO: 2736036 - RNA, 14 nt, Human
aacuuugauuuuau

SEQ ID NO: 2736037 - RNA, 20 nt, Human
aacuuugauuuuauaugcua

SEQ ID NO: 2736038 - RNA, 12 nt, Human
aacuuuguauaa

SEQ ID NO: 2736039 - RNA, 16 nt, Human
aagaaaacuuguauua

SEQ ID NO: 2736040 - RNA, 18 nt, Human
aagaaaacuuguauuaug

SEQ ID NO: 2736041 - RNA, 16 nt, Human
aagaaaauaacaauaa

SEQ ID NO: 2736042 - RNA, 13 nt, Human
aagaaaauaacga

SEQ ID NO: 2736043 - RNA, 18 nt, Human
aagaaaaucucugugaaa

SEQ ID NO: 2736044 - RNA, 14 nt, Human
aagaaacaaaaauc

SEQ ID NO: 2736045 - RNA, 17 nt, Human
aagaaacaaaaaucaaa

SEQ ID NO: 2736046 - RNA, 21 nt, Human
aagaaacuuaagguuaccuuu

SEQ ID NO: 2736047 - RNA, 22 nt, Human
aagaaagcccuuaggaagaauu

SEQ ID NO: 2736048 - RNA, 17 nt, Human
aagaaaggccagcaaau

SEQ ID NO: 2736049 - RNA, 18 nt, Human
aagaaauaggaaauauuu

SEQ ID NO: 2736050 - RNA, 21 nt, Human
aagaaauaggaaauauuuuaa

SEQ ID NO: 2736051 - RNA, 15 nt, Human
aagaaauaugcacaa

SEQ ID NO: 2736052 - RNA, 16 nt, Human
aagaaauauuccuuaa

SEQ ID NO: 2736053 - RNA, 13 nt, Human
aagaaaugaaagc

SEQ ID NO: 2736054 - RNA, 16 nt, Human
aagaaauguaagggaa

SEQ ID NO: 2736055 - RNA, 20 nt, Human
aagaaauucugcaagcuuuu

SEQ ID NO: 2736056 - RNA, 15 nt, Human
aagaacacagugauu

SEQ ID NO: 2736057 - RNA, 20 nt, Human
aagaaccauugauuuaaugu

SEQ ID NO: 2736058 - RNA, 18 nt, Human
aagaagacaacauuaaaa

SEQ ID NO: 2736059 - RNA, 15 nt, Human
aagaagacugcauua

SEQ ID NO: 2736060 - RNA, 19 nt, Human
aagaagagccggagccucc

SEQ ID NO: 2736061 - RNA, 17 nt, Human
aagaagccacagaccua

SEQ ID NO: 2736062 - RNA, 16 nt, Human
aagaagcuagaaaaca

SEQ ID NO: 2736063 - RNA, 21 nt, Human
aagaaggaaauugaauuucca

SEQ ID NO: 2736064 - RNA, 16 nt, Human
aagaaggugggaggau

SEQ ID NO: 2736065 - RNA, 15 nt, Human
aagaagugaaaaucu

SEQ ID NO: 2736066 - RNA, 14 nt, Human
aagaaguugauaug

SEQ ID NO: 2736067 - RNA, 13 nt, Human
aagaauauuuuaa

SEQ ID NO: 2736068 - RNA, 16 nt, Human
aagaaugacuaugcaa

SEQ ID NO: 2736069 - RNA, 16 nt, Human
aagaaugagaagaaug

SEQ ID NO: 2736070 - RNA, 13 nt, Human
aagaauuuuaaaa

SEQ ID NO: 2736071 - RNA, 15 nt, Human
aagaauuuuaaaacu

SEQ ID NO: 2736072 - RNA, 20 nt, Human
aagaauuuucaaaaucaaau

SEQ ID NO: 2736073 - RNA, 14 nt, Human
aagacaaaaagcua

SEQ ID NO: 2736074 - RNA, 16 nt, Human
aagacaaagacaaauu

SEQ ID NO: 2736075 - RNA, 18 nt, Human
aagacaacauuaaaacaa

SEQ ID NO: 2736076 - RNA, 21 nt, Human
aagacaacauuaaaacaauau

SEQ ID NO: 2736077 - RNA, 14 nt, Human
aagacaaggaaaaa

SEQ ID NO: 2736078 - RNA, 17 nt, Human
aagacaaggaaaaaaua

SEQ ID NO: 2736079 - RNA, 20 nt, Human
aagacaaggaaaaaauaaca

SEQ ID NO: 2736080 - RNA, 21 nt, Human
aagacaaggaaaaaauaacaa

SEQ ID NO: 2736081 - RNA, 20 nt, Human
aagacacccccucaaaccca

SEQ ID NO: 2736082 - RNA, 21 nt, Human
aagacagagccccacccucag

SEQ ID NO: 2736083 - RNA, 12 nt, Human
aagacagaggaa

SEQ ID NO: 2736084 - RNA, 13 nt, Human
aagacagugaaag

SEQ ID NO: 2736085 - RNA, 14 nt, Human
aagacagugaaaga

SEQ ID NO: 2736086 - RNA, 17 nt, Human
aagacagugaaagaaaa

SEQ ID NO: 2736087 - RNA, 20 nt, Human
aagacagugaaagaaaauaa

SEQ ID NO: 2736088 - RNA, 23 nt, Human
aagacagugaaagaaaauaacaa

SEQ ID NO: 2736089 - RNA, 22 nt, Human
aagacauaagcaaagacuauga

SEQ ID NO: 2736090 - RNA, 21 nt, Human
aagacccaaaaggcagaagca

SEQ ID NO: 2736091 - RNA, 18 nt, Human
aagaccucauuuugaagg

SEQ ID NO: 2736092 - RNA, 15 nt, Human
aagacgugauuuugc

SEQ ID NO: 2736093 - RNA, 17 nt, Human
aagacuacuagggaaau

SEQ ID NO: 2736094 - RNA, 19 nt, Human
aagacuaugaggaauauuu

SEQ ID NO: 2736095 - RNA, 19 nt, Human
aagacucuacccauauuac

SEQ ID NO: 2736096 - RNA, 13 nt, Human
aagacucugucuc

SEQ ID NO: 2736097 - RNA, 17 nt, Human
aagacucugucucaaaa

SEQ ID NO: 2736098 - RNA, 21 nt, Human
aagagaacaagcaaauauaaa

SEQ ID NO: 2736099 - RNA, 16 nt, Human
aagagacagcccagga

SEQ ID NO: 2736100 - RNA, 15 nt, Human
aagagauggguuuga

SEQ ID NO: 2736101 - RNA, 14 nt, Human
aagagauuuuucau

SEQ ID NO: 2736102 - RNA, 15 nt, Human
aagagauuuuucaug

SEQ ID NO: 2736103 - RNA, 21 nt, Human
aagagauuuuucaugauuuug

SEQ ID NO: 2736104 - RNA, 18 nt, Human
aagagccggagccuccag

SEQ ID NO: 2736105 - RNA, 22 nt, Human
aagagccggagccuccagcugc

SEQ ID NO: 2736106 - RNA, 23 nt, Human
aagagccggagccuccagcugcc

SEQ ID NO: 2736107 - RNA, 13 nt, Human
aagagcuguucac

SEQ ID NO: 2736108 - RNA, 19 nt, Human
aagagcuguucacagccag

SEQ ID NO: 2736109 - RNA, 12 nt, Human
aagagcuuaaca

SEQ ID NO: 2736110 - RNA, 14 nt, Human
aagaggacaggcua

SEQ ID NO: 2736111 - RNA, 17 nt, Human
aagagggauuagggaga

SEQ ID NO: 2736112 - RNA, 14 nt, Human
aagagugaaggauu

SEQ ID NO: 2736113 - RNA, 20 nt, Human
aaguauuuauauauuuauaa

SEQ ID NO: 2736114 - RNA, 13 nt, Human
aaguauuuuauua

SEQ ID NO: 2736115 - RNA, 17 nt, Human
aagucaauguuuucagu

SEQ ID NO: 2736116 - RNA, 15 nt, Human
aagucagcucuucuc

SEQ ID NO: 2736117 - RNA, 19 nt, Human
aagucagucauucagauau

SEQ ID NO: 2736118 - RNA, 20 nt, Human
aagucaucugaugagaacaa

SEQ ID NO: 2736119 - RNA, 15 nt, Human
aaguccaagcauuua

SEQ ID NO: 2736120 - RNA, 11 nt, Human
aagucccugcu

SEQ ID NO: 2736121 - RNA, 14 nt, Human
aagucccugcugcc

SEQ ID NO: 2736122 - RNA, 13 nt, Human
aaguccugggauu

SEQ ID NO: 2736123 - RNA, 22 nt, Human
aaguccugggauuacaggugug

SEQ ID NO: 2736124 - RNA, 19 nt, Human
aaguccuucccuuucauuu

SEQ ID NO: 2736125 - RNA, 20 nt, Human
aaguccuucccuuucauuuu

SEQ ID NO: 2736126 - RNA, 16 nt, Human
aagucugauuuuccug

SEQ ID NO: 2736127 - RNA, 16 nt, Human
aagucuuauuuauuca

SEQ ID NO: 2736128 - RNA, 11 nt, Human
aagucuuccau

SEQ ID NO: 2736129 - RNA, 19 nt, Human
aagucuuucacauuuaaau

SEQ ID NO: 2736130 - RNA, 20 nt, Human
aagucuuucacauuuaaaua

SEQ ID NO: 2736131 - RNA, 21 nt, Human
aagucuuucacauuuaaauaa

SEQ ID NO: 2736132 - RNA, 16 nt, Human
aagugaaaaacaucca

SEQ ID NO: 2736133 - RNA, 16 nt, Human
aagugaaauaagccag

SEQ ID NO: 2736134 - RNA, 19 nt, Human
aagugacaagcucacagac

SEQ ID NO: 2736135 - RNA, 23 nt, Human
aagugauccgcccaucuccgucu

SEQ ID NO: 2736136 - RNA, 13 nt, Human
aagugcagccccg

SEQ ID NO: 2736137 - RNA, 22 nt, Human
aagugcuaauuuugaaaaacug

SEQ ID NO: 2736138 - RNA, 18 nt, Human
aagugcuucuccagccuc

SEQ ID NO: 2736139 - RNA, 22 nt, Human
aaguggaacgagacaagcagcc

SEQ ID NO: 2736140 - RNA, 22 nt, Human
aagugguauagaaaugcugguu

SEQ ID NO: 2736141 - RNA, 19 nt, Human
aagugugacucauuaaaug

SEQ ID NO: 2736142 - RNA, 12 nt, Human
aaguguguguuu

SEQ ID NO: 2736143 - RNA, 21 nt, Human
aaguguuugaaagcuuuauuu

SEQ ID NO: 2736144 - RNA, 20 nt, Human
aaguuagaaaguugauuuua

SEQ ID NO: 2736145 - RNA, 13 nt, Human
aaguuagaacuag

SEQ ID NO: 2736146 - RNA, 14 nt, Human
aaguuauguagaaa

SEQ ID NO: 2736147 - RNA, 21 nt, Human
aaguuauguagaaaaaaguaa

SEQ ID NO: 2736148 - RNA, 13 nt, Human
aaguucaaaacuu

SEQ ID NO: 2736149 - RNA, 14 nt, Human
aaguucaauauaag

SEQ ID NO: 2736150 - RNA, 12 nt, Human
aaguucugcaga

SEQ ID NO: 2736151 - RNA, 12 nt, Human
aaguugauaagu

SEQ ID NO: 2736152 - RNA, 18 nt, Human
aaguugauaugccuuuuc

SEQ ID NO: 2736153 - RNA, 16 nt, Human
aaguugcagugagcug

SEQ ID NO: 2736154 - RNA, 19 nt, Human
aaguugcauagguuuaaua

SEQ ID NO: 2736155 - RNA, 20 nt, Human
aaguuuaauggugccuucau

SEQ ID NO: 2736156 - RNA, 12 nt, Human
aaguuucuggga

SEQ ID NO: 2736157 - RNA, 18 nt, Human
aaguuugaauguuaaaua

SEQ ID NO: 2736158 - RNA, 20 nt, Human
aaguuuuguuuuguuuuuca

SEQ ID NO: 2736159 - RNA, 12 nt, Human
aauaaaaacaaa

SEQ ID NO: 2736160 - RNA, 13 nt, Human
aauaaaaagguga

SEQ ID NO: 2736161 - RNA, 13 nt, Human
aauaaaaauaaaa

SEQ ID NO: 2736162 - RNA, 13 nt, Human
aauaaaaauaaau

SEQ ID NO: 2736163 - RNA, 10 nt, Human
aauaaaacuu

SEQ ID NO: 2736164 - RNA, 18 nt, Human
aauaaaacuuuuccaaug

SEQ ID NO: 2736165 - RNA, 19 nt, Human
aauaaaacuuuuccaauga

SEQ ID NO: 2736166 - RNA, 17 nt, Human
aauaaaaugucuauuuu

SEQ ID NO: 2736167 - RNA, 19 nt, Human
aauaaacauucuaucuauu

SEQ ID NO: 2736168 - RNA, 12 nt, Human
aauaaaccuuuu

SEQ ID NO: 2736169 - RNA, 17 nt, Human
aauaaacuauuuguaaa

SEQ ID NO: 2736170 - RNA, 14 nt, Human
aauaaacucauuuc

SEQ ID NO: 2736171 - RNA, 18 nt, Human
aauaaacucauuucuagc

SEQ ID NO: 2736172 - RNA, 13 nt, Human
aauaaagcaaugu

SEQ ID NO: 2736173 - RNA, 17 nt, Human
aauaaaggaaacccagc

SEQ ID NO: 2736174 - RNA, 14 nt, Human
aauaaaguacaaga

SEQ ID NO: 2736175 - RNA, 14 nt, Human
aauaaaguauauau

SEQ ID NO: 2736176 - RNA, 16 nt, Human
aauaaaguguuugaaa

SEQ ID NO: 2736177 - RNA, 11 nt, Human
aauaaauaaau

SEQ ID NO: 2736178 - RNA, 15 nt, Human
aauaaauaaauaaau

SEQ ID NO: 2736179 - RNA, 16 nt, Human
aauaaauaaauaaaua

SEQ ID NO: 2736180 - RNA, 12 nt, Human
aauaaauguacc

SEQ ID NO: 2736181 - RNA, 22 nt, Human
aauaaauguaucuuauucacau

SEQ ID NO: 2736182 - RNA, 18 nt, Human
aauaaauuauuauuuaaa

SEQ ID NO: 2736183 - RNA, 14 nt, Human
aauaacgauaaaag

SEQ ID NO: 2736184 - RNA, 15 nt, Human
aauaacgauaaaaga

SEQ ID NO: 2736185 - RNA, 17 nt, Human
aauaacgauaaaagaca

SEQ ID NO: 2736186 - RNA, 22 nt, Human
aauaacgauaaaagacagugaa

SEQ ID NO: 2736187 - RNA, 18 nt, Human
aauaacugggaauucugg

SEQ ID NO: 2736188 - RNA, 23 nt, Human
aauaagacggauuuauuuuucca

SEQ ID NO: 2736189 - RNA, 14 nt, Human
aauaagccagacau

SEQ ID NO: 2736190 - RNA, 20 nt, Human
aauaagccagacaucaacag

SEQ ID NO: 2736191 - RNA, 22 nt, Human
aauaagccagacaucaacagau

SEQ ID NO: 2736192 - RNA, 20 nt, Human
aauaaggaacaacguugaca

SEQ ID NO: 2736193 - RNA, 14 nt, Human
aauaaguauucugu

SEQ ID NO: 2736194 - RNA, 22 nt, Human
aauaaguauucuguguuaaaaa

SEQ ID NO: 2736195 - RNA, 20 nt, Human
aauaagucaucugaugagaa

SEQ ID NO: 2736196 - RNA, 22 nt, Human
aauaagucaucugaugagaaca

SEQ ID NO: 2736197 - RNA, 22 nt, Human
aauaaguuuauuucuuaaaucu

SEQ ID NO: 2736198 - RNA, 23 nt, Human
aauaaguuuauuucuuaaaucua

SEQ ID NO: 2736199 - RNA, 14 nt, Human
aauaauccuaaaca

SEQ ID NO: 2736200 - RNA, 18 nt, Human
aauaauccuaaacauaug

SEQ ID NO: 2736201 - RNA, 23 nt, Human
aauaauccucaguuuuugugaaa

SEQ ID NO: 2736202 - RNA, 15 nt, Human
aauaaugaaauaacu

SEQ ID NO: 2736203 - RNA, 12 nt, Human
aauaauuuuuaa

SEQ ID NO: 2736204 - RNA, 19 nt, Human
aauaauuuuuaauuauaug

SEQ ID NO: 2736205 - RNA, 20 nt, Human
aauaauuuuuauauuugaaa

SEQ ID NO: 2736206 - RNA, 21 nt, Human
aauaauuuuuauauuugaaau

SEQ ID NO: 2736207 - RNA, 22 nt, Human
aauaauuuuuauauuugaaaua

SEQ ID NO: 2736208 - RNA, 15 nt, Human
aauacaaaaacuuag

SEQ ID NO: 2736209 - RNA, 13 nt, Human
aauacacacucaa

SEQ ID NO: 2736210 - RNA, 19 nt, Human
aauacacacucaaaucaag

SEQ ID NO: 2736211 - RNA, 23 nt, Human
aauacacuguuaucuucacuuuu

SEQ ID NO: 2736212 - RNA, 20 nt, Human
aauacauauagcagcucuug

SEQ ID NO: 2736213 - RNA, 23 nt, Human
aauacaucccuuaccugggaaag

SEQ ID NO: 2736214 - RNA, 18 nt, Human
aauaccaugccauuuaaa

SEQ ID NO: 2736215 - RNA, 21 nt, Human
aauacgugggcauucaaaugu

SEQ ID NO: 2736216 - RNA, 15 nt, Human
aauacucagguuaau

SEQ ID NO: 2736217 - RNA, 21 nt, Human
aauacuucauuuaaaauauuu

SEQ ID NO: 2736218 - RNA, 19 nt, Human
aauacuugcuucuucccaa

SEQ ID NO: 2736219 - RNA, 22 nt, Human
aauacuugcuuuggaaaaccca

SEQ ID NO: 2736220 - RNA, 23 nt, Human
aauagaaacguguauauuuuuua

SEQ ID NO: 2736221 - RNA, 15 nt, Human
aauagaauuauaacu

SEQ ID NO: 2736222 - RNA, 18 nt, Human
aauagcagacaguguuuu

SEQ ID NO: 2736223 - RNA, 19 nt, Human
aauagcauaaguuucuggg

SEQ ID NO: 2736224 - RNA, 17 nt, Human
aauaggcguaacuaauu

SEQ ID NO: 2736225 - RNA, 22 nt, Human
aauaggcugaugggcaaaaaac

SEQ ID NO: 2736226 - RNA, 23 nt, Human
aauaggcugaugggcaaaaaacc

SEQ ID NO: 2736227 - RNA, 10 nt, Human
aauagggcaa

SEQ ID NO: 2736228 - RNA, 22 nt, Human
aauagucaaauugugugaaagg

SEQ ID NO: 2736229 - RNA, 15 nt, Human
aauagugaauaaagu

SEQ ID NO: 2736230 - RNA, 16 nt, Human
aauagugauuuccaca

SEQ ID NO: 2736231 - RNA, 16 nt, Human
aauagugucugaugaa

SEQ ID NO: 2736232 - RNA, 23 nt, Human
aauagugucugaugaauguuaaa

SEQ ID NO: 2736233 - RNA, 18 nt, Human
aauaguuuuauuaauaaa

SEQ ID NO: 2736234 - RNA, 13 nt, Human
aauauaaaacagg

SEQ ID NO: 2736235 - RNA, 15 nt, Human
aauauaaacagcaac

SEQ ID NO: 2736236 - RNA, 21 nt, Human
aauauaaagcaagauaauaaa

SEQ ID NO: 2736237 - RNA, 15 nt, Human
aauauaaauaaaaau

SEQ ID NO: 2736238 - RNA, 18 nt, Human
aauauaagcugccauaua

SEQ ID NO: 2736239 - RNA, 15 nt, Human
aauauauauuuuaga

SEQ ID NO: 2736240 - RNA, 19 nt, Human
aauauaugaggcuacagaa

SEQ ID NO: 2736241 - RNA, 18 nt, Human
aauauaugcuaagucuua

SEQ ID NO: 2736242 - RNA, 20 nt, Human
aauauauguauuauuuauaa

SEQ ID NO: 2736243 - RNA, 12 nt, Human
aauauauuuccu

SEQ ID NO: 2736244 - RNA, 15 nt, Human
aauauauuuccuuau

SEQ ID NO: 2736245 - RNA, 21 nt, Human
aauauauuuccuuauucagaa

SEQ ID NO: 2736246 - RNA, 16 nt, Human
aauauauuuuaaauau

SEQ ID NO: 2736247 - RNA, 17 nt, Human
aauauauuuuaaauauu

SEQ ID NO: 2736248 - RNA, 13 nt, Human
aauauauuuuaag

SEQ ID NO: 2736249 - RNA, 17 nt, Human
aauaucaguuauuuuua

SEQ ID NO: 2736250 - RNA, 18 nt, Human
aauaucaguuauuuuuaa

SEQ ID NO: 2736251 - RNA, 15 nt, Human
aauaucuaauauaua

SEQ ID NO: 2736252 - RNA, 14 nt, Human
aauaucuauuaaua

SEQ ID NO: 2736253 - RNA, 13 nt, Human
aauaucuuaucuu

SEQ ID NO: 2736254 - RNA, 19 nt, Human
aauaucuucacuugucauu

SEQ ID NO: 2736255 - RNA, 20 nt, Human
aauaucuuuuuuuuaauaaa

SEQ ID NO: 2736256 - RNA, 22 nt, Human
aauaucuuuuuuuuaauaaacc

SEQ ID NO: 2736257 - RNA, 19 nt, Human
aauaugccccauucaacau

SEQ ID NO: 2736258 - RNA, 23 nt, Human
aauuagcuccuccuuuuuccuuc

SEQ ID NO: 2736259 - RNA, 21 nt, Human
aauuaggcaaggcuaugugau

SEQ ID NO: 2736260 - RNA, 21 nt, Human
aauuagugcuaagugugaacu

SEQ ID NO: 2736261 - RNA, 21 nt, Human
aauuagugcuuuuugugucau

SEQ ID NO: 2736262 - RNA, 20 nt, Human
aauuauaacuggaaagaagu

SEQ ID NO: 2736263 - RNA, 22 nt, Human
aauuaucuaucuaucuauuuau

SEQ ID NO: 2736264 - RNA, 16 nt, Human
aauuaucuuaaaacuc

SEQ ID NO: 2736265 - RNA, 23 nt, Human
aauuauggcugguaacauagguu

SEQ ID NO: 2736266 - RNA, 19 nt, Human
aauuauguuaaacuagcau

SEQ ID NO: 2736267 - RNA, 11 nt, Human
aauuauuauuu

SEQ ID NO: 2736268 - RNA, 22 nt, Human
aauuauuauuuaaacaucagca

SEQ ID NO: 2736269 - RNA, 13 nt, Human
aauuauuucacuu

SEQ ID NO: 2736270 - RNA, 15 nt, Human
aauuauuucacuuua

SEQ ID NO: 2736271 - RNA, 17 nt, Human
aauuauuucacuuuaga

SEQ ID NO: 2736272 - RNA, 14 nt, Human
aauuauuuucucuc

SEQ ID NO: 2736273 - RNA, 18 nt, Human
aauuauuuugugaugcaa

SEQ ID NO: 2736274 - RNA, 18 nt, Human
aauucaaaggcauuucuu

SEQ ID NO: 2736275 - RNA, 14 nt, Human
aauucauguugccu

SEQ ID NO: 2736276 - RNA, 20 nt, Human
aauucauguugccuugcaua

SEQ ID NO: 2736277 - RNA, 21 nt, Human
aauucauucacucaacaaaca

SEQ ID NO: 2736278 - RNA, 11 nt, Human
aauuccacagc

SEQ ID NO: 2736279 - RNA, 16 nt, Human
aauuccacagcugcuc

SEQ ID NO: 2736280 - RNA, 18 nt, Human
aauuccaccugcaaucaa

SEQ ID NO: 2736281 - RNA, 19 nt, Human
aauuccaggaaaaucugca

SEQ ID NO: 2736282 - RNA, 20 nt, Human
aauuccguagguuauuuuca

SEQ ID NO: 2736283 - RNA, 20 nt, Human
aauuccuauauccugugacu

SEQ ID NO: 2736284 - RNA, 13 nt, Human
aauucuaaaugaa

SEQ ID NO: 2736285 - RNA, 15 nt, Human
aauucugaaagcaac

SEQ ID NO: 2736286 - RNA, 20 nt, Human
aauucugguagcuaaauaua

SEQ ID NO: 2736287 - RNA, 17 nt, Human
aauucuugccaaauaua

SEQ ID NO: 2736288 - RNA, 21 nt, Human
aauucuuggguguuuauccua

SEQ ID NO: 2736289 - RNA, 14 nt, Human
aauugaaaauggua

SEQ ID NO: 2736290 - RNA, 15 nt, Human
aauugaauucccugc

SEQ ID NO: 2736291 - RNA, 15 nt, Human
aauugacccacaaga

SEQ ID NO: 2736292 - RNA, 16 nt, Human
aauugacccacaagaa

SEQ ID NO: 2736293 - RNA, 19 nt, Human
aauugaucgacuugccaaa

SEQ ID NO: 2736294 - RNA, 11 nt, Human
aauugcagagu

SEQ ID NO: 2736295 - RNA, 17 nt, Human
aauugcuaucgccauca

SEQ ID NO: 2736296 - RNA, 22 nt, Human
aauugcuauguuuugacauuuu

SEQ ID NO: 2736297 - RNA, 13 nt, Human
aauuggagcucgu

SEQ ID NO: 2736298 - RNA, 14 nt, Human
aauuggagcucgug

SEQ ID NO: 2736299 - RNA, 19 nt, Human
aauuggagcucgugggaca

SEQ ID NO: 2736300 - RNA, 14 nt, Human
aauuggcaugaagg

SEQ ID NO: 2736301 - RNA, 12 nt, Human
aauuguaauagg

SEQ ID NO: 2736302 - RNA, 15 nt, Human
aauuguaucuuaguu

SEQ ID NO: 2736303 - RNA, 14 nt, Human
aauuguauuacaaa

SEQ ID NO: 2736304 - RNA, 19 nt, Human
aauuguauuacaaauccaa

SEQ ID NO: 2736305 - RNA, 22 nt, Human
aauuguauuuuaguaagagauu

SEQ ID NO: 2736306 - RNA, 16 nt, Human
aauuguguuuauaauu

SEQ ID NO: 2736307 - RNA, 20 nt, Human
aauuguguuuauaauuuuaa

SEQ ID NO: 2736308 - RNA, 21 nt, Human
aauuguguuuauaauuuuaaa

SEQ ID NO: 2736309 - RNA, 17 nt, Human
aauuguuaaaggcuaug

SEQ ID NO: 2736310 - RNA, 12 nt, Human
aauuuaaaacau

SEQ ID NO: 2736311 - RNA, 11 nt, Human
aauuuaaauau

SEQ ID NO: 2736312 - RNA, 16 nt, Human
aauuuaagauuuuguu

SEQ ID NO: 2736313 - RNA, 19 nt, Human
aauuuagauuugugugcau

SEQ ID NO: 2736314 - RNA, 15 nt, Human
aauuuaguauuuugu

SEQ ID NO: 2736315 - RNA, 16 nt, Human
aauuuaguauuuuguu

SEQ ID NO: 2736316 - RNA, 13 nt, Human
aauuucaugaaaa

SEQ ID NO: 2736317 - RNA, 22 nt, Human
aauuuccaugaguuacacugga

SEQ ID NO: 2736318 - RNA, 19 nt, Human
aauuuccugggagcuuuug

SEQ ID NO: 2736319 - RNA, 12 nt, Human
aauuucuauuug

SEQ ID NO: 2736320 - RNA, 16 nt, Human
aauuucuauuugaucu

SEQ ID NO: 2736321 - RNA, 23 nt, Human
aauuucuauuugaucugauauca

SEQ ID NO: 2736322 - RNA, 16 nt, Human
aauuucuucaacuccc

SEQ ID NO: 2736323 - RNA, 18 nt, Human
aauuugaaacacuuugca

SEQ ID NO: 2736324 - RNA, 19 nt, Human
aauuugauaugugaacagu

SEQ ID NO: 2736325 - RNA, 23 nt, Human
aauuugguuuucacauuggaaac

SEQ ID NO: 2736326 - RNA, 13 nt, Human
aauuugugaaggu

SEQ ID NO: 2736327 - RNA, 21 nt, Human
aauuuguuuucccuucuuaca

SEQ ID NO: 2736328 - RNA, 12 nt, Human
aauuuuaaaaug

SEQ ID NO: 2736329 - RNA, 18 nt, Human
aauuuuagacauucuuua

SEQ ID NO: 2736330 - RNA, 17 nt, Human
aauuuuagcaaagauau

SEQ ID NO: 2736331 - RNA, 21 nt, Human
aauuuuaugcggcauuuucuu

SEQ ID NO: 2736332 - RNA, 18 nt, Human
aauuuuauuauucuuauu

SEQ ID NO: 2736333 - RNA, 21 nt, Human
aauuuucauuguucuauaaca

SEQ ID NO: 2736334 - RNA, 12 nt, Human
aauuuugaaaaa

SEQ ID NO: 2736335 - RNA, 20 nt, Human
aauuuugaugaacaaaauuu

SEQ ID NO: 2736336 - RNA, 15 nt, Human
aauuuugcuaacugg

SEQ ID NO: 2736337 - RNA, 23 nt, Human
aauuuuuaggcugaaagaugacg

SEQ ID NO: 2736338 - RNA, 13 nt, Human
aauuuuuauauuu

SEQ ID NO: 2736339 - RNA, 17 nt, Human
aauuuuuauauuugaaa

SEQ ID NO: 2736340 - RNA, 19 nt, Human
aauuuuuauauuugaaaua

SEQ ID NO: 2736341 - RNA, 21 nt, Human
aauuuuuauauuugaaauauu

SEQ ID NO: 2736342 - RNA, 12 nt, Human
aauuuuucucua

SEQ ID NO: 2736343 - RNA, 21 nt, Human
aauuuuucucuaacucagaaa

SEQ ID NO: 2736344 - RNA, 20 nt, Human
aauuuuucuuauuucauuuc

SEQ ID NO: 2736345 - RNA, 16 nt, Human
aauuuuugaaaacugg

SEQ ID NO: 2736346 - RNA, 19 nt, Human
aauuuuuggccaugaggaa

SEQ ID NO: 2736347 - RNA, 17 nt, Human
aauuuuuguauuuuuag

SEQ ID NO: 2736348 - RNA, 19 nt, Human
aauuuuuucucuaggaaau

SEQ ID NO: 2736349 - RNA, 22 nt, Human
aauuuuuucucuaggaaauauu

SEQ ID NO: 2736350 - RNA, 18 nt, Human
aauuuuuuucaauauuua

SEQ ID NO: 2736351 - RNA, 15 nt, Human
aauuuuuuucaucuu

SEQ ID NO: 2736352 - RNA, 21 nt, Human
aauuuuuuucaucuucucugg

SEQ ID NO: 2736353 - RNA, 18 nt, Human
aauuuuuuugugggaaau

SEQ ID NO: 2736354 - RNA, 13 nt, Human
acaaaaaaaaaau

SEQ ID NO: 2736355 - RNA, 15 nt, Human
acaaaaacaaacaaa

SEQ ID NO: 2736356 - RNA, 18 nt, Human
acaaaaauuagccgggca

SEQ ID NO: 2736357 - RNA, 16 nt, Human
acaaaaguuucauccu

SEQ ID NO: 2736358 - RNA, 18 nt, Human
acaaacagggcugccuuc

SEQ ID NO: 2736359 - RNA, 16 nt, Human
acaaacauguuccugg

SEQ ID NO: 2736360 - RNA, 15 nt, Human
acaaacccaagggca

SEQ ID NO: 2736361 - RNA, 12 nt, Human
acaaagacaaau

SEQ ID NO: 2736362 - RNA, 15 nt, Human
acaaagacaaauucu

SEQ ID NO: 2736363 - RNA, 17 nt, Human
acaaagcccaucauaau

SEQ ID NO: 2736364 - RNA, 18 nt, Human
acaaagcccaucauaaua

SEQ ID NO: 2736365 - RNA, 22 nt, Human
acaaaggcuuauuaauuugacu

SEQ ID NO: 2736366 - RNA, 18 nt, Human
acaaagggaaagccucug

SEQ ID NO: 2736367 - RNA, 15 nt, Human
acaaagggggaggcu

SEQ ID NO: 2736368 - RNA, 15 nt, Human
acaaaguugauuaag

SEQ ID NO: 2736369 - RNA, 23 nt, Human
acaaauacucuuaggaagagaaa

SEQ ID NO: 2736370 - RNA, 18 nt, Human
acaaauaggaauuguuuu

SEQ ID NO: 2736371 - RNA, 20 nt, Human
acaaauauguucugacauaa

SEQ ID NO: 2736372 - RNA, 20 nt, Human
acaaaucagaccuggcugcu

SEQ ID NO: 2736373 - RNA, 14 nt, Human
acaaauccaaugaa

SEQ ID NO: 2736374 - RNA, 16 nt, Human
acaaauccaaugaaau

SEQ ID NO: 2736375 - RNA, 15 nt, Human
acaaaucuuaacuug

SEQ ID NO: 2736376 - RNA, 17 nt, Human
acaaaugcauuucuaaa

SEQ ID NO: 2736377 - RNA, 17 nt, Human
acaaaugcuuaugaaac

SEQ ID NO: 2736378 - RNA, 13 nt, Human
acaaaugggaaac

SEQ ID NO: 2736379 - RNA, 19 nt, Human
acaaauuuacagagacaga

SEQ ID NO: 2736380 - RNA, 12 nt, Human
acaacaaaagcg

SEQ ID NO: 2736381 - RNA, 14 nt, Human
acaacacacagauu

SEQ ID NO: 2736382 - RNA, 21 nt, Human
acaacacacagauuugagcuc

SEQ ID NO: 2736383 - RNA, 15 nt, Human
acaaccaaaagucuu

SEQ ID NO: 2736384 - RNA, 20 nt, Human
acaaccuaaauuugguucua

SEQ ID NO: 2736385 - RNA, 13 nt, Human
acaacuauauugu

SEQ ID NO: 2736386 - RNA, 15 nt, Human
acaacucgaaucacu

SEQ ID NO: 2736387 - RNA, 12 nt, Human
acaacugugacu

SEQ ID NO: 2736388 - RNA, 12 nt, Human
acaagaaaugaa

SEQ ID NO: 2736389 - RNA, 13 nt, Human
acaagaaaugaaa

SEQ ID NO: 2736390 - RNA, 15 nt, Human
acaagaaaugaaagc

SEQ ID NO: 2736391 - RNA, 17 nt, Human
acaagaaaugaaagcag

SEQ ID NO: 2736392 - RNA, 13 nt, Human
acaagaaggaaag

SEQ ID NO: 2736393 - RNA, 15 nt, Human
acaagacccaaaagg

SEQ ID NO: 2736394 - RNA, 17 nt, Human
acaagacugcacaucaa

SEQ ID NO: 2736395 - RNA, 10 nt, Human
acaagagacu

SEQ ID NO: 2736396 - RNA, 17 nt, Human
acaagagacuggaagga

SEQ ID NO: 2736397 - RNA, 14 nt, Human
acaagagcuuaaca

SEQ ID NO: 2736398 - RNA, 14 nt, Human
acaagcaaauauaa

SEQ ID NO: 2736399 - RNA, 22 nt, Human
acaagcaaauauaaacagcaac

SEQ ID NO: 2736400 - RNA, 14 nt, Human
acaagcagcccuua

SEQ ID NO: 2736401 - RNA, 22 nt, Human
acaagcaggcucaacauaacau

SEQ ID NO: 2736402 - RNA, 22 nt, Human
acaagcauucugucuugaaggg

SEQ ID NO: 2736403 - RNA, 17 nt, Human
acaagccuccuuuuaaa

SEQ ID NO: 2736404 - RNA, 19 nt, Human
acagugauuaccagggacu

SEQ ID NO: 2736405 - RNA, 21 nt, Human
acagugauuaccagggacuga

SEQ ID NO: 2736406 - RNA, 17 nt, Human
acaguuaaguuuugugu

SEQ ID NO: 2736407 - RNA, 21 nt, Human
acaguuaccucugccucagaa

SEQ ID NO: 2736408 - RNA, 19 nt, Human
acaguuagagauuuuuaaa

SEQ ID NO: 2736409 - RNA, 20 nt, Human
acaguuagagauuuuuaaau

SEQ ID NO: 2736410 - RNA, 23 nt, Human
acaguucauauguaccauguaca

SEQ ID NO: 2736411 - RNA, 19 nt, Human
acaguuccccuauguggaa

SEQ ID NO: 2736412 - RNA, 22 nt, Human
acaguucuuuguuuggaggcuc

SEQ ID NO: 2736413 - RNA, 16 nt, Human
acaguugcauugacug

SEQ ID NO: 2736414 - RNA, 20 nt, Human
acaguuuucugagaaagacu

SEQ ID NO: 2736415 - RNA, 12 nt, Human
acauaaaauaca

SEQ ID NO: 2736416 - RNA, 18 nt, Human
acauaaaauacaaaaacu

SEQ ID NO: 2736417 - RNA, 12 nt, Human
acauaagcuaga

SEQ ID NO: 2736418 - RNA, 15 nt, Human
acauaagggaggaaa

SEQ ID NO: 2736419 - RNA, 21 nt, Human
acauacauguaaaauaugucu

SEQ ID NO: 2736420 - RNA, 23 nt, Human
acauagaauaguguuggaaaaug

SEQ ID NO: 2736421 - RNA, 14 nt, Human
acauagugaggagc

SEQ ID NO: 2736422 - RNA, 19 nt, Human
acauauagcagcucuugaa

SEQ ID NO: 2736423 - RNA, 18 nt, Human
acauauauaacaaugcug

SEQ ID NO: 2736424 - RNA, 22 nt, Human
acauauauaacaaugcuguauu

SEQ ID NO: 2736425 - RNA, 23 nt, Human
acauauccaggcaccaggacuag

SEQ ID NO: 2736426 - RNA, 10 nt, Human
acauauuucu

SEQ ID NO: 2736427 - RNA, 15 nt, Human
acaucaacagauaaa

SEQ ID NO: 2736428 - RNA, 17 nt, Human
acaucagcaaaaaagua

SEQ ID NO: 2736429 - RNA, 20 nt, Human
acaucagcaaaaaaguacuu

SEQ ID NO: 2736430 - RNA, 13 nt, Human
acaucaggaaaga

SEQ ID NO: 2736431 - RNA, 16 nt, Human
acauccauucuucccu

SEQ ID NO: 2736432 - RNA, 15 nt, Human
acaucccacucacaa

SEQ ID NO: 2736433 - RNA, 22 nt, Human
acauccuaagcucaucuauuuc

SEQ ID NO: 2736434 - RNA, 14 nt, Human
acauccuacaagac

SEQ ID NO: 2736435 - RNA, 15 nt, Human
acauccuacaagaca

SEQ ID NO: 2736436 - RNA, 16 nt, Human
acauccuacaagacac

SEQ ID NO: 2736437 - RNA, 18 nt, Human
acauccuacaagacacag

SEQ ID NO: 2736438 - RNA, 14 nt, Human
acauccucuaugcc

SEQ ID NO: 2736439 - RNA, 16 nt, Human
acauccucuaugccag

SEQ ID NO: 2736440 - RNA, 18 nt, Human
acaucuagcaaauguuau

SEQ ID NO: 2736441 - RNA, 22 nt, Human
acaucugagaaaagcuuugaac

SEQ ID NO: 2736442 - RNA, 13 nt, Human
acaucuuucacau

SEQ ID NO: 2736443 - RNA, 16 nt, Human
acaugaacuuguaaag

SEQ ID NO: 2736444 - RNA, 18 nt, Human
acaugaacuuguaaagga

SEQ ID NO: 2736445 - RNA, 13 nt, Human
acaugaagaagcu

SEQ ID NO: 2736446 - RNA, 16 nt, Human
acaugaaguccaagca

SEQ ID NO: 2736447 - RNA, 19 nt, Human
acaugaauugcauuuuacu

SEQ ID NO: 2736448 - RNA, 13 nt, Human
acaugagagacag

SEQ ID NO: 2736449 - RNA, 20 nt, Human
acaugagguacugagaguga

SEQ ID NO: 2736450 - RNA, 21 nt, Human
acaugagguacugagagugaa

SEQ ID NO: 2736451 - RNA, 22 nt, Human
acaugagguacugagagugaac

SEQ ID NO: 2736452 - RNA, 13 nt, Human
acaugauccugca

SEQ ID NO: 2736453 - RNA, 15 nt, Human
acaugauccugcaau

SEQ ID NO: 2736454 - RNA, 18 nt, Human
acaugauuccagccauca

SEQ ID NO: 2736455 - RNA, 16 nt, Human
acaugauuuggggaaa

SEQ ID NO: 2736456 - RNA, 19 nt, Human
acaugcacugauguugugu

SEQ ID NO: 2736457 - RNA, 21 nt, Human
acaugcacugauguuguguuu

SEQ ID NO: 2736458 - RNA, 20 nt, Human
acaugcauuacugcaugcac

SEQ ID NO: 2736459 - RNA, 15 nt, Human
acaugcucacacauu

SEQ ID NO: 2736460 - RNA, 14 nt, Human
acaugcuuuuuaau

SEQ ID NO: 2736461 - RNA, 22 nt, Human
acauggaagaccucauuuugaa

SEQ ID NO: 2736462 - RNA, 16 nt, Human
acaugggacauuugcu

SEQ ID NO: 2736463 - RNA, 19 nt, Human
acaugggaucaaguccugc

SEQ ID NO: 2736464 - RNA, 14 nt, Human
acaugucuagagaa

SEQ ID NO: 2736465 - RNA, 14 nt, Human
acauguggcccaac

SEQ ID NO: 2736466 - RNA, 19 nt, Human
acauguggcccaacacaau

SEQ ID NO: 2736467 - RNA, 22 nt, Human
acauguggcccaacacaauucu

SEQ ID NO: 2736468 - RNA, 18 nt, Human
acauguuacaacacggac

SEQ ID NO: 2736469 - RNA, 17 nt, Human
acauguucacuuauuga

SEQ ID NO: 2736470 - RNA, 22 nt, Human
acauguuucuuuguaaugaaaa

SEQ ID NO: 2736471 - RNA, 13 nt, Human
acauuaaaacaau

SEQ ID NO: 2736472 - RNA, 21 nt, Human
acauuaaaauguuagaaaaaa

SEQ ID NO: 2736473 - RNA, 13 nt, Human
acauuaauauuua

SEQ ID NO: 2736474 - RNA, 14 nt, Human
acauuaauuaucua

SEQ ID NO: 2736475 - RNA, 20 nt, Human
acauuaauuaucuaguuuaa

SEQ ID NO: 2736476 - RNA, 13 nt, Human
acauuacaacagu

SEQ ID NO: 2736477 - RNA, 17 nt, Human
acauuacucugaaauug

SEQ ID NO: 2736478 - RNA, 21 nt, Human
acauuacucugaaauuguaac

SEQ ID NO: 2736479 - RNA, 14 nt, Human
acauuaggaaaagu

SEQ ID NO: 2736480 - RNA, 16 nt, Human
acauuauuaucaacaa

SEQ ID NO: 2736481 - RNA, 14 nt, Human
acauucagagcuua

SEQ ID NO: 2736482 - RNA, 13 nt, Human
acauucagggcua

SEQ ID NO: 2736483 - RNA, 23 nt, Human
acauucagggcuauuuuuucccc

SEQ ID NO: 2736484 - RNA, 13 nt, Human
acauuccucugcc

SEQ ID NO: 2736485 - RNA, 13 nt, Human
acauucuaucuau

SEQ ID NO: 2736486 - RNA, 16 nt, Human
acauucuuaaaguguc

SEQ ID NO: 2736487 - RNA, 15 nt, Human
acauucuuccugauu

SEQ ID NO: 2736488 - RNA, 22 nt, Human
acauuggaaacaagucagucau

SEQ ID NO: 2736489 - RNA, 17 nt, Human
acauuguauaguuggaa

SEQ ID NO: 2736490 - RNA, 18 nt, Human
acauuguuugucugucuu

SEQ ID NO: 2736491 - RNA, 18 nt, Human
acauuuauauuuuuguga

SEQ ID NO: 2736492 - RNA, 15 nt, Human
acauuuaucuuugua

SEQ ID NO: 2736493 - RNA, 19 nt, Human
acauuuauguuccuuuuaa

SEQ ID NO: 2736494 - RNA, 22 nt, Human
acauuucccccuagccugccuc

SEQ ID NO: 2736495 - RNA, 23 nt, Human
acauuucccccuagccugccucc

SEQ ID NO: 2736496 - RNA, 17 nt, Human
acauuuccuaaauauau

SEQ ID NO: 2736497 - RNA, 24 nt, Human
acauuugcgaaugguuccauucuc

SEQ ID NO: 2736498 - RNA, 18 nt, Human
acauuugcucauggaauu

SEQ ID NO: 2736499 - RNA, 19 nt, Human
acauuuguauaaaauaauu

SEQ ID NO: 2736500 - RNA, 11 nt, Human
acauuuuuaag

SEQ ID NO: 2736501 - RNA, 18 nt, Human
acauuuuuguauuuuguu

SEQ ID NO: 2736502 - RNA, 19 nt, Human
accaaaaaaaggaaggaag

SEQ ID NO: 2736503 - RNA, 23 nt, Human
accaaagacuacauauugucacu

SEQ ID NO: 2736504 - RNA, 13 nt, Human
accaaauggagug

SEQ ID NO: 2736505 - RNA, 14 nt, Human
accaacacccugag

SEQ ID NO: 2736506 - RNA, 21 nt, Human
accaacacccugagguugugu

SEQ ID NO: 2736507 - RNA, 21 nt, Human
accaacacuaacauauaaugu

SEQ ID NO: 2736508 - RNA, 22 nt, Human
accaaccuggaguugaaaaucu

SEQ ID NO: 2736509 - RNA, 15 nt, Human
accaaccuuuuccca

SEQ ID NO: 2736510 - RNA, 23 nt, Human
accaaggagccaaacauccuaca

SEQ ID NO: 2736511 - RNA, 19 nt, Human
accaaggcccccgggccga

SEQ ID NO: 2736512 - RNA, 16 nt, Human
accaaucaugaauuag

SEQ ID NO: 2736513 - RNA, 22 nt, Human
accaaucaugaauuaguuuuau

SEQ ID NO: 2736514 - RNA, 12 nt, Human
accaaucauuuu

SEQ ID NO: 2736515 - RNA, 21 nt, Human
accaaucauuuuaauuauuau

SEQ ID NO: 2736516 - RNA, 14 nt, Human
accacaagacugca

SEQ ID NO: 2736517 - RNA, 20 nt, Human
accacaagggucacaauacu

SEQ ID NO: 2736518 - RNA, 14 nt, Human
accacauccagccu

SEQ ID NO: 2736519 - RNA, 20 nt, Human
accacaugggugaacacuca

SEQ ID NO: 2736520 - RNA, 12 nt, Human
accaccacgccu

SEQ ID NO: 2736521 - RNA, 20 nt, Human
accaccacgccuggcuaauu

SEQ ID NO: 2736522 - RNA, 21 nt, Human
accacccuugccauggagguu

SEQ ID NO: 2736523 - RNA, 17 nt, Human
accaccgcgcccagccu

SEQ ID NO: 2736524 - RNA, 18 nt, Human
accaccgcgcccagccuu

SEQ ID NO: 2736525 - RNA, 21 nt, Human
accaccugccuauauuuuuug

SEQ ID NO: 2736526 - RNA, 12 nt, Human
accacugcagaa

SEQ ID NO: 2736527 - RNA, 19 nt, Human
accacugcagaagacagua

SEQ ID NO: 2736528 - RNA, 21 nt, Human
accacuggagaucaccagugu

SEQ ID NO: 2736529 - RNA, 19 nt, Human
accacuguguauuuaacug

SEQ ID NO: 2736530 - RNA, 21 nt, Human
accagagaagggcuuggacuc

SEQ ID NO: 2736531 - RNA, 13 nt, Human
accagcaggcugg

SEQ ID NO: 2736532 - RNA, 12 nt, Human
accagccaaccu

SEQ ID NO: 2736533 - RNA, 11 nt, Human
accagccuggu

SEQ ID NO: 2736534 - RNA, 14 nt, Human
accaggcaccccca

SEQ ID NO: 2736535 - RNA, 20 nt, Human
accaggcacccccagaauga

SEQ ID NO: 2736536 - RNA, 14 nt, Human
accaggcauccucc

SEQ ID NO: 2736537 - RNA, 14 nt, Human
accaggcugcucag

SEQ ID NO: 2736538 - RNA, 23 nt, Human
accaggcugcucagggcuggucu

SEQ ID NO: 2736539 - RNA, 16 nt, Human
accaggcuugccugca

SEQ ID NO: 2736540 - RNA, 22 nt, Human
accagggaugaugcaacauccu

SEQ ID NO: 2736541 - RNA, 15 nt, Human
accagucccucccca

SEQ ID NO: 2736542 - RNA, 20 nt, Human
accagucugacuguuuccau

SEQ ID NO: 2736543 - RNA, 13 nt, Human
accauaauucugg

SEQ ID NO: 2736544 - RNA, 16 nt, Human
accaucccggccggcg

SEQ ID NO: 2736545 - RNA, 16 nt, Human
accauguuggccaggc

SEQ ID NO: 2736546 - RNA, 18 nt, Human
accauguuggccaggcuu

SEQ ID NO: 2736547 - RNA, 14 nt, Human
accauuuccucaga

SEQ ID NO: 2736548 - RNA, 14 nt, Human
acgcccaggacccc

SEQ ID NO: 2736549 - RNA, 21 nt, Human
acgccuggcuaauuuuuguau

SEQ ID NO: 2736550 - RNA, 19 nt, Human
acgccuggcugauuuuugu

SEQ ID NO: 2736551 - RNA, 16 nt, Human
acgccuguaaucccag

SEQ ID NO: 2736552 - RNA, 14 nt, Human
acgcgcgcuccgcg

SEQ ID NO: 2736553 - RNA, 19 nt, Human
acgcgcgcuccgcgcagcu

SEQ ID NO: 2736554 - RNA, 17 nt, Human
acgcucauuguagaaaa

SEQ ID NO: 2736555 - RNA, 23 nt, Human
acgcucauuguagaaaagcuaua

SEQ ID NO: 2736556 - RNA, 17 nt, Human
acgcucucuggccuucg

SEQ ID NO: 2736557 - RNA, 18 nt, Human
acgcucucuggccuucgg

SEQ ID NO: 2736558 - RNA, 21 nt, Human
acgcucucuggccuucggccu

SEQ ID NO: 2736559 - RNA, 17 nt, Human
acgcucugggucgccgg

SEQ ID NO: 2736560 - RNA, 20 nt, Human
acgcucugggucgccggcau

SEQ ID NO: 2736561 - RNA, 20 nt, Human
acggacgaaccuugaaaacu

SEQ ID NO: 2736562 - RNA, 18 nt, Human
acggagauaucccaggaa

SEQ ID NO: 2736563 - RNA, 12 nt, Human
acggagccggga

SEQ ID NO: 2736564 - RNA, 20 nt, Human
acggagccgggaaagaagag

SEQ ID NO: 2736565 - RNA, 18 nt, Human
acggcuccggacgcugcu

SEQ ID NO: 2736566 - RNA, 20 nt, Human
acggcuccggacgcugcugc

SEQ ID NO: 2736567 - RNA, 15 nt, Human
acggcuggagcugcc

SEQ ID NO: 2736568 - RNA, 13 nt, Human
acgggaccagcuc

SEQ ID NO: 2736569 - RNA, 15 nt, Human
acggggacucagccc

SEQ ID NO: 2736570 - RNA, 16 nt, Human
acgggguuugccaugc

SEQ ID NO: 2736571 - RNA, 17 nt, Human
acguaaagcuagaaaug

SEQ ID NO: 2736572 - RNA, 18 nt, Human
acguaaagcuagaaauga

SEQ ID NO: 2736573 - RNA, 20 nt, Human
acgugacuggccugcuggau

SEQ ID NO: 2736574 - RNA, 20 nt, Human
acgugcacgcacacugucug

SEQ ID NO: 2736575 - RNA, 16 nt, Human
acguggguugcacugg

SEQ ID NO: 2736576 - RNA, 14 nt, Human
acgugguaaaacac

SEQ ID NO: 2736577 - RNA, 14 nt, Human
acguuaggaggaca

SEQ ID NO: 2736578 - RNA, 20 nt, Human
acguuaggaggacaaaagga

SEQ ID NO: 2736579 - RNA, 16 nt, Human
acguucuuacuaguuu

SEQ ID NO: 2736580 - RNA, 13 nt, Human
acguugcucccca

SEQ ID NO: 2736581 - RNA, 19 nt, Human
acguugcuccccaucaagc

SEQ ID NO: 2736582 - RNA, 16 nt, Human
acguuuucauuaaaau

SEQ ID NO: 2736583 - RNA, 13 nt, Human
acuaaaaaacaaa

SEQ ID NO: 2736584 - RNA, 14 nt, Human
acuaaaaauacaaa

SEQ ID NO: 2736585 - RNA, 13 nt, Human
acuaaaaauuaaa

SEQ ID NO: 2736586 - RNA, 20 nt, Human
acuaaaacaccucagcugcc

SEQ ID NO: 2736587 - RNA, 16 nt, Human
acuaaacaaagaguga

SEQ ID NO: 2736588 - RNA, 22 nt, Human
acuaaaguuagaaaguugauuu

SEQ ID NO: 2736589 - RNA, 20 nt, Human
acuaaauugacacuuaaaaa

SEQ ID NO: 2736590 - RNA, 21 nt, Human
acuaagauuuguaauauuucu

SEQ ID NO: 2736591 - RNA, 20 nt, Human
acuaauagaauuaauggaau

SEQ ID NO: 2736592 - RNA, 21 nt, Human
acuaauagaauuaauggaaua

SEQ ID NO: 2736593 - RNA, 17 nt, Human
acuaaugauuuagugau

SEQ ID NO: 2736594 - RNA, 14 nt, Human
acuaauucauuaau

SEQ ID NO: 2736595 - RNA, 14 nt, Human
acuaauuuuaaaau

SEQ ID NO: 2736596 - RNA, 20 nt, Human
acuacauggaagaccucauu

SEQ ID NO: 2736597 - RNA, 20 nt, Human
acuacauuacuucaaacuga

SEQ ID NO: 2736598 - RNA, 14 nt, Human
acuacuauccaacu

SEQ ID NO: 2736599 - RNA, 18 nt, Human
acuacugaggaucagagu

SEQ ID NO: 2736600 - RNA, 15 nt, Human
acuacuuuaaaaaaa

SEQ ID NO: 2736601 - RNA, 18 nt, Human
acuagaauuuauucaauu

SEQ ID NO: 2736602 - RNA, 19 nt, Human
acuagaguuuagcuggaaa

SEQ ID NO: 2736603 - RNA, 21 nt, Human
acuagaguuuagcuggaaaag

SEQ ID NO: 2736604 - RNA, 20 nt, Human
acuaggcugagcaaucugac

SEQ ID NO: 2736605 - RNA, 13 nt, Human
acuagggcaggga

SEQ ID NO: 2736606 - RNA, 23 nt, Human
acuaggguggugcauuuuuguaa

SEQ ID NO: 2736607 - RNA, 17 nt, Human
acuaggugcugcagccc

SEQ ID NO: 2736608 - RNA, 24 nt, Human
acuagucucaaacuccugaccuca

SEQ ID NO: 2736609 - RNA, 17 nt, Human
acuaguuguaauuuuuu

SEQ ID NO: 2736610 - RNA, 23 nt, Human
acuaguuguaauuuuuuuguggg

SEQ ID NO: 2736611 - RNA, 16 nt, Human
acuaguuucccuugca

SEQ ID NO: 2736612 - RNA, 13 nt, Human
acuauaaaacuag

SEQ ID NO: 2736613 - RNA, 14 nt, Human
acuauaaaacuagg

SEQ ID NO: 2736614 - RNA, 22 nt, Human
acuauauuguuugcuaagcauu

SEQ ID NO: 2736615 - RNA, 15 nt, Human
acuaucucauuucca

SEQ ID NO: 2736616 - RNA, 19 nt, Human
acuaucucauuuccaagca

SEQ ID NO: 2736617 - RNA, 14 nt, Human
acuauggaaaaaaa

SEQ ID NO: 2736618 - RNA, 16 nt, Human
acuaugucauuugcug

SEQ ID NO: 2736619 - RNA, 13 nt, Human
acuauuauauuuc

SEQ ID NO: 2736620 - RNA, 15 nt, Human
acuauuauauuucca

SEQ ID NO: 2736621 - RNA, 12 nt, Human
acuauucauaag

SEQ ID NO: 2736622 - RNA, 19 nt, Human
acuauucccuucuaaccug

SEQ ID NO: 2736623 - RNA, 17 nt, Human
acuauucuugauguaaa

SEQ ID NO: 2736624 - RNA, 17 nt, Human
acuauuuaauuauuuca

SEQ ID NO: 2736625 - RNA, 21 nt, Human
acuauuuaauuauuucacuuu

SEQ ID NO: 2736626 - RNA, 14 nt, Human
acuauuuuucagaa

SEQ ID NO: 2736627 - RNA, 19 nt, Human
acucaaaucaagaaacuua

SEQ ID NO: 2736628 - RNA, 15 nt, Human
acucaacaaacauaa

SEQ ID NO: 2736629 - RNA, 21 nt, Human
acucaagcaagauuucagauu

SEQ ID NO: 2736630 - RNA, 15 nt, Human
acucaauaaagugcu

SEQ ID NO: 2736631 - RNA, 15 nt, Human
acucaccucccccau

SEQ ID NO: 2736632 - RNA, 17 nt, Human
acucaccucccccaucu

SEQ ID NO: 2736633 - RNA, 19 nt, Human
acucacugugggaaggaga

SEQ ID NO: 2736634 - RNA, 14 nt, Human
acucagaaacauca

SEQ ID NO: 2736635 - RNA, 14 nt, Human
acucagaaauuuaa

SEQ ID NO: 2736636 - RNA, 18 nt, Human
acucagacacaaauaaag

SEQ ID NO: 2736637 - RNA, 15 nt, Human
acucagggccccagc

SEQ ID NO: 2736638 - RNA, 17 nt, Human
acucagggccccagcac

SEQ ID NO: 2736639 - RNA, 17 nt, Human
acucagguggcccuacu

SEQ ID NO: 2736640 - RNA, 21 nt, Human
acucaguuuuaacuagaauuu

SEQ ID NO: 2736641 - RNA, 22 nt, Human
acucauacauguuacaacacgg

SEQ ID NO: 2736642 - RNA, 21 nt, Human
acucaucauaaaauaaaguau

SEQ ID NO: 2736643 - RNA, 15 nt, Human
acucaucauuuccau

SEQ ID NO: 2736644 - RNA, 16 nt, Human
acucaucuuucccucc

SEQ ID NO: 2736645 - RNA, 18 nt, Human
acucauuaggauggcuag

SEQ ID NO: 2736646 - RNA, 21 nt, Human
acucauuuauuuccauauuaa

SEQ ID NO: 2736647 - RNA, 14 nt, Human
acucauuuuaaaaa

SEQ ID NO: 2736648 - RNA, 15 nt, Human
acucauuuuaaaaaa

SEQ ID NO: 2736649 - RNA, 22 nt, Human
acucauuuuuguuuucauuauc

SEQ ID NO: 2736650 - RNA, 22 nt, Human
acuccaaacugacucuuaagaa

SEQ ID NO: 2736651 - RNA, 12 nt, Human
acuccaaagaaa

SEQ ID NO: 2736652 - RNA, 15 nt, Human
acuccaaagaaaugu

SEQ ID NO: 2736653 - RNA, 18 nt, Human
acuccaaagaaauguaag

SEQ ID NO: 2736654 - RNA, 20 nt, Human
acuccacuuggacaugggcc

SEQ ID NO: 2736655 - RNA, 21 nt, Human
acuccagccagggcaagagag

SEQ ID NO: 2736656 - RNA, 12 nt, Human
acuccagccuga

SEQ ID NO: 2736657 - RNA, 13 nt, Human
acuccagccugag

SEQ ID NO: 2736658 - RNA, 13 nt, Human
acuccagccuggg

SEQ ID NO: 2736659 - RNA, 17 nt, Human
acuccagugagacagcu

SEQ ID NO: 2736660 - RNA, 20 nt, Human
acuccagugagacagcucug

SEQ ID NO: 2736661 - RNA, 22 nt, Human
acuccauguuggcuagccucug

SEQ ID NO: 2736662 - RNA, 22 nt, Human
acuccauuaaauauaaagcaag

SEQ ID NO: 2736663 - RNA, 12 nt, Human
acuccccuccuu

SEQ ID NO: 2736664 - RNA, 16 nt, Human
acucccuaguuccuuc

SEQ ID NO: 2736665 - RNA, 19 nt, Human
acuccuguucaugcccaua

SEQ ID NO: 2736666 - RNA, 19 nt, Human
acuccuugauuuuagccuu

SEQ ID NO: 2736667 - RNA, 15 nt, Human
acuccuuucucaucu

SEQ ID NO: 2736668 - RNA, 14 nt, Human
acucuaagaaagaa

SEQ ID NO: 2736669 - RNA, 17 nt, Human
acucuacccauauuaca

SEQ ID NO: 2736670 - RNA, 18 nt, Human
acucuauaauguguucau

SEQ ID NO: 2736671 - RNA, 14 nt, Human
acucuauagacucu

SEQ ID NO: 2736672 - RNA, 22 nt, Human
acucucaaagcaaauaauuuuu

SEQ ID NO: 2736673 - RNA, 23 nt, Human
acucucaccauuuggauccugug

SEQ ID NO: 2736674 - RNA, 19 nt, Human
acucucaccccugcuauaa

SEQ ID NO: 2736675 - RNA, 14 nt, Human
acucucuggaagcc

SEQ ID NO: 2736676 - RNA, 21 nt, Human
acucucuuauugccucacuuc

SEQ ID NO: 2736677 - RNA, 16 nt, Human
acucugaaaguuuugg

SEQ ID NO: 2736678 - RNA, 17 nt, Human
acucugcaagaagaaau

SEQ ID NO: 2736679 - RNA, 23 nt, Human
acucugcaagaagaaaucaugau

SEQ ID NO: 2736680 - RNA, 13 nt, Human
acucugcauucua

SEQ ID NO: 2736681 - RNA, 18 nt, Human
acucuguccagccccgua

SEQ ID NO: 2736682 - RNA, 14 nt, Human
acucugucuaccug

SEQ ID NO: 2736683 - RNA, 17 nt, Human
acucuguugccaggcug

SEQ ID NO: 2736684 - RNA, 14 nt, Human
acucuguuuucuuu

SEQ ID NO: 2736685 - RNA, 21 nt, Human
acucuuaagaagacugcauua

SEQ ID NO: 2736686 - RNA, 22 nt, Human
acucuuagcuaaaucccucccc

SEQ ID NO: 2736687 - RNA, 19 nt, Human
acucuuauaucuauauuuu

SEQ ID NO: 2736688 - RNA, 12 nt, Human
acucuucugagc

SEQ ID NO: 2736689 - RNA, 18 nt, Human
acucuucuuacuggugcu

SEQ ID NO: 2736690 - RNA, 12 nt, Human
acucuugaaaaa

SEQ ID NO: 2736691 - RNA, 17 nt, Human
acucuugaaaaaugcau

SEQ ID NO: 2736692 - RNA, 16 nt, Human
acucuuguaauaaaau

SEQ ID NO: 2736693 - RNA, 15 nt, Human
acuuuuucuuuaugu

SEQ ID NO: 2736694 - RNA, 16 nt, Human
acuuuuuuuuaaguua

SEQ ID NO: 2736695 - RNA, 15 nt, Human
acuuuuuuuuuuuau

SEQ ID NO: 2736696 - RNA, 12 nt, Human
agaaaacaauaa

SEQ ID NO: 2736697 - RNA, 16 nt, Human
agaaaacaauaacgau

SEQ ID NO: 2736698 - RNA, 22 nt, Human
agaaaacaauaacgauaaaaga

SEQ ID NO: 2736699 - RNA, 20 nt, Human
agaaaaccuaagcaaacuua

SEQ ID NO: 2736700 - RNA, 13 nt, Human
agaaaauaaaucu

SEQ ID NO: 2736701 - RNA, 14 nt, Human
agaaaauaacaaua

SEQ ID NO: 2736702 - RNA, 15 nt, Human
agaaaauaacaauaa

SEQ ID NO: 2736703 - RNA, 19 nt, Human
agaaaauaacaauaaaaga

SEQ ID NO: 2736704 - RNA, 12 nt, Human
agaaaauaacga

SEQ ID NO: 2736705 - RNA, 15 nt, Human
agaaaauaacgauaa

SEQ ID NO: 2736706 - RNA, 17 nt, Human
agaaaauaacgauaaaa

SEQ ID NO: 2736707 - RNA, 17 nt, Human
agaaaauaagagcucag

SEQ ID NO: 2736708 - RNA, 16 nt, Human
agaaaaucaggcuggc

SEQ ID NO: 2736709 - RNA, 18 nt, Human
agaaaauugugcuggaaa

SEQ ID NO: 2736710 - RNA, 14 nt, Human
agaaacaaaaauca

SEQ ID NO: 2736711 - RNA, 17 nt, Human
agaaacaaaaaucaaac

SEQ ID NO: 2736712 - RNA, 19 nt, Human
agaaacaaaaaucaaacuu

SEQ ID NO: 2736713 - RNA, 18 nt, Human
agaaacacaacuauauug

SEQ ID NO: 2736714 - RNA, 19 nt, Human
agaaacaucaguuacucug

SEQ ID NO: 2736715 - RNA, 15 nt, Human
agaaacauuuaucuu

SEQ ID NO: 2736716 - RNA, 15 nt, Human
agaaacccugcaccc

SEQ ID NO: 2736717 - RNA, 22 nt, Human
agaaaccuuauuguaccucucu

SEQ ID NO: 2736718 - RNA, 17 nt, Human
agaaacguguauauuuu

SEQ ID NO: 2736719 - RNA, 13 nt, Human
agaaagaaaauca

SEQ ID NO: 2736720 - RNA, 16 nt, Human
agaaagacuauucaaa

SEQ ID NO: 2736721 - RNA, 17 nt, Human
agaaagacuauucaaac

SEQ ID NO: 2736722 - RNA, 19 nt, Human
agaaagacuauucaaacag

SEQ ID NO: 2736723 - RNA, 18 nt, Human
agaaagcaguugagacaa

SEQ ID NO: 2736724 - RNA, 21 nt, Human
agaaagcaguugagacaagaa

SEQ ID NO: 2736725 - RNA, 17 nt, Human
agaaaggccagcaaauu

SEQ ID NO: 2736726 - RNA, 21 nt, Human
agaaagucuuauuuauucaua

SEQ ID NO: 2736727 - RNA, 22 nt, Human
agaaagugacaagcucacagac

SEQ ID NO: 2736728 - RNA, 15 nt, Human
agaaauaaaguuggu

SEQ ID NO: 2736729 - RNA, 14 nt, Human
agaaauaggaaaua

SEQ ID NO: 2736730 - RNA, 22 nt, Human
agaaauaggaaauauuuuaaug

SEQ ID NO: 2736731 - RNA, 17 nt, Human
agaaauaucuucacuug

SEQ ID NO: 2736732 - RNA, 18 nt, Human
agaaauaucuucacuugu

SEQ ID NO: 2736733 - RNA, 14 nt, Human
agaaaugaaaaaau

SEQ ID NO: 2736734 - RNA, 14 nt, Human
agaaaugaaagcag

SEQ ID NO: 2736735 - RNA, 18 nt, Human
agaaaugcugguuuuuca

SEQ ID NO: 2736736 - RNA, 17 nt, Human
agaaauuaugugccaga

SEQ ID NO: 2736737 - RNA, 17 nt, Human
agaaauuccaggaaaau

SEQ ID NO: 2736738 - RNA, 18 nt, Human
agaaauuuauaaacuuuu

SEQ ID NO: 2736739 - RNA, 12 nt, Human
agaaauuuuugc

SEQ ID NO: 2736740 - RNA, 19 nt, Human
agaacaagcaaauauaaac

SEQ ID NO: 2736741 - RNA, 20 nt, Human
agaacacgcucucuccaggc

SEQ ID NO: 2736742 - RNA, 21 nt, Human
agaacaucccuccugggaaug

SEQ ID NO: 2736743 - RNA, 18 nt, Human
agaaccuaaguuucaguu

SEQ ID NO: 2736744 - RNA, 16 nt, Human
agaacuaaaaauuaaa

SEQ ID NO: 2736745 - RNA, 18 nt, Human
agaacuauggaaaaaaag

SEQ ID NO: 2736746 - RNA, 23 nt, Human
agaacucaucuagguaaauuaca

SEQ ID NO: 2736747 - RNA, 23 nt, Human
agaacuuauuuguacauuuuuuu

SEQ ID NO: 2736748 - RNA, 15 nt, Human
agaacuucaagcucu

SEQ ID NO: 2736749 - RNA, 16 nt, Human
agaacuuggaaauagu

SEQ ID NO: 2736750 - RNA, 15 nt, Human
agaagaacugaaauc

SEQ ID NO: 2736751 - RNA, 20 nt, Human
agaagaacugaaaucauacu

SEQ ID NO: 2736752 - RNA, 13 nt, Human
agaagaaggaaau

SEQ ID NO: 2736753 - RNA, 14 nt, Human
agaagaagguggga

SEQ ID NO: 2736754 - RNA, 14 nt, Human
agaagaaugacuau

SEQ ID NO: 2736755 - RNA, 17 nt, Human
agaagagccggagccuc

SEQ ID NO: 2736756 - RNA, 22 nt, Human
agaagagccggagccuccagcu

SEQ ID NO: 2736757 - RNA, 18 nt, Human
agaagcaacccaaauguu

SEQ ID NO: 2736758 - RNA, 22 nt, Human
agaagcaccaaucaugaauuag

SEQ ID NO: 2736759 - RNA, 20 nt, Human
agaagcccaauauuauaauu

SEQ ID NO: 2736760 - RNA, 17 nt, Human
agaaggauguacauuuc

SEQ ID NO: 2736761 - RNA, 21 nt, Human
agaaggugggaggaugugaau

SEQ ID NO: 2736762 - RNA, 13 nt, Human
agaaguaaaaaca

SEQ ID NO: 2736763 - RNA, 14 nt, Human
agaaguaaaaacac

SEQ ID NO: 2736764 - RNA, 16 nt, Human
agaagucugcuacccu

SEQ ID NO: 2736765 - RNA, 17 nt, Human
agaagucugcuacccuc

SEQ ID NO: 2736766 - RNA, 14 nt, Human
agaagugaaaaucu

SEQ ID NO: 2736767 - RNA, 13 nt, Human
agaaguugauaug

SEQ ID NO: 2736768 - RNA, 17 nt, Human
agaauaaggaacaacgu

SEQ ID NO: 2736769 - RNA, 15 nt, Human
agaauaccacaggaa

SEQ ID NO: 2736770 - RNA, 12 nt, Human
agaauauauuuc

SEQ ID NO: 2736771 - RNA, 16 nt, Human
agaauauauuuccuua

SEQ ID NO: 2736772 - RNA, 13 nt, Human
agaauauuaaaaa

SEQ ID NO: 2736773 - RNA, 15 nt, Human
agaauauuaaaaauu

SEQ ID NO: 2736774 - RNA, 14 nt, Human
agaauauuagcuuu

SEQ ID NO: 2736775 - RNA, 13 nt, Human
agaauauuuauua

SEQ ID NO: 2736776 - RNA, 16 nt, Human
agaaucacuugaaccc

SEQ ID NO: 2736777 - RNA, 17 nt, Human
agaaucacuugaacccg

SEQ ID NO: 2736778 - RNA, 20 nt, Human
agaaucaugcugagagagcu

SEQ ID NO: 2736779 - RNA, 12 nt, Human
agaaucuagagc

SEQ ID NO: 2736780 - RNA, 23 nt, Human
agaaugagaagaaugacuaugca

SEQ ID NO: 2736781 - RNA, 23 nt, Human
agaaugagagacacacugaagaa

SEQ ID NO: 2736782 - RNA, 18 nt, Human
agaaugauuaugaauuac

SEQ ID NO: 2736783 - RNA, 22 nt, Human
agaauggaacucaaggaaaucu

SEQ ID NO: 2736784 - RNA, 20 nt, Human
agaaugggaugaucauguau

SEQ ID NO: 2736785 - RNA, 17 nt, Human
agaaugggggcagcacc

SEQ ID NO: 2736786 - RNA, 15 nt, Human
agaaugguaucaaua

SEQ ID NO: 2736787 - RNA, 16 nt, Human
agaaugguaucaauaa

SEQ ID NO: 2736788 - RNA, 21 nt, Human
agaauuauaacuggaaagaag

SEQ ID NO: 2736789 - RNA, 14 nt, Human
agaauucauucacu

SEQ ID NO: 2736790 - RNA, 13 nt, Human
agaauucugcuac

SEQ ID NO: 2736791 - RNA, 21 nt, Human
agaauucuguugauggaaaua

SEQ ID NO: 2736792 - RNA, 17 nt, Human
agaauugcuugaaccca

SEQ ID NO: 2736793 - RNA, 13 nt, Human
agaauuuauucaa

SEQ ID NO: 2736794 - RNA, 15 nt, Human
agaauuucuaaaagu

SEQ ID NO: 2736795 - RNA, 18 nt, Human
agaauuucuaaaaguuua

SEQ ID NO: 2736796 - RNA, 20 nt, Human
agaauuucuuuaacuuaauu

SEQ ID NO: 2736797 - RNA, 14 nt, Human
agaauuugauaugu

SEQ ID NO: 2736798 - RNA, 15 nt, Human
agacaaaacuagaga

SEQ ID NO: 2736799 - RNA, 17 nt, Human
agacaaauggaggccug

SEQ ID NO: 2736800 - RNA, 16 nt, Human
agacaagaaaauaaga

SEQ ID NO: 2736801 - RNA, 21 nt, Human
agacaagaaggaaagauuuug

SEQ ID NO: 2736802 - RNA, 15 nt, Human
agacaaggaaaaaau

SEQ ID NO: 2736803 - RNA, 17 nt, Human
agacaaggaaaaaauaa

SEQ ID NO: 2736804 - RNA, 20 nt, Human
agacaaggaaaaaauaacaa

SEQ ID NO: 2736805 - RNA, 17 nt, Human
agacaauauaaugaagu

SEQ ID NO: 2736806 - RNA, 22 nt, Human
agacaauuguuggagagccccu

SEQ ID NO: 2736807 - RNA, 13 nt, Human
agacacaaauaaa

SEQ ID NO: 2736808 - RNA, 12 nt, Human
agacacacauga

SEQ ID NO: 2736809 - RNA, 17 nt, Human
agacacacugaagaagc

SEQ ID NO: 2736810 - RNA, 13 nt, Human
agacacagugacc

SEQ ID NO: 2736811 - RNA, 11 nt, Human
agacacaugug

SEQ ID NO: 2736812 - RNA, 12 nt, Human
agacaccaccac

SEQ ID NO: 2736813 - RNA, 18 nt, Human
agacacugaucuggcugc

SEQ ID NO: 2736814 - RNA, 20 nt, Human
agacacugaucuggcugcag

SEQ ID NO: 2736815 - RNA, 22 nt, Human
agacacugucucuaccaaaaaa

SEQ ID NO: 2736816 - RNA, 12 nt, Human
agacagaaaaaa

SEQ ID NO: 2736817 - RNA, 12 nt, Human
agacagcagguc

SEQ ID NO: 2736818 - RNA, 13 nt, Human
agacagcucugca

SEQ ID NO: 2736819 - RNA, 15 nt, Human
agacagcucugcaua

SEQ ID NO: 2736820 - RNA, 19 nt, Human
agacagggaaagggucucc

SEQ ID NO: 2736821 - RNA, 12 nt, Human
agacagugaaag

SEQ ID NO: 2736822 - RNA, 13 nt, Human
agacagugaaaga

SEQ ID NO: 2736823 - RNA, 17 nt, Human
agacagugaaagaaaau

SEQ ID NO: 2736824 - RNA, 20 nt, Human
agacagugaaagaaaauaac

SEQ ID NO: 2736825 - RNA, 17 nt, Human
agacauagaauaguguu

SEQ ID NO: 2736826 - RNA, 17 nt, Human
agacaucaacagauaaa

SEQ ID NO: 2736827 - RNA, 12 nt, Human
agacaucuggaa

SEQ ID NO: 2736828 - RNA, 21 nt, Human
agacaugagagacagcagguc

SEQ ID NO: 2736829 - RNA, 18 nt, Human
agacauugaggcaggcac

SEQ ID NO: 2736830 - RNA, 22 nt, Human
agaccaaauugagcuagggggg

SEQ ID NO: 2736831 - RNA, 15 nt, Human
agaccaccaagccuu

SEQ ID NO: 2736832 - RNA, 16 nt, Human
agaccaccaagccuug

SEQ ID NO: 2736833 - RNA, 18 nt, Human
agaccagcaggcuggccu

SEQ ID NO: 2736834 - RNA, 12 nt, Human
agaccagccaac

SEQ ID NO: 2736835 - RNA, 14 nt, Human
agaccagccaaccu

SEQ ID NO: 2736836 - RNA, 20 nt, Human
agaccagccaaccugggggc

SEQ ID NO: 2736837 - RNA, 23 nt, Human
agaccauaauguuacauuauuau

SEQ ID NO: 2736838 - RNA, 13 nt, Human
agaccauuuuucc

SEQ ID NO: 2736839 - RNA, 18 nt, Human
agauugugucccauuccc

SEQ ID NO: 2736840 - RNA, 14 nt, Human
agauuuaccacuug

SEQ ID NO: 2736841 - RNA, 12 nt, Human
agauuucaaaaa

SEQ ID NO: 2736842 - RNA, 14 nt, Human
agauuucaaaaaaa

SEQ ID NO: 2736843 - RNA, 15 nt, Human
agauuucaaaaaaaa

SEQ ID NO: 2736844 - RNA, 21 nt, Human
agauuuccuucuuuuuuucuu

SEQ ID NO: 2736845 - RNA, 19 nt, Human
agauuugagcucagcccug

SEQ ID NO: 2736846 - RNA, 13 nt, Human
agauuugugugca

SEQ ID NO: 2736847 - RNA, 19 nt, Human
agauuugugugcaucaggc

SEQ ID NO: 2736848 - RNA, 21 nt, Human
agauuuuccugaaaacccuug

SEQ ID NO: 2736849 - RNA, 20 nt, Human
agauuuuuaaauaaagaauu

SEQ ID NO: 2736850 - RNA, 14 nt, Human
agauuuuucaugau

SEQ ID NO: 2736851 - RNA, 19 nt, Human
agcaaaaaaguacuuaaaa

SEQ ID NO: 2736852 - RNA, 18 nt, Human
agcaaaauuuuuucucua

SEQ ID NO: 2736853 - RNA, 21 nt, Human
agcaacccaaauguucaucaa

SEQ ID NO: 2736854 - RNA, 23 nt, Human
agcaacguggcuuuuuuuuuuuc

SEQ ID NO: 2736855 - RNA, 20 nt, Human
agcaacuuguguuccuaaca

SEQ ID NO: 2736856 - RNA, 14 nt, Human
agcaagauaauaaa

SEQ ID NO: 2736857 - RNA, 18 nt, Human
agcaagggugaugggaaa

SEQ ID NO: 2736858 - RNA, 14 nt, Human
agcaaguauuagaa

SEQ ID NO: 2736859 - RNA, 15 nt, Human
agcaaguauuagaau

SEQ ID NO: 2736860 - RNA, 14 nt, Human
agcaagucaggguu

SEQ ID NO: 2736861 - RNA, 15 nt, Human
agcaagucaggguug

SEQ ID NO: 2736862 - RNA, 14 nt, Human
agcaaguccuuccc

SEQ ID NO: 2736863 - RNA, 20 nt, Human
agcaagugaauuuuucucua

SEQ ID NO: 2736864 - RNA, 23 nt, Human
agcaauccucccacuucagccuc

SEQ ID NO: 2736865 - RNA, 15 nt, Human
agcaaugccugccca

SEQ ID NO: 2736866 - RNA, 17 nt, Human
agcaaugcuucaucccu

SEQ ID NO: 2736867 - RNA, 15 nt, Human
agcaccaucauuccc

SEQ ID NO: 2736868 - RNA, 19 nt, Human
agcacccucuccagaugag

SEQ ID NO: 2736869 - RNA, 18 nt, Human
agcacccucuccagaugg

SEQ ID NO: 2736870 - RNA, 18 nt, Human
agcacgggggccaaggau

SEQ ID NO: 2736871 - RNA, 17 nt, Human
agcacgugguaaaacac

SEQ ID NO: 2736872 - RNA, 19 nt, Human
agcacgugguaaaacacuu

SEQ ID NO: 2736873 - RNA, 17 nt, Human
agcacuguuuggauaug

SEQ ID NO: 2736874 - RNA, 14 nt, Human
agcacuuggagcca

SEQ ID NO: 2736875 - RNA, 16 nt, Human
agcagaagagaaaaug

SEQ ID NO: 2736876 - RNA, 19 nt, Human
agcagagggaucaagcagu

SEQ ID NO: 2736877 - RNA, 21 nt, Human
agcagcaucucugaacauuuc

SEQ ID NO: 2736878 - RNA, 14 nt, Human
agcagccagcucuc

SEQ ID NO: 2736879 - RNA, 19 nt, Human
agcagccagcucucagcca

SEQ ID NO: 2736880 - RNA, 20 nt, Human
agcagcccuuagcccuuccc

SEQ ID NO: 2736881 - RNA, 23 nt, Human
agcagcccuuagcccuuccccuc

SEQ ID NO: 2736882 - RNA, 15 nt, Human
agcagcugcaggggc

SEQ ID NO: 2736883 - RNA, 21 nt, Human
agcagcuuauucacaagaccc

SEQ ID NO: 2736884 - RNA, 23 nt, Human
agcagcuuauucacaagacccaa

SEQ ID NO: 2736885 - RNA, 20 nt, Human
agcaggauuagauaaggcug

SEQ ID NO: 2736886 - RNA, 17 nt, Human
agcagggacuugaaccc

SEQ ID NO: 2736887 - RNA, 18 nt, Human
agcagggacuugaaccca

SEQ ID NO: 2736888 - RNA, 18 nt, Human
agcaggggugcugggacc

SEQ ID NO: 2736889 - RNA, 20 nt, Human
agcaggggugcugggaccug

SEQ ID NO: 2736890 - RNA, 19 nt, Human
agcaggguugguuucccuu

SEQ ID NO: 2736891 - RNA, 12 nt, Human
agcaguaacuga

SEQ ID NO: 2736892 - RNA, 17 nt, Human
agcagucaggaaagaga

SEQ ID NO: 2736893 - RNA, 15 nt, Human
agcagucccuccaca

SEQ ID NO: 2736894 - RNA, 20 nt, Human
agcagugagccaaauguaaa

SEQ ID NO: 2736895 - RNA, 15 nt, Human
agcagugccaaaaua

SEQ ID NO: 2736896 - RNA, 17 nt, Human
agcagugcuugaaugaa

SEQ ID NO: 2736897 - RNA, 14 nt, Human
agcaguggacacca

SEQ ID NO: 2736898 - RNA, 18 nt, Human
agcaguucagagcugccc

SEQ ID NO: 2736899 - RNA, 20 nt, Human
agcaguucagagcugcccuc

SEQ ID NO: 2736900 - RNA, 13 nt, Human
agcauaauacuug

SEQ ID NO: 2736901 - RNA, 19 nt, Human
agcauaguaccucugcuau

SEQ ID NO: 2736902 - RNA, 23 nt, Human
agcauaucugccuuuauuguguu

SEQ ID NO: 2736903 - RNA, 16 nt, Human
agcauauguuuuugua

SEQ ID NO: 2736904 - RNA, 22 nt, Human
agcauauguuuuuguaaguuua

SEQ ID NO: 2736905 - RNA, 15 nt, Human
agcaucucugaacau

SEQ ID NO: 2736906 - RNA, 14 nt, Human
agcaugggaaguga

SEQ ID NO: 2736907 - RNA, 17 nt, Human
agcaugggccuagccca

SEQ ID NO: 2736908 - RNA, 23 nt, Human
agcaugucgucaaagcugaaaug

SEQ ID NO: 2736909 - RNA, 21 nt, Human
agcauuacagugggugccccc

SEQ ID NO: 2736910 - RNA, 11 nt, Human
agcauuauuau

SEQ ID NO: 2736911 - RNA, 15 nt, Human
agcauuccaacuauc

SEQ ID NO: 2736912 - RNA, 16 nt, Human
agcauuccaacuaucu

SEQ ID NO: 2736913 - RNA, 16 nt, Human
agcauucugucuugaa

SEQ ID NO: 2736914 - RNA, 16 nt, Human
agcauuguaaaugugc

SEQ ID NO: 2736915 - RNA, 13 nt, Human
agcauuuauaaau

SEQ ID NO: 2736916 - RNA, 17 nt, Human
agcauuuauaaauggac

SEQ ID NO: 2736917 - RNA, 15 nt, Human
agcauuugaaugcau

SEQ ID NO: 2736918 - RNA, 21 nt, Human
agcauuugucaacaaagucac

SEQ ID NO: 2736919 - RNA, 21 nt, Human
agccaaaagauuggauacgca

SEQ ID NO: 2736920 - RNA, 13 nt, Human
agccaaaccagga

SEQ ID NO: 2736921 - RNA, 17 nt, Human
agccaauauuuuucuua

SEQ ID NO: 2736922 - RNA, 19 nt, Human
agccaaucaguagccagca

SEQ ID NO: 2736923 - RNA, 16 nt, Human
agccaccaaacccggc

SEQ ID NO: 2736924 - RNA, 14 nt, Human
agccacccugccca

SEQ ID NO: 2736925 - RNA, 20 nt, Human
agccacggggacucagcccu

SEQ ID NO: 2736926 - RNA, 18 nt, Human
agccacggugcccggccc

SEQ ID NO: 2736927 - RNA, 11 nt, Human
agccagacauc

SEQ ID NO: 2736928 - RNA, 14 nt, Human
agccagacaucaac

SEQ ID NO: 2736929 - RNA, 12 nt, Human
agccagaggcuc

SEQ ID NO: 2736930 - RNA, 19 nt, Human
agccagaggcucuaaugua

SEQ ID NO: 2736931 - RNA, 14 nt, Human
agccagauuuuccu

SEQ ID NO: 2736932 - RNA, 15 nt, Human
agccagauuuuccug

SEQ ID NO: 2736933 - RNA, 11 nt, Human
agccagcagcc

SEQ ID NO: 2736934 - RNA, 14 nt, Human
agccagcaguucag

SEQ ID NO: 2736935 - RNA, 19 nt, Human
agccagcaguucagagcug

SEQ ID NO: 2736936 - RNA, 14 nt, Human
agccagcugccccc

SEQ ID NO: 2736937 - RNA, 17 nt, Human
agccaggagcugggcag

SEQ ID NO: 2736938 - RNA, 14 nt, Human
agccaggcccagag

SEQ ID NO: 2736939 - RNA, 11 nt, Human
agccagggcug

SEQ ID NO: 2736940 - RNA, 17 nt, Human
agccagguaccuucuca

SEQ ID NO: 2736941 - RNA, 19 nt, Human
agccagugaccaaccuuuu

SEQ ID NO: 2736942 - RNA, 12 nt, Human
agcccaaacugc

SEQ ID NO: 2736943 - RNA, 15 nt, Human
agcccacacauggga

SEQ ID NO: 2736944 - RNA, 17 nt, Human
agcccacuggcucccug

SEQ ID NO: 2736945 - RNA, 16 nt, Human
agcccagagacagcuu

SEQ ID NO: 2736946 - RNA, 13 nt, Human
agcccagcuugaa

SEQ ID NO: 2736947 - RNA, 23 nt, Human
agccccaaguggaacgagacaag

SEQ ID NO: 2736948 - RNA, 16 nt, Human
agccccacccucagau

SEQ ID NO: 2736949 - RNA, 11 nt, Human
agccccaggcg

SEQ ID NO: 2736950 - RNA, 22 nt, Human
agccccaggcggguccgggucg

SEQ ID NO: 2736951 - RNA, 20 nt, Human
agccccaucuccucagcacc

SEQ ID NO: 2736952 - RNA, 14 nt, Human
agcccucccuaccu

SEQ ID NO: 2736953 - RNA, 20 nt, Human
agcccuccuuaucaaaggac

SEQ ID NO: 2736954 - RNA, 22 nt, Human
agcccuccuuaucaaaggacac

SEQ ID NO: 2736955 - RNA, 14 nt, Human
agcccucuucugac

SEQ ID NO: 2736956 - RNA, 12 nt, Human
agcccugcacca

SEQ ID NO: 2736957 - RNA, 16 nt, Human
agcccugcaccaugcu

SEQ ID NO: 2736958 - RNA, 17 nt, Human
agcccugcaccaugcug

SEQ ID NO: 2736959 - RNA, 19 nt, Human
agcccugcaccaugcugcu

SEQ ID NO: 2736960 - RNA, 20 nt, Human
agcccugcaccaugcugcug

SEQ ID NO: 2736961 - RNA, 18 nt, Human
agcccugggaggcucugg

SEQ ID NO: 2736962 - RNA, 17 nt, Human
agcccuguaacaggcuu

SEQ ID NO: 2736963 - RNA, 12 nt, Human
agcccugucucc

SEQ ID NO: 2736964 - RNA, 20 nt, Human
agcccugucuccucucucug

SEQ ID NO: 2736965 - RNA, 20 nt, Human
agcccuuccccucugcagcu

SEQ ID NO: 2736966 - RNA, 18 nt, Human
agcccuuuugucucugca

SEQ ID NO: 2736967 - RNA, 18 nt, Human
agccgcuccugucugcca

SEQ ID NO: 2736968 - RNA, 19 nt, Human
agccgcuccugucugccag

SEQ ID NO: 2736969 - RNA, 15 nt, Human
agccggagccccuug

SEQ ID NO: 2736970 - RNA, 16 nt, Human
agccggagccuccagc

SEQ ID NO: 2736971 - RNA, 18 nt, Human
agccggagccuccagcug

SEQ ID NO: 2736972 - RNA, 18 nt, Human
agccgggaaagaagagcc

SEQ ID NO: 2736973 - RNA, 21 nt, Human
agccuacaggccucacacaca

SEQ ID NO: 2736974 - RNA, 22 nt, Human
agccuacaggccucacacacaa

SEQ ID NO: 2736975 - RNA, 16 nt, Human
agccuacuaaaugcuc

SEQ ID NO: 2736976 - RNA, 19 nt, Human
agccuagccgaccucagcc

SEQ ID NO: 2736977 - RNA, 16 nt, Human
agccuaguugaucagc

SEQ ID NO: 2736978 - RNA, 15 nt, Human
agccucagccuccca

SEQ ID NO: 2736979 - RNA, 13 nt, Human
agccucagucucc

SEQ ID NO: 2736980 - RNA, 16 nt, Human
agccucagucucccuc

SEQ ID NO: 2736981 - RNA, 22 nt, Human
agccucauguccacugguucuu

SEQ ID NO: 2736982 - RNA, 13 nt, Human
agccuccagcugc

SEQ ID NO: 2736983 - RNA, 14 nt, Human
agccuccagcugcc

SEQ ID NO: 2736984 - RNA, 15 nt, Human
agccuccagcugccc

SEQ ID NO: 2736985 - RNA, 17 nt, Human
agcuucacuguaaaaua

SEQ ID NO: 2736986 - RNA, 20 nt, Human
agcuucacuguaaaauaaua

SEQ ID NO: 2736987 - RNA, 16 nt, Human
agcuuccaggcuggcg

SEQ ID NO: 2736988 - RNA, 23 nt, Human
agcuuccauuccaagccugacca

SEQ ID NO: 2736989 - RNA, 12 nt, Human
agcuucuccaac

SEQ ID NO: 2736990 - RNA, 12 nt, Human
agcuucuguucc

SEQ ID NO: 2736991 - RNA, 16 nt, Human
agcuugaaaccuucac

SEQ ID NO: 2736992 - RNA, 19 nt, Human
agcuugaaacugagaugug

SEQ ID NO: 2736993 - RNA, 14 nt, Human
agcuugcagagaug

SEQ ID NO: 2736994 - RNA, 16 nt, Human
agcuuggaaaggacca

SEQ ID NO: 2736995 - RNA, 17 nt, Human
agcuuggaaaggaccag

SEQ ID NO: 2736996 - RNA, 12 nt, Human
agcuuggaaugu

SEQ ID NO: 2736997 - RNA, 22 nt, Human
agcuuguauuccuuuuucucuc

SEQ ID NO: 2736998 - RNA, 21 nt, Human
agcuuguccaacccgaggccc

SEQ ID NO: 2736999 - RNA, 13 nt, Human
agcuuuccucaaa

SEQ ID NO: 2737000 - RNA, 19 nt, Human
agcuuuccucaaaacuuca

SEQ ID NO: 2737001 - RNA, 12 nt, Human
agcuuucuuccu

SEQ ID NO: 2737002 - RNA, 10 nt, Human
agcuuugagg

SEQ ID NO: 2737003 - RNA, 18 nt, Human
agcuuugugcagauucuu

SEQ ID NO: 2737004 - RNA, 23 nt, Human
agcuuuguucuucuuaaagucaa

SEQ ID NO: 2737005 - RNA, 15 nt, Human
agcuuuuaugugaaa

SEQ ID NO: 2737006 - RNA, 14 nt, Human
agcuuuucaaaauu

SEQ ID NO: 2737007 - RNA, 12 nt, Human
agcuuuuuucuc

SEQ ID NO: 2737008 - RNA, 12 nt, Human
agcuuuuuuuga

SEQ ID NO: 2737009 - RNA, 23 nt, Human
agcuuuuuuuuuuuuucuuaaag

SEQ ID NO: 2737010 - RNA, 13 nt, Human
aggaaaaaauaac

SEQ ID NO: 2737011 - RNA, 18 nt, Human
aggaaaagggcuuucuca

SEQ ID NO: 2737012 - RNA, 12 nt, Human
aggaaaauggac

SEQ ID NO: 2737013 - RNA, 17 nt, Human
aggaaaaugggcuuugg

SEQ ID NO: 2737014 - RNA, 16 nt, Human
aggaaagaaaauaaau

SEQ ID NO: 2737015 - RNA, 21 nt, Human
aggaaagaugugaauaggcug

SEQ ID NO: 2737016 - RNA, 18 nt, Human
aggaaagcauguauucag

SEQ ID NO: 2737017 - RNA, 23 nt, Human
aggaaagucauuggcuuuauccu

SEQ ID NO: 2737018 - RNA, 12 nt, Human
aggaaauauuuu

SEQ ID NO: 2737019 - RNA, 15 nt, Human
aggaaaucaaauaug

SEQ ID NO: 2737020 - RNA, 18 nt, Human
aggaaaugcuccuccagg

SEQ ID NO: 2737021 - RNA, 21 nt, Human
aggaaaugcuccuccagggag

SEQ ID NO: 2737022 - RNA, 15 nt, Human
aggaacaaacagggc

SEQ ID NO: 2737023 - RNA, 17 nt, Human
aggaacaaacagggcug

SEQ ID NO: 2737024 - RNA, 14 nt, Human
aggaacuccagaga

SEQ ID NO: 2737025 - RNA, 18 nt, Human
aggaagaaauuccaggaa

SEQ ID NO: 2737026 - RNA, 14 nt, Human
aggaagaaggaaaa

SEQ ID NO: 2737027 - RNA, 14 nt, Human
aggaaggaaagaug

SEQ ID NO: 2737028 - RNA, 21 nt, Human
aggaaggaaagaugugaauag

SEQ ID NO: 2737029 - RNA, 18 nt, Human
aggaaggcuuacacccac

SEQ ID NO: 2737030 - RNA, 21 nt, Human
aggaagggacacauaucaaac

SEQ ID NO: 2737031 - RNA, 22 nt, Human
aggaauccucugugucuucaaa

SEQ ID NO: 2737032 - RNA, 16 nt, Human
aggaaugaaguacuca

SEQ ID NO: 2737033 - RNA, 18 nt, Human
aggaaugaaguacucaua

SEQ ID NO: 2737034 - RNA, 15 nt, Human
aggaauuuaaaaauc

SEQ ID NO: 2737035 - RNA, 17 nt, Human
aggaauuuaaaaauccu

SEQ ID NO: 2737036 - RNA, 14 nt, Human
aggacaaaaggaau

SEQ ID NO: 2737037 - RNA, 15 nt, Human
aggacacugauaugg

SEQ ID NO: 2737038 - RNA, 17 nt, Human
aggacacugauaugggu

SEQ ID NO: 2737039 - RNA, 23 nt, Human
aggaccggccuuugcaccuccau

SEQ ID NO: 2737040 - RNA, 16 nt, Human
aggaccugacuauuga

SEQ ID NO: 2737041 - RNA, 15 nt, Human
aggacgcccucacug

SEQ ID NO: 2737042 - RNA, 15 nt, Human
aggacgcucucuggc

SEQ ID NO: 2737043 - RNA, 23 nt, Human
aggacgggccacacguggcuggc

SEQ ID NO: 2737044 - RNA, 13 nt, Human
aggacuagggcug

SEQ ID NO: 2737045 - RNA, 15 nt, Human
aggacuagggcugga

SEQ ID NO: 2737046 - RNA, 13 nt, Human
aggacuguagaaa

SEQ ID NO: 2737047 - RNA, 22 nt, Human
aggagacaaaacuagagacuca

SEQ ID NO: 2737048 - RNA, 15 nt, Human
aggagaccuacccuc

SEQ ID NO: 2737049 - RNA, 11 nt, Human
aggagaggagu

SEQ ID NO: 2737050 - RNA, 20 nt, Human
aggagauggaaguugcagug

SEQ ID NO: 2737051 - RNA, 15 nt, Human
aggagcccugggagg

SEQ ID NO: 2737052 - RNA, 13 nt, Human
aggagcucccagg

SEQ ID NO: 2737053 - RNA, 13 nt, Human
aggagcuggaaac

SEQ ID NO: 2737054 - RNA, 14 nt, Human
aggagcuggaaaca

SEQ ID NO: 2737055 - RNA, 23 nt, Human
aggagcuguugagguaccuccaa

SEQ ID NO: 2737056 - RNA, 23 nt, Human
aggaggaucacuuuaggccuggu

SEQ ID NO: 2737057 - RNA, 19 nt, Human
aggaggcaaauaucuugaa

SEQ ID NO: 2737058 - RNA, 13 nt, Human
aggaggcugagag

SEQ ID NO: 2737059 - RNA, 16 nt, Human
aggaggcugagagccc

SEQ ID NO: 2737060 - RNA, 19 nt, Human
aggaggguuagggaggggu

SEQ ID NO: 2737061 - RNA, 11 nt, Human
aggaguacacc

SEQ ID NO: 2737062 - RNA, 18 nt, Human
aggaguacaccccaacag

SEQ ID NO: 2737063 - RNA, 20 nt, Human
aggaguacaccccaacagca

SEQ ID NO: 2737064 - RNA, 15 nt, Human
aggaguauccucuug

SEQ ID NO: 2737065 - RNA, 20 nt, Human
aggaguggguugauuucagc

SEQ ID NO: 2737066 - RNA, 18 nt, Human
aggagugugaagcaagga

SEQ ID NO: 2737067 - RNA, 11 nt, Human
aggaguuuggc

SEQ ID NO: 2737068 - RNA, 20 nt, Human
aggauaaaguugguaaaccu

SEQ ID NO: 2737069 - RNA, 19 nt, Human
aggauaccauauacagcuc

SEQ ID NO: 2737070 - RNA, 23 nt, Human
aggauaccauauacagcucagaa

SEQ ID NO: 2737071 - RNA, 21 nt, Human
aggauauccucccuccagaua

SEQ ID NO: 2737072 - RNA, 17 nt, Human
aggaucguuuuuuccca

SEQ ID NO: 2737073 - RNA, 14 nt, Human
aggaugagggaaaa

SEQ ID NO: 2737074 - RNA, 19 nt, Human
aggaugagggaaaagaaaa

SEQ ID NO: 2737075 - RNA, 11 nt, Human
aggaugaugac

SEQ ID NO: 2737076 - RNA, 16 nt, Human
aggaugaugacuaugg

SEQ ID NO: 2737077 - RNA, 14 nt, Human
aggauggcaggagg

SEQ ID NO: 2737078 - RNA, 15 nt, Human
aggauggcaggaggc

SEQ ID NO: 2737079 - RNA, 11 nt, Human
aggauggcuag

SEQ ID NO: 2737080 - RNA, 22 nt, Human
aggauggcuaguaucaaaagaa

SEQ ID NO: 2737081 - RNA, 18 nt, Human
aggaugggaacaaggaag

SEQ ID NO: 2737082 - RNA, 21 nt, Human
aggaugggaacaaggaaggaa

SEQ ID NO: 2737083 - RNA, 22 nt, Human
aggaugguucccuugaugaaga

SEQ ID NO: 2737084 - RNA, 14 nt, Human
aggaugucugccac

SEQ ID NO: 2737085 - RNA, 20 nt, Human
aggauguggaaaccuccuuc

SEQ ID NO: 2737086 - RNA, 13 nt, Human
aggauugggaaaa

SEQ ID NO: 2737087 - RNA, 18 nt, Human
aggauuuauguuuaauuc

SEQ ID NO: 2737088 - RNA, 23 nt, Human
aggauuuauguuuaauucugaaa

SEQ ID NO: 2737089 - RNA, 19 nt, Human
aggauuuugaggguggggg

SEQ ID NO: 2737090 - RNA, 18 nt, Human
aggcaaaaggaagcaggg

SEQ ID NO: 2737091 - RNA, 22 nt, Human
aggcaacugaggcagacagcag

SEQ ID NO: 2737092 - RNA, 18 nt, Human
aggcacacaccaccacgc

SEQ ID NO: 2737093 - RNA, 15 nt, Human
aggcacacugagcca

SEQ ID NO: 2737094 - RNA, 18 nt, Human
aggcacacugagccagca

SEQ ID NO: 2737095 - RNA, 16 nt, Human
aggcacacuucuucuu

SEQ ID NO: 2737096 - RNA, 22 nt, Human
aggcacaguggcucacaccugu

SEQ ID NO: 2737097 - RNA, 17 nt, Human
aggcaccugucccagaa

SEQ ID NO: 2737098 - RNA, 15 nt, Human
aggcacuaucugggu

SEQ ID NO: 2737099 - RNA, 19 nt, Human
aggcagaagcaacccaaau

SEQ ID NO: 2737100 - RNA, 21 nt, Human
aggcagacagcagcucaggca

SEQ ID NO: 2737101 - RNA, 16 nt, Human
aggcagaccugacucu

SEQ ID NO: 2737102 - RNA, 21 nt, Human
aggcagagguugcagugagcc

SEQ ID NO: 2737103 - RNA, 13 nt, Human
aggcagccugccu

SEQ ID NO: 2737104 - RNA, 14 nt, Human
aggcagccugccuu

SEQ ID NO: 2737105 - RNA, 21 nt, Human
aggcagcuuuuucucucccac

SEQ ID NO: 2737106 - RNA, 17 nt, Human
aggcaggaggaucacuu

SEQ ID NO: 2737107 - RNA, 16 nt, Human
aggcaggcacugccaa

SEQ ID NO: 2737108 - RNA, 17 nt, Human
aggcagggucaggagag

SEQ ID NO: 2737109 - RNA, 19 nt, Human
aggcaggucugaagcucaa

SEQ ID NO: 2737110 - RNA, 13 nt, Human
aggcauagcccug

SEQ ID NO: 2737111 - RNA, 18 nt, Human
aggcauagcccugccuca

SEQ ID NO: 2737112 - RNA, 21 nt, Human
aggcauccaaaggcuccugag

SEQ ID NO: 2737113 - RNA, 18 nt, Human
aggcauccccaggcccug

SEQ ID NO: 2737114 - RNA, 19 nt, Human
aggcauccuccacaauagc

SEQ ID NO: 2737115 - RNA, 19 nt, Human
aggcauccuuccucacacc

SEQ ID NO: 2737116 - RNA, 13 nt, Human
aggcaucgcaaug

SEQ ID NO: 2737117 - RNA, 21 nt, Human
aggcaugagucagucugauga

SEQ ID NO: 2737118 - RNA, 23 nt, Human
aggcaugagucagucugaugaga

SEQ ID NO: 2737119 - RNA, 18 nt, Human
aggcauuuaggccauggg

SEQ ID NO: 2737120 - RNA, 17 nt, Human
aggccaggcacaguggc

SEQ ID NO: 2737121 - RNA, 13 nt, Human
aggccaugggaca

SEQ ID NO: 2737122 - RNA, 14 nt, Human
aggccaugggacag

SEQ ID NO: 2737123 - RNA, 17 nt, Human
aggccaugggacaggga

SEQ ID NO: 2737124 - RNA, 17 nt, Human
aggccccaagcccacug

SEQ ID NO: 2737125 - RNA, 20 nt, Human
aggcccccgggccgacggag

SEQ ID NO: 2737126 - RNA, 20 nt, Human
aggcccgcaugcggcccagg

SEQ ID NO: 2737127 - RNA, 14 nt, Human
aggcccugcucuuc

SEQ ID NO: 2737128 - RNA, 20 nt, Human
aggcccugcucuuccucagc

SEQ ID NO: 2737129 - RNA, 15 nt, Human
aggccucacacacaa

SEQ ID NO: 2737130 - RNA, 11 nt, Human
aguacacccca

SEQ ID NO: 2737131 - RNA, 23 nt, Human
aguacauguuaaacuuacuuagu

SEQ ID NO: 2737132 - RNA, 20 nt, Human
aguacugggauuacaggcgu

SEQ ID NO: 2737133 - RNA, 15 nt, Human
aguacuuaaaacugu

SEQ ID NO: 2737134 - RNA, 22 nt, Human
aguacuuaaaacuguaaauuua

SEQ ID NO: 2737135 - RNA, 16 nt, Human
aguagauuaagagaug

SEQ ID NO: 2737136 - RNA, 18 nt, Human
aguagccagcaucugccu

SEQ ID NO: 2737137 - RNA, 16 nt, Human
aguagcugagacuaca

SEQ ID NO: 2737138 - RNA, 13 nt, Human
aguauaauauuaa

SEQ ID NO: 2737139 - RNA, 21 nt, Human
aguauacuguauuuuuaccuu

SEQ ID NO: 2737140 - RNA, 18 nt, Human
aguauauucaaaaauuau

SEQ ID NO: 2737141 - RNA, 15 nt, Human
aguauauuucccugu

SEQ ID NO: 2737142 - RNA, 18 nt, Human
aguauauuucccuguuuc

SEQ ID NO: 2737143 - RNA, 14 nt, Human
aguauccaagguua

SEQ ID NO: 2737144 - RNA, 22 nt, Human
aguauccucuugccaaaucaaa

SEQ ID NO: 2737145 - RNA, 19 nt, Human
aguauccuucagccugaaa

SEQ ID NO: 2737146 - RNA, 13 nt, Human
aguaucuuuuuau

SEQ ID NO: 2737147 - RNA, 18 nt, Human
aguaucuuuuuauucagc

SEQ ID NO: 2737148 - RNA, 15 nt, Human
aguaugcacuaauca

SEQ ID NO: 2737149 - RNA, 22 nt, Human
aguauugacuuguauaccuugu

SEQ ID NO: 2737150 - RNA, 14 nt, Human
aguauuuauauauu

SEQ ID NO: 2737151 - RNA, 13 nt, Human
aguauuuuccaca

SEQ ID NO: 2737152 - RNA, 16 nt, Human
agucaacuccuuucuc

SEQ ID NO: 2737153 - RNA, 18 nt, Human
agucaaggcuuagacccu

SEQ ID NO: 2737154 - RNA, 15 nt, Human
agucaagggugugug

SEQ ID NO: 2737155 - RNA, 21 nt, Human
agucaagggugugugcagcau

SEQ ID NO: 2737156 - RNA, 14 nt, Human
agucacaaagccca

SEQ ID NO: 2737157 - RNA, 14 nt, Human
agucacagcuacac

SEQ ID NO: 2737158 - RNA, 14 nt, Human
agucagaagaccug

SEQ ID NO: 2737159 - RNA, 16 nt, Human
agucagaauagaaauu

SEQ ID NO: 2737160 - RNA, 15 nt, Human
agucagacuggauag

SEQ ID NO: 2737161 - RNA, 15 nt, Human
agucagcucuucucc

SEQ ID NO: 2737162 - RNA, 22 nt, Human
agucaggaaagagaacuuccag

SEQ ID NO: 2737163 - RNA, 17 nt, Human
agucauaaccuuaccag

SEQ ID NO: 2737164 - RNA, 16 nt, Human
agucauucagauauga

SEQ ID NO: 2737165 - RNA, 17 nt, Human
agucauucugccugccc

SEQ ID NO: 2737166 - RNA, 17 nt, Human
agucauuuaauaaaugu

SEQ ID NO: 2737167 - RNA, 19 nt, Human
agucauuuaauaaaugugc

SEQ ID NO: 2737168 - RNA, 18 nt, Human
agucauuugcugagcaug

SEQ ID NO: 2737169 - RNA, 15 nt, Human
aguccagcuuaguuc

SEQ ID NO: 2737170 - RNA, 20 nt, Human
aguccagcuuaguucaaguc

SEQ ID NO: 2737171 - RNA, 18 nt, Human
aguccauugggcaggcag

SEQ ID NO: 2737172 - RNA, 12 nt, Human
aguccccagccu

SEQ ID NO: 2737173 - RNA, 14 nt, Human
aguccccagccugc

SEQ ID NO: 2737174 - RNA, 21 nt, Human
aguccccagccugcucccuag

SEQ ID NO: 2737175 - RNA, 20 nt, Human
aguccuacaagcuaaaauua

SEQ ID NO: 2737176 - RNA, 16 nt, Human
aguccucuuucaaagg

SEQ ID NO: 2737177 - RNA, 15 nt, Human
aguccugggauuaca

SEQ ID NO: 2737178 - RNA, 13 nt, Human
agucuaacaaauu

SEQ ID NO: 2737179 - RNA, 14 nt, Human
agucucccucccuu

SEQ ID NO: 2737180 - RNA, 21 nt, Human
agucucccucccuuggggccu

SEQ ID NO: 2737181 - RNA, 12 nt, Human
agucucuaucau

SEQ ID NO: 2737182 - RNA, 23 nt, Human
agucucuaucauuaaaguucuag

SEQ ID NO: 2737183 - RNA, 22 nt, Human
agucucuggaauuugaaacacu

SEQ ID NO: 2737184 - RNA, 14 nt, Human
agucugacuguuuc

SEQ ID NO: 2737185 - RNA, 18 nt, Human
agucugacuguuuccauc

SEQ ID NO: 2737186 - RNA, 15 nt, Human
agucugaugagaacu

SEQ ID NO: 2737187 - RNA, 15 nt, Human
agucugauuuuccug

SEQ ID NO: 2737188 - RNA, 18 nt, Human
agucugucacccagguug

SEQ ID NO: 2737189 - RNA, 15 nt, Human
agucuguuccccaug

SEQ ID NO: 2737190 - RNA, 15 nt, Human
agucuguuuucccuc

SEQ ID NO: 2737191 - RNA, 18 nt, Human
agucuguuuucccuccuu

SEQ ID NO: 2737192 - RNA, 22 nt, Human
agucuuacucuguugccaggcu

SEQ ID NO: 2737193 - RNA, 16 nt, Human
agucuuauaauagguu

SEQ ID NO: 2737194 - RNA, 14 nt, Human
agucuuauauauug

SEQ ID NO: 2737195 - RNA, 16 nt, Human
agucuuauauauugua

SEQ ID NO: 2737196 - RNA, 12 nt, Human
agucuucaucaa

SEQ ID NO: 2737197 - RNA, 18 nt, Human
agucuuccucugucuccu

SEQ ID NO: 2737198 - RNA, 16 nt, Human
agucuugccuugcuga

SEQ ID NO: 2737199 - RNA, 17 nt, Human
agucuuguauuaaguug

SEQ ID NO: 2737200 - RNA, 22 nt, Human
agucuuguauuaaguuguuaau

SEQ ID NO: 2737201 - RNA, 11 nt, Human
agugaaaaucu

SEQ ID NO: 2737202 - RNA, 15 nt, Human
agugaaagaaaauaa

SEQ ID NO: 2737203 - RNA, 21 nt, Human
agugaaagaaaauaacaauaa

SEQ ID NO: 2737204 - RNA, 18 nt, Human
agugaaagaaaauaacga

SEQ ID NO: 2737205 - RNA, 23 nt, Human
agugaacauucgaccuccauuac

SEQ ID NO: 2737206 - RNA, 16 nt, Human
agugaaggauuuaugu

SEQ ID NO: 2737207 - RNA, 18 nt, Human
agugacagcagucaggga

SEQ ID NO: 2737208 - RNA, 23 nt, Human
agugacauguuuacaaaccucaa

SEQ ID NO: 2737209 - RNA, 22 nt, Human
agugacuuaguguacaugaaag

SEQ ID NO: 2737210 - RNA, 16 nt, Human
agugagacagcucugc

SEQ ID NO: 2737211 - RNA, 17 nt, Human
agugagacagcucugca

SEQ ID NO: 2737212 - RNA, 17 nt, Human
agugagacucugucuca

SEQ ID NO: 2737213 - RNA, 22 nt, Human
agugagcagucaggaaagagaa

SEQ ID NO: 2737214 - RNA, 21 nt, Human
agugagcuuggaaaggaccag

SEQ ID NO: 2737215 - RNA, 20 nt, Human
agugaggcggauugagaagg

SEQ ID NO: 2737216 - RNA, 20 nt, Human
agugauacuauccaguuacu

SEQ ID NO: 2737217 - RNA, 14 nt, Human
agugauauuucccc

SEQ ID NO: 2737218 - RNA, 16 nt, Human
agugauccgcccaucu

SEQ ID NO: 2737219 - RNA, 17 nt, Human
agugauuaccagggacu

SEQ ID NO: 2737220 - RNA, 14 nt, Human
agugcaaauacucu

SEQ ID NO: 2737221 - RNA, 18 nt, Human
agugcacuaauguguaag

SEQ ID NO: 2737222 - RNA, 21 nt, Human
agugcaguggcaucaucucag

SEQ ID NO: 2737223 - RNA, 13 nt, Human
agugcaguggcgc

SEQ ID NO: 2737224 - RNA, 23 nt, Human
agugcaguggcgcgaucucagcu

SEQ ID NO: 2737225 - RNA, 18 nt, Human
agugcauuuaugagcucu

SEQ ID NO: 2737226 - RNA, 21 nt, Human
agugcccccaacagcacccuc

SEQ ID NO: 2737227 - RNA, 16 nt, Human
agugccgacagcucuc

SEQ ID NO: 2737228 - RNA, 19 nt, Human
agugccuccaaguucaaaa

SEQ ID NO: 2737229 - RNA, 16 nt, Human
agugccuguaaucaca

SEQ ID NO: 2737230 - RNA, 15 nt, Human
agugccuuucuucuc

SEQ ID NO: 2737231 - RNA, 21 nt, Human
agugcuaauuuugaaaaacug

SEQ ID NO: 2737232 - RNA, 16 nt, Human
agugcuucuccagccu

SEQ ID NO: 2737233 - RNA, 23 nt, Human
agugcuucuccagccucagccuc

SEQ ID NO: 2737234 - RNA, 13 nt, Human
agugcuuggccca

SEQ ID NO: 2737235 - RNA, 15 nt, Human
agugcuuggcccagg

SEQ ID NO: 2737236 - RNA, 14 nt, Human
agugcuuucuucuc

SEQ ID NO: 2737237 - RNA, 15 nt, Human
agugcuuuuuguguc

SEQ ID NO: 2737238 - RNA, 22 nt, Human
aguggcaucaucucagcucacu

SEQ ID NO: 2737239 - RNA, 16 nt, Human
aguggcgcgcgccacc

SEQ ID NO: 2737240 - RNA, 19 nt, Human
aguggcuuccaauuuuugg

SEQ ID NO: 2737241 - RNA, 17 nt, Human
agugggagccagggcug

SEQ ID NO: 2737242 - RNA, 21 nt, Human
agugggugccccccuugccag

SEQ ID NO: 2737243 - RNA, 22 nt, Human
agugggugccccccuugccaga

SEQ ID NO: 2737244 - RNA, 20 nt, Human
agugggugguagcagaggga

SEQ ID NO: 2737245 - RNA, 14 nt, Human
agugguauagaaau

SEQ ID NO: 2737246 - RNA, 15 nt, Human
agugguauagaaaug

SEQ ID NO: 2737247 - RNA, 16 nt, Human
agugguauagaaaugc

SEQ ID NO: 2737248 - RNA, 15 nt, Human
aguguaaguucacaa

SEQ ID NO: 2737249 - RNA, 16 nt, Human
aguguaauaaaacaug

SEQ ID NO: 2737250 - RNA, 16 nt, Human
aguguacagucuugua

SEQ ID NO: 2737251 - RNA, 23 nt, Human
aguguacaugaaagcguaaagag

SEQ ID NO: 2737252 - RNA, 15 nt, Human
aguguagggaguugu

SEQ ID NO: 2737253 - RNA, 16 nt, Human
agugucaaugcagccc

SEQ ID NO: 2737254 - RNA, 13 nt, Human
aguguccucaucu

SEQ ID NO: 2737255 - RNA, 23 nt, Human
aguguccucaucuguaaaaugga

SEQ ID NO: 2737256 - RNA, 22 nt, Human
agugucugaugaauguuaaauu

SEQ ID NO: 2737257 - RNA, 11 nt, Human
agugucugcug

SEQ ID NO: 2737258 - RNA, 19 nt, Human
agugucuuaauuaaaagaa

SEQ ID NO: 2737259 - RNA, 18 nt, Human
agugucuuacagagaaaa

SEQ ID NO: 2737260 - RNA, 22 nt, Human
agugucuuacagagaaaagaca

SEQ ID NO: 2737261 - RNA, 14 nt, Human
agugucuugaauug

SEQ ID NO: 2737262 - RNA, 18 nt, Human
aguguguggcuuucagag

SEQ ID NO: 2737263 - RNA, 20 nt, Human
aguguucauaaauaaaguuu

SEQ ID NO: 2737264 - RNA, 22 nt, Human
aguguugacaguucauauguac

SEQ ID NO: 2737265 - RNA, 16 nt, Human
aguguuggaaaaugug

SEQ ID NO: 2737266 - RNA, 21 nt, Human
aguguuggagaagaacugaaa

SEQ ID NO: 2737267 - RNA, 13 nt, Human
aguguuuagcaua

SEQ ID NO: 2737268 - RNA, 12 nt, Human
aguguuugaaag

SEQ ID NO: 2737269 - RNA, 13 nt, Human
aguguuugaaagc

SEQ ID NO: 2737270 - RNA, 22 nt, Human
aguguuuuaggagcaugagugc

SEQ ID NO: 2737271 - RNA, 18 nt, Human
aguuacacauuuuucaga

SEQ ID NO: 2737272 - RNA, 13 nt, Human
aguuaccucugcc

SEQ ID NO: 2737273 - RNA, 13 nt, Human
aguuaggaacugg

SEQ ID NO: 2737274 - RNA, 17 nt, Human
aguuaggaacugguguc

SEQ ID NO: 2737275 - RNA, 19 nt, Human
auaauguuacauuauuauc

SEQ ID NO: 2737276 - RNA, 16 nt, Human
auaauguuguuauuua

SEQ ID NO: 2737277 - RNA, 18 nt, Human
auaauguuguuauuuaaa

SEQ ID NO: 2737278 - RNA, 22 nt, Human
auaauguuucaaacauauauaa

SEQ ID NO: 2737279 - RNA, 13 nt, Human
auaauuuaaaaua

SEQ ID NO: 2737280 - RNA, 17 nt, Human
auaauuuaaaauaugcu

SEQ ID NO: 2737281 - RNA, 12 nt, Human
auaauuuaaaua

SEQ ID NO: 2737282 - RNA, 22 nt, Human
auaauuuugugaagcaaaauuu

SEQ ID NO: 2737283 - RNA, 12 nt, Human
auaauuuuuaau

SEQ ID NO: 2737284 - RNA, 21 nt, Human
auaauuuuuaauuauauggcu

SEQ ID NO: 2737285 - RNA, 15 nt, Human
auaauuuuuauauuu

SEQ ID NO: 2737286 - RNA, 19 nt, Human
auaauuuuuauauuugaaa

SEQ ID NO: 2737287 - RNA, 22 nt, Human
auaauuuuuauauuugaaauau

SEQ ID NO: 2737288 - RNA, 14 nt, Human
auaauuuuucacuu

SEQ ID NO: 2737289 - RNA, 14 nt, Human
auacaaaaaaaaaa

SEQ ID NO: 2737290 - RNA, 19 nt, Human
auacaaaggcuuauuaauu

SEQ ID NO: 2737291 - RNA, 15 nt, Human
auacaauaaagaaug

SEQ ID NO: 2737292 - RNA, 12 nt, Human
auacaaucauca

SEQ ID NO: 2737293 - RNA, 22 nt, Human
auacaauguuauguauuauuau

SEQ ID NO: 2737294 - RNA, 17 nt, Human
auacaauuaaagcuguu

SEQ ID NO: 2737295 - RNA, 20 nt, Human
auacaauuaaagcuguuauu

SEQ ID NO: 2737296 - RNA, 18 nt, Human
auacaccagagauaauau

SEQ ID NO: 2737297 - RNA, 13 nt, Human
auacacuuuuuaa

SEQ ID NO: 2737298 - RNA, 15 nt, Human
auacacuuuuuaaaa

SEQ ID NO: 2737299 - RNA, 13 nt, Human
auacagggcauuu

SEQ ID NO: 2737300 - RNA, 16 nt, Human
auacaguaauuuuaag

SEQ ID NO: 2737301 - RNA, 23 nt, Human
auacaguggagacaucuggaaag

SEQ ID NO: 2737302 - RNA, 21 nt, Human
auacauaaaguaugugcauau

SEQ ID NO: 2737303 - RNA, 20 nt, Human
auacauaccuauauacucac

SEQ ID NO: 2737304 - RNA, 13 nt, Human
auacaugcuuuuu

SEQ ID NO: 2737305 - RNA, 21 nt, Human
auacaugcuuuuuaaugagau

SEQ ID NO: 2737306 - RNA, 16 nt, Human
auacauguuacaacac

SEQ ID NO: 2737307 - RNA, 20 nt, Human
auacauuauuggacuuccau

SEQ ID NO: 2737308 - RNA, 13 nt, Human
auacauuucucau

SEQ ID NO: 2737309 - RNA, 17 nt, Human
auacauuucucauaccu

SEQ ID NO: 2737310 - RNA, 16 nt, Human
auacauuuucuaagaa

SEQ ID NO: 2737311 - RNA, 15 nt, Human
auaccacaggaacca

SEQ ID NO: 2737312 - RNA, 14 nt, Human
auaccaugaugcug

SEQ ID NO: 2737313 - RNA, 20 nt, Human
auacccccugcaaagcccag

SEQ ID NO: 2737314 - RNA, 23 nt, Human
auaccuaucaucuuaaguaggga

SEQ ID NO: 2737315 - RNA, 18 nt, Human
auaccucacuuuacacaa

SEQ ID NO: 2737316 - RNA, 20 nt, Human
auaccugauauauuccacca

SEQ ID NO: 2737317 - RNA, 20 nt, Human
auacgugggcauucaaaugu

SEQ ID NO: 2737318 - RNA, 15 nt, Human
auacguuaggaggac

SEQ ID NO: 2737319 - RNA, 13 nt, Human
auacuaauaaaau

SEQ ID NO: 2737320 - RNA, 18 nt, Human
auacuaauaaaauacaua

SEQ ID NO: 2737321 - RNA, 19 nt, Human
auacuaauuauacccccug

SEQ ID NO: 2737322 - RNA, 13 nt, Human
auacuauccaguu

SEQ ID NO: 2737323 - RNA, 19 nt, Human
auacuauggaauuucuccc

SEQ ID NO: 2737324 - RNA, 16 nt, Human
auacuauuuaagagaa

SEQ ID NO: 2737325 - RNA, 21 nt, Human
auacuauuuaauuauuucacu

SEQ ID NO: 2737326 - RNA, 23 nt, Human
auacuauuuaauuauuucacuuu

SEQ ID NO: 2737327 - RNA, 15 nt, Human
auacucauuaggaug

SEQ ID NO: 2737328 - RNA, 11 nt, Human
auacucuuaua

SEQ ID NO: 2737329 - RNA, 20 nt, Human
auacucuuauaucuauauuu

SEQ ID NO: 2737330 - RNA, 15 nt, Human
auacuguauuuuuac

SEQ ID NO: 2737331 - RNA, 21 nt, Human
auacuucuuaggguuaugauu

SEQ ID NO: 2737332 - RNA, 15 nt, Human
auacuugaaaauuaa

SEQ ID NO: 2737333 - RNA, 16 nt, Human
auacuuuaauaaaugu

SEQ ID NO: 2737334 - RNA, 12 nt, Human
auagaauauuua

SEQ ID NO: 2737335 - RNA, 17 nt, Human
auagaauggaacucaag

SEQ ID NO: 2737336 - RNA, 18 nt, Human
auagaauuaacacaugau

SEQ ID NO: 2737337 - RNA, 16 nt, Human
auagaauuaauggaau

SEQ ID NO: 2737338 - RNA, 15 nt, Human
auagaauuauaacug

SEQ ID NO: 2737339 - RNA, 14 nt, Human
auagaccuaaaaua

SEQ ID NO: 2737340 - RNA, 22 nt, Human
auagaccuaaaauaaaaugaag

SEQ ID NO: 2737341 - RNA, 16 nt, Human
auagagaaauaugauu

SEQ ID NO: 2737342 - RNA, 20 nt, Human
auagagacuuugugaaaaaa

SEQ ID NO: 2737343 - RNA, 22 nt, Human
auagagacuuugugaaaaaaaa

SEQ ID NO: 2737344 - RNA, 13 nt, Human
auagaguguuauc

SEQ ID NO: 2737345 - RNA, 17 nt, Human
auagauucccugagcag

SEQ ID NO: 2737346 - RNA, 15 nt, Human
auagcagauuuuaau

SEQ ID NO: 2737347 - RNA, 16 nt, Human
auagcagauuuuaauu

SEQ ID NO: 2737348 - RNA, 20 nt, Human
auagcagggcauggcuggga

SEQ ID NO: 2737349 - RNA, 23 nt, Human
auagcauauguuuuuguaaguuu

SEQ ID NO: 2737350 - RNA, 14 nt, Human
auagcaucucagga

SEQ ID NO: 2737351 - RNA, 21 nt, Human
auagccagguaccuucucacc

SEQ ID NO: 2737352 - RNA, 15 nt, Human
auagcuacuaauuuu

SEQ ID NO: 2737353 - RNA, 15 nt, Human
auaggaaauauuuua

SEQ ID NO: 2737354 - RNA, 18 nt, Human
auaggaaauauuuuaaug

SEQ ID NO: 2737355 - RNA, 18 nt, Human
auagggagggaaggggga

SEQ ID NO: 2737356 - RNA, 14 nt, Human
auagguuuaauaau

SEQ ID NO: 2737357 - RNA, 18 nt, Human
auagucaaauugugugaa

SEQ ID NO: 2737358 - RNA, 23 nt, Human
auagucauguaagcugaaaauau

SEQ ID NO: 2737359 - RNA, 15 nt, Human
auagucauucugccu

SEQ ID NO: 2737360 - RNA, 16 nt, Human
auagucauucugccug

SEQ ID NO: 2737361 - RNA, 20 nt, Human
auagucauucugccugcccu

SEQ ID NO: 2737362 - RNA, 13 nt, Human
auagugagacacu

SEQ ID NO: 2737363 - RNA, 18 nt, Human
auagugagacacugucuc

SEQ ID NO: 2737364 - RNA, 14 nt, Human
auagugucugauga

SEQ ID NO: 2737365 - RNA, 17 nt, Human
auaguguuggaaaaugu

SEQ ID NO: 2737366 - RNA, 20 nt, Human
auaguucaaagccaaguuua

SEQ ID NO: 2737367 - RNA, 21 nt, Human
auaguuguaccgcaaugugac

SEQ ID NO: 2737368 - RNA, 13 nt, Human
auauaaagcaaga

SEQ ID NO: 2737369 - RNA, 12 nt, Human
auauaaauaaaa

SEQ ID NO: 2737370 - RNA, 18 nt, Human
auauaaauuuaucauuua

SEQ ID NO: 2737371 - RNA, 14 nt, Human
auauaaauuuuuuu

SEQ ID NO: 2737372 - RNA, 21 nt, Human
auauaagugauugcugguuuu

SEQ ID NO: 2737373 - RNA, 20 nt, Human
auauaagugcuguauaaaau

SEQ ID NO: 2737374 - RNA, 13 nt, Human
auauaagugugug

SEQ ID NO: 2737375 - RNA, 20 nt, Human
auauaaguguguguuuuuca

SEQ ID NO: 2737376 - RNA, 20 nt, Human
auauaauaaauguacauuaa

SEQ ID NO: 2737377 - RNA, 16 nt, Human
auauaauacaaaggcu

SEQ ID NO: 2737378 - RNA, 14 nt, Human
auauaauauuuuua

SEQ ID NO: 2737379 - RNA, 14 nt, Human
auauaauucaccuu

SEQ ID NO: 2737380 - RNA, 13 nt, Human
auauaauucuuau

SEQ ID NO: 2737381 - RNA, 22 nt, Human
auauaccugauauauuccacca

SEQ ID NO: 2737382 - RNA, 21 nt, Human
auauacuccuaguaauuuaag

SEQ ID NO: 2737383 - RNA, 18 nt, Human
auauacuuuaauaaaugu

SEQ ID NO: 2737384 - RNA, 19 nt, Human
auauacuuuaauaaaugua

SEQ ID NO: 2737385 - RNA, 15 nt, Human
auauagaaauguauu

SEQ ID NO: 2737386 - RNA, 17 nt, Human
auauauaacaaugcugu

SEQ ID NO: 2737387 - RNA, 22 nt, Human
auauauaacaaugcuguauuuu

SEQ ID NO: 2737388 - RNA, 18 nt, Human
auauauacauacaugcau

SEQ ID NO: 2737389 - RNA, 13 nt, Human
auauauagcagcu

SEQ ID NO: 2737390 - RNA, 11 nt, Human
auauauauaca

SEQ ID NO: 2737391 - RNA, 15 nt, Human
auauauauacauaca

SEQ ID NO: 2737392 - RNA, 14 nt, Human
auauauaucaaaua

SEQ ID NO: 2737393 - RNA, 14 nt, Human
auauauauuuuuuu

SEQ ID NO: 2737394 - RNA, 22 nt, Human
auauauauuuuuuuuuuuaaaa

SEQ ID NO: 2737395 - RNA, 14 nt, Human
auauaucaaauaua

SEQ ID NO: 2737396 - RNA, 20 nt, Human
auauaucaaauauauucagc

SEQ ID NO: 2737397 - RNA, 15 nt, Human
auauaucauagcaaa

SEQ ID NO: 2737398 - RNA, 22 nt, Human
auauaugcuaagucuuauauau

SEQ ID NO: 2737399 - RNA, 23 nt, Human
auauauguauuuauaaauauauu

SEQ ID NO: 2737400 - RNA, 20 nt, Human
auauauguguuuuucacauu

SEQ ID NO: 2737401 - RNA, 19 nt, Human
auauauuuauaacucauca

SEQ ID NO: 2737402 - RNA, 14 nt, Human
auauauuuccuuau

SEQ ID NO: 2737403 - RNA, 17 nt, Human
auauauuuccuuauuca

SEQ ID NO: 2737404 - RNA, 14 nt, Human
auauauuuuaaaua

SEQ ID NO: 2737405 - RNA, 20 nt, Human
auauauuuuaaauauuuuuu

SEQ ID NO: 2737406 - RNA, 23 nt, Human
auauauuuuaagacgaaacauuu

SEQ ID NO: 2737407 - RNA, 14 nt, Human
auauauuuuagaua

SEQ ID NO: 2737408 - RNA, 13 nt, Human
auauauuuuguag

SEQ ID NO: 2737409 - RNA, 19 nt, Human
auauauuuuuuuuuuuaaa

SEQ ID NO: 2737410 - RNA, 20 nt, Human
auauauuuuuuuuuuuaaaa

SEQ ID NO: 2737411 - RNA, 21 nt, Human
auauauuuuuuuuuuuaaaaa

SEQ ID NO: 2737412 - RNA, 22 nt, Human
auaucaaacugaaacaaaauua

SEQ ID NO: 2737413 - RNA, 14 nt, Human
auaucaaauauauu

SEQ ID NO: 2737414 - RNA, 15 nt, Human
auaucaauuuaaaaa

SEQ ID NO: 2737415 - RNA, 16 nt, Human
auaucaauuuaaaaaa

SEQ ID NO: 2737416 - RNA, 19 nt, Human
auaucagcccaaaagucaa

SEQ ID NO: 2737417 - RNA, 16 nt, Human
auaucaguuauuuuua

SEQ ID NO: 2737418 - RNA, 18 nt, Human
auaucaguuauuuuuaaa

SEQ ID NO: 2737419 - RNA, 16 nt, Human
auaucauagcaaauaa

SEQ ID NO: 2737420 - RNA, 18 nt, Human
aucaugcugagagagcug

SEQ ID NO: 2737421 - RNA, 13 nt, Human
aucauuaaaguuc

SEQ ID NO: 2737422 - RNA, 23 nt, Human
aucauuaaaguucuagugaccga

SEQ ID NO: 2737423 - RNA, 13 nt, Human
aucauucauuuuc

SEQ ID NO: 2737424 - RNA, 20 nt, Human
aucauuuaguuauaaaaaua

SEQ ID NO: 2737425 - RNA, 23 nt, Human
aucauuuccauuuacccuucuuu

SEQ ID NO: 2737426 - RNA, 19 nt, Human
aucauuuuaauuauuauuc

SEQ ID NO: 2737427 - RNA, 12 nt, Human
aucauuuucaaa

SEQ ID NO: 2737428 - RNA, 21 nt, Human
auccaaaaauguguaagaaca

SEQ ID NO: 2737429 - RNA, 15 nt, Human
auccaacuuauauuu

SEQ ID NO: 2737430 - RNA, 13 nt, Human
auccaagcaaaug

SEQ ID NO: 2737431 - RNA, 17 nt, Human
auccaagcaaaugugaa

SEQ ID NO: 2737432 - RNA, 14 nt, Human
auccaaugaaauga

SEQ ID NO: 2737433 - RNA, 18 nt, Human
auccacccgccucagccu

SEQ ID NO: 2737434 - RNA, 22 nt, Human
auccacccgccucagccuccca

SEQ ID NO: 2737435 - RNA, 19 nt, Human
auccacuuuccaauaaaga

SEQ ID NO: 2737436 - RNA, 14 nt, Human
auccagaaagaaaa

SEQ ID NO: 2737437 - RNA, 22 nt, Human
auccagauagguuaccaguaac

SEQ ID NO: 2737438 - RNA, 22 nt, Human
auccagccugcugccugcuuuu

SEQ ID NO: 2737439 - RNA, 20 nt, Human
auccaguauuguuccuuuug

SEQ ID NO: 2737440 - RNA, 17 nt, Human
auccaguuacugccggu

SEQ ID NO: 2737441 - RNA, 14 nt, Human
auccauacauuugu

SEQ ID NO: 2737442 - RNA, 19 nt, Human
auccauggugugcuggcuu

SEQ ID NO: 2737443 - RNA, 14 nt, Human
auccauucuucccu

SEQ ID NO: 2737444 - RNA, 15 nt, Human
auccauucuucccuu

SEQ ID NO: 2737445 - RNA, 16 nt, Human
auccauucuucccuug

SEQ ID NO: 2737446 - RNA, 14 nt, Human
aucccacucacaac

SEQ ID NO: 2737447 - RNA, 21 nt, Human
aucccacucacaacagcugcc

SEQ ID NO: 2737448 - RNA, 17 nt, Human
aucccagcacuuuggga

SEQ ID NO: 2737449 - RNA, 22 nt, Human
aucccagcacuuugggaggcug

SEQ ID NO: 2737450 - RNA, 17 nt, Human
auccccaagccuggcaa

SEQ ID NO: 2737451 - RNA, 21 nt, Human
auccccaagccuggcaaggga

SEQ ID NO: 2737452 - RNA, 15 nt, Human
auccccacgccacag

SEQ ID NO: 2737453 - RNA, 16 nt, Human
auccccacgccacagc

SEQ ID NO: 2737454 - RNA, 16 nt, Human
auccccagcuguuuau

SEQ ID NO: 2737455 - RNA, 16 nt, Human
auccccauuucuuuuu

SEQ ID NO: 2737456 - RNA, 15 nt, Human
auccccuucuccccu

SEQ ID NO: 2737457 - RNA, 17 nt, Human
aucccggccggcgcgcu

SEQ ID NO: 2737458 - RNA, 12 nt, Human
aucccucccucc

SEQ ID NO: 2737459 - RNA, 20 nt, Human
aucccucccuccaccucccu

SEQ ID NO: 2737460 - RNA, 21 nt, Human
aucccuccugggaaugaagca

SEQ ID NO: 2737461 - RNA, 21 nt, Human
aucccucuaucucuaaagaaa

SEQ ID NO: 2737462 - RNA, 22 nt, Human
auccgcccaucuccgucuccca

SEQ ID NO: 2737463 - RNA, 13 nt, Human
auccuaagcucau

SEQ ID NO: 2737464 - RNA, 21 nt, Human
auccuaauaaaaaggugacca

SEQ ID NO: 2737465 - RNA, 19 nt, Human
auccuacuuccccuuccua

SEQ ID NO: 2737466 - RNA, 15 nt, Human
auccuagucucuauc

SEQ ID NO: 2737467 - RNA, 20 nt, Human
auccucacucaguccagcuu

SEQ ID NO: 2737468 - RNA, 22 nt, Human
auccucccacuucagccuccca

SEQ ID NO: 2737469 - RNA, 20 nt, Human
auccucgaggcccuagcauu

SEQ ID NO: 2737470 - RNA, 23 nt, Human
auccucucucuguguuacccagu

SEQ ID NO: 2737471 - RNA, 12 nt, Human
auccucuugcca

SEQ ID NO: 2737472 - RNA, 19 nt, Human
auccucuugccaaaucaaa

SEQ ID NO: 2737473 - RNA, 21 nt, Human
auccugaggcuccacuugguc

SEQ ID NO: 2737474 - RNA, 20 nt, Human
auccugaugagguuucuacu

SEQ ID NO: 2737475 - RNA, 21 nt, Human
auccugcaauuccacuuauag

SEQ ID NO: 2737476 - RNA, 13 nt, Human
auccugcaggcag

SEQ ID NO: 2737477 - RNA, 15 nt, Human
auccugccccugagc

SEQ ID NO: 2737478 - RNA, 15 nt, Human
auccuggaauaucuc

SEQ ID NO: 2737479 - RNA, 16 nt, Human
auccugucccuccucc

SEQ ID NO: 2737480 - RNA, 19 nt, Human
auccugugggaccugggcc

SEQ ID NO: 2737481 - RNA, 22 nt, Human
auccuuaucgaaacucauuuua

SEQ ID NO: 2737482 - RNA, 14 nt, Human
auccuucagccuga

SEQ ID NO: 2737483 - RNA, 15 nt, Human
auccuucagccugaa

SEQ ID NO: 2737484 - RNA, 18 nt, Human
auccuucagccugaaaga

SEQ ID NO: 2737485 - RNA, 12 nt, Human
auccuuccuuuu

SEQ ID NO: 2737486 - RNA, 14 nt, Human
auccuugaagauuu

SEQ ID NO: 2737487 - RNA, 16 nt, Human
auccuugaagauuuac

SEQ ID NO: 2737488 - RNA, 16 nt, Human
auccuuuguuuucuga

SEQ ID NO: 2737489 - RNA, 22 nt, Human
aucgaaaugacgguguuaauuu

SEQ ID NO: 2737490 - RNA, 15 nt, Human
aucgauuuuuaaaaa

SEQ ID NO: 2737491 - RNA, 23 nt, Human
aucgcagacacaugugcuggcca

SEQ ID NO: 2737492 - RNA, 12 nt, Human
aucguguccccu

SEQ ID NO: 2737493 - RNA, 14 nt, Human
aucguguccccuau

SEQ ID NO: 2737494 - RNA, 23 nt, Human
aucgugucuggcguuguggggau

SEQ ID NO: 2737495 - RNA, 13 nt, Human
aucguuuuuuccc

SEQ ID NO: 2737496 - RNA, 15 nt, Human
aucuaauauauauga

SEQ ID NO: 2737497 - RNA, 12 nt, Human
aucuaauuuuua

SEQ ID NO: 2737498 - RNA, 13 nt, Human
aucuacacuccag

SEQ ID NO: 2737499 - RNA, 18 nt, Human
aucuacacuccagugaga

SEQ ID NO: 2737500 - RNA, 20 nt, Human
aucuacaugucuagagaaca

SEQ ID NO: 2737501 - RNA, 15 nt, Human
aucuagcaaauguua

SEQ ID NO: 2737502 - RNA, 15 nt, Human
aucuauauuuuacau

SEQ ID NO: 2737503 - RNA, 15 nt, Human
aucuaugcauuuucu

SEQ ID NO: 2737504 - RNA, 14 nt, Human
aucuaugccacaag

SEQ ID NO: 2737505 - RNA, 18 nt, Human
aucuauguagaauauauu

SEQ ID NO: 2737506 - RNA, 17 nt, Human
aucuauuaauauaugua

SEQ ID NO: 2737507 - RNA, 15 nt, Human
aucuauuuaaauauu

SEQ ID NO: 2737508 - RNA, 18 nt, Human
aucuauuuaaauauuuau

SEQ ID NO: 2737509 - RNA, 18 nt, Human
aucucaaaaaaaaaaaca

SEQ ID NO: 2737510 - RNA, 17 nt, Human
aucucaaacuucuauuu

SEQ ID NO: 2737511 - RNA, 12 nt, Human
aucucaauauuu

SEQ ID NO: 2737512 - RNA, 15 nt, Human
aucucaauauuucag

SEQ ID NO: 2737513 - RNA, 15 nt, Human
aucucacauuuuccc

SEQ ID NO: 2737514 - RNA, 22 nt, Human
aucucagucugucacccagguu

SEQ ID NO: 2737515 - RNA, 14 nt, Human
aucucccucuuccc

SEQ ID NO: 2737516 - RNA, 14 nt, Human
aucuccgucaacuc

SEQ ID NO: 2737517 - RNA, 18 nt, Human
aucuccuguuaauauggu

SEQ ID NO: 2737518 - RNA, 15 nt, Human
aucucggcucacugc

SEQ ID NO: 2737519 - RNA, 15 nt, Human
aucucugaauuugag

SEQ ID NO: 2737520 - RNA, 21 nt, Human
aucucugaauuugagauacaa

SEQ ID NO: 2737521 - RNA, 14 nt, Human
aucucuucucagaa

SEQ ID NO: 2737522 - RNA, 22 nt, Human
aucucuucuggguuccuuccuc

SEQ ID NO: 2737523 - RNA, 23 nt, Human
aucucuucuggguuccuuccucu

SEQ ID NO: 2737524 - RNA, 18 nt, Human
aucucuuguuuaaauuca

SEQ ID NO: 2737525 - RNA, 19 nt, Human
aucucuuguuuaaauucaa

SEQ ID NO: 2737526 - RNA, 14 nt, Human
aucugagagaugac

SEQ ID NO: 2737527 - RNA, 19 nt, Human
aucugagagaugacaggga

SEQ ID NO: 2737528 - RNA, 11 nt, Human
aucugccuccc

SEQ ID NO: 2737529 - RNA, 17 nt, Human
aucugcuauucuccaua

SEQ ID NO: 2737530 - RNA, 16 nt, Human
aucuggaaaguuuucu

SEQ ID NO: 2737531 - RNA, 18 nt, Human
aucuguuuuuauauuucu

SEQ ID NO: 2737532 - RNA, 19 nt, Human
aucuuaaaugccaggccug

SEQ ID NO: 2737533 - RNA, 19 nt, Human
aucuuaauuauuguacauu

SEQ ID NO: 2737534 - RNA, 16 nt, Human
aucuuauaauuuaaaa

SEQ ID NO: 2737535 - RNA, 17 nt, Human
aucuuauaauuuaaaau

SEQ ID NO: 2737536 - RNA, 15 nt, Human
aucuuaucauauuuc

SEQ ID NO: 2737537 - RNA, 12 nt, Human
aucuucacuuuu

SEQ ID NO: 2737538 - RNA, 16 nt, Human
aucuucacuuuuauaa

SEQ ID NO: 2737539 - RNA, 22 nt, Human
aucuucacuuuuauaagaaaua

SEQ ID NO: 2737540 - RNA, 14 nt, Human
aucuucagaaaacc

SEQ ID NO: 2737541 - RNA, 21 nt, Human
aucuuguaaagguccuggcaa

SEQ ID NO: 2737542 - RNA, 15 nt, Human
aucuuuaauuuuaca

SEQ ID NO: 2737543 - RNA, 15 nt, Human
aucuuuauaguucua

SEQ ID NO: 2737544 - RNA, 17 nt, Human
aucuuucugccuuuggc

SEQ ID NO: 2737545 - RNA, 12 nt, Human
aucuuugagcgc

SEQ ID NO: 2737546 - RNA, 19 nt, Human
aucuuuuuacuaaacucag

SEQ ID NO: 2737547 - RNA, 21 nt, Human
aucuuuuuuuuaauaaaccau

SEQ ID NO: 2737548 - RNA, 16 nt, Human
augaaaaccacauugg

SEQ ID NO: 2737549 - RNA, 14 nt, Human
augaaacauuacag

SEQ ID NO: 2737550 - RNA, 21 nt, Human
augaaagcagggacuugaacc

SEQ ID NO: 2737551 - RNA, 14 nt, Human
augaaauaacuagg

SEQ ID NO: 2737552 - RNA, 18 nt, Human
augaaaucagaguuuuca

SEQ ID NO: 2737553 - RNA, 15 nt, Human
augaaccuuuacauc

SEQ ID NO: 2737554 - RNA, 13 nt, Human
augaacuuuccac

SEQ ID NO: 2737555 - RNA, 14 nt, Human
augaacuuuuuguu

SEQ ID NO: 2737556 - RNA, 15 nt, Human
augaagaaguugaua

SEQ ID NO: 2737557 - RNA, 17 nt, Human
augaaggcuguacacug

SEQ ID NO: 2737558 - RNA, 14 nt, Human
augaaggucacucg

SEQ ID NO: 2737559 - RNA, 14 nt, Human
augaaguacucaua

SEQ ID NO: 2737560 - RNA, 17 nt, Human
augaaguacucauacau

SEQ ID NO: 2737561 - RNA, 20 nt, Human
augaaguuguagguaauauu

SEQ ID NO: 2737562 - RNA, 13 nt, Human
augaaguuuuuuu

SEQ ID NO: 2737563 - RNA, 17 nt, Human
augaauacaauuaaagc

SEQ ID NO: 2737564 - RNA, 19 nt, Human
augaauacaauuaaagcug

SEQ ID NO: 2737565 - RNA, 21 nt, Human
augaauacuuuauaaaggauu

SEQ ID NO: 2737566 - RNA, 21 nt, Human
augggguaccuaguccccagc

SEQ ID NO: 2737567 - RNA, 15 nt, Human
augggguuucaccau

SEQ ID NO: 2737568 - RNA, 13 nt, Human
augggucagaguu

SEQ ID NO: 2737569 - RNA, 12 nt, Human
auggguuuuauu

SEQ ID NO: 2737570 - RNA, 13 nt, Human
augguauuaaaga

SEQ ID NO: 2737571 - RNA, 18 nt, Human
augguauuugaguguuuu

SEQ ID NO: 2737572 - RNA, 23 nt, Human
augguauuugaguguuuuaagau

SEQ ID NO: 2737573 - RNA, 22 nt, Human
auggucccuauuccuccuuccc

SEQ ID NO: 2737574 - RNA, 15 nt, Human
augguggccuggggc

SEQ ID NO: 2737575 - RNA, 17 nt, Human
augguggccuggggcuu

SEQ ID NO: 2737576 - RNA, 14 nt, Human
auggugugaccacu

SEQ ID NO: 2737577 - RNA, 15 nt, Human
augguuguauuauuu

SEQ ID NO: 2737578 - RNA, 22 nt, Human
augguuguauuauuuuuuaaaa

SEQ ID NO: 2737579 - RNA, 19 nt, Human
augguuucuagagaugguu

SEQ ID NO: 2737580 - RNA, 18 nt, Human
auguaaaagacuuuuuuu

SEQ ID NO: 2737581 - RNA, 15 nt, Human
auguaaacaaaggaa

SEQ ID NO: 2737582 - RNA, 20 nt, Human
auguaaacaauaucagacuu

SEQ ID NO: 2737583 - RNA, 14 nt, Human
auguaaauagaaac

SEQ ID NO: 2737584 - RNA, 21 nt, Human
auguaaugguggccuggggcu

SEQ ID NO: 2737585 - RNA, 16 nt, Human
auguacaauaaagcaa

SEQ ID NO: 2737586 - RNA, 20 nt, Human
auguacaauaaagcaaugug

SEQ ID NO: 2737587 - RNA, 21 nt, Human
auguacaauaaagcaaugugg

SEQ ID NO: 2737588 - RNA, 23 nt, Human
auguacaauaaagcaauguggua

SEQ ID NO: 2737589 - RNA, 19 nt, Human
auguacauuuccaaauuca

SEQ ID NO: 2737590 - RNA, 22 nt, Human
auguacauuuccaaauucacaa

SEQ ID NO: 2737591 - RNA, 12 nt, Human
auguaccaugua

SEQ ID NO: 2737592 - RNA, 18 nt, Human
auguagauaaacucagaa

SEQ ID NO: 2737593 - RNA, 17 nt, Human
auguagcaaauuccaau

SEQ ID NO: 2737594 - RNA, 21 nt, Human
auguagcaaauuccaauacau

SEQ ID NO: 2737595 - RNA, 23 nt, Human
auguaggguucccuuauauuaau

SEQ ID NO: 2737596 - RNA, 13 nt, Human
auguaucuuauuc

SEQ ID NO: 2737597 - RNA, 18 nt, Human
auguauguacuucaugcu

SEQ ID NO: 2737598 - RNA, 12 nt, Human
auguauuauuua

SEQ ID NO: 2737599 - RNA, 21 nt, Human
auguauucuuuuaguuuuuaa

SEQ ID NO: 2737600 - RNA, 15 nt, Human
auguauuuauaaaua

SEQ ID NO: 2737601 - RNA, 16 nt, Human
auguauuuuaaaauaa

SEQ ID NO: 2737602 - RNA, 23 nt, Human
augucaaggguucaagauuguuc

SEQ ID NO: 2737603 - RNA, 18 nt, Human
augucacuagggcaggga

SEQ ID NO: 2737604 - RNA, 15 nt, Human
augucauuucauuuc

SEQ ID NO: 2737605 - RNA, 16 nt, Human
augucauuucauuucc

SEQ ID NO: 2737606 - RNA, 21 nt, Human
augucauuugcuggagcucug

SEQ ID NO: 2737607 - RNA, 20 nt, Human
augucgucaaagcugaaaug

SEQ ID NO: 2737608 - RNA, 15 nt, Human
augucugaaauggaa

SEQ ID NO: 2737609 - RNA, 18 nt, Human
augucugaaauggaacag

SEQ ID NO: 2737610 - RNA, 15 nt, Human
augucugccacaccu

SEQ ID NO: 2737611 - RNA, 21 nt, Human
augugaaauaaaaguagaaua

SEQ ID NO: 2737612 - RNA, 16 nt, Human
augugaaauuuacauc

SEQ ID NO: 2737613 - RNA, 11 nt, Human
augugcaauaa

SEQ ID NO: 2737614 - RNA, 11 nt, Human
augugcaauau

SEQ ID NO: 2737615 - RNA, 15 nt, Human
augugcagccaccag

SEQ ID NO: 2737616 - RNA, 20 nt, Human
augugcauauuuuauuauag

SEQ ID NO: 2737617 - RNA, 22 nt, Human
augugcuaguaauuggaaaggc

SEQ ID NO: 2737618 - RNA, 12 nt, Human
augugcuggcca

SEQ ID NO: 2737619 - RNA, 20 nt, Human
augugcuuguaaaaagucaa

SEQ ID NO: 2737620 - RNA, 23 nt, Human
augugcuuuuaaaaaaaaauacu

SEQ ID NO: 2737621 - RNA, 13 nt, Human
auguggcuguauc

SEQ ID NO: 2737622 - RNA, 11 nt, Human
auguguaucuc

SEQ ID NO: 2737623 - RNA, 15 nt, Human
auguguggcauuuuc

SEQ ID NO: 2737624 - RNA, 17 nt, Human
auguuaaaacugggaca

SEQ ID NO: 2737625 - RNA, 18 nt, Human
auguuaaaacugggacag

SEQ ID NO: 2737626 - RNA, 16 nt, Human
auguuacuacaugcac

SEQ ID NO: 2737627 - RNA, 18 nt, Human
auguuagagaauuuccuu

SEQ ID NO: 2737628 - RNA, 22 nt, Human
auguucacccaaccacauccca

SEQ ID NO: 2737629 - RNA, 18 nt, Human
auguuccuaauaaagcuu

SEQ ID NO: 2737630 - RNA, 17 nt, Human
auguuccuagugaaaga

SEQ ID NO: 2737631 - RNA, 15 nt, Human
auguuccuuauauuu

SEQ ID NO: 2737632 - RNA, 20 nt, Human
auguuccuuuuaaagaaaca

SEQ ID NO: 2737633 - RNA, 22 nt, Human
auguuccuuuuaaagaaacaaa

SEQ ID NO: 2737634 - RNA, 14 nt, Human
auguucuaagaagu

SEQ ID NO: 2737635 - RNA, 16 nt, Human
auguugacaugggaca

SEQ ID NO: 2737636 - RNA, 21 nt, Human
auguugacucuaaaguugauu

SEQ ID NO: 2737637 - RNA, 16 nt, Human
auguugagcagcaucu

SEQ ID NO: 2737638 - RNA, 14 nt, Human
auguuggccaggcu

SEQ ID NO: 2737639 - RNA, 16 nt, Human
auguuuaagaaauuuu

SEQ ID NO: 2737640 - RNA, 21 nt, Human
auguuuaauucugaaagcaac

SEQ ID NO: 2737641 - RNA, 17 nt, Human
auguuuacagaucccca

SEQ ID NO: 2737642 - RNA, 15 nt, Human
auguuuagaaacaca

SEQ ID NO: 2737643 - RNA, 12 nt, Human
auguuuaggaug

SEQ ID NO: 2737644 - RNA, 17 nt, Human
auguuucaaacauauau

SEQ ID NO: 2737645 - RNA, 23 nt, Human
auguuucaaacauauauaacaau

SEQ ID NO: 2737646 - RNA, 12 nt, Human
auguuucacugu

SEQ ID NO: 2737647 - RNA, 16 nt, Human
auguuucacugugcaa

SEQ ID NO: 2737648 - RNA, 14 nt, Human
auguuucuugggga

SEQ ID NO: 2737649 - RNA, 20 nt, Human
auguuucuuggggaauaugu

SEQ ID NO: 2737650 - RNA, 19 nt, Human
auguuugcauguucacuuc

SEQ ID NO: 2737651 - RNA, 19 nt, Human
auguuuucaggcuagaugu

SEQ ID NO: 2737652 - RNA, 15 nt, Human
auguuuuuuuuuaaa

SEQ ID NO: 2737653 - RNA, 16 nt, Human
auuaaaagaauauuuu

SEQ ID NO: 2737654 - RNA, 18 nt, Human
auuaaaagugucuugaga

SEQ ID NO: 2737655 - RNA, 12 nt, Human
auuaaaaucaca

SEQ ID NO: 2737656 - RNA, 19 nt, Human
auuaaaaucacaaacucau

SEQ ID NO: 2737657 - RNA, 13 nt, Human
auuaaaauuuuuu

SEQ ID NO: 2737658 - RNA, 13 nt, Human
auuaaagaucugc

SEQ ID NO: 2737659 - RNA, 14 nt, Human
auuaaaguucuagu

SEQ ID NO: 2737660 - RNA, 15 nt, Human
auuaaaguucuagug

SEQ ID NO: 2737661 - RNA, 15 nt, Human
auuaaauauaauaug

SEQ ID NO: 2737662 - RNA, 20 nt, Human
auuaaauggaaguaaauguu

SEQ ID NO: 2737663 - RNA, 22 nt, Human
auuaacucagacacaaauaaag

SEQ ID NO: 2737664 - RNA, 18 nt, Human
auuaagaaaaucuauuuu

SEQ ID NO: 2737665 - RNA, 14 nt, Human
auuaagaaaggaag

SEQ ID NO: 2737666 - RNA, 15 nt, Human
auuaagacuuuaugu

SEQ ID NO: 2737667 - RNA, 20 nt, Human
auuaaggcauaagaaaacua

SEQ ID NO: 2737668 - RNA, 15 nt, Human
auuaaguaaugauaa

SEQ ID NO: 2737669 - RNA, 13 nt, Human
auuaauauauauu

SEQ ID NO: 2737670 - RNA, 19 nt, Human
auuaauauauauuaucuuu

SEQ ID NO: 2737671 - RNA, 12 nt, Human
auuaauauaugu

SEQ ID NO: 2737672 - RNA, 19 nt, Human
auuaauuccuucagcacuu

SEQ ID NO: 2737673 - RNA, 14 nt, Human
auuaauuuguaaga

SEQ ID NO: 2737674 - RNA, 17 nt, Human
auuacaaauccaaugaa

SEQ ID NO: 2737675 - RNA, 19 nt, Human
auuacagaugggcaaauua

SEQ ID NO: 2737676 - RNA, 16 nt, Human
auuacaggcgugagcc

SEQ ID NO: 2737677 - RNA, 19 nt, Human
auuacaggcgugagccacc

SEQ ID NO: 2737678 - RNA, 20 nt, Human
auuacaguuagagauuuuua

SEQ ID NO: 2737679 - RNA, 22 nt, Human
auuacaguuagagauuuuuaaa

SEQ ID NO: 2737680 - RNA, 14 nt, Human
auuacaucuuucac

SEQ ID NO: 2737681 - RNA, 23 nt, Human
auuacaucuuucacauuggcuau

SEQ ID NO: 2737682 - RNA, 18 nt, Human
auuacauuuguauaaaau

SEQ ID NO: 2737683 - RNA, 18 nt, Human
auuacauuuuaaacacau

SEQ ID NO: 2737684 - RNA, 17 nt, Human
auuaccaguuuuccuaa

SEQ ID NO: 2737685 - RNA, 23 nt, Human
auuaccauuauggauaaagauga

SEQ ID NO: 2737686 - RNA, 16 nt, Human
auuacccccagcuuug

SEQ ID NO: 2737687 - RNA, 17 nt, Human
auuaccuugagccagua

SEQ ID NO: 2737688 - RNA, 18 nt, Human
auuacugccuauuuuaau

SEQ ID NO: 2737689 - RNA, 19 nt, Human
auuacugccuauuuuaaua

SEQ ID NO: 2737690 - RNA, 20 nt, Human
auuacugccuauuuuaauaa

SEQ ID NO: 2737691 - RNA, 13 nt, Human
auuacuguaagaa

SEQ ID NO: 2737692 - RNA, 15 nt, Human
auuacuguaagaaaa

SEQ ID NO: 2737693 - RNA, 17 nt, Human
auuacuguaagaaaaua

SEQ ID NO: 2737694 - RNA, 20 nt, Human
auuacuguaagaaaauauca

SEQ ID NO: 2737695 - RNA, 21 nt, Human
auuacuguaagaaaauaucac

SEQ ID NO: 2737696 - RNA, 22 nt, Human
auuacuguaagaaaauaucacu

SEQ ID NO: 2737697 - RNA, 14 nt, Human
auuacuuuugcugu

SEQ ID NO: 2737698 - RNA, 13 nt, Human
auuagaaauguaa

SEQ ID NO: 2737699 - RNA, 18 nt, Human
auuagaaauguaauuaug

SEQ ID NO: 2737700 - RNA, 19 nt, Human
auuagaaauguaauuaugu

SEQ ID NO: 2737701 - RNA, 12 nt, Human
auuagaccaagc

SEQ ID NO: 2737702 - RNA, 19 nt, Human
auuagauguucucuaucau

SEQ ID NO: 2737703 - RNA, 17 nt, Human
auuagcauggccacauc

SEQ ID NO: 2737704 - RNA, 13 nt, Human
auuaggaaaaguu

SEQ ID NO: 2737705 - RNA, 21 nt, Human
auuaggauggcuaguaucaaa

SEQ ID NO: 2737706 - RNA, 23 nt, Human
auuagggugguauuuagucuauu

SEQ ID NO: 2737707 - RNA, 19 nt, Human
auuaguuagccaauauuuu

SEQ ID NO: 2737708 - RNA, 17 nt, Human
auuauaauauacuauau

SEQ ID NO: 2737709 - RNA, 14 nt, Human
auuauaauuuuuuu

SEQ ID NO: 2737710 - RNA, 16 nt, Human
auuauaauuuuuuuca

SEQ ID NO: 2737711 - RNA, 16 nt, Human
auuguaaaauggugug

SEQ ID NO: 2737712 - RNA, 16 nt, Human
auuguacaguuuuuau

SEQ ID NO: 2737713 - RNA, 12 nt, Human
auuguagaaaag

SEQ ID NO: 2737714 - RNA, 15 nt, Human
auuguagcauccugg

SEQ ID NO: 2737715 - RNA, 15 nt, Human
auuguauucagaguu

SEQ ID NO: 2737716 - RNA, 17 nt, Human
auugucacaggacagcc

SEQ ID NO: 2737717 - RNA, 14 nt, Human
auuguccaggucua

SEQ ID NO: 2737718 - RNA, 13 nt, Human
auugucuagugaa

SEQ ID NO: 2737719 - RNA, 14 nt, Human
auugucuagugaaa

SEQ ID NO: 2737720 - RNA, 15 nt, Human
auugugaucagacca

SEQ ID NO: 2737721 - RNA, 21 nt, Human
auugugccccugcacuccagc

SEQ ID NO: 2737722 - RNA, 16 nt, Human
auugugcuggaaaugg

SEQ ID NO: 2737723 - RNA, 17 nt, Human
auugugcuggaaaugga

SEQ ID NO: 2737724 - RNA, 14 nt, Human
auugugggcucugg

SEQ ID NO: 2737725 - RNA, 18 nt, Human
auuguguguuauuuaaau

SEQ ID NO: 2737726 - RNA, 19 nt, Human
auuguguguuauuuaaaug

SEQ ID NO: 2737727 - RNA, 20 nt, Human
auuguguuuauaauuuuaaa

SEQ ID NO: 2737728 - RNA, 19 nt, Human
auuguuaaaggcuaugauu

SEQ ID NO: 2737729 - RNA, 13 nt, Human
auuguuacuggua

SEQ ID NO: 2737730 - RNA, 14 nt, Human
auuguuacugguac

SEQ ID NO: 2737731 - RNA, 17 nt, Human
auuguucucuaauaugu

SEQ ID NO: 2737732 - RNA, 21 nt, Human
auuguugacaacugugacugu

SEQ ID NO: 2737733 - RNA, 15 nt, Human
auuguuggcuguucc

SEQ ID NO: 2737734 - RNA, 16 nt, Human
auuguuuaaaaucauu

SEQ ID NO: 2737735 - RNA, 16 nt, Human
auuguuugucugucuu

SEQ ID NO: 2737736 - RNA, 22 nt, Human
auuguuuuuccuuguauuuaaa

SEQ ID NO: 2737737 - RNA, 17 nt, Human
auuuaaaaaacuaacac

SEQ ID NO: 2737738 - RNA, 14 nt, Human
auuuaaaauauuuu

SEQ ID NO: 2737739 - RNA, 13 nt, Human
auuuaaacaucag

SEQ ID NO: 2737740 - RNA, 21 nt, Human
auuuaaacaucagcaaaaaag

SEQ ID NO: 2737741 - RNA, 18 nt, Human
auuuaaaccuauacucac

SEQ ID NO: 2737742 - RNA, 23 nt, Human
auuuaaagcuuauuaaaacucau

SEQ ID NO: 2737743 - RNA, 23 nt, Human
auuuaaauagcuuuuuucucuga

SEQ ID NO: 2737744 - RNA, 15 nt, Human
auuuaaauauuuauu

SEQ ID NO: 2737745 - RNA, 17 nt, Human
auuuaaauauuuauuua

SEQ ID NO: 2737746 - RNA, 20 nt, Human
auuuaaauuauuuuuguuca

SEQ ID NO: 2737747 - RNA, 21 nt, Human
auuuaaauuauuuuuguucau

SEQ ID NO: 2737748 - RNA, 15 nt, Human
auuuaacauuauuua

SEQ ID NO: 2737749 - RNA, 16 nt, Human
auuuaacauuauuuau

SEQ ID NO: 2737750 - RNA, 20 nt, Human
auuuaagagaacaagcaaau

SEQ ID NO: 2737751 - RNA, 16 nt, Human
auuuaagauaauuaua

SEQ ID NO: 2737752 - RNA, 16 nt, Human
auuuaagguauauaaa

SEQ ID NO: 2737753 - RNA, 21 nt, Human
auuuaauagguuuggacaaaa

SEQ ID NO: 2737754 - RNA, 16 nt, Human
auuuaauguggaaaug

SEQ ID NO: 2737755 - RNA, 14 nt, Human
auuuaauuauuuca

SEQ ID NO: 2737756 - RNA, 18 nt, Human
auuuaauucauguugccu

SEQ ID NO: 2737757 - RNA, 19 nt, Human
auuuacagagacagaaagc

SEQ ID NO: 2737758 - RNA, 22 nt, Human
auuuacgcucauuguagaaaag

SEQ ID NO: 2737759 - RNA, 19 nt, Human
auuuacggaacucaaauac

SEQ ID NO: 2737760 - RNA, 19 nt, Human
auuuacuaugcacaacaga

SEQ ID NO: 2737761 - RNA, 17 nt, Human
auuuacuuuguuauuuu

SEQ ID NO: 2737762 - RNA, 12 nt, Human
auuuacuuuuaa

SEQ ID NO: 2737763 - RNA, 23 nt, Human
auuuagaaagaagcccaauauua

SEQ ID NO: 2737764 - RNA, 15 nt, Human
auuuagauguauagg

SEQ ID NO: 2737765 - RNA, 22 nt, Human
auuuagcaggaagcugugagag

SEQ ID NO: 2737766 - RNA, 18 nt, Human
auuuaguauuuuguuuca

SEQ ID NO: 2737767 - RNA, 16 nt, Human
auuuaguuauaaaaau

SEQ ID NO: 2737768 - RNA, 19 nt, Human
auuuaguuauaaaaauaua

SEQ ID NO: 2737769 - RNA, 21 nt, Human
auuuauaaaaauaaaaaacac

SEQ ID NO: 2737770 - RNA, 23 nt, Human
auuuauaaaaauaaaaaacacug

SEQ ID NO: 2737771 - RNA, 17 nt, Human
auuuauaacaaccuaaa

SEQ ID NO: 2737772 - RNA, 15 nt, Human
auuuauaacucauca

SEQ ID NO: 2737773 - RNA, 14 nt, Human
auuuauauauguau

SEQ ID NO: 2737774 - RNA, 21 nt, Human
auuuauauauuuauaacucau

SEQ ID NO: 2737775 - RNA, 20 nt, Human
auuuauauggggaauauauu

SEQ ID NO: 2737776 - RNA, 21 nt, Human
auuuauauggggaauauauuu

SEQ ID NO: 2737777 - RNA, 19 nt, Human
auuuauauugauaagaucu

SEQ ID NO: 2737778 - RNA, 19 nt, Human
auuuaucuauuuaaauauu

SEQ ID NO: 2737779 - RNA, 14 nt, Human
auuuaucuuuguac

SEQ ID NO: 2737780 - RNA, 17 nt, Human
auuuaugagcucuucau

SEQ ID NO: 2737781 - RNA, 18 nt, Human
auuuaugagcucuucaug

SEQ ID NO: 2737782 - RNA, 18 nt, Human
auuuaugcauauuauuuu

SEQ ID NO: 2737783 - RNA, 22 nt, Human
auuuaugcauauuauuuuaugu

SEQ ID NO: 2737784 - RNA, 12 nt, Human
auuuauuaauau

SEQ ID NO: 2737785 - RNA, 18 nt, Human
auuuauuacuguaagaaa

SEQ ID NO: 2737786 - RNA, 14 nt, Human
auuuauuauuuuca

SEQ ID NO: 2737787 - RNA, 19 nt, Human
auuuauucaauaaaguauu

SEQ ID NO: 2737788 - RNA, 13 nt, Human
auuuauugagcac

SEQ ID NO: 2737789 - RNA, 14 nt, Human
auuuauugagcacc

SEQ ID NO: 2737790 - RNA, 20 nt, Human
auuuauugaggcuuuaaaac

SEQ ID NO: 2737791 - RNA, 12 nt, Human
auuuauuuuaau

SEQ ID NO: 2737792 - RNA, 13 nt, Human
auuuauuuuaaua

SEQ ID NO: 2737793 - RNA, 14 nt, Human
auuuauuuuaauaa

SEQ ID NO: 2737794 - RNA, 15 nt, Human
auuuauuuuuccauu

SEQ ID NO: 2737795 - RNA, 15 nt, Human
auuuauuuuuuuacu

SEQ ID NO: 2737796 - RNA, 12 nt, Human
auuucaaaaaaa

SEQ ID NO: 2737797 - RNA, 19 nt, Human
auuucagaaaugcugucau

SEQ ID NO: 2737798 - RNA, 15 nt, Human
auuucagaagaaauu

SEQ ID NO: 2737799 - RNA, 21 nt, Human
auuucagcagcugcagcucau

SEQ ID NO: 2737800 - RNA, 19 nt, Human
auuucauaccuaucaucuu

SEQ ID NO: 2737801 - RNA, 15 nt, Human
auuucaugaaaagau

SEQ ID NO: 2737802 - RNA, 17 nt, Human
auuucaugaaaagauua

SEQ ID NO: 2737803 - RNA, 15 nt, Human
auuucauucaauauc

SEQ ID NO: 2737804 - RNA, 17 nt, Human
auuucauugcucagaaa

SEQ ID NO: 2737805 - RNA, 23 nt, Human
auuucauugcucagaaaugucau

SEQ ID NO: 2737806 - RNA, 14 nt, Human
auuucauuuccuau

SEQ ID NO: 2737807 - RNA, 14 nt, Human
auuuccaagaaaua

SEQ ID NO: 2737808 - RNA, 22 nt, Human
auuuccaagaaauauuccuuaa

SEQ ID NO: 2737809 - RNA, 19 nt, Human
auuucccccuagccugccu

SEQ ID NO: 2737810 - RNA, 18 nt, Human
auuuccuaaauauauuuu

SEQ ID NO: 2737811 - RNA, 19 nt, Human
auuuccuaaauauauuuua

SEQ ID NO: 2737812 - RNA, 16 nt, Human
auuuccuaauuuugag

SEQ ID NO: 2737813 - RNA, 22 nt, Human
auuuccuaguucuguagaaaug

SEQ ID NO: 2737814 - RNA, 23 nt, Human
auuuccuaguucuguagaaaugg

SEQ ID NO: 2737815 - RNA, 16 nt, Human
auuuccucauuuuuau

SEQ ID NO: 2737816 - RNA, 19 nt, Human
auuuccuuauucagaauuu

SEQ ID NO: 2737817 - RNA, 14 nt, Human
auuuccuucuuuuu

SEQ ID NO: 2737818 - RNA, 17 nt, Human
auuucuaaaaguuuaag

SEQ ID NO: 2737819 - RNA, 17 nt, Human
auuucuaggacugaauu

SEQ ID NO: 2737820 - RNA, 13 nt, Human
auuucuaugaaau

SEQ ID NO: 2737821 - RNA, 14 nt, Human
auuucuaugaaaua

SEQ ID NO: 2737822 - RNA, 15 nt, Human
auuucuaugaaauau

SEQ ID NO: 2737823 - RNA, 16 nt, Human
auuucuaugaaauauu

SEQ ID NO: 2737824 - RNA, 11 nt, Human
auuucucauac

SEQ ID NO: 2737825 - RNA, 21 nt, Human
auuucuuaaaucuaguaauuu

SEQ ID NO: 2737826 - RNA, 20 nt, Human
auuucuugagguaaaagcau

SEQ ID NO: 2737827 - RNA, 21 nt, Human
auuucuugagguaaaagcauc

SEQ ID NO: 2737828 - RNA, 22 nt, Human
auuucuugaguuuuguuuuaaa

SEQ ID NO: 2737829 - RNA, 16 nt, Human
auuucuuuuuuaaaug

SEQ ID NO: 2737830 - RNA, 22 nt, Human
auuucuuuuuuaaaugaagaaa

SEQ ID NO: 2737831 - RNA, 18 nt, Human
auuugaaauauugacuuu

SEQ ID NO: 2737832 - RNA, 21 nt, Human
auuugaaauauugacuuuuua

SEQ ID NO: 2737833 - RNA, 21 nt, Human
auuugaaauauuuucuuuguu

SEQ ID NO: 2737834 - RNA, 14 nt, Human
auuugaaauuguau

SEQ ID NO: 2737835 - RNA, 14 nt, Human
auuugaauauaaau

SEQ ID NO: 2737836 - RNA, 21 nt, Human
auuugaauauaaauuuaucau

SEQ ID NO: 2737837 - RNA, 17 nt, Human
auuugaaugcauuuugu

SEQ ID NO: 2737838 - RNA, 21 nt, Human
auuugacuagaaaauuuaaaa

SEQ ID NO: 2737839 - RNA, 17 nt, Human
auuugagauacaaacau

SEQ ID NO: 2737840 - RNA, 16 nt, Human
auuugaugcuacagga

SEQ ID NO: 2737841 - RNA, 16 nt, Human
auuugcugagcaugua

SEQ ID NO: 2737842 - RNA, 20 nt, Human
auuugcugagcauguacuga

SEQ ID NO: 2737843 - RNA, 18 nt, Human
auuugcugauugucugaa

SEQ ID NO: 2737844 - RNA, 18 nt, Human
auuugcuggagcucugcc

SEQ ID NO: 2737845 - RNA, 13 nt, Human
auuugcuguuauu

SEQ ID NO: 2737846 - RNA, 19 nt, Human
auuugcuguuauuuuaucu

SEQ ID NO: 2737847 - RNA, 18 nt, Human
auuuggccguuuugugaa

SEQ ID NO: 2737848 - RNA, 18 nt, Human
auuugggcacaacacauc

SEQ ID NO: 2737849 - RNA, 18 nt, Human
auuugggggacuuacaug

SEQ ID NO: 2737850 - RNA, 11 nt, Human
auuugguucua

SEQ ID NO: 2737851 - RNA, 15 nt, Human
auuugguuuucacau

SEQ ID NO: 2737852 - RNA, 15 nt, Human
auuuguaacaagccu

SEQ ID NO: 2737853 - RNA, 17 nt, Human
auuuguaacaagccucc

SEQ ID NO: 2737854 - RNA, 23 nt, Human
auuuguaacaagccuccuuuuaa

SEQ ID NO: 2737855 - RNA, 18 nt, Human
auuuguaguguuggagaa

SEQ ID NO: 2737856 - RNA, 19 nt, Human
caaaggacaccauuuuggc

SEQ ID NO: 2737857 - RNA, 14 nt, Human
caaagggaaagccu

SEQ ID NO: 2737858 - RNA, 13 nt, Human
caaaggucaagaa

SEQ ID NO: 2737859 - RNA, 21 nt, Human
caaaguccugggauuacaggu

SEQ ID NO: 2737860 - RNA, 21 nt, Human
caaagugagcuccuaagccau

SEQ ID NO: 2737861 - RNA, 23 nt, Human
caaagugagcuccuaagccaugg

SEQ ID NO: 2737862 - RNA, 20 nt, Human
caaagugcuggcauuacagg

SEQ ID NO: 2737863 - RNA, 14 nt, Human
caaagugcugggau

SEQ ID NO: 2737864 - RNA, 22 nt, Human
caaagugcugggauuaacaggu

SEQ ID NO: 2737865 - RNA, 14 nt, Human
caaaguuaagaauc

SEQ ID NO: 2737866 - RNA, 16 nt, Human
caaaguugauuaagaa

SEQ ID NO: 2737867 - RNA, 20 nt, Human
caaaguugauuaagaaagga

SEQ ID NO: 2737868 - RNA, 21 nt, Human
caaaguugauuaagaaaggaa

SEQ ID NO: 2737869 - RNA, 18 nt, Human
caaaguuuaccagaaagc

SEQ ID NO: 2737870 - RNA, 20 nt, Human
caaauacgugggcauucaaa

SEQ ID NO: 2737871 - RNA, 20 nt, Human
caaauagaauuugagcauca

SEQ ID NO: 2737872 - RNA, 16 nt, Human
caaauauaaacagcaa

SEQ ID NO: 2737873 - RNA, 19 nt, Human
caaauauaaacagcaacuu

SEQ ID NO: 2737874 - RNA, 14 nt, Human
caaauauaaauaaa

SEQ ID NO: 2737875 - RNA, 16 nt, Human
caaauauaaauaaaaa

SEQ ID NO: 2737876 - RNA, 18 nt, Human
caaauauaaauaaaaaua

SEQ ID NO: 2737877 - RNA, 15 nt, Human
caaauauaucugcua

SEQ ID NO: 2737878 - RNA, 15 nt, Human
caaauaugcaaagca

SEQ ID NO: 2737879 - RNA, 16 nt, Human
caaauaugcaaagcac

SEQ ID NO: 2737880 - RNA, 17 nt, Human
caaauaugcaaagcacu

SEQ ID NO: 2737881 - RNA, 23 nt, Human
caaaucaaaagacuuuuuccuug

SEQ ID NO: 2737882 - RNA, 20 nt, Human
caaaucagaccuggcugcuu

SEQ ID NO: 2737883 - RNA, 17 nt, Human
caaauccaaugaaauga

SEQ ID NO: 2737884 - RNA, 14 nt, Human
caaaugcaccaugu

SEQ ID NO: 2737885 - RNA, 19 nt, Human
caaaugcuuaugaaacuaa

SEQ ID NO: 2737886 - RNA, 16 nt, Human
caaauggaaaguaacu

SEQ ID NO: 2737887 - RNA, 16 nt, Human
caaaugggaaacaaaa

SEQ ID NO: 2737888 - RNA, 22 nt, Human
caaaugggaaacaaaaggauaa

SEQ ID NO: 2737889 - RNA, 20 nt, Human
caaauguaauugauuuauuu

SEQ ID NO: 2737890 - RNA, 14 nt, Human
caaauguucaucaa

SEQ ID NO: 2737891 - RNA, 15 nt, Human
caaauguucaucaau

SEQ ID NO: 2737892 - RNA, 21 nt, Human
caaauguucaucaaugaauga

SEQ ID NO: 2737893 - RNA, 21 nt, Human
caaauuaaggcauaagaaaac

SEQ ID NO: 2737894 - RNA, 12 nt, Human
caaauucacaag

SEQ ID NO: 2737895 - RNA, 12 nt, Human
caaauuccagaa

SEQ ID NO: 2737896 - RNA, 18 nt, Human
caaauugagcuagggggg

SEQ ID NO: 2737897 - RNA, 13 nt, Human
caaauugucacag

SEQ ID NO: 2737898 - RNA, 17 nt, Human
caaauuuacagagacag

SEQ ID NO: 2737899 - RNA, 22 nt, Human
caaauuuacagagacagaaagc

SEQ ID NO: 2737900 - RNA, 19 nt, Human
caacaaaagcgauuauuau

SEQ ID NO: 2737901 - RNA, 12 nt, Human
caacaaacauaa

SEQ ID NO: 2737902 - RNA, 21 nt, Human
caacaacaaaagcgauuauua

SEQ ID NO: 2737903 - RNA, 19 nt, Human
caacacacagauuugagcu

SEQ ID NO: 2737904 - RNA, 22 nt, Human
caacacaucaggaaagagagca

SEQ ID NO: 2737905 - RNA, 17 nt, Human
caacaccccacagaagu

SEQ ID NO: 2737906 - RNA, 16 nt, Human
caacacggacgaaccu

SEQ ID NO: 2737907 - RNA, 23 nt, Human
caacacggacgaaccuugaaaac

SEQ ID NO: 2737908 - RNA, 12 nt, Human
caacagcacccu

SEQ ID NO: 2737909 - RNA, 19 nt, Human
caacagcacccucuccaga

SEQ ID NO: 2737910 - RNA, 23 nt, Human
caacagcacccucuccagaugca

SEQ ID NO: 2737911 - RNA, 18 nt, Human
caacagguaaaacagggc

SEQ ID NO: 2737912 - RNA, 18 nt, Human
caacaguagagagggaac

SEQ ID NO: 2737913 - RNA, 23 nt, Human
caacaguuuuugcuaauuuuuag

SEQ ID NO: 2737914 - RNA, 14 nt, Human
caacaguuuuuuau

SEQ ID NO: 2737915 - RNA, 13 nt, Human
caacauagugaga

SEQ ID NO: 2737916 - RNA, 19 nt, Human
caacaucgcagacacaugu

SEQ ID NO: 2737917 - RNA, 20 nt, Human
caacaugcacugauguugug

SEQ ID NO: 2737918 - RNA, 19 nt, Human
caaccaaagacuacauauu

SEQ ID NO: 2737919 - RNA, 22 nt, Human
caaccaaauggagugacuuagu

SEQ ID NO: 2737920 - RNA, 19 nt, Human
caaccacaucccacucaca

SEQ ID NO: 2737921 - RNA, 18 nt, Human
caaccacucauucaaaag

SEQ ID NO: 2737922 - RNA, 16 nt, Human
caaccacuucauucuu

SEQ ID NO: 2737923 - RNA, 12 nt, Human
caacccaaaugu

SEQ ID NO: 2737924 - RNA, 14 nt, Human
caaccggccaccag

SEQ ID NO: 2737925 - RNA, 16 nt, Human
caaccuaaauuugguu

SEQ ID NO: 2737926 - RNA, 18 nt, Human
caaccuccaccuucuggg

SEQ ID NO: 2737927 - RNA, 12 nt, Human
caaccuccgccu

SEQ ID NO: 2737928 - RNA, 13 nt, Human
caaccuccgccuc

SEQ ID NO: 2737929 - RNA, 16 nt, Human
caaccuccgccuccca

SEQ ID NO: 2737930 - RNA, 17 nt, Human
caaccuccgccucccau

SEQ ID NO: 2737931 - RNA, 16 nt, Human
caaccucugccuccca

SEQ ID NO: 2737932 - RNA, 17 nt, Human
caaccucugccucccag

SEQ ID NO: 2737933 - RNA, 12 nt, Human
caaccugccagc

SEQ ID NO: 2737934 - RNA, 13 nt, Human
caaccugccagcu

SEQ ID NO: 2737935 - RNA, 20 nt, Human
caaccuggaguugaaaaucu

SEQ ID NO: 2737936 - RNA, 17 nt, Human
caaccuucugaggagcu

SEQ ID NO: 2737937 - RNA, 13 nt, Human
caaccuuuuccca

SEQ ID NO: 2737938 - RNA, 15 nt, Human
caaccuuuucccaac

SEQ ID NO: 2737939 - RNA, 23 nt, Human
caacggggugaaacccugucucu

SEQ ID NO: 2737940 - RNA, 15 nt, Human
caacguggcccagag

SEQ ID NO: 2737941 - RNA, 23 nt, Human
caacguggcuuuuuuuuuuuccc

SEQ ID NO: 2737942 - RNA, 20 nt, Human
caacuaucucauuuccaagc

SEQ ID NO: 2737943 - RNA, 15 nt, Human
caacuauggccugug

SEQ ID NO: 2737944 - RNA, 20 nt, Human
caacuccaaacugacucuua

SEQ ID NO: 2737945 - RNA, 20 nt, Human
caacuccagaaagugacaag

SEQ ID NO: 2737946 - RNA, 22 nt, Human
caacuccagaaagugacaagcu

SEQ ID NO: 2737947 - RNA, 11 nt, Human
caacucccugc

SEQ ID NO: 2737948 - RNA, 19 nt, Human
caacucccugccccccagc

SEQ ID NO: 2737949 - RNA, 16 nt, Human
caacuccuuucucauc

SEQ ID NO: 2737950 - RNA, 13 nt, Human
caacugaggcaga

SEQ ID NO: 2737951 - RNA, 21 nt, Human
caacugaggcagacagcagcu

SEQ ID NO: 2737952 - RNA, 19 nt, Human
caacuggauacuagaucuu

SEQ ID NO: 2737953 - RNA, 23 nt, Human
caacugugacuguacccaaaugg

SEQ ID NO: 2737954 - RNA, 18 nt, Human
caacuuguguuccuaaca

SEQ ID NO: 2737955 - RNA, 23 nt, Human
caacuuugaagucugauuuuccu

SEQ ID NO: 2737956 - RNA, 22 nt, Human
caacuuuuccuuugaauccucu

SEQ ID NO: 2737957 - RNA, 15 nt, Human
caacuuuuguguaau

SEQ ID NO: 2737958 - RNA, 14 nt, Human
caagaaaugaaagc

SEQ ID NO: 2737959 - RNA, 17 nt, Human
caagaaaugaaagcagg

SEQ ID NO: 2737960 - RNA, 12 nt, Human
caagaacuuauu

SEQ ID NO: 2737961 - RNA, 19 nt, Human
caagaagauaaucuccaaa

SEQ ID NO: 2737962 - RNA, 12 nt, Human
caagaaggaaag

SEQ ID NO: 2737963 - RNA, 13 nt, Human
caagaaggaaaga

SEQ ID NO: 2737964 - RNA, 19 nt, Human
caagaaggaaagauuuugu

SEQ ID NO: 2737965 - RNA, 20 nt, Human
caagaaugagaagaaugacu

SEQ ID NO: 2737966 - RNA, 21 nt, Human
caagacccaaaaggcagaagc

SEQ ID NO: 2737967 - RNA, 21 nt, Human
caagaccccaucucaaaaaaa

SEQ ID NO: 2737968 - RNA, 14 nt, Human
caagacucugucuc

SEQ ID NO: 2737969 - RNA, 22 nt, Human
caagacucugucucaaaaaaua

SEQ ID NO: 2737970 - RNA, 20 nt, Human
caagacugcaaacccuuuca

SEQ ID NO: 2737971 - RNA, 19 nt, Human
caagacugcacaucaaaau

SEQ ID NO: 2737972 - RNA, 21 nt, Human
caagacugcacaucaaaauau

SEQ ID NO: 2737973 - RNA, 23 nt, Human
caagagaauugcuugaacccagg

SEQ ID NO: 2737974 - RNA, 19 nt, Human
caagagagcgagacccugu

SEQ ID NO: 2737975 - RNA, 14 nt, Human
caagagccugagug

SEQ ID NO: 2737976 - RNA, 20 nt, Human
caagagccuuuuuuugaaaa

SEQ ID NO: 2737977 - RNA, 21 nt, Human
caagaggcuguucccaccagg

SEQ ID NO: 2737978 - RNA, 22 nt, Human
caagaugaugaugaucuuuaaa

SEQ ID NO: 2737979 - RNA, 18 nt, Human
caagauugugucccauuc

SEQ ID NO: 2737980 - RNA, 15 nt, Human
caagauuguuccugc

SEQ ID NO: 2737981 - RNA, 15 nt, Human
caagauuucagauuu

SEQ ID NO: 2737982 - RNA, 22 nt, Human
caagauuucagauuugugacca

SEQ ID NO: 2737983 - RNA, 17 nt, Human
caagcaaaugugaauca

SEQ ID NO: 2737984 - RNA, 16 nt, Human
caagcaauccucccac

SEQ ID NO: 2737985 - RNA, 13 nt, Human
caagcaccuggga

SEQ ID NO: 2737986 - RNA, 22 nt, Human
caagcacuaaacaaagagugaa

SEQ ID NO: 2737987 - RNA, 17 nt, Human
caagcagaagagaaaau

SEQ ID NO: 2737988 - RNA, 19 nt, Human
caagcagcccuuagcccuu

SEQ ID NO: 2737989 - RNA, 18 nt, Human
caagcaggaagaaggaaa

SEQ ID NO: 2737990 - RNA, 13 nt, Human
caagcaguuugaa

SEQ ID NO: 2737991 - RNA, 14 nt, Human
caagcaguuugaaa

SEQ ID NO: 2737992 - RNA, 17 nt, Human
caagcaguuugaaauug

SEQ ID NO: 2737993 - RNA, 22 nt, Human
caagcauaccaacacgagcagg

SEQ ID NO: 2737994 - RNA, 23 nt, Human
caagcaugagucacuacgccugg

SEQ ID NO: 2737995 - RNA, 12 nt, Human
caagcauucugu

SEQ ID NO: 2737996 - RNA, 17 nt, Human
caagcauuuagauguau

SEQ ID NO: 2737997 - RNA, 22 nt, Human
caagcauuuagauguauagguu

SEQ ID NO: 2737998 - RNA, 15 nt, Human
caagcccuuuacuug

SEQ ID NO: 2737999 - RNA, 22 nt, Human
caagcccuuuacuugaccuccu

SEQ ID NO: 2738000 - RNA, 23 nt, Human
cacagcaguugaaaagacuccaa

SEQ ID NO: 2738001 - RNA, 21 nt, Human
cacagcauggagucacagcca

SEQ ID NO: 2738002 - RNA, 22 nt, Human
cacagcauggagucacagccac

SEQ ID NO: 2738003 - RNA, 17 nt, Human
cacagccccuggucagu

SEQ ID NO: 2738004 - RNA, 23 nt, Human
cacagccccuggucagucugccc

SEQ ID NO: 2738005 - RNA, 20 nt, Human
cacagcccuuuugucucugc

SEQ ID NO: 2738006 - RNA, 22 nt, Human
cacagcccuuuugucucugcaa

SEQ ID NO: 2738007 - RNA, 20 nt, Human
cacagccucuuagaugcagu

SEQ ID NO: 2738008 - RNA, 17 nt, Human
cacagcuucagccagga

SEQ ID NO: 2738009 - RNA, 19 nt, Human
cacagcuucagccaggagc

SEQ ID NO: 2738010 - RNA, 14 nt, Human
cacaggcacagguc

SEQ ID NO: 2738011 - RNA, 17 nt, Human
cacaggcuccaaacugg

SEQ ID NO: 2738012 - RNA, 15 nt, Human
cacaggggacaggau

SEQ ID NO: 2738013 - RNA, 17 nt, Human
cacagugccgacagcuc

SEQ ID NO: 2738014 - RNA, 17 nt, Human
cacagugggagccaggg

SEQ ID NO: 2738015 - RNA, 19 nt, Human
cacagugggagccagggcu

SEQ ID NO: 2738016 - RNA, 19 nt, Human
cacaguuuucugagaaaga

SEQ ID NO: 2738017 - RNA, 16 nt, Human
cacauauccaggcacc

SEQ ID NO: 2738018 - RNA, 19 nt, Human
cacauaucgauuuuuaaaa

SEQ ID NO: 2738019 - RNA, 13 nt, Human
cacaucagcuugc

SEQ ID NO: 2738020 - RNA, 16 nt, Human
cacaucaggaaagaga

SEQ ID NO: 2738021 - RNA, 16 nt, Human
cacauccauucuuccc

SEQ ID NO: 2738022 - RNA, 17 nt, Human
cacauccauucuucccu

SEQ ID NO: 2738023 - RNA, 13 nt, Human
cacauccuguggg

SEQ ID NO: 2738024 - RNA, 19 nt, Human
cacauccugugggaccugg

SEQ ID NO: 2738025 - RNA, 22 nt, Human
cacaucugagccccgaaucuga

SEQ ID NO: 2738026 - RNA, 23 nt, Human
cacaugaacuuguaaaggaauuu

SEQ ID NO: 2738027 - RNA, 16 nt, Human
cacaugaaguccaagc

SEQ ID NO: 2738028 - RNA, 21 nt, Human
cacaugaaguccaagcauuua

SEQ ID NO: 2738029 - RNA, 14 nt, Human
cacaugauccugca

SEQ ID NO: 2738030 - RNA, 17 nt, Human
cacaugauuccagccau

SEQ ID NO: 2738031 - RNA, 12 nt, Human
cacaugggauca

SEQ ID NO: 2738032 - RNA, 13 nt, Human
cacaugggaucaa

SEQ ID NO: 2738033 - RNA, 20 nt, Human
cacauguaucuaugcauuuu

SEQ ID NO: 2738034 - RNA, 22 nt, Human
cacaugugugguacaugguguu

SEQ ID NO: 2738035 - RNA, 13 nt, Human
cacauuaaaaugu

SEQ ID NO: 2738036 - RNA, 14 nt, Human
cacauuacaacagu

SEQ ID NO: 2738037 - RNA, 21 nt, Human
cacauucagggcuauuuuuuc

SEQ ID NO: 2738038 - RNA, 23 nt, Human
cacauucagggcuauuuuuuccc

SEQ ID NO: 2738039 - RNA, 23 nt, Human
cacauuggaaacaagucagucau

SEQ ID NO: 2738040 - RNA, 23 nt, Human
cacauuuaaauaaaguguuugaa

SEQ ID NO: 2738041 - RNA, 19 nt, Human
cacauuuucccuucccuga

SEQ ID NO: 2738042 - RNA, 23 nt, Human
caccaaggagccaaacauccuac

SEQ ID NO: 2738043 - RNA, 16 nt, Human
caccaccacgccuggc

SEQ ID NO: 2738044 - RNA, 16 nt, Human
caccacccuugccaug

SEQ ID NO: 2738045 - RNA, 21 nt, Human
caccaccucaccaguuuccag

SEQ ID NO: 2738046 - RNA, 20 nt, Human
caccagagauaauaugagaa

SEQ ID NO: 2738047 - RNA, 19 nt, Human
caccagaugucgcccuacu

SEQ ID NO: 2738048 - RNA, 14 nt, Human
caccaggacgcccu

SEQ ID NO: 2738049 - RNA, 18 nt, Human
caccaggauauccucccu

SEQ ID NO: 2738050 - RNA, 19 nt, Human
caccaggauauccucccuc

SEQ ID NO: 2738051 - RNA, 15 nt, Human
caccaggcugcucag

SEQ ID NO: 2738052 - RNA, 19 nt, Human
caccaggcugcucagggcu

SEQ ID NO: 2738053 - RNA, 21 nt, Human
caccagucugacuguuuccau

SEQ ID NO: 2738054 - RNA, 21 nt, Human
caccaugcccggcuaauuuuu

SEQ ID NO: 2738055 - RNA, 13 nt, Human
caccaugcugcug

SEQ ID NO: 2738056 - RNA, 14 nt, Human
caccaugcugcugg

SEQ ID NO: 2738057 - RNA, 19 nt, Human
caccaugcugcuggggaag

SEQ ID NO: 2738058 - RNA, 14 nt, Human
cacccacuucccac

SEQ ID NO: 2738059 - RNA, 19 nt, Human
cacccagucuguuccccau

SEQ ID NO: 2738060 - RNA, 21 nt, Human
cacccaguugugacaauuaaa

SEQ ID NO: 2738061 - RNA, 20 nt, Human
cacccauuagcagucccucc

SEQ ID NO: 2738062 - RNA, 21 nt, Human
cacccauuagcagucccucca

SEQ ID NO: 2738063 - RNA, 12 nt, Human
caccccaacagc

SEQ ID NO: 2738064 - RNA, 16 nt, Human
caccccaacagcaccc

SEQ ID NO: 2738065 - RNA, 18 nt, Human
caccccaacagcacccuc

SEQ ID NO: 2738066 - RNA, 21 nt, Human
caccccaacagcacccucucc

SEQ ID NO: 2738067 - RNA, 22 nt, Human
caccccaacagcacccucucca

SEQ ID NO: 2738068 - RNA, 23 nt, Human
caccccaacagcacccucuccag

SEQ ID NO: 2738069 - RNA, 15 nt, Human
caccccuccccugcc

SEQ ID NO: 2738070 - RNA, 17 nt, Human
caccccuccccugcccu

SEQ ID NO: 2738071 - RNA, 12 nt, Human
cacccucccacu

SEQ ID NO: 2738072 - RNA, 15 nt, Human
cacccucccacugcc

SEQ ID NO: 2738073 - RNA, 17 nt, Human
cacccucccacugccaa

SEQ ID NO: 2738074 - RNA, 19 nt, Human
cacccucuccagaugcagc

SEQ ID NO: 2738075 - RNA, 19 nt, Human
cacccugaggugagcauca

SEQ ID NO: 2738076 - RNA, 14 nt, Human
cacccugagguugu

SEQ ID NO: 2738077 - RNA, 15 nt, Human
cacccuguccaaacu

SEQ ID NO: 2738078 - RNA, 23 nt, Human
caccgcagggugaacugcagcga

SEQ ID NO: 2738079 - RNA, 15 nt, Human
caccuacaugaggua

SEQ ID NO: 2738080 - RNA, 13 nt, Human
caccucagagaca

SEQ ID NO: 2738081 - RNA, 20 nt, Human
caccucagcugccuccccag

SEQ ID NO: 2738082 - RNA, 16 nt, Human
caccucauggaauugg

SEQ ID NO: 2738083 - RNA, 13 nt, Human
caccucccccauc

SEQ ID NO: 2738084 - RNA, 12 nt, Human
caccuccuaaga

SEQ ID NO: 2738085 - RNA, 20 nt, Human
caccuccuaagaaggcaccu

SEQ ID NO: 2738086 - RNA, 19 nt, Human
caccucgcagguucaagca

SEQ ID NO: 2738087 - RNA, 21 nt, Human
caccucuccaaagcccucccu

SEQ ID NO: 2738088 - RNA, 17 nt, Human
caccugagcgcucagcu

SEQ ID NO: 2738089 - RNA, 23 nt, Human
caccugcccugcugagucccagg

SEQ ID NO: 2738090 - RNA, 16 nt, Human
caccugccuauauuuu

SEQ ID NO: 2738091 - RNA, 20 nt, Human
caccugccuuggcuucccaa

SEQ ID NO: 2738092 - RNA, 14 nt, Human
caccugcugagccc

SEQ ID NO: 2738093 - RNA, 15 nt, Human
caccugggauuacaa

SEQ ID NO: 2738094 - RNA, 16 nt, Human
caccuguaaucccagc

SEQ ID NO: 2738095 - RNA, 19 nt, Human
caccuguaaucccagcuac

SEQ ID NO: 2738096 - RNA, 19 nt, Human
caccugugccguccccaga

SEQ ID NO: 2738097 - RNA, 12 nt, Human
caccuguuuuua

SEQ ID NO: 2738098 - RNA, 21 nt, Human
caccuuagaccaccaagccuu

SEQ ID NO: 2738099 - RNA, 14 nt, Human
caccuuaggaauaa

SEQ ID NO: 2738100 - RNA, 15 nt, Human
caccuucuggguuca

SEQ ID NO: 2738101 - RNA, 18 nt, Human
caccuuuagaauauuaaa

SEQ ID NO: 2738102 - RNA, 20 nt, Human
cacgagcaggcuacugucag

SEQ ID NO: 2738103 - RNA, 16 nt, Human
cacgcaggcacagcag

SEQ ID NO: 2738104 - RNA, 17 nt, Human
cacgccuguaaucccag

SEQ ID NO: 2738105 - RNA, 20 nt, Human
cacgcucugggucgccggca

SEQ ID NO: 2738106 - RNA, 19 nt, Human
cacggcuggagcugccucu

SEQ ID NO: 2738107 - RNA, 16 nt, Human
cacgggggccaaggau

SEQ ID NO: 2738108 - RNA, 21 nt, Human
cacuaaaacaccucagcugcc

SEQ ID NO: 2738109 - RNA, 15 nt, Human
cacuaaacaaagagu

SEQ ID NO: 2738110 - RNA, 16 nt, Human
cacuacaaccuccgcc

SEQ ID NO: 2738111 - RNA, 17 nt, Human
cacuacaaccuccgccu

SEQ ID NO: 2738112 - RNA, 17 nt, Human
cacuacauuacuucaaa

SEQ ID NO: 2738113 - RNA, 13 nt, Human
cacuagacccacu

SEQ ID NO: 2738114 - RNA, 13 nt, Human
cacuagcccuccu

SEQ ID NO: 2738115 - RNA, 14 nt, Human
cacuagggcaggga

SEQ ID NO: 2738116 - RNA, 19 nt, Human
cacuaggguccaccaggag

SEQ ID NO: 2738117 - RNA, 16 nt, Human
cacuaguauuucuaug

SEQ ID NO: 2738118 - RNA, 21 nt, Human
cacuaguauuucuaugaaaua

SEQ ID NO: 2738119 - RNA, 21 nt, Human
cacuaucuggguuuugggggg

SEQ ID NO: 2738120 - RNA, 22 nt, Human
cacuaucuguaaugccuuuucu

SEQ ID NO: 2738121 - RNA, 18 nt, Human
cacuaucuuaauuauugu

SEQ ID NO: 2738122 - RNA, 22 nt, Human
cacucacuacagggaccaggga

SEQ ID NO: 2738123 - RNA, 18 nt, Human
cacucagauccuccucau

SEQ ID NO: 2738124 - RNA, 18 nt, Human
cacucauaauucuucacc

SEQ ID NO: 2738125 - RNA, 20 nt, Human
cacucaugcauuguccucuu

SEQ ID NO: 2738126 - RNA, 18 nt, Human
cacucguggugaggcuga

SEQ ID NO: 2738127 - RNA, 22 nt, Human
cacucuauguucuaagaaguga

SEQ ID NO: 2738128 - RNA, 11 nt, Human
cacucuugaaa

SEQ ID NO: 2738129 - RNA, 11 nt, Human
cacugaagaag

SEQ ID NO: 2738130 - RNA, 19 nt, Human
cacugaucuggcugcaguu

SEQ ID NO: 2738131 - RNA, 17 nt, Human
cacugaugacuuuuuau

SEQ ID NO: 2738132 - RNA, 20 nt, Human
cacugcaaccuccaccuccu

SEQ ID NO: 2738133 - RNA, 15 nt, Human
cacugcaaccucugc

SEQ ID NO: 2738134 - RNA, 19 nt, Human
cacugcaaccucugccucc

SEQ ID NO: 2738135 - RNA, 22 nt, Human
cacugcagaagacaguauggca

SEQ ID NO: 2738136 - RNA, 22 nt, Human
cacugccaaaacaucaaccugc

SEQ ID NO: 2738137 - RNA, 22 nt, Human
cacugccuucucaacuccaaac

SEQ ID NO: 2738138 - RNA, 18 nt, Human
cacuggaugaaaauguuc

SEQ ID NO: 2738139 - RNA, 13 nt, Human
cacuggccaccca

SEQ ID NO: 2738140 - RNA, 14 nt, Human
cacuggccacccaa

SEQ ID NO: 2738141 - RNA, 16 nt, Human
cacugggagaaaugaa

SEQ ID NO: 2738142 - RNA, 18 nt, Human
cacugggagaaaugaaaa

SEQ ID NO: 2738143 - RNA, 13 nt, Human
cacuggggugugu

SEQ ID NO: 2738144 - RNA, 15 nt, Human
cagcaagucaggguu

SEQ ID NO: 2738145 - RNA, 16 nt, Human
cagcaagucaggguug

SEQ ID NO: 2738146 - RNA, 22 nt, Human
cagcacagccucuuagaugcag

SEQ ID NO: 2738147 - RNA, 23 nt, Human
cagcaccuccuaagaaggcaccu

SEQ ID NO: 2738148 - RNA, 12 nt, Human
cagcagagaagu

SEQ ID NO: 2738149 - RNA, 14 nt, Human
cagcagagacgggg

SEQ ID NO: 2738150 - RNA, 22 nt, Human
cagcagcucaggcacacuucuu

SEQ ID NO: 2738151 - RNA, 17 nt, Human
cagcaggauagaguggg

SEQ ID NO: 2738152 - RNA, 22 nt, Human
cagcaggauagagugggacagu

SEQ ID NO: 2738153 - RNA, 20 nt, Human
cagcaggucucaugggggug

SEQ ID NO: 2738154 - RNA, 16 nt, Human
cagcagucagggacag

SEQ ID NO: 2738155 - RNA, 17 nt, Human
cagcagugccaaaauau

SEQ ID NO: 2738156 - RNA, 20 nt, Human
cagcaguucagagcugcccu

SEQ ID NO: 2738157 - RNA, 21 nt, Human
cagcaguucagagcugcccuc

SEQ ID NO: 2738158 - RNA, 22 nt, Human
cagcaucccuagucucuaccca

SEQ ID NO: 2738159 - RNA, 18 nt, Human
cagcauggagucacagcc

SEQ ID NO: 2738160 - RNA, 20 nt, Human
cagcauggagucacagccac

SEQ ID NO: 2738161 - RNA, 22 nt, Human
cagcauuuacuaugcacaacag

SEQ ID NO: 2738162 - RNA, 23 nt, Human
cagcauuuacuaugcacaacaga

SEQ ID NO: 2738163 - RNA, 16 nt, Human
cagcauuuuacuacuu

SEQ ID NO: 2738164 - RNA, 17 nt, Human
cagccaacuauggccug

SEQ ID NO: 2738165 - RNA, 20 nt, Human
cagccacggggacucagccc

SEQ ID NO: 2738166 - RNA, 11 nt, Human
cagccagcagu

SEQ ID NO: 2738167 - RNA, 14 nt, Human
cagccagcaguuca

SEQ ID NO: 2738168 - RNA, 22 nt, Human
cagccagcaguucagagcugcc

SEQ ID NO: 2738169 - RNA, 16 nt, Human
cagccagcucucagcc

SEQ ID NO: 2738170 - RNA, 17 nt, Human
cagccaggcccagagca

SEQ ID NO: 2738171 - RNA, 21 nt, Human
cagccaggcggcuggaauuga

SEQ ID NO: 2738172 - RNA, 17 nt, Human
cagccagugaccaaccu

SEQ ID NO: 2738173 - RNA, 14 nt, Human
cagccauguauuug

SEQ ID NO: 2738174 - RNA, 23 nt, Human
cagccaugugauuacccucuggg

SEQ ID NO: 2738175 - RNA, 22 nt, Human
cagccccaucuccucagcaccc

SEQ ID NO: 2738176 - RNA, 22 nt, Human
cagccccuggucagucugcccu

SEQ ID NO: 2738177 - RNA, 22 nt, Human
cagcccuggugggcagagaggu

SEQ ID NO: 2738178 - RNA, 15 nt, Human
cagcccuuagcccuu

SEQ ID NO: 2738179 - RNA, 17 nt, Human
cagcccuuuugucucug

SEQ ID NO: 2738180 - RNA, 19 nt, Human
cagccgcuccugucugcca

SEQ ID NO: 2738181 - RNA, 22 nt, Human
cagccgcuccugucugccagcc

SEQ ID NO: 2738182 - RNA, 12 nt, Human
cagccucagccu

SEQ ID NO: 2738183 - RNA, 14 nt, Human
cagccucagccucc

SEQ ID NO: 2738184 - RNA, 16 nt, Human
cagccucagccuccca

SEQ ID NO: 2738185 - RNA, 17 nt, Human
cagccucccaaagugcu

SEQ ID NO: 2738186 - RNA, 17 nt, Human
cagccucccaagcaccu

SEQ ID NO: 2738187 - RNA, 19 nt, Human
cagccucccaagcaccugg

SEQ ID NO: 2738188 - RNA, 23 nt, Human
cagccucccaagcaccugggauu

SEQ ID NO: 2738189 - RNA, 19 nt, Human
cagccucuuagaugcaguu

SEQ ID NO: 2738190 - RNA, 18 nt, Human
cagccugaaagaggaaug

SEQ ID NO: 2738191 - RNA, 21 nt, Human
cagccugaaagaggaaugaag

SEQ ID NO: 2738192 - RNA, 20 nt, Human
cagccugagcgacagugaga

SEQ ID NO: 2738193 - RNA, 12 nt, Human
cagccugccuuu

SEQ ID NO: 2738194 - RNA, 13 nt, Human
cagccugccuuua

SEQ ID NO: 2738195 - RNA, 13 nt, Human
cagccugcucccu

SEQ ID NO: 2738196 - RNA, 16 nt, Human
cagccugcucccuagc

SEQ ID NO: 2738197 - RNA, 18 nt, Human
cagccugcucccuagcca

SEQ ID NO: 2738198 - RNA, 20 nt, Human
cagccugcucccuagccaga

SEQ ID NO: 2738199 - RNA, 21 nt, Human
cagccugcucccuagccagag

SEQ ID NO: 2738200 - RNA, 16 nt, Human
cagccuggcucuccca

SEQ ID NO: 2738201 - RNA, 17 nt, Human
cagccuggcucucccag

SEQ ID NO: 2738202 - RNA, 18 nt, Human
cagccuggcucucccagc

SEQ ID NO: 2738203 - RNA, 21 nt, Human
cagccugggugacagagcaag

SEQ ID NO: 2738204 - RNA, 20 nt, Human
cagcgagggacaccgagugg

SEQ ID NO: 2738205 - RNA, 15 nt, Human
cagcgaguacuuccc

SEQ ID NO: 2738206 - RNA, 19 nt, Human
cagcggcaucaggcuuucu

SEQ ID NO: 2738207 - RNA, 14 nt, Human
cagcuaauuuuugu

SEQ ID NO: 2738208 - RNA, 19 nt, Human
cagcuacacagaucacagc

SEQ ID NO: 2738209 - RNA, 22 nt, Human
cagcuaccugcucagcccugca

SEQ ID NO: 2738210 - RNA, 18 nt, Human
cagcuacuugggaggcug

SEQ ID NO: 2738211 - RNA, 19 nt, Human
cagcuacuugggaggcuga

SEQ ID NO: 2738212 - RNA, 16 nt, Human
cagcucacuacaaccu

SEQ ID NO: 2738213 - RNA, 23 nt, Human
cagcucacuacaaccuccgccuc

SEQ ID NO: 2738214 - RNA, 23 nt, Human
cagcucacugcaaccuccaccuc

SEQ ID NO: 2738215 - RNA, 22 nt, Human
cagcucacugcaaccucugccu

SEQ ID NO: 2738216 - RNA, 20 nt, Human
cagcucagaaguuucuucuu

SEQ ID NO: 2738217 - RNA, 22 nt, Human
cagcucagaaguuucuucuuua

SEQ ID NO: 2738218 - RNA, 17 nt, Human
cagcucaggcacacuuc

SEQ ID NO: 2738219 - RNA, 19 nt, Human
cagcucaggcuggcaccgc

SEQ ID NO: 2738220 - RNA, 21 nt, Human
cagcucaggcuggcaccgcug

SEQ ID NO: 2738221 - RNA, 18 nt, Human
cagcucuaaaugucaauc

SEQ ID NO: 2738222 - RNA, 21 nt, Human
cagcucuaucccaaccucucc

SEQ ID NO: 2738223 - RNA, 13 nt, Human
cagcucucagcca

SEQ ID NO: 2738224 - RNA, 14 nt, Human
cagcucuccccuuc

SEQ ID NO: 2738225 - RNA, 19 nt, Human
cagcugcaggggccucugu

SEQ ID NO: 2738226 - RNA, 23 nt, Human
cagcugccccggggaggggcgcu

SEQ ID NO: 2738227 - RNA, 11 nt, Human
cagcugccucc

SEQ ID NO: 2738228 - RNA, 13 nt, Human
cagcugccucccc

SEQ ID NO: 2738229 - RNA, 14 nt, Human
cagcugccuccccu

SEQ ID NO: 2738230 - RNA, 18 nt, Human
cagcugccuccccuccuc

SEQ ID NO: 2738231 - RNA, 20 nt, Human
cagcugccuccccuccucug

SEQ ID NO: 2738232 - RNA, 22 nt, Human
cagcugccuggaagagcagccc

SEQ ID NO: 2738233 - RNA, 19 nt, Human
cagcuggccgggagccuga

SEQ ID NO: 2738234 - RNA, 14 nt, Human
cagcuguaugauuc

SEQ ID NO: 2738235 - RNA, 18 nt, Human
cagcuuaguucaaguccu

SEQ ID NO: 2738236 - RNA, 23 nt, Human
cagcuucagccaggagcugggca

SEQ ID NO: 2738237 - RNA, 20 nt, Human
cagcuuccaggcuggcgugc

SEQ ID NO: 2738238 - RNA, 19 nt, Human
cagcuucucauccugcagg

SEQ ID NO: 2738239 - RNA, 21 nt, Human
cagcuucucauccugcaggca

SEQ ID NO: 2738240 - RNA, 14 nt, Human
cagcuugaaacuga

SEQ ID NO: 2738241 - RNA, 18 nt, Human
cagcuugcccuguuaaaa

SEQ ID NO: 2738242 - RNA, 20 nt, Human
cagcuugcccuguuaaaaga

SEQ ID NO: 2738243 - RNA, 21 nt, Human
cagcuugcccuguuaaaagau

SEQ ID NO: 2738244 - RNA, 12 nt, Human
cagcuuuaaagg

SEQ ID NO: 2738245 - RNA, 18 nt, Human
cagcuuuaguagauauua

SEQ ID NO: 2738246 - RNA, 22 nt, Human
cagcuuuaguagauauuaccag

SEQ ID NO: 2738247 - RNA, 15 nt, Human
cagcuuuauggagau

SEQ ID NO: 2738248 - RNA, 16 nt, Human
cagcuuuccucaaaac

SEQ ID NO: 2738249 - RNA, 18 nt, Human
cagcuuuccucaaaacuu

SEQ ID NO: 2738250 - RNA, 16 nt, Human
cagcuuuguucuucuu

SEQ ID NO: 2738251 - RNA, 18 nt, Human
cagcuuuguucuucuuaa

SEQ ID NO: 2738252 - RNA, 15 nt, Human
cagcuuuuuaccaag

SEQ ID NO: 2738253 - RNA, 19 nt, Human
cagcuuuuucucucccacu

SEQ ID NO: 2738254 - RNA, 13 nt, Human
caggaaaaagugg

SEQ ID NO: 2738255 - RNA, 17 nt, Human
caggaaaaaguggguuu

SEQ ID NO: 2738256 - RNA, 19 nt, Human
caggaaaauggacaucaaa

SEQ ID NO: 2738257 - RNA, 21 nt, Human
caggaaaucaaauaugcaaag

SEQ ID NO: 2738258 - RNA, 19 nt, Human
caggaacaaacagggcugc

SEQ ID NO: 2738259 - RNA, 13 nt, Human
caggaaccacaag

SEQ ID NO: 2738260 - RNA, 17 nt, Human
caggaaccacaagacug

SEQ ID NO: 2738261 - RNA, 16 nt, Human
caggaagcugugagag

SEQ ID NO: 2738262 - RNA, 16 nt, Human
caggaaguagaggagg

SEQ ID NO: 2738263 - RNA, 17 nt, Human
caggaaucacuggcugu

SEQ ID NO: 2738264 - RNA, 23 nt, Human
caggaaucacuggcuguuaaucu

SEQ ID NO: 2738265 - RNA, 14 nt, Human
caggacacucacua

SEQ ID NO: 2738266 - RNA, 16 nt, Human
caggaccaucccggcc

SEQ ID NO: 2738267 - RNA, 17 nt, Human
caggaccaucccggccg

SEQ ID NO: 2738268 - RNA, 18 nt, Human
caggaccaucccggccgg

SEQ ID NO: 2738269 - RNA, 20 nt, Human
caggaccaucccggccggcg

SEQ ID NO: 2738270 - RNA, 20 nt, Human
caggacccuguccaaucuuu

SEQ ID NO: 2738271 - RNA, 14 nt, Human
caggacgcccucac

SEQ ID NO: 2738272 - RNA, 17 nt, Human
caggacgcccucacugc

SEQ ID NO: 2738273 - RNA, 14 nt, Human
caggacuagggcug

SEQ ID NO: 2738274 - RNA, 16 nt, Human
caggacuagggcugga

SEQ ID NO: 2738275 - RNA, 14 nt, Human
caggagaggggcag

SEQ ID NO: 2738276 - RNA, 12 nt, Human
caggagcccugg

SEQ ID NO: 2738277 - RNA, 16 nt, Human
caggagcccugggagg

SEQ ID NO: 2738278 - RNA, 23 nt, Human
caggagcccugggaggcucugga

SEQ ID NO: 2738279 - RNA, 15 nt, Human
caggaggaaggcuua

SEQ ID NO: 2738280 - RNA, 14 nt, Human
caggaggaucacuu

SEQ ID NO: 2738281 - RNA, 16 nt, Human
caggaggcauccaaag

SEQ ID NO: 2738282 - RNA, 14 nt, Human
caggaggggcuucu

SEQ ID NO: 2738283 - RNA, 17 nt, Human
caggaggggcuucuggg

SEQ ID NO: 2738284 - RNA, 23 nt, Human
caggaggugcuaucgcaccacug

SEQ ID NO: 2738285 - RNA, 13 nt, Human
caggaguacaccc

SEQ ID NO: 2738286 - RNA, 20 nt, Human
caggaguacaccccaacagc

SEQ ID NO: 2738287 - RNA, 19 nt, Human
cagugucaaugcagccccc

SEQ ID NO: 2738288 - RNA, 16 nt, Human
caguguccucaucugu

SEQ ID NO: 2738289 - RNA, 14 nt, Human
cagugucugcugga

SEQ ID NO: 2738290 - RNA, 19 nt, Human
cagugucuggcacuuggga

SEQ ID NO: 2738291 - RNA, 16 nt, Human
caguguguggcuuuca

SEQ ID NO: 2738292 - RNA, 18 nt, Human
caguuaaguuuugugugu

SEQ ID NO: 2738293 - RNA, 21 nt, Human
caguuaccucugccucagaaa

SEQ ID NO: 2738294 - RNA, 21 nt, Human
caguuacugccgguuugaaaa

SEQ ID NO: 2738295 - RNA, 16 nt, Human
caguucagagcugccc

SEQ ID NO: 2738296 - RNA, 17 nt, Human
caguucagagcugcccu

SEQ ID NO: 2738297 - RNA, 21 nt, Human
caguucagagcugcccucucc

SEQ ID NO: 2738298 - RNA, 18 nt, Human
caguucauauguaccaug

SEQ ID NO: 2738299 - RNA, 21 nt, Human
caguucauccauucuauuguu

SEQ ID NO: 2738300 - RNA, 18 nt, Human
caguucccucuugcucag

SEQ ID NO: 2738301 - RNA, 23 nt, Human
caguucccucuugcucagugggg

SEQ ID NO: 2738302 - RNA, 14 nt, Human
caguucugaagaag

SEQ ID NO: 2738303 - RNA, 20 nt, Human
caguucuuuggcugaaagga

SEQ ID NO: 2738304 - RNA, 14 nt, Human
caguugagacaaga

SEQ ID NO: 2738305 - RNA, 18 nt, Human
caguugagacaagaaaau

SEQ ID NO: 2738306 - RNA, 14 nt, Human
caguuguccuccuu

SEQ ID NO: 2738307 - RNA, 21 nt, Human
caguuuuaacuagaauuuauu

SEQ ID NO: 2738308 - RNA, 15 nt, Human
caguuuuaucauuuu

SEQ ID NO: 2738309 - RNA, 15 nt, Human
caguuuuuauauaga

SEQ ID NO: 2738310 - RNA, 14 nt, Human
caguuuuugugaaa

SEQ ID NO: 2738311 - RNA, 19 nt, Human
caguuuuugugaaaagcuc

SEQ ID NO: 2738312 - RNA, 20 nt, Human
caguuuuugugaaaagcucc

SEQ ID NO: 2738313 - RNA, 14 nt, Human
cauaaaauacaaaa

SEQ ID NO: 2738314 - RNA, 17 nt, Human
cauaaaauacaaaaacu

SEQ ID NO: 2738315 - RNA, 14 nt, Human
cauaaagucuugcc

SEQ ID NO: 2738316 - RNA, 19 nt, Human
cauaaagucuugccuugcu

SEQ ID NO: 2738317 - RNA, 16 nt, Human
cauaaauaaaguuugu

SEQ ID NO: 2738318 - RNA, 22 nt, Human
cauaaauguugacaugggacau

SEQ ID NO: 2738319 - RNA, 23 nt, Human
cauaaauuauuguuuuucuuuuu

SEQ ID NO: 2738320 - RNA, 20 nt, Human
cauaagauauuuuucaugau

SEQ ID NO: 2738321 - RNA, 21 nt, Human
cauaagauauuuuucaugauu

SEQ ID NO: 2738322 - RNA, 14 nt, Human
cauaagauuuaaau

SEQ ID NO: 2738323 - RNA, 19 nt, Human
cauaagauuuaaauuauuu

SEQ ID NO: 2738324 - RNA, 18 nt, Human
cauaagggaggaaaaaaa

SEQ ID NO: 2738325 - RNA, 15 nt, Human
cauaauacuugcuuu

SEQ ID NO: 2738326 - RNA, 19 nt, Human
cauaauacuugcuuuggaa

SEQ ID NO: 2738327 - RNA, 16 nt, Human
cauaauauaaaacagg

SEQ ID NO: 2738328 - RNA, 20 nt, Human
cauaaugcucauacuuaucu

SEQ ID NO: 2738329 - RNA, 15 nt, Human
cauaaugguuuuuaa

SEQ ID NO: 2738330 - RNA, 16 nt, Human
cauaauguuacauuau

SEQ ID NO: 2738331 - RNA, 11 nt, Human
cauaauuauua

SEQ ID NO: 2738332 - RNA, 12 nt, Human
cauacagauuug

SEQ ID NO: 2738333 - RNA, 13 nt, Human
cauacaguaauuu

SEQ ID NO: 2738334 - RNA, 15 nt, Human
cauacauguaaaaua

SEQ ID NO: 2738335 - RNA, 13 nt, Human
cauacauuucuca

SEQ ID NO: 2738336 - RNA, 15 nt, Human
cauacauuucucaua

SEQ ID NO: 2738337 - RNA, 18 nt, Human
cauacauuuucuaagaaa

SEQ ID NO: 2738338 - RNA, 20 nt, Human
cauacauuuucuaagaaaca

SEQ ID NO: 2738339 - RNA, 14 nt, Human
cauaccccuggcca

SEQ ID NO: 2738340 - RNA, 23 nt, Human
cauaccguguaccucaguucccu

SEQ ID NO: 2738341 - RNA, 14 nt, Human
cauaccuuccccac

SEQ ID NO: 2738342 - RNA, 21 nt, Human
cauacuaauuauacccccugc

SEQ ID NO: 2738343 - RNA, 23 nt, Human
cauacuaauuauacccccugcaa

SEQ ID NO: 2738344 - RNA, 13 nt, Human
cauacuauggaau

SEQ ID NO: 2738345 - RNA, 14 nt, Human
cauacucuguaaca

SEQ ID NO: 2738346 - RNA, 20 nt, Human
cauacucuguaacaguugca

SEQ ID NO: 2738347 - RNA, 23 nt, Human
cauacuucuuaggguuaugauua

SEQ ID NO: 2738348 - RNA, 16 nt, Human
cauagaaauugccuga

SEQ ID NO: 2738349 - RNA, 12 nt, Human
cauagaaguaaa

SEQ ID NO: 2738350 - RNA, 14 nt, Human
cauagaaguaaaaa

SEQ ID NO: 2738351 - RNA, 14 nt, Human
cauagaauaguguu

SEQ ID NO: 2738352 - RNA, 13 nt, Human
cauagagacuugg

SEQ ID NO: 2738353 - RNA, 17 nt, Human
cauagagacuuugugaa

SEQ ID NO: 2738354 - RNA, 23 nt, Human
cauagagacuuugugaaaaaaaa

SEQ ID NO: 2738355 - RNA, 23 nt, Human
cauagauguagauaaacucagaa

SEQ ID NO: 2738356 - RNA, 19 nt, Human
cauagauucccugagcagg

SEQ ID NO: 2738357 - RNA, 12 nt, Human
cauagcagcuua

SEQ ID NO: 2738358 - RNA, 18 nt, Human
cauagcaucucaggagau

SEQ ID NO: 2738359 - RNA, 15 nt, Human
cauagccaggaaacu

SEQ ID NO: 2738360 - RNA, 15 nt, Human
cauagcuaaaaaaug

SEQ ID NO: 2738361 - RNA, 18 nt, Human
cauagguuuaauaauuuu

SEQ ID NO: 2738362 - RNA, 22 nt, Human
cauagguuuaauaauuuuuaau

SEQ ID NO: 2738363 - RNA, 18 nt, Human
cauaguaccaaucauuuu

SEQ ID NO: 2738364 - RNA, 14 nt, Human
cauagugagacacu

SEQ ID NO: 2738365 - RNA, 18 nt, Human
cauagugagacacugucu

SEQ ID NO: 2738366 - RNA, 20 nt, Human
cauagugagacacugucucu

SEQ ID NO: 2738367 - RNA, 19 nt, Human
cauagugaggagcuuugaa

SEQ ID NO: 2738368 - RNA, 13 nt, Human
cauauaaucuuac

SEQ ID NO: 2738369 - RNA, 14 nt, Human
cauauacagcucag

SEQ ID NO: 2738370 - RNA, 18 nt, Human
cauauacagcucagaagu

SEQ ID NO: 2738371 - RNA, 14 nt, Human
cauauauaacaaug

SEQ ID NO: 2738372 - RNA, 20 nt, Human
cauauauaacaaugcuguau

SEQ ID NO: 2738373 - RNA, 13 nt, Human
cauauauuuugua

SEQ ID NO: 2738374 - RNA, 19 nt, Human
cauaucaaacugaaacaaa

SEQ ID NO: 2738375 - RNA, 20 nt, Human
cauaucaaacugaaacaaaa

SEQ ID NO: 2738376 - RNA, 17 nt, Human
cauaucgauuuuuaaaa

SEQ ID NO: 2738377 - RNA, 16 nt, Human
cauaucucccucuucc

SEQ ID NO: 2738378 - RNA, 11 nt, Human
cauaugaaaag

SEQ ID NO: 2738379 - RNA, 19 nt, Human
cauaugaaaaggcuaagcu

SEQ ID NO: 2738380 - RNA, 14 nt, Human
cauaugaauaacau

SEQ ID NO: 2738381 - RNA, 18 nt, Human
cauauguaccauguacau

SEQ ID NO: 2738382 - RNA, 21 nt, Human
cauauguuuuuguaaguuuau

SEQ ID NO: 2738383 - RNA, 17 nt, Human
cauauuguuacugguac

SEQ ID NO: 2738384 - RNA, 19 nt, Human
cauauuuauaaaaauaaaa

SEQ ID NO: 2738385 - RNA, 22 nt, Human
cauauuucaaaugauuuucaaa

SEQ ID NO: 2738386 - RNA, 22 nt, Human
cauauuuguacaccaauauuca

SEQ ID NO: 2738387 - RNA, 15 nt, Human
cauauuuuucauagc

SEQ ID NO: 2738388 - RNA, 23 nt, Human
caucaacagauaaauaguuuaug

SEQ ID NO: 2738389 - RNA, 21 nt, Human
caucaaccugccagcuggccu

SEQ ID NO: 2738390 - RNA, 14 nt, Human
caucaauuuuucuu

SEQ ID NO: 2738391 - RNA, 18 nt, Human
caucacauuccucugccc

SEQ ID NO: 2738392 - RNA, 13 nt, Human
caucaccuccccc

SEQ ID NO: 2738393 - RNA, 23 nt, Human
caucaccuuagaccaccaagccu

SEQ ID NO: 2738394 - RNA, 15 nt, Human
caucagcuccagcug

SEQ ID NO: 2738395 - RNA, 17 nt, Human
caucagcugcugaaaca

SEQ ID NO: 2738396 - RNA, 12 nt, Human
caucaggaaaga

SEQ ID NO: 2738397 - RNA, 23 nt, Human
caucauaaaauaaaguauauaua

SEQ ID NO: 2738398 - RNA, 15 nt, Human
caucauaauauaaaa

SEQ ID NO: 2738399 - RNA, 14 nt, Human
caucaucucagcuc

SEQ ID NO: 2738400 - RNA, 14 nt, Human
caucaucuucuggg

SEQ ID NO: 2738401 - RNA, 22 nt, Human
caucaucuucuggguuaggccu

SEQ ID NO: 2738402 - RNA, 14 nt, Human
caucauuuacuuuu

SEQ ID NO: 2738403 - RNA, 17 nt, Human
cauccaaaggcuccuga

SEQ ID NO: 2738404 - RNA, 16 nt, Human
cauccacguccugucu

SEQ ID NO: 2738405 - RNA, 16 nt, Human
cauccauucuauuguu

SEQ ID NO: 2738406 - RNA, 15 nt, Human
cauccauucuccuga

SEQ ID NO: 2738407 - RNA, 15 nt, Human
cauccauucuucccu

SEQ ID NO: 2738408 - RNA, 13 nt, Human
caucccacccgcc

SEQ ID NO: 2738409 - RNA, 14 nt, Human
cauccccaggcccu

SEQ ID NO: 2738410 - RNA, 22 nt, Human
cauccccaggcccugcucuucc

SEQ ID NO: 2738411 - RNA, 13 nt, Human
caucccggccggc

SEQ ID NO: 2738412 - RNA, 14 nt, Human
caucccggccggcg

SEQ ID NO: 2738413 - RNA, 16 nt, Human
caucccggccggcgcg

SEQ ID NO: 2738414 - RNA, 17 nt, Human
caucccggccggcgcgc

SEQ ID NO: 2738415 - RNA, 20 nt, Human
caucccuagaaagccaugug

SEQ ID NO: 2738416 - RNA, 18 nt, Human
caucccuagucucuaccc

SEQ ID NO: 2738417 - RNA, 16 nt, Human
caucccucccuccacc

SEQ ID NO: 2738418 - RNA, 18 nt, Human
caucccucccuccaccuc

SEQ ID NO: 2738419 - RNA, 21 nt, Human
caucccucccuccaccucccu

SEQ ID NO: 2738420 - RNA, 22 nt, Human
caucccucccuccaccucccug

SEQ ID NO: 2738421 - RNA, 13 nt, Human
caucccuccuggg

SEQ ID NO: 2738422 - RNA, 17 nt, Human
caucccuuaccugggaa

SEQ ID NO: 2738423 - RNA, 13 nt, Human
cauccuacaagac

SEQ ID NO: 2738424 - RNA, 14 nt, Human
cauccuacaagaca

SEQ ID NO: 2738425 - RNA, 18 nt, Human
cauccuagucucuaucau

SEQ ID NO: 2738426 - RNA, 19 nt, Human
cauccuagucucuaucauu

SEQ ID NO: 2738427 - RNA, 23 nt, Human
cauccucgaggcccuagcauuuc

SEQ ID NO: 2738428 - RNA, 15 nt, Human
cauccugaggcucca

SEQ ID NO: 2738429 - RNA, 17 nt, Human
cauccugaggcuccacu

SEQ ID NO: 2738430 - RNA, 23 nt, Human
cauccugaggcuccacuuggucu

SEQ ID NO: 2738431 - RNA, 15 nt, Human
cauccugcaggcagc

SEQ ID NO: 2738432 - RNA, 17 nt, Human
cauugaggcaggcacug

SEQ ID NO: 2738433 - RNA, 16 nt, Human
cauugauuuaauguaa

SEQ ID NO: 2738434 - RNA, 16 nt, Human
cauugcaaccuccacc

SEQ ID NO: 2738435 - RNA, 13 nt, Human
cauuggagauguu

SEQ ID NO: 2738436 - RNA, 16 nt, Human
cauuguaaaugugcuu

SEQ ID NO: 2738437 - RNA, 21 nt, Human
cauuguaaaugugcuuuuaaa

SEQ ID NO: 2738438 - RNA, 18 nt, Human
cauuguaauugcuaucgc

SEQ ID NO: 2738439 - RNA, 15 nt, Human
cauuguauucagagu

SEQ ID NO: 2738440 - RNA, 23 nt, Human
cauuguggucacaggaaguagag

SEQ ID NO: 2738441 - RNA, 17 nt, Human
cauuguuggcuguuccu

SEQ ID NO: 2738442 - RNA, 17 nt, Human
cauuguuugucugucuu

SEQ ID NO: 2738443 - RNA, 18 nt, Human
cauuuacccuucuuuucu

SEQ ID NO: 2738444 - RNA, 19 nt, Human
cauuuacuaugcacaacag

SEQ ID NO: 2738445 - RNA, 13 nt, Human
cauuuaggccaug

SEQ ID NO: 2738446 - RNA, 15 nt, Human
cauuuaguuauaaaa

SEQ ID NO: 2738447 - RNA, 16 nt, Human
cauuuaguuauaaaaa

SEQ ID NO: 2738448 - RNA, 22 nt, Human
cauuuaguuauaaaaauauaua

SEQ ID NO: 2738449 - RNA, 12 nt, Human
cauuuauauuuu

SEQ ID NO: 2738450 - RNA, 19 nt, Human
cauuuauuuccauauuaaa

SEQ ID NO: 2738451 - RNA, 21 nt, Human
cauuucaaaagguauuuauug

SEQ ID NO: 2738452 - RNA, 15 nt, Human
cauuucagaaaugcu

SEQ ID NO: 2738453 - RNA, 14 nt, Human
cauuuccaagcaag

SEQ ID NO: 2738454 - RNA, 23 nt, Human
cauuuccuaaauauauuuuaaga

SEQ ID NO: 2738455 - RNA, 14 nt, Human
cauuuccucagacu

SEQ ID NO: 2738456 - RNA, 16 nt, Human
cauuucuaaagccauu

SEQ ID NO: 2738457 - RNA, 14 nt, Human
cauuucuauuuauu

SEQ ID NO: 2738458 - RNA, 18 nt, Human
cauuucucauaccuuccc

SEQ ID NO: 2738459 - RNA, 16 nt, Human
cauuucugcaucagcu

SEQ ID NO: 2738460 - RNA, 20 nt, Human
cauuucuugagguaaaagca

SEQ ID NO: 2738461 - RNA, 21 nt, Human
cauuucuugagguaaaagcau

SEQ ID NO: 2738462 - RNA, 22 nt, Human
cauuucuuuucugcauguucua

SEQ ID NO: 2738463 - RNA, 17 nt, Human
cauuugcacuauuggaa

SEQ ID NO: 2738464 - RNA, 12 nt, Human
cauuugcugagc

SEQ ID NO: 2738465 - RNA, 22 nt, Human
cauuugggaugcuacucuagua

SEQ ID NO: 2738466 - RNA, 22 nt, Human
cauuuguagcauccucuuuaau

SEQ ID NO: 2738467 - RNA, 13 nt, Human
cauuuguauaaaa

SEQ ID NO: 2738468 - RNA, 15 nt, Human
cauuuguauaaaaua

SEQ ID NO: 2738469 - RNA, 16 nt, Human
cauuuguauaaaauaa

SEQ ID NO: 2738470 - RNA, 23 nt, Human
cauuuuaaaaaauggaacauaaa

SEQ ID NO: 2738471 - RNA, 21 nt, Human
cauuuuaaacacauuaggaaa

SEQ ID NO: 2738472 - RNA, 19 nt, Human
cauuuuacuacuuuaaaaa

SEQ ID NO: 2738473 - RNA, 21 nt, Human
cauuuuacuacuuuaaaaaaa

SEQ ID NO: 2738474 - RNA, 13 nt, Human
cauuuucacuuuu

SEQ ID NO: 2738475 - RNA, 14 nt, Human
cauuuucuaagaaa

SEQ ID NO: 2738476 - RNA, 22 nt, Human
cauuuucuaagaaacauuuaua

SEQ ID NO: 2738477 - RNA, 14 nt, Human
cauuuuggaaggcu

SEQ ID NO: 2738478 - RNA, 16 nt, Human
cauuuugguaaaauac

SEQ ID NO: 2738479 - RNA, 16 nt, Human
cauuuuuaguuuaaaa

SEQ ID NO: 2738480 - RNA, 21 nt, Human
cauuuuuauaaugucccuuca

SEQ ID NO: 2738481 - RNA, 20 nt, Human
cauuuuucagauauaaaaga

SEQ ID NO: 2738482 - RNA, 12 nt, Human
cauuuuuuucua

SEQ ID NO: 2738483 - RNA, 18 nt, Human
cauuuuuuucuaauaguu

SEQ ID NO: 2738484 - RNA, 15 nt, Human
ccaaaaaucucaaua

SEQ ID NO: 2738485 - RNA, 19 nt, Human
ccaaaaauguguaagaaca

SEQ ID NO: 2738486 - RNA, 17 nt, Human
ccaaaagguauuuuaau

SEQ ID NO: 2738487 - RNA, 19 nt, Human
ccaaacaugcacuuccuug

SEQ ID NO: 2738488 - RNA, 12 nt, Human
ccaaaccaggac

SEQ ID NO: 2738489 - RNA, 19 nt, Human
ccaaacugccuaagcccuc

SEQ ID NO: 2738490 - RNA, 21 nt, Human
ccaaagucucuggaauuugaa

SEQ ID NO: 2738491 - RNA, 21 nt, Human
ccaaauauaaauaaaaauaau

SEQ ID NO: 2738492 - RNA, 20 nt, Human
ccaaaucaaaagacuuuuuc

SEQ ID NO: 2738493 - RNA, 22 nt, Human
ccaaaucaaaagacuuuuuccu

SEQ ID NO: 2738494 - RNA, 23 nt, Human
ccaaauguaaaauagugaauaaa

SEQ ID NO: 2738495 - RNA, 20 nt, Human
ccaaauguucaucaaugaau

SEQ ID NO: 2738496 - RNA, 13 nt, Human
ccaaauucacaag

SEQ ID NO: 2738497 - RNA, 13 nt, Human
ccaaauugagcua

SEQ ID NO: 2738498 - RNA, 14 nt, Human
ccaaauuuguauuu

SEQ ID NO: 2738499 - RNA, 12 nt, Human
ccaacacccuga

SEQ ID NO: 2738500 - RNA, 20 nt, Human
ccaacacccugagguugugu

SEQ ID NO: 2738501 - RNA, 15 nt, Human
ccaacacgagcaggc

SEQ ID NO: 2738502 - RNA, 14 nt, Human
ccaacagcacccuc

SEQ ID NO: 2738503 - RNA, 17 nt, Human
ccaacagcacccucucc

SEQ ID NO: 2738504 - RNA, 16 nt, Human
ccaacaugaaaacaau

SEQ ID NO: 2738505 - RNA, 20 nt, Human
ccaacaugaaaacaauucuu

SEQ ID NO: 2738506 - RNA, 21 nt, Human
ccaacaugaaaacaauucuua

SEQ ID NO: 2738507 - RNA, 15 nt, Human
ccaacaugcacugau

SEQ ID NO: 2738508 - RNA, 23 nt, Human
ccaacaugcacugauguuguguu

SEQ ID NO: 2738509 - RNA, 19 nt, Human
ccaaccacaucccacucac

SEQ ID NO: 2738510 - RNA, 15 nt, Human
ccaaccauuuccuca

SEQ ID NO: 2738511 - RNA, 17 nt, Human
ccaacccgaggcccgca

SEQ ID NO: 2738512 - RNA, 13 nt, Human
ccaaccucuccca

SEQ ID NO: 2738513 - RNA, 20 nt, Human
ccaaccucucccaacuauaa

SEQ ID NO: 2738514 - RNA, 13 nt, Human
ccaaccuuuuccc

SEQ ID NO: 2738515 - RNA, 21 nt, Human
ccaacgaguaauuuauuguuu

SEQ ID NO: 2738516 - RNA, 13 nt, Human
ccaacguggccca

SEQ ID NO: 2738517 - RNA, 15 nt, Human
ccaacuauaaaacua

SEQ ID NO: 2738518 - RNA, 13 nt, Human
ccaacuuauauuu

SEQ ID NO: 2738519 - RNA, 23 nt, Human
ccaagaaugagaagaaugacuau

SEQ ID NO: 2738520 - RNA, 22 nt, Human
ccaagagugaagggaagagaca

SEQ ID NO: 2738521 - RNA, 18 nt, Human
ccaagagugcacuacugu

SEQ ID NO: 2738522 - RNA, 14 nt, Human
ccaagcaaguauua

SEQ ID NO: 2738523 - RNA, 20 nt, Human
ccaagcauuuagauguauag

SEQ ID NO: 2738524 - RNA, 18 nt, Human
ccaagccuggcaagggaa

SEQ ID NO: 2738525 - RNA, 17 nt, Human
ccaagcugguggcucug

SEQ ID NO: 2738526 - RNA, 15 nt, Human
ccaaggagccaaaca

SEQ ID NO: 2738527 - RNA, 13 nt, Human
ccaaggaugcccc

SEQ ID NO: 2738528 - RNA, 17 nt, Human
ccaaggaugccccgucc

SEQ ID NO: 2738529 - RNA, 19 nt, Human
ccaagguuaggguuggagc

SEQ ID NO: 2738530 - RNA, 20 nt, Human
ccaaguaaauguuuguccuu

SEQ ID NO: 2738531 - RNA, 15 nt, Human
ccaaguucaaaacuu

SEQ ID NO: 2738532 - RNA, 17 nt, Human
ccaaguucuuaguugcu

SEQ ID NO: 2738533 - RNA, 18 nt, Human
ccaauauuauaauuuuuu

SEQ ID NO: 2738534 - RNA, 19 nt, Human
ccaaucauuuuaauuauua

SEQ ID NO: 2738535 - RNA, 20 nt, Human
ccaaucauuuuaauuauuau

SEQ ID NO: 2738536 - RNA, 17 nt, Human
ccaauuagcuccuccuu

SEQ ID NO: 2738537 - RNA, 21 nt, Human
ccaauucauccucacucaguc

SEQ ID NO: 2738538 - RNA, 23 nt, Human
ccaauugcuuuaccuuuuuucuu

SEQ ID NO: 2738539 - RNA, 19 nt, Human
ccacaaaauugggaaagga

SEQ ID NO: 2738540 - RNA, 13 nt, Human
ccacaacacacag

SEQ ID NO: 2738541 - RNA, 14 nt, Human
ccacaaucuaggau

SEQ ID NO: 2738542 - RNA, 17 nt, Human
ccacacaugggaucaag

SEQ ID NO: 2738543 - RNA, 22 nt, Human
ccacacaugggaucaaguccug

SEQ ID NO: 2738544 - RNA, 12 nt, Human
ccacaccucucc

SEQ ID NO: 2738545 - RNA, 14 nt, Human
ccacagaagugcuu

SEQ ID NO: 2738546 - RNA, 14 nt, Human
ccacaggaaccaca

SEQ ID NO: 2738547 - RNA, 15 nt, Human
ccacaggcacagguc

SEQ ID NO: 2738548 - RNA, 20 nt, Human
ccacaggcacagguccccag

SEQ ID NO: 2738549 - RNA, 20 nt, Human
ccacaguuccccuaugugga

SEQ ID NO: 2738550 - RNA, 20 nt, Human
ccacauagaugcugauggag

SEQ ID NO: 2738551 - RNA, 14 nt, Human
ccacauccuguggg

SEQ ID NO: 2738552 - RNA, 21 nt, Human
ccacauccugugggaccuggg

SEQ ID NO: 2738553 - RNA, 15 nt, Human
ccacaucugagcccc

SEQ ID NO: 2738554 - RNA, 18 nt, Human
ccacaucugagccccgaa

SEQ ID NO: 2738555 - RNA, 18 nt, Human
ccacauucagagcuuacu

SEQ ID NO: 2738556 - RNA, 17 nt, Human
ccacauuggagauguuu

SEQ ID NO: 2738557 - RNA, 14 nt, Human
ccaccaaacccggc

SEQ ID NO: 2738558 - RNA, 15 nt, Human
ccaccaaacccggcc

SEQ ID NO: 2738559 - RNA, 15 nt, Human
ccaccacgcccagcu

SEQ ID NO: 2738560 - RNA, 17 nt, Human
ccaccaggaguucuccc

SEQ ID NO: 2738561 - RNA, 18 nt, Human
ccaccaggauauccuccc

SEQ ID NO: 2738562 - RNA, 19 nt, Human
ccaccaggauauccucccu

SEQ ID NO: 2738563 - RNA, 21 nt, Human
ccaccaggauauccucccucc

SEQ ID NO: 2738564 - RNA, 23 nt, Human
ccaccagucugacuguuuccauc

SEQ ID NO: 2738565 - RNA, 16 nt, Human
ccaccaguugaauuuc

SEQ ID NO: 2738566 - RNA, 16 nt, Human
ccaccauggccagcua

SEQ ID NO: 2738567 - RNA, 16 nt, Human
ccaccauucugaggcc

SEQ ID NO: 2738568 - RNA, 20 nt, Human
ccacccaaacggaggcagcu

SEQ ID NO: 2738569 - RNA, 14 nt, Human
ccacccgcccaccg

SEQ ID NO: 2738570 - RNA, 14 nt, Human
ccacccgccucagc

SEQ ID NO: 2738571 - RNA, 15 nt, Human
ccacccgccucagcc

SEQ ID NO: 2738572 - RNA, 19 nt, Human
ccaccucaccaguuuccag

SEQ ID NO: 2738573 - RNA, 12 nt, Human
ccaccucccugc

SEQ ID NO: 2738574 - RNA, 23 nt, Human
ccaccucccugcaauaaaauggg

SEQ ID NO: 2738575 - RNA, 21 nt, Human
ccaccucgcagguucaagcaa

SEQ ID NO: 2738576 - RNA, 20 nt, Human
ccaccugccuuggcuuccca

SEQ ID NO: 2738577 - RNA, 16 nt, Human
ccccugcacuccagcc

SEQ ID NO: 2738578 - RNA, 15 nt, Human
ccccugcccuagagc

SEQ ID NO: 2738579 - RNA, 17 nt, Human
ccccuggccaaggaaga

SEQ ID NO: 2738580 - RNA, 23 nt, Human
ccccugggaccaggcacccccag

SEQ ID NO: 2738581 - RNA, 16 nt, Human
ccccuucccacacugu

SEQ ID NO: 2738582 - RNA, 19 nt, Human
ccccuucccacacugucca

SEQ ID NO: 2738583 - RNA, 21 nt, Human
ccccuuccuaauuccacagcu

SEQ ID NO: 2738584 - RNA, 12 nt, Human
ccccuugccaua

SEQ ID NO: 2738585 - RNA, 18 nt, Human
ccccuuugcugacccucc

SEQ ID NO: 2738586 - RNA, 20 nt, Human
ccccuuugcugacccucccc

SEQ ID NO: 2738587 - RNA, 18 nt, Human
cccgauucacccugucca

SEQ ID NO: 2738588 - RNA, 12 nt, Human
cccgccucagcc

SEQ ID NO: 2738589 - RNA, 13 nt, Human
cccgccucagccu

SEQ ID NO: 2738590 - RNA, 23 nt, Human
cccgcuccugguuggucacagaa

SEQ ID NO: 2738591 - RNA, 15 nt, Human
cccgcuguuccucgc

SEQ ID NO: 2738592 - RNA, 16 nt, Human
cccgcuguuccucgcc

SEQ ID NO: 2738593 - RNA, 17 nt, Human
cccgcuguuccucgcca

SEQ ID NO: 2738594 - RNA, 19 nt, Human
cccgcuguuccucgccacg

SEQ ID NO: 2738595 - RNA, 21 nt, Human
cccgcuguuccucgccacgcu

SEQ ID NO: 2738596 - RNA, 13 nt, Human
cccggccgcgcug

SEQ ID NO: 2738597 - RNA, 14 nt, Human
cccggccgcgcugc

SEQ ID NO: 2738598 - RNA, 21 nt, Human
cccggccgcgcugcgcgccgc

SEQ ID NO: 2738599 - RNA, 14 nt, Human
cccggccggcgcgc

SEQ ID NO: 2738600 - RNA, 17 nt, Human
cccggccggcgcgcuca

SEQ ID NO: 2738601 - RNA, 19 nt, Human
cccggccggcgcgcucauc

SEQ ID NO: 2738602 - RNA, 23 nt, Human
cccggccggcgcgcucaucccac

SEQ ID NO: 2738603 - RNA, 23 nt, Human
cccgggaguggcgcgcgccacca

SEQ ID NO: 2738604 - RNA, 13 nt, Human
cccgggccgacgg

SEQ ID NO: 2738605 - RNA, 14 nt, Human
cccgggccgacgga

SEQ ID NO: 2738606 - RNA, 21 nt, Human
cccgggccgacggagccggga

SEQ ID NO: 2738607 - RNA, 16 nt, Human
cccgugugccugagcg

SEQ ID NO: 2738608 - RNA, 15 nt, Human
cccuaagcccccacu

SEQ ID NO: 2738609 - RNA, 19 nt, Human
cccuacaccccuccccugc

SEQ ID NO: 2738610 - RNA, 21 nt, Human
cccuagaaagccaugugcagc

SEQ ID NO: 2738611 - RNA, 17 nt, Human
cccuagagcacacugua

SEQ ID NO: 2738612 - RNA, 14 nt, Human
cccuagccagaggc

SEQ ID NO: 2738613 - RNA, 13 nt, Human
cccuagccugccu

SEQ ID NO: 2738614 - RNA, 17 nt, Human
cccuagccugccucccc

SEQ ID NO: 2738615 - RNA, 17 nt, Human
cccuagucucuacccag

SEQ ID NO: 2738616 - RNA, 14 nt, Human
cccuaguuccuuca

SEQ ID NO: 2738617 - RNA, 16 nt, Human
cccuauccuacuuccc

SEQ ID NO: 2738618 - RNA, 22 nt, Human
cccuauccuacuuccccuuccu

SEQ ID NO: 2738619 - RNA, 18 nt, Human
cccuauuccuccuucccu

SEQ ID NO: 2738620 - RNA, 16 nt, Human
cccucaaacccauucc

SEQ ID NO: 2738621 - RNA, 20 nt, Human
cccucaaacccauucccucu

SEQ ID NO: 2738622 - RNA, 22 nt, Human
cccucaaacccauucccucucc

SEQ ID NO: 2738623 - RNA, 20 nt, Human
cccucacugcaggcuccccu

SEQ ID NO: 2738624 - RNA, 21 nt, Human
cccuccacauuucccccuagc

SEQ ID NO: 2738625 - RNA, 17 nt, Human
cccuccaccucccugca

SEQ ID NO: 2738626 - RNA, 14 nt, Human
cccuccccaaaggc

SEQ ID NO: 2738627 - RNA, 11 nt, Human
cccucccucca

SEQ ID NO: 2738628 - RNA, 13 nt, Human
cccucccuccacc

SEQ ID NO: 2738629 - RNA, 15 nt, Human
cccucccuccaccuc

SEQ ID NO: 2738630 - RNA, 13 nt, Human
cccuccuuaucaa

SEQ ID NO: 2738631 - RNA, 15 nt, Human
cccuccuuggagaca

SEQ ID NO: 2738632 - RNA, 23 nt, Human
cccucuccaggagaccuacccuc

SEQ ID NO: 2738633 - RNA, 12 nt, Human
cccucuccuggg

SEQ ID NO: 2738634 - RNA, 16 nt, Human
cccucuccugggcagc

SEQ ID NO: 2738635 - RNA, 18 nt, Human
cccucuccugggcagcug

SEQ ID NO: 2738636 - RNA, 23 nt, Human
cccucucugcaggcagccugccu

SEQ ID NO: 2738637 - RNA, 18 nt, Human
cccucuggcuccagcugg

SEQ ID NO: 2738638 - RNA, 19 nt, Human
cccucuggcuccagcuggc

SEQ ID NO: 2738639 - RNA, 15 nt, Human
cccucuggcugcugg

SEQ ID NO: 2738640 - RNA, 16 nt, Human
cccugaaagucccaga

SEQ ID NO: 2738641 - RNA, 14 nt, Human
cccugaagaccccc

SEQ ID NO: 2738642 - RNA, 22 nt, Human
cccugaagaucuagugaacauu

SEQ ID NO: 2738643 - RNA, 16 nt, Human
cccugaauuuaaauag

SEQ ID NO: 2738644 - RNA, 16 nt, Human
cccugagcccauggca

SEQ ID NO: 2738645 - RNA, 14 nt, Human
cccugaggugagca

SEQ ID NO: 2738646 - RNA, 20 nt, Human
cccugaggugagcaucaucu

SEQ ID NO: 2738647 - RNA, 18 nt, Human
cccugcaauaaaaugggu

SEQ ID NO: 2738648 - RNA, 13 nt, Human
cccugcacuccag

SEQ ID NO: 2738649 - RNA, 18 nt, Human
cccugcacuccagccuga

SEQ ID NO: 2738650 - RNA, 21 nt, Human
cccugcagacaugagagacag

SEQ ID NO: 2738651 - RNA, 17 nt, Human
cccugcagucacagcua

SEQ ID NO: 2738652 - RNA, 15 nt, Human
cccugccccccagcc

SEQ ID NO: 2738653 - RNA, 19 nt, Human
cccugccccccagcccucc

SEQ ID NO: 2738654 - RNA, 20 nt, Human
cccugccccccagcccuccu

SEQ ID NO: 2738655 - RNA, 19 nt, Human
cccugccucaagcuaugug

SEQ ID NO: 2738656 - RNA, 18 nt, Human
cccugccuggaucucaca

SEQ ID NO: 2738657 - RNA, 13 nt, Human
cccugcucuuccu

SEQ ID NO: 2738658 - RNA, 23 nt, Human
cccugcucuuccucagcugugug

SEQ ID NO: 2738659 - RNA, 21 nt, Human
cccugcugagucccaggcuga

SEQ ID NO: 2738660 - RNA, 22 nt, Human
cccugcugagucccaggcugag

SEQ ID NO: 2738661 - RNA, 19 nt, Human
cccugcugcccucccccuc

SEQ ID NO: 2738662 - RNA, 15 nt, Human
cccugcugcccuucc

SEQ ID NO: 2738663 - RNA, 17 nt, Human
cccugcugcccuucccc

SEQ ID NO: 2738664 - RNA, 14 nt, Human
cccuggaaaaugaa

SEQ ID NO: 2738665 - RNA, 21 nt, Human
cccugggaccaggcaccccca

SEQ ID NO: 2738666 - RNA, 17 nt, Human
cccugggaggcucugga

SEQ ID NO: 2738667 - RNA, 14 nt, Human
cccugggcccagua

SEQ ID NO: 2738668 - RNA, 13 nt, Human
cccuggggcuuua

SEQ ID NO: 2738669 - RNA, 19 nt, Human
cccugguaauaaguacugu

SEQ ID NO: 2738670 - RNA, 14 nt, Human
cccuggucccuugg

SEQ ID NO: 2738671 - RNA, 12 nt, Human
cccuguacucca

SEQ ID NO: 2738672 - RNA, 15 nt, Human
cccuguacuccagcc

SEQ ID NO: 2738673 - RNA, 18 nt, Human
cccuguacuccagccugg

SEQ ID NO: 2738674 - RNA, 23 nt, Human
cccuguccaaacugccuaagccc

SEQ ID NO: 2738675 - RNA, 18 nt, Human
cccugucucagggugagg

SEQ ID NO: 2738676 - RNA, 19 nt, Human
cccugucuccucucucugu

SEQ ID NO: 2738677 - RNA, 14 nt, Human
cccugugcggccug

SEQ ID NO: 2738678 - RNA, 23 nt, Human
cccuguuucuggcaccaggaauc

SEQ ID NO: 2738679 - RNA, 14 nt, Human
cccuguuucuucca

SEQ ID NO: 2738680 - RNA, 19 nt, Human
cccuguuucuuccacagug

SEQ ID NO: 2738681 - RNA, 22 nt, Human
cccuguuucuuccacagugccu

SEQ ID NO: 2738682 - RNA, 13 nt, Human
cccuuccccuucc

SEQ ID NO: 2738683 - RNA, 19 nt, Human
cccuucccuugagcccucu

SEQ ID NO: 2738684 - RNA, 22 nt, Human
cccuuccugggucuaccacuca

SEQ ID NO: 2738685 - RNA, 21 nt, Human
cccuucuuuuuguucuucauc

SEQ ID NO: 2738686 - RNA, 20 nt, Human
cccuugagcccucuauggug

SEQ ID NO: 2738687 - RNA, 21 nt, Human
cccuugagcccucuauggugu

SEQ ID NO: 2738688 - RNA, 13 nt, Human
cccuugaugaaga

SEQ ID NO: 2738689 - RNA, 16 nt, Human
cccuugaugaagaagu

SEQ ID NO: 2738690 - RNA, 13 nt, Human
cccuugccagaca

SEQ ID NO: 2738691 - RNA, 17 nt, Human
cccuugguccuggaaca

SEQ ID NO: 2738692 - RNA, 16 nt, Human
cccuuuacccccauga

SEQ ID NO: 2738693 - RNA, 17 nt, Human
cccuuucauuuuuucca

SEQ ID NO: 2738694 - RNA, 17 nt, Human
cccuuucugccccugcu

SEQ ID NO: 2738695 - RNA, 22 nt, Human
cccuuugcugacccuccccaaa

SEQ ID NO: 2738696 - RNA, 21 nt, Human
ccgacggagccgggaaagaag

SEQ ID NO: 2738697 - RNA, 20 nt, Human
ccgaggugggcagaucacuu

SEQ ID NO: 2738698 - RNA, 17 nt, Human
ccgcaaugugacuuaau

SEQ ID NO: 2738699 - RNA, 20 nt, Human
ccgcagggugaacugcagcg

SEQ ID NO: 2738700 - RNA, 23 nt, Human
ccgcagggugaacugcagcgagu

SEQ ID NO: 2738701 - RNA, 16 nt, Human
ccgcagugagagagug

SEQ ID NO: 2738702 - RNA, 17 nt, Human
ccgcagugagagagugg

SEQ ID NO: 2738703 - RNA, 14 nt, Human
ccgccacccuccca

SEQ ID NO: 2738704 - RNA, 16 nt, Human
ccgccauucucaagcc

SEQ ID NO: 2738705 - RNA, 21 nt, Human
ccgccauucucaagcccugca

SEQ ID NO: 2738706 - RNA, 14 nt, Human
ccgccucagccucc

SEQ ID NO: 2738707 - RNA, 16 nt, Human
ccgccucagccuccca

SEQ ID NO: 2738708 - RNA, 23 nt, Human
ccgcgcagcucaggcuggcaccg

SEQ ID NO: 2738709 - RNA, 13 nt, Human
ccgcgcuccucgg

SEQ ID NO: 2738710 - RNA, 16 nt, Human
ccgcgcugcgcgccgc

SEQ ID NO: 2738711 - RNA, 23 nt, Human
ccgcgcugcgcgccgcgcuccuc

SEQ ID NO: 2738712 - RNA, 18 nt, Human
ccgcuacuuccagggcua

SEQ ID NO: 2738713 - RNA, 19 nt, Human
ccgcucaggcugaccacuu

SEQ ID NO: 2738714 - RNA, 19 nt, Human
ccgcuccugucugccagcc

SEQ ID NO: 2738715 - RNA, 12 nt, Human
ccgcucucucug

SEQ ID NO: 2738716 - RNA, 20 nt, Human
ccgcuguacgcgagcgcgcg

SEQ ID NO: 2738717 - RNA, 12 nt, Human
ccgcugucucug

SEQ ID NO: 2738718 - RNA, 13 nt, Human
ccgcugucucuga

SEQ ID NO: 2738719 - RNA, 14 nt, Human
ccgcugucucugag

SEQ ID NO: 2738720 - RNA, 16 nt, Human
ccgcugucucugaggg

SEQ ID NO: 2738721 - RNA, 16 nt, Human
ccgcuguuccucgcca

SEQ ID NO: 2738722 - RNA, 15 nt, Human
ccucuaaaaggccug

SEQ ID NO: 2738723 - RNA, 19 nt, Human
ccucuauggccccugccuu

SEQ ID NO: 2738724 - RNA, 22 nt, Human
ccucuaugguguggcaaagccu

SEQ ID NO: 2738725 - RNA, 18 nt, Human
ccucuccaaagcccuccc

SEQ ID NO: 2738726 - RNA, 19 nt, Human
ccucuccaaagcccucccu

SEQ ID NO: 2738727 - RNA, 20 nt, Human
ccucuccaaagcccucccua

SEQ ID NO: 2738728 - RNA, 19 nt, Human
ccucuccagaugcagcccc

SEQ ID NO: 2738729 - RNA, 20 nt, Human
ccucuccagaugcagcccca

SEQ ID NO: 2738730 - RNA, 12 nt, Human
ccucuccugggc

SEQ ID NO: 2738731 - RNA, 16 nt, Human
ccucuccugggcagcu

SEQ ID NO: 2738732 - RNA, 18 nt, Human
ccucuccugggcagcugc

SEQ ID NO: 2738733 - RNA, 22 nt, Human
ccucucucuguaauaaacucau

SEQ ID NO: 2738734 - RNA, 21 nt, Human
ccucucucuguguuacccagu

SEQ ID NO: 2738735 - RNA, 15 nt, Human
ccucucugcaggcag

SEQ ID NO: 2738736 - RNA, 15 nt, Human
ccucugagagcauca

SEQ ID NO: 2738737 - RNA, 13 nt, Human
ccucugccuccca

SEQ ID NO: 2738738 - RNA, 17 nt, Human
ccucugcuugccauccc

SEQ ID NO: 2738739 - RNA, 19 nt, Human
ccucugcuugccaucccuc

SEQ ID NO: 2738740 - RNA, 16 nt, Human
ccucuggauuuuguau

SEQ ID NO: 2738741 - RNA, 16 nt, Human
ccucuggcuccagcug

SEQ ID NO: 2738742 - RNA, 17 nt, Human
ccucuggcuccagcugg

SEQ ID NO: 2738743 - RNA, 18 nt, Human
ccucuggcuccagcuggc

SEQ ID NO: 2738744 - RNA, 19 nt, Human
ccucuggcuccagcuggcc

SEQ ID NO: 2738745 - RNA, 22 nt, Human
ccucuggcugcugguggcgcug

SEQ ID NO: 2738746 - RNA, 23 nt, Human
ccucuggggcauuauccaucuuu

SEQ ID NO: 2738747 - RNA, 17 nt, Human
ccucugggucucagugu

SEQ ID NO: 2738748 - RNA, 19 nt, Human
ccucuguauacaaaacccu

SEQ ID NO: 2738749 - RNA, 13 nt, Human
ccucuguauuuga

SEQ ID NO: 2738750 - RNA, 23 nt, Human
ccucuguugccaaggcuggagug

SEQ ID NO: 2738751 - RNA, 15 nt, Human
ccucuucugacacua

SEQ ID NO: 2738752 - RNA, 23 nt, Human
ccucuucugacacuaaaacaccu

SEQ ID NO: 2738753 - RNA, 16 nt, Human
ccucuuuuuauuuaga

SEQ ID NO: 2738754 - RNA, 15 nt, Human
ccugaaacucauaga

SEQ ID NO: 2738755 - RNA, 15 nt, Human
ccugaaagucccaga

SEQ ID NO: 2738756 - RNA, 17 nt, Human
ccugaaggcauccccag

SEQ ID NO: 2738757 - RNA, 16 nt, Human
ccugacgaacuccuug

SEQ ID NO: 2738758 - RNA, 14 nt, Human
ccugagaccaaggc

SEQ ID NO: 2738759 - RNA, 16 nt, Human
ccugagaccaaggccc

SEQ ID NO: 2738760 - RNA, 14 nt, Human
ccugagaccagcca

SEQ ID NO: 2738761 - RNA, 19 nt, Human
ccugagcaggauuuuaauc

SEQ ID NO: 2738762 - RNA, 18 nt, Human
ccugagcccauggcacuc

SEQ ID NO: 2738763 - RNA, 11 nt, Human
ccugagcccca

SEQ ID NO: 2738764 - RNA, 16 nt, Human
ccugagccccaaaagg

SEQ ID NO: 2738765 - RNA, 16 nt, Human
ccugagcgacagugag

SEQ ID NO: 2738766 - RNA, 15 nt, Human
ccugagcgcucagcu

SEQ ID NO: 2738767 - RNA, 15 nt, Human
ccugagcggaccuuc

SEQ ID NO: 2738768 - RNA, 17 nt, Human
ccugagcggaccuuccc

SEQ ID NO: 2738769 - RNA, 16 nt, Human
ccugagcuugcagaga

SEQ ID NO: 2738770 - RNA, 13 nt, Human
ccugaggcuccac

SEQ ID NO: 2738771 - RNA, 18 nt, Human
ccugaggugagcaucauc

SEQ ID NO: 2738772 - RNA, 13 nt, Human
ccugaguagaaag

SEQ ID NO: 2738773 - RNA, 20 nt, Human
ccugaguagaaaggccuuua

SEQ ID NO: 2738774 - RNA, 19 nt, Human
ccugauauauuccaccagg

SEQ ID NO: 2738775 - RNA, 16 nt, Human
ccugaucaccugcccu

SEQ ID NO: 2738776 - RNA, 21 nt, Human
ccugaucaccugcccugcuga

SEQ ID NO: 2738777 - RNA, 19 nt, Human
ccugauuauuuucuacaca

SEQ ID NO: 2738778 - RNA, 23 nt, Human
ccugauuauuuucuacacauaca

SEQ ID NO: 2738779 - RNA, 16 nt, Human
ccugcaaagcccagcu

SEQ ID NO: 2738780 - RNA, 19 nt, Human
ccugcaccaugcugcuggg

SEQ ID NO: 2738781 - RNA, 20 nt, Human
ccugcaccaugcugcugggg

SEQ ID NO: 2738782 - RNA, 18 nt, Human
ccugcacuccagccugag

SEQ ID NO: 2738783 - RNA, 17 nt, Human
ccugcagacucacugug

SEQ ID NO: 2738784 - RNA, 20 nt, Human
ccugcagacucacuguggga

SEQ ID NO: 2738785 - RNA, 21 nt, Human
ccugcaggcaggaacaaacag

SEQ ID NO: 2738786 - RNA, 23 nt, Human
ccugcaggcaggaacaaacaggg

SEQ ID NO: 2738787 - RNA, 14 nt, Human
ccugcagucacagc

SEQ ID NO: 2738788 - RNA, 21 nt, Human
ccugcauugagcuugcaugcu

SEQ ID NO: 2738789 - RNA, 12 nt, Human
ccugccagcugg

SEQ ID NO: 2738790 - RNA, 15 nt, Human
ccugccagcuggccu

SEQ ID NO: 2738791 - RNA, 13 nt, Human
ccugccccccagc

SEQ ID NO: 2738792 - RNA, 16 nt, Human
ccugccccccagcccu

SEQ ID NO: 2738793 - RNA, 18 nt, Human
ccugcccugaaaguccca

SEQ ID NO: 2738794 - RNA, 19 nt, Human
ccugccuaagugcagcccc

SEQ ID NO: 2738795 - RNA, 20 nt, Human
ccugccuaagugcagccccg

SEQ ID NO: 2738796 - RNA, 13 nt, Human
ccugccucagccu

SEQ ID NO: 2738797 - RNA, 14 nt, Human
ccugccuccccugc

SEQ ID NO: 2738798 - RNA, 15 nt, Human
ccugccuccccugcc

SEQ ID NO: 2738799 - RNA, 12 nt, Human
ccugccucucug

SEQ ID NO: 2738800 - RNA, 15 nt, Human
ccugccucucugcag

SEQ ID NO: 2738801 - RNA, 17 nt, Human
ccugccucucugcaggu

SEQ ID NO: 2738802 - RNA, 14 nt, Human
ccugcucagcccug

SEQ ID NO: 2738803 - RNA, 16 nt, Human
ccugcucagcccugca

SEQ ID NO: 2738804 - RNA, 14 nt, Human
ccugcucccuagcc

SEQ ID NO: 2738805 - RNA, 19 nt, Human
ccugcucccuagccagagg

SEQ ID NO: 2738806 - RNA, 20 nt, Human
ccugcucccuagccagaggc

SEQ ID NO: 2738807 - RNA, 13 nt, Human
ccugcucgcccac

SEQ ID NO: 2738808 - RNA, 18 nt, Human
ccugcucgcccacuuccu

SEQ ID NO: 2738809 - RNA, 17 nt, Human
ccugcucuuccucagcu

SEQ ID NO: 2738810 - RNA, 14 nt, Human
ccugcugagcccca

SEQ ID NO: 2738811 - RNA, 16 nt, Human
ccugcugcccuccccc

SEQ ID NO: 2738812 - RNA, 17 nt, Human
ccugcugcccuuccccu

SEQ ID NO: 2738813 - RNA, 20 nt, Human
ccugcuggauguggaggggg

SEQ ID NO: 2738814 - RNA, 13 nt, Human
ccugcuuuucccc

SEQ ID NO: 2738815 - RNA, 14 nt, Human
ccuggaaaaugaau

SEQ ID NO: 2738816 - RNA, 22 nt, Human
ccuggacugugugcucaggagc

SEQ ID NO: 2738817 - RNA, 18 nt, Human
ccuggaucucacaagcac

SEQ ID NO: 2738818 - RNA, 13 nt, Human
ccuggccaaggaa

SEQ ID NO: 2738819 - RNA, 21 nt, Human
ccuggcggggugggguggggg

SEQ ID NO: 2738820 - RNA, 20 nt, Human
ccuggcucucccagccaggu

SEQ ID NO: 2738821 - RNA, 16 nt, Human
ccuggcugauuuuugu

SEQ ID NO: 2738822 - RNA, 12 nt, Human
ccuggcugggag

SEQ ID NO: 2738823 - RNA, 22 nt, Human
ccugggaccaggcacccccaga

SEQ ID NO: 2738824 - RNA, 19 nt, Human
ccugggaggcucuggagcc

SEQ ID NO: 2738825 - RNA, 14 nt, Human
ccugggauuacagg

SEQ ID NO: 2738826 - RNA, 23 nt, Human
ccugggauuacaggugugagcca

SEQ ID NO: 2738827 - RNA, 13 nt, Human
ccugggcagcugc

SEQ ID NO: 2738828 - RNA, 14 nt, Human
ccugggcagcugcc

SEQ ID NO: 2738829 - RNA, 16 nt, Human
ccugggcagcugccuc

SEQ ID NO: 2738830 - RNA, 20 nt, Human
ccugggcagcugccuccccu

SEQ ID NO: 2738831 - RNA, 22 nt, Human
ccugggcagcugccuccccucc

SEQ ID NO: 2738832 - RNA, 14 nt, Human
ccugggcugaggca

SEQ ID NO: 2738833 - RNA, 22 nt, Human
ccuggguucacagaucuuucug

SEQ ID NO: 2738834 - RNA, 13 nt, Human
ccuggucucuccu

SEQ ID NO: 2738835 - RNA, 20 nt, Human
ccuggucugguugggcagcc

SEQ ID NO: 2738836 - RNA, 20 nt, Human
ccuggugcacgcaggcacag

SEQ ID NO: 2738837 - RNA, 23 nt, Human
ccuggugcacgcaggcacagcag

SEQ ID NO: 2738838 - RNA, 21 nt, Human
ccuggugccucaccccuugcc

SEQ ID NO: 2738839 - RNA, 15 nt, Human
ccuggugggcagaga

SEQ ID NO: 2738840 - RNA, 16 nt, Human
ccuggugggcagagag

SEQ ID NO: 2738841 - RNA, 17 nt, Human
ccuggugggccuccucu

SEQ ID NO: 2738842 - RNA, 24 nt, Human
ccugguuggucacagaaugacuga

SEQ ID NO: 2738843 - RNA, 14 nt, Human
ccuguaacaggcuu

SEQ ID NO: 2738844 - RNA, 22 nt, Human
ccuguaacuugaagguggcuac

SEQ ID NO: 2738845 - RNA, 18 nt, Human
ccuguaaucauauaauaa

SEQ ID NO: 2738846 - RNA, 16 nt, Human
ccuguacuuuuuccag

SEQ ID NO: 2738847 - RNA, 14 nt, Human
ccuguaugauuccu

SEQ ID NO: 2738848 - RNA, 18 nt, Human
ccugucacgugugggcaa

SEQ ID NO: 2738849 - RNA, 15 nt, Human
ccugucaucucacau

SEQ ID NO: 2738850 - RNA, 17 nt, Human
ccuguccagccugcauc

SEQ ID NO: 2738851 - RNA, 16 nt, Human
ccuguccugaccuguc

SEQ ID NO: 2738852 - RNA, 20 nt, Human
ccugucgaaggggaggcaca

SEQ ID NO: 2738853 - RNA, 18 nt, Human
ccugucucaauaaauaaa

SEQ ID NO: 2738854 - RNA, 17 nt, Human
ccugucuccucucucug

SEQ ID NO: 2738855 - RNA, 17 nt, Human
ccugucucuacaaaaaa

SEQ ID NO: 2738856 - RNA, 15 nt, Human
ccugucuguuuccuc

SEQ ID NO: 2738857 - RNA, 16 nt, Human
ccugucuguuuccucu

SEQ ID NO: 2738858 - RNA, 17 nt, Human
ccugucuguuuccucug

SEQ ID NO: 2738859 - RNA, 20 nt, Human
ccugucuguuuccucuguau

SEQ ID NO: 2738860 - RNA, 18 nt, Human
ccuguggccaaguucuua

SEQ ID NO: 2738861 - RNA, 21 nt, Human
ccuguggccaaguucuuaguu

SEQ ID NO: 2738862 - RNA, 16 nt, Human
ccuguguauucauucu

SEQ ID NO: 2738863 - RNA, 17 nt, Human
ccuguguauucauucuc

SEQ ID NO: 2738864 - RNA, 17 nt, Human
ccuguguuacugauuug

SEQ ID NO: 2738865 - RNA, 15 nt, Human
ccuguucgcgcgccu

SEQ ID NO: 2738866 - RNA, 16 nt, Human
ccuguucugcgcugug

SEQ ID NO: 2738867 - RNA, 16 nt, Human
cgcgcgcuccgcgcag

SEQ ID NO: 2738868 - RNA, 12 nt, Human
cgcgcucauccc

SEQ ID NO: 2738869 - RNA, 18 nt, Human
cgcgcucaucccacccgc

SEQ ID NO: 2738870 - RNA, 20 nt, Human
cgcgcucaucccacccgccc

SEQ ID NO: 2738871 - RNA, 13 nt, Human
cgcgcuccgcgca

SEQ ID NO: 2738872 - RNA, 17 nt, Human
cgcgcuccgcgcagcuc

SEQ ID NO: 2738873 - RNA, 15 nt, Human
cgcgcugcgcgccgc

SEQ ID NO: 2738874 - RNA, 16 nt, Human
cgcgcugcgcgccgcg

SEQ ID NO: 2738875 - RNA, 23 nt, Human
cgcggcgggagggcgcggggcgg

SEQ ID NO: 2738876 - RNA, 15 nt, Human
cgcggggcggggagc

SEQ ID NO: 2738877 - RNA, 14 nt, Human
cgcuaccuuuugcu

SEQ ID NO: 2738878 - RNA, 16 nt, Human
cgcucaucccacccgc

SEQ ID NO: 2738879 - RNA, 17 nt, Human
cgcucaucccacccgcc

SEQ ID NO: 2738880 - RNA, 22 nt, Human
cgcucaucccacccgcccaccg

SEQ ID NO: 2738881 - RNA, 15 nt, Human
cgcuccucggacggc

SEQ ID NO: 2738882 - RNA, 18 nt, Human
cgcuccucggacggcucc

SEQ ID NO: 2738883 - RNA, 14 nt, Human
cgcucgcuuccgca

SEQ ID NO: 2738884 - RNA, 12 nt, Human
cgcucggccugc

SEQ ID NO: 2738885 - RNA, 16 nt, Human
cgcucggccugcucgc

SEQ ID NO: 2738886 - RNA, 20 nt, Human
cgcucggccugcucgcccac

SEQ ID NO: 2738887 - RNA, 16 nt, Human
cgcucucucugagggg

SEQ ID NO: 2738888 - RNA, 21 nt, Human
cgcucucuggccuucggccuc

SEQ ID NO: 2738889 - RNA, 22 nt, Human
cgcucucuggccuucggccucc

SEQ ID NO: 2738890 - RNA, 23 nt, Human
cgcucucuggccuucggccucca

SEQ ID NO: 2738891 - RNA, 14 nt, Human
cgcugcgcgccgcg

SEQ ID NO: 2738892 - RNA, 15 nt, Human
cgcugcgcgccgcgc

SEQ ID NO: 2738893 - RNA, 20 nt, Human
cgcuggcugcgcucggccug

SEQ ID NO: 2738894 - RNA, 22 nt, Human
cgcuggcugcgcucggccugcu

SEQ ID NO: 2738895 - RNA, 14 nt, Human
cgcuguuccucgcc

SEQ ID NO: 2738896 - RNA, 15 nt, Human
cgcuguuccucgcca

SEQ ID NO: 2738897 - RNA, 17 nt, Human
cgcuguuccucgccacg

SEQ ID NO: 2738898 - RNA, 19 nt, Human
cgcuguuccucgccacgcu

SEQ ID NO: 2738899 - RNA, 22 nt, Human
cgcuuucaugaauucugucauu

SEQ ID NO: 2738900 - RNA, 11 nt, Human
cgcuuucucug

SEQ ID NO: 2738901 - RNA, 20 nt, Human
cggacgcugcugccgugggc

SEQ ID NO: 2738902 - RNA, 23 nt, Human
cggacgcugcugccgugggccug

SEQ ID NO: 2738903 - RNA, 17 nt, Human
cggagaaccccaggacg

SEQ ID NO: 2738904 - RNA, 11 nt, Human
cggagauaucc

SEQ ID NO: 2738905 - RNA, 21 nt, Human
cggagccccuugggcagguca

SEQ ID NO: 2738906 - RNA, 22 nt, Human
cggagccgggaaagaagagccg

SEQ ID NO: 2738907 - RNA, 14 nt, Human
cggagccuccagcu

SEQ ID NO: 2738908 - RNA, 18 nt, Human
cggagccuccagcugccc

SEQ ID NO: 2738909 - RNA, 12 nt, Human
cggcaucaggcu

SEQ ID NO: 2738910 - RNA, 22 nt, Human
cggccaccagaugucgcccuac

SEQ ID NO: 2738911 - RNA, 16 nt, Human
cggccacggugccucc

SEQ ID NO: 2738912 - RNA, 19 nt, Human
cggccacggugccuccaga

SEQ ID NO: 2738913 - RNA, 12 nt, Human
cggcccugugcg

SEQ ID NO: 2738914 - RNA, 18 nt, Human
cggcccugugcggccugg

SEQ ID NO: 2738915 - RNA, 20 nt, Human
cggcccugugcggccugguc

SEQ ID NO: 2738916 - RNA, 15 nt, Human
cggccgcgcugcgcg

SEQ ID NO: 2738917 - RNA, 18 nt, Human
cggccgcgcugcgcgccg

SEQ ID NO: 2738918 - RNA, 21 nt, Human
cggccgcgcugcgcgccgcgc

SEQ ID NO: 2738919 - RNA, 13 nt, Human
cggccggcgcgcu

SEQ ID NO: 2738920 - RNA, 14 nt, Human
cggccuccauccug

SEQ ID NO: 2738921 - RNA, 20 nt, Human
cggccuccauccugaggcuc

SEQ ID NO: 2738922 - RNA, 22 nt, Human
cggccuccauccugaggcucca

SEQ ID NO: 2738923 - RNA, 14 nt, Human
cggccugcucgccc

SEQ ID NO: 2738924 - RNA, 19 nt, Human
cggccugcucgcccacuuc

SEQ ID NO: 2738925 - RNA, 22 nt, Human
cggccugcucgcccacuuccuc

SEQ ID NO: 2738926 - RNA, 21 nt, Human
cggcgcgcucaucccacccgc

SEQ ID NO: 2738927 - RNA, 18 nt, Human
cggcggcccugugcggcc

SEQ ID NO: 2738928 - RNA, 21 nt, Human
cggcggcccugugcggccugg

SEQ ID NO: 2738929 - RNA, 19 nt, Human
cggcgggagggcgcggggc

SEQ ID NO: 2738930 - RNA, 20 nt, Human
cggcgggagggcgcggggcg

SEQ ID NO: 2738931 - RNA, 13 nt, Human
cggcuaauuuuug

SEQ ID NO: 2738932 - RNA, 18 nt, Human
cggcuccggacgcugcug

SEQ ID NO: 2738933 - RNA, 19 nt, Human
cggcuccggacgcugcugc

SEQ ID NO: 2738934 - RNA, 17 nt, Human
cggcuggagcugccucu

SEQ ID NO: 2738935 - RNA, 16 nt, Human
cggcuuccuuccucuc

SEQ ID NO: 2738936 - RNA, 18 nt, Human
cggcuuccuuccucucug

SEQ ID NO: 2738937 - RNA, 12 nt, Human
cgggaaggaggg

SEQ ID NO: 2738938 - RNA, 12 nt, Human
cgggagccugau

SEQ ID NO: 2738939 - RNA, 15 nt, Human
cgggagccugaucac

SEQ ID NO: 2738940 - RNA, 16 nt, Human
cgggagggcgcggggc

SEQ ID NO: 2738941 - RNA, 11 nt, Human
cgggaguggcg

SEQ ID NO: 2738942 - RNA, 14 nt, Human
cgggaguggcgcgc

SEQ ID NO: 2738943 - RNA, 18 nt, Human
cgggaguggcgcgcgcca

SEQ ID NO: 2738944 - RNA, 15 nt, Human
cgggauuaguacaca

SEQ ID NO: 2738945 - RNA, 11 nt, Human
cgggccgacgg

SEQ ID NO: 2738946 - RNA, 21 nt, Human
cggggaaggauuuugcaguuc

SEQ ID NO: 2738947 - RNA, 16 nt, Human
cggggagcgagcccca

SEQ ID NO: 2738948 - RNA, 16 nt, Human
cggggaggggcgcucg

SEQ ID NO: 2738949 - RNA, 19 nt, Human
cggggcggggagcgagccc

SEQ ID NO: 2738950 - RNA, 18 nt, Human
cggggugggaaagauuac

SEQ ID NO: 2738951 - RNA, 14 nt, Human
cggggugggguggg

SEQ ID NO: 2738952 - RNA, 23 nt, Human
cgggguuugccaugcuggccagg

SEQ ID NO: 2738953 - RNA, 13 nt, Human
cggguuucaccau

SEQ ID NO: 2738954 - RNA, 15 nt, Human
cggguuucaccaugu

SEQ ID NO: 2738955 - RNA, 15 nt, Human
cgguccuugcugcac

SEQ ID NO: 2738956 - RNA, 22 nt, Human
cgguccuugcugcaccugugcc

SEQ ID NO: 2738957 - RNA, 13 nt, Human
cggugccuccaga

SEQ ID NO: 2738958 - RNA, 19 nt, Human
cgguguuaauuuugcuaac

SEQ ID NO: 2738959 - RNA, 18 nt, Human
cguauucccauuagacca

SEQ ID NO: 2738960 - RNA, 20 nt, Human
cgucuuaucuaaucaugaaa

SEQ ID NO: 2738961 - RNA, 23 nt, Human
cgucuugacuuuggcaaaugagc

SEQ ID NO: 2738962 - RNA, 15 nt, Human
cgugaccugccaggc

SEQ ID NO: 2738963 - RNA, 16 nt, Human
cgugacuggccugcug

SEQ ID NO: 2738964 - RNA, 17 nt, Human
cgugacuggccugcugg

SEQ ID NO: 2738965 - RNA, 12 nt, Human
cgugagccacca

SEQ ID NO: 2738966 - RNA, 13 nt, Human
cgugauccacccg

SEQ ID NO: 2738967 - RNA, 21 nt, Human
cgugauccacccgccucagcc

SEQ ID NO: 2738968 - RNA, 15 nt, Human
cgugaucucagcuca

SEQ ID NO: 2738969 - RNA, 16 nt, Human
cgugaucucagcucac

SEQ ID NO: 2738970 - RNA, 21 nt, Human
cgugcauugugcuucuuucuu

SEQ ID NO: 2738971 - RNA, 14 nt, Human
cgugcuugucccug

SEQ ID NO: 2738972 - RNA, 18 nt, Human
cgugcuugucccugugga

SEQ ID NO: 2738973 - RNA, 22 nt, Human
cgugcuugucccuguggaagua

SEQ ID NO: 2738974 - RNA, 18 nt, Human
cguggugcgagugcguga

SEQ ID NO: 2738975 - RNA, 16 nt, Human
cguguguguuuuaaac

SEQ ID NO: 2738976 - RNA, 21 nt, Human
cguuaagaauuguuaaaggcu

SEQ ID NO: 2738977 - RNA, 13 nt, Human
cguuaauguaaag

SEQ ID NO: 2738978 - RNA, 23 nt, Human
cguucacauuuuuguauuuuguu

SEQ ID NO: 2738979 - RNA, 20 nt, Human
cguucccggguagccacugg

SEQ ID NO: 2738980 - RNA, 13 nt, Human
cguugagccacca

SEQ ID NO: 2738981 - RNA, 15 nt, Human
cuaaaaaacaaagaa

SEQ ID NO: 2738982 - RNA, 18 nt, Human
cuaaaaaacgaaaagucu

SEQ ID NO: 2738983 - RNA, 18 nt, Human
cuaaaaaggcauguaauu

SEQ ID NO: 2738984 - RNA, 16 nt, Human
cuaaaaauuaaaaccu

SEQ ID NO: 2738985 - RNA, 22 nt, Human
cuaaaaauugugaucagaccau

SEQ ID NO: 2738986 - RNA, 16 nt, Human
cuaaaauaaaaugaag

SEQ ID NO: 2738987 - RNA, 17 nt, Human
cuaaaauuagaugaacu

SEQ ID NO: 2738988 - RNA, 19 nt, Human
cuaaaauuagaugaacuca

SEQ ID NO: 2738989 - RNA, 14 nt, Human
cuaaaauuguauag

SEQ ID NO: 2738990 - RNA, 19 nt, Human
cuaaacaaagagugaagga

SEQ ID NO: 2738991 - RNA, 14 nt, Human
cuaaacauaugaau

SEQ ID NO: 2738992 - RNA, 23 nt, Human
cuaaacauaugaauuauguuugc

SEQ ID NO: 2738993 - RNA, 15 nt, Human
cuaaacauguuuauc

SEQ ID NO: 2738994 - RNA, 17 nt, Human
cuaaagcccagagacag

SEQ ID NO: 2738995 - RNA, 12 nt, Human
cuaaaucuauuu

SEQ ID NO: 2738996 - RNA, 16 nt, Human
cuaaaucuauuuauua

SEQ ID NO: 2738997 - RNA, 21 nt, Human
cuaaaugacuuuucuccucuc

SEQ ID NO: 2738998 - RNA, 20 nt, Human
cuaaaugucaaucagccuag

SEQ ID NO: 2738999 - RNA, 16 nt, Human
cuaaauucuuucauuu

SEQ ID NO: 2739000 - RNA, 20 nt, Human
cuaaauugacacuuaaaaau

SEQ ID NO: 2739001 - RNA, 14 nt, Human
cuaaauuugguucu

SEQ ID NO: 2739002 - RNA, 16 nt, Human
cuaacaaguagcaccc

SEQ ID NO: 2739003 - RNA, 22 nt, Human
cuaacauauaauguuguuauuu

SEQ ID NO: 2739004 - RNA, 15 nt, Human
cuaacgagaaauaga

SEQ ID NO: 2739005 - RNA, 18 nt, Human
cuaacuggguuaaauauu

SEQ ID NO: 2739006 - RNA, 20 nt, Human
cuaagaaauaugcacaauag

SEQ ID NO: 2739007 - RNA, 18 nt, Human
cuaagaaggcaccucucu

SEQ ID NO: 2739008 - RNA, 14 nt, Human
cuaagcauuccaac

SEQ ID NO: 2739009 - RNA, 21 nt, Human
cuaagcauuccaacuaucuca

SEQ ID NO: 2739010 - RNA, 23 nt, Human
cuaagcccuccgccauucucaag

SEQ ID NO: 2739011 - RNA, 14 nt, Human
cuaagccuucuggu

SEQ ID NO: 2739012 - RNA, 19 nt, Human
cuauguucuaagaagugaa

SEQ ID NO: 2739013 - RNA, 21 nt, Human
cuauguucuaagaagugaaaa

SEQ ID NO: 2739014 - RNA, 16 nt, Human
cuauguuguugcacuu

SEQ ID NO: 2739015 - RNA, 18 nt, Human
cuauguuucacugugcaa

SEQ ID NO: 2739016 - RNA, 21 nt, Human
cuauuauagaauggaacucaa

SEQ ID NO: 2739017 - RNA, 14 nt, Human
cuauuauauuucca

SEQ ID NO: 2739018 - RNA, 21 nt, Human
cuauucauaagauuuaaauua

SEQ ID NO: 2739019 - RNA, 12 nt, Human
cuauuccuccuu

SEQ ID NO: 2739020 - RNA, 15 nt, Human
cuauuccuccuuccc

SEQ ID NO: 2739021 - RNA, 18 nt, Human
cuauucuagccugcauug

SEQ ID NO: 2739022 - RNA, 22 nt, Human
cuauucuagucuauuuguugau

SEQ ID NO: 2739023 - RNA, 22 nt, Human
cuauucuccauacucuguaaca

SEQ ID NO: 2739024 - RNA, 14 nt, Human
cuauugccucugag

SEQ ID NO: 2739025 - RNA, 14 nt, Human
cuauuuaagagaac

SEQ ID NO: 2739026 - RNA, 14 nt, Human
cuauuuaauuauuu

SEQ ID NO: 2739027 - RNA, 18 nt, Human
cuauuuaauuauuucacu

SEQ ID NO: 2739028 - RNA, 21 nt, Human
cuauuuaauuauuucacuuua

SEQ ID NO: 2739029 - RNA, 18 nt, Human
cuauuuauuaaguauuuu

SEQ ID NO: 2739030 - RNA, 13 nt, Human
cuauuuauuaaua

SEQ ID NO: 2739031 - RNA, 19 nt, Human
cuauuuauuuauuuauuug

SEQ ID NO: 2739032 - RNA, 21 nt, Human
cuauuuauuuauuuauuugag

SEQ ID NO: 2739033 - RNA, 18 nt, Human
cuauuuuaauaaacacuc

SEQ ID NO: 2739034 - RNA, 18 nt, Human
cuauuuuguaacuuucuc

SEQ ID NO: 2739035 - RNA, 11 nt, Human
cuauuuuguag

SEQ ID NO: 2739036 - RNA, 16 nt, Human
cuauuuuuggaagagg

SEQ ID NO: 2739037 - RNA, 15 nt, Human
cuauuuuuuccccca

SEQ ID NO: 2739038 - RNA, 12 nt, Human
cucaaaacaggg

SEQ ID NO: 2739039 - RNA, 19 nt, Human
cucaaacccauucccucuc

SEQ ID NO: 2739040 - RNA, 23 nt, Human
cucaaagagggagugcauuuaug

SEQ ID NO: 2739041 - RNA, 12 nt, Human
cucaaagugcug

SEQ ID NO: 2739042 - RNA, 24 nt, Human
cucaaauuguucucuaauauguaa

SEQ ID NO: 2739043 - RNA, 22 nt, Human
cucaacccccauuucuauuuau

SEQ ID NO: 2739044 - RNA, 13 nt, Human
cucaaccucccaa

SEQ ID NO: 2739045 - RNA, 14 nt, Human
cucaacucugagug

SEQ ID NO: 2739046 - RNA, 18 nt, Human
cucaacuuugacaaccau

SEQ ID NO: 2739047 - RNA, 19 nt, Human
cucaagcccugcagucaca

SEQ ID NO: 2739048 - RNA, 21 nt, Human
cucaagcuaugugagcucacc

SEQ ID NO: 2739049 - RNA, 16 nt, Human
cucaagcugcaucuag

SEQ ID NO: 2739050 - RNA, 13 nt, Human
cucaagucuuauu

SEQ ID NO: 2739051 - RNA, 16 nt, Human
cucaauaaaguacaag

SEQ ID NO: 2739052 - RNA, 17 nt, Human
cucaauaaagugcuuug

SEQ ID NO: 2739053 - RNA, 14 nt, Human
cucaauaaauaaau

SEQ ID NO: 2739054 - RNA, 20 nt, Human
cucaauaagccucagcuuuc

SEQ ID NO: 2739055 - RNA, 12 nt, Human
cucaauauuuca

SEQ ID NO: 2739056 - RNA, 22 nt, Human
cucaauauuucagauaaucaca

SEQ ID NO: 2739057 - RNA, 18 nt, Human
cucacacucaugcauugu

SEQ ID NO: 2739058 - RNA, 21 nt, Human
cucacagugggagccagggcu

SEQ ID NO: 2739059 - RNA, 20 nt, Human
cucacauccauucuucccuu

SEQ ID NO: 2739060 - RNA, 22 nt, Human
cucacauuuggggcuagacagu

SEQ ID NO: 2739061 - RNA, 13 nt, Human
cucacauuuuccc

SEQ ID NO: 2739062 - RNA, 16 nt, Human
cucacauuuucccuuc

SEQ ID NO: 2739063 - RNA, 14 nt, Human
cucaccagucccuc

SEQ ID NO: 2739064 - RNA, 21 nt, Human
cucaccugagcgcucagcuuc

SEQ ID NO: 2739065 - RNA, 22 nt, Human
cucacugcaggcuccccuccuc

SEQ ID NO: 2739066 - RNA, 13 nt, Human
cucacugugggaa

SEQ ID NO: 2739067 - RNA, 16 nt, Human
cucacugugggaagga

SEQ ID NO: 2739068 - RNA, 15 nt, Human
cucagaaacaucagu

SEQ ID NO: 2739069 - RNA, 15 nt, Human
cucagaaguuucuuc

SEQ ID NO: 2739070 - RNA, 18 nt, Human
cucagaaguuucuucuuu

SEQ ID NO: 2739071 - RNA, 19 nt, Human
cucagaaguuucuucuuua

SEQ ID NO: 2739072 - RNA, 16 nt, Human
cucagacucuaagaaa

SEQ ID NO: 2739073 - RNA, 19 nt, Human
cucagacucuaagaaagaa

SEQ ID NO: 2739074 - RNA, 17 nt, Human
cucagaggcagugacag

SEQ ID NO: 2739075 - RNA, 22 nt, Human
cucagaggcagugacagcaguc

SEQ ID NO: 2739076 - RNA, 13 nt, Human
cucagaugcacau

SEQ ID NO: 2739077 - RNA, 13 nt, Human
cucagcccugcac

SEQ ID NO: 2739078 - RNA, 14 nt, Human
cucagcccugcacc

SEQ ID NO: 2739079 - RNA, 16 nt, Human
cucagcccugcaccau

SEQ ID NO: 2739080 - RNA, 13 nt, Human
cucagccucccaa

SEQ ID NO: 2739081 - RNA, 14 nt, Human
cucagccucccaaa

SEQ ID NO: 2739082 - RNA, 17 nt, Human
cucagccuuccccuugc

SEQ ID NO: 2739083 - RNA, 15 nt, Human
cucagcucacuacaa

SEQ ID NO: 2739084 - RNA, 15 nt, Human
cucagcucacugcaa

SEQ ID NO: 2739085 - RNA, 22 nt, Human
cucagcucacugcaaccucugc

SEQ ID NO: 2739086 - RNA, 14 nt, Human
cucagcugccuccc

SEQ ID NO: 2739087 - RNA, 16 nt, Human
cucagcugccucccca

SEQ ID NO: 2739088 - RNA, 21 nt, Human
cucagcuucacccugagguga

SEQ ID NO: 2739089 - RNA, 15 nt, Human
cucagcuucuccaac

SEQ ID NO: 2739090 - RNA, 16 nt, Human
cucaggaggucaagau

SEQ ID NO: 2739091 - RNA, 16 nt, Human
cucaggcaaucugccc

SEQ ID NO: 2739092 - RNA, 19 nt, Human
cucaggcaaucugcccgcc

SEQ ID NO: 2739093 - RNA, 21 nt, Human
cucaggcaaucugcccgccug

SEQ ID NO: 2739094 - RNA, 17 nt, Human
cucaggcuggcaccgcu

SEQ ID NO: 2739095 - RNA, 24 nt, Human
cucagggacucaucuuucccuccu

SEQ ID NO: 2739096 - RNA, 16 nt, Human
cucagggccccagcac

SEQ ID NO: 2739097 - RNA, 17 nt, Human
cucagggccccagcacu

SEQ ID NO: 2739098 - RNA, 21 nt, Human
cucaguagucagacuggauag

SEQ ID NO: 2739099 - RNA, 21 nt, Human
cucaguccaugaagauguaga

SEQ ID NO: 2739100 - RNA, 14 nt, Human
cucagucucccucc

SEQ ID NO: 2739101 - RNA, 19 nt, Human
cucagugggggcagagcca

SEQ ID NO: 2739102 - RNA, 22 nt, Human
cucagugggggcagagccaccu

SEQ ID NO: 2739103 - RNA, 21 nt, Human
cucagugucaaugcagccccc

SEQ ID NO: 2739104 - RNA, 16 nt, Human
cucaguguccucaucu

SEQ ID NO: 2739105 - RNA, 12 nt, Human
cucaguucacug

SEQ ID NO: 2739106 - RNA, 23 nt, Human
cucauaauucuucaccuuaggaa

SEQ ID NO: 2739107 - RNA, 12 nt, Human
cucauaccuucc

SEQ ID NO: 2739108 - RNA, 22 nt, Human
cucauagacacugaucuggcug

SEQ ID NO: 2739109 - RNA, 18 nt, Human
cucauauccaguauuguu

SEQ ID NO: 2739110 - RNA, 11 nt, Human
cucaucauaaa

SEQ ID NO: 2739111 - RNA, 14 nt, Human
cucaucauuuccau

SEQ ID NO: 2739112 - RNA, 13 nt, Human
cucauccacuuuc

SEQ ID NO: 2739113 - RNA, 14 nt, Human
cucaucccacccgc

SEQ ID NO: 2739114 - RNA, 17 nt, Human
cucauccugcaggcagc

SEQ ID NO: 2739115 - RNA, 19 nt, Human
cucaucuccccaucauugg

SEQ ID NO: 2739116 - RNA, 15 nt, Human
cucaucucuucuuuu

SEQ ID NO: 2739117 - RNA, 15 nt, Human
cucaucuuucccucc

SEQ ID NO: 2739118 - RNA, 14 nt, Human
cucaucuuuuuacu

SEQ ID NO: 2739119 - RNA, 16 nt, Human
cucaugaaccucaagc

SEQ ID NO: 2739120 - RNA, 16 nt, Human
cucaugaguaacugau

SEQ ID NO: 2739121 - RNA, 18 nt, Human
cucaugcauuguccucuu

SEQ ID NO: 2739122 - RNA, 12 nt, Human
cucauggaauug

SEQ ID NO: 2739123 - RNA, 18 nt, Human
cucauggaauuggagcuc

SEQ ID NO: 2739124 - RNA, 19 nt, Human
cucauggaauuggagcucg

SEQ ID NO: 2739125 - RNA, 20 nt, Human
cucauggaauuggagcucgu

SEQ ID NO: 2739126 - RNA, 23 nt, Human
cucauggaauuggagcucgugga

SEQ ID NO: 2739127 - RNA, 23 nt, Human
cucauguccacugguucuucuug

SEQ ID NO: 2739128 - RNA, 16 nt, Human
cucauuguagaaaagc

SEQ ID NO: 2739129 - RNA, 22 nt, Human
cucauuuauuuccauauuaaaa

SEQ ID NO: 2739130 - RNA, 14 nt, Human
cucauuuuaaaaaa

SEQ ID NO: 2739131 - RNA, 23 nt, Human
cuccaaacugacucuuaagaaga

SEQ ID NO: 2739132 - RNA, 17 nt, Human
cuccaaagcccucccua

SEQ ID NO: 2739133 - RNA, 18 nt, Human
cuccaaagcccucccuac

SEQ ID NO: 2739134 - RNA, 17 nt, Human
cuccaaguucaaaacuu

SEQ ID NO: 2739135 - RNA, 16 nt, Human
cuccaauacucagguu

SEQ ID NO: 2739136 - RNA, 16 nt, Human
cuccaccaucgucuuc

SEQ ID NO: 2739137 - RNA, 17 nt, Human
cuccaccucccugcaau

SEQ ID NO: 2739138 - RNA, 20 nt, Human
cuccaccucccugcaauaaa

SEQ ID NO: 2739139 - RNA, 14 nt, Human
cuccaccuccuggg

SEQ ID NO: 2739140 - RNA, 14 nt, Human
cuccaccuucuggg

SEQ ID NO: 2739141 - RNA, 14 nt, Human
cuccacucugaguc

SEQ ID NO: 2739142 - RNA, 21 nt, Human
cuccacuuggacaugggcccc

SEQ ID NO: 2739143 - RNA, 18 nt, Human
cuccacuuggucugugag

SEQ ID NO: 2739144 - RNA, 21 nt, Human
cuccagagggaauugcagagu

SEQ ID NO: 2739145 - RNA, 23 nt, Human
cuccagaugggagugcccccaac

SEQ ID NO: 2739146 - RNA, 14 nt, Human
cuccagccucagcc

SEQ ID NO: 2739147 - RNA, 19 nt, Human
cuccagccucagccuccca

SEQ ID NO: 2739148 - RNA, 11 nt, Human
cuccagccuga

SEQ ID NO: 2739149 - RNA, 12 nt, Human
cuccagcugccc

SEQ ID NO: 2739150 - RNA, 13 nt, Human
cuccagcugcccc

SEQ ID NO: 2739151 - RNA, 20 nt, Human
cuccagcugcucugucuucu

SEQ ID NO: 2739152 - RNA, 21 nt, Human
cuccagcugcucugucuucuu

SEQ ID NO: 2739153 - RNA, 21 nt, Human
cuccagcuggccgggagccug

SEQ ID NO: 2739154 - RNA, 20 nt, Human
cuccaggagaccuacccucc

SEQ ID NO: 2739155 - RNA, 15 nt, Human
cuccagggagucuca

SEQ ID NO: 2739156 - RNA, 14 nt, Human
cuccagugagacag

SEQ ID NO: 2739157 - RNA, 16 nt, Human
cucugcuugccauccc

SEQ ID NO: 2739158 - RNA, 17 nt, Human
cucuggauuauauuaug

SEQ ID NO: 2739159 - RNA, 17 nt, Human
cucuggccuguacccag

SEQ ID NO: 2739160 - RNA, 13 nt, Human
cucuggccuucgg

SEQ ID NO: 2739161 - RNA, 17 nt, Human
cucuggccuucggccuc

SEQ ID NO: 2739162 - RNA, 20 nt, Human
cucuggccuucggccuccau

SEQ ID NO: 2739163 - RNA, 22 nt, Human
cucuggccuucggccuccaucc

SEQ ID NO: 2739164 - RNA, 14 nt, Human
cucuggcuccagcu

SEQ ID NO: 2739165 - RNA, 22 nt, Human
cucugggauagcugacccagcc

SEQ ID NO: 2739166 - RNA, 17 nt, Human
cucuggggagcucagga

SEQ ID NO: 2739167 - RNA, 18 nt, Human
cucuggggagcucaggaa

SEQ ID NO: 2739168 - RNA, 20 nt, Human
cucuggggagcucaggaagg

SEQ ID NO: 2739169 - RNA, 18 nt, Human
cucuguaacaguugcauu

SEQ ID NO: 2739170 - RNA, 16 nt, Human
cucuguaauaaacuca

SEQ ID NO: 2739171 - RNA, 16 nt, Human
cucuguagaaggagua

SEQ ID NO: 2739172 - RNA, 20 nt, Human
cucugucgcccaugcuggag

SEQ ID NO: 2739173 - RNA, 15 nt, Human
cucugucuaccuggu

SEQ ID NO: 2739174 - RNA, 19 nt, Human
cucugucucaaaaaauaaa

SEQ ID NO: 2739175 - RNA, 21 nt, Human
cucugucucaaaaaauaaaaa

SEQ ID NO: 2739176 - RNA, 13 nt, Human
cucugucuccuaa

SEQ ID NO: 2739177 - RNA, 14 nt, Human
cucugucuucuuug

SEQ ID NO: 2739178 - RNA, 16 nt, Human
cucugugaucuugcuc

SEQ ID NO: 2739179 - RNA, 17 nt, Human
cucugugucuucaaagc

SEQ ID NO: 2739180 - RNA, 17 nt, Human
cucuguucauuuccuca

SEQ ID NO: 2739181 - RNA, 19 nt, Human
cucuguucugcacacagca

SEQ ID NO: 2739182 - RNA, 20 nt, Human
cucuguucugcacacagcac

SEQ ID NO: 2739183 - RNA, 20 nt, Human
cucuguugagccuuccuuuc

SEQ ID NO: 2739184 - RNA, 16 nt, Human
cucuuaagaagacugc

SEQ ID NO: 2739185 - RNA, 15 nt, Human
cucuuauagaauauu

SEQ ID NO: 2739186 - RNA, 13 nt, Human
cucuucuccaucc

SEQ ID NO: 2739187 - RNA, 21 nt, Human
cucuucuggguuccuuccucu

SEQ ID NO: 2739188 - RNA, 21 nt, Human
cucuugaaguauauauaucau

SEQ ID NO: 2739189 - RNA, 14 nt, Human
cucuugaggcacag

SEQ ID NO: 2739190 - RNA, 19 nt, Human
cucuugccaaaucaaaaga

SEQ ID NO: 2739191 - RNA, 14 nt, Human
cucuugccucaacc

SEQ ID NO: 2739192 - RNA, 20 nt, Human
cucuuuaauggguaaacagc

SEQ ID NO: 2739193 - RNA, 16 nt, Human
cucuuuauucagcccc

SEQ ID NO: 2739194 - RNA, 18 nt, Human
cucuuuccuccacaccau

SEQ ID NO: 2739195 - RNA, 17 nt, Human
cucuuuugggauuuuug

SEQ ID NO: 2739196 - RNA, 21 nt, Human
cugaaacugcccacucugcaa

SEQ ID NO: 2739197 - RNA, 15 nt, Human
cugaaagaggaauga

SEQ ID NO: 2739198 - RNA, 17 nt, Human
cugaaagaggaaugaag

SEQ ID NO: 2739199 - RNA, 14 nt, Human
cugaaagucccaga

SEQ ID NO: 2739200 - RNA, 16 nt, Human
cugaaauggaacagau

SEQ ID NO: 2739201 - RNA, 22 nt, Human
cugaaauggaacagauuucaaa

SEQ ID NO: 2739202 - RNA, 16 nt, Human
cugaacucccucucug

SEQ ID NO: 2739203 - RNA, 12 nt, Human
cugaagaagcac

SEQ ID NO: 2739204 - RNA, 13 nt, Human
cugaagaagcacc

SEQ ID NO: 2739205 - RNA, 18 nt, Human
cugaagaagcaccaauca

SEQ ID NO: 2739206 - RNA, 13 nt, Human
cugaagcuguguc

SEQ ID NO: 2739207 - RNA, 20 nt, Human
cugaaggcauccccaggccc

SEQ ID NO: 2739208 - RNA, 21 nt, Human
cugaaggcauccccaggcccu

SEQ ID NO: 2739209 - RNA, 17 nt, Human
cugaagggcaucaugca

SEQ ID NO: 2739210 - RNA, 20 nt, Human
cugaagggcaucaugcaucu

SEQ ID NO: 2739211 - RNA, 19 nt, Human
cugaagggguucucacagu

SEQ ID NO: 2739212 - RNA, 12 nt, Human
cugaauuauuuu

SEQ ID NO: 2739213 - RNA, 18 nt, Human
cugaccaauauuguacag

SEQ ID NO: 2739214 - RNA, 21 nt, Human
cugaccccaaguuauccaccu

SEQ ID NO: 2739215 - RNA, 14 nt, Human
cugacgaacuccuu

SEQ ID NO: 2739216 - RNA, 15 nt, Human
cugacgaacuccuug

SEQ ID NO: 2739217 - RNA, 21 nt, Human
cugacuauucuugauguaaaa

SEQ ID NO: 2739218 - RNA, 22 nt, Human
cugacuauucuugauguaaaau

SEQ ID NO: 2739219 - RNA, 20 nt, Human
cugacucucuuaaggaggcu

SEQ ID NO: 2739220 - RNA, 16 nt, Human
cugacucuuaagaaga

SEQ ID NO: 2739221 - RNA, 22 nt, Human
cugacucuugcagggguagccu

SEQ ID NO: 2739222 - RNA, 13 nt, Human
cugagacacaugg

SEQ ID NO: 2739223 - RNA, 16 nt, Human
cugagacagaaucuca

SEQ ID NO: 2739224 - RNA, 18 nt, Human
cugagacagaaucucagu

SEQ ID NO: 2739225 - RNA, 20 nt, Human
cugagaccaaggcccccggg

SEQ ID NO: 2739226 - RNA, 21 nt, Human
cugagaccaaggcccccgggc

SEQ ID NO: 2739227 - RNA, 23 nt, Human
cugagaccagccaaccugggggc

SEQ ID NO: 2739228 - RNA, 15 nt, Human
cugagagaugacagg

SEQ ID NO: 2739229 - RNA, 20 nt, Human
cugagagcccaaacugcugu

SEQ ID NO: 2739230 - RNA, 14 nt, Human
cugagauccuuccu

SEQ ID NO: 2739231 - RNA, 20 nt, Human
cugagauccuuccuuuugag

SEQ ID NO: 2739232 - RNA, 18 nt, Human
cugagaugugaacacauc

SEQ ID NO: 2739233 - RNA, 19 nt, Human
cugagauuuugcuugagca

SEQ ID NO: 2739234 - RNA, 14 nt, Human
cugagcaaucugac

SEQ ID NO: 2739235 - RNA, 20 nt, Human
cugagcaccuacuuacaugc

SEQ ID NO: 2739236 - RNA, 22 nt, Human
cugagcagugcuugaaugaagu

SEQ ID NO: 2739237 - RNA, 16 nt, Human
cugagcauuuaauaug

SEQ ID NO: 2739238 - RNA, 17 nt, Human
cugagccagcagccugg

SEQ ID NO: 2739239 - RNA, 16 nt, Human
cugagccucagucucc

SEQ ID NO: 2739240 - RNA, 20 nt, Human
cugagccucagucucccucc

SEQ ID NO: 2739241 - RNA, 21 nt, Human
cugagccucagucucccuccc

SEQ ID NO: 2739242 - RNA, 12 nt, Human
cugagccugccu

SEQ ID NO: 2739243 - RNA, 18 nt, Human
cugagccuugggaccccu

SEQ ID NO: 2739244 - RNA, 16 nt, Human
cugagcgacagugaga

SEQ ID NO: 2739245 - RNA, 17 nt, Human
cugagcgcucagcuuca

SEQ ID NO: 2739246 - RNA, 17 nt, Human
cugagcggaccuuccca

SEQ ID NO: 2739247 - RNA, 18 nt, Human
cugagcggaccuucccag

SEQ ID NO: 2739248 - RNA, 20 nt, Human
cugagcggaccuucccagcu

SEQ ID NO: 2739249 - RNA, 22 nt, Human
cugagcggaccuucccagcuag

SEQ ID NO: 2739250 - RNA, 15 nt, Human
cugagcuugcagaga

SEQ ID NO: 2739251 - RNA, 16 nt, Human
cugagcuugcagagau

SEQ ID NO: 2739252 - RNA, 15 nt, Human
cugaggcaagagaau

SEQ ID NO: 2739253 - RNA, 14 nt, Human
cugaggcagacagc

SEQ ID NO: 2739254 - RNA, 17 nt, Human
cugaggcagacagcagc

SEQ ID NO: 2739255 - RNA, 15 nt, Human
cugaggcaggaggau

SEQ ID NO: 2739256 - RNA, 20 nt, Human
cugaggcaggaggaucacuu

SEQ ID NO: 2739257 - RNA, 22 nt, Human
cugaggcauccuuccucacacc

SEQ ID NO: 2739258 - RNA, 12 nt, Human
cugaggccaggg

SEQ ID NO: 2739259 - RNA, 21 nt, Human
cugaggccuagacucugucua

SEQ ID NO: 2739260 - RNA, 14 nt, Human
cugaggcuccacuu

SEQ ID NO: 2739261 - RNA, 22 nt, Human
cugaggcuccacuuggucugug

SEQ ID NO: 2739262 - RNA, 18 nt, Human
cugagggcauagaaguaa

SEQ ID NO: 2739263 - RNA, 20 nt, Human
cugagggggugggggugcug

SEQ ID NO: 2739264 - RNA, 20 nt, Human
cugagguuguguguggaagg

SEQ ID NO: 2739265 - RNA, 18 nt, Human
cugagucaacuccuuucu

SEQ ID NO: 2739266 - RNA, 14 nt, Human
cugagucccaggcu

SEQ ID NO: 2739267 - RNA, 18 nt, Human
cugagucccaggcugagc

SEQ ID NO: 2739268 - RNA, 21 nt, Human
cugagucccaggcugagccuc

SEQ ID NO: 2739269 - RNA, 14 nt, Human
cugagugcaccacu

SEQ ID NO: 2739270 - RNA, 15 nt, Human
cugagugcaccacuu

SEQ ID NO: 2739271 - RNA, 21 nt, Human
cugaguguugccuaauuuguu

SEQ ID NO: 2739272 - RNA, 16 nt, Human
cugaguuccugcaugc

SEQ ID NO: 2739273 - RNA, 17 nt, Human
cugaguuccugcaugcc

SEQ ID NO: 2739274 - RNA, 18 nt, Human
cugauauauguguuuuuc

SEQ ID NO: 2739275 - RNA, 22 nt, Human
cugauauauguguuuuucacau

SEQ ID NO: 2739276 - RNA, 24 nt, Human
cugauauauguguuuuucacauuu

SEQ ID NO: 2739277 - RNA, 20 nt, Human
cugauauuggacaguaaaau

SEQ ID NO: 2739278 - RNA, 21 nt, Human
cugauauuggacaguaaaauc

SEQ ID NO: 2739279 - RNA, 18 nt, Human
cugaugaauguuaaauua

SEQ ID NO: 2739280 - RNA, 14 nt, Human
cugaugacuuuuua

SEQ ID NO: 2739281 - RNA, 10 nt, Human
cugaugcagu

SEQ ID NO: 2739282 - RNA, 13 nt, Human
cugaugggcaaaa

SEQ ID NO: 2739283 - RNA, 18 nt, Human
cugaugggcaaaaaacca

SEQ ID NO: 2739284 - RNA, 20 nt, Human
cugaugggcaaaaaaccaau

SEQ ID NO: 2739285 - RNA, 15 nt, Human
cugauguaugaggaa

SEQ ID NO: 2739286 - RNA, 17 nt, Human
cugauuaaaguuaaaua

SEQ ID NO: 2739287 - RNA, 21 nt, Human
cugauuguuauuggguaucac

SEQ ID NO: 2739288 - RNA, 20 nt, Human
cugauuuaucuauuuaaaua

SEQ ID NO: 2739289 - RNA, 20 nt, Human
cugauuuguaacaagccucc

SEQ ID NO: 2739290 - RNA, 14 nt, Human
cugauuuuccugga

SEQ ID NO: 2739291 - RNA, 16 nt, Human
cugauuuuccuggaca

SEQ ID NO: 2739292 - RNA, 12 nt, Human
cugcaaacccuu

SEQ ID NO: 2739293 - RNA, 15 nt, Human
cugcaaacccuuuca

SEQ ID NO: 2739294 - RNA, 17 nt, Human
cugcaaacugccuucuu

SEQ ID NO: 2739295 - RNA, 14 nt, Human
cugcaaagcccagc

SEQ ID NO: 2739296 - RNA, 14 nt, Human
cugcaaccuccacc

SEQ ID NO: 2739297 - RNA, 11 nt, Human
cugcaaccugu

SEQ ID NO: 2739298 - RNA, 14 nt, Human
cugcaagaagaaau

SEQ ID NO: 2739299 - RNA, 13 nt, Human
cugcaauaaaaug

SEQ ID NO: 2739300 - RNA, 20 nt, Human
cugcaauagaacccucuggg

SEQ ID NO: 2739301 - RNA, 20 nt, Human
cugcaauauuugaauuuuaa

SEQ ID NO: 2739302 - RNA, 13 nt, Human
cuggagugagggg

SEQ ID NO: 2739303 - RNA, 22 nt, Human
cuggagugcaguggcaucaucu

SEQ ID NO: 2739304 - RNA, 17 nt, Human
cuggagugcaguggcgc

SEQ ID NO: 2739305 - RNA, 18 nt, Human
cuggagugcaguggcgca

SEQ ID NO: 2739306 - RNA, 17 nt, Human
cuggauaguccgucucu

SEQ ID NO: 2739307 - RNA, 16 nt, Human
cuggaucucacaagca

SEQ ID NO: 2739308 - RNA, 16 nt, Human
cuggauguggaggggg

SEQ ID NO: 2739309 - RNA, 17 nt, Human
cuggauuccucacuuug

SEQ ID NO: 2739310 - RNA, 22 nt, Human
cuggauugaucggagccuccuc

SEQ ID NO: 2739311 - RNA, 13 nt, Human
cuggauuuuaaaa

SEQ ID NO: 2739312 - RNA, 17 nt, Human
cuggcaaggguucaccu

SEQ ID NO: 2739313 - RNA, 22 nt, Human
cuggcaaggguucaccugggcu

SEQ ID NO: 2739314 - RNA, 16 nt, Human
cuggcacuugggacaa

SEQ ID NO: 2739315 - RNA, 17 nt, Human
cuggcacuuuuuuaaau

SEQ ID NO: 2739316 - RNA, 16 nt, Human
cuggccaacgggguga

SEQ ID NO: 2739317 - RNA, 16 nt, Human
cuggccaccugcugag

SEQ ID NO: 2739318 - RNA, 21 nt, Human
cuggccaccugcugagcccca

SEQ ID NO: 2739319 - RNA, 15 nt, Human
cuggccaggcugguc

SEQ ID NO: 2739320 - RNA, 14 nt, Human
cuggccgggagccu

SEQ ID NO: 2739321 - RNA, 23 nt, Human
cuggccgggagccugaucaccug

SEQ ID NO: 2739322 - RNA, 21 nt, Human
cuggccucugcucaacuagca

SEQ ID NO: 2739323 - RNA, 13 nt, Human
cuggccugcugga

SEQ ID NO: 2739324 - RNA, 14 nt, Human
cuggccugcuggau

SEQ ID NO: 2739325 - RNA, 15 nt, Human
cuggccugcuggaug

SEQ ID NO: 2739326 - RNA, 17 nt, Human
cuggccuguacccagua

SEQ ID NO: 2739327 - RNA, 15 nt, Human
cuggccuucggccuc

SEQ ID NO: 2739328 - RNA, 19 nt, Human
cuggccuucggccuccauc

SEQ ID NO: 2739329 - RNA, 19 nt, Human
cuggccuuguaagacccuu

SEQ ID NO: 2739330 - RNA, 20 nt, Human
cuggcgacaguuuuccuucu

SEQ ID NO: 2739331 - RNA, 13 nt, Human
cuggcgugcagca

SEQ ID NO: 2739332 - RNA, 20 nt, Human
cuggcuaauuagcauggcca

SEQ ID NO: 2739333 - RNA, 17 nt, Human
cuggcuacugcucugug

SEQ ID NO: 2739334 - RNA, 14 nt, Human
cuggcuccagcugg

SEQ ID NO: 2739335 - RNA, 21 nt, Human
cuggcucccuggaagagauca

SEQ ID NO: 2739336 - RNA, 19 nt, Human
cuggcucucccagccaggu

SEQ ID NO: 2739337 - RNA, 19 nt, Human
cuggcucuggacaggcacu

SEQ ID NO: 2739338 - RNA, 22 nt, Human
cuggcugcgcucggccugcucg

SEQ ID NO: 2739339 - RNA, 18 nt, Human
cuggcugcugguggcgcu

SEQ ID NO: 2739340 - RNA, 14 nt, Human
cuggcugcuuggag

SEQ ID NO: 2739341 - RNA, 12 nt, Human
cuggcugggagu

SEQ ID NO: 2739342 - RNA, 17 nt, Human
cuggcugggaguggcau

SEQ ID NO: 2739343 - RNA, 13 nt, Human
cuggcuuaaaaug

SEQ ID NO: 2739344 - RNA, 14 nt, Human
cuggcuuaaaaugu

SEQ ID NO: 2739345 - RNA, 21 nt, Human
cuggcuuaaaauguaauuaau

SEQ ID NO: 2739346 - RNA, 18 nt, Human
cugggaauuacaggcgug

SEQ ID NO: 2739347 - RNA, 19 nt, Human
cugggaauuacaggcguga

SEQ ID NO: 2739348 - RNA, 22 nt, Human
cugggaauuacaggcgugagcc

SEQ ID NO: 2739349 - RNA, 20 nt, Human
cugggacaggggagaaccua

SEQ ID NO: 2739350 - RNA, 22 nt, Human
cugggacaggggagaaccuagg

SEQ ID NO: 2739351 - RNA, 17 nt, Human
cugggaccaggcacccc

SEQ ID NO: 2739352 - RNA, 20 nt, Human
cugggacguggcuagucaua

SEQ ID NO: 2739353 - RNA, 15 nt, Human
cugggagccccaauu

SEQ ID NO: 2739354 - RNA, 14 nt, Human
cugggaggcucugg

SEQ ID NO: 2739355 - RNA, 20 nt, Human
cugggaggcucuggagccca

SEQ ID NO: 2739356 - RNA, 19 nt, Human
cugggauacugugcccaga

SEQ ID NO: 2739357 - RNA, 22 nt, Human
cugggauacugugcccagagcc

SEQ ID NO: 2739358 - RNA, 18 nt, Human
cugggauagcugacccag

SEQ ID NO: 2739359 - RNA, 14 nt, Human
cugggaucacugau

SEQ ID NO: 2739360 - RNA, 16 nt, Human
cugggauuacaggcgu

SEQ ID NO: 2739361 - RNA, 19 nt, Human
cugggcagaaggccaagag

SEQ ID NO: 2739362 - RNA, 15 nt, Human
cugggcagcugccuc

SEQ ID NO: 2739363 - RNA, 18 nt, Human
cugggcagcugccucccc

SEQ ID NO: 2739364 - RNA, 23 nt, Human
cugggcagcugccuccccuccuc

SEQ ID NO: 2739365 - RNA, 20 nt, Human
cugggcccaguaccuagcug

SEQ ID NO: 2739366 - RNA, 13 nt, Human
cugggccccugcc

SEQ ID NO: 2739367 - RNA, 15 nt, Human
cugggcugugggcaa

SEQ ID NO: 2739368 - RNA, 18 nt, Human
cugggcugugggcaagcc

SEQ ID NO: 2739369 - RNA, 22 nt, Human
cuggggaacauagaacucauga

SEQ ID NO: 2739370 - RNA, 17 nt, Human
cuggggcauggaaggca

SEQ ID NO: 2739371 - RNA, 18 nt, Human
cuggggccuguugaagau

SEQ ID NO: 2739372 - RNA, 18 nt, Human
cuggggcuuuaacuccug

SEQ ID NO: 2739373 - RNA, 19 nt, Human
cuggggcuuuaacuccugc

SEQ ID NO: 2739374 - RNA, 20 nt, Human
cuggggcuuuaacuccugcu

SEQ ID NO: 2739375 - RNA, 13 nt, Human
cugggggagggga

SEQ ID NO: 2739376 - RNA, 13 nt, Human
cugggucgccggc

SEQ ID NO: 2739377 - RNA, 14 nt, Human
cugggucgccggca

SEQ ID NO: 2739378 - RNA, 17 nt, Human
cugggucucaguguccu

SEQ ID NO: 2739379 - RNA, 16 nt, Human
cuggguuaggccuugc

SEQ ID NO: 2739380 - RNA, 11 nt, Human
cuggguucaag

SEQ ID NO: 2739381 - RNA, 21 nt, Human
cuggguuccuuccucugagcc

SEQ ID NO: 2739382 - RNA, 22 nt, Human
cuggguuccuuccucugagccu

SEQ ID NO: 2739383 - RNA, 21 nt, Human
cuggguuuuggggggacgcua

SEQ ID NO: 2739384 - RNA, 19 nt, Human
cugguagaggaugaggaaa

SEQ ID NO: 2739385 - RNA, 21 nt, Human
cugguagcuaaauauauauuu

SEQ ID NO: 2739386 - RNA, 19 nt, Human
cugguccaacaugaaaaca

SEQ ID NO: 2739387 - RNA, 17 nt, Human
cugguccuaagucccug

SEQ ID NO: 2739388 - RNA, 18 nt, Human
cuggucucaaacuccuga

SEQ ID NO: 2739389 - RNA, 21 nt, Human
cuggucucgaacugcuggauu

SEQ ID NO: 2739390 - RNA, 18 nt, Human
cuggucucuccuuguucu

SEQ ID NO: 2739391 - RNA, 19 nt, Human
cuggucucuccuuguucug

SEQ ID NO: 2739392 - RNA, 19 nt, Human
cuggucugaggucauuaaa

SEQ ID NO: 2739393 - RNA, 20 nt, Human
cuggugcacgcaggcacagc

SEQ ID NO: 2739394 - RNA, 12 nt, Human
cugguggcgcug

SEQ ID NO: 2739395 - RNA, 22 nt, Human
cuggugucuucaggggccacac

SEQ ID NO: 2739396 - RNA, 13 nt, Human
cugguugggcagc

SEQ ID NO: 2739397 - RNA, 20 nt, Human
cuguaaaauggagacaccac

SEQ ID NO: 2739398 - RNA, 17 nt, Human
cuguaaaaugugggauu

SEQ ID NO: 2739399 - RNA, 16 nt, Human
cuguaaauuuauuaug

SEQ ID NO: 2739400 - RNA, 13 nt, Human
cuguaacaaugua

SEQ ID NO: 2739401 - RNA, 14 nt, Human
cuguaaucccagcu

SEQ ID NO: 2739402 - RNA, 17 nt, Human
cuguaaugccuuuucuc

SEQ ID NO: 2739403 - RNA, 21 nt, Human
cuguacagacagaaaaaacug

SEQ ID NO: 2739404 - RNA, 22 nt, Human
cuguacagacagaaaaaacuga

SEQ ID NO: 2739405 - RNA, 21 nt, Human
cuguacccaguagaugccacc

SEQ ID NO: 2739406 - RNA, 16 nt, Human
cuguacgcgagcgcgc

SEQ ID NO: 2739407 - RNA, 16 nt, Human
cuguacuccagccugg

SEQ ID NO: 2739408 - RNA, 13 nt, Human
cuguacuuuuucc

SEQ ID NO: 2739409 - RNA, 15 nt, Human
cuguacuuuuuccag

SEQ ID NO: 2739410 - RNA, 17 nt, Human
cuguagaaaugguugua

SEQ ID NO: 2739411 - RNA, 13 nt, Human
cuguauaaaauca

SEQ ID NO: 2739412 - RNA, 18 nt, Human
cuguauacaaaacccuuu

SEQ ID NO: 2739413 - RNA, 19 nt, Human
cuguauacugugugcuaaa

SEQ ID NO: 2739414 - RNA, 16 nt, Human
cuguaucuagccugga

SEQ ID NO: 2739415 - RNA, 16 nt, Human
cuguaucuuguuuuuc

SEQ ID NO: 2739416 - RNA, 16 nt, Human
cuguaugaguggaaau

SEQ ID NO: 2739417 - RNA, 15 nt, Human
cuguauguccuuggu

SEQ ID NO: 2739418 - RNA, 18 nt, Human
cuguauuugaaucagccu

SEQ ID NO: 2739419 - RNA, 20 nt, Human
cuguauuuuuaccuuuuucc

SEQ ID NO: 2739420 - RNA, 20 nt, Human
cugucacgugugggcaaugu

SEQ ID NO: 2739421 - RNA, 21 nt, Human
cugucauaaugguuuuuaaca

SEQ ID NO: 2739422 - RNA, 15 nt, Human
cugucauccacuuua

SEQ ID NO: 2739423 - RNA, 18 nt, Human
cuguccaaucuuugacaa

SEQ ID NO: 2739424 - RNA, 16 nt, Human
cuguccauucuuccuc

SEQ ID NO: 2739425 - RNA, 19 nt, Human
cuguccauucuuccuccca

SEQ ID NO: 2739426 - RNA, 20 nt, Human
cuguccauucuuccucccau

SEQ ID NO: 2739427 - RNA, 19 nt, Human
cugucccagcgagggacac

SEQ ID NO: 2739428 - RNA, 23 nt, Human
cugucccagcgagggacaccgag

SEQ ID NO: 2739429 - RNA, 13 nt, Human
cuguccuggaggg

SEQ ID NO: 2739430 - RNA, 14 nt, Human
cugucggagcccug

SEQ ID NO: 2739431 - RNA, 16 nt, Human
cugucggagcccuguc

SEQ ID NO: 2739432 - RNA, 19 nt, Human
cugucucaaaaaauaaaaa

SEQ ID NO: 2739433 - RNA, 13 nt, Human
cugucucagggug

SEQ ID NO: 2739434 - RNA, 14 nt, Human
cugucucaguccau

SEQ ID NO: 2739435 - RNA, 13 nt, Human
cugucuccuaagc

SEQ ID NO: 2739436 - RNA, 19 nt, Human
cugucuccuaagcuggagu

SEQ ID NO: 2739437 - RNA, 16 nt, Human
cugucucuacaaaaaa

SEQ ID NO: 2739438 - RNA, 15 nt, Human
cugucugccagccag

SEQ ID NO: 2739439 - RNA, 22 nt, Human
cugucuggacuuuccagagacc

SEQ ID NO: 2739440 - RNA, 20 nt, Human
cugucuucguauucccauua

SEQ ID NO: 2739441 - RNA, 23 nt, Human
cugugaagugagaccuuccuuuu

SEQ ID NO: 2739442 - RNA, 17 nt, Human
cugugacugucucacuu

SEQ ID NO: 2739443 - RNA, 16 nt, Human
cugugagaugcuagaa

SEQ ID NO: 2739444 - RNA, 20 nt, Human
cugugagaugcuagaacucc

SEQ ID NO: 2739445 - RNA, 14 nt, Human
cugugaucuugcuc

SEQ ID NO: 2739446 - RNA, 21 nt, Human
cuucucuuaaacacuaaaaag

SEQ ID NO: 2739447 - RNA, 15 nt, Human
cuucugagccugccu

SEQ ID NO: 2739448 - RNA, 16 nt, Human
cuucugagccugccuu

SEQ ID NO: 2739449 - RNA, 15 nt, Human
cuucugaggagcugu

SEQ ID NO: 2739450 - RNA, 16 nt, Human
cuucugggcagacucu

SEQ ID NO: 2739451 - RNA, 16 nt, Human
cuucuggguuccuucc

SEQ ID NO: 2739452 - RNA, 19 nt, Human
cuucuuacaaugcauucug

SEQ ID NO: 2739453 - RNA, 19 nt, Human
cuucuuccaacguggccca

SEQ ID NO: 2739454 - RNA, 13 nt, Human
cuucuugaaauca

SEQ ID NO: 2739455 - RNA, 19 nt, Human
cuucuugauaccugggaua

SEQ ID NO: 2739456 - RNA, 21 nt, Human
cuucuuggacuucuugaaauc

SEQ ID NO: 2739457 - RNA, 17 nt, Human
cuucuuggccaugggag

SEQ ID NO: 2739458 - RNA, 19 nt, Human
cuucuuggccaugggaggc

SEQ ID NO: 2739459 - RNA, 23 nt, Human
cuucuuggccaugggaggccuuu

SEQ ID NO: 2739460 - RNA, 21 nt, Human
cuucuuuaaagggauggcaag

SEQ ID NO: 2739461 - RNA, 13 nt, Human
cuucuuucaugaa

SEQ ID NO: 2739462 - RNA, 14 nt, Human
cuucuuuuuuucuu

SEQ ID NO: 2739463 - RNA, 15 nt, Human
cuucuuuuuuucuug

SEQ ID NO: 2739464 - RNA, 19 nt, Human
cuugaaacugagaugugaa

SEQ ID NO: 2739465 - RNA, 21 nt, Human
cuugaaauagugucugaugaa

SEQ ID NO: 2739466 - RNA, 21 nt, Human
cuugaaggucuaggugcuuua

SEQ ID NO: 2739467 - RNA, 22 nt, Human
cuugaauuguaggugacuauua

SEQ ID NO: 2739468 - RNA, 13 nt, Human
cuugacuuuggca

SEQ ID NO: 2739469 - RNA, 21 nt, Human
cuugaggacuugggcgggaca

SEQ ID NO: 2739470 - RNA, 22 nt, Human
cuugaggcacagaaacuccugu

SEQ ID NO: 2739471 - RNA, 18 nt, Human
cuugagggcaagagccac

SEQ ID NO: 2739472 - RNA, 14 nt, Human
cuugagguaaaagc

SEQ ID NO: 2739473 - RNA, 17 nt, Human
cuugaguuuaaauugua

SEQ ID NO: 2739474 - RNA, 14 nt, Human
cuugaugaagaagu

SEQ ID NO: 2739475 - RNA, 18 nt, Human
cuugauggucccuauucc

SEQ ID NO: 2739476 - RNA, 20 nt, Human
cuugauuuuagccuucucug

SEQ ID NO: 2739477 - RNA, 20 nt, Human
cuugcacuagaggaacccua

SEQ ID NO: 2739478 - RNA, 22 nt, Human
cuugcauaagagcuuaagaacc

SEQ ID NO: 2739479 - RNA, 23 nt, Human
cuugccaaauauaaauaaaaaua

SEQ ID NO: 2739480 - RNA, 14 nt, Human
cuugccaaaucaaa

SEQ ID NO: 2739481 - RNA, 12 nt, Human
cuugccaaauuu

SEQ ID NO: 2739482 - RNA, 20 nt, Human
cuugccauaauuacuauguc

SEQ ID NO: 2739483 - RNA, 13 nt, Human
cuugccaucccuc

SEQ ID NO: 2739484 - RNA, 16 nt, Human
cuugccaucccucccu

SEQ ID NO: 2739485 - RNA, 19 nt, Human
cuugccaucccucccucca

SEQ ID NO: 2739486 - RNA, 18 nt, Human
cuugcccagggcucagcc

SEQ ID NO: 2739487 - RNA, 20 nt, Human
cuugcccuggugccucaccc

SEQ ID NO: 2739488 - RNA, 18 nt, Human
cuugcccuguuaaaagau

SEQ ID NO: 2739489 - RNA, 19 nt, Human
cuugcccuguuaaaagaug

SEQ ID NO: 2739490 - RNA, 16 nt, Human
cuugccugcaggcaug

SEQ ID NO: 2739491 - RNA, 19 nt, Human
cuugccugcaggcaugagu

SEQ ID NO: 2739492 - RNA, 17 nt, Human
cuugccuugcugaacuc

SEQ ID NO: 2739493 - RNA, 18 nt, Human
cuugccuugcugaacucc

SEQ ID NO: 2739494 - RNA, 13 nt, Human
cuugcucucggug

SEQ ID NO: 2739495 - RNA, 14 nt, Human
cuugcucucggugc

SEQ ID NO: 2739496 - RNA, 20 nt, Human
cuugcucucggugcuuccaa

SEQ ID NO: 2739497 - RNA, 19 nt, Human
cuugcucuugaugccuggc

SEQ ID NO: 2739498 - RNA, 13 nt, Human
cuugcugcaccug

SEQ ID NO: 2739499 - RNA, 21 nt, Human
cuuggaaauagugauuuccac

SEQ ID NO: 2739500 - RNA, 16 nt, Human
cuuggaauccugggga

SEQ ID NO: 2739501 - RNA, 18 nt, Human
cuuggaauccuggggaac

SEQ ID NO: 2739502 - RNA, 15 nt, Human
cuuggacucauuuua

SEQ ID NO: 2739503 - RNA, 16 nt, Human
cuuggacuucuugaaa

SEQ ID NO: 2739504 - RNA, 16 nt, Human
cuuggagacagggccc

SEQ ID NO: 2739505 - RNA, 13 nt, Human
cuuggccauggga

SEQ ID NO: 2739506 - RNA, 18 nt, Human
cuugggaauuuucuucca

SEQ ID NO: 2739507 - RNA, 19 nt, Human
cuuggggccuaugcagagg

SEQ ID NO: 2739508 - RNA, 18 nt, Human
cuuggggcugaugcaguu

SEQ ID NO: 2739509 - RNA, 14 nt, Human
cuuggucugugaga

SEQ ID NO: 2739510 - RNA, 19 nt, Human
cuuggugauuccgcaguga

SEQ ID NO: 2739511 - RNA, 19 nt, Human
cuugguucucuccaccagg

SEQ ID NO: 2739512 - RNA, 12 nt, Human
cuugguuuuaau

SEQ ID NO: 2739513 - RNA, 22 nt, Human
cuuguaaaguacagacuuuuuu

SEQ ID NO: 2739514 - RNA, 23 nt, Human
cuuguaaaguacagacuuuuuuu

SEQ ID NO: 2739515 - RNA, 18 nt, Human
cuuguaauucuaaaugaa

SEQ ID NO: 2739516 - RNA, 19 nt, Human
cuuguaauuugaaauauuu

SEQ ID NO: 2739517 - RNA, 22 nt, Human
cuuguacucugaaaguuuugga

SEQ ID NO: 2739518 - RNA, 16 nt, Human
cuuguauaucuuguuu

SEQ ID NO: 2739519 - RNA, 17 nt, Human
cuuguauaucuuguuuu

SEQ ID NO: 2739520 - RNA, 16 nt, Human
cuuguauuaugugugu

SEQ ID NO: 2739521 - RNA, 18 nt, Human
cuuguauuccuuuuucuc

SEQ ID NO: 2739522 - RNA, 10 nt, Human
cuuguauuuu

SEQ ID NO: 2739523 - RNA, 16 nt, Human
cuuguauuuuacuuuu

SEQ ID NO: 2739524 - RNA, 16 nt, Human
cuuguauuuuuccaau

SEQ ID NO: 2739525 - RNA, 18 nt, Human
cuuguauuuuuccaauua

SEQ ID NO: 2739526 - RNA, 18 nt, Human
cuugucaauaaaauccau

SEQ ID NO: 2739527 - RNA, 20 nt, Human
cuuguccaacccgaggcccg

SEQ ID NO: 2739528 - RNA, 23 nt, Human
cuuguccccaacaccccacagaa

SEQ ID NO: 2739529 - RNA, 12 nt, Human
cuugucucccag

SEQ ID NO: 2739530 - RNA, 21 nt, Human
cuugucucgaacuccugaccc

SEQ ID NO: 2739531 - RNA, 13 nt, Human
cuugucucugggc

SEQ ID NO: 2739532 - RNA, 15 nt, Human
cuugugaggagcugg

SEQ ID NO: 2739533 - RNA, 17 nt, Human
cuuguguuucuuuaguu

SEQ ID NO: 2739534 - RNA, 21 nt, Human
cuuguguuucuuuaguuuuug

SEQ ID NO: 2739535 - RNA, 14 nt, Human
cuuguucugauaau

SEQ ID NO: 2739536 - RNA, 21 nt, Human
cuuguuggacgagaaaacaau

SEQ ID NO: 2739537 - RNA, 16 nt, Human
cuuguuggauuuuugu

SEQ ID NO: 2739538 - RNA, 21 nt, Human
cuuguuggauuuuugucuugu

SEQ ID NO: 2739539 - RNA, 13 nt, Human
cuuguuucagagu

SEQ ID NO: 2739540 - RNA, 15 nt, Human
cuuuaaaacuuaucc

SEQ ID NO: 2739541 - RNA, 13 nt, Human
cuuuaaaauacac

SEQ ID NO: 2739542 - RNA, 20 nt, Human
cuuuaaaauuuuuuuagaaa

SEQ ID NO: 2739543 - RNA, 16 nt, Human
cuuuaacacagugucu

SEQ ID NO: 2739544 - RNA, 12 nt, Human
cuuuaacuccug

SEQ ID NO: 2739545 - RNA, 16 nt, Human
cuuuaaguguaacugg

SEQ ID NO: 2739546 - RNA, 16 nt, Human
cuuuaaugaauaaaca

SEQ ID NO: 2739547 - RNA, 17 nt, Human
cuuuaaugaauaaacau

SEQ ID NO: 2739548 - RNA, 18 nt, Human
cuuuaaugaauaaacauu

SEQ ID NO: 2739549 - RNA, 16 nt, Human
cuuuaauggguaaaca

SEQ ID NO: 2739550 - RNA, 12 nt, Human
cuuuaauuucau

SEQ ID NO: 2739551 - RNA, 18 nt, Human
cuuuaauuucaugaaaag

SEQ ID NO: 2739552 - RNA, 19 nt, Human
cuuuaauuuuacauuuccu

SEQ ID NO: 2739553 - RNA, 20 nt, Human
cuuuacaaauagaauuugag

SEQ ID NO: 2739554 - RNA, 17 nt, Human
cuuuacuguuagucauu

SEQ ID NO: 2739555 - RNA, 13 nt, Human
cuuuacuuucccc

SEQ ID NO: 2739556 - RNA, 16 nt, Human
cuuuacuuuccccuug

SEQ ID NO: 2739557 - RNA, 17 nt, Human
cuuuagggaccugcugu

SEQ ID NO: 2739558 - RNA, 14 nt, Human
cuuuauauuauuuu

SEQ ID NO: 2739559 - RNA, 24 nt, Human
cuuuaucuugaauaauguaagaca

SEQ ID NO: 2739560 - RNA, 17 nt, Human
cuuuauguaguuuuuau

SEQ ID NO: 2739561 - RNA, 20 nt, Human
cuuuauguuacuacaugcac

SEQ ID NO: 2739562 - RNA, 14 nt, Human
cuuuauuagugaag

SEQ ID NO: 2739563 - RNA, 16 nt, Human
cuuuauuuucuauaau

SEQ ID NO: 2739564 - RNA, 12 nt, Human
cuuuauuuugag

SEQ ID NO: 2739565 - RNA, 21 nt, Human
cuuuauuuuuuaaguauuuau

SEQ ID NO: 2739566 - RNA, 17 nt, Human
cuuucacaggggacagg

SEQ ID NO: 2739567 - RNA, 20 nt, Human
cuuucacaggggacaggaug

SEQ ID NO: 2739568 - RNA, 11 nt, Human
cuuucagagcc

SEQ ID NO: 2739569 - RNA, 14 nt, Human
cuuucauaaagucu

SEQ ID NO: 2739570 - RNA, 19 nt, Human
cuuucauaaagucuugccu

SEQ ID NO: 2739571 - RNA, 14 nt, Human
cuuucauaauaagu

SEQ ID NO: 2739572 - RNA, 21 nt, Human
cuuucaucuuggucacauaca

SEQ ID NO: 2739573 - RNA, 21 nt, Human
cuuuccaauaaagaguuccuu

SEQ ID NO: 2739574 - RNA, 23 nt, Human
cuuuccaauaaagaguuccuucu

SEQ ID NO: 2739575 - RNA, 13 nt, Human
cuuuccacagaag

SEQ ID NO: 2739576 - RNA, 19 nt, Human
cuuuccacagaagcuccag

SEQ ID NO: 2739577 - RNA, 22 nt, Human
cuuuccacagaagcuccaggua

SEQ ID NO: 2739578 - RNA, 13 nt, Human
cuuuccaugaguu

SEQ ID NO: 2739579 - RNA, 17 nt, Human
cuuucccaacagcucca

SEQ ID NO: 2739580 - RNA, 15 nt, Human
cuuucccuaagccag

SEQ ID NO: 2739581 - RNA, 18 nt, Human
cuuuccgaggccccuguc

SEQ ID NO: 2739582 - RNA, 14 nt, Human
cuuucucaauaagc

SEQ ID NO: 2739583 - RNA, 22 nt, Human
cuuucucaucuuguccccaaca

SEQ ID NO: 2739584 - RNA, 13 nt, Human
cuuucucugaggg

SEQ ID NO: 2739585 - RNA, 16 nt, Human
cuuucucugagggggu

SEQ ID NO: 2739586 - RNA, 22 nt, Human
cuuucuuagaaauuuauuuccu

SEQ ID NO: 2739587 - RNA, 20 nt, Human
cuuucuucuuugaauuuccu

SEQ ID NO: 2739588 - RNA, 14 nt, Human
cuuucuuuuuuaaa

SEQ ID NO: 2739589 - RNA, 16 nt, Human
cuuucuuuuuuuucuu

SEQ ID NO: 2739590 - RNA, 19 nt, Human
cuuugaaaaaguauaaaua

SEQ ID NO: 2739591 - RNA, 17 nt, Human
gaaaucagaguuuucau

SEQ ID NO: 2739592 - RNA, 14 nt, Human
gaaaucauacuucu

SEQ ID NO: 2739593 - RNA, 15 nt, Human
gaaaucauacuucuu

SEQ ID NO: 2739594 - RNA, 17 nt, Human
gaaaucaugaagauauu

SEQ ID NO: 2739595 - RNA, 11 nt, Human
gaaaugaaaaa

SEQ ID NO: 2739596 - RNA, 15 nt, Human
gaaaugaaagcaggg

SEQ ID NO: 2739597 - RNA, 18 nt, Human
gaaaugaaagcagggacu

SEQ ID NO: 2739598 - RNA, 20 nt, Human
gaaaugagcacgcauggaaa

SEQ ID NO: 2739599 - RNA, 15 nt, Human
gaaaugauguuucau

SEQ ID NO: 2739600 - RNA, 16 nt, Human
gaaaugcugguuuuuc

SEQ ID NO: 2739601 - RNA, 15 nt, Human
gaaauggggaacuac

SEQ ID NO: 2739602 - RNA, 15 nt, Human
gaaauguaagggaaa

SEQ ID NO: 2739603 - RNA, 12 nt, Human
gaaauguauucu

SEQ ID NO: 2739604 - RNA, 16 nt, Human
gaaauguauucuuuua

SEQ ID NO: 2739605 - RNA, 15 nt, Human
gaaauuaacucagac

SEQ ID NO: 2739606 - RNA, 21 nt, Human
gaaauuccaggaaaaucugca

SEQ ID NO: 2739607 - RNA, 15 nt, Human
gaaauucugcaagcu

SEQ ID NO: 2739608 - RNA, 17 nt, Human
gaaauugccugacgaac

SEQ ID NO: 2739609 - RNA, 14 nt, Human
gaaauuuauaaacu

SEQ ID NO: 2739610 - RNA, 22 nt, Human
gaaauuuauaaacuuuuuucuu

SEQ ID NO: 2739611 - RNA, 20 nt, Human
gaacaaacagggcugccuuc

SEQ ID NO: 2739612 - RNA, 19 nt, Human
gaacacccuauauuuugca

SEQ ID NO: 2739613 - RNA, 18 nt, Human
gaacacugggggagggga

SEQ ID NO: 2739614 - RNA, 17 nt, Human
gaacagauuucaaaaaa

SEQ ID NO: 2739615 - RNA, 23 nt, Human
gaacagauuucaaaaaaaaaccc

SEQ ID NO: 2739616 - RNA, 14 nt, Human
gaacagucucuuga

SEQ ID NO: 2739617 - RNA, 18 nt, Human
gaacagucucuugaggca

SEQ ID NO: 2739618 - RNA, 18 nt, Human
gaacagugauuaccaggg

SEQ ID NO: 2739619 - RNA, 13 nt, Human
gaacauagaacuc

SEQ ID NO: 2739620 - RNA, 20 nt, Human
gaacaucacagcuuauuucc

SEQ ID NO: 2739621 - RNA, 14 nt, Human
gaacaucccuccug

SEQ ID NO: 2739622 - RNA, 23 nt, Human
gaacaugagccuuuguugcuauc

SEQ ID NO: 2739623 - RNA, 21 nt, Human
gaaccacaagacugcacauca

SEQ ID NO: 2739624 - RNA, 20 nt, Human
gaaccacucauaauucuuca

SEQ ID NO: 2739625 - RNA, 13 nt, Human
gaaccuaggguga

SEQ ID NO: 2739626 - RNA, 14 nt, Human
gaaccuugaaaacu

SEQ ID NO: 2739627 - RNA, 16 nt, Human
gaaccuuuacauccag

SEQ ID NO: 2739628 - RNA, 14 nt, Human
gaacgagacaagca

SEQ ID NO: 2739629 - RNA, 15 nt, Human
gaacgauuuagaaag

SEQ ID NO: 2739630 - RNA, 20 nt, Human
gaacguaaucguguccccua

SEQ ID NO: 2739631 - RNA, 19 nt, Human
gaacguuuuuccuguucuu

SEQ ID NO: 2739632 - RNA, 16 nt, Human
gaacuacuagaaaauu

SEQ ID NO: 2739633 - RNA, 16 nt, Human
gaacucaaggaaaucu

SEQ ID NO: 2739634 - RNA, 12 nt, Human
gaacucaauaaa

SEQ ID NO: 2739635 - RNA, 15 nt, Human
gaacuccagagauga

SEQ ID NO: 2739636 - RNA, 19 nt, Human
gaacucccucucugcaggc

SEQ ID NO: 2739637 - RNA, 16 nt, Human
gaacucccuuucaaca

SEQ ID NO: 2739638 - RNA, 21 nt, Human
gaacucucgagcguugcuggg

SEQ ID NO: 2739639 - RNA, 17 nt, Human
gaacucugagcagugcu

SEQ ID NO: 2739640 - RNA, 18 nt, Human
gaacucugagcagugcuu

SEQ ID NO: 2739641 - RNA, 14 nt, Human
gaacugcuggauuc

SEQ ID NO: 2739642 - RNA, 20 nt, Human
gaacuggacccuguugcuaa

SEQ ID NO: 2739643 - RNA, 16 nt, Human
gaacugucucucauga

SEQ ID NO: 2739644 - RNA, 17 nt, Human
gaacuuuccacauucag

SEQ ID NO: 2739645 - RNA, 21 nt, Human
gaacuuuccacauucagagcu

SEQ ID NO: 2739646 - RNA, 17 nt, Human
gaacuuuuuguuuuguu

SEQ ID NO: 2739647 - RNA, 14 nt, Human
gaagaacucucugg

SEQ ID NO: 2739648 - RNA, 18 nt, Human
gaagaacucucuggaagc

SEQ ID NO: 2739649 - RNA, 16 nt, Human
gaagaagcaccaauca

SEQ ID NO: 2739650 - RNA, 21 nt, Human
gaagaagcaccaaucaugaau

SEQ ID NO: 2739651 - RNA, 22 nt, Human
gaagaagcaccaaucaugaauu

SEQ ID NO: 2739652 - RNA, 18 nt, Human
gaagacagagccccaccc

SEQ ID NO: 2739653 - RNA, 21 nt, Human
gaagacagagccccacccuca

SEQ ID NO: 2739654 - RNA, 17 nt, Human
gaagaccucauuuugaa

SEQ ID NO: 2739655 - RNA, 16 nt, Human
gaagagaaaccaggga

SEQ ID NO: 2739656 - RNA, 18 nt, Human
gaagagccggagccucca

SEQ ID NO: 2739657 - RNA, 19 nt, Human
gaagagccggagccuccag

SEQ ID NO: 2739658 - RNA, 21 nt, Human
gaagagccggagccuccagcu

SEQ ID NO: 2739659 - RNA, 17 nt, Human
gaagagcuguucacagc

SEQ ID NO: 2739660 - RNA, 18 nt, Human
gaagaggguuaggagggu

SEQ ID NO: 2739661 - RNA, 20 nt, Human
gaagaguggguuucacaagu

SEQ ID NO: 2739662 - RNA, 18 nt, Human
gaagaugcuuguauuuua

SEQ ID NO: 2739663 - RNA, 18 nt, Human
gaagaugguaccaccagu

SEQ ID NO: 2739664 - RNA, 18 nt, Human
gaagcaccaaucaugaau

SEQ ID NO: 2739665 - RNA, 13 nt, Human
gaagcagccaagu

SEQ ID NO: 2739666 - RNA, 21 nt, Human
gaagcuagaaaacaggcaaau

SEQ ID NO: 2739667 - RNA, 16 nt, Human
gaagcucaacucucuu

SEQ ID NO: 2739668 - RNA, 22 nt, Human
gaagcuuuuaugugaaacaugu

SEQ ID NO: 2739669 - RNA, 21 nt, Human
gaaggaaagaauaaccaacac

SEQ ID NO: 2739670 - RNA, 18 nt, Human
gaaggagcucccaggagg

SEQ ID NO: 2739671 - RNA, 19 nt, Human
gaaggagcucccaggaggg

SEQ ID NO: 2739672 - RNA, 16 nt, Human
gaaggcauccccaggc

SEQ ID NO: 2739673 - RNA, 18 nt, Human
gaaggcauccccaggccc

SEQ ID NO: 2739674 - RNA, 20 nt, Human
gaaggcugaggcaggaggau

SEQ ID NO: 2739675 - RNA, 14 nt, Human
gaaggcuuacaccc

SEQ ID NO: 2739676 - RNA, 20 nt, Human
gaagggacacauaucaaacu

SEQ ID NO: 2739677 - RNA, 12 nt, Human
gaaggggcggcg

SEQ ID NO: 2739678 - RNA, 18 nt, Human
gaagggguucucacagug

SEQ ID NO: 2739679 - RNA, 21 nt, Human
gaaggugaaacauuuucuccc

SEQ ID NO: 2739680 - RNA, 19 nt, Human
gaaggugggaggaugugaa

SEQ ID NO: 2739681 - RNA, 14 nt, Human
gaaguauaggccag

SEQ ID NO: 2739682 - RNA, 16 nt, Human
gaaguaucuugguugu

SEQ ID NO: 2739683 - RNA, 22 nt, Human
gaaguaucuugguugugacaga

SEQ ID NO: 2739684 - RNA, 20 nt, Human
gaagucaaggcuuagacccu

SEQ ID NO: 2739685 - RNA, 20 nt, Human
gaagucugcuacccucauuu

SEQ ID NO: 2739686 - RNA, 12 nt, Human
gaagucuuccau

SEQ ID NO: 2739687 - RNA, 22 nt, Human
gaagugaaaaucuacacuccag

SEQ ID NO: 2739688 - RNA, 22 nt, Human
gaagugauacuauccaguuacu

SEQ ID NO: 2739689 - RNA, 23 nt, Human
gaagugcuaauuuugaaaaacug

SEQ ID NO: 2739690 - RNA, 18 nt, Human
gaaguuaagcaacaucua

SEQ ID NO: 2739691 - RNA, 17 nt, Human
gaaguugcagugagcug

SEQ ID NO: 2739692 - RNA, 15 nt, Human
gaaguuucauccgca

SEQ ID NO: 2739693 - RNA, 19 nt, Human
gaauaaaauuuuuaaucuu

SEQ ID NO: 2739694 - RNA, 18 nt, Human
gaauaauccuaaacauau

SEQ ID NO: 2739695 - RNA, 22 nt, Human
gaauaauccuaaacauaugaau

SEQ ID NO: 2739696 - RNA, 16 nt, Human
gaauaaucuccuguua

SEQ ID NO: 2739697 - RNA, 14 nt, Human
gaauaauguaagac

SEQ ID NO: 2739698 - RNA, 20 nt, Human
gaauaauguaagacaaauau

SEQ ID NO: 2739699 - RNA, 19 nt, Human
gaauacucuuauaucuaua

SEQ ID NO: 2739700 - RNA, 15 nt, Human
gaauauaaauuuauc

SEQ ID NO: 2739701 - RNA, 16 nt, Human
gaauauaaauuuauca

SEQ ID NO: 2739702 - RNA, 15 nt, Human
gaauauauuuccuua

SEQ ID NO: 2739703 - RNA, 12 nt, Human
gaauaucuauua

SEQ ID NO: 2739704 - RNA, 17 nt, Human
gaauaucuauuaauaua

SEQ ID NO: 2739705 - RNA, 22 nt, Human
gaauaucuccgucaacucauau

SEQ ID NO: 2739706 - RNA, 13 nt, Human
gaaucacaauaau

SEQ ID NO: 2739707 - RNA, 21 nt, Human
gaaucacucauuuauuuccau

SEQ ID NO: 2739708 - RNA, 14 nt, Human
gaaucacuugaacc

SEQ ID NO: 2739709 - RNA, 16 nt, Human
gaaucacuugaacccg

SEQ ID NO: 2739710 - RNA, 17 nt, Human
gaaucauaugggauacu

SEQ ID NO: 2739711 - RNA, 18 nt, Human
gaaucauaugggauacug

SEQ ID NO: 2739712 - RNA, 20 nt, Human
gaauccagaaauaaugaaau

SEQ ID NO: 2739713 - RNA, 23 nt, Human
gaaucccucuaucucuaaagaaa

SEQ ID NO: 2739714 - RNA, 15 nt, Human
gaauccucucucugu

SEQ ID NO: 2739715 - RNA, 16 nt, Human
gaauccucucucugug

SEQ ID NO: 2739716 - RNA, 15 nt, Human
gaaugaagcaaugcu

SEQ ID NO: 2739717 - RNA, 22 nt, Human
gaaugaccuggccgcagugagg

SEQ ID NO: 2739718 - RNA, 13 nt, Human
gaaugagaagaau

SEQ ID NO: 2739719 - RNA, 17 nt, Human
gaaugagagacacacug

SEQ ID NO: 2739720 - RNA, 23 nt, Human
gaaugagagacacacugaagaag

SEQ ID NO: 2739721 - RNA, 14 nt, Human
gaaugauuaugaau

SEQ ID NO: 2739722 - RNA, 16 nt, Human
gaaugauuaugaauua

SEQ ID NO: 2739723 - RNA, 23 nt, Human
gaaugauuaugaauuacauuugu

SEQ ID NO: 2739724 - RNA, 12 nt, Human
gaauggaagagg

SEQ ID NO: 2739725 - RNA, 16 nt, Human
gaauggcuaagcaaaa

SEQ ID NO: 2739726 - RNA, 19 nt, Human
gaaugggggcagcaccucc

SEQ ID NO: 2739727 - RNA, 12 nt, Human
gaaugguaucaa

SEQ ID NO: 2739728 - RNA, 19 nt, Human
gaauguaaucaauguuucu

SEQ ID NO: 2739729 - RNA, 21 nt, Human
gaauguuaaauaaauuguaua

SEQ ID NO: 2739730 - RNA, 14 nt, Human
gaauuacauuugua

SEQ ID NO: 2739731 - RNA, 20 nt, Human
gaauuauccggucggguuuu

SEQ ID NO: 2739732 - RNA, 15 nt, Human
gaauucauucacuca

SEQ ID NO: 2739733 - RNA, 18 nt, Human
gaauucuggauuguguau

SEQ ID NO: 2739734 - RNA, 22 nt, Human
gaauugaauucccugccuggau

SEQ ID NO: 2739735 - RNA, 22 nt, Human
gacucugucucaaaaaauaaaa

SEQ ID NO: 2739736 - RNA, 14 nt, Human
gacucuuaagaaga

SEQ ID NO: 2739737 - RNA, 18 nt, Human
gacucuuaagaagacugc

SEQ ID NO: 2739738 - RNA, 14 nt, Human
gacucuugcagggg

SEQ ID NO: 2739739 - RNA, 15 nt, Human
gacucuugcaggggu

SEQ ID NO: 2739740 - RNA, 15 nt, Human
gacugaauuucuaug

SEQ ID NO: 2739741 - RNA, 20 nt, Human
gacugcacaucaaaauaugc

SEQ ID NO: 2739742 - RNA, 23 nt, Human
gacugcauuauauuuauuacugu

SEQ ID NO: 2739743 - RNA, 16 nt, Human
gacugccaagccaugg

SEQ ID NO: 2739744 - RNA, 20 nt, Human
gacuggauaguccgucucug

SEQ ID NO: 2739745 - RNA, 17 nt, Human
gacugguucaaauguug

SEQ ID NO: 2739746 - RNA, 18 nt, Human
gacuguggcugcuagcac

SEQ ID NO: 2739747 - RNA, 20 nt, Human
gacuguggcugcuagcacuu

SEQ ID NO: 2739748 - RNA, 13 nt, Human
gacugugggcucc

SEQ ID NO: 2739749 - RNA, 17 nt, Human
gacugugggcuccauuc

SEQ ID NO: 2739750 - RNA, 22 nt, Human
gacugugggcuccauucaaagu

SEQ ID NO: 2739751 - RNA, 17 nt, Human
gacuuacaugauucauu

SEQ ID NO: 2739752 - RNA, 15 nt, Human
gacuuacuauuuauu

SEQ ID NO: 2739753 - RNA, 18 nt, Human
gacuucuaaguaaaacca

SEQ ID NO: 2739754 - RNA, 17 nt, Human
gacuucuugaaaucaau

SEQ ID NO: 2739755 - RNA, 12 nt, Human
gacuugagugcu

SEQ ID NO: 2739756 - RNA, 22 nt, Human
gacuuuucuccucucagugggu

SEQ ID NO: 2739757 - RNA, 13 nt, Human
gacuuuuuccuug

SEQ ID NO: 2739758 - RNA, 20 nt, Human
gagaaaaaacuuaaguagau

SEQ ID NO: 2739759 - RNA, 16 nt, Human
gagaaaacaauaacga

SEQ ID NO: 2739760 - RNA, 16 nt, Human
gagaacacugugcucu

SEQ ID NO: 2739761 - RNA, 14 nt, Human
gagaacagggcuga

SEQ ID NO: 2739762 - RNA, 17 nt, Human
gagaaccccaggacgcc

SEQ ID NO: 2739763 - RNA, 21 nt, Human
gagaagaacugaaaucauacu

SEQ ID NO: 2739764 - RNA, 12 nt, Human
gagaagaaugac

SEQ ID NO: 2739765 - RNA, 11 nt, Human
gagaagagaau

SEQ ID NO: 2739766 - RNA, 14 nt, Human
gagaagagaauauu

SEQ ID NO: 2739767 - RNA, 13 nt, Human
gagaauauuagcu

SEQ ID NO: 2739768 - RNA, 18 nt, Human
gagaaucacuugaacccg

SEQ ID NO: 2739769 - RNA, 14 nt, Human
gagacaagaaaaua

SEQ ID NO: 2739770 - RNA, 13 nt, Human
gagacaagcagcc

SEQ ID NO: 2739771 - RNA, 12 nt, Human
gagacaccacca

SEQ ID NO: 2739772 - RNA, 13 nt, Human
gagacaccaccac

SEQ ID NO: 2739773 - RNA, 14 nt, Human
gagacacugucucu

SEQ ID NO: 2739774 - RNA, 18 nt, Human
gagacagaaagcagaaca

SEQ ID NO: 2739775 - RNA, 13 nt, Human
gagacagcucugc

SEQ ID NO: 2739776 - RNA, 16 nt, Human
gagacagggcccuguc

SEQ ID NO: 2739777 - RNA, 15 nt, Human
gagacaggguuucac

SEQ ID NO: 2739778 - RNA, 16 nt, Human
gagacaggguuucacc

SEQ ID NO: 2739779 - RNA, 19 nt, Human
gagacauugaggcaggcac

SEQ ID NO: 2739780 - RNA, 16 nt, Human
gagaccaaggcccccg

SEQ ID NO: 2739781 - RNA, 15 nt, Human
gagaccacaagcagg

SEQ ID NO: 2739782 - RNA, 18 nt, Human
gagaccacuguuaucaaa

SEQ ID NO: 2739783 - RNA, 22 nt, Human
gagaccagccaaccugggggcu

SEQ ID NO: 2739784 - RNA, 15 nt, Human
gagacggguuucacc

SEQ ID NO: 2739785 - RNA, 16 nt, Human
gagacucugucucagu

SEQ ID NO: 2739786 - RNA, 16 nt, Human
gagagaaugagagaca

SEQ ID NO: 2739787 - RNA, 13 nt, Human
gagagagcuggag

SEQ ID NO: 2739788 - RNA, 14 nt, Human
gagagaguggcugg

SEQ ID NO: 2739789 - RNA, 19 nt, Human
gagagaugacagggaaaac

SEQ ID NO: 2739790 - RNA, 13 nt, Human
gagagcacgccug

SEQ ID NO: 2739791 - RNA, 13 nt, Human
gagagcacuugaa

SEQ ID NO: 2739792 - RNA, 21 nt, Human
gagagcaguuugguuucuagc

SEQ ID NO: 2739793 - RNA, 16 nt, Human
gagaguacaccccaac

SEQ ID NO: 2739794 - RNA, 20 nt, Human
gagaguacaccccaacagca

SEQ ID NO: 2739795 - RNA, 13 nt, Human
gagauacagaauu

SEQ ID NO: 2739796 - RNA, 21 nt, Human
gagauacaguggagacaucug

SEQ ID NO: 2739797 - RNA, 17 nt, Human
gagauaucccaggaaaa

SEQ ID NO: 2739798 - RNA, 17 nt, Human
gagaugaggccgccaug

SEQ ID NO: 2739799 - RNA, 15 nt, Human
gagaugcuagaacuc

SEQ ID NO: 2739800 - RNA, 20 nt, Human
gagaugcuagaacucccuuu

SEQ ID NO: 2739801 - RNA, 11 nt, Human
gagauggagga

SEQ ID NO: 2739802 - RNA, 20 nt, Human
gagauggagucuugcucugu

SEQ ID NO: 2739803 - RNA, 16 nt, Human
gagaugggguuucacc

SEQ ID NO: 2739804 - RNA, 14 nt, Human
gagauguuuaguaa

SEQ ID NO: 2739805 - RNA, 14 nt, Human
gagauucagacugu

SEQ ID NO: 2739806 - RNA, 15 nt, Human
gagauuccugagcca

SEQ ID NO: 2739807 - RNA, 15 nt, Human
gagauugugccccug

SEQ ID NO: 2739808 - RNA, 15 nt, Human
gagauuucaugccug

SEQ ID NO: 2739809 - RNA, 21 nt, Human
gagcaagucagaauagaaauu

SEQ ID NO: 2739810 - RNA, 14 nt, Human
gagcaaguccuucc

SEQ ID NO: 2739811 - RNA, 20 nt, Human
gagcaccugcaggcgugacc

SEQ ID NO: 2739812 - RNA, 14 nt, Human
gagcaggcuacugu

SEQ ID NO: 2739813 - RNA, 16 nt, Human
gagcaguagcuggagg

SEQ ID NO: 2739814 - RNA, 22 nt, Human
gagcaguuugguuucuagcaug

SEQ ID NO: 2739815 - RNA, 16 nt, Human
gagcaucaucuucugg

SEQ ID NO: 2739816 - RNA, 19 nt, Human
gagcaucuccucaacucug

SEQ ID NO: 2739817 - RNA, 13 nt, Human
gagcaugagugcc

SEQ ID NO: 2739818 - RNA, 18 nt, Human
gagccaacagaagcuucc

SEQ ID NO: 2739819 - RNA, 14 nt, Human
gagccaaggguuca

SEQ ID NO: 2739820 - RNA, 17 nt, Human
gagccacaguuccccua

SEQ ID NO: 2739821 - RNA, 20 nt, Human
gagccaccaagcugguggcu

SEQ ID NO: 2739822 - RNA, 14 nt, Human
gagcccauggcacu

SEQ ID NO: 2739823 - RNA, 21 nt, Human
gagccccucacacagcccugg

SEQ ID NO: 2739824 - RNA, 21 nt, Human
gagccgagauugugccccugc

SEQ ID NO: 2739825 - RNA, 23 nt, Human
gagccgagauugugccccugcac

SEQ ID NO: 2739826 - RNA, 13 nt, Human
gagccggagccuc

SEQ ID NO: 2739827 - RNA, 17 nt, Human
gagccggagccuccagc

SEQ ID NO: 2739828 - RNA, 18 nt, Human
gagccggagccuccagcu

SEQ ID NO: 2739829 - RNA, 20 nt, Human
gagccggagccuccagcugc

SEQ ID NO: 2739830 - RNA, 14 nt, Human
gagccgggaaagaa

SEQ ID NO: 2739831 - RNA, 17 nt, Human
gagccgggaaagaagag

SEQ ID NO: 2739832 - RNA, 18 nt, Human
gagccgggaaagaagagc

SEQ ID NO: 2739833 - RNA, 18 nt, Human
gagccgguccuugcugca

SEQ ID NO: 2739834 - RNA, 20 nt, Human
gagccucagucucccucccu

SEQ ID NO: 2739835 - RNA, 22 nt, Human
gagccucagucucccucccuug

SEQ ID NO: 2739836 - RNA, 19 nt, Human
gagccugaucaccugcccu

SEQ ID NO: 2739837 - RNA, 15 nt, Human
gagccugccuuucuc

SEQ ID NO: 2739838 - RNA, 23 nt, Human
gagccuucccaaguugugcuuga

SEQ ID NO: 2739839 - RNA, 15 nt, Human
gagcgcgcgcgcccu

SEQ ID NO: 2739840 - RNA, 21 nt, Human
gagcuaggggggucagccagc

SEQ ID NO: 2739841 - RNA, 13 nt, Human
gagcucaccaguc

SEQ ID NO: 2739842 - RNA, 19 nt, Human
gagcucaccagucccuccc

SEQ ID NO: 2739843 - RNA, 15 nt, Human
gagcucagcccuggu

SEQ ID NO: 2739844 - RNA, 13 nt, Human
gagcucaggaggu

SEQ ID NO: 2739845 - RNA, 12 nt, Human
gagcucccagga

SEQ ID NO: 2739846 - RNA, 23 nt, Human
gagcucccaggaggggcuucugg

SEQ ID NO: 2739847 - RNA, 15 nt, Human
gagcugcccucuccu

SEQ ID NO: 2739848 - RNA, 22 nt, Human
gagcuuaacccuggaaaaugaa

SEQ ID NO: 2739849 - RNA, 18 nt, Human
gaggaauuucuguucuuc

SEQ ID NO: 2739850 - RNA, 13 nt, Human
gaggacgcucucu

SEQ ID NO: 2739851 - RNA, 16 nt, Human
gaggacgcucucuggc

SEQ ID NO: 2739852 - RNA, 21 nt, Human
gaggacgcucucuggccuucg

SEQ ID NO: 2739853 - RNA, 17 nt, Human
gaggagcuuugaaacga

SEQ ID NO: 2739854 - RNA, 13 nt, Human
gaggcaagagaau

SEQ ID NO: 2739855 - RNA, 18 nt, Human
gaggcacacuuucuggca

SEQ ID NO: 2739856 - RNA, 18 nt, Human
gaggcagaccugacucuc

SEQ ID NO: 2739857 - RNA, 21 nt, Human
gaggcagaccugacucucuua

SEQ ID NO: 2739858 - RNA, 17 nt, Human
gaggcagagguugcagu

SEQ ID NO: 2739859 - RNA, 19 nt, Human
gaggcauccaaaggcuccu

SEQ ID NO: 2739860 - RNA, 23 nt, Human
gaggcauccaaaggcuccugaga

SEQ ID NO: 2739861 - RNA, 23 nt, Human
gaggcauuuaggccaugggacag

SEQ ID NO: 2739862 - RNA, 14 nt, Human
gaggccacguucuu

SEQ ID NO: 2739863 - RNA, 18 nt, Human
gaggccacguucuuacua

SEQ ID NO: 2739864 - RNA, 19 nt, Human
gaggccuagacucugucua

SEQ ID NO: 2739865 - RNA, 15 nt, Human
gaggccuuucccuaa

SEQ ID NO: 2739866 - RNA, 23 nt, Human
gaggcggaauugcucucccagcc

SEQ ID NO: 2739867 - RNA, 22 nt, Human
gaggcggauugagaaggagcuc

SEQ ID NO: 2739868 - RNA, 15 nt, Human
gaggcggguggauca

SEQ ID NO: 2739869 - RNA, 17 nt, Human
gaggcuccacuuggucu

SEQ ID NO: 2739870 - RNA, 21 nt, Human
gaggcuccacuuggucuguga

SEQ ID NO: 2739871 - RNA, 14 nt, Human
gaggcucuaaugua

SEQ ID NO: 2739872 - RNA, 18 nt, Human
gaggcugaggcgggugga

SEQ ID NO: 2739873 - RNA, 21 nt, Human
gaggcugaggcggguggauca

SEQ ID NO: 2739874 - RNA, 19 nt, Human
gaggcuguugucuuuuccu

SEQ ID NO: 2739875 - RNA, 20 nt, Human
gaggcuguugucuuuuccuu

SEQ ID NO: 2739876 - RNA, 21 nt, Human
gagggaauaauaccuaagccu

SEQ ID NO: 2739877 - RNA, 16 nt, Human
gagggaauugcagagu

SEQ ID NO: 2739878 - RNA, 17 nt, Human
gagggauuagggagaga

SEQ ID NO: 2739879 - RNA, 18 nt, Human
gagggcaagagccacagu

SEQ ID NO: 2739880 - RNA, 22 nt, Human
gauguuuagaaacacaacuaua

SEQ ID NO: 2739881 - RNA, 15 nt, Human
gauuaaaguuaaaua

SEQ ID NO: 2739882 - RNA, 15 nt, Human
gauuaagaaaggaag

SEQ ID NO: 2739883 - RNA, 16 nt, Human
gauuaagaaaggaagu

SEQ ID NO: 2739884 - RNA, 23 nt, Human
gauuacaaggcuuuaucucaggg

SEQ ID NO: 2739885 - RNA, 13 nt, Human
gauuacaggcgug

SEQ ID NO: 2739886 - RNA, 14 nt, Human
gauuacaggcguga

SEQ ID NO: 2739887 - RNA, 23 nt, Human
gauuacaggcgugagccaccucg

SEQ ID NO: 2739888 - RNA, 20 nt, Human
gauuacaggugugagccacc

SEQ ID NO: 2739889 - RNA, 18 nt, Human
gauuacugccuauuuuaa

SEQ ID NO: 2739890 - RNA, 14 nt, Human
gauuaguacacacu

SEQ ID NO: 2739891 - RNA, 17 nt, Human
gauuaucaauuaccaca

SEQ ID NO: 2739892 - RNA, 20 nt, Human
gauuaucaauuaccacacca

SEQ ID NO: 2739893 - RNA, 18 nt, Human
gauuaugaucucagaaau

SEQ ID NO: 2739894 - RNA, 17 nt, Human
gauucaugcugauuguu

SEQ ID NO: 2739895 - RNA, 19 nt, Human
gauucccugagcaggauuu

SEQ ID NO: 2739896 - RNA, 14 nt, Human
gauuccucacuuug

SEQ ID NO: 2739897 - RNA, 15 nt, Human
gauuccugagccagu

SEQ ID NO: 2739898 - RNA, 22 nt, Human
gauucuccugccucagccuccc

SEQ ID NO: 2739899 - RNA, 16 nt, Human
gauucuuccaucugau

SEQ ID NO: 2739900 - RNA, 20 nt, Human
gauucuuccaucugauugug

SEQ ID NO: 2739901 - RNA, 12 nt, Human
gauugugggaua

SEQ ID NO: 2739902 - RNA, 16 nt, Human
gauuuaaggccaggca

SEQ ID NO: 2739903 - RNA, 14 nt, Human
gauuuaccacuugu

SEQ ID NO: 2739904 - RNA, 16 nt, Human
gauuuacgcucauugu

SEQ ID NO: 2739905 - RNA, 13 nt, Human
gauuuagcaggaa

SEQ ID NO: 2739906 - RNA, 17 nt, Human
gauuuaucuauuuaaau

SEQ ID NO: 2739907 - RNA, 21 nt, Human
gauuuaucuauuuaaauauuu

SEQ ID NO: 2739908 - RNA, 18 nt, Human
gauuucaaaaaaaaaccc

SEQ ID NO: 2739909 - RNA, 15 nt, Human
gauuuccacagugac

SEQ ID NO: 2739910 - RNA, 22 nt, Human
gauuugauguauguaauacaua

SEQ ID NO: 2739911 - RNA, 19 nt, Human
gauuugugugcaucaggcu

SEQ ID NO: 2739912 - RNA, 23 nt, Human
gauuuuaauaauauauuuuaaau

SEQ ID NO: 2739913 - RNA, 17 nt, Human
gauuuuaaucuuuuucu

SEQ ID NO: 2739914 - RNA, 18 nt, Human
gauuuuagccuucucugu

SEQ ID NO: 2739915 - RNA, 19 nt, Human
gauuuuccugaaaacccuu

SEQ ID NO: 2739916 - RNA, 21 nt, Human
gauuuuccugaaaacccuugc

SEQ ID NO: 2739917 - RNA, 18 nt, Human
gauuuugcaguucuuugg

SEQ ID NO: 2739918 - RNA, 17 nt, Human
gauuuuuaaauaaagaa

SEQ ID NO: 2739919 - RNA, 19 nt, Human
gauuuuucaugauuuugaa

SEQ ID NO: 2739920 - RNA, 22 nt, Human
gcaaaaccaaauauuccagaga

SEQ ID NO: 2739921 - RNA, 19 nt, Human
gcaaaguuuaauggugccu

SEQ ID NO: 2739922 - RNA, 16 nt, Human
gcaaauaauuuuucac

SEQ ID NO: 2739923 - RNA, 14 nt, Human
gcaaauauaaacag

SEQ ID NO: 2739924 - RNA, 15 nt, Human
gcaaauaucuugaaa

SEQ ID NO: 2739925 - RNA, 19 nt, Human
gcaaaugagccggagcccc

SEQ ID NO: 2739926 - RNA, 14 nt, Human
gcaaaugcuguauu

SEQ ID NO: 2739927 - RNA, 21 nt, Human
gcaaauugucacaggacagcc

SEQ ID NO: 2739928 - RNA, 16 nt, Human
gcaaauuuucuuccau

SEQ ID NO: 2739929 - RNA, 15 nt, Human
gcaaccccaucaucc

SEQ ID NO: 2739930 - RNA, 13 nt, Human
gcaaccuccaccu

SEQ ID NO: 2739931 - RNA, 14 nt, Human
gcaaccuccaccuc

SEQ ID NO: 2739932 - RNA, 22 nt, Human
gcaaccuccaccuucuggguuc

SEQ ID NO: 2739933 - RNA, 15 nt, Human
gcaaccucugccucc

SEQ ID NO: 2739934 - RNA, 16 nt, Human
gcaaccucugccuccc

SEQ ID NO: 2739935 - RNA, 22 nt, Human
gcaacugaggcagacagcagcu

SEQ ID NO: 2739936 - RNA, 18 nt, Human
gcaacuuuguauaaaagg

SEQ ID NO: 2739937 - RNA, 23 nt, Human
gcaagaccccaucucaaaaaaaa

SEQ ID NO: 2739938 - RNA, 17 nt, Human
gcaagcagaagagaaaa

SEQ ID NO: 2739939 - RNA, 15 nt, Human
gcaagcucuaucacc

SEQ ID NO: 2739940 - RNA, 21 nt, Human
gcaagcucuaucaccaaggag

SEQ ID NO: 2739941 - RNA, 18 nt, Human
gcaauaaaauggguuuua

SEQ ID NO: 2739942 - RNA, 12 nt, Human
gcaauaauagua

SEQ ID NO: 2739943 - RNA, 16 nt, Human
gcaauaauaguaguag

SEQ ID NO: 2739944 - RNA, 15 nt, Human
gcaaucauggugcuc

SEQ ID NO: 2739945 - RNA, 15 nt, Human
gcaauccaagcagga

SEQ ID NO: 2739946 - RNA, 16 nt, Human
gcaauccaagcaggaa

SEQ ID NO: 2739947 - RNA, 18 nt, Human
gcaauccucccacuucag

SEQ ID NO: 2739948 - RNA, 23 nt, Human
gcaauccucccacuucagccucc

SEQ ID NO: 2739949 - RNA, 23 nt, Human
gcaaugccugcccauuggagaga

SEQ ID NO: 2739950 - RNA, 16 nt, Human
gcaaugcuucaucccu

SEQ ID NO: 2739951 - RNA, 19 nt, Human
gcaaugugacuuaaugcca

SEQ ID NO: 2739952 - RNA, 22 nt, Human
gcacacaccaccacgccuggcu

SEQ ID NO: 2739953 - RNA, 16 nt, Human
gcacacccuccagaga

SEQ ID NO: 2739954 - RNA, 15 nt, Human
gcacacugucugccc

SEQ ID NO: 2739955 - RNA, 19 nt, Human
gcacacugucugcccccgu

SEQ ID NO: 2739956 - RNA, 21 nt, Human
gcacacugucugcccccguuc

SEQ ID NO: 2739957 - RNA, 22 nt, Human
gcacagcauggagucacagcca

SEQ ID NO: 2739958 - RNA, 15 nt, Human
gcacagccucuuaga

SEQ ID NO: 2739959 - RNA, 22 nt, Human
gcacagccucuuagaugcaguu

SEQ ID NO: 2739960 - RNA, 23 nt, Human
gcacagccucuuagaugcaguuc

SEQ ID NO: 2739961 - RNA, 15 nt, Human
gcacagguccccaga

SEQ ID NO: 2739962 - RNA, 17 nt, Human
gcacagguccccagaug

SEQ ID NO: 2739963 - RNA, 19 nt, Human
gcacagugaucaaguuauu

SEQ ID NO: 2739964 - RNA, 22 nt, Human
gcacaguuuucugagaaagacu

SEQ ID NO: 2739965 - RNA, 17 nt, Human
gcaccaggacuagggcu

SEQ ID NO: 2739966 - RNA, 16 nt, Human
gcaccaugcugcuggg

SEQ ID NO: 2739967 - RNA, 19 nt, Human
gcaccaugucaaggguuca

SEQ ID NO: 2739968 - RNA, 20 nt, Human
gcacccccagaaugaccugg

SEQ ID NO: 2739969 - RNA, 13 nt, Human
gcacccucuccag

SEQ ID NO: 2739970 - RNA, 19 nt, Human
gcaccuccuaagaaggcac

SEQ ID NO: 2739971 - RNA, 20 nt, Human
gcaccucucuggguugaagg

SEQ ID NO: 2739972 - RNA, 14 nt, Human
gcaccugcaggcgu

SEQ ID NO: 2739973 - RNA, 15 nt, Human
gcaccugcaggcgug

SEQ ID NO: 2739974 - RNA, 16 nt, Human
gcaccugcaggcguga

SEQ ID NO: 2739975 - RNA, 18 nt, Human
gcaccugucccagaaaaa

SEQ ID NO: 2739976 - RNA, 20 nt, Human
gcaccuuuagaauauuaaaa

SEQ ID NO: 2739977 - RNA, 19 nt, Human
gcacgcauggaaaaguuuc

SEQ ID NO: 2739978 - RNA, 19 nt, Human
gcacguccuugggcgucuc

SEQ ID NO: 2739979 - RNA, 16 nt, Human
gcacgugguaaaacac

SEQ ID NO: 2739980 - RNA, 12 nt, Human
gcacuaaacaaa

SEQ ID NO: 2739981 - RNA, 18 nt, Human
gcacuaaagcaguggaca

SEQ ID NO: 2739982 - RNA, 15 nt, Human
gcacuacuguacucc

SEQ ID NO: 2739983 - RNA, 20 nt, Human
gcacuagaggaacccuacac

SEQ ID NO: 2739984 - RNA, 18 nt, Human
gcacuaguauuucuauga

SEQ ID NO: 2739985 - RNA, 12 nt, Human
gcacuccagccu

SEQ ID NO: 2739986 - RNA, 14 nt, Human
gcacuggccaccca

SEQ ID NO: 2739987 - RNA, 15 nt, Human
gcacuggccacccaa

SEQ ID NO: 2739988 - RNA, 14 nt, Human
gcacuguaaaaugu

SEQ ID NO: 2739989 - RNA, 21 nt, Human
gcacuguggguagacacacau

SEQ ID NO: 2739990 - RNA, 17 nt, Human
gcacuugaaaaugaaau

SEQ ID NO: 2739991 - RNA, 14 nt, Human
gcacuuggcugcau

SEQ ID NO: 2739992 - RNA, 15 nt, Human
gcacuuggcugcaua

SEQ ID NO: 2739993 - RNA, 20 nt, Human
gcacuugggacaaaaacaaa

SEQ ID NO: 2739994 - RNA, 19 nt, Human
gcacuuuaacacagugucu

SEQ ID NO: 2739995 - RNA, 17 nt, Human
gcacuuuagaauaugcc

SEQ ID NO: 2739996 - RNA, 12 nt, Human
gcagaacagccg

SEQ ID NO: 2739997 - RNA, 20 nt, Human
gcagacacaugugcuggcca

SEQ ID NO: 2739998 - RNA, 21 nt, Human
gcagacacaugugcuggccac

SEQ ID NO: 2739999 - RNA, 20 nt, Human
gcagacaguguuuucuggga

SEQ ID NO: 2740000 - RNA, 22 nt, Human
gcagaccugacucucuuaagga

SEQ ID NO: 2740001 - RNA, 21 nt, Human
gcagacucacugugggaagga

SEQ ID NO: 2740002 - RNA, 23 nt, Human
gcagacucuggucaagaagcauc

SEQ ID NO: 2740003 - RNA, 15 nt, Human
gcagagacgggguuu

SEQ ID NO: 2740004 - RNA, 22 nt, Human
gcagagacgggguuugccaugc

SEQ ID NO: 2740005 - RNA, 20 nt, Human
gcagagaugaggccgccaug

SEQ ID NO: 2740006 - RNA, 23 nt, Human
gcagaguucuauaauguaaacaa

SEQ ID NO: 2740007 - RNA, 14 nt, Human
gcagauaaacagua

SEQ ID NO: 2740008 - RNA, 17 nt, Human
gcagauacagggaugag

SEQ ID NO: 2740009 - RNA, 21 nt, Human
gcagaucuacaugucuagaga

SEQ ID NO: 2740010 - RNA, 15 nt, Human
gcagcaucagcaucc

SEQ ID NO: 2740011 - RNA, 16 nt, Human
gcagcaucagcauccc

SEQ ID NO: 2740012 - RNA, 17 nt, Human
gcagcaucagcaucccu

SEQ ID NO: 2740013 - RNA, 14 nt, Human
gcagcaucccuagu

SEQ ID NO: 2740014 - RNA, 21 nt, Human
gcagcauuguuggcuguuccu

SEQ ID NO: 2740015 - RNA, 13 nt, Human
gcagccaaccuaa

SEQ ID NO: 2740016 - RNA, 19 nt, Human
gcagccuaacacggugcuc

SEQ ID NO: 2740017 - RNA, 20 nt, Human
gcagccugcagacucacugu

SEQ ID NO: 2740018 - RNA, 12 nt, Human
gcagccuggcca

SEQ ID NO: 2740019 - RNA, 18 nt, Human
gcagcucaagggcuggca

SEQ ID NO: 2740020 - RNA, 14 nt, Human
gcagcucaggcaca

SEQ ID NO: 2740021 - RNA, 15 nt, Human
gcagcucaggcuggc

SEQ ID NO: 2740022 - RNA, 16 nt, Human
gcagcucaggcuggca

SEQ ID NO: 2740023 - RNA, 23 nt, Human
gcagcucuaaaugucaaucagcc

SEQ ID NO: 2740024 - RNA, 14 nt, Human
gccaucuuggacuu

SEQ ID NO: 2740025 - RNA, 13 nt, Human
gccaugaaucacc

SEQ ID NO: 2740026 - RNA, 11 nt, Human
gccaugaggaa

SEQ ID NO: 2740027 - RNA, 11 nt, Human
gccaugggaca

SEQ ID NO: 2740028 - RNA, 14 nt, Human
gccaugggacaggg

SEQ ID NO: 2740029 - RNA, 17 nt, Human
gccaugggacagggagg

SEQ ID NO: 2740030 - RNA, 23 nt, Human
gccaugggacagggaggacgcuc

SEQ ID NO: 2740031 - RNA, 21 nt, Human
gccauggguagccugggugua

SEQ ID NO: 2740032 - RNA, 13 nt, Human
gccaugugcagcc

SEQ ID NO: 2740033 - RNA, 14 nt, Human
gccaugugcagcca

SEQ ID NO: 2740034 - RNA, 17 nt, Human
gccaugugcagccacca

SEQ ID NO: 2740035 - RNA, 12 nt, Human
gccauucucaag

SEQ ID NO: 2740036 - RNA, 15 nt, Human
gccauucucaagccc

SEQ ID NO: 2740037 - RNA, 21 nt, Human
gcccaagaaugagaagaauga

SEQ ID NO: 2740038 - RNA, 14 nt, Human
gcccaagggugggu

SEQ ID NO: 2740039 - RNA, 17 nt, Human
gcccacaaugcuuugcc

SEQ ID NO: 2740040 - RNA, 19 nt, Human
gcccacggcuggagcugcc

SEQ ID NO: 2740041 - RNA, 22 nt, Human
gcccacuagacccacuggacuc

SEQ ID NO: 2740042 - RNA, 19 nt, Human
gcccacuuccucccggccg

SEQ ID NO: 2740043 - RNA, 20 nt, Human
gcccacuuccucccggccgc

SEQ ID NO: 2740044 - RNA, 21 nt, Human
gcccacuuccucccggccgcg

SEQ ID NO: 2740045 - RNA, 23 nt, Human
gcccacuuccucccggccgcgcu

SEQ ID NO: 2740046 - RNA, 17 nt, Human
gcccagcggcaucaggc

SEQ ID NO: 2740047 - RNA, 20 nt, Human
gcccagcuugaaaccuucac

SEQ ID NO: 2740048 - RNA, 16 nt, Human
gcccaggauacuggca

SEQ ID NO: 2740049 - RNA, 14 nt, Human
gcccagggcucagc

SEQ ID NO: 2740050 - RNA, 16 nt, Human
gcccauaccccuggcc

SEQ ID NO: 2740051 - RNA, 22 nt, Human
gcccaucccaaaaucauaagau

SEQ ID NO: 2740052 - RNA, 21 nt, Human
gcccauccugccccugagccc

SEQ ID NO: 2740053 - RNA, 20 nt, Human
gcccaucuccgucucccaaa

SEQ ID NO: 2740054 - RNA, 22 nt, Human
gcccaucuccgucucccaaagu

SEQ ID NO: 2740055 - RNA, 20 nt, Human
gcccaugcuggagugcagug

SEQ ID NO: 2740056 - RNA, 17 nt, Human
gccccagauaccaugau

SEQ ID NO: 2740057 - RNA, 12 nt, Human
gccccaucagcu

SEQ ID NO: 2740058 - RNA, 20 nt, Human
gccccaucagcuccagcugc

SEQ ID NO: 2740059 - RNA, 14 nt, Human
gcccccaacagcac

SEQ ID NO: 2740060 - RNA, 17 nt, Human
gcccccaacagcacccu

SEQ ID NO: 2740061 - RNA, 20 nt, Human
gcccccaaccauuuccucag

SEQ ID NO: 2740062 - RNA, 21 nt, Human
gcccccacuugccauaaaacu

SEQ ID NO: 2740063 - RNA, 16 nt, Human
gcccccagagccacag

SEQ ID NO: 2740064 - RNA, 15 nt, Human
gccccccagcccucc

SEQ ID NO: 2740065 - RNA, 19 nt, Human
gccccccagcccuccuuau

SEQ ID NO: 2740066 - RNA, 16 nt, Human
gccccccuugccagac

SEQ ID NO: 2740067 - RNA, 16 nt, Human
gcccccgggccgacgg

SEQ ID NO: 2740068 - RNA, 20 nt, Human
gcccccgggccgacggagcc

SEQ ID NO: 2740069 - RNA, 15 nt, Human
gcccccuaagccccc

SEQ ID NO: 2740070 - RNA, 18 nt, Human
gccccgggaguggcgcgc

SEQ ID NO: 2740071 - RNA, 18 nt, Human
gccccgucccccucuggc

SEQ ID NO: 2740072 - RNA, 18 nt, Human
gccccugcacuccagccu

SEQ ID NO: 2740073 - RNA, 13 nt, Human
gccccugccucuc

SEQ ID NO: 2740074 - RNA, 16 nt, Human
gccccugccucucugc

SEQ ID NO: 2740075 - RNA, 20 nt, Human
gccccugccuucccaggagu

SEQ ID NO: 2740076 - RNA, 19 nt, Human
gccccuguacuccagccug

SEQ ID NO: 2740077 - RNA, 20 nt, Human
gccccuguacuccagccugg

SEQ ID NO: 2740078 - RNA, 20 nt, Human
gccccuuugcugacccuccc

SEQ ID NO: 2740079 - RNA, 15 nt, Human
gcccgcaugcggccc

SEQ ID NO: 2740080 - RNA, 17 nt, Human
gcccgucuucagccuag

SEQ ID NO: 2740081 - RNA, 17 nt, Human
gcccucccccuccucuc

SEQ ID NO: 2740082 - RNA, 19 nt, Human
gcccucccccuccucucca

SEQ ID NO: 2740083 - RNA, 16 nt, Human
gcccuccucucccagu

SEQ ID NO: 2740084 - RNA, 16 nt, Human
gcccucuccugggcag

SEQ ID NO: 2740085 - RNA, 17 nt, Human
gcccucuccugggcagc

SEQ ID NO: 2740086 - RNA, 16 nt, Human
gcccucuugaaucucu

SEQ ID NO: 2740087 - RNA, 18 nt, Human
gcccucuugaaucucuga

SEQ ID NO: 2740088 - RNA, 17 nt, Human
gcccugcaccaugcugc

SEQ ID NO: 2740089 - RNA, 18 nt, Human
gcccugcagucacagcua

SEQ ID NO: 2740090 - RNA, 20 nt, Human
gcccugcucuuccucagcug

SEQ ID NO: 2740091 - RNA, 17 nt, Human
gcccugcugcccucccc

SEQ ID NO: 2740092 - RNA, 20 nt, Human
gcccugcugcccucccccuc

SEQ ID NO: 2740093 - RNA, 13 nt, Human
gcccuggacugug

SEQ ID NO: 2740094 - RNA, 20 nt, Human
gcccugggaggcucuggagc

SEQ ID NO: 2740095 - RNA, 23 nt, Human
gcccuggugccucaccccuugcc

SEQ ID NO: 2740096 - RNA, 18 nt, Human
gcccuggugggcagagag

SEQ ID NO: 2740097 - RNA, 15 nt, Human
gcccugugcggccug

SEQ ID NO: 2740098 - RNA, 19 nt, Human
gcccuuccccucugcagcu

SEQ ID NO: 2740099 - RNA, 22 nt, Human
gcccuuccccucugcagcuucc

SEQ ID NO: 2740100 - RNA, 19 nt, Human
gcccuuucucagggcagau

SEQ ID NO: 2740101 - RNA, 16 nt, Human
gccgacggagccggga

SEQ ID NO: 2740102 - RNA, 19 nt, Human
gccgagauugugccccugc

SEQ ID NO: 2740103 - RNA, 14 nt, Human
gccgcgcuccucgg

SEQ ID NO: 2740104 - RNA, 17 nt, Human
gccgcgcugcgcgccgc

SEQ ID NO: 2740105 - RNA, 14 nt, Human
gccgcuccugucug

SEQ ID NO: 2740106 - RNA, 21 nt, Human
gccgcuccugucugccagcca

SEQ ID NO: 2740107 - RNA, 15 nt, Human
gccgcucucucugag

SEQ ID NO: 2740108 - RNA, 16 nt, Human
gccgcugucucugagg

SEQ ID NO: 2740109 - RNA, 21 nt, Human
gccgcugucucugaggggugg

SEQ ID NO: 2740110 - RNA, 13 nt, Human
gccgcuuucucug

SEQ ID NO: 2740111 - RNA, 16 nt, Human
gccgcuuucucugagg

SEQ ID NO: 2740112 - RNA, 13 nt, Human
gccggagccccuu

SEQ ID NO: 2740113 - RNA, 17 nt, Human
gccggagccuccagcug

SEQ ID NO: 2740114 - RNA, 16 nt, Human
gccgggaaagaagagc

SEQ ID NO: 2740115 - RNA, 17 nt, Human
gccgggaaagaagagcc

SEQ ID NO: 2740116 - RNA, 23 nt, Human
gccgggaaagaagagccggagcc

SEQ ID NO: 2740117 - RNA, 14 nt, Human
gccgggcgcggugg

SEQ ID NO: 2740118 - RNA, 20 nt, Human
gccgggcgugguggugagug

SEQ ID NO: 2740119 - RNA, 14 nt, Human
gccgugggccugag

SEQ ID NO: 2740120 - RNA, 17 nt, Human
gccuaacacggugcuca

SEQ ID NO: 2740121 - RNA, 15 nt, Human
gccuaagugcagccc

SEQ ID NO: 2740122 - RNA, 15 nt, Human
gccuaauuuguuuuc

SEQ ID NO: 2740123 - RNA, 18 nt, Human
gccuagcccacuggcucc

SEQ ID NO: 2740124 - RNA, 19 nt, Human
gccuagcccacuggcuccc

SEQ ID NO: 2740125 - RNA, 17 nt, Human
gccuagccgaccucagc

SEQ ID NO: 2740126 - RNA, 19 nt, Human
gccuagccgaccucagccu

SEQ ID NO: 2740127 - RNA, 18 nt, Human
gccuaucagcauuuuacu

SEQ ID NO: 2740128 - RNA, 20 nt, Human
gccuauuuuaauaaacacuc

SEQ ID NO: 2740129 - RNA, 16 nt, Human
gccucaaaugcaccau

SEQ ID NO: 2740130 - RNA, 21 nt, Human
gccucaagcuaugugagcuca

SEQ ID NO: 2740131 - RNA, 12 nt, Human
gccucacacaca

SEQ ID NO: 2740132 - RNA, 16 nt, Human
gccucacacacaaugu

SEQ ID NO: 2740133 - RNA, 15 nt, Human
gccucagccucccaa

SEQ ID NO: 2740134 - RNA, 22 nt, Human
gccucagccucccaaagugcug

SEQ ID NO: 2740135 - RNA, 24 nt, Human
gccucagccucccgaguagcuggg

SEQ ID NO: 2740136 - RNA, 20 nt, Human
gccucagggugcacacagga

SEQ ID NO: 2740137 - RNA, 21 nt, Human
gccucagggugcacacaggau

SEQ ID NO: 2740138 - RNA, 14 nt, Human
gccucagucucccu

SEQ ID NO: 2740139 - RNA, 16 nt, Human
gccucagucucccucc

SEQ ID NO: 2740140 - RNA, 15 nt, Human
gccucauguccacug

SEQ ID NO: 2740141 - RNA, 14 nt, Human
gccuccagagacug

SEQ ID NO: 2740142 - RNA, 13 nt, Human
gccuccagagagu

SEQ ID NO: 2740143 - RNA, 11 nt, Human
gccuccagcug

SEQ ID NO: 2740144 - RNA, 13 nt, Human
gccuccagcugcc

SEQ ID NO: 2740145 - RNA, 13 nt, Human
gccuccauccuga

SEQ ID NO: 2740146 - RNA, 14 nt, Human
gccuccauccugag

SEQ ID NO: 2740147 - RNA, 15 nt, Human
gccuccauccugagg

SEQ ID NO: 2740148 - RNA, 17 nt, Human
gccucccaaagugcugg

SEQ ID NO: 2740149 - RNA, 19 nt, Human
gccucccaaguagcugaga

SEQ ID NO: 2740150 - RNA, 21 nt, Human
gccucccagguucaagugcuu

SEQ ID NO: 2740151 - RNA, 13 nt, Human
gccuccccagcuc

SEQ ID NO: 2740152 - RNA, 13 nt, Human
gccuccccuccuc

SEQ ID NO: 2740153 - RNA, 14 nt, Human
gccuccccuccucu

SEQ ID NO: 2740154 - RNA, 18 nt, Human
gccuccccugccucacca

SEQ ID NO: 2740155 - RNA, 23 nt, Human
gccuccccugccucaccagcccu

SEQ ID NO: 2740156 - RNA, 19 nt, Human
gccucccgaguagcuggga

SEQ ID NO: 2740157 - RNA, 17 nt, Human
gccucgaccucucucaa

SEQ ID NO: 2740158 - RNA, 21 nt, Human
gccucgaggagguaaugaauu

SEQ ID NO: 2740159 - RNA, 15 nt, Human
gccucguuccagugg

SEQ ID NO: 2740160 - RNA, 22 nt, Human
gccucuaaaaggccugucccug

SEQ ID NO: 2740161 - RNA, 16 nt, Human
gccucucucauccacu

SEQ ID NO: 2740162 - RNA, 13 nt, Human
gccucuguauuua

SEQ ID NO: 2740163 - RNA, 19 nt, Human
gccucuguuccuuucucug

SEQ ID NO: 2740164 - RNA, 15 nt, Human
gccucuuagaugcag

SEQ ID NO: 2740165 - RNA, 18 nt, Human
gccugacgaacuccuuga

SEQ ID NO: 2740166 - RNA, 18 nt, Human
gccugacugccaagccau

SEQ ID NO: 2740167 - RNA, 22 nt, Human
gccugacugccaagccaugggu

SEQ ID NO: 2740168 - RNA, 17 nt, Human
gccugagcgacagugag

SEQ ID NO: 2740169 - RNA, 14 nt, Human
gcucauuuuuucuu

SEQ ID NO: 2740170 - RNA, 18 nt, Human
gcuccacuuggucuguga

SEQ ID NO: 2740171 - RNA, 13 nt, Human
gcuccagcugcuc

SEQ ID NO: 2740172 - RNA, 11 nt, Human
gcuccagcugg

SEQ ID NO: 2740173 - RNA, 19 nt, Human
gcuccagguagagggugug

SEQ ID NO: 2740174 - RNA, 19 nt, Human
gcuccagugauaagagaug

SEQ ID NO: 2740175 - RNA, 21 nt, Human
gcuccauucaaagugagcucc

SEQ ID NO: 2740176 - RNA, 18 nt, Human
gcuccauuuuuagugaaa

SEQ ID NO: 2740177 - RNA, 20 nt, Human
gcuccccuccucggcuuccu

SEQ ID NO: 2740178 - RNA, 22 nt, Human
gcuccccucggagaagagcugu

SEQ ID NO: 2740179 - RNA, 13 nt, Human
gcucccuagccag

SEQ ID NO: 2740180 - RNA, 17 nt, Human
gcucccuagccagaggc

SEQ ID NO: 2740181 - RNA, 18 nt, Human
gcuccgcgcagcucaggc

SEQ ID NO: 2740182 - RNA, 19 nt, Human
gcuccgcgcagcucaggcu

SEQ ID NO: 2740183 - RNA, 21 nt, Human
gcuccgcgcagcucaggcugg

SEQ ID NO: 2740184 - RNA, 16 nt, Human
gcuccggacgcugcug

SEQ ID NO: 2740185 - RNA, 19 nt, Human
gcuccggacgcugcugccg

SEQ ID NO: 2740186 - RNA, 24 nt, Human
gcuccggacgcugcugccgugggc

SEQ ID NO: 2740187 - RNA, 20 nt, Human
gcuccuaauguugaauuuug

SEQ ID NO: 2740188 - RNA, 10 nt, Human
gcuccuccuu

SEQ ID NO: 2740189 - RNA, 20 nt, Human
gcuccuccuuuuuccuucca

SEQ ID NO: 2740190 - RNA, 21 nt, Human
gcuccuccuuuuuccuuccag

SEQ ID NO: 2740191 - RNA, 17 nt, Human
gcuccucggacggcucc

SEQ ID NO: 2740192 - RNA, 21 nt, Human
gcuccugucugccagccagca

SEQ ID NO: 2740193 - RNA, 24 nt, Human
gcuccugucugccagccagcagcc

SEQ ID NO: 2740194 - RNA, 20 nt, Human
gcucgcccacuuccucccgg

SEQ ID NO: 2740195 - RNA, 14 nt, Human
gcucgcuuccgcau

SEQ ID NO: 2740196 - RNA, 14 nt, Human
gcucggccugcucg

SEQ ID NO: 2740197 - RNA, 18 nt, Human
gcucggccugcucgccca

SEQ ID NO: 2740198 - RNA, 21 nt, Human
gcucggccugcucgcccacuu

SEQ ID NO: 2740199 - RNA, 22 nt, Human
gcucuaauguacaauaaagcaa

SEQ ID NO: 2740200 - RNA, 22 nt, Human
gcucuaucccaaccucucccaa

SEQ ID NO: 2740201 - RNA, 14 nt, Human
gcucuccaaaggcu

SEQ ID NO: 2740202 - RNA, 16 nt, Human
gcucucccagccaggu

SEQ ID NO: 2740203 - RNA, 13 nt, Human
gcucuccccuucu

SEQ ID NO: 2740204 - RNA, 18 nt, Human
gcucucuccgaggggugg

SEQ ID NO: 2740205 - RNA, 12 nt, Human
gcucucucugag

SEQ ID NO: 2740206 - RNA, 16 nt, Human
gcucucucugaggggg

SEQ ID NO: 2740207 - RNA, 13 nt, Human
gcucucuggccuu

SEQ ID NO: 2740208 - RNA, 16 nt, Human
gcucucuggccuucgg

SEQ ID NO: 2740209 - RNA, 15 nt, Human
gcucucuugugcauu

SEQ ID NO: 2740210 - RNA, 19 nt, Human
gcucugaagaacucucugg

SEQ ID NO: 2740211 - RNA, 21 nt, Human
gcucugaagaacucucuggaa

SEQ ID NO: 2740212 - RNA, 16 nt, Human
gcucugcccauccugc

SEQ ID NO: 2740213 - RNA, 22 nt, Human
gcucuggacuugccuccagaga

SEQ ID NO: 2740214 - RNA, 14 nt, Human
gcucugggucgccg

SEQ ID NO: 2740215 - RNA, 16 nt, Human
gcucugggucgccggc

SEQ ID NO: 2740216 - RNA, 16 nt, Human
gcucugugugcucuga

SEQ ID NO: 2740217 - RNA, 22 nt, Human
gcucuucauguuucaggagaga

SEQ ID NO: 2740218 - RNA, 20 nt, Human
gcugacacagacauccucua

SEQ ID NO: 2740219 - RNA, 20 nt, Human
gcugacaugaagcuguugug

SEQ ID NO: 2740220 - RNA, 12 nt, Human
gcugaggcagga

SEQ ID NO: 2740221 - RNA, 12 nt, Human
gcugaggcgggu

SEQ ID NO: 2740222 - RNA, 15 nt, Human
gcugaggcgggugga

SEQ ID NO: 2740223 - RNA, 17 nt, Human
gcugagggcauagaagu

SEQ ID NO: 2740224 - RNA, 21 nt, Human
gcugagggcauagaaguaaaa

SEQ ID NO: 2740225 - RNA, 21 nt, Human
gcugagucccaggcugagccu

SEQ ID NO: 2740226 - RNA, 12 nt, Human
gcugauaaacug

SEQ ID NO: 2740227 - RNA, 13 nt, Human
gcugaugaacucu

SEQ ID NO: 2740228 - RNA, 12 nt, Human
gcugaugcaguu

SEQ ID NO: 2740229 - RNA, 14 nt, Human
gcugauuaaaccaa

SEQ ID NO: 2740230 - RNA, 14 nt, Human
gcugcaaaauguua

SEQ ID NO: 2740231 - RNA, 19 nt, Human
gcugcaccugugccguccc

SEQ ID NO: 2740232 - RNA, 19 nt, Human
gcugcccccagagccacag

SEQ ID NO: 2740233 - RNA, 13 nt, Human
gcugccccgggga

SEQ ID NO: 2740234 - RNA, 14 nt, Human
gcugccccggggag

SEQ ID NO: 2740235 - RNA, 19 nt, Human
gcugccccggggaggggcg

SEQ ID NO: 2740236 - RNA, 15 nt, Human
gcugcccgucuucag

SEQ ID NO: 2740237 - RNA, 13 nt, Human
gcugcccuccccc

SEQ ID NO: 2740238 - RNA, 14 nt, Human
gcugcccucccccu

SEQ ID NO: 2740239 - RNA, 15 nt, Human
gcugcccucccccuc

SEQ ID NO: 2740240 - RNA, 15 nt, Human
gcugcccucuccugg

SEQ ID NO: 2740241 - RNA, 14 nt, Human
gcugcccuuccccu

SEQ ID NO: 2740242 - RNA, 11 nt, Human
gcugccggcac

SEQ ID NO: 2740243 - RNA, 23 nt, Human
gcugccuccccagcucuauccca

SEQ ID NO: 2740244 - RNA, 13 nt, Human
gcugccuccccuc

SEQ ID NO: 2740245 - RNA, 14 nt, Human
gcugccuccccucc

SEQ ID NO: 2740246 - RNA, 17 nt, Human
gcugccucucucaucca

SEQ ID NO: 2740247 - RNA, 18 nt, Human
gcugccuggaagagcagc

SEQ ID NO: 2740248 - RNA, 14 nt, Human
gcugcgcagcaucc

SEQ ID NO: 2740249 - RNA, 12 nt, Human
gcugcgcgccgc

SEQ ID NO: 2740250 - RNA, 14 nt, Human
gcugcgcgccgcgc

SEQ ID NO: 2740251 - RNA, 16 nt, Human
gcugcgcgccgcgcuc

SEQ ID NO: 2740252 - RNA, 15 nt, Human
gcugcgcucggccug

SEQ ID NO: 2740253 - RNA, 17 nt, Human
gcugcgcucggccugcu

SEQ ID NO: 2740254 - RNA, 20 nt, Human
gcugcucucuccgaggggug

SEQ ID NO: 2740255 - RNA, 12 nt, Human
gcugcucugucu

SEQ ID NO: 2740256 - RNA, 18 nt, Human
gcugcugagugcaccacu

SEQ ID NO: 2740257 - RNA, 18 nt, Human
gcugcuggggaagacagu

SEQ ID NO: 2740258 - RNA, 21 nt, Human
gcuggaauugaauucccugcc

SEQ ID NO: 2740259 - RNA, 23 nt, Human
gcuggagcucugcccauccugcc

SEQ ID NO: 2740260 - RNA, 23 nt, Human
gcuggagugcaguggcaucaucu

SEQ ID NO: 2740261 - RNA, 19 nt, Human
gcuggagugcaguggcgca

SEQ ID NO: 2740262 - RNA, 19 nt, Human
gcuggauguggagggggcg

SEQ ID NO: 2740263 - RNA, 22 nt, Human
gcuggcaccgcuguacgcgagc

SEQ ID NO: 2740264 - RNA, 21 nt, Human
gcuggccaccugcugagcccc

SEQ ID NO: 2740265 - RNA, 15 nt, Human
gcuggccgggagccu

SEQ ID NO: 2740266 - RNA, 19 nt, Human
gcuggccuugugaggagcu

SEQ ID NO: 2740267 - RNA, 20 nt, Human
gcuggcggccucguuccagu

SEQ ID NO: 2740268 - RNA, 14 nt, Human
gcugggaauuacag

SEQ ID NO: 2740269 - RNA, 13 nt, Human
gcugggaguggca

SEQ ID NO: 2740270 - RNA, 14 nt, Human
gcugggaguggcau

SEQ ID NO: 2740271 - RNA, 18 nt, Human
gcugggccccugccucuc

SEQ ID NO: 2740272 - RNA, 20 nt, Human
gcuggggcauggaaggcaag

SEQ ID NO: 2740273 - RNA, 16 nt, Human
gcuggggccaggcugg

SEQ ID NO: 2740274 - RNA, 17 nt, Human
gcuggggccaggcuggg

SEQ ID NO: 2740275 - RNA, 18 nt, Human
gcugggucgcccuggacu

SEQ ID NO: 2740276 - RNA, 15 nt, Human
gcugguggcgcuggc

SEQ ID NO: 2740277 - RNA, 19 nt, Human
gcugguggcgcuggcugcg

SEQ ID NO: 2740278 - RNA, 13 nt, Human
gcugguuuuucag

SEQ ID NO: 2740279 - RNA, 13 nt, Human
gcuguacgcgagc

SEQ ID NO: 2740280 - RNA, 14 nt, Human
gcuguacgcgagcg

SEQ ID NO: 2740281 - RNA, 14 nt, Human
gcuguagaagaugg

SEQ ID NO: 2740282 - RNA, 20 nt, Human
gcuguaucuuguuuuuccac

SEQ ID NO: 2740283 - RNA, 15 nt, Human
gcuguauuuuaaaag

SEQ ID NO: 2740284 - RNA, 17 nt, Human
gcuguauuuuaaaagaa

SEQ ID NO: 2740285 - RNA, 14 nt, Human
gcugucccaaacau

SEQ ID NO: 2740286 - RNA, 14 nt, Human
gcugucccaagggc

SEQ ID NO: 2740287 - RNA, 23 nt, Human
gcugucuauguggcuguaucuug

SEQ ID NO: 2740288 - RNA, 24 nt, Human
gcugucuauucuagucuauuuguu

SEQ ID NO: 2740289 - RNA, 14 nt, Human
gcuguggccagcuu

SEQ ID NO: 2740290 - RNA, 13 nt, Human
gcuguguacaaug

SEQ ID NO: 2740291 - RNA, 14 nt, Human
gcuguuaaucuuuc

SEQ ID NO: 2740292 - RNA, 15 nt, Human
gcuguuaaucuuuca

SEQ ID NO: 2740293 - RNA, 16 nt, Human
gcuguuaaucuuucaa

SEQ ID NO: 2740294 - RNA, 14 nt, Human
gcuguuauaaucuu

SEQ ID NO: 2740295 - RNA, 22 nt, Human
gcuguucccaccaggcugcuca

SEQ ID NO: 2740296 - RNA, 15 nt, Human
gcuguucuuuaaaug

SEQ ID NO: 2740297 - RNA, 12 nt, Human
gcuguugagcug

SEQ ID NO: 2740298 - RNA, 13 nt, Human
gcuguugagcugu

SEQ ID NO: 2740299 - RNA, 21 nt, Human
gcuuaacccuggaaaaugaau

SEQ ID NO: 2740300 - RNA, 21 nt, Human
gcuuacacccacaguggaaag

SEQ ID NO: 2740301 - RNA, 15 nt, Human
gcuuagacccucaug

SEQ ID NO: 2740302 - RNA, 21 nt, Human
gcuuagacccucaugcugcca

SEQ ID NO: 2740303 - RNA, 22 nt, Human
gcuuagacccucaugcugccaa

SEQ ID NO: 2740304 - RNA, 12 nt, Human
gcuuagaccuca

SEQ ID NO: 2740305 - RNA, 13 nt, Human
gcuuagaccucag

SEQ ID NO: 2740306 - RNA, 18 nt, Human
gcuuauugucuagugaaa

SEQ ID NO: 2740307 - RNA, 21 nt, Human
gcuuauugucuagugaaacuc

SEQ ID NO: 2740308 - RNA, 11 nt, Human
gcuuauuuccu

SEQ ID NO: 2740309 - RNA, 16 nt, Human
gcuucaagaaauuacu

SEQ ID NO: 2740310 - RNA, 16 nt, Human
gcuucacuguaaaaua

SEQ ID NO: 2740311 - RNA, 13 nt, Human
gcuucagccagga

SEQ ID NO: 2740312 - RNA, 17 nt, Human
gcuucagccaggagcug

SEQ ID NO: 2740313 - RNA, 15 nt, Human
gcuucagucuuuucc

SEQ ID NO: 2740314 - RNA, 16 nt, Human
gcuucagucuuuucca

SEQ ID NO: 2740315 - RNA, 20 nt, Human
ggagcuuugaaacgaggauu

SEQ ID NO: 2740316 - RNA, 13 nt, Human
ggaggacgcucuc

SEQ ID NO: 2740317 - RNA, 20 nt, Human
ggaggacgcucucuggccuu

SEQ ID NO: 2740318 - RNA, 17 nt, Human
ggaggcuaaagcccaga

SEQ ID NO: 2740319 - RNA, 18 nt, Human
ggaggcuaaagcccagag

SEQ ID NO: 2740320 - RNA, 17 nt, Human
ggagggcgcggggcggg

SEQ ID NO: 2740321 - RNA, 19 nt, Human
ggagggcgcggggcgggga

SEQ ID NO: 2740322 - RNA, 13 nt, Human
ggaggggcgcucg

SEQ ID NO: 2740323 - RNA, 23 nt, Human
ggagggggcgcgugcaggcagca

SEQ ID NO: 2740324 - RNA, 19 nt, Human
ggagggguuaaagcugccg

SEQ ID NO: 2740325 - RNA, 22 nt, Human
ggagggguuaaagcugccggca

SEQ ID NO: 2740326 - RNA, 15 nt, Human
ggaggguuagggagg

SEQ ID NO: 2740327 - RNA, 18 nt, Human
ggaggguuagggaggggu

SEQ ID NO: 2740328 - RNA, 12 nt, Human
ggaggucauuuu

SEQ ID NO: 2740329 - RNA, 24 nt, Human
ggaguacaccccaacagcacccuc

SEQ ID NO: 2740330 - RNA, 17 nt, Human
ggaguaccauaauucug

SEQ ID NO: 2740331 - RNA, 18 nt, Human
ggaguaccauaauucugg

SEQ ID NO: 2740332 - RNA, 13 nt, Human
ggaguauccucuu

SEQ ID NO: 2740333 - RNA, 15 nt, Human
ggagucacagccacu

SEQ ID NO: 2740334 - RNA, 20 nt, Human
ggaguuaggcuauucacaac

SEQ ID NO: 2740335 - RNA, 14 nt, Human
ggaguuccuaacca

SEQ ID NO: 2740336 - RNA, 15 nt, Human
ggauacuccaugggg

SEQ ID NO: 2740337 - RNA, 17 nt, Human
ggauacuccauggggug

SEQ ID NO: 2740338 - RNA, 15 nt, Human
ggauagagagggaau

SEQ ID NO: 2740339 - RNA, 18 nt, Human
ggauagcugacccagccc

SEQ ID NO: 2740340 - RNA, 23 nt, Human
ggaucaaguccugcaagcagagg

SEQ ID NO: 2740341 - RNA, 15 nt, Human
ggauccugccugccc

SEQ ID NO: 2740342 - RNA, 19 nt, Human
ggaucucacaagcacuuuc

SEQ ID NO: 2740343 - RNA, 16 nt, Human
ggaugagggaaaagaa

SEQ ID NO: 2740344 - RNA, 19 nt, Human
ggaugagggaaaagaaaaa

SEQ ID NO: 2740345 - RNA, 12 nt, Human
ggaugcccacgg

SEQ ID NO: 2740346 - RNA, 16 nt, Human
ggaugccccguccccc

SEQ ID NO: 2740347 - RNA, 20 nt, Human
ggaugcugucuucguacugg

SEQ ID NO: 2740348 - RNA, 17 nt, Human
ggauggagccagcucug

SEQ ID NO: 2740349 - RNA, 23 nt, Human
ggauggcaaccagaccauugucu

SEQ ID NO: 2740350 - RNA, 15 nt, Human
ggauggcaagaugug

SEQ ID NO: 2740351 - RNA, 15 nt, Human
ggauggcgcaggaac

SEQ ID NO: 2740352 - RNA, 18 nt, Human
ggaugggaacaaggaagg

SEQ ID NO: 2740353 - RNA, 15 nt, Human
ggauguggagggggc

SEQ ID NO: 2740354 - RNA, 23 nt, Human
ggauguggggaaguuaggaacug

SEQ ID NO: 2740355 - RNA, 18 nt, Human
ggauuauauuaugaagcu

SEQ ID NO: 2740356 - RNA, 13 nt, Human
ggauuugcaaccc

SEQ ID NO: 2740357 - RNA, 18 nt, Human
ggauuugccuucucuaaa

SEQ ID NO: 2740358 - RNA, 20 nt, Human
ggauuuucagcccucagaau

SEQ ID NO: 2740359 - RNA, 12 nt, Human
ggauuuuugaag

SEQ ID NO: 2740360 - RNA, 23 nt, Human
ggcaaagacuauucccuucuaac

SEQ ID NO: 2740361 - RNA, 17 nt, Human
ggcaaccagaccauugu

SEQ ID NO: 2740362 - RNA, 19 nt, Human
ggcaagggaauuucuucaa

SEQ ID NO: 2740363 - RNA, 21 nt, Human
ggcaagugggugaaagaugga

SEQ ID NO: 2740364 - RNA, 14 nt, Human
ggcaauagucaaau

SEQ ID NO: 2740365 - RNA, 23 nt, Human
ggcaauuaauuccuucagcacuu

SEQ ID NO: 2740366 - RNA, 17 nt, Human
ggcacaacacaucagga

SEQ ID NO: 2740367 - RNA, 14 nt, Human
ggcacacugagcca

SEQ ID NO: 2740368 - RNA, 18 nt, Human
ggcacacugagccagcag

SEQ ID NO: 2740369 - RNA, 21 nt, Human
ggcacagaacuuaaggaugga

SEQ ID NO: 2740370 - RNA, 16 nt, Human
ggcacagguccccaga

SEQ ID NO: 2740371 - RNA, 21 nt, Human
ggcacagguccccagaugaga

SEQ ID NO: 2740372 - RNA, 15 nt, Human
ggcaccgcuguacgc

SEQ ID NO: 2740373 - RNA, 19 nt, Human
ggcaccgcuguacgcgagc

SEQ ID NO: 2740374 - RNA, 21 nt, Human
ggcaccgcuguacgcgagcgc

SEQ ID NO: 2740375 - RNA, 14 nt, Human
ggcaccucucuggg

SEQ ID NO: 2740376 - RNA, 18 nt, Human
ggcacugugggacuggga

SEQ ID NO: 2740377 - RNA, 11 nt, Human
ggcacuuggga

SEQ ID NO: 2740378 - RNA, 14 nt, Human
ggcacuugggacaa

SEQ ID NO: 2740379 - RNA, 18 nt, Human
ggcagacagcagcucagg

SEQ ID NO: 2740380 - RNA, 16 nt, Human
ggcagagagguaggga

SEQ ID NO: 2740381 - RNA, 13 nt, Human
ggcagauguuccu

SEQ ID NO: 2740382 - RNA, 15 nt, Human
ggcagccagaccagc

SEQ ID NO: 2740383 - RNA, 14 nt, Human
ggcagcugccuccc

SEQ ID NO: 2740384 - RNA, 16 nt, Human
ggcagcugccuccccu

SEQ ID NO: 2740385 - RNA, 18 nt, Human
ggcagcuuuccucaaaac

SEQ ID NO: 2740386 - RNA, 13 nt, Human
ggcaggaaaaugg

SEQ ID NO: 2740387 - RNA, 21 nt, Human
ggcaggaacaaacagggcugc

SEQ ID NO: 2740388 - RNA, 23 nt, Human
ggcaggaacaaacagggcugccu

SEQ ID NO: 2740389 - RNA, 16 nt, Human
ggcaggaggaucacuu

SEQ ID NO: 2740390 - RNA, 13 nt, Human
ggcaggcacugcc

SEQ ID NO: 2740391 - RNA, 15 nt, Human
ggcaggcacugccaa

SEQ ID NO: 2740392 - RNA, 16 nt, Human
ggcagggucaggagag

SEQ ID NO: 2740393 - RNA, 20 nt, Human
ggcaggucacacaaccuguc

SEQ ID NO: 2740394 - RNA, 19 nt, Human
ggcagugcuuggcccagga

SEQ ID NO: 2740395 - RNA, 21 nt, Human
ggcagugcuuggcccaggagu

SEQ ID NO: 2740396 - RNA, 17 nt, Human
ggcauagaaguaaaaac

SEQ ID NO: 2740397 - RNA, 13 nt, Human
ggcauagcccugc

SEQ ID NO: 2740398 - RNA, 17 nt, Human
ggcaucaggcuuucuua

SEQ ID NO: 2740399 - RNA, 20 nt, Human
ggcauccccaggcccugcuc

SEQ ID NO: 2740400 - RNA, 17 nt, Human
ggcaugcgccaccaugg

SEQ ID NO: 2740401 - RNA, 16 nt, Human
ggcauggguuuuauua

SEQ ID NO: 2740402 - RNA, 15 nt, Human
ggcauguagcuacag

SEQ ID NO: 2740403 - RNA, 15 nt, Human
ggcauuauccaucuu

SEQ ID NO: 2740404 - RNA, 14 nt, Human
ggcauucaaaugua

SEQ ID NO: 2740405 - RNA, 15 nt, Human
ggccaagaggcuguu

SEQ ID NO: 2740406 - RNA, 21 nt, Human
ggccacacaggaucuuuugua

SEQ ID NO: 2740407 - RNA, 15 nt, Human
ggccacacguggcug

SEQ ID NO: 2740408 - RNA, 18 nt, Human
ggccacaucugagccccg

SEQ ID NO: 2740409 - RNA, 15 nt, Human
ggccaccugcugagc

SEQ ID NO: 2740410 - RNA, 18 nt, Human
ggccacucuuagcuaaau

SEQ ID NO: 2740411 - RNA, 12 nt, Human
ggccagcuccgc

SEQ ID NO: 2740412 - RNA, 22 nt, Human
ggccauagucauucugccugcc

SEQ ID NO: 2740413 - RNA, 16 nt, Human
ggccaucaaccucugu

SEQ ID NO: 2740414 - RNA, 15 nt, Human
ggccaugggacaggg

SEQ ID NO: 2740415 - RNA, 18 nt, Human
ggccaugggacagggagg

SEQ ID NO: 2740416 - RNA, 20 nt, Human
ggccaugggacagggaggac

SEQ ID NO: 2740417 - RNA, 15 nt, Human
ggccauuacccccag

SEQ ID NO: 2740418 - RNA, 19 nt, Human
ggcccaacacaauucuucu

SEQ ID NO: 2740419 - RNA, 22 nt, Human
ggcccaggaguuuggccagaag

SEQ ID NO: 2740420 - RNA, 19 nt, Human
ggcccaggauggcuuugaa

SEQ ID NO: 2740421 - RNA, 22 nt, Human
ggcccaguaccuagcuggcucu

SEQ ID NO: 2740422 - RNA, 12 nt, Human
ggccccagcacu

SEQ ID NO: 2740423 - RNA, 21 nt, Human
ggccccagcacuaaagcagug

SEQ ID NO: 2740424 - RNA, 19 nt, Human
ggccccugucucaggguga

SEQ ID NO: 2740425 - RNA, 22 nt, Human
ggccccuuugcugacccucccc

SEQ ID NO: 2740426 - RNA, 14 nt, Human
ggcccugugcggcc

SEQ ID NO: 2740427 - RNA, 18 nt, Human
ggccgacggagccgggaa

SEQ ID NO: 2740428 - RNA, 19 nt, Human
ggccgacggagccgggaaa

SEQ ID NO: 2740429 - RNA, 16 nt, Human
ggccgcgcugcgcgcc

SEQ ID NO: 2740430 - RNA, 22 nt, Human
ggccggcgcgcucaucccaccc

SEQ ID NO: 2740431 - RNA, 14 nt, Human
ggccgggagccuga

SEQ ID NO: 2740432 - RNA, 15 nt, Human
ggccgggcgcggugg

SEQ ID NO: 2740433 - RNA, 15 nt, Human
ggccguuuugugaag

SEQ ID NO: 2740434 - RNA, 20 nt, Human
ggccuaugcagagguccaca

SEQ ID NO: 2740435 - RNA, 14 nt, Human
ggccuauguggucu

SEQ ID NO: 2740436 - RNA, 14 nt, Human
ggccuccauccuga

SEQ ID NO: 2740437 - RNA, 15 nt, Human
ggccuccauccugag

SEQ ID NO: 2740438 - RNA, 17 nt, Human
ggccuccucuguccagg

SEQ ID NO: 2740439 - RNA, 14 nt, Human
ggccugacugccaa

SEQ ID NO: 2740440 - RNA, 15 nt, Human
ggccugagaccaagg

SEQ ID NO: 2740441 - RNA, 21 nt, Human
ggccugagaccaaggcccccg

SEQ ID NO: 2740442 - RNA, 19 nt, Human
ggccugcucgcccacuucc

SEQ ID NO: 2740443 - RNA, 13 nt, Human
ggccuggcuggga

SEQ ID NO: 2740444 - RNA, 18 nt, Human
ggccuggcugggaguggc

SEQ ID NO: 2740445 - RNA, 14 nt, Human
ggccuucggccucc

SEQ ID NO: 2740446 - RNA, 17 nt, Human
ggccuucggccuccauc

SEQ ID NO: 2740447 - RNA, 18 nt, Human
ggccuugugaggagcugg

SEQ ID NO: 2740448 - RNA, 23 nt, Human
ggcgacucuauagacucuaggac

SEQ ID NO: 2740449 - RNA, 12 nt, Human
ggcgcgaucuca

SEQ ID NO: 2740450 - RNA, 14 nt, Human
ggcgcgcgccacca

SEQ ID NO: 2740451 - RNA, 14 nt, Human
ggcgcgguggcuca

SEQ ID NO: 2740452 - RNA, 14 nt, Human
ggcgcgugcaggca

SEQ ID NO: 2740453 - RNA, 13 nt, Human
ggcgcucgcuucc

SEQ ID NO: 2740454 - RNA, 21 nt, Human
ggcgcuggcugcgcucggccu

SEQ ID NO: 2740455 - RNA, 20 nt, Human
ggcggcuggaauugaauucc

SEQ ID NO: 2740456 - RNA, 19 nt, Human
ggcgggagggcgcggggcg

SEQ ID NO: 2740457 - RNA, 21 nt, Human
ggcggguccgggucgcaggac

SEQ ID NO: 2740458 - RNA, 15 nt, Human
ggcguaacuaauuuu

SEQ ID NO: 2740459 - RNA, 14 nt, Human
ggcgugagccacca

SEQ ID NO: 2740460 - RNA, 18 nt, Human
ggggcuuuaacuccugcu

SEQ ID NO: 2740461 - RNA, 13 nt, Human
gggggaggugagg

SEQ ID NO: 2740462 - RNA, 13 nt, Human
gggggugggggug

SEQ ID NO: 2740463 - RNA, 15 nt, Human
gggggugggggugcc

SEQ ID NO: 2740464 - RNA, 20 nt, Human
gggguaccuaguccccagcc

SEQ ID NO: 2740465 - RNA, 20 nt, Human
ggggugaaacccugucucua

SEQ ID NO: 2740466 - RNA, 13 nt, Human
ggggugggaaaga

SEQ ID NO: 2740467 - RNA, 11 nt, Human
gggguggugga

SEQ ID NO: 2740468 - RNA, 20 nt, Human
ggguaccuaguccccagccu

SEQ ID NO: 2740469 - RNA, 20 nt, Human
ggguagcauuuguguugaag

SEQ ID NO: 2740470 - RNA, 16 nt, Human
gggucagccagcccuc

SEQ ID NO: 2740471 - RNA, 21 nt, Human
gggucuguaaaaucuuucuuu

SEQ ID NO: 2740472 - RNA, 11 nt, Human
gggugaacugc

SEQ ID NO: 2740473 - RNA, 23 nt, Human
gggugccgcucucucugaggggg

SEQ ID NO: 2740474 - RNA, 21 nt, Human
gggugccgcugucucugaggg

SEQ ID NO: 2740475 - RNA, 21 nt, Human
gggugccgcuuucucugaggg

SEQ ID NO: 2740476 - RNA, 23 nt, Human
gggugccgcuuucucugaggggg

SEQ ID NO: 2740477 - RNA, 18 nt, Human
gggugcucucucugaggg

SEQ ID NO: 2740478 - RNA, 20 nt, Human
gggugcucucucugaggggg

SEQ ID NO: 2740479 - RNA, 14 nt, Human
gggugcugggcccc

SEQ ID NO: 2740480 - RNA, 22 nt, Human
ggguggaaaaacagaccggggu

SEQ ID NO: 2740481 - RNA, 17 nt, Human
gggugguagcagaggga

SEQ ID NO: 2740482 - RNA, 13 nt, Human
ggguuaaagcugc

SEQ ID NO: 2740483 - RNA, 20 nt, Human
ggguuaaauauuuugcuaac

SEQ ID NO: 2740484 - RNA, 14 nt, Human
ggguucaagauugu

SEQ ID NO: 2740485 - RNA, 20 nt, Human
ggguucaagcgauucucuug

SEQ ID NO: 2740486 - RNA, 21 nt, Human
ggguucccgugugccugagcg

SEQ ID NO: 2740487 - RNA, 20 nt, Human
ggguuccuuccucugagccu

SEQ ID NO: 2740488 - RNA, 22 nt, Human
ggguuccuuccucugagccuug

SEQ ID NO: 2740489 - RNA, 11 nt, Human
ggguugggggg

SEQ ID NO: 2740490 - RNA, 18 nt, Human
gguaagcaccaggacgcc

SEQ ID NO: 2740491 - RNA, 19 nt, Human
gguacccacuugcuuuuaa

SEQ ID NO: 2740492 - RNA, 18 nt, Human
gguacuucaaauccuuga

SEQ ID NO: 2740493 - RNA, 14 nt, Human
gguagaaagaagau

SEQ ID NO: 2740494 - RNA, 11 nt, Human
gguagcagagg

SEQ ID NO: 2740495 - RNA, 12 nt, Human
gguauaaaagau

SEQ ID NO: 2740496 - RNA, 22 nt, Human
gguauauaaauuuucccaaaac

SEQ ID NO: 2740497 - RNA, 14 nt, Human
gguaucaccacugg

SEQ ID NO: 2740498 - RNA, 13 nt, Human
gguauuugagugu

SEQ ID NO: 2740499 - RNA, 17 nt, Human
gguauuuuaaucaccaa

SEQ ID NO: 2740500 - RNA, 18 nt, Human
ggucacacaaccuguccc

SEQ ID NO: 2740501 - RNA, 11 nt, Human
ggucacaggaa

SEQ ID NO: 2740502 - RNA, 16 nt, Human
ggucacagggccuggg

SEQ ID NO: 2740503 - RNA, 23 nt, Human
ggucacucguggugaggcugaca

SEQ ID NO: 2740504 - RNA, 15 nt, Human
ggucaggagaggggc

SEQ ID NO: 2740505 - RNA, 13 nt, Human
gguccacaacaca

SEQ ID NO: 2740506 - RNA, 17 nt, Human
ggucccuauuccuccuu

SEQ ID NO: 2740507 - RNA, 18 nt, Human
ggucccugcucucaguuc

SEQ ID NO: 2740508 - RNA, 19 nt, Human
gguccgggucgcaggacca

SEQ ID NO: 2740509 - RNA, 18 nt, Human
gguccuuaggccucugag

SEQ ID NO: 2740510 - RNA, 21 nt, Human
gguccuugcugcaccugugcc

SEQ ID NO: 2740511 - RNA, 19 nt, Human
ggucgaggcuacagugagc

SEQ ID NO: 2740512 - RNA, 13 nt, Human
ggucgcaggacca

SEQ ID NO: 2740513 - RNA, 20 nt, Human
ggucgcaggaccaucccggc

SEQ ID NO: 2740514 - RNA, 16 nt, Human
ggucuaccacucagag

SEQ ID NO: 2740515 - RNA, 20 nt, Human
ggucuaccuguucgcgcgcc

SEQ ID NO: 2740516 - RNA, 21 nt, Human
ggucuaggacacaguuccugg

SEQ ID NO: 2740517 - RNA, 20 nt, Human
ggucucaguguccucaucug

SEQ ID NO: 2740518 - RNA, 13 nt, Human
ggucucccucugu

SEQ ID NO: 2740519 - RNA, 16 nt, Human
ggucuccuaaaguacu

SEQ ID NO: 2740520 - RNA, 15 nt, Human
ggucucgaacugcug

SEQ ID NO: 2740521 - RNA, 16 nt, Human
ggucugaagcucaacu

SEQ ID NO: 2740522 - RNA, 15 nt, Human
ggugaaaugcagagu

SEQ ID NO: 2740523 - RNA, 22 nt, Human
ggugacccugaugaaaacauag

SEQ ID NO: 2740524 - RNA, 22 nt, Human
ggugagaacccuugcacuagag

SEQ ID NO: 2740525 - RNA, 15 nt, Human
ggugagcuacaaaug

SEQ ID NO: 2740526 - RNA, 16 nt, Human
ggugagugccuguaau

SEQ ID NO: 2740527 - RNA, 16 nt, Human
ggugauguuccgaagg

SEQ ID NO: 2740528 - RNA, 15 nt, Human
ggugccccccuugcc

SEQ ID NO: 2740529 - RNA, 22 nt, Human
ggugccccccuugccagacaug

SEQ ID NO: 2740530 - RNA, 13 nt, Human
ggugccgcugucu

SEQ ID NO: 2740531 - RNA, 16 nt, Human
ggugcugcagccccug

SEQ ID NO: 2740532 - RNA, 17 nt, Human
ggugcugcagccccugg

SEQ ID NO: 2740533 - RNA, 19 nt, Human
ggugcugcagccccuggga

SEQ ID NO: 2740534 - RNA, 11 nt, Human
ggugcugcucu

SEQ ID NO: 2740535 - RNA, 14 nt, Human
ggugcugcucucuc

SEQ ID NO: 2740536 - RNA, 19 nt, Human
gguggacccagggaugaca

SEQ ID NO: 2740537 - RNA, 20 nt, Human
gguggcaggaaaauggacau

SEQ ID NO: 2740538 - RNA, 12 nt, Human
gguggcgcuggc

SEQ ID NO: 2740539 - RNA, 14 nt, Human
gguggcgcuggcug

SEQ ID NO: 2740540 - RNA, 22 nt, Human
gguggcgcuggcugcgcucggc

SEQ ID NO: 2740541 - RNA, 14 nt, Human
ggugggcagagagg

SEQ ID NO: 2740542 - RNA, 20 nt, Human
ggugggcagaucacuugagc

SEQ ID NO: 2740543 - RNA, 22 nt, Human
ggugguauguuuucaggcuaga

SEQ ID NO: 2740544 - RNA, 19 nt, Human
gguggugagugccuguaau

SEQ ID NO: 2740545 - RNA, 11 nt, Human
gguuaaugcug

SEQ ID NO: 2740546 - RNA, 20 nt, Human
gguuaaugcugaaaaaucau

SEQ ID NO: 2740547 - RNA, 18 nt, Human
gguucaagcaauccuccc

SEQ ID NO: 2740548 - RNA, 19 nt, Human
gguuccuuccucugagccu

SEQ ID NO: 2740549 - RNA, 16 nt, Human
gguucuaggccgggcg

SEQ ID NO: 2740550 - RNA, 14 nt, Human
gguucucuccacca

SEQ ID NO: 2740551 - RNA, 15 nt, Human
gguuggagugcagug

SEQ ID NO: 2740552 - RNA, 15 nt, Human
gguugguuucccuuc

SEQ ID NO: 2740553 - RNA, 19 nt, Human
gguuuaauaauuuuuaauu

SEQ ID NO: 2740554 - RNA, 13 nt, Human
gguuucaccaugu

SEQ ID NO: 2740555 - RNA, 17 nt, Human
gguuugcaauccaagca

SEQ ID NO: 2740556 - RNA, 22 nt, Human
gguuugccaugcuggccaggcu

SEQ ID NO: 2740557 - RNA, 13 nt, Human
gguuuuaaagcuu

SEQ ID NO: 2740558 - RNA, 21 nt, Human
gguuuuaguugcaacuuugua

SEQ ID NO: 2740559 - RNA, 20 nt, Human
guaaaauagugaauaaaguc

SEQ ID NO: 2740560 - RNA, 16 nt, Human
guaaaauugccauauu

SEQ ID NO: 2740561 - RNA, 17 nt, Human
guaaacggucucucacu

SEQ ID NO: 2740562 - RNA, 19 nt, Human
guaaagcuuugugcagauu

SEQ ID NO: 2740563 - RNA, 14 nt, Human
guaaaggcaaacuu

SEQ ID NO: 2740564 - RNA, 15 nt, Human
guaaagugauuuuug

SEQ ID NO: 2740565 - RNA, 18 nt, Human
guaaauagaaacguguau

SEQ ID NO: 2740566 - RNA, 21 nt, Human
guaaaucagacuaugaaguuu

SEQ ID NO: 2740567 - RNA, 21 nt, Human
guaacaggcuugaaucaaaga

SEQ ID NO: 2740568 - RNA, 19 nt, Human
guaacuaauuuuaacucua

SEQ ID NO: 2740569 - RNA, 15 nt, Human
guaacugacaacuug

SEQ ID NO: 2740570 - RNA, 14 nt, Human
guaacugauuugua

SEQ ID NO: 2740571 - RNA, 15 nt, Human
guaagauuuccuucu

SEQ ID NO: 2740572 - RNA, 15 nt, Human
guaaggggaauugag

SEQ ID NO: 2740573 - RNA, 17 nt, Human
guaauagggaaaauucu

SEQ ID NO: 2740574 - RNA, 18 nt, Human
guaauauugcaaggcaaa

SEQ ID NO: 2740575 - RNA, 20 nt, Human
guaauauuucuucaaauaaa

SEQ ID NO: 2740576 - RNA, 21 nt, Human
guaaucauauaauaaauguac

SEQ ID NO: 2740577 - RNA, 11 nt, Human
guaaugaaaau

SEQ ID NO: 2740578 - RNA, 17 nt, Human
guaaugaauuaaagaag

SEQ ID NO: 2740579 - RNA, 15 nt, Human
guaaugauaacugga

SEQ ID NO: 2740580 - RNA, 14 nt, Human
guaaugcauuaugg

SEQ ID NO: 2740581 - RNA, 23 nt, Human
guaauuccguagguuauuuucag

SEQ ID NO: 2740582 - RNA, 16 nt, Human
guaauucuaaaugaau

SEQ ID NO: 2740583 - RNA, 18 nt, Human
guaauuucagaagaaauu

SEQ ID NO: 2740584 - RNA, 19 nt, Human
guaauuugaaauauuuucu

SEQ ID NO: 2740585 - RNA, 23 nt, Human
guaauuugaaauauuuucuuugu

SEQ ID NO: 2740586 - RNA, 15 nt, Human
guacaauaaagcaau

SEQ ID NO: 2740587 - RNA, 21 nt, Human
guacaauaaagcaauguggua

SEQ ID NO: 2740588 - RNA, 22 nt, Human
guacaauuauaagcuguuuuua

SEQ ID NO: 2740589 - RNA, 12 nt, Human
guacaccccaac

SEQ ID NO: 2740590 - RNA, 16 nt, Human
guacaccccaacagca

SEQ ID NO: 2740591 - RNA, 17 nt, Human
guacaccccaacagcac

SEQ ID NO: 2740592 - RNA, 19 nt, Human
guacaccccaacagcaccc

SEQ ID NO: 2740593 - RNA, 16 nt, Human
guacagacagaaaaaa

SEQ ID NO: 2740594 - RNA, 13 nt, Human
guacagucuugua

SEQ ID NO: 2740595 - RNA, 15 nt, Human
guacaguuauuuaug

SEQ ID NO: 2740596 - RNA, 12 nt, Human
guacauucuucc

SEQ ID NO: 2740597 - RNA, 17 nt, Human
guacauuuccaaauuca

SEQ ID NO: 2740598 - RNA, 21 nt, Human
guacauuuccaaauucacaag

SEQ ID NO: 2740599 - RNA, 17 nt, Human
guacccaguagaugcca

SEQ ID NO: 2740600 - RNA, 22 nt, Human
guacccaguagaugccacccag

SEQ ID NO: 2740601 - RNA, 22 nt, Human
guaccuaguccccagccugcuc

SEQ ID NO: 2740602 - RNA, 14 nt, Human
guaccuccaaggac

SEQ ID NO: 2740603 - RNA, 13 nt, Human
guacgcgagcgcg

SEQ ID NO: 2740604 - RNA, 21 nt, Human
guacgcgagcgcgcgcgcccu

SEQ ID NO: 2740605 - RNA, 23 nt, Human
guacuaagcgcuagaggaagcag

SEQ ID NO: 2740606 - RNA, 21 nt, Human
guacuccagccagggcaagag

SEQ ID NO: 2740607 - RNA, 14 nt, Human
guacuccagccugg

SEQ ID NO: 2740608 - RNA, 19 nt, Human
guacugagagugaacaaau

SEQ ID NO: 2740609 - RNA, 14 nt, Human
guacugauuacugc

SEQ ID NO: 2740610 - RNA, 15 nt, Human
guacuggcugaugga

SEQ ID NO: 2740611 - RNA, 19 nt, Human
guacuggcugauggaguaa

SEQ ID NO: 2740612 - RNA, 23 nt, Human
guacuguguacagaauucugcua

SEQ ID NO: 2740613 - RNA, 17 nt, Human
guacuucaaauccuuga

SEQ ID NO: 2740614 - RNA, 14 nt, Human
guacuuuauuuucu

SEQ ID NO: 2740615 - RNA, 20 nt, Human
guacuuuauuuucuauaauu

SEQ ID NO: 2740616 - RNA, 15 nt, Human
guagaaaagggaacu

SEQ ID NO: 2740617 - RNA, 15 nt, Human
guagaauauauuucc

SEQ ID NO: 2740618 - RNA, 16 nt, Human
guagaauauauuuccu

SEQ ID NO: 2740619 - RNA, 17 nt, Human
guagaaugggggcagca

SEQ ID NO: 2740620 - RNA, 12 nt, Human
guagacacacau

SEQ ID NO: 2740621 - RNA, 20 nt, Human
guagacgugcacgcacacug

SEQ ID NO: 2740622 - RNA, 20 nt, Human
guagagacggguuucaccau

SEQ ID NO: 2740623 - RNA, 18 nt, Human
guagccacuucacuuuuu

SEQ ID NO: 2740624 - RNA, 14 nt, Human
guaggaaacuaggu

SEQ ID NO: 2740625 - RNA, 20 nt, Human
guaggauuuugagggugggg

SEQ ID NO: 2740626 - RNA, 16 nt, Human
guaguaugaugggugu

SEQ ID NO: 2740627 - RNA, 13 nt, Human
guagucagacugg

SEQ ID NO: 2740628 - RNA, 19 nt, Human
guaguccuguaauggaagc

SEQ ID NO: 2740629 - RNA, 24 nt, Human
guaguccuguaauggaagcaucua

SEQ ID NO: 2740630 - RNA, 13 nt, Human
guaguuagcuuuc

SEQ ID NO: 2740631 - RNA, 23 nt, Human
guauaaaaauaaaaaagauccca

SEQ ID NO: 2740632 - RNA, 12 nt, Human
guauaaauaaaa

SEQ ID NO: 2740633 - RNA, 16 nt, Human
guauaauucacauugu

SEQ ID NO: 2740634 - RNA, 21 nt, Human
guauaauucacauuguauuca

SEQ ID NO: 2740635 - RNA, 16 nt, Human
guauacaaaacccuuu

SEQ ID NO: 2740636 - RNA, 14 nt, Human
guauacuguauuuu

SEQ ID NO: 2740637 - RNA, 21 nt, Human
guauacugugugcuaaaacaa

SEQ ID NO: 2740638 - RNA, 16 nt, Human
guauagaccuaaaaua

SEQ ID NO: 2740639 - RNA, 18 nt, Human
guauagcauauguuuuug

SEQ ID NO: 2740640 - RNA, 12 nt, Human
guauaggccagg

SEQ ID NO: 2740641 - RNA, 18 nt, Human
guauauauaucauagcaa

SEQ ID NO: 2740642 - RNA, 11 nt, Human
guauauucaaa

SEQ ID NO: 2740643 - RNA, 15 nt, Human
guauauuuuauauca

SEQ ID NO: 2740644 - RNA, 20 nt, Human
guaucaaaagaaagaaaauc

SEQ ID NO: 2740645 - RNA, 14 nt, Human
guauccaaaaaugu

SEQ ID NO: 2740646 - RNA, 14 nt, Human
guauccucuugcca

SEQ ID NO: 2740647 - RNA, 17 nt, Human
guauccuucagccugaa

SEQ ID NO: 2740648 - RNA, 15 nt, Human
guaucuucuuuugug

SEQ ID NO: 2740649 - RNA, 16 nt, Human
guaucuuguuuuucca

SEQ ID NO: 2740650 - RNA, 14 nt, Human
guaugauucccagc

SEQ ID NO: 2740651 - RNA, 20 nt, Human
guaugauuccuugauggaga

SEQ ID NO: 2740652 - RNA, 11 nt, Human
guauggcaaac

SEQ ID NO: 2740653 - RNA, 20 nt, Human
guauggcagcuuuccucaaa

SEQ ID NO: 2740654 - RNA, 17 nt, Human
guauggugggaaguugg

SEQ ID NO: 2740655 - RNA, 22 nt, Human
guauuaaguuguuaauaaaagu

SEQ ID NO: 2740656 - RNA, 15 nt, Human
guauuagaauaccac

SEQ ID NO: 2740657 - RNA, 15 nt, Human
guauuauaauucaaa

SEQ ID NO: 2740658 - RNA, 15 nt, Human
guauuauuuuuuaaa

SEQ ID NO: 2740659 - RNA, 17 nt, Human
guauuauuuuuuaaaaa

SEQ ID NO: 2740660 - RNA, 18 nt, Human
guauuauuuuuuaaaaaa

SEQ ID NO: 2740661 - RNA, 19 nt, Human
guauucuuuuaguuuuuaa

SEQ ID NO: 2740662 - RNA, 21 nt, Human
guauugcauuuaauuuauuga

SEQ ID NO: 2740663 - RNA, 20 nt, Human
guauuuaauagguuuggaca

SEQ ID NO: 2740664 - RNA, 23 nt, Human
guauuuauucaauaaaguauuua

SEQ ID NO: 2740665 - RNA, 18 nt, Human
guauuuguuuguauuuug

SEQ ID NO: 2740666 - RNA, 14 nt, Human
guauuuuaaaagaa

SEQ ID NO: 2740667 - RNA, 13 nt, Human
guauuuuaaaaua

SEQ ID NO: 2740668 - RNA, 13 nt, Human
guauuuuaaucac

SEQ ID NO: 2740669 - RNA, 21 nt, Human
guauuuuuaccuuuuuccuuc

SEQ ID NO: 2740670 - RNA, 22 nt, Human
guauuuuuaccuuuuuccuucc

SEQ ID NO: 2740671 - RNA, 17 nt, Human
gucaaaguucauagagu

SEQ ID NO: 2740672 - RNA, 19 nt, Human
gucaaauugugugaaaggu

SEQ ID NO: 2740673 - RNA, 20 nt, Human
gucaacuccuuucucaucuu

SEQ ID NO: 2740674 - RNA, 21 nt, Human
gucaagaucagccugggcaac

SEQ ID NO: 2740675 - RNA, 19 nt, Human
gucaagggugugugcagca

SEQ ID NO: 2740676 - RNA, 22 nt, Human
gucaagggugugugcagcauug

SEQ ID NO: 2740677 - RNA, 18 nt, Human
gucaauaaaauccauaca

SEQ ID NO: 2740678 - RNA, 22 nt, Human
gucaaucuguccguucacaugu

SEQ ID NO: 2740679 - RNA, 11 nt, Human
gucacaauacu

SEQ ID NO: 2740680 - RNA, 17 nt, Human
gucacacaaccuguccc

SEQ ID NO: 2740681 - RNA, 23 nt, Human
gucacacaaccugucccagcgag

SEQ ID NO: 2740682 - RNA, 22 nt, Human
gucacaggaaguagaggaggcc

SEQ ID NO: 2740683 - RNA, 19 nt, Human
gucacauaaugcucauacu

SEQ ID NO: 2740684 - RNA, 16 nt, Human
gucacauuccaagccu

SEQ ID NO: 2740685 - RNA, 14 nt, Human
gucacccacuuccc

SEQ ID NO: 2740686 - RNA, 18 nt, Human
gucacccacuucccacua

SEQ ID NO: 2740687 - RNA, 18 nt, Human
gucaccucauggaauugg

SEQ ID NO: 2740688 - RNA, 15 nt, Human
gucacugacacacac

SEQ ID NO: 2740689 - RNA, 16 nt, Human
gucagaagaccugguc

SEQ ID NO: 2740690 - RNA, 19 nt, Human
gucagaguuccgacugcca

SEQ ID NO: 2740691 - RNA, 22 nt, Human
gucagcccccuaagcccccacu

SEQ ID NO: 2740692 - RNA, 20 nt, Human
gucagcuccccucggagaag

SEQ ID NO: 2740693 - RNA, 13 nt, Human
gucagcucuucuc

SEQ ID NO: 2740694 - RNA, 14 nt, Human
gucagcucuucucc

SEQ ID NO: 2740695 - RNA, 17 nt, Human
gucauaacuaaauaaag

SEQ ID NO: 2740696 - RNA, 17 nt, Human
gucaucugaugagaaca

SEQ ID NO: 2740697 - RNA, 16 nt, Human
gucauuauuaggaagu

SEQ ID NO: 2740698 - RNA, 14 nt, Human
gucauuguucuugu

SEQ ID NO: 2740699 - RNA, 17 nt, Human
gucauuucauuuccuau

SEQ ID NO: 2740700 - RNA, 14 nt, Human
guccaagcauacca

SEQ ID NO: 2740701 - RNA, 15 nt, Human
guccaagcauaccaa

SEQ ID NO: 2740702 - RNA, 23 nt, Human
guccaccaggaguucucccacca

SEQ ID NO: 2740703 - RNA, 19 nt, Human
guccagggcccugagcucg

SEQ ID NO: 2740704 - RNA, 15 nt, Human
guccauucuuccucc

SEQ ID NO: 2740705 - RNA, 16 nt, Human
guccauucuuccuccc

SEQ ID NO: 2740706 - RNA, 19 nt, Human
guccauucuuccucccauu

SEQ ID NO: 2740707 - RNA, 16 nt, Human
guccauugggcaggca

SEQ ID NO: 2740708 - RNA, 15 nt, Human
gucccaggcugagcc

SEQ ID NO: 2740709 - RNA, 20 nt, Human
guccccagccugcucccuag

SEQ ID NO: 2740710 - RNA, 20 nt, Human
guccccuauccuacuucccc

SEQ ID NO: 2740711 - RNA, 15 nt, Human
gucccuauuccuccu

SEQ ID NO: 2740712 - RNA, 16 nt, Human
gucccuauuccuccuu

SEQ ID NO: 2740713 - RNA, 21 nt, Human
gucccugcagcucucuuuccu

SEQ ID NO: 2740714 - RNA, 19 nt, Human
gucccugcugcccuucccc

SEQ ID NO: 2740715 - RNA, 21 nt, Human
gucccuguggaaguaucuugg

SEQ ID NO: 2740716 - RNA, 16 nt, Human
guccgaggugggcaga

SEQ ID NO: 2740717 - RNA, 17 nt, Human
guccgaggugggcagau

SEQ ID NO: 2740718 - RNA, 16 nt, Human
guccgggucgcaggac

SEQ ID NO: 2740719 - RNA, 14 nt, Human
guccgucucugcuu

SEQ ID NO: 2740720 - RNA, 24 nt, Human
guccucaucuguaaaauggagaca

SEQ ID NO: 2740721 - RNA, 13 nt, Human
guccucuuucaaa

SEQ ID NO: 2740722 - RNA, 18 nt, Human
guccuggaggggcugggg

SEQ ID NO: 2740723 - RNA, 16 nt, Human
guccuucccuuucauu

SEQ ID NO: 2740724 - RNA, 15 nt, Human
guccuugcugcaccu

SEQ ID NO: 2740725 - RNA, 19 nt, Human
guccuuggugccuggagcc

SEQ ID NO: 2740726 - RNA, 23 nt, Human
gucgcaggaccaucccggccggc

SEQ ID NO: 2740727 - RNA, 18 nt, Human
gucgcccuacucaccuga

SEQ ID NO: 2740728 - RNA, 14 nt, Human
gucgcccuggacug

SEQ ID NO: 2740729 - RNA, 21 nt, Human
gucuaaaaaaggaauccucug

SEQ ID NO: 2740730 - RNA, 14 nt, Human
gucuacacagaugu

SEQ ID NO: 2740731 - RNA, 16 nt, Human
gucuaucuuugagcgc

SEQ ID NO: 2740732 - RNA, 21 nt, Human
gucucaaacuccugaccucag

SEQ ID NO: 2740733 - RNA, 14 nt, Human
gucucaaugcucau

SEQ ID NO: 2740734 - RNA, 12 nt, Human
gucucagcuuca

SEQ ID NO: 2740735 - RNA, 19 nt, Human
gucucagcuucacccugag

SEQ ID NO: 2740736 - RNA, 22 nt, Human
gucucagcuucacccugaggug

SEQ ID NO: 2740737 - RNA, 23 nt, Human
gucucagcuucacccugagguga

SEQ ID NO: 2740738 - RNA, 16 nt, Human
gucucaggaaaucaaa

SEQ ID NO: 2740739 - RNA, 16 nt, Human
gucucagugucaaugc

SEQ ID NO: 2740740 - RNA, 21 nt, Human
gucucagugucaaugcagccc

SEQ ID NO: 2740741 - RNA, 23 nt, Human
gucuccaaaaucggaucuggggc

SEQ ID NO: 2740742 - RNA, 17 nt, Human
gucucccaaagugcugg

SEQ ID NO: 2740743 - RNA, 15 nt, Human
gucucccagcucagg

SEQ ID NO: 2740744 - RNA, 22 nt, Human
gucucccucuguugccaaggcu

SEQ ID NO: 2740745 - RNA, 15 nt, Human
gucuccuaagcugga

SEQ ID NO: 2740746 - RNA, 18 nt, Human
gucucgaacugcuggauu

SEQ ID NO: 2740747 - RNA, 16 nt, Human
gucucuacauaaaaua

SEQ ID NO: 2740748 - RNA, 21 nt, Human
gucucuaccaaaaaaaggaag

SEQ ID NO: 2740749 - RNA, 16 nt, Human
uaaaaguuuuuuauua

SEQ ID NO: 2740750 - RNA, 21 nt, Human
uaaaauaaaguauauauagaa

SEQ ID NO: 2740751 - RNA, 13 nt, Human
uaaaauaaauuau

SEQ ID NO: 2740752 - RNA, 14 nt, Human
uaaaauaauaacug

SEQ ID NO: 2740753 - RNA, 18 nt, Human
uaaaauaauaacugggaa

SEQ ID NO: 2740754 - RNA, 17 nt, Human
uaaaauaauuuuuauau

SEQ ID NO: 2740755 - RNA, 22 nt, Human
uaaaauaauuuuuauauuugaa

SEQ ID NO: 2740756 - RNA, 13 nt, Human
uaaaauacaaaaa

SEQ ID NO: 2740757 - RNA, 14 nt, Human
uaaaauagugaaua

SEQ ID NO: 2740758 - RNA, 23 nt, Human
uaaaauauaugaggcuacagaac

SEQ ID NO: 2740759 - RNA, 16 nt, Human
uaaaauaugucuuucu

SEQ ID NO: 2740760 - RNA, 15 nt, Human
uaaaaucuaauucaa

SEQ ID NO: 2740761 - RNA, 22 nt, Human
uaaaaucuuucuuucuuagaaa

SEQ ID NO: 2740762 - RNA, 20 nt, Human
uaaaaugaauacaauuaaag

SEQ ID NO: 2740763 - RNA, 13 nt, Human
uaaaaugagaaau

SEQ ID NO: 2740764 - RNA, 17 nt, Human
uaaaaugagaaaucuaa

SEQ ID NO: 2740765 - RNA, 22 nt, Human
uaaaaugagaaaucuaaaaaac

SEQ ID NO: 2740766 - RNA, 15 nt, Human
uaaaaugagcaaaag

SEQ ID NO: 2740767 - RNA, 18 nt, Human
uaaaaugagcaaaaguug

SEQ ID NO: 2740768 - RNA, 18 nt, Human
uaaaauggagacaccacc

SEQ ID NO: 2740769 - RNA, 20 nt, Human
uaaaauguaauuaaucuugu

SEQ ID NO: 2740770 - RNA, 20 nt, Human
uaaaaugucuugcuugauug

SEQ ID NO: 2740771 - RNA, 20 nt, Human
uaaaauuaucaauaucuaau

SEQ ID NO: 2740772 - RNA, 17 nt, Human
uaaaauucauuccauuu

SEQ ID NO: 2740773 - RNA, 15 nt, Human
uaaaauuuuuaaucu

SEQ ID NO: 2740774 - RNA, 16 nt, Human
uaaaauuuuuuuagaa

SEQ ID NO: 2740775 - RNA, 21 nt, Human
uaaaauuuuuuuagaaagcau

SEQ ID NO: 2740776 - RNA, 22 nt, Human
uaaaauuuuuuuagaaagcauu

SEQ ID NO: 2740777 - RNA, 22 nt, Human
uaaacaaagagugaaggauuua

SEQ ID NO: 2740778 - RNA, 13 nt, Human
uaaacauguuuau

SEQ ID NO: 2740779 - RNA, 23 nt, Human
uaaaccaaggcuagaaccaccug

SEQ ID NO: 2740780 - RNA, 16 nt, Human
uaaaccuauacucacu

SEQ ID NO: 2740781 - RNA, 21 nt, Human
uaaaccuuuuuggacacacaa

SEQ ID NO: 2740782 - RNA, 23 nt, Human
uaaacucaauaaguuuauuucuu

SEQ ID NO: 2740783 - RNA, 15 nt, Human
uaaacucagaggcag

SEQ ID NO: 2740784 - RNA, 22 nt, Human
uaaacuggaaauaaaagauugu

SEQ ID NO: 2740785 - RNA, 11 nt, Human
uaaagaaacaa

SEQ ID NO: 2740786 - RNA, 14 nt, Human
uaaagaaacaaaaa

SEQ ID NO: 2740787 - RNA, 22 nt, Human
uaaagaaggugugggccagaca

SEQ ID NO: 2740788 - RNA, 23 nt, Human
uaaagaaggugugggccagacaa

SEQ ID NO: 2740789 - RNA, 15 nt, Human
uaaagaauuuucaaa

SEQ ID NO: 2740790 - RNA, 17 nt, Human
uaaagaauuuucaaaau

SEQ ID NO: 2740791 - RNA, 20 nt, Human
uaaagaauuuucaaaaucaa

SEQ ID NO: 2740792 - RNA, 17 nt, Human
uaaagacuuuuaugaua

SEQ ID NO: 2740793 - RNA, 13 nt, Human
uaaagcaaugugg

SEQ ID NO: 2740794 - RNA, 15 nt, Human
uaaagcuagaaauga

SEQ ID NO: 2740795 - RNA, 20 nt, Human
uaaagcuucuguuccgugcu

SEQ ID NO: 2740796 - RNA, 14 nt, Human
uaaaggaauuuaaa

SEQ ID NO: 2740797 - RNA, 16 nt, Human
uaaaggaauuuaaaaa

SEQ ID NO: 2740798 - RNA, 20 nt, Human
uaaaggcuaugauugucuuu

SEQ ID NO: 2740799 - RNA, 19 nt, Human
uaaaguaaaaacaaagaaa

SEQ ID NO: 2740800 - RNA, 21 nt, Human
uaaaguaaaaacaaagaaauu

SEQ ID NO: 2740801 - RNA, 17 nt, Human
uaaaguaaaggcaaacu

SEQ ID NO: 2740802 - RNA, 13 nt, Human
uaaaguacaagag

SEQ ID NO: 2740803 - RNA, 16 nt, Human
uaaagugauauuuccc

SEQ ID NO: 2740804 - RNA, 17 nt, Human
uaaaguguuugaaagcu

SEQ ID NO: 2740805 - RNA, 14 nt, Human
uaaaguucuaguga

SEQ ID NO: 2740806 - RNA, 22 nt, Human
uaaaguugauuuaaggccaggc

SEQ ID NO: 2740807 - RNA, 16 nt, Human
uaaauaaaaagcauua

SEQ ID NO: 2740808 - RNA, 22 nt, Human
uaaauaaaaagcauuauuauuu

SEQ ID NO: 2740809 - RNA, 17 nt, Human
uaaauaaagaauuuuaa

SEQ ID NO: 2740810 - RNA, 22 nt, Human
uaaauaaagcuugcaacaaaau

SEQ ID NO: 2740811 - RNA, 15 nt, Human
uaaauaaauaaaaac

SEQ ID NO: 2740812 - RNA, 14 nt, Human
uaaauaaauaaaua

SEQ ID NO: 2740813 - RNA, 15 nt, Human
uaaauaaauaaauaa

SEQ ID NO: 2740814 - RNA, 16 nt, Human
uaaauaaauaaauaaa

SEQ ID NO: 2740815 - RNA, 21 nt, Human
uaaauaaauguaucuuauuca

SEQ ID NO: 2740816 - RNA, 13 nt, Human
uaaauauaaaaau

SEQ ID NO: 2740817 - RNA, 23 nt, Human
uaaauauacuccuaguaauuuaa

SEQ ID NO: 2740818 - RNA, 12 nt, Human
uaaauauauauu

SEQ ID NO: 2740819 - RNA, 13 nt, Human
uaaauauauauuu

SEQ ID NO: 2740820 - RNA, 15 nt, Human
uaaauauauauuuua

SEQ ID NO: 2740821 - RNA, 18 nt, Human
uaaauauguuagcaaaga

SEQ ID NO: 2740822 - RNA, 13 nt, Human
uaaauauuuugcu

SEQ ID NO: 2740823 - RNA, 15 nt, Human
uaaaucuaaaucuau

SEQ ID NO: 2740824 - RNA, 15 nt, Human
uaaaucuaucaaaau

SEQ ID NO: 2740825 - RNA, 16 nt, Human
uaaaucuaucaaaauu

SEQ ID NO: 2740826 - RNA, 17 nt, Human
uaaaucuauuuauuaau

SEQ ID NO: 2740827 - RNA, 15 nt, Human
uaaaugaaauugaaa

SEQ ID NO: 2740828 - RNA, 16 nt, Human
uaaaugaaauugaaaa

SEQ ID NO: 2740829 - RNA, 17 nt, Human
uaaaugaaauugaaaau

SEQ ID NO: 2740830 - RNA, 12 nt, Human
uaaaugaagaaa

SEQ ID NO: 2740831 - RNA, 13 nt, Human
uaaaugagugugu

SEQ ID NO: 2740832 - RNA, 17 nt, Human
uaaaugccaggccuggc

SEQ ID NO: 2740833 - RNA, 13 nt, Human
uaaaugugauuua

SEQ ID NO: 2740834 - RNA, 16 nt, Human
uaaaugugcuuuuaaa

SEQ ID NO: 2740835 - RNA, 17 nt, Human
uaaaugugcuuuuaaaa

SEQ ID NO: 2740836 - RNA, 20 nt, Human
uaaaugugcuuuuaaaaaaa

SEQ ID NO: 2740837 - RNA, 20 nt, Human
uaaaugugguacaagcauuc

SEQ ID NO: 2740838 - RNA, 17 nt, Human
uaaauguugacauggga

SEQ ID NO: 2740839 - RNA, 21 nt, Human
uaaauuaguuagccaauauuu

SEQ ID NO: 2740840 - RNA, 19 nt, Human
uaaauuauuauuuaaacau

SEQ ID NO: 2740841 - RNA, 19 nt, Human
uaaauuauuuuuguucaua

SEQ ID NO: 2740842 - RNA, 15 nt, Human
uaaauucuuucauuu

SEQ ID NO: 2740843 - RNA, 18 nt, Human
uaaauugacacuuaaaaa

SEQ ID NO: 2740844 - RNA, 22 nt, Human
uaaauugacacuuaaaaauggu

SEQ ID NO: 2740845 - RNA, 14 nt, Human
uaaauuuaucauuu

SEQ ID NO: 2740846 - RNA, 19 nt, Human
uaaauuuucccaaaacuga

SEQ ID NO: 2740847 - RNA, 14 nt, Human
uaacaacaacaaca

SEQ ID NO: 2740848 - RNA, 21 nt, Human
uaacaaccuaaauuugguucu

SEQ ID NO: 2740849 - RNA, 14 nt, Human
uaacaacuugucua

SEQ ID NO: 2740850 - RNA, 20 nt, Human
uaacaagccuccuuuuaaag

SEQ ID NO: 2740851 - RNA, 13 nt, Human
uaacaauaaaaga

SEQ ID NO: 2740852 - RNA, 15 nt, Human
uaacaauaaaagaca

SEQ ID NO: 2740853 - RNA, 20 nt, Human
uaacaauaaaagacaaggaa

SEQ ID NO: 2740854 - RNA, 13 nt, Human
uaacaaugaaagu

SEQ ID NO: 2740855 - RNA, 23 nt, Human
uaacaaugcuguauuuuaaaaga

SEQ ID NO: 2740856 - RNA, 16 nt, Human
uaacaggcaaaaggaa

SEQ ID NO: 2740857 - RNA, 24 nt, Human
uaacaguugcauugacugucacau

SEQ ID NO: 2740858 - RNA, 19 nt, Human
uaacauaagcuagaaaaau

SEQ ID NO: 2740859 - RNA, 15 nt, Human
uaacauagguuuuua

SEQ ID NO: 2740860 - RNA, 20 nt, Human
uaacaucugagaaaagcuuu

SEQ ID NO: 2740861 - RNA, 14 nt, Human
uaacaugaauauuu

SEQ ID NO: 2740862 - RNA, 21 nt, Human
uaacaugauuuggggaaagga

SEQ ID NO: 2740863 - RNA, 14 nt, Human
uaacauuauuuaua

SEQ ID NO: 2740864 - RNA, 16 nt, Human
uaacauuauuuauaug

SEQ ID NO: 2740865 - RNA, 20 nt, Human
uaaccaggggccaugaauca

SEQ ID NO: 2740866 - RNA, 12 nt, Human
uaacccuggaaa

SEQ ID NO: 2740867 - RNA, 14 nt, Human
uaaccucuaaauuc

SEQ ID NO: 2740868 - RNA, 19 nt, Human
uaaccucuaaauucuuuca

SEQ ID NO: 2740869 - RNA, 13 nt, Human
uaacgauaaaaga

SEQ ID NO: 2740870 - RNA, 18 nt, Human
uaacguuuucauuaaaau

SEQ ID NO: 2740871 - RNA, 23 nt, Human
uaacuaaaguuagaaaguugauu

SEQ ID NO: 2740872 - RNA, 14 nt, Human
uaacuaauuuuaac

SEQ ID NO: 2740873 - RNA, 15 nt, Human
uaacuaauuuuaacu

SEQ ID NO: 2740874 - RNA, 13 nt, Human
uaacuaucgaaau

SEQ ID NO: 2740875 - RNA, 14 nt, Human
uaacucagaaacau

SEQ ID NO: 2740876 - RNA, 17 nt, Human
uaacugauuuguaacaa

SEQ ID NO: 2740877 - RNA, 17 nt, Human
uaacugcauugagaacu

SEQ ID NO: 2740878 - RNA, 13 nt, Human
uaacuggaaacuu

SEQ ID NO: 2740879 - RNA, 16 nt, Human
uaacuggaaacuucag

SEQ ID NO: 2740880 - RNA, 20 nt, Human
uaacuggagccccaucagcu

SEQ ID NO: 2740881 - RNA, 18 nt, Human
uaacuggcaguuuuccau

SEQ ID NO: 2740882 - RNA, 23 nt, Human
uaacuuuuuuuuaaguuacacau

SEQ ID NO: 2740883 - RNA, 14 nt, Human
uaagaaagaacacg

SEQ ID NO: 2740884 - RNA, 16 nt, Human
uaagaaauaggaaaua

SEQ ID NO: 2740885 - RNA, 17 nt, Human
uaagaaauaggaaauau

SEQ ID NO: 2740886 - RNA, 16 nt, Human
uaagaaauaugcacaa

SEQ ID NO: 2740887 - RNA, 12 nt, Human
uaagaagacugc

SEQ ID NO: 2740888 - RNA, 13 nt, Human
uaagaagugaaaa

SEQ ID NO: 2740889 - RNA, 22 nt, Human
uaagaagugaaaaucuacacuc

SEQ ID NO: 2740890 - RNA, 13 nt, Human
uaagacaaauaug

SEQ ID NO: 2740891 - RNA, 22 nt, Human
uaagacaaauauguucugacau

SEQ ID NO: 2740892 - RNA, 22 nt, Human
uaagacacccccucaaacccau

SEQ ID NO: 2740893 - RNA, 13 nt, Human
uaagacgaaacau

SEQ ID NO: 2740894 - RNA, 16 nt, Human
uacacacucaaaucaa

SEQ ID NO: 2740895 - RNA, 16 nt, Human
uacacagaucacagcu

SEQ ID NO: 2740896 - RNA, 19 nt, Human
uacacauacauguaaaaua

SEQ ID NO: 2740897 - RNA, 20 nt, Human
uacacauguaucuaugcauu

SEQ ID NO: 2740898 - RNA, 14 nt, Human
uacacauuuuucag

SEQ ID NO: 2740899 - RNA, 22 nt, Human
uacacauuuuucagauauaaaa

SEQ ID NO: 2740900 - RNA, 13 nt, Human
uacaccccaacag

SEQ ID NO: 2740901 - RNA, 18 nt, Human
uacaccccaacagcaccc

SEQ ID NO: 2740902 - RNA, 19 nt, Human
uacaccccaacagcacccu

SEQ ID NO: 2740903 - RNA, 20 nt, Human
uacaccccuccccugcccua

SEQ ID NO: 2740904 - RNA, 19 nt, Human
uacacuccagugagacagc

SEQ ID NO: 2740905 - RNA, 16 nt, Human
uacacuggaugaaaau

SEQ ID NO: 2740906 - RNA, 18 nt, Human
uacacuggaugaaaaugu

SEQ ID NO: 2740907 - RNA, 19 nt, Human
uacacuggaugaaaauguu

SEQ ID NO: 2740908 - RNA, 13 nt, Human
uacacuuuuuaaa

SEQ ID NO: 2740909 - RNA, 15 nt, Human
uacagaacuaaaaau

SEQ ID NO: 2740910 - RNA, 13 nt, Human
uacagacuuuuuu

SEQ ID NO: 2740911 - RNA, 18 nt, Human
uacagagaaaagacauaa

SEQ ID NO: 2740912 - RNA, 20 nt, Human
uacagauccccaagccuggc

SEQ ID NO: 2740913 - RNA, 23 nt, Human
uacagcucagaaguuucuucuuu

SEQ ID NO: 2740914 - RNA, 14 nt, Human
uacaggcgugagcc

SEQ ID NO: 2740915 - RNA, 23 nt, Human
uacaggcgugagccaccaaaccc

SEQ ID NO: 2740916 - RNA, 18 nt, Human
uacagggaugaggcagac

SEQ ID NO: 2740917 - RNA, 16 nt, Human
uacagggcauuuuggu

SEQ ID NO: 2740918 - RNA, 22 nt, Human
uacagguccugcugaaacugcc

SEQ ID NO: 2740919 - RNA, 13 nt, Human
uacagugagccaa

SEQ ID NO: 2740920 - RNA, 16 nt, Human
uacagugagccaagag

SEQ ID NO: 2740921 - RNA, 20 nt, Human
uacaguuagagauuuuuaaa

SEQ ID NO: 2740922 - RNA, 16 nt, Human
uacaguucucccaagg

SEQ ID NO: 2740923 - RNA, 22 nt, Human
uacaguuuaccgaaaaucauau

SEQ ID NO: 2740924 - RNA, 14 nt, Human
uacauaaauuuagu

SEQ ID NO: 2740925 - RNA, 21 nt, Human
uacauaagggaggaaaaaaaa

SEQ ID NO: 2740926 - RNA, 22 nt, Human
uacauaagggaggaaaaaaaau

SEQ ID NO: 2740927 - RNA, 17 nt, Human
uacauacaugcauacac

SEQ ID NO: 2740928 - RNA, 12 nt, Human
uacauacugcug

SEQ ID NO: 2740929 - RNA, 18 nt, Human
uacauacugcugucuaug

SEQ ID NO: 2740930 - RNA, 21 nt, Human
uacauauugucacugacacac

SEQ ID NO: 2740931 - RNA, 20 nt, Human
uacaucccuuaccugggaaa

SEQ ID NO: 2740932 - RNA, 12 nt, Human
uacaucuuucac

SEQ ID NO: 2740933 - RNA, 21 nt, Human
uacaugagguacugagaguga

SEQ ID NO: 2740934 - RNA, 22 nt, Human
uacaugagguacugagagugaa

SEQ ID NO: 2740935 - RNA, 14 nt, Human
uacaugauucauuu

SEQ ID NO: 2740936 - RNA, 15 nt, Human
uacaugauucauuuu

SEQ ID NO: 2740937 - RNA, 17 nt, Human
uacauggaagaccucau

SEQ ID NO: 2740938 - RNA, 14 nt, Human
uacauguaaaauau

SEQ ID NO: 2740939 - RNA, 14 nt, Human
uacaugucuagaga

SEQ ID NO: 2740940 - RNA, 13 nt, Human
uacauguuuucuu

SEQ ID NO: 2740941 - RNA, 14 nt, Human
uacauucuuaaagu

SEQ ID NO: 2740942 - RNA, 23 nt, Human
uacauuguuugucugucuucaua

SEQ ID NO: 2740943 - RNA, 16 nt, Human
uacauuuccaaauuca

SEQ ID NO: 2740944 - RNA, 19 nt, Human
uacauuuccuaaauauauu

SEQ ID NO: 2740945 - RNA, 16 nt, Human
uacauuuguauaaaau

SEQ ID NO: 2740946 - RNA, 17 nt, Human
uacauuuuaaacacauu

SEQ ID NO: 2740947 - RNA, 18 nt, Human
uacauuuuaaacacauua

SEQ ID NO: 2740948 - RNA, 16 nt, Human
uacauuuucuaagaaa

SEQ ID NO: 2740949 - RNA, 21 nt, Human
uaccaaucauuuuaauuauua

SEQ ID NO: 2740950 - RNA, 12 nt, Human
uaccacaggaac

SEQ ID NO: 2740951 - RNA, 18 nt, Human
uaccacaggaaccacaag

SEQ ID NO: 2740952 - RNA, 16 nt, Human
uaccacucagagaaac

SEQ ID NO: 2740953 - RNA, 20 nt, Human
uaccagcccuacaccauucc

SEQ ID NO: 2740954 - RNA, 13 nt, Human
uaccaguuuuccu

SEQ ID NO: 2740955 - RNA, 15 nt, Human
uacccaguagaugcc

SEQ ID NO: 2740956 - RNA, 16 nt, Human
uacccaguagaugcca

SEQ ID NO: 2740957 - RNA, 18 nt, Human
uacccaguagaugccacu

SEQ ID NO: 2740958 - RNA, 16 nt, Human
uaccccuggccaagga

SEQ ID NO: 2740959 - RNA, 19 nt, Human
uaccccuggccaaggaaga

SEQ ID NO: 2740960 - RNA, 15 nt, Human
uacccucauuucuca

SEQ ID NO: 2740961 - RNA, 16 nt, Human
uacccucauuucucau

SEQ ID NO: 2740962 - RNA, 20 nt, Human
uacccucauuucucaucuuu

SEQ ID NO: 2740963 - RNA, 17 nt, Human
uaccguguaccucaguu

SEQ ID NO: 2740964 - RNA, 17 nt, Human
uaccuaccaagauauac

SEQ ID NO: 2740965 - RNA, 15 nt, Human
uaccuaguccccagc

SEQ ID NO: 2740966 - RNA, 19 nt, Human
uaccuaguccccagccugc

SEQ ID NO: 2740967 - RNA, 17 nt, Human
uaccucaguucccucuu

SEQ ID NO: 2740968 - RNA, 12 nt, Human
uaccuccaagga

SEQ ID NO: 2740969 - RNA, 13 nt, Human
uaccuccaaggac

SEQ ID NO: 2740970 - RNA, 18 nt, Human
uaccucugccucagaaaa

SEQ ID NO: 2740971 - RNA, 21 nt, Human
uaccucugccucagaaaacaa

SEQ ID NO: 2740972 - RNA, 15 nt, Human
uaccucugcuauuug

SEQ ID NO: 2740973 - RNA, 22 nt, Human
uaccucugcuauuugcuguuau

SEQ ID NO: 2740974 - RNA, 22 nt, Human
uaccugcucagcccugcaccau

SEQ ID NO: 2740975 - RNA, 23 nt, Human
uaccuguaacuugaagguggcua

SEQ ID NO: 2740976 - RNA, 19 nt, Human
uaccuguuaguauuauugu

SEQ ID NO: 2740977 - RNA, 17 nt, Human
uaccuguucgcgcgccu

SEQ ID NO: 2740978 - RNA, 12 nt, Human
uaccuuccccac

SEQ ID NO: 2740979 - RNA, 17 nt, Human
uaccuugaacacugggg

SEQ ID NO: 2740980 - RNA, 16 nt, Human
uaccuuugacaaaggu

SEQ ID NO: 2740981 - RNA, 13 nt, Human
uaccuuuuuccuu

SEQ ID NO: 2740982 - RNA, 14 nt, Human
uaccuuuuuccuuc

SEQ ID NO: 2740983 - RNA, 15 nt, Human
uaccuuuuuccuucc

SEQ ID NO: 2740984 - RNA, 13 nt, Human
uaccuuuuuucuu

SEQ ID NO: 2740985 - RNA, 16 nt, Human
uacgcgcgcuccgcgc

SEQ ID NO: 2740986 - RNA, 17 nt, Human
uacgcucauuguagaaa

SEQ ID NO: 2740987 - RNA, 11 nt, Human
uacgugcaaua

SEQ ID NO: 2740988 - RNA, 14 nt, Human
uacguuaggaggac

SEQ ID NO: 2740989 - RNA, 15 nt, Human
uacuaaaaauacaaa

SEQ ID NO: 2740990 - RNA, 12 nt, Human
uacuaauaaaau

SEQ ID NO: 2740991 - RNA, 13 nt, Human
uacuaauaaaaua

SEQ ID NO: 2740992 - RNA, 15 nt, Human
uacuaauaaaauaca

SEQ ID NO: 2740993 - RNA, 14 nt, Human
uacuaauuuuaaaa

SEQ ID NO: 2740994 - RNA, 17 nt, Human
uacuacugaaucucuaa

SEQ ID NO: 2740995 - RNA, 15 nt, Human
uacuagaaaauugug

SEQ ID NO: 2740996 - RNA, 23 nt, Human
uacuagagcaagcaggaaucaga

SEQ ID NO: 2740997 - RNA, 22 nt, Human
uacuagggaaaugccuuuguac

SEQ ID NO: 2740998 - RNA, 18 nt, Human
uacuaguuucccuugcau

SEQ ID NO: 2740999 - RNA, 13 nt, Human
uacuauauuuaug

SEQ ID NO: 2741000 - RNA, 19 nt, Human
uacuauccaacuuauauuu

SEQ ID NO: 2741001 - RNA, 16 nt, Human
uacuaugcacaacaga

SEQ ID NO: 2741002 - RNA, 14 nt, Human
uacuaugcuguuau

SEQ ID NO: 2741003 - RNA, 19 nt, Human
uacuauuauccccauuucu

SEQ ID NO: 2741004 - RNA, 19 nt, Human
uacuauuuaauuauuucac

SEQ ID NO: 2741005 - RNA, 17 nt, Human
uacuauuuauugcugaa

SEQ ID NO: 2741006 - RNA, 19 nt, Human
uacuccccuccuugaacua

SEQ ID NO: 2741007 - RNA, 17 nt, Human
uacucucaccauuugga

SEQ ID NO: 2741008 - RNA, 13 nt, Human
uacucuuauaucu

SEQ ID NO: 2741009 - RNA, 20 nt, Human
uacugagagugaacaaauuu

SEQ ID NO: 2741010 - RNA, 17 nt, Human
uacugaggaucagagua

SEQ ID NO: 2741011 - RNA, 13 nt, Human
uacugauuuuuaa

SEQ ID NO: 2741012 - RNA, 13 nt, Human
uacugccuauuuu

SEQ ID NO: 2741013 - RNA, 16 nt, Human
uacuggaaggcuucca

SEQ ID NO: 2741014 - RNA, 19 nt, Human
uacuggaaggcuuccacua

SEQ ID NO: 2741015 - RNA, 15 nt, Human
uacuguaagaaaaua

SEQ ID NO: 2741016 - RNA, 22 nt, Human
uacuguaaggcaaucauggugc

SEQ ID NO: 2741017 - RNA, 22 nt, Human
uacuguacagacagaaaaaacu

SEQ ID NO: 2741018 - RNA, 18 nt, Human
uacuguagcaaccugaaa

SEQ ID NO: 2741019 - RNA, 14 nt, Human
uacuguauuuuuac

SEQ ID NO: 2741020 - RNA, 23 nt, Human
uacuguauuuuuaccuuuuuccu

SEQ ID NO: 2741021 - RNA, 16 nt, Human
uacugugcccagagcc

SEQ ID NO: 2741022 - RNA, 15 nt, Human
uacuuacaugcauua

SEQ ID NO: 2741023 - RNA, 17 nt, Human
uacuuacaugcauuacu

SEQ ID NO: 2741024 - RNA, 13 nt, Human
uacuucaaacuga

SEQ ID NO: 2741025 - RNA, 19 nt, Human
uacuucauuuaaaauauuu

SEQ ID NO: 2741026 - RNA, 19 nt, Human
uacuucuuaggguuaugau

SEQ ID NO: 2741027 - RNA, 20 nt, Human
uacuucuucucauacuauuu

SEQ ID NO: 2741028 - RNA, 15 nt, Human
uacuucuugaagccg

SEQ ID NO: 2741029 - RNA, 18 nt, Human
uacuuuauuuucuauaau

SEQ ID NO: 2741030 - RNA, 14 nt, Human
uacuuuguccuuuu

SEQ ID NO: 2741031 - RNA, 14 nt, Human
uacuuugugcauuc

SEQ ID NO: 2741032 - RNA, 16 nt, Human
uacuuuguuauuuuuc

SEQ ID NO: 2741033 - RNA, 14 nt, Human
uacuuuucuucuau

SEQ ID NO: 2741034 - RNA, 20 nt, Human
uacuuuuggcauuuuacugu

SEQ ID NO: 2741035 - RNA, 18 nt, Human
uacuuuuuucauuauugg

SEQ ID NO: 2741036 - RNA, 19 nt, Human
uagaaaaagcaguaacuga

SEQ ID NO: 2741037 - RNA, 16 nt, Human
uagaaaacaggcaaau

SEQ ID NO: 2741038 - RNA, 16 nt, Human
uagaaaagcuauaaaa

SEQ ID NO: 2741039 - RNA, 21 nt, Human
uagaaaagggaacugaacauu

SEQ ID NO: 2741040 - RNA, 15 nt, Human
uauaaauggaauuac

SEQ ID NO: 2741041 - RNA, 20 nt, Human
uauaaauuuaucauuuaguu

SEQ ID NO: 2741042 - RNA, 21 nt, Human
uauaaauuuaucauuuaguua

SEQ ID NO: 2741043 - RNA, 14 nt, Human
uauaaauuuuccca

SEQ ID NO: 2741044 - RNA, 12 nt, Human
uauaacaacaac

SEQ ID NO: 2741045 - RNA, 18 nt, Human
uauaacaaugcuguauuu

SEQ ID NO: 2741046 - RNA, 19 nt, Human
uauaacaaugcuguauuuu

SEQ ID NO: 2741047 - RNA, 10 nt, Human
uauaacucau

SEQ ID NO: 2741048 - RNA, 14 nt, Human
uauaacucaucaua

SEQ ID NO: 2741049 - RNA, 22 nt, Human
uauaagaaauaggaaauauuuu

SEQ ID NO: 2741050 - RNA, 17 nt, Human
uauaagcuguuuuuaua

SEQ ID NO: 2741051 - RNA, 20 nt, Human
uauaagcuuguauuccuuuu

SEQ ID NO: 2741052 - RNA, 15 nt, Human
uauaagcuuuucuuu

SEQ ID NO: 2741053 - RNA, 19 nt, Human
uauaaguguguguuuuuca

SEQ ID NO: 2741054 - RNA, 23 nt, Human
uauaaguguguguuuuucauaaa

SEQ ID NO: 2741055 - RNA, 14 nt, Human
uauaauaugcacac

SEQ ID NO: 2741056 - RNA, 16 nt, Human
uauaauauuuuuaaua

SEQ ID NO: 2741057 - RNA, 17 nt, Human
uauaauauuuuuaauau

SEQ ID NO: 2741058 - RNA, 17 nt, Human
uauaaucaagccuaaaa

SEQ ID NO: 2741059 - RNA, 18 nt, Human
uauaaucauuauuacuuu

SEQ ID NO: 2741060 - RNA, 18 nt, Human
uauaaucauuuaucauau

SEQ ID NO: 2741061 - RNA, 14 nt, Human
uauaaucuuuuaua

SEQ ID NO: 2741062 - RNA, 14 nt, Human
uauaauguaaacaa

SEQ ID NO: 2741063 - RNA, 15 nt, Human
uauaauguaaacaau

SEQ ID NO: 2741064 - RNA, 16 nt, Human
uauaauguaaacaaua

SEQ ID NO: 2741065 - RNA, 17 nt, Human
uauaaugucccuucaca

SEQ ID NO: 2741066 - RNA, 23 nt, Human
uauaauucuuaugccauauaauu

SEQ ID NO: 2741067 - RNA, 12 nt, Human
uauaauuuaaaa

SEQ ID NO: 2741068 - RNA, 13 nt, Human
uauaauuuaaaau

SEQ ID NO: 2741069 - RNA, 16 nt, Human
uauaauuuuaaauguu

SEQ ID NO: 2741070 - RNA, 23 nt, Human
uauaauuuugugaagcaaaauuu

SEQ ID NO: 2741071 - RNA, 15 nt, Human
uauaauuuuuuucaa

SEQ ID NO: 2741072 - RNA, 17 nt, Human
uauaauuuuuuucaaua

SEQ ID NO: 2741073 - RNA, 19 nt, Human
uauaauuuuuuucaauauu

SEQ ID NO: 2741074 - RNA, 22 nt, Human
uauacaguuuaccgaaaaucau

SEQ ID NO: 2741075 - RNA, 16 nt, Human
uauacauacaugcaua

SEQ ID NO: 2741076 - RNA, 20 nt, Human
uauaccucacuuuacacaau

SEQ ID NO: 2741077 - RNA, 23 nt, Human
uauaccugauauauuccaccagg

SEQ ID NO: 2741078 - RNA, 20 nt, Human
uauacuguauuuuuaccuuu

SEQ ID NO: 2741079 - RNA, 20 nt, Human
uauacugugugcuaaaacaa

SEQ ID NO: 2741080 - RNA, 21 nt, Human
uauacugugugcuaaaacaag

SEQ ID NO: 2741081 - RNA, 22 nt, Human
uauacuuguggacuaaaagaua

SEQ ID NO: 2741082 - RNA, 18 nt, Human
uauacuuuaauaaaugua

SEQ ID NO: 2741083 - RNA, 19 nt, Human
uauagaaauguauucuuuu

SEQ ID NO: 2741084 - RNA, 23 nt, Human
uauagaaauguauucuuuuaguu

SEQ ID NO: 2741085 - RNA, 13 nt, Human
uauagaauauuua

SEQ ID NO: 2741086 - RNA, 18 nt, Human
uauaggauguggggaagu

SEQ ID NO: 2741087 - RNA, 17 nt, Human
uauaggugcuacaaaaa

SEQ ID NO: 2741088 - RNA, 19 nt, Human
uauaggugcuacaaaaaca

SEQ ID NO: 2741089 - RNA, 23 nt, Human
uauagguugauggugguauguuu

SEQ ID NO: 2741090 - RNA, 20 nt, Human
uauaguuacccaaauuaaga

SEQ ID NO: 2741091 - RNA, 23 nt, Human
uauaguucuacuccauuaaauau

SEQ ID NO: 2741092 - RNA, 16 nt, Human
uauauaaauuuuccca

SEQ ID NO: 2741093 - RNA, 17 nt, Human
uauauauacauauauau

SEQ ID NO: 2741094 - RNA, 17 nt, Human
uauauaucaaauauauu

SEQ ID NO: 2741095 - RNA, 21 nt, Human
uauauauguauuuauaaauau

SEQ ID NO: 2741096 - RNA, 17 nt, Human
uauauauuuuuuucuga

SEQ ID NO: 2741097 - RNA, 19 nt, Human
uauaucaguccucuuucaa

SEQ ID NO: 2741098 - RNA, 15 nt, Human
uauauccacuaaaau

SEQ ID NO: 2741099 - RNA, 14 nt, Human
uauaucuauauuuu

SEQ ID NO: 2741100 - RNA, 23 nt, Human
uauaugugaaauaaaaguagaau

SEQ ID NO: 2741101 - RNA, 20 nt, Human
uauauguguuuuucacauuu

SEQ ID NO: 2741102 - RNA, 15 nt, Human
uauauuguagauaau

SEQ ID NO: 2741103 - RNA, 14 nt, Human
uauauuuauaacuc

SEQ ID NO: 2741104 - RNA, 14 nt, Human
uauauuuccuuauu

SEQ ID NO: 2741105 - RNA, 18 nt, Human
uauauuuccuuauucaga

SEQ ID NO: 2741106 - RNA, 15 nt, Human
uauauuuuaaauauu

SEQ ID NO: 2741107 - RNA, 14 nt, Human
uauauuuuacauaa

SEQ ID NO: 2741108 - RNA, 13 nt, Human
uauauuuuuagac

SEQ ID NO: 2741109 - RNA, 19 nt, Human
uauauuuuugugauuuugu

SEQ ID NO: 2741110 - RNA, 21 nt, Human
uauauuuuuuguuaaaugauu

SEQ ID NO: 2741111 - RNA, 22 nt, Human
uaucaaaacuuucuuuucugga

SEQ ID NO: 2741112 - RNA, 15 nt, Human
uaucaaaagaaagaa

SEQ ID NO: 2741113 - RNA, 21 nt, Human
uaucaaaagaaagaaaaucag

SEQ ID NO: 2741114 - RNA, 22 nt, Human
uaucaaacugaagccagaaaua

SEQ ID NO: 2741115 - RNA, 12 nt, Human
uaucaccacugg

SEQ ID NO: 2741116 - RNA, 17 nt, Human
uaucaguuauuuuuaaa

SEQ ID NO: 2741117 - RNA, 16 nt, Human
uaucauauauauacau

SEQ ID NO: 2741118 - RNA, 12 nt, Human
uaucaugugaaa

SEQ ID NO: 2741119 - RNA, 14 nt, Human
uaucauuuucaaaa

SEQ ID NO: 2741120 - RNA, 23 nt, Human
uauccaccugccuuggcuuccca

SEQ ID NO: 2741121 - RNA, 18 nt, Human
uaucccaaccucucccaa

SEQ ID NO: 2741122 - RNA, 15 nt, Human
uauccuaauaaaaag

SEQ ID NO: 2741123 - RNA, 16 nt, Human
uauccuacuuccccuu

SEQ ID NO: 2741124 - RNA, 15 nt, Human
uauccuaucucucca

SEQ ID NO: 2741125 - RNA, 17 nt, Human
uauccuaucucuccaac

SEQ ID NO: 2741126 - RNA, 16 nt, Human
uauccucccuccagau

SEQ ID NO: 2741127 - RNA, 15 nt, Human
uauccuucagccuga

SEQ ID NO: 2741128 - RNA, 16 nt, Human
uauccuucagccugaa

SEQ ID NO: 2741129 - RNA, 15 nt, Human
uaucgauuuuuaaaa

SEQ ID NO: 2741130 - RNA, 18 nt, Human
uaucgccaucacagcuga

SEQ ID NO: 2741131 - RNA, 19 nt, Human
uaucguuagugcuagugga

SEQ ID NO: 2741132 - RNA, 17 nt, Human
uaucuaguuuaauuaau

SEQ ID NO: 2741133 - RNA, 17 nt, Human
uaucuaugcauuuucug

SEQ ID NO: 2741134 - RNA, 22 nt, Human
uaucuauguagaauauauuucc

SEQ ID NO: 2741135 - RNA, 13 nt, Human
uaucuauuaauau

SEQ ID NO: 2741136 - RNA, 17 nt, Human
uaucuauuaauauaugu

SEQ ID NO: 2741137 - RNA, 17 nt, Human
uaucuauuuaaauauuu

SEQ ID NO: 2741138 - RNA, 13 nt, Human
uaucucacacuca

SEQ ID NO: 2741139 - RNA, 16 nt, Human
uaucucaucucuucuu

SEQ ID NO: 2741140 - RNA, 20 nt, Human
uaucuccgucaacucauauu

SEQ ID NO: 2741141 - RNA, 20 nt, Human
uaucucuaaagaaaaucucu

SEQ ID NO: 2741142 - RNA, 12 nt, Human
uaucuuauucac

SEQ ID NO: 2741143 - RNA, 15 nt, Human
uaucuucacuuuuau

SEQ ID NO: 2741144 - RNA, 20 nt, Human
uaucuucacuuuuauaagaa

SEQ ID NO: 2741145 - RNA, 21 nt, Human
uaucuuccuauaauuuuagac

SEQ ID NO: 2741146 - RNA, 14 nt, Human
uaucuuguuuuggu

SEQ ID NO: 2741147 - RNA, 14 nt, Human
uaucuuguuuuucc

SEQ ID NO: 2741148 - RNA, 20 nt, Human
uaucuuguuuuuccacuacu

SEQ ID NO: 2741149 - RNA, 16 nt, Human
uaucuuuucauacauu

SEQ ID NO: 2741150 - RNA, 20 nt, Human
uaucuuuucauacauuuucu

SEQ ID NO: 2741151 - RNA, 15 nt, Human
uaucuuuuuauucag

SEQ ID NO: 2741152 - RNA, 13 nt, Human
uaugaaauauuau

SEQ ID NO: 2741153 - RNA, 22 nt, Human
uaugaaccaccgcgcccagccu

SEQ ID NO: 2741154 - RNA, 23 nt, Human
uaugacaggauguuugcucagcu

SEQ ID NO: 2741155 - RNA, 15 nt, Human
uaugacgugacuggc

SEQ ID NO: 2741156 - RNA, 18 nt, Human
uaugagauagguacuauu

SEQ ID NO: 2741157 - RNA, 18 nt, Human
uaugaggcuacagaacua

SEQ ID NO: 2741158 - RNA, 23 nt, Human
uaugaggcuguugucuuuuccuu

SEQ ID NO: 2741159 - RNA, 22 nt, Human
uaugauguacauguacugauua

SEQ ID NO: 2741160 - RNA, 15 nt, Human
uaugcaaagcacuga

SEQ ID NO: 2741161 - RNA, 14 nt, Human
uaugcauacaguaa

SEQ ID NO: 2741162 - RNA, 20 nt, Human
uaugcauauuauuuuauguu

SEQ ID NO: 2741163 - RNA, 17 nt, Human
uaugccacaagaacccc

SEQ ID NO: 2741164 - RNA, 15 nt, Human
uaugccuuuucccaa

SEQ ID NO: 2741165 - RNA, 21 nt, Human
uaugccuuuucccaacuccag

SEQ ID NO: 2741166 - RNA, 17 nt, Human
uaugcuauugaaguuuu

SEQ ID NO: 2741167 - RNA, 20 nt, Human
uaugcuauuuauuaaguauu

SEQ ID NO: 2741168 - RNA, 21 nt, Human
uauggaaaaaaaggaagaaau

SEQ ID NO: 2741169 - RNA, 17 nt, Human
uauggcacuaguauuuc

SEQ ID NO: 2741170 - RNA, 14 nt, Human
uaugggacauuuuu

SEQ ID NO: 2741171 - RNA, 17 nt, Human
uauggggaaaaaacugu

SEQ ID NO: 2741172 - RNA, 17 nt, Human
uaugguuguauuauuuu

SEQ ID NO: 2741173 - RNA, 14 nt, Human
uauguagaaaaaag

SEQ ID NO: 2741174 - RNA, 14 nt, Human
uauguagaauauau

SEQ ID NO: 2741175 - RNA, 14 nt, Human
uauguauauuuuau

SEQ ID NO: 2741176 - RNA, 16 nt, Human
uauguauuauuuauaa

SEQ ID NO: 2741177 - RNA, 15 nt, Human
uauguauuuauaaau

SEQ ID NO: 2741178 - RNA, 18 nt, Human
uauguauuuauaaauaua

SEQ ID NO: 2741179 - RNA, 18 nt, Human
uaugucauuucauuuccu

SEQ ID NO: 2741180 - RNA, 24 nt, Human
uaugucauuugcuggagcucugcc

SEQ ID NO: 2741181 - RNA, 20 nt, Human
uauguccuuggugccuggag

SEQ ID NO: 2741182 - RNA, 20 nt, Human
uauguccuuuuuaaugugua

SEQ ID NO: 2741183 - RNA, 13 nt, Human
uaugucuuuuacc

SEQ ID NO: 2741184 - RNA, 23 nt, Human
ucaaaggcauuucuuuucugcau

SEQ ID NO: 2741185 - RNA, 12 nt, Human
ucaaauaaaucu

SEQ ID NO: 2741186 - RNA, 14 nt, Human
ucaaauaaaucucu

SEQ ID NO: 2741187 - RNA, 16 nt, Human
ucaaauaaguauuuau

SEQ ID NO: 2741188 - RNA, 20 nt, Human
ucaaauaugcaaagcacuga

SEQ ID NO: 2741189 - RNA, 13 nt, Human
ucaaaugauuuuc

SEQ ID NO: 2741190 - RNA, 16 nt, Human
ucaaauguauuacagu

SEQ ID NO: 2741191 - RNA, 18 nt, Human
ucaaauuccagaaugauu

SEQ ID NO: 2741192 - RNA, 21 nt, Human
ucaaauuccagaaugauuuua

SEQ ID NO: 2741193 - RNA, 13 nt, Human
ucaacaauaguga

SEQ ID NO: 2741194 - RNA, 15 nt, Human
ucaacacuaacauga

SEQ ID NO: 2741195 - RNA, 13 nt, Human
ucaacagauaaau

SEQ ID NO: 2741196 - RNA, 12 nt, Human
ucaacaugguga

SEQ ID NO: 2741197 - RNA, 19 nt, Human
ucaacauggugaaaccccg

SEQ ID NO: 2741198 - RNA, 19 nt, Human
ucaaccucccaagcaguug

SEQ ID NO: 2741199 - RNA, 17 nt, Human
ucaaccucuuccccgcc

SEQ ID NO: 2741200 - RNA, 14 nt, Human
ucaacucauauuuu

SEQ ID NO: 2741201 - RNA, 23 nt, Human
ucaacucccugccccccagcccu

SEQ ID NO: 2741202 - RNA, 18 nt, Human
ucaacuuuuccuuugaau

SEQ ID NO: 2741203 - RNA, 12 nt, Human
ucaagaagcauc

SEQ ID NO: 2741204 - RNA, 18 nt, Human
ucaagacugcaaacccuu

SEQ ID NO: 2741205 - RNA, 23 nt, Human
ucaagacugcaaacccuuucaua

SEQ ID NO: 2741206 - RNA, 15 nt, Human
ucaagaucagccugg

SEQ ID NO: 2741207 - RNA, 17 nt, Human
ucaagcaauccucccac

SEQ ID NO: 2741208 - RNA, 23 nt, Human
ucaagccuaaaauuguauagacc

SEQ ID NO: 2741209 - RNA, 14 nt, Human
ucaagccugccuca

SEQ ID NO: 2741210 - RNA, 21 nt, Human
ucaagcgauucuccugccuca

SEQ ID NO: 2741211 - RNA, 13 nt, Human
ucaagcugcaucu

SEQ ID NO: 2741212 - RNA, 18 nt, Human
ucaagggcuggcacuuuu

SEQ ID NO: 2741213 - RNA, 18 nt, Human
ucaaggguacacugccuu

SEQ ID NO: 2741214 - RNA, 21 nt, Human
ucaaggguacacugccuucuc

SEQ ID NO: 2741215 - RNA, 18 nt, Human
ucaagggugugugcagca

SEQ ID NO: 2741216 - RNA, 16 nt, Human
ucaaguauaauauuaa

SEQ ID NO: 2741217 - RNA, 18 nt, Human
ucaagucagcucuucucc

SEQ ID NO: 2741218 - RNA, 14 nt, Human
ucaaguccugcaag

SEQ ID NO: 2741219 - RNA, 21 nt, Human
ucaagucuuucacauuuaaau

SEQ ID NO: 2741220 - RNA, 21 nt, Human
ucaagugcuucuccagccuca

SEQ ID NO: 2741221 - RNA, 12 nt, Human
ucaauaaaacuu

SEQ ID NO: 2741222 - RNA, 20 nt, Human
ucaauaaaauccauacauuu

SEQ ID NO: 2741223 - RNA, 22 nt, Human
ucaauaaaauccauacauuugu

SEQ ID NO: 2741224 - RNA, 23 nt, Human
ucaauaaaauccauacauuugug

SEQ ID NO: 2741225 - RNA, 21 nt, Human
ucaauaaguuuauuucuuaaa

SEQ ID NO: 2741226 - RNA, 18 nt, Human
ucaauacuucauuuaaaa

SEQ ID NO: 2741227 - RNA, 23 nt, Human
ucaauaucuaauauauaugaaua

SEQ ID NO: 2741228 - RNA, 14 nt, Human
ucaauauuuauuau

SEQ ID NO: 2741229 - RNA, 23 nt, Human
ucaauauuuauuauuuucaccug

SEQ ID NO: 2741230 - RNA, 14 nt, Human
ucaauauuucagau

SEQ ID NO: 2741231 - RNA, 23 nt, Human
ucaaucaaauaaguauuuauaau

SEQ ID NO: 2741232 - RNA, 18 nt, Human
ucaaucagccuaguugau

SEQ ID NO: 2741233 - RNA, 19 nt, Human
ucaaucagccuaguugauc

SEQ ID NO: 2741234 - RNA, 17 nt, Human
ucaauccaagaacuuau

SEQ ID NO: 2741235 - RNA, 20 nt, Human
ucaaucuguccguucacaug

SEQ ID NO: 2741236 - RNA, 21 nt, Human
ucaaucuuaucauauuucaaa

SEQ ID NO: 2741237 - RNA, 14 nt, Human
ucaaugcagccccc

SEQ ID NO: 2741238 - RNA, 15 nt, Human
ucaauuaccuucuau

SEQ ID NO: 2741239 - RNA, 19 nt, Human
ucaauucuugccaaauaua

SEQ ID NO: 2741240 - RNA, 18 nt, Human
ucacaaaaguauauucaa

SEQ ID NO: 2741241 - RNA, 15 nt, Human
ucacaaacucaucca

SEQ ID NO: 2741242 - RNA, 19 nt, Human
ucacaagacccaaaaggca

SEQ ID NO: 2741243 - RNA, 22 nt, Human
ucacaagacccaaaaggcagaa

SEQ ID NO: 2741244 - RNA, 17 nt, Human
ucacaagugaaaaacau

SEQ ID NO: 2741245 - RNA, 19 nt, Human
ucacaagugaaaaacaucc

SEQ ID NO: 2741246 - RNA, 12 nt, Human
ucacaauaauuu

SEQ ID NO: 2741247 - RNA, 14 nt, Human
ucacaauaauuuuc

SEQ ID NO: 2741248 - RNA, 18 nt, Human
ucacagaagaaggaaauu

SEQ ID NO: 2741249 - RNA, 15 nt, Human
ucacagaucuuucug

SEQ ID NO: 2741250 - RNA, 15 nt, Human
ucacagcuacacaga

SEQ ID NO: 2741251 - RNA, 23 nt, Human
ucacagcuacacagaucacagcu

SEQ ID NO: 2741252 - RNA, 18 nt, Human
ucacagcuucagccagga

SEQ ID NO: 2741253 - RNA, 15 nt, Human
ucacaggacagcccu

SEQ ID NO: 2741254 - RNA, 19 nt, Human
ucacaggacagcccuucuu

SEQ ID NO: 2741255 - RNA, 21 nt, Human
ucacaggagcuuaaacagcug

SEQ ID NO: 2741256 - RNA, 16 nt, Human
ucacagggccugggga

SEQ ID NO: 2741257 - RNA, 18 nt, Human
ucacagguagacaguaua

SEQ ID NO: 2741258 - RNA, 20 nt, Human
ucacaugaacuuguaaagga

SEQ ID NO: 2741259 - RNA, 19 nt, Human
ucacauucagggcuauuuu

SEQ ID NO: 2741260 - RNA, 20 nt, Human
ucacauuccaagccucaugu

SEQ ID NO: 2741261 - RNA, 13 nt, Human
ucacauuccugaa

SEQ ID NO: 2741262 - RNA, 23 nt, Human
ucacauuuaaauaaaguguuuga

SEQ ID NO: 2741263 - RNA, 14 nt, Human
ucaccaaggcugau

SEQ ID NO: 2741264 - RNA, 20 nt, Human
ucaccacuggagaucaccag

SEQ ID NO: 2741265 - RNA, 11 nt, Human
ucaccagcccu

SEQ ID NO: 2741266 - RNA, 15 nt, Human
ucaccagucccuccc

SEQ ID NO: 2741267 - RNA, 18 nt, Human
ucaccagucccuccccaa

SEQ ID NO: 2741268 - RNA, 18 nt, Human
ucaccauguuggccaggc

SEQ ID NO: 2741269 - RNA, 23 nt, Human
ucaccccuaaaagaaacccugca

SEQ ID NO: 2741270 - RNA, 12 nt, Human
ucaccccuugcc

SEQ ID NO: 2741271 - RNA, 14 nt, Human
ucaccccuugccau

SEQ ID NO: 2741272 - RNA, 21 nt, Human
ucacccugaggugagcaucau

SEQ ID NO: 2741273 - RNA, 14 nt, Human
ucacccugauuuua

SEQ ID NO: 2741274 - RNA, 11 nt, Human
ucaccuccccc

SEQ ID NO: 2741275 - RNA, 21 nt, Human
ucaccugggcugaggcauccu

SEQ ID NO: 2741276 - RNA, 14 nt, Human
ucaccuguuuuuaa

SEQ ID NO: 2741277 - RNA, 18 nt, Human
ucaccuuaggaauaaucu

SEQ ID NO: 2741278 - RNA, 13 nt, Human
ucacguaaagcua

SEQ ID NO: 2741279 - RNA, 23 nt, Human
ucacuacaaccuccgccucccau

SEQ ID NO: 2741280 - RNA, 16 nt, Human
ucacuacgccuggcug

SEQ ID NO: 2741281 - RNA, 16 nt, Human
ucacuagggcagggac

SEQ ID NO: 2741282 - RNA, 23 nt, Human
ucacugcaaccucugccucccag

SEQ ID NO: 2741283 - RNA, 15 nt, Human
ucacugcaggcuccc

SEQ ID NO: 2741284 - RNA, 18 nt, Human
ucacuggcuguuaaucuu

SEQ ID NO: 2741285 - RNA, 12 nt, Human
ucacuugaaccc

SEQ ID NO: 2741286 - RNA, 20 nt, Human
ucacuugaacccgggaggca

SEQ ID NO: 2741287 - RNA, 20 nt, Human
ucacuugguucaguaccaca

SEQ ID NO: 2741288 - RNA, 12 nt, Human
ucacuuguuuua

SEQ ID NO: 2741289 - RNA, 15 nt, Human
ucacuuuuauaagaa

SEQ ID NO: 2741290 - RNA, 16 nt, Human
ucagaaaacaaggaug

SEQ ID NO: 2741291 - RNA, 22 nt, Human
ucagaaaacaaggaugaauuaa

SEQ ID NO: 2741292 - RNA, 12 nt, Human
ucagaagaccug

SEQ ID NO: 2741293 - RNA, 21 nt, Human
ucagaaguuucuucuuuaggc

SEQ ID NO: 2741294 - RNA, 15 nt, Human
ucagaauuucuaaaa

SEQ ID NO: 2741295 - RNA, 20 nt, Human
ucagaauuucuaaaaguuua

SEQ ID NO: 2741296 - RNA, 14 nt, Human
ucagacaagcugca

SEQ ID NO: 2741297 - RNA, 19 nt, Human
ucagacacaaauaaaggaa

SEQ ID NO: 2741298 - RNA, 16 nt, Human
ucagaccuagaauaau

SEQ ID NO: 2741299 - RNA, 22 nt, Human
ucagagacucagggccccagca

SEQ ID NO: 2741300 - RNA, 16 nt, Human
ucagagccuccuuucu

SEQ ID NO: 2741301 - RNA, 16 nt, Human
ucagagcgcacaggga

SEQ ID NO: 2741302 - RNA, 17 nt, Human
ucagagcugcccucucc

SEQ ID NO: 2741303 - RNA, 21 nt, Human
ucagauauaaaagacugacca

SEQ ID NO: 2741304 - RNA, 13 nt, Human
ucagccagcccuc

SEQ ID NO: 2741305 - RNA, 15 nt, Human
ucagccauguauuug

SEQ ID NO: 2741306 - RNA, 18 nt, Human
ucagcccccuaagccccc

SEQ ID NO: 2741307 - RNA, 19 nt, Human
ucagccccgggaguggcgc

SEQ ID NO: 2741308 - RNA, 21 nt, Human
ucagcccugcaccaugcugcu

SEQ ID NO: 2741309 - RNA, 21 nt, Human
ucagccuacaggccucacaca

SEQ ID NO: 2741310 - RNA, 19 nt, Human
ucagccuagccgaccucag

SEQ ID NO: 2741311 - RNA, 22 nt, Human
ucagccugaaagaggaaugaag

SEQ ID NO: 2741312 - RNA, 21 nt, Human
ucagccuggugggccuccucu

SEQ ID NO: 2741313 - RNA, 17 nt, Human
ucagccuuccccuugcc

SEQ ID NO: 2741314 - RNA, 17 nt, Human
ucagcguuaauguaaag

SEQ ID NO: 2741315 - RNA, 14 nt, Human
ucagcucacugcaa

SEQ ID NO: 2741316 - RNA, 22 nt, Human
ucagcucacugcaaccuccacc

SEQ ID NO: 2741317 - RNA, 21 nt, Human
ucagcucagcuaaugaagugu

SEQ ID NO: 2741318 - RNA, 16 nt, Human
ucagcuccagcugcuc

SEQ ID NO: 2741319 - RNA, 17 nt, Human
ucagcuccagcugcucu

SEQ ID NO: 2741320 - RNA, 18 nt, Human
ucagcuccagcugcucug

SEQ ID NO: 2741321 - RNA, 15 nt, Human
ucagcuucuccaaca

SEQ ID NO: 2741322 - RNA, 21 nt, Human
ucagcuugcccuguuaaaaga

SEQ ID NO: 2741323 - RNA, 20 nt, Human
ucagcuuucuaagaucuaac

SEQ ID NO: 2741324 - RNA, 18 nt, Human
ucaggaaagagagcacca

SEQ ID NO: 2741325 - RNA, 19 nt, Human
ucaggagagaguugaaccu

SEQ ID NO: 2741326 - RNA, 22 nt, Human
ucaggaguggguugauuucagc

SEQ ID NO: 2741327 - RNA, 23 nt, Human
ucaggaguuccuaaccagccugg

SEQ ID NO: 2741328 - RNA, 13 nt, Human
uccagauauacuu

SEQ ID NO: 2741329 - RNA, 15 nt, Human
uccagauccuggaaa

SEQ ID NO: 2741330 - RNA, 18 nt, Human
uccagaugagaguacacc

SEQ ID NO: 2741331 - RNA, 21 nt, Human
uccagaugagaguacacccca

SEQ ID NO: 2741332 - RNA, 21 nt, Human
uccagaugggagugcccccaa

SEQ ID NO: 2741333 - RNA, 15 nt, Human
uccagccaucaccuu

SEQ ID NO: 2741334 - RNA, 18 nt, Human
uccagccucagccuccca

SEQ ID NO: 2741335 - RNA, 22 nt, Human
uccagccuucucucaaggagag

SEQ ID NO: 2741336 - RNA, 12 nt, Human
uccagcugcccc

SEQ ID NO: 2741337 - RNA, 15 nt, Human
uccagcugccccggg

SEQ ID NO: 2741338 - RNA, 13 nt, Human
uccagcuggccgg

SEQ ID NO: 2741339 - RNA, 15 nt, Human
uccagcuggccggga

SEQ ID NO: 2741340 - RNA, 17 nt, Human
uccagcuggccgggagc

SEQ ID NO: 2741341 - RNA, 18 nt, Human
uccagcuggccgggagcc

SEQ ID NO: 2741342 - RNA, 22 nt, Human
uccagcuggccgggagccugau

SEQ ID NO: 2741343 - RNA, 18 nt, Human
uccaggagaccuacccuc

SEQ ID NO: 2741344 - RNA, 21 nt, Human
uccaggagaccuacccuccac

SEQ ID NO: 2741345 - RNA, 18 nt, Human
uccaggcuggcgugcagc

SEQ ID NO: 2741346 - RNA, 20 nt, Human
uccaggcuggcgugcagcau

SEQ ID NO: 2741347 - RNA, 19 nt, Human
uccagggcuacgcgcgcuc

SEQ ID NO: 2741348 - RNA, 23 nt, Human
uccagguagaggguguguaagua

SEQ ID NO: 2741349 - RNA, 23 nt, Human
uccaggucuaccaaaaaucucaa

SEQ ID NO: 2741350 - RNA, 16 nt, Human
uccaguauuguuccuu

SEQ ID NO: 2741351 - RNA, 23 nt, Human
uccagucuaaaaaaggaauccuc

SEQ ID NO: 2741352 - RNA, 19 nt, Human
uccagugagacagcucugc

SEQ ID NO: 2741353 - RNA, 15 nt, Human
uccauacucuguaac

SEQ ID NO: 2741354 - RNA, 12 nt, Human
uccauauuaaaa

SEQ ID NO: 2741355 - RNA, 20 nt, Human
uccaucaaggguacacugcc

SEQ ID NO: 2741356 - RNA, 21 nt, Human
uccaucaaggguacacugccu

SEQ ID NO: 2741357 - RNA, 13 nt, Human
uccauccuaccac

SEQ ID NO: 2741358 - RNA, 15 nt, Human
uccauccugaggcuc

SEQ ID NO: 2741359 - RNA, 16 nt, Human
uccauccugaggcucc

SEQ ID NO: 2741360 - RNA, 18 nt, Human
uccauccugaggcuccac

SEQ ID NO: 2741361 - RNA, 19 nt, Human
uccauccugaggcuccacu

SEQ ID NO: 2741362 - RNA, 20 nt, Human
uccauccugaggcuccacuu

SEQ ID NO: 2741363 - RNA, 18 nt, Human
uccaugggccauaugaaa

SEQ ID NO: 2741364 - RNA, 16 nt, Human
uccauggggugggggu

SEQ ID NO: 2741365 - RNA, 22 nt, Human
uccauggugugcuggcuuaaaa

SEQ ID NO: 2741366 - RNA, 14 nt, Human
uccauuaaauauaa

SEQ ID NO: 2741367 - RNA, 15 nt, Human
uccauucuucccuug

SEQ ID NO: 2741368 - RNA, 17 nt, Human
uccauucuuccucccau

SEQ ID NO: 2741369 - RNA, 11 nt, Human
uccauuguaau

SEQ ID NO: 2741370 - RNA, 16 nt, Human
uccauuuuuuucuaau

SEQ ID NO: 2741371 - RNA, 12 nt, Human
ucccaaacaugc

SEQ ID NO: 2741372 - RNA, 18 nt, Human
ucccaacuauaaaacuag

SEQ ID NO: 2741373 - RNA, 15 nt, Human
ucccaacuccagaaa

SEQ ID NO: 2741374 - RNA, 17 nt, Human
ucccaagcaccugggau

SEQ ID NO: 2741375 - RNA, 16 nt, Human
ucccaagcaguuggga

SEQ ID NO: 2741376 - RNA, 24 nt, Human
ucccaagcaguugggacuacaggc

SEQ ID NO: 2741377 - RNA, 13 nt, Human
ucccaaguagcug

SEQ ID NO: 2741378 - RNA, 18 nt, Human
ucccaauugcuuuaccuu

SEQ ID NO: 2741379 - RNA, 13 nt, Human
ucccacccgccca

SEQ ID NO: 2741380 - RNA, 12 nt, Human
ucccacugccaa

SEQ ID NO: 2741381 - RNA, 16 nt, Human
ucccagaaaaagcauc

SEQ ID NO: 2741382 - RNA, 17 nt, Human
ucccagaucaagccugc

SEQ ID NO: 2741383 - RNA, 21 nt, Human
ucccagccagcaguucagagc

SEQ ID NO: 2741384 - RNA, 23 nt, Human
ucccagccagcaguucagagcug

SEQ ID NO: 2741385 - RNA, 21 nt, Human
ucccaggaggggcuucugggc

SEQ ID NO: 2741386 - RNA, 15 nt, Human
ucccaggaguacacc

SEQ ID NO: 2741387 - RNA, 16 nt, Human
ucccaggaguacaccc

SEQ ID NO: 2741388 - RNA, 18 nt, Human
ucccaggaguacacccca

SEQ ID NO: 2741389 - RNA, 14 nt, Human
ucccaggcugagcc

SEQ ID NO: 2741390 - RNA, 17 nt, Human
ucccaggcugagccuca

SEQ ID NO: 2741391 - RNA, 17 nt, Human
ucccagucauuuaauaa

SEQ ID NO: 2741392 - RNA, 13 nt, Human
ucccaugaagaaa

SEQ ID NO: 2741393 - RNA, 18 nt, Human
ucccauuagaccaagcuu

SEQ ID NO: 2741394 - RNA, 21 nt, Human
ucccauuagaccaagcuuguc

SEQ ID NO: 2741395 - RNA, 16 nt, Human
ucccauucaggaugcc

SEQ ID NO: 2741396 - RNA, 12 nt, Human
uccccagaugag

SEQ ID NO: 2741397 - RNA, 20 nt, Human
uccccagccugcucccuagc

SEQ ID NO: 2741398 - RNA, 21 nt, Human
uccccagccugcucccuagcc

SEQ ID NO: 2741399 - RNA, 13 nt, Human
uccccagcucuau

SEQ ID NO: 2741400 - RNA, 18 nt, Human
uccccaggcccugcucuu

SEQ ID NO: 2741401 - RNA, 21 nt, Human
uccccaggcccugcucuuccu

SEQ ID NO: 2741402 - RNA, 16 nt, Human
uccccaugauguuuag

SEQ ID NO: 2741403 - RNA, 16 nt, Human
uccccaugguuuuaau

SEQ ID NO: 2741404 - RNA, 16 nt, Human
ucccccacaaacccaa

SEQ ID NO: 2741405 - RNA, 13 nt, Human
uccccccacagcc

SEQ ID NO: 2741406 - RNA, 17 nt, Human
ucccccuagccugccuc

SEQ ID NO: 2741407 - RNA, 19 nt, Human
uccccuauccuacuucccc

SEQ ID NO: 2741408 - RNA, 16 nt, Human
uccccuauguggaagu

SEQ ID NO: 2741409 - RNA, 15 nt, Human
uccccuggguucaca

SEQ ID NO: 2741410 - RNA, 17 nt, Human
uccccugucacgugugg

SEQ ID NO: 2741411 - RNA, 17 nt, Human
uccccuucacucccacc

SEQ ID NO: 2741412 - RNA, 15 nt, Human
uccccuucccacacu

SEQ ID NO: 2741413 - RNA, 19 nt, Human
ucccgauucacccugucca

SEQ ID NO: 2741414 - RNA, 19 nt, Human
ucccgcuguuccucgccac

SEQ ID NO: 2741415 - RNA, 23 nt, Human
ucccgcuguuccucgccacgcuc

SEQ ID NO: 2741416 - RNA, 15 nt, Human
ucccggccgcgcugc

SEQ ID NO: 2741417 - RNA, 17 nt, Human
ucccuacaccccucccc

SEQ ID NO: 2741418 - RNA, 19 nt, Human
ucccuacaccccuccccug

SEQ ID NO: 2741419 - RNA, 22 nt, Human
ucccuacaccccuccccugccc

SEQ ID NO: 2741420 - RNA, 22 nt, Human
ucccuagaaagccaugugcagc

SEQ ID NO: 2741421 - RNA, 23 nt, Human
ucccuagaaagccaugugcagcc

SEQ ID NO: 2741422 - RNA, 12 nt, Human
ucccuagccaga

SEQ ID NO: 2741423 - RNA, 19 nt, Human
ucccuagccagaggcucua

SEQ ID NO: 2741424 - RNA, 19 nt, Human
ucccuagcugugaccucuc

SEQ ID NO: 2741425 - RNA, 16 nt, Human
ucccuagucucuaccc

SEQ ID NO: 2741426 - RNA, 18 nt, Human
ucccuagucucuacccag

SEQ ID NO: 2741427 - RNA, 19 nt, Human
ucccuauuccuccuucccu

SEQ ID NO: 2741428 - RNA, 20 nt, Human
ucccuauuccuccuucccuu

SEQ ID NO: 2741429 - RNA, 22 nt, Human
ucccuccacauuucccccuagc

SEQ ID NO: 2741430 - RNA, 13 nt, Human
ucccuccaccucc

SEQ ID NO: 2741431 - RNA, 14 nt, Human
ucccuccaccuccc

SEQ ID NO: 2741432 - RNA, 15 nt, Human
ucccuccagauauac

SEQ ID NO: 2741433 - RNA, 19 nt, Human
ucccucccaaguaaauguu

SEQ ID NO: 2741434 - RNA, 13 nt, Human
ucccucccuccac

SEQ ID NO: 2741435 - RNA, 14 nt, Human
ucccucccuccacc

SEQ ID NO: 2741436 - RNA, 15 nt, Human
ucccucccuccaccu

SEQ ID NO: 2741437 - RNA, 14 nt, Human
ucccucuguugcca

SEQ ID NO: 2741438 - RNA, 18 nt, Human
ucccucuguugccaaggc

SEQ ID NO: 2741439 - RNA, 14 nt, Human
ucccugaagaucua

SEQ ID NO: 2741440 - RNA, 13 nt, Human
ucccugagcagga

SEQ ID NO: 2741441 - RNA, 19 nt, Human
ucccugcagcucucuuucc

SEQ ID NO: 2741442 - RNA, 16 nt, Human
ucccugccccccagcc

SEQ ID NO: 2741443 - RNA, 17 nt, Human
ucccugccccccagccc

SEQ ID NO: 2741444 - RNA, 21 nt, Human
ucccugcugcccuuccccuuc

SEQ ID NO: 2741445 - RNA, 23 nt, Human
ucccuggaagagaucaagccauc

SEQ ID NO: 2741446 - RNA, 18 nt, Human
ucccuggauuuuuaccag

SEQ ID NO: 2741447 - RNA, 21 nt, Human
ucccuggggcuuuaacuccug

SEQ ID NO: 2741448 - RNA, 18 nt, Human
ucccuggucccuuggaga

SEQ ID NO: 2741449 - RNA, 16 nt, Human
ucccuguuucuuccac

SEQ ID NO: 2741450 - RNA, 15 nt, Human
ucccuugaugaagaa

SEQ ID NO: 2741451 - RNA, 20 nt, Human
ucccuugauggucccuauuc

SEQ ID NO: 2741452 - RNA, 15 nt, Human
ucccuugcaugguuu

SEQ ID NO: 2741453 - RNA, 14 nt, Human
ucccuuucauuuuu

SEQ ID NO: 2741454 - RNA, 18 nt, Human
ucccuuucauuuuuucca

SEQ ID NO: 2741455 - RNA, 21 nt, Human
ucccuuuggagauuuuuuaau

SEQ ID NO: 2741456 - RNA, 22 nt, Human
ucccuuuggagauuuuuuaauc

SEQ ID NO: 2741457 - RNA, 15 nt, Human
ucccuuuguccacaa

SEQ ID NO: 2741458 - RNA, 17 nt, Human
ucccuuuguccacaagu

SEQ ID NO: 2741459 - RNA, 22 nt, Human
ucccuuuugcugccucuaaaag

SEQ ID NO: 2741460 - RNA, 13 nt, Human
ucccuuuuuuuaa

SEQ ID NO: 2741461 - RNA, 14 nt, Human
ucccuuuuuuuaag

SEQ ID NO: 2741462 - RNA, 15 nt, Human
uccgaagucuuccau

SEQ ID NO: 2741463 - RNA, 15 nt, Human
uccgcauccuagucu

SEQ ID NO: 2741464 - RNA, 12 nt, Human
uccgccucccau

SEQ ID NO: 2741465 - RNA, 19 nt, Human
uccgcgcagcucaggcugg

SEQ ID NO: 2741466 - RNA, 15 nt, Human
uccgcuacuuccagg

SEQ ID NO: 2741467 - RNA, 18 nt, Human
uccguagguuauuuucag

SEQ ID NO: 2741468 - RNA, 17 nt, Human
uccgucaacucauauuu

SEQ ID NO: 2741469 - RNA, 15 nt, Human
uccgucucccaaagu

SEQ ID NO: 2741470 - RNA, 23 nt, Human
uccguggcacugcauacaaucug

SEQ ID NO: 2741471 - RNA, 21 nt, Human
uccuaaaacuuuaaaacuuga

SEQ ID NO: 2741472 - RNA, 19 nt, Human
uccuaaauauauuuuaaga

SEQ ID NO: 2741473 - RNA, 16 nt, Human
ucuagcaugaagacag

SEQ ID NO: 2741474 - RNA, 22 nt, Human
ucuagcaugucgucaaagcuga

SEQ ID NO: 2741475 - RNA, 23 nt, Human
ucuagcaugucgucaaagcugaa

SEQ ID NO: 2741476 - RNA, 15 nt, Human
ucuaggacugaauua

SEQ ID NO: 2741477 - RNA, 16 nt, Human
ucuaguacuugggaga

SEQ ID NO: 2741478 - RNA, 14 nt, Human
ucuagugaaacucg

SEQ ID NO: 2741479 - RNA, 18 nt, Human
ucuauaauauaagcugcc

SEQ ID NO: 2741480 - RNA, 23 nt, Human
ucuauaauguaaacaauaucaga

SEQ ID NO: 2741481 - RNA, 17 nt, Human
ucuauaauguguucauu

SEQ ID NO: 2741482 - RNA, 13 nt, Human
ucuauaauuuaaa

SEQ ID NO: 2741483 - RNA, 14 nt, Human
ucuauaauuuaaau

SEQ ID NO: 2741484 - RNA, 16 nt, Human
ucuauaauuuaaauau

SEQ ID NO: 2741485 - RNA, 15 nt, Human
ucuaucauuuaauaa

SEQ ID NO: 2741486 - RNA, 14 nt, Human
ucuaucccaaccuc

SEQ ID NO: 2741487 - RNA, 13 nt, Human
ucuaucuauuuau

SEQ ID NO: 2741488 - RNA, 14 nt, Human
ucuaucuauuuauu

SEQ ID NO: 2741489 - RNA, 16 nt, Human
ucuaucucuaaagaaa

SEQ ID NO: 2741490 - RNA, 15 nt, Human
ucuaugaaauauuau

SEQ ID NO: 2741491 - RNA, 18 nt, Human
ucuaugaaauauuauguu

SEQ ID NO: 2741492 - RNA, 20 nt, Human
ucuaugagggcuaauaucuu

SEQ ID NO: 2741493 - RNA, 15 nt, Human
ucuaugcauuuucug

SEQ ID NO: 2741494 - RNA, 14 nt, Human
ucuaugccacaaga

SEQ ID NO: 2741495 - RNA, 17 nt, Human
ucuaugugcuuguaaaa

SEQ ID NO: 2741496 - RNA, 21 nt, Human
ucuauuaccuguuaguauuau

SEQ ID NO: 2741497 - RNA, 22 nt, Human
ucuauuaccuguuaguauuauu

SEQ ID NO: 2741498 - RNA, 17 nt, Human
ucuauuagccacaaaau

SEQ ID NO: 2741499 - RNA, 14 nt, Human
ucuauuaggaaaua

SEQ ID NO: 2741500 - RNA, 18 nt, Human
ucuauuaggaaauauucu

SEQ ID NO: 2741501 - RNA, 23 nt, Human
ucuauuccugguagaauagauau

SEQ ID NO: 2741502 - RNA, 13 nt, Human
ucuauugccucug

SEQ ID NO: 2741503 - RNA, 16 nt, Human
ucuauugccucugaga

SEQ ID NO: 2741504 - RNA, 17 nt, Human
ucuauuucuuuuuaauu

SEQ ID NO: 2741505 - RNA, 13 nt, Human
ucucaaaacugca

SEQ ID NO: 2741506 - RNA, 15 nt, Human
ucucaaacuucuauu

SEQ ID NO: 2741507 - RNA, 15 nt, Human
ucucaaccucuuccc

SEQ ID NO: 2741508 - RNA, 23 nt, Human
ucucaagcccugcagucacagcu

SEQ ID NO: 2741509 - RNA, 15 nt, Human
ucucaauaaauaaau

SEQ ID NO: 2741510 - RNA, 20 nt, Human
ucucaauaagccucagcuuu

SEQ ID NO: 2741511 - RNA, 13 nt, Human
ucucaauuucuac

SEQ ID NO: 2741512 - RNA, 21 nt, Human
ucucacaagcacuuucccucu

SEQ ID NO: 2741513 - RNA, 23 nt, Human
ucucacagugggagccagggcug

SEQ ID NO: 2741514 - RNA, 14 nt, Human
ucucacauuuauau

SEQ ID NO: 2741515 - RNA, 13 nt, Human
ucucacuuaaucc

SEQ ID NO: 2741516 - RNA, 17 nt, Human
ucucacuuguuuuauuu

SEQ ID NO: 2741517 - RNA, 20 nt, Human
ucucacuuguuuuauuuaac

SEQ ID NO: 2741518 - RNA, 15 nt, Human
ucucagaaauuguau

SEQ ID NO: 2741519 - RNA, 21 nt, Human
ucucagaaauuguaucuuagu

SEQ ID NO: 2741520 - RNA, 19 nt, Human
ucucagcucacugcaaccu

SEQ ID NO: 2741521 - RNA, 13 nt, Human
ucucauccacuuu

SEQ ID NO: 2741522 - RNA, 15 nt, Human
ucucauccugcaggc

SEQ ID NO: 2741523 - RNA, 14 nt, Human
ucucaucuuuuuac

SEQ ID NO: 2741524 - RNA, 12 nt, Human
ucucaugaaccu

SEQ ID NO: 2741525 - RNA, 16 nt, Human
ucuccaaagcccuccc

SEQ ID NO: 2741526 - RNA, 15 nt, Human
ucuccaacaauaaga

SEQ ID NO: 2741527 - RNA, 19 nt, Human
ucuccacuggaaaacugcu

SEQ ID NO: 2741528 - RNA, 22 nt, Human
ucuccagagggaauugcagagu

SEQ ID NO: 2741529 - RNA, 19 nt, Human
ucuccagccucagccuccc

SEQ ID NO: 2741530 - RNA, 21 nt, Human
ucuccagccucagccucccaa

SEQ ID NO: 2741531 - RNA, 16 nt, Human
ucuccauacucuguaa

SEQ ID NO: 2741532 - RNA, 13 nt, Human
ucuccauguacug

SEQ ID NO: 2741533 - RNA, 13 nt, Human
ucucccagccagg

SEQ ID NO: 2741534 - RNA, 15 nt, Human
ucucccagucauuua

SEQ ID NO: 2741535 - RNA, 20 nt, Human
ucucccagucauuuaauaaa

SEQ ID NO: 2741536 - RNA, 14 nt, Human
ucuccccuucucug

SEQ ID NO: 2741537 - RNA, 13 nt, Human
ucucccucccuug

SEQ ID NO: 2741538 - RNA, 15 nt, Human
ucuccuaaaguacug

SEQ ID NO: 2741539 - RNA, 14 nt, Human
ucuccucaacucug

SEQ ID NO: 2741540 - RNA, 14 nt, Human
ucuccucucagugg

SEQ ID NO: 2741541 - RNA, 15 nt, Human
ucuccucucucugua

SEQ ID NO: 2741542 - RNA, 12 nt, Human
ucuccugggcag

SEQ ID NO: 2741543 - RNA, 14 nt, Human
ucuccugggcagcu

SEQ ID NO: 2741544 - RNA, 21 nt, Human
ucuccugggcagcugccuccc

SEQ ID NO: 2741545 - RNA, 17 nt, Human
ucuccuguacuuuuucc

SEQ ID NO: 2741546 - RNA, 18 nt, Human
ucuccuguacuuuuucca

SEQ ID NO: 2741547 - RNA, 21 nt, Human
ucuccuuguugugauuuucac

SEQ ID NO: 2741548 - RNA, 23 nt, Human
ucucguaagauuuccuucuuuuu

SEQ ID NO: 2741549 - RNA, 18 nt, Human
ucucuaaagaaaaucucu

SEQ ID NO: 2741550 - RNA, 15 nt, Human
ucucuaauauguaaa

SEQ ID NO: 2741551 - RNA, 15 nt, Human
ucucuacaaaaaaaa

SEQ ID NO: 2741552 - RNA, 14 nt, Human
ucucuacauaaaau

SEQ ID NO: 2741553 - RNA, 16 nt, Human
ucucuaccaaaaaaag

SEQ ID NO: 2741554 - RNA, 23 nt, Human
ucucuaccaaaaaaaggaaggaa

SEQ ID NO: 2741555 - RNA, 22 nt, Human
ucucuacccaguagaugccacu

SEQ ID NO: 2741556 - RNA, 19 nt, Human
ucucuacuaaaaauacaaa

SEQ ID NO: 2741557 - RNA, 22 nt, Human
ucucuacuaaaaauacaaaaau

SEQ ID NO: 2741558 - RNA, 16 nt, Human
ucucuaggaaauauuu

SEQ ID NO: 2741559 - RNA, 14 nt, Human
ucucuaucauuaaa

SEQ ID NO: 2741560 - RNA, 19 nt, Human
ucucuaucauuaaaguucu

SEQ ID NO: 2741561 - RNA, 24 nt, Human
ucucuaucauuaaaguucuaguga

SEQ ID NO: 2741562 - RNA, 15 nt, Human
ucucuaucauuuaau

SEQ ID NO: 2741563 - RNA, 16 nt, Human
ucucuauuaggaaaua

SEQ ID NO: 2741564 - RNA, 22 nt, Human
ucucucaaggagaggcaaagaa

SEQ ID NO: 2741565 - RNA, 17 nt, Human
ucucucacuuguuuuau

SEQ ID NO: 2741566 - RNA, 13 nt, Human
ucucuccaaccag

SEQ ID NO: 2741567 - RNA, 22 nt, Human
ucucuccaccagguucuuucuu

SEQ ID NO: 2741568 - RNA, 13 nt, Human
ucucuccaggcag

SEQ ID NO: 2741569 - RNA, 22 nt, Human
ucucuccucuccccaugauguu

SEQ ID NO: 2741570 - RNA, 20 nt, Human
ucucuccuguacuuuuucca

SEQ ID NO: 2741571 - RNA, 19 nt, Human
ucucuccuuguucugauaa

SEQ ID NO: 2741572 - RNA, 12 nt, Human
ucucucugaggg

SEQ ID NO: 2741573 - RNA, 13 nt, Human
ucucucugagggg

SEQ ID NO: 2741574 - RNA, 12 nt, Human
ucucucuucuuu

SEQ ID NO: 2741575 - RNA, 23 nt, Human
ucucugaagaguggguuucacaa

SEQ ID NO: 2741576 - RNA, 20 nt, Human
ucucugcaggcagccugccu

SEQ ID NO: 2741577 - RNA, 14 nt, Human
ucucugcagguccc

SEQ ID NO: 2741578 - RNA, 15 nt, Human
ucucugccuugguau

SEQ ID NO: 2741579 - RNA, 20 nt, Human
ucucuggccuguacccagua

SEQ ID NO: 2741580 - RNA, 16 nt, Human
ucucuguaauaaacuc

SEQ ID NO: 2741581 - RNA, 15 nt, Human
ucucuguucauuucc

SEQ ID NO: 2741582 - RNA, 19 nt, Human
ucucuuaaacacuaaaaag

SEQ ID NO: 2741583 - RNA, 13 nt, Human
ucucuugauuuuc

SEQ ID NO: 2741584 - RNA, 20 nt, Human
ucucuugauuuucauuauuc

SEQ ID NO: 2741585 - RNA, 23 nt, Human
ucucuugccucaaccucccaagc

SEQ ID NO: 2741586 - RNA, 14 nt, Human
ucugaaaauugaug

SEQ ID NO: 2741587 - RNA, 13 nt, Human
ucugaaauuuccu

SEQ ID NO: 2741588 - RNA, 22 nt, Human
ucugaacccagggaagacaaga

SEQ ID NO: 2741589 - RNA, 17 nt, Human
ucugaagcucaacucuc

SEQ ID NO: 2741590 - RNA, 23 nt, Human
ucugacacuaaaacaccucagcu

SEQ ID NO: 2741591 - RNA, 16 nt, Human
ucugacuauuuuucag

SEQ ID NO: 2741592 - RNA, 22 nt, Human
ucugagaaaagcuuugaacccu

SEQ ID NO: 2741593 - RNA, 15 nt, Human
ucugagaagcucuga

SEQ ID NO: 2741594 - RNA, 18 nt, Human
ucugagagauucaugcug

SEQ ID NO: 2741595 - RNA, 19 nt, Human
ucugagcauuuaauaugga

SEQ ID NO: 2741596 - RNA, 13 nt, Human
ucugagccuuggg

SEQ ID NO: 2741597 - RNA, 19 nt, Human
ucugaggcuucuggggcuu

SEQ ID NO: 2741598 - RNA, 18 nt, Human
ucugagggggugggggug

SEQ ID NO: 2741599 - RNA, 15 nt, Human
ucugagggguggggg

SEQ ID NO: 2741600 - RNA, 17 nt, Human
ucugaggggugggggug

SEQ ID NO: 2741601 - RNA, 18 nt, Human
ucugaugagaacucugag

SEQ ID NO: 2741602 - RNA, 22 nt, Human
ucugaugagaacucugagcagu

SEQ ID NO: 2741603 - RNA, 13 nt, Human
ucugauuuuccug

SEQ ID NO: 2741604 - RNA, 20 nt, Human
ucugcaacuacuauccaacu

SEQ ID NO: 2741605 - RNA, 18 nt, Human
ucugcaagaagaaaucau

SEQ ID NO: 2741606 - RNA, 15 nt, Human
ucugcaaugaccuuc

SEQ ID NO: 2741607 - RNA, 14 nt, Human
ucugcacacagcac

SEQ ID NO: 2741608 - RNA, 15 nt, Human
ucugcagauaaacag

SEQ ID NO: 2741609 - RNA, 19 nt, Human
ucugcagcuuccaggcugg

SEQ ID NO: 2741610 - RNA, 12 nt, Human
ucugcagguccc

SEQ ID NO: 2741611 - RNA, 16 nt, Human
ucugcauguucuaaau

SEQ ID NO: 2741612 - RNA, 13 nt, Human
ucugccagccagc

SEQ ID NO: 2741613 - RNA, 15 nt, Human
ucugcccugcuuuug

SEQ ID NO: 2741614 - RNA, 23 nt, Human
ucugcccugcuuuugcuagguca

SEQ ID NO: 2741615 - RNA, 13 nt, Human
ucugcccuuguca

SEQ ID NO: 2741616 - RNA, 16 nt, Human
ucugccuccccuucac

SEQ ID NO: 2741617 - RNA, 14 nt, Human
ucugccugcccuga

SEQ ID NO: 2741618 - RNA, 20 nt, Human
ucugccuuuauuguguuugu

SEQ ID NO: 2741619 - RNA, 17 nt, Human
ugaaaguugauaaguac

SEQ ID NO: 2741620 - RNA, 17 nt, Human
ugaaauaagccagacau

SEQ ID NO: 2741621 - RNA, 17 nt, Human
ugaaauauuauuuuaua

SEQ ID NO: 2741622 - RNA, 23 nt, Human
ugaaauauugacuuuuuauggca

SEQ ID NO: 2741623 - RNA, 10 nt, Human
ugaaaucaau

SEQ ID NO: 2741624 - RNA, 17 nt, Human
ugaaaucagaguuuuca

SEQ ID NO: 2741625 - RNA, 17 nt, Human
ugaaaugacuaaaaaac

SEQ ID NO: 2741626 - RNA, 16 nt, Human
ugaaaugacugucuaa

SEQ ID NO: 2741627 - RNA, 23 nt, Human
ugaaaugaguuuuucuuuucauu

SEQ ID NO: 2741628 - RNA, 13 nt, Human
ugaaauuguauua

SEQ ID NO: 2741629 - RNA, 15 nt, Human
ugaaauuguauuaca

SEQ ID NO: 2741630 - RNA, 19 nt, Human
ugaaauuguauuacaaauc

SEQ ID NO: 2741631 - RNA, 21 nt, Human
ugaaauuguauuacaaaucca

SEQ ID NO: 2741632 - RNA, 20 nt, Human
ugaaauuuucuagaauacua

SEQ ID NO: 2741633 - RNA, 21 nt, Human
ugaaauuuucuagaauacuaa

SEQ ID NO: 2741634 - RNA, 18 nt, Human
ugaacaaaauuuccuaau

SEQ ID NO: 2741635 - RNA, 21 nt, Human
ugaacaaauuuacagagacag

SEQ ID NO: 2741636 - RNA, 21 nt, Human
ugaacaguuguguuugaagca

SEQ ID NO: 2741637 - RNA, 20 nt, Human
ugaaccaccgcgcccagccu

SEQ ID NO: 2741638 - RNA, 18 nt, Human
ugaacccgggaggcagag

SEQ ID NO: 2741639 - RNA, 18 nt, Human
ugaacuacuagaaaauug

SEQ ID NO: 2741640 - RNA, 18 nt, Human
ugaacuagaguuuagcug

SEQ ID NO: 2741641 - RNA, 21 nt, Human
ugaacuagaguuuagcuggaa

SEQ ID NO: 2741642 - RNA, 16 nt, Human
ugaacucuguuuucuu

SEQ ID NO: 2741643 - RNA, 22 nt, Human
ugaacucuguuuucuuucuaau

SEQ ID NO: 2741644 - RNA, 21 nt, Human
ugaacugauggguuucuccag

SEQ ID NO: 2741645 - RNA, 13 nt, Human
ugaacugcagcga

SEQ ID NO: 2741646 - RNA, 21 nt, Human
ugaacuggacccuguugcuaa

SEQ ID NO: 2741647 - RNA, 17 nt, Human
ugaacuugguuuuaauu

SEQ ID NO: 2741648 - RNA, 14 nt, Human
ugaacuuuuuauug

SEQ ID NO: 2741649 - RNA, 21 nt, Human
ugaacuuuuuguuuuguuucu

SEQ ID NO: 2741650 - RNA, 18 nt, Human
ugaagaagcuagaaaaca

SEQ ID NO: 2741651 - RNA, 18 nt, Human
ugaagaaucacaauaauu

SEQ ID NO: 2741652 - RNA, 17 nt, Human
ugaagagauuuuucaug

SEQ ID NO: 2741653 - RNA, 18 nt, Human
ugaagagugugaggaaaa

SEQ ID NO: 2741654 - RNA, 16 nt, Human
ugaagauacugaaaua

SEQ ID NO: 2741655 - RNA, 18 nt, Human
ugaagauauuuuuccauu

SEQ ID NO: 2741656 - RNA, 14 nt, Human
ugaagauuuaccac

SEQ ID NO: 2741657 - RNA, 15 nt, Human
ugaagcaaaauuuuu

SEQ ID NO: 2741658 - RNA, 14 nt, Human
ugaagcaaggagcu

SEQ ID NO: 2741659 - RNA, 19 nt, Human
ugaagcaaggagcuuagau

SEQ ID NO: 2741660 - RNA, 18 nt, Human
ugaagcuguguccucaug

SEQ ID NO: 2741661 - RNA, 13 nt, Human
ugaagcuguugug

SEQ ID NO: 2741662 - RNA, 15 nt, Human
ugaagcuguugugug

SEQ ID NO: 2741663 - RNA, 23 nt, Human
ugaagcuuuuaugugaaacaugu

SEQ ID NO: 2741664 - RNA, 21 nt, Human
ugaaggaauaucucuucucag

SEQ ID NO: 2741665 - RNA, 24 nt, Human
ugaaggaugcugucuucguacugg

SEQ ID NO: 2741666 - RNA, 18 nt, Human
ugaaggauuuauguuuaa

SEQ ID NO: 2741667 - RNA, 18 nt, Human
ugaaggcauccccaggcc

SEQ ID NO: 2741668 - RNA, 14 nt, Human
ugaaggggcggcgg

SEQ ID NO: 2741669 - RNA, 15 nt, Human
ugaaggggcggcggc

SEQ ID NO: 2741670 - RNA, 17 nt, Human
ugaagguaaaauugaaa

SEQ ID NO: 2741671 - RNA, 21 nt, Human
ugaagguggaaauaaacuauu

SEQ ID NO: 2741672 - RNA, 16 nt, Human
ugaaguacucauacau

SEQ ID NO: 2741673 - RNA, 17 nt, Human
ugaaguacucauacaug

SEQ ID NO: 2741674 - RNA, 15 nt, Human
ugaaguccaagcauu

SEQ ID NO: 2741675 - RNA, 21 nt, Human
ugaaguccaagcauuuagaug

SEQ ID NO: 2741676 - RNA, 16 nt, Human
ugaaguucaucuugca

SEQ ID NO: 2741677 - RNA, 15 nt, Human
ugaauaucuauuaau

SEQ ID NO: 2741678 - RNA, 20 nt, Human
ugaauauuuaguguucauaa

SEQ ID NO: 2741679 - RNA, 17 nt, Human
ugaaucacguaaagcua

SEQ ID NO: 2741680 - RNA, 16 nt, Human
ugaauccagaaauaau

SEQ ID NO: 2741681 - RNA, 18 nt, Human
ugaauccagaaauaauga

SEQ ID NO: 2741682 - RNA, 17 nt, Human
ugaauggcuaagcaaaa

SEQ ID NO: 2741683 - RNA, 15 nt, Human
ugaauguaaauuugu

SEQ ID NO: 2741684 - RNA, 15 nt, Human
ugaauuacauuugua

SEQ ID NO: 2741685 - RNA, 22 nt, Human
ugaauuguaggugacuauuaua

SEQ ID NO: 2741686 - RNA, 16 nt, Human
ugaauuuaaauagcuu

SEQ ID NO: 2741687 - RNA, 17 nt, Human
ugaauuuccuaucugua

SEQ ID NO: 2741688 - RNA, 23 nt, Human
ugaauuugugaagguggaaauaa

SEQ ID NO: 2741689 - RNA, 11 nt, Human
ugaauuuugau

SEQ ID NO: 2741690 - RNA, 21 nt, Human
ugaauuuuucucuaacucaga

SEQ ID NO: 2741691 - RNA, 15 nt, Human
ugacaagcucacaga

SEQ ID NO: 2741692 - RNA, 16 nt, Human
ugacaagcucacagac

SEQ ID NO: 2741693 - RNA, 18 nt, Human
ugacaagcucacagaccu

SEQ ID NO: 2741694 - RNA, 19 nt, Human
ugacaagguucuucccuuu

SEQ ID NO: 2741695 - RNA, 15 nt, Human
ugacaauuaaaagug

SEQ ID NO: 2741696 - RNA, 18 nt, Human
ugacacagacauccucua

SEQ ID NO: 2741697 - RNA, 15 nt, Human
ugacacagcuguccc

SEQ ID NO: 2741698 - RNA, 14 nt, Human
ugacacuaaaacac

SEQ ID NO: 2741699 - RNA, 19 nt, Human
ugacacuagcuaauaucaa

SEQ ID NO: 2741700 - RNA, 14 nt, Human
ugacacuuaaaaau

SEQ ID NO: 2741701 - RNA, 16 nt, Human
ugacacuuaaaaaugg

SEQ ID NO: 2741702 - RNA, 17 nt, Human
ugacacuuaaaaauggu

SEQ ID NO: 2741703 - RNA, 14 nt, Human
ugacagcccaaggg

SEQ ID NO: 2741704 - RNA, 16 nt, Human
ugacagggaaaacugc

SEQ ID NO: 2741705 - RNA, 13 nt, Human
ugacauaaguauu

SEQ ID NO: 2741706 - RNA, 16 nt, Human
ugaccaaccuuuuccc

SEQ ID NO: 2741707 - RNA, 21 nt, Human
ugaccauacuaauuauacccc

SEQ ID NO: 2741708 - RNA, 15 nt, Human
ugaccauuagcauuu

SEQ ID NO: 2741709 - RNA, 22 nt, Human
ugacccacaagaaaugaaagca

SEQ ID NO: 2741710 - RNA, 13 nt, Human
ugacccccauccc

SEQ ID NO: 2741711 - RNA, 19 nt, Human
ugacgguguuaauuuugcu

SEQ ID NO: 2741712 - RNA, 23 nt, Human
ugacguaggaacgguaaauuucu

SEQ ID NO: 2741713 - RNA, 16 nt, Human
ugacgucaucaucaca

SEQ ID NO: 2741714 - RNA, 21 nt, Human
ugacuagaaaauuuaaaacau

SEQ ID NO: 2741715 - RNA, 18 nt, Human
ugacuauuauagaaugga

SEQ ID NO: 2741716 - RNA, 17 nt, Human
ugacuauuauauuucca

SEQ ID NO: 2741717 - RNA, 20 nt, Human
ugacuauucuugauguaaaa

SEQ ID NO: 2741718 - RNA, 23 nt, Human
ugacuccacucugagucccagag

SEQ ID NO: 2741719 - RNA, 18 nt, Human
ugacugccaagccauggg

SEQ ID NO: 2741720 - RNA, 15 nt, Human
ugacuggccugcugg

SEQ ID NO: 2741721 - RNA, 16 nt, Human
ugacuuaaugccacua

SEQ ID NO: 2741722 - RNA, 18 nt, Human
ugacuuaguguacaugaa

SEQ ID NO: 2741723 - RNA, 15 nt, Human
ugacuuauuuauaua

SEQ ID NO: 2741724 - RNA, 15 nt, Human
ugacuucuaaguaaa

SEQ ID NO: 2741725 - RNA, 14 nt, Human
ugacuuuucuccuc

SEQ ID NO: 2741726 - RNA, 14 nt, Human
ugagaaaccuuauu

SEQ ID NO: 2741727 - RNA, 18 nt, Human
ugagaaagacuauucaaa

SEQ ID NO: 2741728 - RNA, 20 nt, Human
ugagaaagacuauucaaaca

SEQ ID NO: 2741729 - RNA, 20 nt, Human
ugagaacugcauauguuucg

SEQ ID NO: 2741730 - RNA, 17 nt, Human
ugagaagagaauauuag

SEQ ID NO: 2741731 - RNA, 15 nt, Human
ugagaaggagcuccc

SEQ ID NO: 2741732 - RNA, 18 nt, Human
ugagaaggagcucccagg

SEQ ID NO: 2741733 - RNA, 16 nt, Human
ugagacaaauggaggc

SEQ ID NO: 2741734 - RNA, 16 nt, Human
ugagacaagaaaauaa

SEQ ID NO: 2741735 - RNA, 18 nt, Human
ugagacagagucuuccuc

SEQ ID NO: 2741736 - RNA, 20 nt, Human
ugagacagcucugcauacuc

SEQ ID NO: 2741737 - RNA, 14 nt, Human
ugagaccagccaac

SEQ ID NO: 2741738 - RNA, 19 nt, Human
ugagacuacaggcacacac

SEQ ID NO: 2741739 - RNA, 22 nt, Human
ugagacucugucucaguccaug

SEQ ID NO: 2741740 - RNA, 13 nt, Human
ugagagaaaauaa

SEQ ID NO: 2741741 - RNA, 12 nt, Human
ugagagacacac

SEQ ID NO: 2741742 - RNA, 19 nt, Human
ugagagacacacugaagaa

SEQ ID NO: 2741743 - RNA, 20 nt, Human
ugagagacacacugaagaag

SEQ ID NO: 2741744 - RNA, 21 nt, Human
ugagagacacacugaagaagc

SEQ ID NO: 2741745 - RNA, 15 nt, Human
ugagagaguggcugg

SEQ ID NO: 2741746 - RNA, 19 nt, Human
ugagagaugacagggaaaa

SEQ ID NO: 2741747 - RNA, 13 nt, Human
ugagagcaucagg

SEQ ID NO: 2741748 - RNA, 22 nt, Human
ugagagcccaaacugcuguccc

SEQ ID NO: 2741749 - RNA, 21 nt, Human
ugagaguacaccccaacagca

SEQ ID NO: 2741750 - RNA, 20 nt, Human
ugagagucugugacccacuu

SEQ ID NO: 2741751 - RNA, 14 nt, Human
ugagaugcuagaac

SEQ ID NO: 2741752 - RNA, 15 nt, Human
ugagaugcuagaacu

SEQ ID NO: 2741753 - RNA, 16 nt, Human
ugagaugcuagaacuc

SEQ ID NO: 2741754 - RNA, 17 nt, Human
ugagaugcuagaacucc

SEQ ID NO: 2741755 - RNA, 17 nt, Human
ugagaugggagaaucac

SEQ ID NO: 2741756 - RNA, 14 nt, Human
ugagaugguuucua

SEQ ID NO: 2741757 - RNA, 16 nt, Human
ugagauguguucacaa

SEQ ID NO: 2741758 - RNA, 22 nt, Human
ugagauuuugcuugagcaggau

SEQ ID NO: 2741759 - RNA, 14 nt, Human
ugagcaaaaccaaa

SEQ ID NO: 2741760 - RNA, 18 nt, Human
ugagcaaaaccaaauauu

SEQ ID NO: 2741761 - RNA, 14 nt, Human
ugagcaaaaguuga

SEQ ID NO: 2741762 - RNA, 14 nt, Human
ugagcaccugcagg

SEQ ID NO: 2741763 - RNA, 13 nt, Human
ugagcagucagga

SEQ ID NO: 2741764 - RNA, 14 nt, Human
ugcagccccuggga

SEQ ID NO: 2741765 - RNA, 19 nt, Human
ugcagcgaguacuucccgc

SEQ ID NO: 2741766 - RNA, 21 nt, Human
ugcagcgaguacuucccgcug

SEQ ID NO: 2741767 - RNA, 16 nt, Human
ugcagcucaugaguaa

SEQ ID NO: 2741768 - RNA, 22 nt, Human
ugcagcucuccccuucucugua

SEQ ID NO: 2741769 - RNA, 16 nt, Human
ugcagcucucuuuccu

SEQ ID NO: 2741770 - RNA, 21 nt, Human
ugcagcugagagaaaauaauc

SEQ ID NO: 2741771 - RNA, 23 nt, Human
ugcagcugagagaaaauaaucau

SEQ ID NO: 2741772 - RNA, 14 nt, Human
ugcagcuuccaggc

SEQ ID NO: 2741773 - RNA, 12 nt, Human
ugcaggcagcag

SEQ ID NO: 2741774 - RNA, 21 nt, Human
ugcaggcagcuuuuucucucc

SEQ ID NO: 2741775 - RNA, 18 nt, Human
ugcaggcaggaacaaaca

SEQ ID NO: 2741776 - RNA, 20 nt, Human
ugcagucacagcuacacaga

SEQ ID NO: 2741777 - RNA, 13 nt, Human
ugcaguggcgcaa

SEQ ID NO: 2741778 - RNA, 16 nt, Human
ugcagugucugcugga

SEQ ID NO: 2741779 - RNA, 16 nt, Human
ugcaguucugaagaag

SEQ ID NO: 2741780 - RNA, 23 nt, Human
ugcauacucauuaggauggcuag

SEQ ID NO: 2741781 - RNA, 15 nt, Human
ugcauagaauaaaau

SEQ ID NO: 2741782 - RNA, 18 nt, Human
ugcauagaauaaaauuuu

SEQ ID NO: 2741783 - RNA, 20 nt, Human
ugcauagaauaaaauuuuua

SEQ ID NO: 2741784 - RNA, 22 nt, Human
ugcauagaauaaaauuuuuaau

SEQ ID NO: 2741785 - RNA, 16 nt, Human
ugcauagguuuaauaa

SEQ ID NO: 2741786 - RNA, 18 nt, Human
ugcauagguuuaauaauu

SEQ ID NO: 2741787 - RNA, 23 nt, Human
ugcauagguuuaauaauuuuuaa

SEQ ID NO: 2741788 - RNA, 13 nt, Human
ugcauaguaccaa

SEQ ID NO: 2741789 - RNA, 17 nt, Human
ugcauauuuuauuauag

SEQ ID NO: 2741790 - RNA, 12 nt, Human
ugcaucuagagg

SEQ ID NO: 2741791 - RNA, 13 nt, Human
ugcaucugaaaau

SEQ ID NO: 2741792 - RNA, 14 nt, Human
ugcaucugaaaauu

SEQ ID NO: 2741793 - RNA, 19 nt, Human
ugcaucuuauuucugucaa

SEQ ID NO: 2741794 - RNA, 16 nt, Human
ugcaugguuuagaaag

SEQ ID NO: 2741795 - RNA, 21 nt, Human
ugcauguugcccuguugcugc

SEQ ID NO: 2741796 - RNA, 22 nt, Human
ugcauguugcccuguugcugcc

SEQ ID NO: 2741797 - RNA, 11 nt, Human
ugcauuaaaaa

SEQ ID NO: 2741798 - RNA, 19 nt, Human
ugcauuaaaaaugcauaua

SEQ ID NO: 2741799 - RNA, 17 nt, Human
ugcauuauaucaaaucu

SEQ ID NO: 2741800 - RNA, 18 nt, Human
ugcauucuggauuuuaaa

SEQ ID NO: 2741801 - RNA, 17 nt, Human
ugcauugccuguaacaa

SEQ ID NO: 2741802 - RNA, 14 nt, Human
ugcauuguccucuu

SEQ ID NO: 2741803 - RNA, 17 nt, Human
ugcauuuaugagcucuu

SEQ ID NO: 2741804 - RNA, 13 nt, Human
ugcauuucuaaag

SEQ ID NO: 2741805 - RNA, 17 nt, Human
ugcauuuuggaaggcug

SEQ ID NO: 2741806 - RNA, 15 nt, Human
ugcauuuuguuuggu

SEQ ID NO: 2741807 - RNA, 22 nt, Human
ugccaaaacaucaaccugccag

SEQ ID NO: 2741808 - RNA, 13 nt, Human
ugccaaaauauaa

SEQ ID NO: 2741809 - RNA, 15 nt, Human
ugccaaauauaaaua

SEQ ID NO: 2741810 - RNA, 16 nt, Human
ugccaaauauaaauaa

SEQ ID NO: 2741811 - RNA, 19 nt, Human
ugccaaaucaaaagacuuu

SEQ ID NO: 2741812 - RNA, 13 nt, Human
ugccaaggcugga

SEQ ID NO: 2741813 - RNA, 13 nt, Human
ugccaauauccua

SEQ ID NO: 2741814 - RNA, 14 nt, Human
ugccagauuuaugc

SEQ ID NO: 2741815 - RNA, 15 nt, Human
ugccagccagcagcc

SEQ ID NO: 2741816 - RNA, 15 nt, Human
ugccaggccuggcaa

SEQ ID NO: 2741817 - RNA, 19 nt, Human
ugccaguuguccuccuucc

SEQ ID NO: 2741818 - RNA, 11 nt, Human
ugccauaaaac

SEQ ID NO: 2741819 - RNA, 18 nt, Human
ugccauaauuacuauguc

SEQ ID NO: 2741820 - RNA, 14 nt, Human
ugccauauaauuca

SEQ ID NO: 2741821 - RNA, 17 nt, Human
ugccauauaauucaccu

SEQ ID NO: 2741822 - RNA, 15 nt, Human
ugccaucauuuacuu

SEQ ID NO: 2741823 - RNA, 14 nt, Human
ugccaucccucccu

SEQ ID NO: 2741824 - RNA, 20 nt, Human
ugccaugcuggccaggcugg

SEQ ID NO: 2741825 - RNA, 18 nt, Human
ugccaugugcuaguaauu

SEQ ID NO: 2741826 - RNA, 23 nt, Human
ugccaugugcuaguaauuggaaa

SEQ ID NO: 2741827 - RNA, 15 nt, Human
ugccauguggcagau

SEQ ID NO: 2741828 - RNA, 18 nt, Human
ugccauguggcagaucua

SEQ ID NO: 2741829 - RNA, 13 nt, Human
ugcccaagaauga

SEQ ID NO: 2741830 - RNA, 17 nt, Human
ugcccaagaaugagaag

SEQ ID NO: 2741831 - RNA, 18 nt, Human
ugcccaguuagccucugc

SEQ ID NO: 2741832 - RNA, 16 nt, Human
ugcccauaccccuggc

SEQ ID NO: 2741833 - RNA, 18 nt, Human
ugcccauaccccuggcca

SEQ ID NO: 2741834 - RNA, 13 nt, Human
ugcccauccugcc

SEQ ID NO: 2741835 - RNA, 17 nt, Human
ugcccauccugccccug

SEQ ID NO: 2741836 - RNA, 21 nt, Human
ugcccccaacagcacccucuc

SEQ ID NO: 2741837 - RNA, 15 nt, Human
ugcccccaaccauuu

SEQ ID NO: 2741838 - RNA, 13 nt, Human
ugccccccuugcc

SEQ ID NO: 2741839 - RNA, 20 nt, Human
ugccccggggaggggcgcuc

SEQ ID NO: 2741840 - RNA, 22 nt, Human
ugccccggggaggggcgcucgc

SEQ ID NO: 2741841 - RNA, 23 nt, Human
ugccccggggaggggcgcucgcu

SEQ ID NO: 2741842 - RNA, 23 nt, Human
ugccccuacccuggacuugccuc

SEQ ID NO: 2741843 - RNA, 19 nt, Human
ugccccugagcccauggca

SEQ ID NO: 2741844 - RNA, 18 nt, Human
ugcccggcuaauuuuugu

SEQ ID NO: 2741845 - RNA, 23 nt, Human
ugcccggcuaauuuuuguauuuu

SEQ ID NO: 2741846 - RNA, 16 nt, Human
ugcccuaggugagaac

SEQ ID NO: 2741847 - RNA, 17 nt, Human
ugcccucccccuccucu

SEQ ID NO: 2741848 - RNA, 15 nt, Human
ugcccucuccugggc

SEQ ID NO: 2741849 - RNA, 21 nt, Human
ugcccucuccugggcagcugc

SEQ ID NO: 2741850 - RNA, 17 nt, Human
ugcccugaaagucccag

SEQ ID NO: 2741851 - RNA, 21 nt, Human
ugcccugaaagucccagauca

SEQ ID NO: 2741852 - RNA, 12 nt, Human
ugcccugcugcc

SEQ ID NO: 2741853 - RNA, 15 nt, Human
ugcccugcugcccuc

SEQ ID NO: 2741854 - RNA, 16 nt, Human
ugcccugcugcccucc

SEQ ID NO: 2741855 - RNA, 14 nt, Human
ugcccuguuaaaag

SEQ ID NO: 2741856 - RNA, 15 nt, Human
ugcccuguugcugcc

SEQ ID NO: 2741857 - RNA, 16 nt, Human
ugccgacagcucucca

SEQ ID NO: 2741858 - RNA, 16 nt, Human
ugccgccuccuugugc

SEQ ID NO: 2741859 - RNA, 14 nt, Human
ugccgcucucucug

SEQ ID NO: 2741860 - RNA, 15 nt, Human
ugccgcucucucuga

SEQ ID NO: 2741861 - RNA, 10 nt, Human
ugccgcuguc

SEQ ID NO: 2741862 - RNA, 13 nt, Human
ugccgcugucucu

SEQ ID NO: 2741863 - RNA, 17 nt, Human
ugccgcugucucugagg

SEQ ID NO: 2741864 - RNA, 17 nt, Human
ugccgcuuucucugagg

SEQ ID NO: 2741865 - RNA, 15 nt, Human
ugccgugggccugag

SEQ ID NO: 2741866 - RNA, 19 nt, Human
ugccuaagcccuccgccau

SEQ ID NO: 2741867 - RNA, 15 nt, Human
ugccuaagugcagcc

SEQ ID NO: 2741868 - RNA, 21 nt, Human
ugccuaucagcauuuuacuac

SEQ ID NO: 2741869 - RNA, 19 nt, Human
ugccucaagcuaugugagc

SEQ ID NO: 2741870 - RNA, 14 nt, Human
ugccucaccagccc

SEQ ID NO: 2741871 - RNA, 16 nt, Human
ugccucaccccuugcc

SEQ ID NO: 2741872 - RNA, 19 nt, Human
ugccucaguuuccugaccu

SEQ ID NO: 2741873 - RNA, 11 nt, Human
ugccuccagau

SEQ ID NO: 2741874 - RNA, 14 nt, Human
ugccucccagguuc

SEQ ID NO: 2741875 - RNA, 15 nt, Human
ugccuccccuccucu

SEQ ID NO: 2741876 - RNA, 20 nt, Human
ugccuccccugccucaccag

SEQ ID NO: 2741877 - RNA, 21 nt, Human
ugccuccccuucacucccacc

SEQ ID NO: 2741878 - RNA, 16 nt, Human
ugccucccucucguaa

SEQ ID NO: 2741879 - RNA, 15 nt, Human
ugccucuaaaaggcc

SEQ ID NO: 2741880 - RNA, 18 nt, Human
ugccucucugcagguccc

SEQ ID NO: 2741881 - RNA, 21 nt, Human
ugccugagcggaccuucccag

SEQ ID NO: 2741882 - RNA, 15 nt, Human
ugccugcaggcauga

SEQ ID NO: 2741883 - RNA, 22 nt, Human
ugccugcuuuuuauggccugug

SEQ ID NO: 2741884 - RNA, 16 nt, Human
ugccuguaacaaugua

SEQ ID NO: 2741885 - RNA, 15 nt, Human
ugccuguaaucacag

SEQ ID NO: 2741886 - RNA, 21 nt, Human
ugccuguaaucacagcuacuu

SEQ ID NO: 2741887 - RNA, 13 nt, Human
ugccuucuggccu

SEQ ID NO: 2741888 - RNA, 19 nt, Human
ugccuugcugaacucccuc

SEQ ID NO: 2741889 - RNA, 13 nt, Human
ugccuuguuucau

SEQ ID NO: 2741890 - RNA, 16 nt, Human
ugccuuuauaaucuuu

SEQ ID NO: 2741891 - RNA, 12 nt, Human
ugccuuucuucu

SEQ ID NO: 2741892 - RNA, 14 nt, Human
ugccuuucuucucu

SEQ ID NO: 2741893 - RNA, 19 nt, Human
ugccuuuucccaacuccag

SEQ ID NO: 2741894 - RNA, 16 nt, Human
ugcgaaugguuccauu

SEQ ID NO: 2741895 - RNA, 14 nt, Human
ugcgagugcgugaa

SEQ ID NO: 2741896 - RNA, 14 nt, Human
ugcgcgccgcgcuc

SEQ ID NO: 2741897 - RNA, 20 nt, Human
ugcgcgccgcgcuccucgga

SEQ ID NO: 2741898 - RNA, 20 nt, Human
ugcggccagcuccgcgccag

SEQ ID NO: 2741899 - RNA, 18 nt, Human
ugcggcccaggauggcuu

SEQ ID NO: 2741900 - RNA, 12 nt, Human
ugcggccugguc

SEQ ID NO: 2741901 - RNA, 20 nt, Human
ugcggcuccucagggacuca

SEQ ID NO: 2741902 - RNA, 18 nt, Human
ugcuaacuggguuaaaua

SEQ ID NO: 2741903 - RNA, 19 nt, Human
ugcuaacuggguuaaauau

SEQ ID NO: 2741904 - RNA, 12 nt, Human
ugcuaagcauuc

SEQ ID NO: 2741905 - RNA, 23 nt, Human
ugcuaagccccagcaagcaaucc

SEQ ID NO: 2741906 - RNA, 14 nt, Human
ugcuaagucuuaua

SEQ ID NO: 2741907 - RNA, 16 nt, Human
ugcuaagucuuauaua

SEQ ID NO: 2741908 - RNA, 17 nt, Human
ugcuacaaaaacacagc

SEQ ID NO: 2741909 - RNA, 19 nt, Human
ugcuacaaaaacacagcaa

SEQ ID NO: 2741910 - RNA, 19 nt, Human
uggagggggcgcgugcagg

SEQ ID NO: 2741911 - RNA, 15 nt, Human
uggaguaaaucgcua

SEQ ID NO: 2741912 - RNA, 12 nt, Human
uggagugcagug

SEQ ID NO: 2741913 - RNA, 22 nt, Human
uggagugcaguggcaucaucuc

SEQ ID NO: 2741914 - RNA, 17 nt, Human
uggagugcaguggcgca

SEQ ID NO: 2741915 - RNA, 17 nt, Human
uggaguuucucuagaag

SEQ ID NO: 2741916 - RNA, 16 nt, Human
uggauacuccaugggg

SEQ ID NO: 2741917 - RNA, 19 nt, Human
uggauacuccauggggugg

SEQ ID NO: 2741918 - RNA, 16 nt, Human
uggauaggcacaggaa

SEQ ID NO: 2741919 - RNA, 22 nt, Human
uggaugauccccacgccacagc

SEQ ID NO: 2741920 - RNA, 16 nt, Human
uggaugcucucguuga

SEQ ID NO: 2741921 - RNA, 22 nt, Human
uggauuugcaaccccaucaucc

SEQ ID NO: 2741922 - RNA, 20 nt, Human
uggauuuuaaaaguuuuuua

SEQ ID NO: 2741923 - RNA, 19 nt, Human
uggcaaacugccaucauuu

SEQ ID NO: 2741924 - RNA, 19 nt, Human
uggcaagcucuaucaccaa

SEQ ID NO: 2741925 - RNA, 22 nt, Human
uggcacuaguauuucuaugaaa

SEQ ID NO: 2741926 - RNA, 15 nt, Human
uggcacuuauaacca

SEQ ID NO: 2741927 - RNA, 13 nt, Human
uggcagagccagg

SEQ ID NO: 2741928 - RNA, 16 nt, Human
uggcagcuuuccucaa

SEQ ID NO: 2741929 - RNA, 16 nt, Human
uggcaguggaacuaag

SEQ ID NO: 2741930 - RNA, 10 nt, Human
uggcagugua

SEQ ID NO: 2741931 - RNA, 13 nt, Human
uggcaguuuucca

SEQ ID NO: 2741932 - RNA, 18 nt, Human
uggcauauugauaauaaa

SEQ ID NO: 2741933 - RNA, 20 nt, Human
uggcauauugauaauaaaau

SEQ ID NO: 2741934 - RNA, 12 nt, Human
uggcaucaucuc

SEQ ID NO: 2741935 - RNA, 14 nt, Human
uggcaucaucucag

SEQ ID NO: 2741936 - RNA, 15 nt, Human
uggcauuuuacugua

SEQ ID NO: 2741937 - RNA, 20 nt, Human
uggccacacaggaucuuuug

SEQ ID NO: 2741938 - RNA, 19 nt, Human
uggccacaucugagccccg

SEQ ID NO: 2741939 - RNA, 20 nt, Human
uggccacaucugagccccga

SEQ ID NO: 2741940 - RNA, 14 nt, Human
uggccaccugcuga

SEQ ID NO: 2741941 - RNA, 22 nt, Human
uggcccaacacaauucuucuuc

SEQ ID NO: 2741942 - RNA, 16 nt, Human
uggcccagagaagcca

SEQ ID NO: 2741943 - RNA, 20 nt, Human
uggcccaggaguuuggccag

SEQ ID NO: 2741944 - RNA, 17 nt, Human
uggccgcagugaggcgg

SEQ ID NO: 2741945 - RNA, 15 nt, Human
uggccgggagccuga

SEQ ID NO: 2741946 - RNA, 24 nt, Human
uggccgggagccugaucaccugcc

SEQ ID NO: 2741947 - RNA, 20 nt, Human
uggccucugcucaacuagca

SEQ ID NO: 2741948 - RNA, 10 nt, Human
uggccugugg

SEQ ID NO: 2741949 - RNA, 14 nt, Human
uggccuucggccuc

SEQ ID NO: 2741950 - RNA, 21 nt, Human
uggccuucggccuccauccug

SEQ ID NO: 2741951 - RNA, 17 nt, Human
uggcgcaaucuuaacuc

SEQ ID NO: 2741952 - RNA, 15 nt, Human
uggcgcaggaacuca

SEQ ID NO: 2741953 - RNA, 15 nt, Human
uggcgcgcgccacca

SEQ ID NO: 2741954 - RNA, 19 nt, Human
uggcgcgcgccaccacgcc

SEQ ID NO: 2741955 - RNA, 19 nt, Human
uggcgcuggcugcgcucgg

SEQ ID NO: 2741956 - RNA, 22 nt, Human
uggcgcuggcugcgcucggccu

SEQ ID NO: 2741957 - RNA, 18 nt, Human
uggcgugaucucagcuca

SEQ ID NO: 2741958 - RNA, 17 nt, Human
uggcuaagcaaaaugug

SEQ ID NO: 2741959 - RNA, 15 nt, Human
uggcuaauuagcaug

SEQ ID NO: 2741960 - RNA, 14 nt, Human
uggcuagccucugg

SEQ ID NO: 2741961 - RNA, 15 nt, Human
uggcucacgccugua

SEQ ID NO: 2741962 - RNA, 13 nt, Human
uggcuccagcugg

SEQ ID NO: 2741963 - RNA, 14 nt, Human
uggcucucccagcc

SEQ ID NO: 2741964 - RNA, 14 nt, Human
uggcucugugugcu

SEQ ID NO: 2741965 - RNA, 17 nt, Human
uggcugcgcucggccug

SEQ ID NO: 2741966 - RNA, 23 nt, Human
uggcugcgcucggccugcucgcc

SEQ ID NO: 2741967 - RNA, 16 nt, Human
uggcugggaguggcau

SEQ ID NO: 2741968 - RNA, 11 nt, Human
uggcuguuccu

SEQ ID NO: 2741969 - RNA, 15 nt, Human
uggcuguuccugcag

SEQ ID NO: 2741970 - RNA, 21 nt, Human
uggcuuaaaauguaauuaauc

SEQ ID NO: 2741971 - RNA, 22 nt, Human
uggcuucaaauuguaagcaugc

SEQ ID NO: 2741972 - RNA, 16 nt, Human
uggcuuccaauuuuug

SEQ ID NO: 2741973 - RNA, 14 nt, Human
uggcuucccaaagu

SEQ ID NO: 2741974 - RNA, 23 nt, Human
uggcuugaguuuaaauuguaaua

SEQ ID NO: 2741975 - RNA, 14 nt, Human
uggcuuuuggcucc

SEQ ID NO: 2741976 - RNA, 18 nt, Human
uggcuuuuggcuccaccc

SEQ ID NO: 2741977 - RNA, 16 nt, Human
uggcuuuuuuuuuuuc

SEQ ID NO: 2741978 - RNA, 15 nt, Human
ugggaaaaaguaauu

SEQ ID NO: 2741979 - RNA, 23 nt, Human
ugggaacaucacauuccucugcc

SEQ ID NO: 2741980 - RNA, 15 nt, Human
ugggaaggagacaaa

SEQ ID NO: 2741981 - RNA, 20 nt, Human
ugggaaggagacaaaacuag

SEQ ID NO: 2741982 - RNA, 22 nt, Human
ugggaauauuugaaucuugucu

SEQ ID NO: 2741983 - RNA, 17 nt, Human
ugggaauuuucuuccaa

SEQ ID NO: 2741984 - RNA, 19 nt, Human
ugggacaggggagaaccua

SEQ ID NO: 2741985 - RNA, 15 nt, Human
ugggacagucaccuc

SEQ ID NO: 2741986 - RNA, 18 nt, Human
ugggacagucaccucaug

SEQ ID NO: 2741987 - RNA, 22 nt, Human
ugggacagucaccucauggaau

SEQ ID NO: 2741988 - RNA, 23 nt, Human
ugggacaguuccugagaccagcc

SEQ ID NO: 2741989 - RNA, 24 nt, Human
ugggacaguuccugagaccagcca

SEQ ID NO: 2741990 - RNA, 19 nt, Human
ugggacauuugcucaugga

SEQ ID NO: 2741991 - RNA, 22 nt, Human
ugggacauuugcucauggaauu

SEQ ID NO: 2741992 - RNA, 15 nt, Human
ugggagccagggcug

SEQ ID NO: 2741993 - RNA, 15 nt, Human
ugggagcugccaaga

SEQ ID NO: 2741994 - RNA, 13 nt, Human
ugggaggcugaga

SEQ ID NO: 2741995 - RNA, 18 nt, Human
ugggauacuauuuaauua

SEQ ID NO: 2741996 - RNA, 22 nt, Human
ugggauacuauuuaauuauuuc

SEQ ID NO: 2741997 - RNA, 21 nt, Human
ugggauagcugacccagcccc

SEQ ID NO: 2741998 - RNA, 13 nt, Human
ugggaucacugau

SEQ ID NO: 2741999 - RNA, 20 nt, Human
ugggcacaacacaucaggaa

SEQ ID NO: 2742000 - RNA, 22 nt, Human
ugggcacuguggguagacacac

SEQ ID NO: 2742001 - RNA, 22 nt, Human
ugggcagaaggccaagaggcug

SEQ ID NO: 2742002 - RNA, 14 nt, Human
ugggcagaucacuu

SEQ ID NO: 2742003 - RNA, 11 nt, Human
ugggcagcugc

SEQ ID NO: 2742004 - RNA, 13 nt, Human
ugggcauucaaau

SEQ ID NO: 2742005 - RNA, 21 nt, Human
ugggcauucuuguuucaauuc

SEQ ID NO: 2742006 - RNA, 19 nt, Human
ugggccauagucauucugc

SEQ ID NO: 2742007 - RNA, 23 nt, Human
ugggcccaguaccuagcuggcuc

SEQ ID NO: 2742008 - RNA, 19 nt, Human
ugggccccagauaccauga

SEQ ID NO: 2742009 - RNA, 23 nt, Human
ugggccccugccucucugcaggu

SEQ ID NO: 2742010 - RNA, 15 nt, Human
ugggccuccucuguc

SEQ ID NO: 2742011 - RNA, 18 nt, Human
ugggccugagaccaaggc

SEQ ID NO: 2742012 - RNA, 21 nt, Human
uggggaauauguuagagaauu

SEQ ID NO: 2742013 - RNA, 21 nt, Human
uggggcacugugggacuggga

SEQ ID NO: 2742014 - RNA, 17 nt, Human
uggggcagugcuuggcc

SEQ ID NO: 2742015 - RNA, 23 nt, Human
uggggcagugcuuggcccaggag

SEQ ID NO: 2742016 - RNA, 13 nt, Human
uggggccaggcug

SEQ ID NO: 2742017 - RNA, 17 nt, Human
uggggcugaugcaguug

SEQ ID NO: 2742018 - RNA, 13 nt, Human
ugggggcagagcc

SEQ ID NO: 2742019 - RNA, 11 nt, Human
ugggggcagca

SEQ ID NO: 2742020 - RNA, 18 nt, Human
uggggggggugcugggcc

SEQ ID NO: 2742021 - RNA, 20 nt, Human
ugggggugccgcucucucug

SEQ ID NO: 2742022 - RNA, 16 nt, Human
ugggguuucaccaugu

SEQ ID NO: 2742023 - RNA, 17 nt, Human
ugggguuucaccauguu

SEQ ID NO: 2742024 - RNA, 16 nt, Human
uggguagccugggugu

SEQ ID NO: 2742025 - RNA, 19 nt, Human
uggguaguggggaagaggg

SEQ ID NO: 2742026 - RNA, 15 nt, Human
uggguaucaccacug

SEQ ID NO: 2742027 - RNA, 16 nt, Human
ugggucgccggcaucu

SEQ ID NO: 2742028 - RNA, 22 nt, Human
ugggucuaccacucagagaaac

SEQ ID NO: 2742029 - RNA, 14 nt, Human
uggguuccuuccuc

SEQ ID NO: 2742030 - RNA, 22 nt, Human
uggguuccuuccucugagccuu

SEQ ID NO: 2742031 - RNA, 13 nt, Human
uggguugcacugg

SEQ ID NO: 2742032 - RNA, 23 nt, Human
ugguaaccucuuacuuauuaucu

SEQ ID NO: 2742033 - RNA, 17 nt, Human
ugguaagcaccaggacg

SEQ ID NO: 2742034 - RNA, 21 nt, Human
ugguaauaaguacuguguaca

SEQ ID NO: 2742035 - RNA, 22 nt, Human
ugguacccacuugcuuuuaaaa

SEQ ID NO: 2742036 - RNA, 16 nt, Human
ugguacuagauacuga

SEQ ID NO: 2742037 - RNA, 22 nt, Human
ugguagcuaaauauauauuuua

SEQ ID NO: 2742038 - RNA, 16 nt, Human
ugguagggggaaaaug

SEQ ID NO: 2742039 - RNA, 14 nt, Human
ugguauguuuucag

SEQ ID NO: 2742040 - RNA, 14 nt, Human
ugguauuguauuua

SEQ ID NO: 2742041 - RNA, 16 nt, Human
uggucaacauggugaa

SEQ ID NO: 2742042 - RNA, 19 nt, Human
uggucccuauuccuccuuc

SEQ ID NO: 2742043 - RNA, 21 nt, Human
uggucccuauuccuccuuccc

SEQ ID NO: 2742044 - RNA, 13 nt, Human
ugguccuaagucc

SEQ ID NO: 2742045 - RNA, 21 nt, Human
ugguccuaagucccugcugcc

SEQ ID NO: 2742046 - RNA, 22 nt, Human
ugguccuaagucccugcugccc

SEQ ID NO: 2742047 - RNA, 22 nt, Human
uggucucagugucaaugcagcc

SEQ ID NO: 2742048 - RNA, 23 nt, Human
uggucucagugucaaugcagccc

SEQ ID NO: 2742049 - RNA, 14 nt, Human
uggucuccaucucu

SEQ ID NO: 2742050 - RNA, 20 nt, Human
uggucucgaacugcuggauu

SEQ ID NO: 2742051 - RNA, 21 nt, Human
uggucugugagaugcuagaac

SEQ ID NO: 2742052 - RNA, 19 nt, Human
uggugaaaccuggucucua

SEQ ID NO: 2742053 - RNA, 17 nt, Human
uggugaaaugcagaguc

SEQ ID NO: 2742054 - RNA, 16 nt, Human
ugugcauauuuuauua

SEQ ID NO: 2742055 - RNA, 18 nt, Human
ugugcauauuuuauuaua

SEQ ID NO: 2742056 - RNA, 22 nt, Human
ugugccugagcggaccuuccca

SEQ ID NO: 2742057 - RNA, 13 nt, Human
ugugcggccuggu

SEQ ID NO: 2742058 - RNA, 16 nt, Human
ugugcucaggagcccu

SEQ ID NO: 2742059 - RNA, 21 nt, Human
ugugcugcccgucuucagccu

SEQ ID NO: 2742060 - RNA, 19 nt, Human
ugugcuggcuuaaaaugua

SEQ ID NO: 2742061 - RNA, 20 nt, Human
ugugcuggcuuaaaauguaa

SEQ ID NO: 2742062 - RNA, 16 nt, Human
ugugcuuucuaucuaa

SEQ ID NO: 2742063 - RNA, 13 nt, Human
ugugcuuuuaaaa

SEQ ID NO: 2742064 - RNA, 23 nt, Human
uguggaaggugaucuggcucugg

SEQ ID NO: 2742065 - RNA, 15 nt, Human
uguggaaguggggcg

SEQ ID NO: 2742066 - RNA, 19 nt, Human
uguggauuuaauguggaaa

SEQ ID NO: 2742067 - RNA, 13 nt, Human
uguggcagagcca

SEQ ID NO: 2742068 - RNA, 15 nt, Human
uguggcagaucuaca

SEQ ID NO: 2742069 - RNA, 20 nt, Human
uguggccugaguaaugcauu

SEQ ID NO: 2742070 - RNA, 21 nt, Human
uguggccugaguaaugcauua

SEQ ID NO: 2742071 - RNA, 14 nt, Human
uguggcuguaucuu

SEQ ID NO: 2742072 - RNA, 16 nt, Human
uguggcuuucagagcc

SEQ ID NO: 2742073 - RNA, 14 nt, Human
ugugggacugggac

SEQ ID NO: 2742074 - RNA, 22 nt, Human
ugugggauacuauuuaauuauu

SEQ ID NO: 2742075 - RNA, 24 nt, Human
ugugggccagacaaggccuuggag

SEQ ID NO: 2742076 - RNA, 22 nt, Human
uguggguagacacacaugaagu

SEQ ID NO: 2742077 - RNA, 20 nt, Human
ugugguacaugguguuugug

SEQ ID NO: 2742078 - RNA, 16 nt, Human
uguggucacaggaagu

SEQ ID NO: 2742079 - RNA, 20 nt, Human
uguggugggacagggaccca

SEQ ID NO: 2742080 - RNA, 14 nt, Human
ugugguuagaaaag

SEQ ID NO: 2742081 - RNA, 23 nt, Human
ugugguuagaaaaguuauguaga

SEQ ID NO: 2742082 - RNA, 12 nt, Human
uguguaagaaca

SEQ ID NO: 2742083 - RNA, 16 nt, Human
uguguaagacaaaaag

SEQ ID NO: 2742084 - RNA, 17 nt, Human
uguguacaaugugagau

SEQ ID NO: 2742085 - RNA, 14 nt, Human
uguguauuauaauu

SEQ ID NO: 2742086 - RNA, 15 nt, Human
ugugucaguggaugc

SEQ ID NO: 2742087 - RNA, 19 nt, Human
ugugugagguucgcuuauc

SEQ ID NO: 2742088 - RNA, 14 nt, Human
uguguguuuuaaac

SEQ ID NO: 2742089 - RNA, 14 nt, Human
uguguuggccagga

SEQ ID NO: 2742090 - RNA, 19 nt, Human
uguguuuacagacgugugc

SEQ ID NO: 2742091 - RNA, 15 nt, Human
uguguuuacuuuaug

SEQ ID NO: 2742092 - RNA, 15 nt, Human
uguguuuauuucacu

SEQ ID NO: 2742093 - RNA, 18 nt, Human
uguguuugacgggaaaca

SEQ ID NO: 2742094 - RNA, 20 nt, Human
uguuaaaagaugaaaauauu

SEQ ID NO: 2742095 - RNA, 13 nt, Human
uguuaauuuugcu

SEQ ID NO: 2742096 - RNA, 15 nt, Human
uguuacauuauuauc

SEQ ID NO: 2742097 - RNA, 19 nt, Human
uguuacauuauuaucaaca

SEQ ID NO: 2742098 - RNA, 23 nt, Human
uguuauagguuguuggauaaauc

SEQ ID NO: 2742099 - RNA, 17 nt, Human
uguuaucuucacuuuua

SEQ ID NO: 2742100 - RNA, 19 nt, Human
uguuaucuucacuuuuaua

SEQ ID NO: 2742101 - RNA, 19 nt, Human
uguuaugcauaaagucagu

SEQ ID NO: 2742102 - RNA, 14 nt, Human
uguuauuuuuuaau

SEQ ID NO: 2742103 - RNA, 18 nt, Human
uguucaagaccagccugg

SEQ ID NO: 2742104 - RNA, 21 nt, Human
uguucacagccagacuggcac

SEQ ID NO: 2742105 - RNA, 15 nt, Human
uguucacccaaccac

SEQ ID NO: 2742106 - RNA, 19 nt, Human
uguucccaccaggcugcuc

SEQ ID NO: 2742107 - RNA, 17 nt, Human
uguuccccuuugcuuca

SEQ ID NO: 2742108 - RNA, 16 nt, Human
uguuccugcuuuuccc

SEQ ID NO: 2742109 - RNA, 17 nt, Human
uguucuaagaagugaaa

SEQ ID NO: 2742110 - RNA, 13 nt, Human
uguucuauaacaa

SEQ ID NO: 2742111 - RNA, 14 nt, Human
uguucuauuuuaau

SEQ ID NO: 2742112 - RNA, 23 nt, Human
uguucucuucuuuaaagggaugg

SEQ ID NO: 2742113 - RNA, 22 nt, Human
uguucugauauuggacaguaaa

SEQ ID NO: 2742114 - RNA, 19 nt, Human
uguucugugauauaagugu

SEQ ID NO: 2742115 - RNA, 23 nt, Human
uguucuuaagacgugauuuugcu

SEQ ID NO: 2742116 - RNA, 17 nt, Human
uguugagcagcaucucu

SEQ ID NO: 2742117 - RNA, 16 nt, Human
uguugagguaccucca

SEQ ID NO: 2742118 - RNA, 23 nt, Human
uguugagguaccuccaaggaccg

SEQ ID NO: 2742119 - RNA, 18 nt, Human
uguugauagcaagugaau

SEQ ID NO: 2742120 - RNA, 19 nt, Human
uguugcauagaauaaaauu

SEQ ID NO: 2742121 - RNA, 11 nt, Human
uguugcauuaa

SEQ ID NO: 2742122 - RNA, 18 nt, Human
uguugcauuaaaaaugca

SEQ ID NO: 2742123 - RNA, 22 nt, Human
uguugcccacagcuguaugauu

SEQ ID NO: 2742124 - RNA, 22 nt, Human
uguuggagaagaacugaaauca

SEQ ID NO: 2742125 - RNA, 23 nt, Human
uguuggagaagaacugaaaucau

SEQ ID NO: 2742126 - RNA, 21 nt, Human
uguuggauuuuugucuugugu

SEQ ID NO: 2742127 - RNA, 14 nt, Human
uguuggccaggcuu

SEQ ID NO: 2742128 - RNA, 17 nt, Human
uguuggcuguuccugca

SEQ ID NO: 2742129 - RNA, 23 nt, Human
uguugggguggguauaaaagaug

SEQ ID NO: 2742130 - RNA, 20 nt, Human
uguuggugaacuugguuuua

SEQ ID NO: 2742131 - RNA, 20 nt, Human
uguuguaauauuucuucaaa

SEQ ID NO: 2742132 - RNA, 16 nt, Human
uguuguaugucuuguu

SEQ ID NO: 2742133 - RNA, 15 nt, Human
uguugucuuuuccuu

SEQ ID NO: 2742134 - RNA, 15 nt, Human
uguuguguuuuuaac

SEQ ID NO: 2742135 - RNA, 17 nt, Human
uguuuaaaaucauuucu

SEQ ID NO: 2742136 - RNA, 17 nt, Human
uguuuaauucugaaagc

SEQ ID NO: 2742137 - RNA, 16 nt, Human
uguuuagaaacacaac

SEQ ID NO: 2742138 - RNA, 20 nt, Human
uguuuaggauguugaaaaag

SEQ ID NO: 2742139 - RNA, 23 nt, Human
uguuuaggauguugaaaaaguuc

SEQ ID NO: 2742140 - RNA, 19 nt, Human
uguuuaguaaucauauugu

SEQ ID NO: 2742141 - RNA, 14 nt, Human
uguuuauaaacauu

SEQ ID NO: 2742142 - RNA, 15 nt, Human
uguuuauaauuuuaa

SEQ ID NO: 2742143 - RNA, 17 nt, Human
uguuuauaauuuuaaau

SEQ ID NO: 2742144 - RNA, 15 nt, Human
uguuuauuuguuuuu

SEQ ID NO: 2742145 - RNA, 14 nt, Human
uguuucaaacauau

SEQ ID NO: 2742146 - RNA, 14 nt, Human
uguuucacugugca

SEQ ID NO: 2742147 - RNA, 17 nt, Human
uguuucacuugguucag

SEQ ID NO: 2742148 - RNA, 14 nt, Human
uguuucauauugau

SEQ ID NO: 2742149 - RNA, 22 nt, Human
uguuucauauuuuucauagcua

SEQ ID NO: 2742150 - RNA, 12 nt, Human
uguuuccaucaa

SEQ ID NO: 2742151 - RNA, 16 nt, Human
uguuuccuagcgcagc

SEQ ID NO: 2742152 - RNA, 18 nt, Human
uguuuccuagcgcagcca

SEQ ID NO: 2742153 - RNA, 12 nt, Human
uguuuccucugu

SEQ ID NO: 2742154 - RNA, 18 nt, Human
uguuuccuuauauuaugg

SEQ ID NO: 2742155 - RNA, 17 nt, Human
uguuucgcugauauaug

SEQ ID NO: 2742156 - RNA, 14 nt, Human
uguuucuacuacau

SEQ ID NO: 2742157 - RNA, 14 nt, Human
uguuucuuaaaugg

SEQ ID NO: 2742158 - RNA, 18 nt, Human
uguuucuugagaagagaa

SEQ ID NO: 2742159 - RNA, 20 nt, Human
uguuucuuggggaauauguu

SEQ ID NO: 2742160 - RNA, 18 nt, Human
uguuucuuuaguuuuugu

SEQ ID NO: 2742161 - RNA, 23 nt, Human
uguuucuuuguaaugaaaaccac

SEQ ID NO: 2742162 - RNA, 12 nt, Human
uguuugaaagcu

SEQ ID NO: 2742163 - RNA, 19 nt, Human
uguuugccgcuuaagcuuu

SEQ ID NO: 2742164 - RNA, 15 nt, Human
uguuugcucagcuuc

SEQ ID NO: 2742165 - RNA, 19 nt, Human
uguuuuaaaaugagaaauc

SEQ ID NO: 2742166 - RNA, 20 nt, Human
uguuuuaagauaaauuauaa

SEQ ID NO: 2742167 - RNA, 21 nt, Human
uguuuuaagauaaauuauaag

SEQ ID NO: 2742168 - RNA, 16 nt, Human
uguuuuaggaauacau

SEQ ID NO: 2742169 - RNA, 22 nt, Human
uguuuucaggcuagauguaugu

SEQ ID NO: 2742170 - RNA, 19 nt, Human
uguuuucauuaucucaaaa

SEQ ID NO: 2742171 - RNA, 16 nt, Human
uguuuucccuccuugg

SEQ ID NO: 2742172 - RNA, 18 nt, Human
uguuuuggugguuuuagu

SEQ ID NO: 2742173 - RNA, 15 nt, Human
uguuuuuaagcuguu

SEQ ID NO: 2742174 - RNA, 17 nt, Human
uguuuuuauauauguga

SEQ ID NO: 2742175 - RNA, 12 nt, Human
uguuuuucacau

SEQ ID NO: 2742176 - RNA, 13 nt, Human
uguuuuucuuuuu

SEQ ID NO: 2742177 - RNA, 11 nt, Human
uguuuuuucua

SEQ ID NO: 2742178 - RNA, 19 nt, Human
uguuuuuuuuuuuuuugag

SEQ ID NO: 2742179 - RNA, 22 nt, Human
uuaaaaaaaaaacguauugcau

SEQ ID NO: 2742180 - RNA, 19 nt, Human
uuaaaaaaaaaccugagcc

SEQ ID NO: 2742181 - RNA, 20 nt, Human
uuaaaaaaaaaccugagccc

SEQ ID NO: 2742182 - RNA, 13 nt, Human
uuaaaaaagaaac

SEQ ID NO: 2742183 - RNA, 23 nt, Human
uuaaaaaugguuuaaauggucaa

SEQ ID NO: 2742184 - RNA, 20 nt, Human
uuaaaagaauauuuuaacuu

SEQ ID NO: 2742185 - RNA, 16 nt, Human
uuaaaagaaugauuau

SEQ ID NO: 2742186 - RNA, 19 nt, Human
uuaaaagaaugauuaugaa

SEQ ID NO: 2742187 - RNA, 22 nt, Human
uuaaaagaaugauuaugaauua

SEQ ID NO: 2742188 - RNA, 14 nt, Human
uuaaaauagccaua

SEQ ID NO: 2742189 - RNA, 11 nt, Human
uuaaaaucauu

SEQ ID NO: 2742190 - RNA, 13 nt, Human
uuaaaaucauuuc

SEQ ID NO: 2742191 - RNA, 18 nt, Human
uuaaaaugagaaaucuaa

SEQ ID NO: 2742192 - RNA, 19 nt, Human
uuaaacaaaaaaagcauug

SEQ ID NO: 2742193 - RNA, 18 nt, Human
uuaaacacauuaggaaaa

SEQ ID NO: 2742194 - RNA, 18 nt, Human
uuaaacacuaaaaaggca

SEQ ID NO: 2742195 - RNA, 21 nt, Human
uuaaacaucagcaaaaaagua

SEQ ID NO: 2742196 - RNA, 15 nt, Human
uuaaacuaaggcccu

SEQ ID NO: 2742197 - RNA, 17 nt, Human
uuaaacuggaaauaaaa

SEQ ID NO: 2742198 - RNA, 15 nt, Human
uuauacgauaaauaa

SEQ ID NO: 2742199 - RNA, 15 nt, Human
uuauacuuuguaaag

SEQ ID NO: 2742200 - RNA, 13 nt, Human
uuauagaauauuu

SEQ ID NO: 2742201 - RNA, 14 nt, Human
uuauagcuacuaau

SEQ ID NO: 2742202 - RNA, 13 nt, Human
uuauauaaauuuu

SEQ ID NO: 2742203 - RNA, 14 nt, Human
uuauauaauauuuu

SEQ ID NO: 2742204 - RNA, 12 nt, Human
uuauauacaauu

SEQ ID NO: 2742205 - RNA, 15 nt, Human
uuauauauauuuuuu

SEQ ID NO: 2742206 - RNA, 21 nt, Human
uuauauauauuuuuuucugaa

SEQ ID NO: 2742207 - RNA, 14 nt, Human
uuauauauguauuu

SEQ ID NO: 2742208 - RNA, 17 nt, Human
uuauaucaauuuaaaaa

SEQ ID NO: 2742209 - RNA, 17 nt, Human
uuauauccacuaaaauc

SEQ ID NO: 2742210 - RNA, 14 nt, Human
uuauaucuauauuu

SEQ ID NO: 2742211 - RNA, 15 nt, Human
uuauaugcuauuuau

SEQ ID NO: 2742212 - RNA, 17 nt, Human
uuauaugcuucuguuuu

SEQ ID NO: 2742213 - RNA, 15 nt, Human
uuauauuauuuugaa

SEQ ID NO: 2742214 - RNA, 19 nt, Human
uuauauugauaagaucuuu

SEQ ID NO: 2742215 - RNA, 11 nt, Human
uuauauuuauu

SEQ ID NO: 2742216 - RNA, 20 nt, Human
uuauauuuauuacuguaaga

SEQ ID NO: 2742217 - RNA, 19 nt, Human
uuauauuucuguuaaaaua

SEQ ID NO: 2742218 - RNA, 15 nt, Human
uuauauuugaaauau

SEQ ID NO: 2742219 - RNA, 15 nt, Human
uuauauuuuugugau

SEQ ID NO: 2742220 - RNA, 21 nt, Human
uuaucagucauaacuaaauaa

SEQ ID NO: 2742221 - RNA, 23 nt, Human
uuaucagucauaacuaaauaaag

SEQ ID NO: 2742222 - RNA, 17 nt, Human
uuaucaugugucuucug

SEQ ID NO: 2742223 - RNA, 18 nt, Human
uuaucauuuaguuauaaa

SEQ ID NO: 2742224 - RNA, 21 nt, Human
uuauccggucggguuuuauug

SEQ ID NO: 2742225 - RNA, 16 nt, Human
uuauccuaucucucca

SEQ ID NO: 2742226 - RNA, 22 nt, Human
uuaucuaaucaugaaacucccu

SEQ ID NO: 2742227 - RNA, 21 nt, Human
uuaucuaucuaucuauuuauu

SEQ ID NO: 2742228 - RNA, 13 nt, Human
uuaucuauuuaaa

SEQ ID NO: 2742229 - RNA, 19 nt, Human
uuaucuauuuaaauauuua

SEQ ID NO: 2742230 - RNA, 17 nt, Human
uuaucucaaaacugcac

SEQ ID NO: 2742231 - RNA, 18 nt, Human
uuaucucaaaacugcacu

SEQ ID NO: 2742232 - RNA, 23 nt, Human
uuaucugagucaacuccuuucuc

SEQ ID NO: 2742233 - RNA, 14 nt, Human
uuaucuugaauaau

SEQ ID NO: 2742234 - RNA, 14 nt, Human
uuaucuuuuuagua

SEQ ID NO: 2742235 - RNA, 13 nt, Human
uuaugaaacauua

SEQ ID NO: 2742236 - RNA, 14 nt, Human
uuaugaaccuuuac

SEQ ID NO: 2742237 - RNA, 14 nt, Human
uuaugauuaaguaa

SEQ ID NO: 2742238 - RNA, 23 nt, Human
uuaugccgcuagauacaugcuuu

SEQ ID NO: 2742239 - RNA, 18 nt, Human
uuaugccucuguauuuaa

SEQ ID NO: 2742240 - RNA, 15 nt, Human
uuaugcuaagugaaa

SEQ ID NO: 2742241 - RNA, 18 nt, Human
uuauggagauauaauucu

SEQ ID NO: 2742242 - RNA, 19 nt, Human
uuauggcacuaguauuucu

SEQ ID NO: 2742243 - RNA, 21 nt, Human
uuaugguuguauuauuuuuua

SEQ ID NO: 2742244 - RNA, 12 nt, Human
uuaugugaaaca

SEQ ID NO: 2742245 - RNA, 17 nt, Human
uuaugugaaacauguuu

SEQ ID NO: 2742246 - RNA, 20 nt, Human
uuaugugcaauaaaauguau

SEQ ID NO: 2742247 - RNA, 19 nt, Human
uuauuaauuugacuagaaa

SEQ ID NO: 2742248 - RNA, 18 nt, Human
uuauuacuguaagaaaau

SEQ ID NO: 2742249 - RNA, 12 nt, Human
uuauuauaguca

SEQ ID NO: 2742250 - RNA, 18 nt, Human
uuauuauauauauauauu

SEQ ID NO: 2742251 - RNA, 20 nt, Human
uuauuaugcauuauaucaaa

SEQ ID NO: 2742252 - RNA, 13 nt, Human
uuauucacaagac

SEQ ID NO: 2742253 - RNA, 12 nt, Human
uuauucacugua

SEQ ID NO: 2742254 - RNA, 20 nt, Human
uuauucacuguauguccuug

SEQ ID NO: 2742255 - RNA, 20 nt, Human
uuauugaggcuuuaaaacuu

SEQ ID NO: 2742256 - RNA, 12 nt, Human
uuauuguagcau

SEQ ID NO: 2742257 - RNA, 21 nt, Human
uuauugucuagugaaacucgu

SEQ ID NO: 2742258 - RNA, 18 nt, Human
uuauuguugcauuaaaaa

SEQ ID NO: 2742259 - RNA, 18 nt, Human
uuauuuagggaacugcuu

SEQ ID NO: 2742260 - RNA, 12 nt, Human
uuauuucacuuu

SEQ ID NO: 2742261 - RNA, 16 nt, Human
uuauuuccauauuaaa

SEQ ID NO: 2742262 - RNA, 21 nt, Human
uuauuuuaauaauguuucaaa

SEQ ID NO: 2742263 - RNA, 21 nt, Human
uuauuuucuauaauuuaaaua

SEQ ID NO: 2742264 - RNA, 12 nt, Human
uuauuuugccaa

SEQ ID NO: 2742265 - RNA, 21 nt, Human
uuauuuugugaugcaaauaaa

SEQ ID NO: 2742266 - RNA, 11 nt, Human
uuauuuuuaaa

SEQ ID NO: 2742267 - RNA, 14 nt, Human
uuauuuuuccauuu

SEQ ID NO: 2742268 - RNA, 14 nt, Human
uuauuuuuuaagua

SEQ ID NO: 2742269 - RNA, 12 nt, Human
uucaaaacuuau

SEQ ID NO: 2742270 - RNA, 21 nt, Human
uucaaaauuguuacaaauugu

SEQ ID NO: 2742271 - RNA, 13 nt, Human
uucaaacauauau

SEQ ID NO: 2742272 - RNA, 20 nt, Human
uucaaagugucuugaauugu

SEQ ID NO: 2742273 - RNA, 15 nt, Human
uucaaaguuaagaau

SEQ ID NO: 2742274 - RNA, 15 nt, Human
uucaaauuguaagca

SEQ ID NO: 2742275 - RNA, 13 nt, Human
uucaaauuugaug

SEQ ID NO: 2742276 - RNA, 19 nt, Human
uucaacaaccggccaccag

SEQ ID NO: 2742277 - RNA, 16 nt, Human
uucaauaaaacuuuuc

SEQ ID NO: 2742278 - RNA, 19 nt, Human
uucaauacuucauuuaaaa

SEQ ID NO: 2742279 - RNA, 18 nt, Human
uucaauaucuuuuuuuua

SEQ ID NO: 2742280 - RNA, 20 nt, Human
uucaauaucuuuuuuuuaau

SEQ ID NO: 2742281 - RNA, 18 nt, Human
uucaaugccccugaauuu

SEQ ID NO: 2742282 - RNA, 14 nt, Human
uucacaagugaaaa

SEQ ID NO: 2742283 - RNA, 21 nt, Human
uucacaagugaaaaacaucca

SEQ ID NO: 2742284 - RNA, 15 nt, Human
uucacacacaggcaa

SEQ ID NO: 2742285 - RNA, 11 nt, Human
uucacagggga

SEQ ID NO: 2742286 - RNA, 16 nt, Human
uucacaggggacagga

SEQ ID NO: 2742287 - RNA, 15 nt, Human
uucacagucacauuc

SEQ ID NO: 2742288 - RNA, 16 nt, Human
uucacauccuguguuu

SEQ ID NO: 2742289 - RNA, 20 nt, Human
uucacaucgcagauucuccc

SEQ ID NO: 2742290 - RNA, 14 nt, Human
uucacauuggaaac

SEQ ID NO: 2742291 - RNA, 19 nt, Human
uucacauuggaaacaaguc

SEQ ID NO: 2742292 - RNA, 14 nt, Human
uucacauuuaaaua

SEQ ID NO: 2742293 - RNA, 15 nt, Human
uucacauuuaaauaa

SEQ ID NO: 2742294 - RNA, 16 nt, Human
uucacauuuaaauaaa

SEQ ID NO: 2742295 - RNA, 12 nt, Human
uucacauuuuug

SEQ ID NO: 2742296 - RNA, 18 nt, Human
uucacauuuuuguauuuu

SEQ ID NO: 2742297 - RNA, 20 nt, Human
uucacauuuuuguauuuugu

SEQ ID NO: 2742298 - RNA, 21 nt, Human
uucaccaauaaguauucugug

SEQ ID NO: 2742299 - RNA, 21 nt, Human
uucaccauguuagccaggcug

SEQ ID NO: 2742300 - RNA, 19 nt, Human
uucaccauguuggccaggc

SEQ ID NO: 2742301 - RNA, 13 nt, Human
uucaccuguuuuu

SEQ ID NO: 2742302 - RNA, 21 nt, Human
uucaccuuaggaauaaucucc

SEQ ID NO: 2742303 - RNA, 19 nt, Human
uucacuguguuggccagga

SEQ ID NO: 2742304 - RNA, 17 nt, Human
uucacuuuuauaagaaa

SEQ ID NO: 2742305 - RNA, 24 nt, Human
uucacuuuuggcuuguaaaguaca

SEQ ID NO: 2742306 - RNA, 14 nt, Human
uucagagcugcccu

SEQ ID NO: 2742307 - RNA, 18 nt, Human
uucagagcugcccucucc

SEQ ID NO: 2742308 - RNA, 19 nt, Human
uucagagcugcccucuccu

SEQ ID NO: 2742309 - RNA, 16 nt, Human
uucagauaaucacaau

SEQ ID NO: 2742310 - RNA, 18 nt, Human
uucagcaccuacagugua

SEQ ID NO: 2742311 - RNA, 23 nt, Human
uucagcagagacgggguuugcca

SEQ ID NO: 2742312 - RNA, 23 nt, Human
uucagccuagccgaccucagccu

SEQ ID NO: 2742313 - RNA, 12 nt, Human
uucagccugaaa

SEQ ID NO: 2742314 - RNA, 21 nt, Human
uucagcucagcuaaugaagug

SEQ ID NO: 2742315 - RNA, 15 nt, Human
uucagggcuauuuuu

SEQ ID NO: 2742316 - RNA, 14 nt, Human
uucaggggccacac

SEQ ID NO: 2742317 - RNA, 14 nt, Human
uucaggucuuucuu

SEQ ID NO: 2742318 - RNA, 15 nt, Human
uucagucuuuuccau

SEQ ID NO: 2742319 - RNA, 17 nt, Human
uucagugcugccgauaa

SEQ ID NO: 2742320 - RNA, 16 nt, Human
uucaguuauuauauuu

SEQ ID NO: 2742321 - RNA, 17 nt, Human
uucaguugauuuuacaa

SEQ ID NO: 2742322 - RNA, 19 nt, Human
uucauaaagucuugccuug

SEQ ID NO: 2742323 - RNA, 17 nt, Human
uucauaagaauucuguu

SEQ ID NO: 2742324 - RNA, 19 nt, Human
uucauaagaauucuguuga

SEQ ID NO: 2742325 - RNA, 18 nt, Human
uucauaagauuuaaauua

SEQ ID NO: 2742326 - RNA, 16 nt, Human
uucauaauuauuauuu

SEQ ID NO: 2742327 - RNA, 20 nt, Human
uucauacauuuucuaagaaa

SEQ ID NO: 2742328 - RNA, 22 nt, Human
uucauacauuuucuaagaaaca

SEQ ID NO: 2742329 - RNA, 17 nt, Human
uucauaccuaucaucuu

SEQ ID NO: 2742330 - RNA, 18 nt, Human
uucauagcagauuuuaau

SEQ ID NO: 2742331 - RNA, 19 nt, Human
uucauauuuucuuucaaaa

SEQ ID NO: 2742332 - RNA, 20 nt, Human
uucaucaccccuaaaagaaa

SEQ ID NO: 2742333 - RNA, 17 nt, Human
uucauccgcaaauuuuc

SEQ ID NO: 2742334 - RNA, 12 nt, Human
uucauccuuuuc

SEQ ID NO: 2742335 - RNA, 19 nt, Human
uucaugaaggggcggcggc

SEQ ID NO: 2742336 - RNA, 16 nt, Human
uucaugaauucuguca

SEQ ID NO: 2742337 - RNA, 16 nt, Human
uucaugcuguucauga

SEQ ID NO: 2742338 - RNA, 15 nt, Human
uucauguacauccau

SEQ ID NO: 2742339 - RNA, 18 nt, Human
uucauguauuuuaaaaua

SEQ ID NO: 2742340 - RNA, 15 nt, Human
uucauuaaucugccu

SEQ ID NO: 2742341 - RNA, 18 nt, Human
uucauucaagucagcucu

SEQ ID NO: 2742342 - RNA, 14 nt, Human
uucauucaauaucu

SEQ ID NO: 2742343 - RNA, 22 nt, Human
uucauucacucaacaaacauaa

SEQ ID NO: 2742344 - RNA, 19 nt, Human
uucuuuggcugaaaggaag

SEQ ID NO: 2742345 - RNA, 21 nt, Human
uucuuuuuaauuucugcaaau

SEQ ID NO: 2742346 - RNA, 18 nt, Human
uugaaaaaguauaaauaa

SEQ ID NO: 2742347 - RNA, 23 nt, Human
uugaaaaaguucugcagauaaac

SEQ ID NO: 2742348 - RNA, 18 nt, Human
uugaaaaugguauuaaag

SEQ ID NO: 2742349 - RNA, 15 nt, Human
uugaaaccuucacuu

SEQ ID NO: 2742350 - RNA, 11 nt, Human
uugaaacugag

SEQ ID NO: 2742351 - RNA, 12 nt, Human
uugaaauuguau

SEQ ID NO: 2742352 - RNA, 14 nt, Human
uugaaauuguauua

SEQ ID NO: 2742353 - RNA, 20 nt, Human
uugaacccgggaggcagagg

SEQ ID NO: 2742354 - RNA, 18 nt, Human
uugaacuuuuuauugauu

SEQ ID NO: 2742355 - RNA, 19 nt, Human
uugaagagguuuuaaagcu

SEQ ID NO: 2742356 - RNA, 22 nt, Human
uugaagggcaggugcuucagga

SEQ ID NO: 2742357 - RNA, 23 nt, Human
uugaaguuuuggcaauugacuau

SEQ ID NO: 2742358 - RNA, 14 nt, Human
uugaauaaauaaau

SEQ ID NO: 2742359 - RNA, 22 nt, Human
uugaauaauacaccagagauaa

SEQ ID NO: 2742360 - RNA, 15 nt, Human
uugaauccagaaaua

SEQ ID NO: 2742361 - RNA, 16 nt, Human
uugaaucuugucucaa

SEQ ID NO: 2742362 - RNA, 14 nt, Human
uugaauuuuaaauc

SEQ ID NO: 2742363 - RNA, 19 nt, Human
uugaauuuuuuuuaacauu

SEQ ID NO: 2742364 - RNA, 14 nt, Human
uugacacuuaaaaa

SEQ ID NO: 2742365 - RNA, 16 nt, Human
uugacaguucauaugu

SEQ ID NO: 2742366 - RNA, 12 nt, Human
uugacauuuuua

SEQ ID NO: 2742367 - RNA, 22 nt, Human
uugacccacaagaaaugaaagc

SEQ ID NO: 2742368 - RNA, 23 nt, Human
uugacccucacaggagcaucucc

SEQ ID NO: 2742369 - RNA, 14 nt, Human
uugagacaagaaaa

SEQ ID NO: 2742370 - RNA, 18 nt, Human
uugagauguguucacaau

SEQ ID NO: 2742371 - RNA, 22 nt, Human
uugagcaggauuagauaaggcu

SEQ ID NO: 2742372 - RNA, 14 nt, Human
uugaggacuugggc

SEQ ID NO: 2742373 - RNA, 23 nt, Human
uugagggcaagagccacaguaua

SEQ ID NO: 2742374 - RNA, 21 nt, Human
uugagugucuuaauuaaaaga

SEQ ID NO: 2742375 - RNA, 18 nt, Human
uugaguuuaaauuguaau

SEQ ID NO: 2742376 - RNA, 15 nt, Human
uugauaaagggccaa

SEQ ID NO: 2742377 - RNA, 20 nt, Human
uugauaaguacaugauaagc

SEQ ID NO: 2742378 - RNA, 13 nt, Human
uugauaauaaaau

SEQ ID NO: 2742379 - RNA, 23 nt, Human
uugauagcaagugaauuuuucuc

SEQ ID NO: 2742380 - RNA, 13 nt, Human
uugaucagcuuau

SEQ ID NO: 2742381 - RNA, 16 nt, Human
uugaucgacuugccaa

SEQ ID NO: 2742382 - RNA, 12 nt, Human
uugaugcuacag

SEQ ID NO: 2742383 - RNA, 14 nt, Human
uugauggaaauaca

SEQ ID NO: 2742384 - RNA, 13 nt, Human
uugauuuaaugua

SEQ ID NO: 2742385 - RNA, 13 nt, Human
uugcaaccuccac

SEQ ID NO: 2742386 - RNA, 20 nt, Human
uugcaaccuccaccuucugg

SEQ ID NO: 2742387 - RNA, 15 nt, Human
uugcaacuuuguaua

SEQ ID NO: 2742388 - RNA, 13 nt, Human
uugcaagacauag

SEQ ID NO: 2742389 - RNA, 16 nt, Human
uugcaagccagauuuu

SEQ ID NO: 2742390 - RNA, 17 nt, Human
uugcacagcuaugaagg

SEQ ID NO: 2742391 - RNA, 15 nt, Human
uugcagcucuccccu

SEQ ID NO: 2742392 - RNA, 14 nt, Human
uugcagugagcuga

SEQ ID NO: 2742393 - RNA, 17 nt, Human
uugcaguuuuuuccuag

SEQ ID NO: 2742394 - RNA, 16 nt, Human
uugcauaagagcuuaa

SEQ ID NO: 2742395 - RNA, 18 nt, Human
uugcauagguuuaauaau

SEQ ID NO: 2742396 - RNA, 23 nt, Human
uugcaugguuuagaaagcuugcc

SEQ ID NO: 2742397 - RNA, 13 nt, Human
uugcauuaaaaau

SEQ ID NO: 2742398 - RNA, 17 nt, Human
uugccaaauauaaauaa

SEQ ID NO: 2742399 - RNA, 18 nt, Human
uugccaaauauaaauaaa

SEQ ID NO: 2742400 - RNA, 22 nt, Human
uugccaaauauaaauaaaaaua

SEQ ID NO: 2742401 - RNA, 20 nt, Human
uugccaggcuggagugcagu

SEQ ID NO: 2742402 - RNA, 16 nt, Human
uugccauaauuacuau

SEQ ID NO: 2742403 - RNA, 19 nt, Human
uugccauaauuacuauguc

SEQ ID NO: 2742404 - RNA, 12 nt, Human
uugccaucccuc

SEQ ID NO: 2742405 - RNA, 21 nt, Human
uugccaugcuggccaggcugg

SEQ ID NO: 2742406 - RNA, 19 nt, Human
uugccaugugcuaguaauu

SEQ ID NO: 2742407 - RNA, 12 nt, Human
uugcccagggcu

SEQ ID NO: 2742408 - RNA, 16 nt, Human
uugcccuguuaaaaga

SEQ ID NO: 2742409 - RNA, 12 nt, Human
uugccugcaggc

SEQ ID NO: 2742410 - RNA, 14 nt, Human
uugccugcaggcau

SEQ ID NO: 2742411 - RNA, 23 nt, Human
uugccugcaggcaugagucaguc

SEQ ID NO: 2742412 - RNA, 14 nt, Human
uugccuugcauaau

SEQ ID NO: 2742413 - RNA, 21 nt, Human
uugcuacagggcucacagaau

SEQ ID NO: 2742414 - RNA, 16 nt, Human
uugcuaggucacagag

SEQ ID NO: 2742415 - RNA, 15 nt, Human
uugcuaguuuuugac

SEQ ID NO: 2742416 - RNA, 14 nt, Human
uugcuguccuggag

SEQ ID NO: 2742417 - RNA, 14 nt, Human
uugcuugaacccag

SEQ ID NO: 2742418 - RNA, 19 nt, Human
uugcuuugauggaauaaac

SEQ ID NO: 2742419 - RNA, 13 nt, Human
uugcuuuuaaaau

SEQ ID NO: 2742420 - RNA, 17 nt, Human
uuggacgagaaaacaau

SEQ ID NO: 2742421 - RNA, 23 nt, Human
uuggacgagaaaacaauaacgau

SEQ ID NO: 2742422 - RNA, 22 nt, Human
uuggacugaagggguucucaca

SEQ ID NO: 2742423 - RNA, 20 nt, Human
uuggagaagaacugaaauca

SEQ ID NO: 2742424 - RNA, 20 nt, Human
uuggagauguuuaguaauca

SEQ ID NO: 2742425 - RNA, 12 nt, Human
uuggagugcagu

SEQ ID NO: 2742426 - RNA, 18 nt, Human
uuggcagaguucuauaau

SEQ ID NO: 2742427 - RNA, 16 nt, Human
uuggcaguguagggag

SEQ ID NO: 2742428 - RNA, 14 nt, Human
uuggccaugaggaa

SEQ ID NO: 2742429 - RNA, 12 nt, Human
uuggccauggga

SEQ ID NO: 2742430 - RNA, 14 nt, Human
uugggaaaaaguaa

SEQ ID NO: 2742431 - RNA, 16 nt, Human
uugggaaaaaguaauu

SEQ ID NO: 2742432 - RNA, 11 nt, Human
uugggaaagga

SEQ ID NO: 2742433 - RNA, 13 nt, Human
uugggacaaaaac

SEQ ID NO: 2742434 - RNA, 12 nt, Human
uugggaggcuga

SEQ ID NO: 2742435 - RNA, 19 nt, Human
uugggaggcugaggcgggu

SEQ ID NO: 2742436 - RNA, 22 nt, Human
uugggaggcugaggcgggugga

SEQ ID NO: 2742437 - RNA, 12 nt, Human
uugggcaggcag

SEQ ID NO: 2742438 - RNA, 14 nt, Human
uuggggaagacugu

SEQ ID NO: 2742439 - RNA, 18 nt, Human
uuggggcuagacaguucu

SEQ ID NO: 2742440 - RNA, 20 nt, Human
uuggucugugagaugcuaga

SEQ ID NO: 2742441 - RNA, 22 nt, Human
uuggucuugauaagcuauguug

SEQ ID NO: 2742442 - RNA, 20 nt, Human
uuggugaacuugguuuuaau

SEQ ID NO: 2742443 - RNA, 19 nt, Human
uuggugauuccgcagugag

SEQ ID NO: 2742444 - RNA, 16 nt, Human
uuguaaaggaauuuaa

SEQ ID NO: 2742445 - RNA, 20 nt, Human
uuguaaaggaauuuaaaaau

SEQ ID NO: 2742446 - RNA, 23 nt, Human
uuguaacaagccuccuuuuaaag

SEQ ID NO: 2742447 - RNA, 19 nt, Human
uuguaauaaaaugucuauu

SEQ ID NO: 2742448 - RNA, 20 nt, Human
uuguaauauuucuucaaaua

SEQ ID NO: 2742449 - RNA, 21 nt, Human
uuguaauucuaaaugaauguu

SEQ ID NO: 2742450 - RNA, 14 nt, Human
uuguaauuugaaau

SEQ ID NO: 2742451 - RNA, 21 nt, Human
uuguaauuuuuuugugggaaa

SEQ ID NO: 2742452 - RNA, 17 nt, Human
uuguacacagaaauaca

SEQ ID NO: 2742453 - RNA, 15 nt, Human
uuguacauauaagug

SEQ ID NO: 2742454 - RNA, 18 nt, Human
uuguacucugaaaguuuu

SEQ ID NO: 2742455 - RNA, 19 nt, Human
uuguacucugaaaguuuug

SEQ ID NO: 2742456 - RNA, 14 nt, Human
uuguacuuuauuuu

SEQ ID NO: 2742457 - RNA, 15 nt, Human
uuguagaaaagcuau

SEQ ID NO: 2742458 - RNA, 16 nt, Human
uuguagauaauacagu

SEQ ID NO: 2742459 - RNA, 20 nt, Human
uuguaggugacuauuauauu

SEQ ID NO: 2742460 - RNA, 14 nt, Human
uuguauaaaauaau

SEQ ID NO: 2742461 - RNA, 15 nt, Human
uuguauaucuuguuu

SEQ ID NO: 2742462 - RNA, 19 nt, Human
uuguauuauuuuuuaaaaa

SEQ ID NO: 2742463 - RNA, 13 nt, Human
uuguauuuaaaua

SEQ ID NO: 2742464 - RNA, 13 nt, Human
uuguauuuuacuu

SEQ ID NO: 2742465 - RNA, 17 nt, Human
uugucaauaaaauccau

SEQ ID NO: 2742466 - RNA, 13 nt, Human
uugucuauuaccu

SEQ ID NO: 2742467 - RNA, 16 nt, Human
uugucugaaauuuucu

SEQ ID NO: 2742468 - RNA, 12 nt, Human
uugucuuuuccu

SEQ ID NO: 2742469 - RNA, 11 nt, Human
uugugaaauua

SEQ ID NO: 2742470 - RNA, 17 nt, Human
uugugaugcaaauaaau

SEQ ID NO: 2742471 - RNA, 20 nt, Human
uugugcaguacuuugugcau

SEQ ID NO: 2742472 - RNA, 19 nt, Human
uugugccccugcacuccag

SEQ ID NO: 2742473 - RNA, 15 nt, Human
uugugcuucuuucuu

SEQ ID NO: 2742474 - RNA, 23 nt, Human
uugugcuuucuaucuaauuuuua

SEQ ID NO: 2742475 - RNA, 19 nt, Human
uuguggggaugaacuuuuu

SEQ ID NO: 2742476 - RNA, 17 nt, Human
uuguggggcuaaggcag

SEQ ID NO: 2742477 - RNA, 15 nt, Human
uugugugaaagguac

SEQ ID NO: 2742478 - RNA, 16 nt, Human
uugugugcaucaggcu

SEQ ID NO: 2742479 - RNA, 22 nt, Human
uuguuaauaaaaguacauguua

SEQ ID NO: 2742480 - RNA, 15 nt, Human
uuguuacaaauugua

SEQ ID NO: 2742481 - RNA, 17 nt, Human
uuguuagcaaaauggau

SEQ ID NO: 2742482 - RNA, 15 nt, Human
uuguuauuuaaagaa

SEQ ID NO: 2742483 - RNA, 20 nt, Human
uuguucccaaauuucauacc

SEQ ID NO: 2742484 - RNA, 22 nt, Human
uuguucuugugaacccaaagug

SEQ ID NO: 2742485 - RNA, 20 nt, Human
uuguugcauuaaaaaugcau

SEQ ID NO: 2742486 - RNA, 20 nt, Human
uuguuucaacaguuuuugcu

SEQ ID NO: 2742487 - RNA, 20 nt, Human
uuguuucauugacuaucaaa

SEQ ID NO: 2742488 - RNA, 19 nt, Human
uuguuucucuuccuuucuu

SEQ ID NO: 2742489 - RNA, 17 nt, Human
uuucccuccuuggagac

SEQ ID NO: 2742490 - RNA, 23 nt, Human
uuucccuccuuggugauuccgca

SEQ ID NO: 2742491 - RNA, 17 nt, Human
uuuccguggcacugcau

SEQ ID NO: 2742492 - RNA, 19 nt, Human
uuuccuaaaucaauucuau

SEQ ID NO: 2742493 - RNA, 12 nt, Human
uuuccuauuuuu

SEQ ID NO: 2742494 - RNA, 22 nt, Human
uuuccucaaaaagauuucccca

SEQ ID NO: 2742495 - RNA, 22 nt, Human
uuuccucauauccaguauuguu

SEQ ID NO: 2742496 - RNA, 19 nt, Human
uuuccugaaaacccuugcc

SEQ ID NO: 2742497 - RNA, 16 nt, Human
uuuccuggcuacucca

SEQ ID NO: 2742498 - RNA, 22 nt, Human
uuuccuuauucagaauuucuaa

SEQ ID NO: 2742499 - RNA, 20 nt, Human
uuuccuuccagucuaaaaaa

SEQ ID NO: 2742500 - RNA, 18 nt, Human
uuuccuucucaucuguga

SEQ ID NO: 2742501 - RNA, 16 nt, Human
uuuccuuguauuuaaa

SEQ ID NO: 2742502 - RNA, 17 nt, Human
uuucuaauaguuuuauu

SEQ ID NO: 2742503 - RNA, 22 nt, Human
uuucuaggacugaauuaugaaa

SEQ ID NO: 2742504 - RNA, 20 nt, Human
uuucuagggaaaugaaagaa

SEQ ID NO: 2742505 - RNA, 13 nt, Human
uuucuaugaaaua

SEQ ID NO: 2742506 - RNA, 16 nt, Human
uuucuaugaaauauua

SEQ ID NO: 2742507 - RNA, 19 nt, Human
uuucuauuugaucugauau

SEQ ID NO: 2742508 - RNA, 13 nt, Human
uuucucaauaagc

SEQ ID NO: 2742509 - RNA, 13 nt, Human
uuucucaucuuuu

SEQ ID NO: 2742510 - RNA, 22 nt, Human
uuucucccuggauuuuuaccag

SEQ ID NO: 2742511 - RNA, 13 nt, Human
uuucuccuuguug

SEQ ID NO: 2742512 - RNA, 15 nt, Human
uuucucuaggaaaua

SEQ ID NO: 2742513 - RNA, 18 nt, Human
uuucucuaggaaauauuu

SEQ ID NO: 2742514 - RNA, 19 nt, Human
uuucucuaggaaauauuua

SEQ ID NO: 2742515 - RNA, 15 nt, Human
uuucucugauacaga

SEQ ID NO: 2742516 - RNA, 21 nt, Human
uuucucuggauuugcaacccc

SEQ ID NO: 2742517 - RNA, 11 nt, Human
uuucugaaauu

SEQ ID NO: 2742518 - RNA, 13 nt, Human
uuucugaauuauu

SEQ ID NO: 2742519 - RNA, 22 nt, Human
uuucugagaaagacuauucaaa

SEQ ID NO: 2742520 - RNA, 17 nt, Human
uuucugaguuccugcau

SEQ ID NO: 2742521 - RNA, 15 nt, Human
uuucugaguuuuacc

SEQ ID NO: 2742522 - RNA, 14 nt, Human
uuucugaugucaaa

SEQ ID NO: 2742523 - RNA, 14 nt, Human
uuucugcuuuaauu

SEQ ID NO: 2742524 - RNA, 17 nt, Human
uuucugcuuuaauuuca

SEQ ID NO: 2742525 - RNA, 21 nt, Human
uuucuggcaccaggaaucccc

SEQ ID NO: 2742526 - RNA, 14 nt, Human
uuucuguuaaaaua

SEQ ID NO: 2742527 - RNA, 18 nt, Human
uuucuuaaagaauuuuca

SEQ ID NO: 2742528 - RNA, 20 nt, Human
uuucuucaacucccugcccc

SEQ ID NO: 2742529 - RNA, 20 nt, Human
uuucuuccuggauuccucac

SEQ ID NO: 2742530 - RNA, 13 nt, Human
uuucuucucucca

SEQ ID NO: 2742531 - RNA, 19 nt, Human
uuucuucucuccagugcac

SEQ ID NO: 2742532 - RNA, 14 nt, Human
uuucuugaaaguac

SEQ ID NO: 2742533 - RNA, 16 nt, Human
uuucuuuguuaaaaua

SEQ ID NO: 2742534 - RNA, 23 nt, Human
uuucuuuuuuugugguuagaaaa

SEQ ID NO: 2742535 - RNA, 15 nt, Human
uuucuuuuuuuucuu

SEQ ID NO: 2742536 - RNA, 15 nt, Human
uuugaaaauaugccu

SEQ ID NO: 2742537 - RNA, 22 nt, Human
uuugaaacgaggauugggaaaa

SEQ ID NO: 2742538 - RNA, 17 nt, Human
uuugaaaucaugaagau

SEQ ID NO: 2742539 - RNA, 18 nt, Human
uuugaagcacagugauca

SEQ ID NO: 2742540 - RNA, 15 nt, Human
uuugaagggaaauuu

SEQ ID NO: 2742541 - RNA, 17 nt, Human
uuugaauccagaaauaa

SEQ ID NO: 2742542 - RNA, 16 nt, Human
uuugaauguuaaauaa

SEQ ID NO: 2742543 - RNA, 18 nt, Human
uuugacaagguucuuccc

SEQ ID NO: 2742544 - RNA, 15 nt, Human
uuugaguguuuuaag

SEQ ID NO: 2742545 - RNA, 17 nt, Human
uuugauaugugaacagu

SEQ ID NO: 2742546 - RNA, 16 nt, Human
uuugaucugauaucag

SEQ ID NO: 2742547 - RNA, 20 nt, Human
uuugcaagccagauuuuccu

SEQ ID NO: 2742548 - RNA, 20 nt, Human
uuugcaucugaaaauugaug

SEQ ID NO: 2742549 - RNA, 13 nt, Human
uuugccaugcugg

SEQ ID NO: 2742550 - RNA, 17 nt, Human
uuugcucagcuucucca

SEQ ID NO: 2742551 - RNA, 21 nt, Human
uuugcuggagcucugcccauc

SEQ ID NO: 2742552 - RNA, 19 nt, Human
uuuggaagaggacuccuua

SEQ ID NO: 2742553 - RNA, 22 nt, Human
uuuggagauuuuuuaauccuuu

SEQ ID NO: 2742554 - RNA, 18 nt, Human
uuuggcuuguaaaguaca

SEQ ID NO: 2742555 - RNA, 15 nt, Human
uuugguaaaauacuu

SEQ ID NO: 2742556 - RNA, 16 nt, Human
uuuggucuaucuuuga

SEQ ID NO: 2742557 - RNA, 14 nt, Human
uuuguaauauuucu

SEQ ID NO: 2742558 - RNA, 15 nt, Human
uuuguaauauuucuc

SEQ ID NO: 2742559 - RNA, 16 nt, Human
uuuguaauauuucucu

SEQ ID NO: 2742560 - RNA, 17 nt, Human
uuuguaaugaaaaccac

SEQ ID NO: 2742561 - RNA, 21 nt, Human
uuuguacauagugaggagcuu

SEQ ID NO: 2742562 - RNA, 18 nt, Human
uuuguacguucuucuauu

SEQ ID NO: 2742563 - RNA, 14 nt, Human
uuuguauaaaauaa

SEQ ID NO: 2742564 - RNA, 20 nt, Human
uuuguauaaaauaauuuuua

SEQ ID NO: 2742565 - RNA, 21 nt, Human
uuuguauaaaauaauuuuuau

SEQ ID NO: 2742566 - RNA, 23 nt, Human
uuuguauaaaauaauuuuuauau

SEQ ID NO: 2742567 - RNA, 18 nt, Human
uuuguauuuuguuuaaau

SEQ ID NO: 2742568 - RNA, 13 nt, Human
uuugucucugcaa

SEQ ID NO: 2742569 - RNA, 21 nt, Human
uuugucugagacagaaucuca

SEQ ID NO: 2742570 - RNA, 18 nt, Human
uuugugaagaaacauuua

SEQ ID NO: 2742571 - RNA, 19 nt, Human
uuugugaagaaacauuuau

SEQ ID NO: 2742572 - RNA, 12 nt, Human
uuugugaagcaa

SEQ ID NO: 2742573 - RNA, 24 nt, Human
uuugugggaaauccacacugagcu

SEQ ID NO: 2742574 - RNA, 13 nt, Human
uuuguguauuaua

SEQ ID NO: 2742575 - RNA, 21 nt, Human
uuuguucuauagcuuuucccu

SEQ ID NO: 2742576 - RNA, 13 nt, Human
uuuguuucagugc

SEQ ID NO: 2742577 - RNA, 13 nt, Human
uuuuaaaaaagaa

SEQ ID NO: 2742578 - RNA, 14 nt, Human
uuuuaaaaaagaaa

SEQ ID NO: 2742579 - RNA, 17 nt, Human
uuuuaaaaaagaaacau

SEQ ID NO: 2742580 - RNA, 18 nt, Human
uuuuaaaaaagaaacauu

SEQ ID NO: 2742581 - RNA, 16 nt, Human
uuuuaaaaaauauaca

SEQ ID NO: 2742582 - RNA, 14 nt, Human
uuuuaaaaaaugga

SEQ ID NO: 2742583 - RNA, 14 nt, Human
uuuuaaaauccacu

SEQ ID NO: 2742584 - RNA, 23 nt, Human
uuuuaaaaugagaaaucuaaaaa

SEQ ID NO: 2742585 - RNA, 16 nt, Human
uuuuaaaccauuuucu

SEQ ID NO: 2742586 - RNA, 21 nt, Human
uuuuaaauaaagaauuuuaaa

SEQ ID NO: 2742587 - RNA, 13 nt, Human
uuuuaaauauuuu

SEQ ID NO: 2742588 - RNA, 18 nt, Human
uuuuaaauauuuuuucuu

SEQ ID NO: 2742589 - RNA, 21 nt, Human
uuuuaaauguuuuuuuuuaaa

SEQ ID NO: 2742590 - RNA, 18 nt, Human
uuuuaacaccuuuuacuc

SEQ ID NO: 2742591 - RNA, 15 nt, Human
uuuuaagauaaauua

SEQ ID NO: 2742592 - RNA, 19 nt, Human
uuuuaaguuauuuuuacau

SEQ ID NO: 2742593 - RNA, 14 nt, Human
uuuuaaucuguauu

SEQ ID NO: 2742594 - RNA, 22 nt, Human
uuuuaauguguauuacaaauau

SEQ ID NO: 2742595 - RNA, 14 nt, Human
uuuuaauuauuauu

SEQ ID NO: 2742596 - RNA, 13 nt, Human
uuuuaauuugguu

SEQ ID NO: 2742597 - RNA, 15 nt, Human
uuuuacaauugaaau

SEQ ID NO: 2742598 - RNA, 15 nt, Human
uuuuaccaaauaaag

SEQ ID NO: 2742599 - RNA, 18 nt, Human
uuuuaccagucucacaug

SEQ ID NO: 2742600 - RNA, 13 nt, Human
uuuuaccuuugac

SEQ ID NO: 2742601 - RNA, 13 nt, Human
uuuuagccuucuc

SEQ ID NO: 2742602 - RNA, 21 nt, Human
uuuuagccuucucuguucauu

SEQ ID NO: 2742603 - RNA, 21 nt, Human
uuuuagggguagcauuugugu

SEQ ID NO: 2742604 - RNA, 16 nt, Human
uuuuagugaaauauua

SEQ ID NO: 2742605 - RNA, 16 nt, Human
uuuuagugauuuuaau

SEQ ID NO: 2742606 - RNA, 18 nt, Human
uuuuagugauuuuaauaa

SEQ ID NO: 2742607 - RNA, 17 nt, Human
uuuuaguugaauuuuuu

SEQ ID NO: 2742608 - RNA, 20 nt, Human
uuuuaguugcaacuuuguau

SEQ ID NO: 2742609 - RNA, 14 nt, Human
uuuuauaagaaaua

SEQ ID NO: 2742610 - RNA, 22 nt, Human
uuuuauagcuacuaauuuuaaa

SEQ ID NO: 2742611 - RNA, 23 nt, Human
uuuuauagcuacuaauuuuaaaa

SEQ ID NO: 2742612 - RNA, 14 nt, Human
uuuuauauccacua

SEQ ID NO: 2742613 - RNA, 13 nt, Human
uuuuauaugcuau

SEQ ID NO: 2742614 - RNA, 14 nt, Human
uuuuauaugcuauu

SEQ ID NO: 2742615 - RNA, 17 nt, Human
uuuuauaugcuauuuau

SEQ ID NO: 2742616 - RNA, 12 nt, Human
uuuuauauuuga

SEQ ID NO: 2742617 - RNA, 17 nt, Human
uuuuaucauuuucaaaa

SEQ ID NO: 2742618 - RNA, 21 nt, Human
uuuuauggcacuaguauuucu

SEQ ID NO: 2742619 - RNA, 16 nt, Human
uuuuauuaauaaacau

SEQ ID NO: 2742620 - RNA, 17 nt, Human
uuuuauuaauaaacauu

SEQ ID NO: 2742621 - RNA, 23 nt, Human
uuuuauuguccguuuacuuguuu

SEQ ID NO: 2742622 - RNA, 18 nt, Human
uuuuauuguuuaaaauca

SEQ ID NO: 2742623 - RNA, 13 nt, Human
uuuuauuuaaccu

SEQ ID NO: 2742624 - RNA, 19 nt, Human
uuuuauuuuuuucugaauu

SEQ ID NO: 2742625 - RNA, 14 nt, Human
uuuucaaaauggag

SEQ ID NO: 2742626 - RNA, 12 nt, Human
uuuucaaauuug

SEQ ID NO: 2742627 - RNA, 18 nt, Human
uuuucaauaaaacuuuuc

SEQ ID NO: 2742628 - RNA, 13 nt, Human
uuuucaauauuua

SEQ ID NO: 2742629 - RNA, 17 nt, Human
uuuucaccuguuuuuaa

SEQ ID NO: 2742630 - RNA, 11 nt, Human
uuuucacuuca

SEQ ID NO: 2742631 - RNA, 19 nt, Human
uuuucaguuauuauauuua

SEQ ID NO: 2742632 - RNA, 11 nt, Human
uuuucaucuuc

SEQ ID NO: 2742633 - RNA, 16 nt, Human
uuuucauuaaaauuuu

SEQ ID NO: 2742634 - RNA, 16 nt, Human
aaaaauacaaaaauua

SEQ ID NO: 2742635 - RNA, 11 nt, Human
aaaaauauaua

SEQ ID NO: 2742636 - RNA, 13 nt, Human
aaaaauccuacuu

SEQ ID NO: 2742637 - RNA, 12 nt, Human
aaaaaucucaau

SEQ ID NO: 2742638 - RNA, 14 nt, Human
aaaaaugcauguug

SEQ ID NO: 2742639 - RNA, 21 nt, Human
aaaaauggaacauaaaauaca

SEQ ID NO: 2742640 - RNA, 16 nt, Human
aaaaauguaggagacu

SEQ ID NO: 2742641 - RNA, 16 nt, Human
aaaaauuaauucuuua

SEQ ID NO: 2742642 - RNA, 16 nt, Human
aaaaauuccaagugau

SEQ ID NO: 2742643 - RNA, 17 nt, Human
aaaaauuccuuuucccg

SEQ ID NO: 2742644 - RNA, 13 nt, Human
aaaaauuuuauag

SEQ ID NO: 2742645 - RNA, 12 nt, Human
aaaacaaagaag

SEQ ID NO: 2742646 - RNA, 19 nt, Human
aaaacaaagaagacaacau

SEQ ID NO: 2742647 - RNA, 20 nt, Human
aaaacaauaacgauaaaaga

SEQ ID NO: 2742648 - RNA, 22 nt, Human
aaaacaauaacgauaaaagaca

SEQ ID NO: 2742649 - RNA, 14 nt, Human
aaaacaauucuuau

SEQ ID NO: 2742650 - RNA, 12 nt, Human
aaaacacagcaa

SEQ ID NO: 2742651 - RNA, 17 nt, Human
aaaacaccucagcugcc

SEQ ID NO: 2742652 - RNA, 15 nt, Human
aaaacaggcaaauuc

SEQ ID NO: 2742653 - RNA, 16 nt, Human
aaaacauguuccuuau

SEQ ID NO: 2742654 - RNA, 23 nt, Human
aaaacguauugcauuuaauuuau

SEQ ID NO: 2742655 - RNA, 13 nt, Human
aaaacuaacaccc

SEQ ID NO: 2742656 - RNA, 22 nt, Human
aaaacuagagacucaaagaggg

SEQ ID NO: 2742657 - RNA, 19 nt, Human
aaaacuaggugcugcagcc

SEQ ID NO: 2742658 - RNA, 14 nt, Human
aaaacuauuaacaa

SEQ ID NO: 2742659 - RNA, 12 nt, Human
aaaacucauuuu

SEQ ID NO: 2742660 - RNA, 19 nt, Human
aaaacuggcuacugcucug

SEQ ID NO: 2742661 - RNA, 22 nt, Human
aaaacugugccuuguuucaaca

SEQ ID NO: 2742662 - RNA, 14 nt, Human
aaaacuuauuggaa

SEQ ID NO: 2742663 - RNA, 22 nt, Human
aaaacuuguauuauguguguuu

SEQ ID NO: 2742664 - RNA, 12 nt, Human
aaaacuuuaaaa

SEQ ID NO: 2742665 - RNA, 13 nt, Human
aaaacuuuaaaac

SEQ ID NO: 2742666 - RNA, 23 nt, Human
aaaacuuuaugcuaagugaaaua

SEQ ID NO: 2742667 - RNA, 13 nt, Human
aaaagaaaaagau

SEQ ID NO: 2742668 - RNA, 14 nt, Human
aaaagaaagaaaau

SEQ ID NO: 2742669 - RNA, 15 nt, Human
aaaagaauauuuuaa

SEQ ID NO: 2742670 - RNA, 21 nt, Human
aaaagaauauuuuaacuuccu

SEQ ID NO: 2742671 - RNA, 13 nt, Human
aaaagacagugaa

SEQ ID NO: 2742672 - RNA, 20 nt, Human
aaaagacauaagcaaagacu

SEQ ID NO: 2742673 - RNA, 14 nt, Human
aaaagacuuuuucc

SEQ ID NO: 2742674 - RNA, 15 nt, Human
aaaagacuuuuuccu

SEQ ID NO: 2742675 - RNA, 10 nt, Human
aaaagaugaa

SEQ ID NO: 2742676 - RNA, 22 nt, Human
aaaagauugagagaauuugugc

SEQ ID NO: 2742677 - RNA, 16 nt, Human
aaaagcaucacaugaa

SEQ ID NO: 2742678 - RNA, 17 nt, Human
aaaagcaucacaugaac

SEQ ID NO: 2742679 - RNA, 14 nt, Human
aaaagcauuauuau

SEQ ID NO: 2742680 - RNA, 18 nt, Human
aaaagccaaaaaccaaau

SEQ ID NO: 2742681 - RNA, 12 nt, Human
aaaagcuauaaa

SEQ ID NO: 2742682 - RNA, 15 nt, Human
aaaaggaaagaaaau

SEQ ID NO: 2742683 - RNA, 18 nt, Human
aaaagggacugagaaauu

SEQ ID NO: 2742684 - RNA, 19 nt, Human
aaaagggcuuucucaauaa

SEQ ID NO: 2742685 - RNA, 16 nt, Human
aaaagguauuuuaauc

SEQ ID NO: 2742686 - RNA, 21 nt, Human
aaaagguauuuuaaucaccaa

SEQ ID NO: 2742687 - RNA, 16 nt, Human
aaaaguauauucaaaa

SEQ ID NO: 2742688 - RNA, 13 nt, Human
aaaaguauccaag

SEQ ID NO: 2742689 - RNA, 15 nt, Human
aaaagucaaucuuau

SEQ ID NO: 2742690 - RNA, 17 nt, Human
aaaagucuccaaagucu

SEQ ID NO: 2742691 - RNA, 16 nt, Human
aaaaguuauguagaaa

SEQ ID NO: 2742692 - RNA, 15 nt, Human
aaaaguugaauuuua

SEQ ID NO: 2742693 - RNA, 17 nt, Human
aaaaguugaauuuuaca

SEQ ID NO: 2742694 - RNA, 13 nt, Human
aaaauaaaaauaa

SEQ ID NO: 2742695 - RNA, 15 nt, Human
aaaauaaaaugaagu

SEQ ID NO: 2742696 - RNA, 20 nt, Human
aaaauaaaguauauauagaa

SEQ ID NO: 2742697 - RNA, 15 nt, Human
aaaauaaauuauuau

SEQ ID NO: 2742698 - RNA, 12 nt, Human
aaaauaacaaua

SEQ ID NO: 2742699 - RNA, 19 nt, Human
aaaauaacaauaaaagaca

SEQ ID NO: 2742700 - RNA, 13 nt, Human
aaaauaacgauaa

SEQ ID NO: 2742701 - RNA, 14 nt, Human
aaaauaacgauaaa

SEQ ID NO: 2742702 - RNA, 19 nt, Human
aaaauaacgauaaaagaca

SEQ ID NO: 2742703 - RNA, 21 nt, Human
aaaauaagagcucaggaugag

SEQ ID NO: 2742704 - RNA, 16 nt, Human
aaaauaauuuuuauau

SEQ ID NO: 2742705 - RNA, 20 nt, Human
aaaauaauuuuuauauuuga

SEQ ID NO: 2742706 - RNA, 14 nt, Human
aaaauacaaaaaaa

SEQ ID NO: 2742707 - RNA, 15 nt, Human
aaaauacaauguuau

SEQ ID NO: 2742708 - RNA, 21 nt, Human
aaaauacauacuauagauucu

SEQ ID NO: 2742709 - RNA, 21 nt, Human
aaaauauaugaggcuacagaa

SEQ ID NO: 2742710 - RNA, 21 nt, Human
aaaauaugccccauucaacau

SEQ ID NO: 2742711 - RNA, 23 nt, Human
aaaauaugccccauucaacaucu

SEQ ID NO: 2742712 - RNA, 17 nt, Human
aaaauaugcucuaaaca

SEQ ID NO: 2742713 - RNA, 15 nt, Human
aaaaucauccaagac

SEQ ID NO: 2742714 - RNA, 19 nt, Human
aaaaucauuucugcaucag

SEQ ID NO: 2742715 - RNA, 20 nt, Human
aaaauccacuuuaucuugaa

SEQ ID NO: 2742716 - RNA, 21 nt, Human
aaaauccacuuuaucuugaau

SEQ ID NO: 2742717 - RNA, 14 nt, Human
aaaauccauacauu

SEQ ID NO: 2742718 - RNA, 17 nt, Human
aaaauccauacauuugu

SEQ ID NO: 2742719 - RNA, 17 nt, Human
aaaaucuaauucaaacu

SEQ ID NO: 2742720 - RNA, 14 nt, Human
aaaaucuacaguac

SEQ ID NO: 2742721 - RNA, 19 nt, Human
aaaaucucaauauuucaga

SEQ ID NO: 2742722 - RNA, 20 nt, Human
aaaaucuuaaaugccaggcc

SEQ ID NO: 2742723 - RNA, 13 nt, Human
aaaaugagcaaaa

SEQ ID NO: 2742724 - RNA, 16 nt, Human
aaaauggacaucaaaa

SEQ ID NO: 2742725 - RNA, 17 nt, Human
aaaaugguauuaaagau

SEQ ID NO: 2742726 - RNA, 18 nt, Human
aaaaugguauuaaagauc

SEQ ID NO: 2742727 - RNA, 16 nt, Human
aaaauggugugaccac

SEQ ID NO: 2742728 - RNA, 18 nt, Human
aaaaugguuuaaaugguc

SEQ ID NO: 2742729 - RNA, 20 nt, Human
aaaaugucuauuuuuaaugu

SEQ ID NO: 2742730 - RNA, 15 nt, Human
aaaaugugauaugua

SEQ ID NO: 2742731 - RNA, 17 nt, Human
aagugcuaauuuugaaa

SEQ ID NO: 2742732 - RNA, 20 nt, Human
aagugcuaauuuugaaaaac

SEQ ID NO: 2742733 - RNA, 18 nt, Human
aagugcuggcauuacagg

SEQ ID NO: 2742734 - RNA, 22 nt, Human
aagugcuggcauuacaggugug

SEQ ID NO: 2742735 - RNA, 13 nt, Human
aagugcugggaau

SEQ ID NO: 2742736 - RNA, 13 nt, Human
aagugcugggauu

SEQ ID NO: 2742737 - RNA, 23 nt, Human
aagugcugggauuaacagguaug

SEQ ID NO: 2742738 - RNA, 15 nt, Human
aagugcuguauaaaa

SEQ ID NO: 2742739 - RNA, 23 nt, Human
aagugcuucuccagccucagccu

SEQ ID NO: 2742740 - RNA, 13 nt, Human
aagugcuuucuuc

SEQ ID NO: 2742741 - RNA, 14 nt, Human
aagugcuuucuucu

SEQ ID NO: 2742742 - RNA, 15 nt, Human
aaauuuauaaacuuu

SEQ ID NO: 2742743 - RNA, 21 nt, Human
aaauuuauaaacuuuuuucuu

SEQ ID NO: 2742744 - RNA, 17 nt, Human
aaauuuccuaauuuuga

SEQ ID NO: 2742745 - RNA, 16 nt, Human
aaauuugaugaaauca

SEQ ID NO: 2742746 - RNA, 19 nt, Human
aaauuugccaauuuacuuu

SEQ ID NO: 2742747 - RNA, 19 nt, Human
aaauuugggggacuuacau

SEQ ID NO: 2742748 - RNA, 15 nt, Human
aaauuuuagcaaaga

SEQ ID NO: 2742749 - RNA, 15 nt, Human
aaauuuuauaguguc

SEQ ID NO: 2742750 - RNA, 14 nt, Human
aaauuuucccaaaa

SEQ ID NO: 2742751 - RNA, 16 nt, Human
aaauuuucccaaaacu

SEQ ID NO: 2742752 - RNA, 18 nt, Human
aaauuuucuagaauacua

SEQ ID NO: 2742753 - RNA, 23 nt, Human
aaauuuuuaaucuuuaauuuuac

SEQ ID NO: 2742754 - RNA, 12 nt, Human
aaauuuuuucuc

SEQ ID NO: 2742755 - RNA, 14 nt, Human
aaauuuuuuuugua

SEQ ID NO: 2742756 - RNA, 17 nt, Human
aacaaaaaucaaacuuu

SEQ ID NO: 2742757 - RNA, 17 nt, Human
aacaaaauuagaaaugu

SEQ ID NO: 2742758 - RNA, 12 nt, Human
aacaaagaaauu

SEQ ID NO: 2742759 - RNA, 16 nt, Human
aacaaagaaauuaugu

SEQ ID NO: 2742760 - RNA, 22 nt, Human
aacaaaguugauuaagaaagga

SEQ ID NO: 2742761 - RNA, 17 nt, Human
aacaaauaggaauuguu

SEQ ID NO: 2742762 - RNA, 14 nt, Human
aacaacaacaacaa

SEQ ID NO: 2742763 - RNA, 17 nt, Human
aacaacuaccugagcua

SEQ ID NO: 2742764 - RNA, 14 nt, Human
aacaacucgaauca

SEQ ID NO: 2742765 - RNA, 13 nt, Human
aacaagccuccuu

SEQ ID NO: 2742766 - RNA, 11 nt, Human
aacaaggaagg

SEQ ID NO: 2742767 - RNA, 16 nt, Human
aacaaggaugaauuaa

SEQ ID NO: 2742768 - RNA, 16 nt, Human
aacaauaaaagacaag

SEQ ID NO: 2742769 - RNA, 18 nt, Human
aacaaugcuguauuuuaa

SEQ ID NO: 2742770 - RNA, 20 nt, Human
aacaaugcuguauuuuaaaa

SEQ ID NO: 2742771 - RNA, 22 nt, Human
aacaauguaauaaaaagccucu

SEQ ID NO: 2742772 - RNA, 13 nt, Human
aacaauucuuauu

SEQ ID NO: 2742773 - RNA, 15 nt, Human
aacaauuugaauaua

SEQ ID NO: 2742774 - RNA, 16 nt, Human
aacaauuugaauauaa

SEQ ID NO: 2742775 - RNA, 21 nt, Human
aacacagugauuuuauuagaa

SEQ ID NO: 2742776 - RNA, 14 nt, Human
aacacauaucgauu

SEQ ID NO: 2742777 - RNA, 12 nt, Human
aacacaucagcu

SEQ ID NO: 2742778 - RNA, 18 nt, Human
aacacaugauccugcaau

SEQ ID NO: 2742779 - RNA, 15 nt, Human
aacaccccacagaag

SEQ ID NO: 2742780 - RNA, 14 nt, Human
aacaccucagcugc

SEQ ID NO: 2742781 - RNA, 19 nt, Human
aacacucaaugguuaacua

SEQ ID NO: 2742782 - RNA, 16 nt, Human
aacacugggagaaaug

SEQ ID NO: 2742783 - RNA, 21 nt, Human
aacacugggagaaaugaaaaa

SEQ ID NO: 2742784 - RNA, 23 nt, Human
aacacugggagaaaugaaaaaau

SEQ ID NO: 2742785 - RNA, 20 nt, Human
aacacuugcggauauucugg

SEQ ID NO: 2742786 - RNA, 14 nt, Human
aacagaagcuucca

SEQ ID NO: 2742787 - RNA, 16 nt, Human
aacagauuauuaccuu

SEQ ID NO: 2742788 - RNA, 17 nt, Human
aacagauuucaaaaaaa

SEQ ID NO: 2742789 - RNA, 14 nt, Human
aacagcacccucuc

SEQ ID NO: 2742790 - RNA, 15 nt, Human
aacagcacccucucc

SEQ ID NO: 2742791 - RNA, 16 nt, Human
aacagcacccucucca

SEQ ID NO: 2742792 - RNA, 19 nt, Human
aacagcacccucuccagau

SEQ ID NO: 2742793 - RNA, 23 nt, Human
aacagucucaggaaaucaaauau

SEQ ID NO: 2742794 - RNA, 17 nt, Human
aacaguguguuggcgcu

SEQ ID NO: 2742795 - RNA, 17 nt, Human
aacaguuaccucugccu

SEQ ID NO: 2742796 - RNA, 22 nt, Human
aacaguuuuugcuaauuuuuag

SEQ ID NO: 2742797 - RNA, 21 nt, Human
aacauagaaauugccugacga

SEQ ID NO: 2742798 - RNA, 21 nt, Human
aacauagaacucaugacggaa

SEQ ID NO: 2742799 - RNA, 15 nt, Human
aacauagguuuuuag

SEQ ID NO: 2742800 - RNA, 21 nt, Human
aacauaugaauuauguuugca

SEQ ID NO: 2742801 - RNA, 16 nt, Human
aacaucacauuccucu

SEQ ID NO: 2742802 - RNA, 17 nt, Human
aacaucagcaaaaaagu

SEQ ID NO: 2742803 - RNA, 15 nt, Human
aacaucuagcaaaug

SEQ ID NO: 2742804 - RNA, 16 nt, Human
aacaugaaaacaauuc

SEQ ID NO: 2742805 - RNA, 15 nt, Human
aacaugaauauuuag

SEQ ID NO: 2742806 - RNA, 21 nt, Human
aacauggugaaaccuggucuc

SEQ ID NO: 2742807 - RNA, 21 nt, Human
aacauguuucuuuguaaugaa

SEQ ID NO: 2742808 - RNA, 22 nt, Human
aacauguuucuuuguaaugaaa

SEQ ID NO: 2742809 - RNA, 14 nt, Human
aacauuauuuauau

SEQ ID NO: 2742810 - RNA, 22 nt, Human
aacauuugguaaggggaauuga

SEQ ID NO: 2742811 - RNA, 21 nt, Human
aaccaaauggagugacuuagu

SEQ ID NO: 2742812 - RNA, 19 nt, Human
aaccaaauuuguauuuaag

SEQ ID NO: 2742813 - RNA, 20 nt, Human
aaccaaggcuagaaccaccu

SEQ ID NO: 2742814 - RNA, 19 nt, Human
aaccaagguuaucuuggaa

SEQ ID NO: 2742815 - RNA, 17 nt, Human
aaccacaagacugcaca

SEQ ID NO: 2742816 - RNA, 14 nt, Human
aaccagagccugag

SEQ ID NO: 2742817 - RNA, 14 nt, Human
aaccagaucauugu

SEQ ID NO: 2742818 - RNA, 22 nt, Human
aaccagaucauugugaaauuau

SEQ ID NO: 2742819 - RNA, 14 nt, Human
aaccagauugucag

SEQ ID NO: 2742820 - RNA, 19 nt, Human
aaccaggacccuguccaau

SEQ ID NO: 2742821 - RNA, 22 nt, Human
aaccagggagccccuuugauga

SEQ ID NO: 2742822 - RNA, 22 nt, Human
aaccauacaaaaauuccuuuuc

SEQ ID NO: 2742823 - RNA, 12 nt, Human
aaccaugaagag

SEQ ID NO: 2742824 - RNA, 22 nt, Human
aaccaugagaccacuguuauca

SEQ ID NO: 2742825 - RNA, 14 nt, Human
aacccagauaaagg

SEQ ID NO: 2742826 - RNA, 19 nt, Human
aacccagcucacaggagcu

SEQ ID NO: 2742827 - RNA, 23 nt, Human
aacccagcucacaggagcuuaaa

SEQ ID NO: 2742828 - RNA, 15 nt, Human
aacccagggaagaca

SEQ ID NO: 2742829 - RNA, 12 nt, Human
aacccauucccu

SEQ ID NO: 2742830 - RNA, 17 nt, Human
aacccauucccucucca

SEQ ID NO: 2742831 - RNA, 19 nt, Human
aaccccaggacgcccucac

SEQ ID NO: 2742832 - RNA, 16 nt, Human
aacccggccugauuaa

SEQ ID NO: 2742833 - RNA, 11 nt, Human
aacccuuucau

SEQ ID NO: 2742834 - RNA, 23 nt, Human
aacccuuucauaaagucuugccu

SEQ ID NO: 2742835 - RNA, 17 nt, Human
aacccuuucugccccug

SEQ ID NO: 2742836 - RNA, 17 nt, Human
aaccuagggugauauua

SEQ ID NO: 2742837 - RNA, 11 nt, Human
aaccuauguuu

SEQ ID NO: 2742838 - RNA, 12 nt, Human
aaccucugccuc

SEQ ID NO: 2742839 - RNA, 12 nt, Human
aaccucuucccc

SEQ ID NO: 2742840 - RNA, 19 nt, Human
aaccugaaauuaacucaga

SEQ ID NO: 2742841 - RNA, 14 nt, Human
aaccugagccccaa

SEQ ID NO: 2742842 - RNA, 23 nt, Human
aaccugccagcuggccuugugag

SEQ ID NO: 2742843 - RNA, 15 nt, Human
aaccugggggcuuua

SEQ ID NO: 2742844 - RNA, 18 nt, Human
aaccuuaccagauuuuua

SEQ ID NO: 2742845 - RNA, 19 nt, Human
aaccuuaccagauuuuuac

SEQ ID NO: 2742846 - RNA, 18 nt, Human
aaccuuauuguaccucuc

SEQ ID NO: 2742847 - RNA, 14 nt, Human
aaccuugaaaacuu

SEQ ID NO: 2742848 - RNA, 18 nt, Human
aaccuuuuauauuuagua

SEQ ID NO: 2742849 - RNA, 14 nt, Human
aaccuuuucccaac

SEQ ID NO: 2742850 - RNA, 22 nt, Human
aaccuuuuuggacacacaaauu

SEQ ID NO: 2742851 - RNA, 16 nt, Human
aacgagacaagcagcc

SEQ ID NO: 2742852 - RNA, 23 nt, Human
aacgaguaauuuauuguuuuucc

SEQ ID NO: 2742853 - RNA, 13 nt, Human
aacgauaaaagac

SEQ ID NO: 2742854 - RNA, 14 nt, Human
aacgauaaaagaca

SEQ ID NO: 2742855 - RNA, 15 nt, Human
aacgauaaaagacag

SEQ ID NO: 2742856 - RNA, 16 nt, Human
aacgauaaaagacagu

SEQ ID NO: 2742857 - RNA, 17 nt, Human
aacgauaaaagacagug

SEQ ID NO: 2742858 - RNA, 20 nt, Human
aacgauaaaagacagugaaa

SEQ ID NO: 2742859 - RNA, 21 nt, Human
acaugcacuuggcugcauaaa

SEQ ID NO: 2742860 - RNA, 18 nt, Human
acaugcucacacauuaca

SEQ ID NO: 2742861 - RNA, 22 nt, Human
acauggcuggagcuagaauuug

SEQ ID NO: 2742862 - RNA, 17 nt, Human
acaugggugaacacuca

SEQ ID NO: 2742863 - RNA, 21 nt, Human
acaugggugcuauugggguug

SEQ ID NO: 2742864 - RNA, 18 nt, Human
acauguaauaagguugaa

SEQ ID NO: 2742865 - RNA, 15 nt, Human
acauguaucuaugca

SEQ ID NO: 2742866 - RNA, 13 nt, Human
acaugucuagaga

SEQ ID NO: 2742867 - RNA, 16 nt, Human
acaugucuagagaaca

SEQ ID NO: 2742868 - RNA, 15 nt, Human
acaugugcuggccac

SEQ ID NO: 2742869 - RNA, 16 nt, Human
acaugugcuggccacc

SEQ ID NO: 2742870 - RNA, 15 nt, Human
acauguuuucuuugc

SEQ ID NO: 2742871 - RNA, 18 nt, Human
acauguuuucuuugcuuu

SEQ ID NO: 2742872 - RNA, 12 nt, Human
acauuaaaaugu

SEQ ID NO: 2742873 - RNA, 22 nt, Human
acauuacaguuagagauuuuua

SEQ ID NO: 2742874 - RNA, 16 nt, Human
acauucagggcuauuu

SEQ ID NO: 2742875 - RNA, 19 nt, Human
acauuccucugcccuuccu

SEQ ID NO: 2742876 - RNA, 21 nt, Human
acauuccucugcccuuccugc

SEQ ID NO: 2742877 - RNA, 18 nt, Human
acauuccugaacaggaua

SEQ ID NO: 2742878 - RNA, 15 nt, Human
acauucuaucuauuc

SEQ ID NO: 2742879 - RNA, 21 nt, Human
acauucuuccugauuauuuuc

SEQ ID NO: 2742880 - RNA, 14 nt, Human
acauuguauucaga

SEQ ID NO: 2742881 - RNA, 16 nt, Human
acauuuauauuuuugu

SEQ ID NO: 2742882 - RNA, 15 nt, Human
acauuuccaaauuca

SEQ ID NO: 2742883 - RNA, 21 nt, Human
acauuucucauaccuucccca

SEQ ID NO: 2742884 - RNA, 15 nt, Human
acauuugcucaugga

SEQ ID NO: 2742885 - RNA, 16 nt, Human
acauuugcucauggaa

SEQ ID NO: 2742886 - RNA, 17 nt, Human
acauuugcucauggaau

SEQ ID NO: 2742887 - RNA, 23 nt, Human
acauuuguagcauccucuuuaau

SEQ ID NO: 2742888 - RNA, 14 nt, Human
acauuuucucccug

SEQ ID NO: 2742889 - RNA, 10 nt, Human
acauuuuuag

SEQ ID NO: 2742890 - RNA, 15 nt, Human
acauuuuuaguuuaa

SEQ ID NO: 2742891 - RNA, 12 nt, Human
acauuuuuguau

SEQ ID NO: 2742892 - RNA, 17 nt, Human
acauuuuuguauuuugu

SEQ ID NO: 2742893 - RNA, 18 nt, Human
accaaaaaucucaauauu

SEQ ID NO: 2742894 - RNA, 19 nt, Human
accaaaaaucucaauauuu

SEQ ID NO: 2742895 - RNA, 16 nt, Human
accaaauugagcuagg

SEQ ID NO: 2742896 - RNA, 13 nt, Human
accaacacccuga

SEQ ID NO: 2742897 - RNA, 14 nt, Human
accaagaagcccaa

SEQ ID NO: 2742898 - RNA, 19 nt, Human
accaagacuacuagggaaa

SEQ ID NO: 2742899 - RNA, 22 nt, Human
accaagacuacuagggaaaugc

SEQ ID NO: 2742900 - RNA, 13 nt, Human
accaagauauacc

SEQ ID NO: 2742901 - RNA, 18 nt, Human
accaagcugguggcucug

SEQ ID NO: 2742902 - RNA, 21 nt, Human
accaaggagccaaacauccua

SEQ ID NO: 2742903 - RNA, 22 nt, Human
accaaggcccccgggccgacgg

SEQ ID NO: 2742904 - RNA, 11 nt, Human
accaaggcuag

SEQ ID NO: 2742905 - RNA, 12 nt, Human
accaaggcugau

SEQ ID NO: 2742906 - RNA, 15 nt, Human
accaaggcugauuaa

SEQ ID NO: 2742907 - RNA, 22 nt, Human
accaauauuguacaguuuuuau

SEQ ID NO: 2742908 - RNA, 15 nt, Human
accaaucauuuuaau

SEQ ID NO: 2742909 - RNA, 20 nt, Human
accaaucauuuuaauuauua

SEQ ID NO: 2742910 - RNA, 22 nt, Human
accacaaugcagugccuuucuu

SEQ ID NO: 2742911 - RNA, 14 nt, Human
accacacccacacu

SEQ ID NO: 2742912 - RNA, 19 nt, Human
accacagcaguugaaaaga

SEQ ID NO: 2742913 - RNA, 15 nt, Human
accacauccagccua

SEQ ID NO: 2742914 - RNA, 17 nt, Human
accacaucccacucaca

SEQ ID NO: 2742915 - RNA, 20 nt, Human
accacauugagucuaucaau

SEQ ID NO: 2742916 - RNA, 21 nt, Human
accacauugagucuaucaauc

SEQ ID NO: 2742917 - RNA, 15 nt, Human
accaccaagccuuga

SEQ ID NO: 2742918 - RNA, 17 nt, Human
accaccacgccuggcua

SEQ ID NO: 2742919 - RNA, 18 nt, Human
accaccugccuauauuuu

SEQ ID NO: 2742920 - RNA, 12 nt, Human
accacucagaga

SEQ ID NO: 2742921 - RNA, 18 nt, Human
accacucauaauucuuca

SEQ ID NO: 2742922 - RNA, 20 nt, Human
accacucauaauucuucacc

SEQ ID NO: 2742923 - RNA, 14 nt, Human
accacugcagaaga

SEQ ID NO: 2742924 - RNA, 17 nt, Human
accacuguguauuuaac

SEQ ID NO: 2742925 - RNA, 18 nt, Human
accacuguguauuuaacu

SEQ ID NO: 2742926 - RNA, 15 nt, Human
accacuguuaucaaa

SEQ ID NO: 2742927 - RNA, 16 nt, Human
accacuuuauuucuuu

SEQ ID NO: 2742928 - RNA, 21 nt, Human
accagagccugaguguugccu

SEQ ID NO: 2742929 - RNA, 19 nt, Human
accagauuuuuacacaugu

SEQ ID NO: 2742930 - RNA, 20 nt, Human
accagccaaccugggggcuu

SEQ ID NO: 2742931 - RNA, 16 nt, Human
accagccuggucaaca

SEQ ID NO: 2742932 - RNA, 16 nt, Human
accagccuuggauacu

SEQ ID NO: 2742933 - RNA, 13 nt, Human
accaggacccugu

SEQ ID NO: 2742934 - RNA, 17 nt, Human
accaggaguucucccac

SEQ ID NO: 2742935 - RNA, 20 nt, Human
accaggaguucucccaccac

SEQ ID NO: 2742936 - RNA, 23 nt, Human
accaggauauccucccuccagau

SEQ ID NO: 2742937 - RNA, 12 nt, Human
accaggcacccc

SEQ ID NO: 2742938 - RNA, 18 nt, Human
accaggcuugccugcagg

SEQ ID NO: 2742939 - RNA, 15 nt, Human
accagggagccccuu

SEQ ID NO: 2742940 - RNA, 15 nt, Human
accagggccuggcug

SEQ ID NO: 2742941 - RNA, 17 nt, Human
accagggccuggcuggg

SEQ ID NO: 2742942 - RNA, 21 nt, Human
accagggccuggcugggagug

SEQ ID NO: 2742943 - RNA, 23 nt, Human
accagggccuggcugggaguggc

SEQ ID NO: 2742944 - RNA, 15 nt, Human
accaggggccaugaa

SEQ ID NO: 2742945 - RNA, 15 nt, Human
accaggucacgcuuu

SEQ ID NO: 2742946 - RNA, 23 nt, Human
accaguaugcuuggacugaaggg

SEQ ID NO: 2742947 - RNA, 23 nt, Human
accagucugacuguuuccaucaa

SEQ ID NO: 2742948 - RNA, 22 nt, Human
accaguguguggcuuucagagc

SEQ ID NO: 2742949 - RNA, 14 nt, Human
accaguuuccaggu

SEQ ID NO: 2742950 - RNA, 15 nt, Human
accaucccggccggc

SEQ ID NO: 2742951 - RNA, 15 nt, Human
accaucgucuucuug

SEQ ID NO: 2742952 - RNA, 20 nt, Human
accaucgucuucuuggccau

SEQ ID NO: 2742953 - RNA, 17 nt, Human
accaugccauuuaaagc

SEQ ID NO: 2742954 - RNA, 15 nt, Human
accaugcugauaaac

SEQ ID NO: 2742955 - RNA, 23 nt, Human
accaugcugcuggggaagacagu

SEQ ID NO: 2742956 - RNA, 23 nt, Human
accauguacauagcuugauaaag

SEQ ID NO: 2742957 - RNA, 15 nt, Human
accauuauggauaaa

SEQ ID NO: 2742958 - RNA, 21 nt, Human
accauuucuugagguaaaagc

SEQ ID NO: 2742959 - RNA, 14 nt, Human
accauuuucuuuuu

SEQ ID NO: 2742960 - RNA, 19 nt, Human
accauuuuggcaagcucua

SEQ ID NO: 2742961 - RNA, 18 nt, Human
accauuuuugaaaccaaa

SEQ ID NO: 2742962 - RNA, 15 nt, Human
acccaaaaggcagaa

SEQ ID NO: 2742963 - RNA, 20 nt, Human
acccaaggaugucugccaca

SEQ ID NO: 2742964 - RNA, 15 nt, Human
acccacuucacacac

SEQ ID NO: 2742965 - RNA, 20 nt, Human
acccacuucacacacaggca

SEQ ID NO: 2742966 - RNA, 13 nt, Human
acccagauaaagg

SEQ ID NO: 2742967 - RNA, 23 nt, Human
acccaggaggugugauuccugaa

SEQ ID NO: 2742968 - RNA, 22 nt, Human
acccaggaguauccucuugcca

SEQ ID NO: 2742969 - RNA, 18 nt, Human
acccagggaugacauguc

SEQ ID NO: 2742970 - RNA, 18 nt, Human
acccagguuggagugcag

SEQ ID NO: 2742971 - RNA, 15 nt, Human
acccaguagaugcca

SEQ ID NO: 2742972 - RNA, 18 nt, Human
acccagucuguuccccau

SEQ ID NO: 2742973 - RNA, 14 nt, Human
acccaguguuuuag

SEQ ID NO: 2742974 - RNA, 21 nt, Human
acccaguugugacaauuaaaa

SEQ ID NO: 2742975 - RNA, 13 nt, Human
acccauucccucu

SEQ ID NO: 2742976 - RNA, 14 nt, Human
accccaacagcacc

SEQ ID NO: 2742977 - RNA, 16 nt, Human
accccaacagcacccu

SEQ ID NO: 2742978 - RNA, 19 nt, Human
accccaaguuauccaccug

SEQ ID NO: 2742979 - RNA, 22 nt, Human
accccacagaagugcuuucuuc

SEQ ID NO: 2742980 - RNA, 21 nt, Human
accccagcuggggccaggcug

SEQ ID NO: 2742981 - RNA, 19 nt, Human
acccccagcuuugaggaaa

SEQ ID NO: 2742982 - RNA, 19 nt, Human
acccccugcaaagcccagc

SEQ ID NO: 2742983 - RNA, 20 nt, Human
acccccugcaaagcccagcu

SEQ ID NO: 2742984 - RNA, 12 nt, Human
acccccugggag

SEQ ID NO: 2742985 - RNA, 20 nt, Human
acuaaauaaagcuugcaaca

SEQ ID NO: 2742986 - RNA, 16 nt, Human
acuaacacccagucug

SEQ ID NO: 2742987 - RNA, 20 nt, Human
acuaacagugugauucaccc

SEQ ID NO: 2742988 - RNA, 12 nt, Human
acuaauaaaaua

SEQ ID NO: 2742989 - RNA, 15 nt, Human
acuaauaaaauacau

SEQ ID NO: 2742990 - RNA, 19 nt, Human
acuaauuauacccccugca

SEQ ID NO: 2742991 - RNA, 13 nt, Human
acuaauuuuaaaa

SEQ ID NO: 2742992 - RNA, 20 nt, Human
acuaauuuuaacucuauaau

SEQ ID NO: 2742993 - RNA, 22 nt, Human
acuacauggaagaccucauuuu

SEQ ID NO: 2742994 - RNA, 16 nt, Human
acuacuuuaaaaaaaa

SEQ ID NO: 2742995 - RNA, 15 nt, Human
acuagaauuuauuca

SEQ ID NO: 2742996 - RNA, 19 nt, Human
acuagacaaguccagccug

SEQ ID NO: 2742997 - RNA, 20 nt, Human
acuagaguuuagcuggaaaa

SEQ ID NO: 2742998 - RNA, 12 nt, Human
acuagcccuccu

SEQ ID NO: 2742999 - RNA, 21 nt, Human
acuaggguggugcauuuuugu

SEQ ID NO: 2743000 - RNA, 17 nt, Human
acuaggugcauauuuau

SEQ ID NO: 2743001 - RNA, 18 nt, Human
acuaggugcauauuuaua

SEQ ID NO: 2743002 - RNA, 16 nt, Human
acuaggugcugcagcc

SEQ ID NO: 2743003 - RNA, 13 nt, Human
acuaguauuucua

SEQ ID NO: 2743004 - RNA, 14 nt, Human
acuaguauuucuau

SEQ ID NO: 2743005 - RNA, 16 nt, Human
acuaguuguaauuuuu

SEQ ID NO: 2743006 - RNA, 11 nt, Human
acuauaaaacu

SEQ ID NO: 2743007 - RNA, 12 nt, Human
acuauaaaacua

SEQ ID NO: 2743008 - RNA, 20 nt, Human
acuauagugugagccaggaa

SEQ ID NO: 2743009 - RNA, 22 nt, Human
acuaucucauuuccaagcaagu

SEQ ID NO: 2743010 - RNA, 21 nt, Human
acuaucuguuuuuauauuucu

SEQ ID NO: 2743011 - RNA, 16 nt, Human
acuaugaggaauauuu

SEQ ID NO: 2743012 - RNA, 12 nt, Human
acuauggaaaaa

SEQ ID NO: 2743013 - RNA, 21 nt, Human
acuauguaggaaagaccauuu

SEQ ID NO: 2743014 - RNA, 15 nt, Human
acuauuaacaacuug

SEQ ID NO: 2743015 - RNA, 21 nt, Human
acuauuaacaacuugucuauu

SEQ ID NO: 2743016 - RNA, 15 nt, Human
agaagaaaucaugau

SEQ ID NO: 2743017 - RNA, 17 nt, Human
agaagaaggaaauugaa

SEQ ID NO: 2743018 - RNA, 13 nt, Human
agaagacaacauu

SEQ ID NO: 2743019 - RNA, 14 nt, Human
agaagagaaaaugu

SEQ ID NO: 2743020 - RNA, 15 nt, Human
agaagagaauauuag

SEQ ID NO: 2743021 - RNA, 13 nt, Human
agaagagccggag

SEQ ID NO: 2743022 - RNA, 20 nt, Human
agaagagccggagccuccag

SEQ ID NO: 2743023 - RNA, 21 nt, Human
agaagagcuguucacagccag

SEQ ID NO: 2743024 - RNA, 15 nt, Human
agaagauagcagggc

SEQ ID NO: 2743025 - RNA, 16 nt, Human
agaagauagcagggca

SEQ ID NO: 2743026 - RNA, 17 nt, Human
agaagaugguaccacca

SEQ ID NO: 2743027 - RNA, 18 nt, Human
agaagccaaaagauugga

SEQ ID NO: 2743028 - RNA, 21 nt, Human
agaagcuagaaaacaggcaaa

SEQ ID NO: 2743029 - RNA, 14 nt, Human
agaaggaaauugaa

SEQ ID NO: 2743030 - RNA, 17 nt, Human
agaaggccaagaggcug

SEQ ID NO: 2743031 - RNA, 20 nt, Human
agaaggcuguggauuuaaug

SEQ ID NO: 2743032 - RNA, 20 nt, Human
agaaggugggaggaugugaa

SEQ ID NO: 2743033 - RNA, 22 nt, Human
agaagucaaggcuuagacccuc

SEQ ID NO: 2743034 - RNA, 20 nt, Human
agaagucguuuuuagggaga

SEQ ID NO: 2743035 - RNA, 15 nt, Human
agaagugcuuucuuc

SEQ ID NO: 2743036 - RNA, 13 nt, Human
agaauaaaauuuu

SEQ ID NO: 2743037 - RNA, 14 nt, Human
agaauaaccaacac

SEQ ID NO: 2743038 - RNA, 20 nt, Human
agaauaccacaggaaccaca

SEQ ID NO: 2743039 - RNA, 15 nt, Human
agaauacuaauaaaa

SEQ ID NO: 2743040 - RNA, 19 nt, Human
agaauacuaauaaaauaca

SEQ ID NO: 2743041 - RNA, 15 nt, Human
agaauagaaauuagu

SEQ ID NO: 2743042 - RNA, 11 nt, Human
agaauauauuu

SEQ ID NO: 2743043 - RNA, 13 nt, Human
agaauauauuucc

SEQ ID NO: 2743044 - RNA, 14 nt, Human
agaauauauuuccu

SEQ ID NO: 2743045 - RNA, 20 nt, Human
agaauaugccuuguuucaua

SEQ ID NO: 2743046 - RNA, 16 nt, Human
agaauauuaaaaauua

SEQ ID NO: 2743047 - RNA, 18 nt, Human
agaauauuaaaaauuaau

SEQ ID NO: 2743048 - RNA, 21 nt, Human
agaaucacaauaauuuucuac

SEQ ID NO: 2743049 - RNA, 15 nt, Human
agaaucacuugaacc

SEQ ID NO: 2743050 - RNA, 19 nt, Human
agaaucucucuucuuuuca

SEQ ID NO: 2743051 - RNA, 23 nt, Human
agaaugaccuggccgcagugagg

SEQ ID NO: 2743052 - RNA, 17 nt, Human
agaaugacugacaaaga

SEQ ID NO: 2743053 - RNA, 14 nt, Human
agaaugagaagaau

SEQ ID NO: 2743054 - RNA, 22 nt, Human
agaaugagagacacacugaaga

SEQ ID NO: 2743055 - RNA, 23 nt, Human
agaaugauuaugaauuacauuug

SEQ ID NO: 2743056 - RNA, 15 nt, Human
agaauuaauggaaua

SEQ ID NO: 2743057 - RNA, 13 nt, Human
agaauuauuuugu

SEQ ID NO: 2743058 - RNA, 15 nt, Human
agaauuauuuuguga

SEQ ID NO: 2743059 - RNA, 20 nt, Human
agaauucuguugauggaaau

SEQ ID NO: 2743060 - RNA, 22 nt, Human
agaauucuuacauguuuucuuu

SEQ ID NO: 2743061 - RNA, 14 nt, Human
agaauuuaaaccua

SEQ ID NO: 2743062 - RNA, 23 nt, Human
agaauuuaaaccuauacucacuu

SEQ ID NO: 2743063 - RNA, 19 nt, Human
agaauuugagcaucaguga

SEQ ID NO: 2743064 - RNA, 22 nt, Human
agaauuugauaugugaacaguu

SEQ ID NO: 2743065 - RNA, 15 nt, Human
agaauuuuaaaacuc

SEQ ID NO: 2743066 - RNA, 22 nt, Human
agaauuuuaugcggcauuuucu

SEQ ID NO: 2743067 - RNA, 16 nt, Human
agacaaauucuguuuc

SEQ ID NO: 2743068 - RNA, 17 nt, Human
agacaagaaggaaagau

SEQ ID NO: 2743069 - RNA, 15 nt, Human
agacaaggccuugga

SEQ ID NO: 2743070 - RNA, 16 nt, Human
agacaaggccuuggag

SEQ ID NO: 2743071 - RNA, 19 nt, Human
agacaauuguuggagagcc

SEQ ID NO: 2743072 - RNA, 15 nt, Human
agacaccaccacccu

SEQ ID NO: 2743073 - RNA, 16 nt, Human
agacaccaccacccuu

SEQ ID NO: 2743074 - RNA, 22 nt, Human
agacaccaccacccuugccaug

SEQ ID NO: 2743075 - RNA, 20 nt, Human
agacacugauguaugaggaa

SEQ ID NO: 2743076 - RNA, 13 nt, Human
agacacugucucu

SEQ ID NO: 2743077 - RNA, 14 nt, Human
agacacugucucua

SEQ ID NO: 2743078 - RNA, 14 nt, Human
agacagaaaaaacu

SEQ ID NO: 2743079 - RNA, 19 nt, Human
agacagagccccacccuca

SEQ ID NO: 2743080 - RNA, 22 nt, Human
agacagagccccacccucagau

SEQ ID NO: 2743081 - RNA, 17 nt, Human
agacagagcuauucucc

SEQ ID NO: 2743082 - RNA, 11 nt, Human
agacagagucu

SEQ ID NO: 2743083 - RNA, 23 nt, Human
agacagagucuuccucugucucc

SEQ ID NO: 2743084 - RNA, 23 nt, Human
agacagcuucucauccugcaggc

SEQ ID NO: 2743085 - RNA, 17 nt, Human
agacaggguuucaccau

SEQ ID NO: 2743086 - RNA, 14 nt, Human
agacagugaaagaa

SEQ ID NO: 2743087 - RNA, 19 nt, Human
agacagugaaagaaaauaa

SEQ ID NO: 2743088 - RNA, 20 nt, Human
agacauacaccuaugucauu

SEQ ID NO: 2743089 - RNA, 16 nt, Human
agacauacauuucuca

SEQ ID NO: 2743090 - RNA, 14 nt, Human
agacaucaacagau

SEQ ID NO: 2743091 - RNA, 19 nt, Human
agacaucaacagauaaaua

SEQ ID NO: 2743092 - RNA, 18 nt, Human
agacauguggugggacag

SEQ ID NO: 2743093 - RNA, 21 nt, Human
agacauguggugggacaggga

SEQ ID NO: 2743094 - RNA, 22 nt, Human
agacauguggugggacagggac

SEQ ID NO: 2743095 - RNA, 16 nt, Human
agacauugaggcaggc

SEQ ID NO: 2743096 - RNA, 17 nt, Human
agacccaaaaggcagaa

SEQ ID NO: 2743097 - RNA, 16 nt, Human
agacccucaugcugcc

SEQ ID NO: 2743098 - RNA, 19 nt, Human
agacccucaugcugccaau

SEQ ID NO: 2743099 - RNA, 22 nt, Human
agacccuuauugcuguccugga

SEQ ID NO: 2743100 - RNA, 13 nt, Human
agaccuaaaauaa

SEQ ID NO: 2743101 - RNA, 19 nt, Human
agaccuaggauuucaugau

SEQ ID NO: 2743102 - RNA, 16 nt, Human
agaccugacucucuua

SEQ ID NO: 2743103 - RNA, 20 nt, Human
agaccuuugaacuagaguuu

SEQ ID NO: 2743104 - RNA, 21 nt, Human
agacggauuuauuuuuccauu

SEQ ID NO: 2743105 - RNA, 20 nt, Human
agacgggguuugccaugcug

SEQ ID NO: 2743106 - RNA, 22 nt, Human
agacgugcacgcacacugucug

SEQ ID NO: 2743107 - RNA, 15 nt, Human
agacucacuguggga

SEQ ID NO: 2743108 - RNA, 16 nt, Human
agacucacugugggaa

SEQ ID NO: 2743109 - RNA, 23 nt, Human
agacuccaaagaaauguaaggga

SEQ ID NO: 2743110 - RNA, 19 nt, Human
agacucgggauuaguacac

SEQ ID NO: 2743111 - RNA, 12 nt, Human
agacucuaagaa

SEQ ID NO: 2743112 - RNA, 12 nt, Human
agacucugucuc

SEQ ID NO: 2743113 - RNA, 22 nt, Human
agacucugucucaguccaugaa

SEQ ID NO: 2743114 - RNA, 17 nt, Human
agacugcauuauauuua

SEQ ID NO: 2743115 - RNA, 15 nt, Human
agacuggaaggacca

SEQ ID NO: 2743116 - RNA, 20 nt, Human
agacuguuuuucagggaggu

SEQ ID NO: 2743117 - RNA, 19 nt, Human
agacuugggaaugagcuga

SEQ ID NO: 2743118 - RNA, 22 nt, Human
agacuugggaaugagcugaagg

SEQ ID NO: 2743119 - RNA, 17 nt, Human
agacuuugugaaaaaaa

SEQ ID NO: 2743120 - RNA, 22 nt, Human
agacuuugugaaaaaaaauuuu

SEQ ID NO: 2743121 - RNA, 13 nt, Human
agacuuuuuccuu

SEQ ID NO: 2743122 - RNA, 16 nt, Human
agagaacaagcaaaua

SEQ ID NO: 2743123 - RNA, 19 nt, Human
agagaacagggcugaagcu

SEQ ID NO: 2743124 - RNA, 17 nt, Human
agagaaguucaauauaa

SEQ ID NO: 2743125 - RNA, 18 nt, Human
agagaaugagagacacac

SEQ ID NO: 2743126 - RNA, 21 nt, Human
agagaaugagagacacacuga

SEQ ID NO: 2743127 - RNA, 22 nt, Human
agagacaacagguaaaacaggg

SEQ ID NO: 2743128 - RNA, 15 nt, Human
agagacagaaagcag

SEQ ID NO: 2743129 - RNA, 16 nt, Human
agagacagaaagcaga

SEQ ID NO: 2743130 - RNA, 17 nt, Human
agagacagaaagcagaa

SEQ ID NO: 2743131 - RNA, 23 nt, Human
agagacagcccaggauacuggca

SEQ ID NO: 2743132 - RNA, 15 nt, Human
agagacucagggccc

SEQ ID NO: 2743133 - RNA, 14 nt, Human
agagacuugggaau

SEQ ID NO: 2743134 - RNA, 21 nt, Human
agagacuuugugaaaaaaaau

SEQ ID NO: 2743135 - RNA, 13 nt, Human
agagagcuggagg

SEQ ID NO: 2743136 - RNA, 14 nt, Human
agagagcuggaggc

SEQ ID NO: 2743137 - RNA, 22 nt, Human
agagagcuggaggcacccaugc

SEQ ID NO: 2743138 - RNA, 13 nt, Human
agagauuccugag

SEQ ID NO: 2743139 - RNA, 18 nt, Human
agagauuuuuaaauaaag

SEQ ID NO: 2743140 - RNA, 20 nt, Human
agagauuuuuaaauaaagaa

SEQ ID NO: 2743141 - RNA, 13 nt, Human
agagcaagacucu

SEQ ID NO: 2743142 - RNA, 21 nt, Human
agagcaagcaggaaucagaga

SEQ ID NO: 2743143 - RNA, 21 nt, Human
agagcaguuugguuucuagca

SEQ ID NO: 2743144 - RNA, 16 nt, Human
agagccccacccucag

SEQ ID NO: 2743145 - RNA, 18 nt, Human
agagccccacccucagau

SEQ ID NO: 2743146 - RNA, 15 nt, Human
agagcccugaggccu

SEQ ID NO: 2743147 - RNA, 18 nt, Human
agagccggagccuccagc

SEQ ID NO: 2743148 - RNA, 20 nt, Human
agagccggagccuccagcug

SEQ ID NO: 2743149 - RNA, 16 nt, Human
agagccuccuuucugg

SEQ ID NO: 2743150 - RNA, 18 nt, Human
agagccuccuuucuggcu

SEQ ID NO: 2743151 - RNA, 16 nt, Human
agagccuuuuuuugaa

SEQ ID NO: 2743152 - RNA, 14 nt, Human
agagcgcacaggga

SEQ ID NO: 2743153 - RNA, 23 nt, Human
agagcucaggaugagggaaaaga

SEQ ID NO: 2743154 - RNA, 15 nt, Human
agagcugcccucucc

SEQ ID NO: 2743155 - RNA, 11 nt, Human
agagcuggagg

SEQ ID NO: 2743156 - RNA, 16 nt, Human
agagcuggaggcaccc

SEQ ID NO: 2743157 - RNA, 17 nt, Human
agagcuggaggcaccca

SEQ ID NO: 2743158 - RNA, 18 nt, Human
agagcuguucacagccag

SEQ ID NO: 2743159 - RNA, 22 nt, Human
agaggacuccuuaaauuugggg

SEQ ID NO: 2743160 - RNA, 15 nt, Human
agaggcaaagaaagg

SEQ ID NO: 2743161 - RNA, 23 nt, Human
agaggcaccugucccagaaaaag

SEQ ID NO: 2743162 - RNA, 13 nt, Human
agaggcagcuuga

SEQ ID NO: 2743163 - RNA, 15 nt, Human
agaggcagcuugaaa

SEQ ID NO: 2743164 - RNA, 15 nt, Human
agaggccugacugcc

SEQ ID NO: 2743165 - RNA, 22 nt, Human
agaggcuacuguaaggcaauca

SEQ ID NO: 2743166 - RNA, 15 nt, Human
agaggcucuaaugua

SEQ ID NO: 2743167 - RNA, 16 nt, Human
agagggagugcauuua

SEQ ID NO: 2743168 - RNA, 15 nt, Human
agaggguuuggaagc

SEQ ID NO: 2743169 - RNA, 14 nt, Human
agagguccacaaca

SEQ ID NO: 2743170 - RNA, 23 nt, Human
agaguaauccaagcaaaugugaa

SEQ ID NO: 2743171 - RNA, 15 nt, Human
agaguacaccccaac

SEQ ID NO: 2743172 - RNA, 17 nt, Human
agaguacaccccaacag

SEQ ID NO: 2743173 - RNA, 19 nt, Human
agaguacucuuguuuccuu

SEQ ID NO: 2743174 - RNA, 24 nt, Human
agagucuuccucugucuccuaagc

SEQ ID NO: 2743175 - RNA, 22 nt, Human
agaguggaaccaacacuaacau

SEQ ID NO: 2743176 - RNA, 15 nt, Human
agaguggcuggggca

SEQ ID NO: 2743177 - RNA, 23 nt, Human
agaguuuagcuggaaaaguaugu

SEQ ID NO: 2743178 - RNA, 22 nt, Human
agaguuuucauguauuuuaaaa

SEQ ID NO: 2743179 - RNA, 16 nt, Human
agauaaagauuucuug

SEQ ID NO: 2743180 - RNA, 21 nt, Human
agauaaagguucaugcaaacu

SEQ ID NO: 2743181 - RNA, 14 nt, Human
agauaaauuauauc

SEQ ID NO: 2743182 - RNA, 17 nt, Human
agauaaauuauaucaau

SEQ ID NO: 2743183 - RNA, 14 nt, Human
agauacaaacaugu

SEQ ID NO: 2743184 - RNA, 17 nt, Human
agauacagggaugaggc

SEQ ID NO: 2743185 - RNA, 17 nt, Human
agauacaguggagacau

SEQ ID NO: 2743186 - RNA, 20 nt, Human
agauacaguggagacaucug

SEQ ID NO: 2743187 - RNA, 17 nt, Human
agauacaugcuuuuuaa

SEQ ID NO: 2743188 - RNA, 19 nt, Human
agauaccaugaugcugagc

SEQ ID NO: 2743189 - RNA, 15 nt, Human
agauacugaaauaaa

SEQ ID NO: 2743190 - RNA, 20 nt, Human
agauacugaaauaaacgucu

SEQ ID NO: 2743191 - RNA, 16 nt, Human
agauagaugaagaagc

SEQ ID NO: 2743192 - RNA, 17 nt, Human
agauagaugaagaagcu

SEQ ID NO: 2743193 - RNA, 13 nt, Human
agauagcagggca

SEQ ID NO: 2743194 - RNA, 16 nt, Human
agauagggagggaagg

SEQ ID NO: 2743195 - RNA, 17 nt, Human
agauagguuaccaguaa

SEQ ID NO: 2743196 - RNA, 14 nt, Human
agauauaccugaua

SEQ ID NO: 2743197 - RNA, 12 nt, Human
agauaucccagg

SEQ ID NO: 2743198 - RNA, 20 nt, Human
agauaucccaggaaaauuaa

SEQ ID NO: 2743199 - RNA, 23 nt, Human
agauaugaggcauuugcagcugu

SEQ ID NO: 2743200 - RNA, 19 nt, Human
agauauuuuucaugauuuu

SEQ ID NO: 2743201 - RNA, 14 nt, Human
agaucaagccugcc

SEQ ID NO: 2743202 - RNA, 16 nt, Human
agaucaagccugccuc

SEQ ID NO: 2743203 - RNA, 15 nt, Human
agaucacagcuucag

SEQ ID NO: 2743204 - RNA, 16 nt, Human
agaucacuugagcuca

SEQ ID NO: 2743205 - RNA, 22 nt, Human
agaucacuugagcucaggaggu

SEQ ID NO: 2743206 - RNA, 17 nt, Human
agauccccguguuacug

SEQ ID NO: 2743207 - RNA, 23 nt, Human
agauccuuccuuuugagggagca

SEQ ID NO: 2743208 - RNA, 19 nt, Human
agaucuacaugucuagaga

SEQ ID NO: 2743209 - RNA, 16 nt, Human
agaucuuacaucugca

SEQ ID NO: 2743210 - RNA, 14 nt, Human
agaugaacucaacu

SEQ ID NO: 2743211 - RNA, 21 nt, Human
agaugaaugagcaaaaccaaa

SEQ ID NO: 2743212 - RNA, 19 nt, Human
agaugagagaacagggcug

SEQ ID NO: 2743213 - RNA, 15 nt, Human
agaugagaguacacc

SEQ ID NO: 2743214 - RNA, 16 nt, Human
agaugagaguacaccc

SEQ ID NO: 2743215 - RNA, 14 nt, Human
agaugaggccgcca

SEQ ID NO: 2743216 - RNA, 22 nt, Human
agaugaucaguaugaaaauguc

SEQ ID NO: 2743217 - RNA, 17 nt, Human
agaugcacaugagcugg

SEQ ID NO: 2743218 - RNA, 13 nt, Human
agaugccacccag

SEQ ID NO: 2743219 - RNA, 19 nt, Human
agaugcuagaacucccuuu

SEQ ID NO: 2743220 - RNA, 22 nt, Human
agaugcuagaacucccuuucaa

SEQ ID NO: 2743221 - RNA, 14 nt, Human
agaugcuuguauuu

SEQ ID NO: 2743222 - RNA, 17 nt, Human
agaugggagaaucacuu

SEQ ID NO: 2743223 - RNA, 14 nt, Human
agauguagaggaga

SEQ ID NO: 2743224 - RNA, 21 nt, Human
agauguagccccucuccugga

SEQ ID NO: 2743225 - RNA, 18 nt, Human
agauguauguacuucaug

SEQ ID NO: 2743226 - RNA, 21 nt, Human
agauguauguacuucaugcug

SEQ ID NO: 2743227 - RNA, 16 nt, Human
agaugucgcccuacuc

SEQ ID NO: 2743228 - RNA, 17 nt, Human
agaugugaacacaucag

SEQ ID NO: 2743229 - RNA, 13 nt, Human
agauuaagauaug

SEQ ID NO: 2743230 - RNA, 23 nt, Human
agauuaugaucucagaaauugua

SEQ ID NO: 2743231 - RNA, 15 nt, Human
agauucaugcacugu

SEQ ID NO: 2743232 - RNA, 17 nt, Human
agauucauucaugucau

SEQ ID NO: 2743233 - RNA, 20 nt, Human
agauucauuuuucuuucuga

SEQ ID NO: 2743234 - RNA, 17 nt, Human
agauucccugagcagga

SEQ ID NO: 2743235 - RNA, 19 nt, Human
agauucuaauggcuuuauu

SEQ ID NO: 2743236 - RNA, 13 nt, Human
agauucucccuug

SEQ ID NO: 2743237 - RNA, 14 nt, Human
agauugugccccug

SEQ ID NO: 2743238 - RNA, 21 nt, Human
agauugugucccauuccccca

SEQ ID NO: 2743239 - RNA, 15 nt, Human
agauuuccauauaaa

SEQ ID NO: 2743240 - RNA, 13 nt, Human
agauuuccccauu

SEQ ID NO: 2743241 - RNA, 13 nt, Human
agauuugcaaagu

SEQ ID NO: 2743242 - RNA, 17 nt, Human
agauuuuucaugauuuu

SEQ ID NO: 2743243 - RNA, 20 nt, Human
agauuuuucaugauuuugaa

SEQ ID NO: 2743244 - RNA, 20 nt, Human
agcaaaaaaguacuuaaaac

SEQ ID NO: 2743245 - RNA, 23 nt, Human
agcaaaaccaaauauuccagaga

SEQ ID NO: 2743246 - RNA, 15 nt, Human
agcaaaauggauaug

SEQ ID NO: 2743247 - RNA, 16 nt, Human
agcaaaauuuuuucuc

SEQ ID NO: 2743248 - RNA, 20 nt, Human
agcaaagacuaugaggaaua

SEQ ID NO: 2743249 - RNA, 12 nt, Human
agcaaagcucuu

SEQ ID NO: 2743250 - RNA, 18 nt, Human
agcaaauaauuuuucacu

SEQ ID NO: 2743251 - RNA, 14 nt, Human
agcaaauauaaaca

SEQ ID NO: 2743252 - RNA, 18 nt, Human
agcaaauauaaacagcaa

SEQ ID NO: 2743253 - RNA, 21 nt, Human
agcaaauauaaacagcaacuu

SEQ ID NO: 2743254 - RNA, 17 nt, Human
agcaaaugugaaucauu

SEQ ID NO: 2743255 - RNA, 21 nt, Human
agcaaaugugaaucauuuuac

SEQ ID NO: 2743256 - RNA, 18 nt, Human
agcaaauguuaugcauaa

SEQ ID NO: 2743257 - RNA, 17 nt, Human
agcaaauuccaauacau

SEQ ID NO: 2743258 - RNA, 18 nt, Human
agcaacaucuagcaaaug

SEQ ID NO: 2743259 - RNA, 23 nt, Human
agcaagacccugaagacccccaa

SEQ ID NO: 2743260 - RNA, 16 nt, Human
agcaagacucugucuc

SEQ ID NO: 2743261 - RNA, 15 nt, Human
agcaagauuucagau

SEQ ID NO: 2743262 - RNA, 23 nt, Human
agcaagcaggaaucagagaccuu

SEQ ID NO: 2743263 - RNA, 15 nt, Human
agcaaggagcuuaga

SEQ ID NO: 2743264 - RNA, 20 nt, Human
agcaagggugaugggaaagc

SEQ ID NO: 2743265 - RNA, 21 nt, Human
agcaaguauuagaauaccaca

SEQ ID NO: 2743266 - RNA, 14 nt, Human
agcaauacccaugu

SEQ ID NO: 2743267 - RNA, 19 nt, Human
agcaauccucccacuucag

SEQ ID NO: 2743268 - RNA, 13 nt, Human
agcaaucugaccc

SEQ ID NO: 2743269 - RNA, 13 nt, Human
agcacagccucuu

SEQ ID NO: 2743270 - RNA, 21 nt, Human
agcacagccucuuagaugcag

SEQ ID NO: 2743271 - RNA, 22 nt, Human
agcacagccucuuagaugcagu

SEQ ID NO: 2743272 - RNA, 15 nt, Human
agcaccaaucaugaa

SEQ ID NO: 2743273 - RNA, 23 nt, Human
agcaccaggacgcccucgagguu

SEQ ID NO: 2743274 - RNA, 16 nt, Human
agcacccucuccagau

SEQ ID NO: 2743275 - RNA, 13 nt, Human
agcaccugcaggc

SEQ ID NO: 2743276 - RNA, 21 nt, Human
agcaccugcaggcgugaccug

SEQ ID NO: 2743277 - RNA, 14 nt, Human
agcaccugggauua

SEQ ID NO: 2743278 - RNA, 17 nt, Human
agcacuaaagcagugga

SEQ ID NO: 2743279 - RNA, 14 nt, Human
agcagaagagaaaa

SEQ ID NO: 2743280 - RNA, 20 nt, Human
agcagagacgggguuugcca

SEQ ID NO: 2743281 - RNA, 22 nt, Human
agcagagacgggguuugccaug

SEQ ID NO: 2743282 - RNA, 13 nt, Human
agcagauuuuaau

SEQ ID NO: 2743283 - RNA, 22 nt, Human
agcagcauaaauguugacaugg

SEQ ID NO: 2743284 - RNA, 19 nt, Human
agcagccagccaacccuuu

SEQ ID NO: 2743285 - RNA, 22 nt, Human
agcagccuggcucucccagcca

SEQ ID NO: 2743286 - RNA, 18 nt, Human
agcagcucaggcacacuu

SEQ ID NO: 2743287 - RNA, 17 nt, Human
agcagcucauaaaugaa

SEQ ID NO: 2743288 - RNA, 19 nt, Human
agcagcuuauucacaagac

SEQ ID NO: 2743289 - RNA, 15 nt, Human
agcagggacuugaac

SEQ ID NO: 2743290 - RNA, 23 nt, Human
agcaggguugguuucccuucuuu

SEQ ID NO: 2743291 - RNA, 15 nt, Human
agcagguaggaggca

SEQ ID NO: 2743292 - RNA, 15 nt, Human
agcaguagcuggagg

SEQ ID NO: 2743293 - RNA, 17 nt, Human
agcagucagaagaccug

SEQ ID NO: 2743294 - RNA, 20 nt, Human
agcagucagaagaccugguc

SEQ ID NO: 2743295 - RNA, 18 nt, Human
agcagugccaaaauauaa

SEQ ID NO: 2743296 - RNA, 23 nt, Human
agcagugcuugaaugaaguugua

SEQ ID NO: 2743297 - RNA, 13 nt, Human
agcaguucagagc

SEQ ID NO: 2743298 - RNA, 15 nt, Human
agcaguucagagcug

SEQ ID NO: 2743299 - RNA, 21 nt, Human
agcaguucagagcugcccucu

SEQ ID NO: 2743300 - RNA, 17 nt, Human
agcaguugaaaagacuc

SEQ ID NO: 2743301 - RNA, 16 nt, Human
agcaguugagacaaga

SEQ ID NO: 2743302 - RNA, 19 nt, Human
agcaguugagacaagaaaa

SEQ ID NO: 2743303 - RNA, 23 nt, Human
agcaguuugguuucuagcaugaa

SEQ ID NO: 2743304 - RNA, 12 nt, Human
agcauaauacuu

SEQ ID NO: 2743305 - RNA, 20 nt, Human
agcaucagugagguuaaacu

SEQ ID NO: 2743306 - RNA, 15 nt, Human
agcaucaucuucugg

SEQ ID NO: 2743307 - RNA, 19 nt, Human
agcaucucaggagauuuca

SEQ ID NO: 2743308 - RNA, 19 nt, Human
agcaucucauuuauaaugu

SEQ ID NO: 2743309 - RNA, 20 nt, Human
agcaucucauuuauaaugua

SEQ ID NO: 2743310 - RNA, 15 nt, Human
agcaucucuggccug

SEQ ID NO: 2743311 - RNA, 17 nt, Human
agcaugauuggugccca

SEQ ID NO: 2743312 - RNA, 17 nt, Human
agcaugcugagauuaca

SEQ ID NO: 2743313 - RNA, 18 nt, Human
agcaugucgucaaagcug

SEQ ID NO: 2743314 - RNA, 22 nt, Human
acuauuaacaacuugucuauua

SEQ ID NO: 2743315 - RNA, 14 nt, Human
acuauuauauuucc

SEQ ID NO: 2743316 - RNA, 19 nt, Human
acuauuauauuuccaagaa

SEQ ID NO: 2743317 - RNA, 21 nt, Human
acuauuauauuuccaagaaau

SEQ ID NO: 2743318 - RNA, 16 nt, Human
acuauucauaagauuu

SEQ ID NO: 2743319 - RNA, 18 nt, Human
acuauugaaguugcagau

SEQ ID NO: 2743320 - RNA, 17 nt, Human
acuauugcuugcacaaa

SEQ ID NO: 2743321 - RNA, 22 nt, Human
acuauugcuugcacaaaccaau

SEQ ID NO: 2743322 - RNA, 21 nt, Human
acuauuuaagagaacaagcaa

SEQ ID NO: 2743323 - RNA, 19 nt, Human
acuauuuaauuauuucacu

SEQ ID NO: 2743324 - RNA, 13 nt, Human
acucaaagaggga

SEQ ID NO: 2743325 - RNA, 21 nt, Human
acucaaaucaagaaacuuaag

SEQ ID NO: 2743326 - RNA, 17 nt, Human
acucaacgagagcacuu

SEQ ID NO: 2743327 - RNA, 16 nt, Human
acucaauaaguuuauu

SEQ ID NO: 2743328 - RNA, 16 nt, Human
acucaaugguuaacua

SEQ ID NO: 2743329 - RNA, 20 nt, Human
acucacauccauucuucccu

SEQ ID NO: 2743330 - RNA, 12 nt, Human
acucacuguggg

SEQ ID NO: 2743331 - RNA, 17 nt, Human
acucagacacaaauaaa

SEQ ID NO: 2743332 - RNA, 14 nt, Human
acucagagaaacaa

SEQ ID NO: 2743333 - RNA, 13 nt, Human
acucagaggcagu

SEQ ID NO: 2743334 - RNA, 17 nt, Human
acucagaggcagugaca

SEQ ID NO: 2743335 - RNA, 23 nt, Human
acucagauccuccucauucacau

SEQ ID NO: 2743336 - RNA, 22 nt, Human
acucaggcccuccuugucuuuu

SEQ ID NO: 2743337 - RNA, 16 nt, Human
acucagggagcauuua

SEQ ID NO: 2743338 - RNA, 15 nt, Human
acucauaauucuuca

SEQ ID NO: 2743339 - RNA, 23 nt, Human
acucauaauucuucaccuuagga

SEQ ID NO: 2743340 - RNA, 20 nt, Human
acucauagacacugaucugg

SEQ ID NO: 2743341 - RNA, 15 nt, Human
acucaucaaucaaau

SEQ ID NO: 2743342 - RNA, 20 nt, Human
acucaucaaucaaauaagua

SEQ ID NO: 2743343 - RNA, 15 nt, Human
acucaucuuucccuc

SEQ ID NO: 2743344 - RNA, 14 nt, Human
acucauuaaaugga

SEQ ID NO: 2743345 - RNA, 21 nt, Human
acucauuaaauggaaguaaau

SEQ ID NO: 2743346 - RNA, 22 nt, Human
acucauuaaauggaaguaaaug

SEQ ID NO: 2743347 - RNA, 16 nt, Human
acucauuaggauggcu

SEQ ID NO: 2743348 - RNA, 18 nt, Human
acucauugcaaccuccac

SEQ ID NO: 2743349 - RNA, 22 nt, Human
acucauuuccuauguaacugca

SEQ ID NO: 2743350 - RNA, 13 nt, Human
acucauuuuaaaa

SEQ ID NO: 2743351 - RNA, 13 nt, Human
acucauuuuuguu

SEQ ID NO: 2743352 - RNA, 15 nt, Human
acuccagccugagcg

SEQ ID NO: 2743353 - RNA, 19 nt, Human
acuccauuaaauauaaagc

SEQ ID NO: 2743354 - RNA, 21 nt, Human
acuccauuaaauauaaagcaa

SEQ ID NO: 2743355 - RNA, 16 nt, Human
acucccucucugcagg

SEQ ID NO: 2743356 - RNA, 12 nt, Human
acucccugcccc

SEQ ID NO: 2743357 - RNA, 23 nt, Human
acucccugccccccagcccuccu

SEQ ID NO: 2743358 - RNA, 14 nt, Human
acucccuuucaaca

SEQ ID NO: 2743359 - RNA, 16 nt, Human
acuccuaggaaaauac

SEQ ID NO: 2743360 - RNA, 16 nt, Human
acuccuaguaauuuaa

SEQ ID NO: 2743361 - RNA, 21 nt, Human
acuccuaguaauuuaagauuu

SEQ ID NO: 2743362 - RNA, 18 nt, Human
acuccugaccucaaguga

SEQ ID NO: 2743363 - RNA, 19 nt, Human
acuccugaccucaagugau

SEQ ID NO: 2743364 - RNA, 17 nt, Human
acuccugcuagaacagu

SEQ ID NO: 2743365 - RNA, 17 nt, Human
acuccuguucaugccca

SEQ ID NO: 2743366 - RNA, 15 nt, Human
acuccuguuucacuu

SEQ ID NO: 2743367 - RNA, 22 nt, Human
acuccuugauuuuagccuucuc

SEQ ID NO: 2743368 - RNA, 19 nt, Human
acucguuaauuuguagugu

SEQ ID NO: 2743369 - RNA, 15 nt, Human
acucuaagaaagaac

SEQ ID NO: 2743370 - RNA, 18 nt, Human
acucuaggacauaaauua

SEQ ID NO: 2743371 - RNA, 23 nt, Human
acucuauguucuaagaagugaaa

SEQ ID NO: 2743372 - RNA, 18 nt, Human
acucucaccauuuggauc

SEQ ID NO: 2743373 - RNA, 19 nt, Human
acucucaccauuuggaucc

SEQ ID NO: 2743374 - RNA, 13 nt, Human
acucucuuaagga

SEQ ID NO: 2743375 - RNA, 19 nt, Human
acucucuuauugccucacu

SEQ ID NO: 2743376 - RNA, 21 nt, Human
acucugaagggcaucaugcau

SEQ ID NO: 2743377 - RNA, 15 nt, Human
acucugagcagugcu

SEQ ID NO: 2743378 - RNA, 15 nt, Human
acucugagucccaga

SEQ ID NO: 2743379 - RNA, 15 nt, Human
acucugcaagaagaa

SEQ ID NO: 2743380 - RNA, 19 nt, Human
acucugcaagaagaaauca

SEQ ID NO: 2743381 - RNA, 17 nt, Human
acucuggucaagaagca

SEQ ID NO: 2743382 - RNA, 20 nt, Human
acucugucuaccuggucugg

SEQ ID NO: 2743383 - RNA, 21 nt, Human
acucugucucaaaaaauaaaa

SEQ ID NO: 2743384 - RNA, 19 nt, Human
acucugucucaguccauga

SEQ ID NO: 2743385 - RNA, 18 nt, Human
acucugugaucuugcucu

SEQ ID NO: 2743386 - RNA, 15 nt, Human
acucuguugccaggc

SEQ ID NO: 2743387 - RNA, 16 nt, Human
acucuguugccaggcu

SEQ ID NO: 2743388 - RNA, 14 nt, Human
acucuuaagaagac

SEQ ID NO: 2743389 - RNA, 18 nt, Human
acucuuaagaagacugca

SEQ ID NO: 2743390 - RNA, 21 nt, Human
acucuuauaucuauauuuuac

SEQ ID NO: 2743391 - RNA, 13 nt, Human
acucuugaaaaau

SEQ ID NO: 2743392 - RNA, 16 nt, Human
acucuugauuguggga

SEQ ID NO: 2743393 - RNA, 18 nt, Human
acucuuguaauaaaaugu

SEQ ID NO: 2743394 - RNA, 15 nt, Human
acucuuuugccauua

SEQ ID NO: 2743395 - RNA, 12 nt, Human
acugaaacaaaa

SEQ ID NO: 2743396 - RNA, 17 nt, Human
acugaacauuccagagc

SEQ ID NO: 2743397 - RNA, 15 nt, Human
acugaagaagcacca

SEQ ID NO: 2743398 - RNA, 14 nt, Human
acugacaaagacau

SEQ ID NO: 2743399 - RNA, 16 nt, Human
acugacaacuugaaua

SEQ ID NO: 2743400 - RNA, 14 nt, Human
acugagaaauuuau

SEQ ID NO: 2743401 - RNA, 20 nt, Human
acugagauccuuccuuuuga

SEQ ID NO: 2743402 - RNA, 18 nt, Human
acugagcuucucugugaa

SEQ ID NO: 2743403 - RNA, 15 nt, Human
acugaggaucagagu

SEQ ID NO: 2743404 - RNA, 16 nt, Human
acugaggaucagagua

SEQ ID NO: 2743405 - RNA, 11 nt, Human
acugaggcaga

SEQ ID NO: 2743406 - RNA, 19 nt, Human
acugaggcagacagcagcu

SEQ ID NO: 2743407 - RNA, 17 nt, Human
acugauacccuuugaaa

SEQ ID NO: 2743408 - RNA, 16 nt, Human
acugauggguuucucc

SEQ ID NO: 2743409 - RNA, 18 nt, Human
acugauggguuucuccag

SEQ ID NO: 2743410 - RNA, 16 nt, Human
acugauguaaguaaac

SEQ ID NO: 2743411 - RNA, 20 nt, Human
acugauguuguguuuuuaac

SEQ ID NO: 2743412 - RNA, 15 nt, Human
acugauuacugccua

SEQ ID NO: 2743413 - RNA, 21 nt, Human
acugauuuaucuauuuaaaua

SEQ ID NO: 2743414 - RNA, 16 nt, Human
acugcaaccucugccu

SEQ ID NO: 2743415 - RNA, 15 nt, Human
acugcacaucaaaau

SEQ ID NO: 2743416 - RNA, 21 nt, Human
acugcacgaauggaagaggca

SEQ ID NO: 2743417 - RNA, 12 nt, Human
acugcagaagac

SEQ ID NO: 2743418 - RNA, 15 nt, Human
acugcagaagacagu

SEQ ID NO: 2743419 - RNA, 16 nt, Human
acugcauacaaucuga

SEQ ID NO: 2743420 - RNA, 16 nt, Human
acugcaugcacuucuu

SEQ ID NO: 2743421 - RNA, 21 nt, Human
acugccaaaacaucaaccugc

SEQ ID NO: 2743422 - RNA, 14 nt, Human
acugccaucauuua

SEQ ID NO: 2743423 - RNA, 19 nt, Human
acugccaucauuuacuuuu

SEQ ID NO: 2743424 - RNA, 17 nt, Human
acugccgguuugaaaau

SEQ ID NO: 2743425 - RNA, 18 nt, Human
acugccgguuugaaaaua

SEQ ID NO: 2743426 - RNA, 17 nt, Human
acaucgcagacacaugu

SEQ ID NO: 2743427 - RNA, 22 nt, Human
acaucuagugagcagucaggaa

SEQ ID NO: 2743428 - RNA, 20 nt, Human
acaucucugauacuuuuuuc

SEQ ID NO: 2743429 - RNA, 17 nt, Human
acaucugagaaaagcuu

SEQ ID NO: 2743430 - RNA, 14 nt, Human
acaucugcagcucu

SEQ ID NO: 2743431 - RNA, 18 nt, Human
acaucuggaaaguuuucu

SEQ ID NO: 2743432 - RNA, 20 nt, Human
acaucuggaaaguuuucucc

SEQ ID NO: 2743433 - RNA, 14 nt, Human
acaucuuucacauu

SEQ ID NO: 2743434 - RNA, 17 nt, Human
acaugaaagcguaaaga

SEQ ID NO: 2743435 - RNA, 18 nt, Human
acaugaaguccaagcauu

SEQ ID NO: 2743436 - RNA, 20 nt, Human
acaugaaguccaagcauuua

SEQ ID NO: 2743437 - RNA, 14 nt, Human
acaugaauauuuag

SEQ ID NO: 2743438 - RNA, 15 nt, Human
acaugagagacagca

SEQ ID NO: 2743439 - RNA, 12 nt, Human
acaugagguacu

SEQ ID NO: 2743440 - RNA, 14 nt, Human
acaugauccugcaa

SEQ ID NO: 2743441 - RNA, 14 nt, Human
acaugauucauuuu

SEQ ID NO: 2743442 - RNA, 18 nt, Human
acaugauuuggggaaagg

SEQ ID NO: 2743443 - RNA, 12 nt, Human
aaaauuaauucu

SEQ ID NO: 2743444 - RNA, 17 nt, Human
aaaauuagaaauguaau

SEQ ID NO: 2743445 - RNA, 14 nt, Human
aaaauuggacuuaa

SEQ ID NO: 2743446 - RNA, 17 nt, Human
aaaauuggacuuaaaau

SEQ ID NO: 2743447 - RNA, 14 nt, Human
aaaauuuaaaacau

SEQ ID NO: 2743448 - RNA, 14 nt, Human
aaaauuuuuucucu

SEQ ID NO: 2743449 - RNA, 21 nt, Human
aaaauuuuuucucuaggaaau

SEQ ID NO: 2743450 - RNA, 19 nt, Human
aaaauuuuuuuagaaagca

SEQ ID NO: 2743451 - RNA, 16 nt, Human
aaacaaaaaaaaaacc

SEQ ID NO: 2743452 - RNA, 12 nt, Human
aaacaaaaaaag

SEQ ID NO: 2743453 - RNA, 19 nt, Human
aaacaaaaggauaaugaau

SEQ ID NO: 2743454 - RNA, 16 nt, Human
aaacaaacgaaaaaca

SEQ ID NO: 2743455 - RNA, 13 nt, Human
aaacaaagaaauu

SEQ ID NO: 2743456 - RNA, 15 nt, Human
aaacaaagaaauuau

SEQ ID NO: 2743457 - RNA, 17 nt, Human
aaacaauaacgauaaaa

SEQ ID NO: 2743458 - RNA, 19 nt, Human
aaacaauaacgauaaaaga

SEQ ID NO: 2743459 - RNA, 21 nt, Human
aaacaauaacgauaaaagaca

SEQ ID NO: 2743460 - RNA, 15 nt, Human
aaacaauuugaauau

SEQ ID NO: 2743461 - RNA, 12 nt, Human
aaacacaacuau

SEQ ID NO: 2743462 - RNA, 11 nt, Human
aaacacauguu

SEQ ID NO: 2743463 - RNA, 19 nt, Human
aaacaccucagcugccucc

SEQ ID NO: 2743464 - RNA, 22 nt, Human
aaacaccucagcugccucccca

SEQ ID NO: 2743465 - RNA, 14 nt, Human
aaacacucuugaaa

SEQ ID NO: 2743466 - RNA, 23 nt, Human
aaacacucuugaaaaaugcaugu

SEQ ID NO: 2743467 - RNA, 20 nt, Human
aaacacugggagaaaugaaa

SEQ ID NO: 2743468 - RNA, 22 nt, Human
aaacacugggagaaaugaaaaa

SEQ ID NO: 2743469 - RNA, 20 nt, Human
aaacagaacuauggaaaaaa

SEQ ID NO: 2743470 - RNA, 22 nt, Human
aaacagaacuauggaaaaaaag

SEQ ID NO: 2743471 - RNA, 20 nt, Human
aaacagcuucucaauuucua

SEQ ID NO: 2743472 - RNA, 22 nt, Human
aaacaggaugguggcaggaaaa

SEQ ID NO: 2743473 - RNA, 23 nt, Human
aaacaggaugguggcaggaaaau

SEQ ID NO: 2743474 - RNA, 22 nt, Human
aaacagggcugccuucuggccu

SEQ ID NO: 2743475 - RNA, 15 nt, Human
aaacauaugaauuau

SEQ ID NO: 2743476 - RNA, 16 nt, Human
aaacaucagcaaaaaa

SEQ ID NO: 2743477 - RNA, 17 nt, Human
aaacaucagcaaaaaag

SEQ ID NO: 2743478 - RNA, 15 nt, Human
aaacauccagauaca

SEQ ID NO: 2743479 - RNA, 13 nt, Human
aaacauccuacaa

SEQ ID NO: 2743480 - RNA, 17 nt, Human
aaacaugcacuuccuug

SEQ ID NO: 2743481 - RNA, 16 nt, Human
aaacauuacucugaaa

SEQ ID NO: 2743482 - RNA, 14 nt, Human
aaacauuuguucua

SEQ ID NO: 2743483 - RNA, 17 nt, Human
aaaccaggacccugucc

SEQ ID NO: 2743484 - RNA, 22 nt, Human
aaaccaggacccuguccaaucu

SEQ ID NO: 2743485 - RNA, 23 nt, Human
aaacccauucccucuccaggaga

SEQ ID NO: 2743486 - RNA, 22 nt, Human
aaacccugucucuacuaaaaau

SEQ ID NO: 2743487 - RNA, 23 nt, Human
aaacccugucucuacuaaaaaua

SEQ ID NO: 2743488 - RNA, 14 nt, Human
aaauaaauaaaaac

SEQ ID NO: 2743489 - RNA, 18 nt, Human
aaauaaaucuaucaaaau

SEQ ID NO: 2743490 - RNA, 14 nt, Human
aaauaaauuauuau

SEQ ID NO: 2743491 - RNA, 20 nt, Human
aaauaaauuauuauuuaaac

SEQ ID NO: 2743492 - RNA, 12 nt, Human
aaauaacaauaa

SEQ ID NO: 2743493 - RNA, 14 nt, Human
aaauaacaauaaaa

SEQ ID NO: 2743494 - RNA, 17 nt, Human
aaauaacaauaaaagac

SEQ ID NO: 2743495 - RNA, 13 nt, Human
aaauaacaaugaa

SEQ ID NO: 2743496 - RNA, 18 nt, Human
aaauaacaaugaaaguug

SEQ ID NO: 2743497 - RNA, 22 nt, Human
aaauaacaaugaaaguugauaa

SEQ ID NO: 2743498 - RNA, 18 nt, Human
aaauaacuuuuuuuuaag

SEQ ID NO: 2743499 - RNA, 21 nt, Human
aaauaagaaccacucauaauu

SEQ ID NO: 2743500 - RNA, 12 nt, Human
aaauaagcaggc

SEQ ID NO: 2743501 - RNA, 14 nt, Human
aaauaaguauuuau

SEQ ID NO: 2743502 - RNA, 16 nt, Human
aaauaaguauuuauaa

SEQ ID NO: 2743503 - RNA, 16 nt, Human
aaauaaugaaauaacu

SEQ ID NO: 2743504 - RNA, 13 nt, Human
aaauaauuuuuau

SEQ ID NO: 2743505 - RNA, 21 nt, Human
aaauaauuuuuauauuugaaa

SEQ ID NO: 2743506 - RNA, 14 nt, Human
aaauacauacuaua

SEQ ID NO: 2743507 - RNA, 23 nt, Human
aaauacugauguuccuagugaaa

SEQ ID NO: 2743508 - RNA, 20 nt, Human
aaauacuucuugaagccgag

SEQ ID NO: 2743509 - RNA, 18 nt, Human
aaauagagaaauaugauu

SEQ ID NO: 2743510 - RNA, 14 nt, Human
aaauaggaaauauu

SEQ ID NO: 2743511 - RNA, 21 nt, Human
aaauagugauuuccacaguga

SEQ ID NO: 2743512 - RNA, 16 nt, Human
aaauaguuuaugauuc

SEQ ID NO: 2743513 - RNA, 13 nt, Human
aaauauaaacagc

SEQ ID NO: 2743514 - RNA, 12 nt, Human
aaauauaaagca

SEQ ID NO: 2743515 - RNA, 12 nt, Human
aaauauaaauaa

SEQ ID NO: 2743516 - RNA, 14 nt, Human
aaauauaaauaaaa

SEQ ID NO: 2743517 - RNA, 15 nt, Human
aaauauaaauaaaaa

SEQ ID NO: 2743518 - RNA, 15 nt, Human
aaauauaaucagaga

SEQ ID NO: 2743519 - RNA, 13 nt, Human
aaauauaucugcu

SEQ ID NO: 2743520 - RNA, 11 nt, Human
aaauauauuua

SEQ ID NO: 2743521 - RNA, 22 nt, Human
aaauauauuuaagauaauuaua

SEQ ID NO: 2743522 - RNA, 18 nt, Human
aaauaucuugaaaggggu

SEQ ID NO: 2743523 - RNA, 15 nt, Human
aaauaugauguuaug

SEQ ID NO: 2743524 - RNA, 13 nt, Human
aaauaugauuugu

SEQ ID NO: 2743525 - RNA, 13 nt, Human
aaauaugcaaagc

SEQ ID NO: 2743526 - RNA, 16 nt, Human
aaauaugcaaagcacu

SEQ ID NO: 2743527 - RNA, 19 nt, Human
aaauauggggaaaaaacug

SEQ ID NO: 2743528 - RNA, 20 nt, Human
aaauauggggaaaaaacugu

SEQ ID NO: 2743529 - RNA, 16 nt, Human
aaauaugucuuucuuu

SEQ ID NO: 2743530 - RNA, 18 nt, Human
aaauauguucugacauaa

SEQ ID NO: 2743531 - RNA, 16 nt, Human
aaauauuauguuaaaa

SEQ ID NO: 2743532 - RNA, 14 nt, Human
aaauauuauuuuau

SEQ ID NO: 2743533 - RNA, 15 nt, Human
aaauauuuauuuuaa

SEQ ID NO: 2743534 - RNA, 16 nt, Human
aaauauuuauuuuaau

SEQ ID NO: 2743535 - RNA, 18 nt, Human
aaauauuuauuuuaauaa

SEQ ID NO: 2743536 - RNA, 21 nt, Human
aaauauuuauuuuaauaaugu

SEQ ID NO: 2743537 - RNA, 20 nt, Human
aaauauuuucuuuguuaaaa

SEQ ID NO: 2743538 - RNA, 22 nt, Human
aaauauuuucuuuguuaaaaua

SEQ ID NO: 2743539 - RNA, 13 nt, Human
aaauauuuugcua

SEQ ID NO: 2743540 - RNA, 14 nt, Human
aaauauuuugcuaa

SEQ ID NO: 2743541 - RNA, 12 nt, Human
aaauauuuuuau

SEQ ID NO: 2743542 - RNA, 15 nt, Human
aaaucaaacuuuaca

SEQ ID NO: 2743543 - RNA, 21 nt, Human
aaaucaaauaugcaaagcacu

SEQ ID NO: 2743544 - RNA, 13 nt, Human
aaaucacucaaau

SEQ ID NO: 2743545 - RNA, 12 nt, Human
aaaucaugaaga

SEQ ID NO: 2743546 - RNA, 13 nt, Human
aaaucaugaagau

SEQ ID NO: 2743547 - RNA, 15 nt, Human
aaaucaugaagauau

SEQ ID NO: 2743548 - RNA, 18 nt, Human
aaaucaugaagauauuuu

SEQ ID NO: 2743549 - RNA, 22 nt, Human
aaaucaugaagauauuuuucca

SEQ ID NO: 2743550 - RNA, 16 nt, Human
aaauccaaugaaauga

SEQ ID NO: 2743551 - RNA, 15 nt, Human
aaauccacuuuaucu

SEQ ID NO: 2743552 - RNA, 13 nt, Human
aaauccuugaaga

SEQ ID NO: 2743553 - RNA, 20 nt, Human
aaauccuugaagauuuacca

SEQ ID NO: 2743554 - RNA, 22 nt, Human
aaauccuuuacuguuagucauu

SEQ ID NO: 2743555 - RNA, 16 nt, Human
aaaucuaaaaaacgaa

SEQ ID NO: 2743556 - RNA, 15 nt, Human
aaaucuaaaucuauu

SEQ ID NO: 2743557 - RNA, 18 nt, Human
aaaucuaaaucuauuuau

SEQ ID NO: 2743558 - RNA, 17 nt, Human
aaaucuaguaauuugua

SEQ ID NO: 2743559 - RNA, 19 nt, Human
aaaucuaucaaaauuaccc

SEQ ID NO: 2743560 - RNA, 23 nt, Human
aaaucuauuuauuaauauuuaac

SEQ ID NO: 2743561 - RNA, 14 nt, Human
aaaucuauuuugua

SEQ ID NO: 2743562 - RNA, 22 nt, Human
aaaucucaaacuucuauuuuua

SEQ ID NO: 2743563 - RNA, 23 nt, Human
aaaucucaaacuucuauuuuuau

SEQ ID NO: 2743564 - RNA, 20 nt, Human
aaaucucuauuaggaaauau

SEQ ID NO: 2743565 - RNA, 23 nt, Human
aaaucucuauuaggaaauauucu

SEQ ID NO: 2743566 - RNA, 12 nt, Human
aaaugaaaaaau

SEQ ID NO: 2743567 - RNA, 13 nt, Human
aaaugaaagcagg

SEQ ID NO: 2743568 - RNA, 17 nt, Human
aaaugaaguggugagcu

SEQ ID NO: 2743569 - RNA, 20 nt, Human
aaaugaaguggugagcuuaa

SEQ ID NO: 2743570 - RNA, 22 nt, Human
aaaugaaucccucuaucucuaa

SEQ ID NO: 2743571 - RNA, 13 nt, Human
aaaugagaaaucu

SEQ ID NO: 2743572 - RNA, 15 nt, Human
aaaugauguuucaua

SEQ ID NO: 2743573 - RNA, 20 nt, Human
aaaugauguuucauaagaau

SEQ ID NO: 2743574 - RNA, 22 nt, Human
aaaugauguuucauaagaauuc

SEQ ID NO: 2743575 - RNA, 20 nt, Human
aaaugauuuucaaauuugau

SEQ ID NO: 2743576 - RNA, 22 nt, Human
aaaugcauuucuaaagccauug

SEQ ID NO: 2743577 - RNA, 16 nt, Human
aaaugccaggccuggc

SEQ ID NO: 2743578 - RNA, 15 nt, Human
aaaugccuuuguacu

SEQ ID NO: 2743579 - RNA, 17 nt, Human
aaaugcugguuuuucag

SEQ ID NO: 2743580 - RNA, 17 nt, Human
aaaugcuguauucuucu

SEQ ID NO: 2743581 - RNA, 19 nt, Human
aaauggaacauaaaauaca

SEQ ID NO: 2743582 - RNA, 18 nt, Human
aaauggaaguaaauguug

SEQ ID NO: 2743583 - RNA, 18 nt, Human
aaauggaauacucuuaua

SEQ ID NO: 2743584 - RNA, 22 nt, Human
aaauggacacagucuaacaaau

SEQ ID NO: 2743585 - RNA, 16 nt, Human
aaauggacaucaaaau

SEQ ID NO: 2743586 - RNA, 18 nt, Human
aaauggagaaaggacccu

SEQ ID NO: 2743587 - RNA, 19 nt, Human
aaauggagacaccaccacc

SEQ ID NO: 2743588 - RNA, 19 nt, Human
aaauggagugacuuagugu

SEQ ID NO: 2743589 - RNA, 14 nt, Human
aaaugggaaacaaa

SEQ ID NO: 2743590 - RNA, 16 nt, Human
aaaugggaaacaaaag

SEQ ID NO: 2743591 - RNA, 14 nt, Human
aaauggugugacca

SEQ ID NO: 2743592 - RNA, 14 nt, Human
aaauguaaaauagu

SEQ ID NO: 2743593 - RNA, 14 nt, Human
aaauguaagggaaa

SEQ ID NO: 2743594 - RNA, 16 nt, Human
aaauguaauuauguuc

SEQ ID NO: 2743595 - RNA, 15 nt, Human
aaauguauucuuuua

SEQ ID NO: 2743596 - RNA, 16 nt, Human
aaaugucuugcuugau

SEQ ID NO: 2743597 - RNA, 16 nt, Human
aaaugugcuuuuaaaa

SEQ ID NO: 2743598 - RNA, 17 nt, Human
aaaugugcuuuuaaaaa

SEQ ID NO: 2743599 - RNA, 21 nt, Human
aagauauuuuucaugauuuug

SEQ ID NO: 2743600 - RNA, 22 nt, Human
aagauauuuuucaugauuuuga

SEQ ID NO: 2743601 - RNA, 13 nt, Human
aagaucagccugg

SEQ ID NO: 2743602 - RNA, 21 nt, Human
aagaucugcaacuacuaucca

SEQ ID NO: 2743603 - RNA, 16 nt, Human
aagaugaaaauauuug

SEQ ID NO: 2743604 - RNA, 16 nt, Human
aagaugaaugagcaaa

SEQ ID NO: 2743605 - RNA, 21 nt, Human
aagauggggucuguaaaaucu

SEQ ID NO: 2743606 - RNA, 19 nt, Human
aagauuaugaucucagaaa

SEQ ID NO: 2743607 - RNA, 21 nt, Human
aagauuaugaucucagaaauu

SEQ ID NO: 2743608 - RNA, 13 nt, Human
aagauugagagaa

SEQ ID NO: 2743609 - RNA, 12 nt, Human
aagauuuccuuc

SEQ ID NO: 2743610 - RNA, 16 nt, Human
aagauuuccuucuuuu

SEQ ID NO: 2743611 - RNA, 15 nt, Human
aagauuucuugaguu

SEQ ID NO: 2743612 - RNA, 13 nt, Human
aagauuuguaaua

SEQ ID NO: 2743613 - RNA, 21 nt, Human
aagauuuuguuguuguuuguu

SEQ ID NO: 2743614 - RNA, 16 nt, Human
aagcaaagcucuuuac

SEQ ID NO: 2743615 - RNA, 14 nt, Human
aagcaacccaaaug

SEQ ID NO: 2743616 - RNA, 16 nt, Human
aagcaacccaaauguu

SEQ ID NO: 2743617 - RNA, 22 nt, Human
aagcaacccaaauguucaucaa

SEQ ID NO: 2743618 - RNA, 15 nt, Human
aagcaagauaauaaa

SEQ ID NO: 2743619 - RNA, 16 nt, Human
aagcaagauuucagau

SEQ ID NO: 2743620 - RNA, 17 nt, Human
aagcacagugaucaagu

SEQ ID NO: 2743621 - RNA, 14 nt, Human
aagcaccaggacgc

SEQ ID NO: 2743622 - RNA, 23 nt, Human
aagcaccuuuagaauauuaaaaa

SEQ ID NO: 2743623 - RNA, 17 nt, Human
aagcacugacuucuaag

SEQ ID NO: 2743624 - RNA, 21 nt, Human
aagcacugacuucuaaguaaa

SEQ ID NO: 2743625 - RNA, 22 nt, Human
aagcacuuuaacacagugucug

SEQ ID NO: 2743626 - RNA, 19 nt, Human
aagcagggacuugaaccca

SEQ ID NO: 2743627 - RNA, 22 nt, Human
aagcagggacuugaacccauau

SEQ ID NO: 2743628 - RNA, 20 nt, Human
aagcaggguugguuucccuu

SEQ ID NO: 2743629 - RNA, 21 nt, Human
aagcaguugagacaagaaaau

SEQ ID NO: 2743630 - RNA, 20 nt, Human
aagcauaccaacacgagcag

SEQ ID NO: 2743631 - RNA, 22 nt, Human
aagcauaccaacacgagcaggc

SEQ ID NO: 2743632 - RNA, 20 nt, Human
aagcaucauuauuugcagag

SEQ ID NO: 2743633 - RNA, 13 nt, Human
aagcauuguaaau

SEQ ID NO: 2743634 - RNA, 13 nt, Human
aagcauuuagaug

SEQ ID NO: 2743635 - RNA, 16 nt, Human
aagcauuuagauguau

SEQ ID NO: 2743636 - RNA, 11 nt, Human
aagccaaaaac

SEQ ID NO: 2743637 - RNA, 20 nt, Human
aagccagacaucaacagaua

SEQ ID NO: 2743638 - RNA, 19 nt, Human
aagccagaucuaugccaca

SEQ ID NO: 2743639 - RNA, 15 nt, Human
aagccagauuuuccu

SEQ ID NO: 2743640 - RNA, 17 nt, Human
aagccagauuuuccuga

SEQ ID NO: 2743641 - RNA, 18 nt, Human
aagccagauuuuccugaa

SEQ ID NO: 2743642 - RNA, 14 nt, Human
aagccauggguagc

SEQ ID NO: 2743643 - RNA, 22 nt, Human
aagcccaaagugguauagaaau

SEQ ID NO: 2743644 - RNA, 17 nt, Human
aagcccaauauuauaau

SEQ ID NO: 2743645 - RNA, 18 nt, Human
aagcccagcuugaaaccu

SEQ ID NO: 2743646 - RNA, 18 nt, Human
aagcccaucauaauauaa

SEQ ID NO: 2743647 - RNA, 22 nt, Human
aagccuaagggauccugccugc

SEQ ID NO: 2743648 - RNA, 16 nt, Human
aagccucauguccacu

SEQ ID NO: 2743649 - RNA, 15 nt, Human
aagccuccuuuuaaa

SEQ ID NO: 2743650 - RNA, 15 nt, Human
aagccuggcaaggga

SEQ ID NO: 2743651 - RNA, 17 nt, Human
aagccuggcaagggaau

SEQ ID NO: 2743652 - RNA, 23 nt, Human
aagcgauucuccugccucagccu

SEQ ID NO: 2743653 - RNA, 19 nt, Human
aagcgauucucuuuauuca

SEQ ID NO: 2743654 - RNA, 23 nt, Human
aagcuaucguaaaauuaagaaag

SEQ ID NO: 2743655 - RNA, 16 nt, Human
aagcucaacucucuua

SEQ ID NO: 2743656 - RNA, 21 nt, Human
aagcuccauuuuuagugaaau

SEQ ID NO: 2743657 - RNA, 14 nt, Human
aagcucuaucacca

SEQ ID NO: 2743658 - RNA, 20 nt, Human
aagcucuaucaccaaggagc

SEQ ID NO: 2743659 - RNA, 22 nt, Human
aagcucuccaaaggcucagauu

SEQ ID NO: 2743660 - RNA, 19 nt, Human
aagcucugaagaacucucu

SEQ ID NO: 2743661 - RNA, 12 nt, Human
aagcugaaaugg

SEQ ID NO: 2743662 - RNA, 14 nt, Human
aagcugaguguuuc

SEQ ID NO: 2743663 - RNA, 15 nt, Human
aagcugaguguuuca

SEQ ID NO: 2743664 - RNA, 17 nt, Human
aagcuggagugcagugg

SEQ ID NO: 2743665 - RNA, 13 nt, Human
aagcuguggccag

SEQ ID NO: 2743666 - RNA, 17 nt, Human
aagcuguguggcagucu

SEQ ID NO: 2743667 - RNA, 18 nt, Human
aagcuguguggcagucug

SEQ ID NO: 2743668 - RNA, 14 nt, Human
aagcuuauuaaaac

SEQ ID NO: 2743669 - RNA, 20 nt, Human
aagcuucacuguaaaauaau

SEQ ID NO: 2743670 - RNA, 19 nt, Human
aagcuuguauuccuuuuuc

SEQ ID NO: 2743671 - RNA, 19 nt, Human
aaggaaauaagaaccacuc

SEQ ID NO: 2743672 - RNA, 17 nt, Human
aaggaaaucugugucag

SEQ ID NO: 2743673 - RNA, 13 nt, Human
aaggaaggaaaga

SEQ ID NO: 2743674 - RNA, 16 nt, Human
aaggagacaaaacuag

SEQ ID NO: 2743675 - RNA, 16 nt, Human
aaggagaggcaaagaa

SEQ ID NO: 2743676 - RNA, 20 nt, Human
aaggagccaaacauccuaca

SEQ ID NO: 2743677 - RNA, 23 nt, Human
aaggaggauggcauauaauacaa

SEQ ID NO: 2743678 - RNA, 17 nt, Human
aaggaggcugagagccc

SEQ ID NO: 2743679 - RNA, 23 nt, Human
aaggaggcugagagcccaaacug

SEQ ID NO: 2743680 - RNA, 18 nt, Human
aaggaguccuugcaucaa

SEQ ID NO: 2743681 - RNA, 17 nt, Human
aaggauaaaguugguaa

SEQ ID NO: 2743682 - RNA, 18 nt, Human
aaggauaaaguugguaaa

SEQ ID NO: 2743683 - RNA, 15 nt, Human
aaggauagggugaug

SEQ ID NO: 2743684 - RNA, 15 nt, Human
aaggaugauaaaagc

SEQ ID NO: 2743685 - RNA, 18 nt, Human
aaggauuuauguuuaauu

SEQ ID NO: 2743686 - RNA, 22 nt, Human
aaggauuuauguuuaauucuga

SEQ ID NO: 2743687 - RNA, 13 nt, Human
aaggcaggaggau

SEQ ID NO: 2743688 - RNA, 21 nt, Human
aaggcaggaggaucacuugag

SEQ ID NO: 2743689 - RNA, 21 nt, Human
aaggcauuucuuuucugcaug

SEQ ID NO: 2743690 - RNA, 17 nt, Human
aaggccaagaggcuguu

SEQ ID NO: 2743691 - RNA, 15 nt, Human
aaggccaugauuuua

SEQ ID NO: 2743692 - RNA, 18 nt, Human
aaggcccccgggccgacg

SEQ ID NO: 2743693 - RNA, 21 nt, Human
aaggcuaugauugucuuuguu

SEQ ID NO: 2743694 - RNA, 16 nt, Human
aaggcugauuaaacca

SEQ ID NO: 2743695 - RNA, 11 nt, Human
aaggcuggagu

SEQ ID NO: 2743696 - RNA, 14 nt, Human
aaggcuguucuuua

SEQ ID NO: 2743697 - RNA, 19 nt, Human
aaggcuuagacccucaugc

SEQ ID NO: 2743698 - RNA, 16 nt, Human
aaggcuuugcccugcu

SEQ ID NO: 2743699 - RNA, 14 nt, Human
aagggaagagacag

SEQ ID NO: 2743700 - RNA, 13 nt, Human
aagggagauucag

SEQ ID NO: 2743701 - RNA, 20 nt, Human
aagggauuuucagcccucag

SEQ ID NO: 2743702 - RNA, 23 nt, Human
aagggauuuucagcccucagaau

SEQ ID NO: 2743703 - RNA, 15 nt, Human
aagggccagaaauau

SEQ ID NO: 2743704 - RNA, 20 nt, Human
aagggcuguuauaaucuuuc

SEQ ID NO: 2743705 - RNA, 15 nt, Human
aaggggcggcggccc

SEQ ID NO: 2743706 - RNA, 15 nt, Human
aaggguacacugccu

SEQ ID NO: 2743707 - RNA, 14 nt, Human
aagggucucccucu

SEQ ID NO: 2743708 - RNA, 16 nt, Human
aaggguggguggggug

SEQ ID NO: 2743709 - RNA, 15 nt, Human
aagguaaaucagacu

SEQ ID NO: 2743710 - RNA, 19 nt, Human
aagguaaaucagacuauga

SEQ ID NO: 2743711 - RNA, 14 nt, Human
aagguacuucaaau

SEQ ID NO: 2743712 - RNA, 17 nt, Human
aagguacuucaaauccu

SEQ ID NO: 2743713 - RNA, 21 nt, Human
aagguacuucaaauccuugaa

SEQ ID NO: 2743714 - RNA, 17 nt, Human
aaggucuaggugcuuua

SEQ ID NO: 2743715 - RNA, 15 nt, Human
aagguggaaauaaac

SEQ ID NO: 2743716 - RNA, 13 nt, Human
aaguaaaaacaaa

SEQ ID NO: 2743717 - RNA, 14 nt, Human
aaguaaaaacaaag

SEQ ID NO: 2743718 - RNA, 16 nt, Human
aaguaaaaccacagca

SEQ ID NO: 2743719 - RNA, 17 nt, Human
aaguaaaaccacagcag

SEQ ID NO: 2743720 - RNA, 20 nt, Human
aaguaaacggucucucacuu

SEQ ID NO: 2743721 - RNA, 16 nt, Human
aaguaaaugugauuua

SEQ ID NO: 2743722 - RNA, 18 nt, Human
aaguaaggaauuuuauuu

SEQ ID NO: 2743723 - RNA, 14 nt, Human
aaguaaugauaacu

SEQ ID NO: 2743724 - RNA, 14 nt, Human
aaguaauuucagaa

SEQ ID NO: 2743725 - RNA, 23 nt, Human
aaguacuuaaaacuguaaauuua

SEQ ID NO: 2743726 - RNA, 14 nt, Human
aaguagaauaaaca

SEQ ID NO: 2743727 - RNA, 15 nt, Human
aaguauauauagaau

SEQ ID NO: 2743728 - RNA, 17 nt, Human
aaguauauucaaaaauu

SEQ ID NO: 2743729 - RNA, 17 nt, Human
aaguauccuucagccug

SEQ ID NO: 2743730 - RNA, 17 nt, Human
aaguaugcacuaaucaa

SEQ ID NO: 2743731 - RNA, 15 nt, Human
aagucaagauuucca

SEQ ID NO: 2743732 - RNA, 15 nt, Human
aagucaauguuuuca

SEQ ID NO: 2743733 - RNA, 19 nt, Human
aagucacauuccugaacag

SEQ ID NO: 2743734 - RNA, 20 nt, Human
aagucacauuccugaacagg

SEQ ID NO: 2743735 - RNA, 14 nt, Human
aagucagucauuca

SEQ ID NO: 2743736 - RNA, 15 nt, Human
aagucauuauuagga

SEQ ID NO: 2743737 - RNA, 20 nt, Human
aaguccaagcauuuagaugu

SEQ ID NO: 2743738 - RNA, 15 nt, Human
aaguccagccuggca

SEQ ID NO: 2743739 - RNA, 23 nt, Human
aagucccagaucaagccugccuc

SEQ ID NO: 2743740 - RNA, 22 nt, Human
aagucccugcugcccuuccccu

SEQ ID NO: 2743741 - RNA, 19 nt, Human
aaguccuacaagcuaaaau

SEQ ID NO: 2743742 - RNA, 15 nt, Human
aaguccugcaagcag

SEQ ID NO: 2743743 - RNA, 13 nt, Human
aaguccuucccuu

SEQ ID NO: 2743744 - RNA, 15 nt, Human
aagucugauuuuccu

SEQ ID NO: 2743745 - RNA, 18 nt, Human
aagucugauuuuccugga

SEQ ID NO: 2743746 - RNA, 15 nt, Human
aagucuuauuuauuc

SEQ ID NO: 2743747 - RNA, 18 nt, Human
aagucuuucacauuuaaa

SEQ ID NO: 2743748 - RNA, 15 nt, Human
aagugaaaaucuaca

SEQ ID NO: 2743749 - RNA, 12 nt, Human
aacgcaaauucg

SEQ ID NO: 2743750 - RNA, 15 nt, Human
aacggggugaaaccc

SEQ ID NO: 2743751 - RNA, 13 nt, Human
aacgucacaucuu

SEQ ID NO: 2743752 - RNA, 14 nt, Human
aacgucuuaaauau

SEQ ID NO: 2743753 - RNA, 22 nt, Human
aacguggcuuuuuuuuuuuccc

SEQ ID NO: 2743754 - RNA, 23 nt, Human
aacguggcuuuuuuuuuuucccu

SEQ ID NO: 2743755 - RNA, 13 nt, Human
aacuaaaaauuaa

SEQ ID NO: 2743756 - RNA, 22 nt, Human
aacuaaauaaagcuugcaacaa

SEQ ID NO: 2743757 - RNA, 21 nt, Human
aacuaacaaccaaagacuaca

SEQ ID NO: 2743758 - RNA, 13 nt, Human
aacuaauagaauu

SEQ ID NO: 2743759 - RNA, 20 nt, Human
aacuaauagaauuaauggaa

SEQ ID NO: 2743760 - RNA, 15 nt, Human
aacuacuagaaaauu

SEQ ID NO: 2743761 - RNA, 18 nt, Human
aacuacugaggaucagag

SEQ ID NO: 2743762 - RNA, 22 nt, Human
aacuacugaggaucagaguaau

SEQ ID NO: 2743763 - RNA, 18 nt, Human
aacuagaauuuauucaau

SEQ ID NO: 2743764 - RNA, 19 nt, Human
aacuagaauuuauucaauu

SEQ ID NO: 2743765 - RNA, 20 nt, Human
aacuagcauaucugccuuua

SEQ ID NO: 2743766 - RNA, 22 nt, Human
aacuaggguggugcauuuuugu

SEQ ID NO: 2743767 - RNA, 23 nt, Human
aacuaggguggugcauuuuugua

SEQ ID NO: 2743768 - RNA, 15 nt, Human
aacuagguaaaaucu

SEQ ID NO: 2743769 - RNA, 24 nt, Human
aacuauaaaacuaggugcugcagc

SEQ ID NO: 2743770 - RNA, 17 nt, Human
aacuaucucauuuccaa

SEQ ID NO: 2743771 - RNA, 15 nt, Human
aacuauggaaaaaaa

SEQ ID NO: 2743772 - RNA, 18 nt, Human
aacucagacacaaauaaa

SEQ ID NO: 2743773 - RNA, 14 nt, Human
aacucauauuuuca

SEQ ID NO: 2743774 - RNA, 13 nt, Human
aacucauccauua

SEQ ID NO: 2743775 - RNA, 16 nt, Human
aacucaugacggaaga

SEQ ID NO: 2743776 - RNA, 20 nt, Human
aacucauuuguuaaaauuau

SEQ ID NO: 2743777 - RNA, 14 nt, Human
aacucccucucugc

SEQ ID NO: 2743778 - RNA, 19 nt, Human
aacucccugccccccagcc

SEQ ID NO: 2743779 - RNA, 22 nt, Human
aacucccugccccccagcccuc

SEQ ID NO: 2743780 - RNA, 22 nt, Human
aacuccuaggaaaauacuauuc

SEQ ID NO: 2743781 - RNA, 23 nt, Human
aacuccugcuagaacagucucuu

SEQ ID NO: 2743782 - RNA, 17 nt, Human
aacucgaaucacucauu

SEQ ID NO: 2743783 - RNA, 14 nt, Human
aacucguuaauuug

SEQ ID NO: 2743784 - RNA, 13 nt, Human
aacucuauaaugu

SEQ ID NO: 2743785 - RNA, 12 nt, Human
aacucucuuauu

SEQ ID NO: 2743786 - RNA, 20 nt, Human
aacucugcauucuaguacuu

SEQ ID NO: 2743787 - RNA, 13 nt, Human
aacucuuaaucaa

SEQ ID NO: 2743788 - RNA, 15 nt, Human
aacugaaacaaaauu

SEQ ID NO: 2743789 - RNA, 19 nt, Human
aacugaaacaaaauuagaa

SEQ ID NO: 2743790 - RNA, 14 nt, Human
aacugaagccagaa

SEQ ID NO: 2743791 - RNA, 21 nt, Human
aacugagauccuuccuuuuga

SEQ ID NO: 2743792 - RNA, 14 nt, Human
aacugaggcagaca

SEQ ID NO: 2743793 - RNA, 22 nt, Human
aacugauguaaguaaacggucu

SEQ ID NO: 2743794 - RNA, 20 nt, Human
aacugcacugucaagaugau

SEQ ID NO: 2743795 - RNA, 14 nt, Human
aacugcauugagaa

SEQ ID NO: 2743796 - RNA, 17 nt, Human
aacugccaucauuuacu

SEQ ID NO: 2743797 - RNA, 18 nt, Human
aacugccaucauuuacuu

SEQ ID NO: 2743798 - RNA, 11 nt, Human
aacugcuggau

SEQ ID NO: 2743799 - RNA, 13 nt, Human
aacuggaaauaaa

SEQ ID NO: 2743800 - RNA, 16 nt, Human
aacuggaaauaaaaga

SEQ ID NO: 2743801 - RNA, 16 nt, Human
aacuggacugguucaa

SEQ ID NO: 2743802 - RNA, 12 nt, Human
aacuggcuacug

SEQ ID NO: 2743803 - RNA, 18 nt, Human
aacuggguuaaauauuuu

SEQ ID NO: 2743804 - RNA, 16 nt, Human
aacuguugucauauuu

SEQ ID NO: 2743805 - RNA, 16 nt, Human
aacuuaagguuaccuu

SEQ ID NO: 2743806 - RNA, 19 nt, Human
aacuuaaguagauaaggaa

SEQ ID NO: 2743807 - RNA, 23 nt, Human
aacuuaaguagauaaggaaauaa

SEQ ID NO: 2743808 - RNA, 17 nt, Human
aacuuacuacugaaucu

SEQ ID NO: 2743809 - RNA, 14 nt, Human
aacuuacuuagugu

SEQ ID NO: 2743810 - RNA, 12 nt, Human
aacuuauuugua

SEQ ID NO: 2743811 - RNA, 13 nt, Human
aacuucagacaua

SEQ ID NO: 2743812 - RNA, 15 nt, Human
aacuucuauuuuuau

SEQ ID NO: 2743813 - RNA, 16 nt, Human
aacuugguuuuaauua

SEQ ID NO: 2743814 - RNA, 22 nt, Human
aacuugguuuuaauuagugaac

SEQ ID NO: 2743815 - RNA, 20 nt, Human
aacuuguaaaggaauuuaaa

SEQ ID NO: 2743816 - RNA, 23 nt, Human
aacuuguaaaggaauuuaaaaau

SEQ ID NO: 2743817 - RNA, 22 nt, Human
aacuuguauuuuuuuucuugua

SEQ ID NO: 2743818 - RNA, 12 nt, Human
aacuuuacagaa

SEQ ID NO: 2743819 - RNA, 23 nt, Human
aacuuuuccaaugacauuuuguu

SEQ ID NO: 2743820 - RNA, 21 nt, Human
aacuuuuguguaaugaaaaug

SEQ ID NO: 2743821 - RNA, 20 nt, Human
aacuuuuuauugauuuuugg

SEQ ID NO: 2743822 - RNA, 23 nt, Human
aacuuuuuguuuuguuucuuccu

SEQ ID NO: 2743823 - RNA, 21 nt, Human
aagaaaauaaaucuaucaaaa

SEQ ID NO: 2743824 - RNA, 12 nt, Human
aagaaaauaaca

SEQ ID NO: 2743825 - RNA, 15 nt, Human
aagaaaauaacaaua

SEQ ID NO: 2743826 - RNA, 12 nt, Human
aagaaaauaacg

SEQ ID NO: 2743827 - RNA, 14 nt, Human
aagaaaauaacgau

SEQ ID NO: 2743828 - RNA, 22 nt, Human
aagaaaauaucacuugucaaua

SEQ ID NO: 2743829 - RNA, 13 nt, Human
aagaaacauuuau

SEQ ID NO: 2743830 - RNA, 23 nt, Human
aagaaagcccuuaggaagaauuu

SEQ ID NO: 2743831 - RNA, 12 nt, Human
aagaaaggaagu

SEQ ID NO: 2743832 - RNA, 16 nt, Human
aagaaaggagauacag

SEQ ID NO: 2743833 - RNA, 22 nt, Human
aagaaauuacuggaaggcuucc

SEQ ID NO: 2743834 - RNA, 12 nt, Human
aagaaauuuuug

SEQ ID NO: 2743835 - RNA, 13 nt, Human
aagaaauuuuugc

SEQ ID NO: 2743836 - RNA, 15 nt, Human
aagaacugaaaucau

SEQ ID NO: 2743837 - RNA, 21 nt, Human
aagaagagccggagccuccag

SEQ ID NO: 2743838 - RNA, 22 nt, Human
aagaagcaccaaucaugaauua

SEQ ID NO: 2743839 - RNA, 18 nt, Human
aagaagcacgugguaaaa

SEQ ID NO: 2743840 - RNA, 23 nt, Human
aagaagcacgugguaaaacacuu

SEQ ID NO: 2743841 - RNA, 21 nt, Human
aagaagcccaauauuauaauu

SEQ ID NO: 2743842 - RNA, 15 nt, Human
aagaagcuaaauccu

SEQ ID NO: 2743843 - RNA, 15 nt, Human
aagaaggaaagauuu

SEQ ID NO: 2743844 - RNA, 21 nt, Human
aagaaggugggaggaugugaa

SEQ ID NO: 2743845 - RNA, 14 nt, Human
aagaagugaaaauc

SEQ ID NO: 2743846 - RNA, 14 nt, Human
aagaaucuuuauag

SEQ ID NO: 2743847 - RNA, 17 nt, Human
aagaaucuuuauaguuc

SEQ ID NO: 2743848 - RNA, 14 nt, Human
aagaaugacuaugc

SEQ ID NO: 2743849 - RNA, 14 nt, Human
aagaaugauuauga

SEQ ID NO: 2743850 - RNA, 18 nt, Human
aagaaugauuaugaauua

SEQ ID NO: 2743851 - RNA, 13 nt, Human
aagaauuguuaaa

SEQ ID NO: 2743852 - RNA, 22 nt, Human
aagaauuucuaggacugaauua

SEQ ID NO: 2743853 - RNA, 12 nt, Human
aagacaaaaagc

SEQ ID NO: 2743854 - RNA, 22 nt, Human
aagacaaauauguucugacaua

SEQ ID NO: 2743855 - RNA, 21 nt, Human
aagacaagaaggaaagauuuu

SEQ ID NO: 2743856 - RNA, 13 nt, Human
aagacaaggaaaa

SEQ ID NO: 2743857 - RNA, 22 nt, Human
aagacagugaaagaaaauaaca

SEQ ID NO: 2743858 - RNA, 14 nt, Human
aagacaguggcccc

SEQ ID NO: 2743859 - RNA, 13 nt, Human
aagaccagccugg

SEQ ID NO: 2743860 - RNA, 16 nt, Human
aagaccauuuuuccuc

SEQ ID NO: 2743861 - RNA, 18 nt, Human
aagaccauuuuuccucca

SEQ ID NO: 2743862 - RNA, 13 nt, Human
aagacccaaaagg

SEQ ID NO: 2743863 - RNA, 17 nt, Human
aagacccaaaaggcaga

SEQ ID NO: 2743864 - RNA, 20 nt, Human
aagacccaaaaggcagaagc

SEQ ID NO: 2743865 - RNA, 22 nt, Human
aagacccaaaaggcagaagcaa

SEQ ID NO: 2743866 - RNA, 21 nt, Human
aagacccugaagacccccaac

SEQ ID NO: 2743867 - RNA, 19 nt, Human
aagacccuuauugcugucc

SEQ ID NO: 2743868 - RNA, 16 nt, Human
aagaccucauuuugaa

SEQ ID NO: 2743869 - RNA, 23 nt, Human
aagacgugauuuugcuguagaag

SEQ ID NO: 2743870 - RNA, 18 nt, Human
aagacuacuagggaaaug

SEQ ID NO: 2743871 - RNA, 14 nt, Human
aagacuaugaggaa

SEQ ID NO: 2743872 - RNA, 15 nt, Human
aagacuauucaaaca

SEQ ID NO: 2743873 - RNA, 16 nt, Human
aagacuauucaaacag

SEQ ID NO: 2743874 - RNA, 21 nt, Human
aagacucgggauuaguacaca

SEQ ID NO: 2743875 - RNA, 18 nt, Human
aagacucugucucaaaaa

SEQ ID NO: 2743876 - RNA, 22 nt, Human
aagacucugucucaaaaaauaa

SEQ ID NO: 2743877 - RNA, 17 nt, Human
aagacugcaaacccuuu

SEQ ID NO: 2743878 - RNA, 16 nt, Human
aagacugcacaucaaa

SEQ ID NO: 2743879 - RNA, 22 nt, Human
aagacuguggcugcuagcacuu

SEQ ID NO: 2743880 - RNA, 13 nt, Human
aagacuuuuauga

SEQ ID NO: 2743881 - RNA, 16 nt, Human
aagagaacaagcaaau

SEQ ID NO: 2743882 - RNA, 16 nt, Human
aagagaacuuccagau

SEQ ID NO: 2743883 - RNA, 19 nt, Human
aagagacagccaacuaugg

SEQ ID NO: 2743884 - RNA, 23 nt, Human
aagagauuuuucaugauuuugaa

SEQ ID NO: 2743885 - RNA, 17 nt, Human
aagagccggagccucca

SEQ ID NO: 2743886 - RNA, 22 nt, Human
aagagccuuuuuuugaaaaaaa

SEQ ID NO: 2743887 - RNA, 23 nt, Human
aagagccuuuuuuugaaaaaaag

SEQ ID NO: 2743888 - RNA, 21 nt, Human
aagagcucaggaugagggaaa

SEQ ID NO: 2743889 - RNA, 15 nt, Human
aagaggacuccuuaa

SEQ ID NO: 2743890 - RNA, 18 nt, Human
aagagggagugcauuuau

SEQ ID NO: 2743891 - RNA, 15 nt, Human
aagaguuuaauuuuu

SEQ ID NO: 2743892 - RNA, 15 nt, Human
aagauaccaaaacca

SEQ ID NO: 2743893 - RNA, 21 nt, Human
aagauacugaaauaaacgucu

SEQ ID NO: 2743894 - RNA, 20 nt, Human
aagauaucucaucucuucuu

SEQ ID NO: 2743895 - RNA, 23 nt, Human
aagauaucucaucucuucuuuua

SEQ ID NO: 2743896 - RNA, 21 nt, Human
aagauauuaacugagaaggcu

SEQ ID NO: 2743897 - RNA, 15 nt, Human
aagauauuuuucaug

SEQ ID NO: 2743898 - RNA, 17 nt, Human
auuuuaauaauguuuca

SEQ ID NO: 2743899 - RNA, 22 nt, Human
auuuuaauaauguuucaaacau

SEQ ID NO: 2743900 - RNA, 14 nt, Human
auuuuaaucaccaa

SEQ ID NO: 2743901 - RNA, 21 nt, Human
auuuuaaucaccaaggcugau

SEQ ID NO: 2743902 - RNA, 18 nt, Human
auuuuaauuuugaauaaa

SEQ ID NO: 2743903 - RNA, 22 nt, Human
auuuuaauuuugaauaaauaaa

SEQ ID NO: 2743904 - RNA, 18 nt, Human
auuuuacacacauuaaaa

SEQ ID NO: 2743905 - RNA, 15 nt, Human
auuuuacauggcugg

SEQ ID NO: 2743906 - RNA, 16 nt, Human
auuuuacuuuuccauu

SEQ ID NO: 2743907 - RNA, 18 nt, Human
auuuuagacauucuuuau

SEQ ID NO: 2743908 - RNA, 20 nt, Human
auuuuagacauucuuuaucu

SEQ ID NO: 2743909 - RNA, 19 nt, Human
auuuuagauagaugaagaa

SEQ ID NO: 2743910 - RNA, 12 nt, Human
auuuuagcaaag

SEQ ID NO: 2743911 - RNA, 24 nt, Human
auuuuagcaaagauaucucaucuc

SEQ ID NO: 2743912 - RNA, 18 nt, Human
auuuuagccuucucuguu

SEQ ID NO: 2743913 - RNA, 22 nt, Human
auuuuagggguagcauuugugu

SEQ ID NO: 2743914 - RNA, 21 nt, Human
auuuuaggucuuaauacacac

SEQ ID NO: 2743915 - RNA, 21 nt, Human
auuuuaguaagagauuccuga

SEQ ID NO: 2743916 - RNA, 14 nt, Human
auuuuaucugcuau

SEQ ID NO: 2743917 - RNA, 22 nt, Human
auuuuauuacaucuuucacauu

SEQ ID NO: 2743918 - RNA, 14 nt, Human
auuuuauuaggagu

SEQ ID NO: 2743919 - RNA, 12 nt, Human
auuuucaaaaug

SEQ ID NO: 2743920 - RNA, 13 nt, Human
auuuucacuuuug

SEQ ID NO: 2743921 - RNA, 19 nt, Human
auuuucaguuauuauauuu

SEQ ID NO: 2743922 - RNA, 20 nt, Human
auuuucaguuauuauauuua

SEQ ID NO: 2743923 - RNA, 23 nt, Human
auuuucaucaccccuaaaagaaa

SEQ ID NO: 2743924 - RNA, 13 nt, Human
auuuucaugcugu

SEQ ID NO: 2743925 - RNA, 16 nt, Human
auuuucaugcuguuca

SEQ ID NO: 2743926 - RNA, 14 nt, Human
auuuucccaaaacu

SEQ ID NO: 2743927 - RNA, 16 nt, Human
auuuucccuucccuga

SEQ ID NO: 2743928 - RNA, 21 nt, Human
auuuuccugaaaacccuugcc

SEQ ID NO: 2743929 - RNA, 19 nt, Human
auuuuccuggacaguuuuc

SEQ ID NO: 2743930 - RNA, 14 nt, Human
auuuucuauaauuu

SEQ ID NO: 2743931 - RNA, 19 nt, Human
auuuucuauaauuuaaaua

SEQ ID NO: 2743932 - RNA, 23 nt, Human
auuuucuauaauuuaaauauaug

SEQ ID NO: 2743933 - RNA, 15 nt, Human
auuuucugccaccca

SEQ ID NO: 2743934 - RNA, 22 nt, Human
auuuucuucucacauuuauauu

SEQ ID NO: 2743935 - RNA, 15 nt, Human
auuuucuuuguuaaa

SEQ ID NO: 2743936 - RNA, 18 nt, Human
auuuucuuuuuuuguggu

SEQ ID NO: 2743937 - RNA, 18 nt, Human
auuuugaaaaacugcuca

SEQ ID NO: 2743938 - RNA, 13 nt, Human
auuuugaaaucau

SEQ ID NO: 2743939 - RNA, 17 nt, Human
auuuugaauaaauaaau

SEQ ID NO: 2743940 - RNA, 19 nt, Human
auuuugagaaagucuuauu

SEQ ID NO: 2743941 - RNA, 18 nt, Human
auuuugaugaacaaaauu

SEQ ID NO: 2743942 - RNA, 17 nt, Human
auuuuggaaggcugagg

SEQ ID NO: 2743943 - RNA, 19 nt, Human
auuuugguaaaauacuucu

SEQ ID NO: 2743944 - RNA, 19 nt, Human
auuuugugaagcaaaauuu

SEQ ID NO: 2743945 - RNA, 13 nt, Human
auuuugugaugca

SEQ ID NO: 2743946 - RNA, 18 nt, Human
auuuuuaaauaaagaauu

SEQ ID NO: 2743947 - RNA, 21 nt, Human
auuuuuaaauaaagaauuuua

SEQ ID NO: 2743948 - RNA, 16 nt, Human
auuuuuaaguuauuuu

SEQ ID NO: 2743949 - RNA, 17 nt, Human
auuuuuaccuuuuuccu

SEQ ID NO: 2743950 - RNA, 20 nt, Human
auuuuuaccuuuuuccuucc

SEQ ID NO: 2743951 - RNA, 14 nt, Human
auuuuuaguagaga

SEQ ID NO: 2743952 - RNA, 18 nt, Human
auuuuuagugaaauauua

SEQ ID NO: 2743953 - RNA, 16 nt, Human
auuuuuaguuuaaaaa

SEQ ID NO: 2743954 - RNA, 21 nt, Human
auuuuuaugugcaauaaaaug

SEQ ID NO: 2743955 - RNA, 16 nt, Human
auuuuucagauauaaa

SEQ ID NO: 2743956 - RNA, 19 nt, Human
auuuuucagauauaaaaga

SEQ ID NO: 2743957 - RNA, 18 nt, Human
auuuuuccauuuuuuucu

SEQ ID NO: 2743958 - RNA, 16 nt, Human
auuuuuccccaaaaag

SEQ ID NO: 2743959 - RNA, 15 nt, Human
auuuuuguauuuuua

SEQ ID NO: 2743960 - RNA, 15 nt, Human
auuuuugucuugugu

SEQ ID NO: 2743961 - RNA, 22 nt, Human
auuuuuuaaguauuuauauauu

SEQ ID NO: 2743962 - RNA, 15 nt, Human
auuuuuuaauuauua

SEQ ID NO: 2743963 - RNA, 20 nt, Human
auuuuuuuagaaagcauuug

SEQ ID NO: 2743964 - RNA, 16 nt, Human
auuuuuuucugaaauu

SEQ ID NO: 2743965 - RNA, 23 nt, Human
auuuuuuuucuuguauuuuucca

SEQ ID NO: 2743966 - RNA, 15 nt, Human
auuuuuuuuguuuca

SEQ ID NO: 2743967 - RNA, 21 nt, Human
auuuuuuuuuucaauaaaacu

SEQ ID NO: 2743968 - RNA, 16 nt, Human
auuuuuuuuuuuaaaa

SEQ ID NO: 2743969 - RNA, 13 nt, Human
caaaaaaaaaccc

SEQ ID NO: 2743970 - RNA, 13 nt, Human
caaaaacacagca

SEQ ID NO: 2743971 - RNA, 16 nt, Human
caaaaaccaaauuugu

SEQ ID NO: 2743972 - RNA, 13 nt, Human
caaaaaucaaacu

SEQ ID NO: 2743973 - RNA, 22 nt, Human
caaaaauuagccgggcauggug

SEQ ID NO: 2743974 - RNA, 14 nt, Human
caaaaauuauauuu

SEQ ID NO: 2743975 - RNA, 17 nt, Human
caaaaauuccuuuuccc

SEQ ID NO: 2743976 - RNA, 18 nt, Human
caaaacuagagacucaaa

SEQ ID NO: 2743977 - RNA, 22 nt, Human
caaaacugauacccuuugaaaa

SEQ ID NO: 2743978 - RNA, 15 nt, Human
caaaacuuauuggaa

SEQ ID NO: 2743979 - RNA, 15 nt, Human
caaaacuuucuuuuc

SEQ ID NO: 2743980 - RNA, 17 nt, Human
caaaagaaagaaaauca

SEQ ID NO: 2743981 - RNA, 15 nt, Human
caaaagacuuuuucc

SEQ ID NO: 2743982 - RNA, 15 nt, Human
caaaaggaagcaggg

SEQ ID NO: 2743983 - RNA, 13 nt, Human
caaaaggauaaug

SEQ ID NO: 2743984 - RNA, 16 nt, Human
caaaaggauaaugaau

SEQ ID NO: 2743985 - RNA, 19 nt, Human
caaaaguauauucaaaaau

SEQ ID NO: 2743986 - RNA, 22 nt, Human
caaaaguuucauccuuuucauu

SEQ ID NO: 2743987 - RNA, 18 nt, Human
caaaaucauaagauauuu

SEQ ID NO: 2743988 - RNA, 19 nt, Human
caaaaugugauauguaccu

SEQ ID NO: 2743989 - RNA, 18 nt, Human
caaaauuacccuaaacau

SEQ ID NO: 2743990 - RNA, 20 nt, Human
caaaauuagugcuuuuugug

SEQ ID NO: 2743991 - RNA, 17 nt, Human
caaaauuggacuuaaaa

SEQ ID NO: 2743992 - RNA, 19 nt, Human
caaaauuguuacaaauugu

SEQ ID NO: 2743993 - RNA, 13 nt, Human
caaacaaaaaaaa

SEQ ID NO: 2743994 - RNA, 15 nt, Human
caaacaaaaaaaaaa

SEQ ID NO: 2743995 - RNA, 15 nt, Human
caaacaaacaaaaaa

SEQ ID NO: 2743996 - RNA, 15 nt, Human
caaacaauuugaaua

SEQ ID NO: 2743997 - RNA, 22 nt, Human
caaacaauuugaauauaaauuu

SEQ ID NO: 2743998 - RNA, 19 nt, Human
caaacagaacuauggaaaa

SEQ ID NO: 2743999 - RNA, 22 nt, Human
caaacagaacuauggaaaaaaa

SEQ ID NO: 2744000 - RNA, 21 nt, Human
caaacagucucaggaaaucaa

SEQ ID NO: 2744001 - RNA, 20 nt, Human
caaacauccuacaagacaca

SEQ ID NO: 2744002 - RNA, 18 nt, Human
caaacaugcacuuccuug

SEQ ID NO: 2744003 - RNA, 18 nt, Human
caaacauguuccugggau

SEQ ID NO: 2744004 - RNA, 17 nt, Human
caaaccaauuaaaccca

SEQ ID NO: 2744005 - RNA, 14 nt, Human
caaacgaaaaacau

SEQ ID NO: 2744006 - RNA, 16 nt, Human
caaacugaaacaaaau

SEQ ID NO: 2744007 - RNA, 15 nt, Human
caaacugacucuuaa

SEQ ID NO: 2744008 - RNA, 21 nt, Human
caaacugagauccuuccuuuu

SEQ ID NO: 2744009 - RNA, 20 nt, Human
caaacugccaucauuuacuu

SEQ ID NO: 2744010 - RNA, 12 nt, Human
caaacugccuaa

SEQ ID NO: 2744011 - RNA, 15 nt, Human
caaacugcuguccca

SEQ ID NO: 2744012 - RNA, 18 nt, Human
caaacuuuacagaaagau

SEQ ID NO: 2744013 - RNA, 16 nt, Human
caaacuuuauuuugug

SEQ ID NO: 2744014 - RNA, 14 nt, Human
caaagaaauguaag

SEQ ID NO: 2744015 - RNA, 19 nt, Human
caaagaaauguaagggaaa

SEQ ID NO: 2744016 - RNA, 23 nt, Human
caaagacuaugaggaauauuugc

SEQ ID NO: 2744017 - RNA, 15 nt, Human
caaagaugacugugg

SEQ ID NO: 2744018 - RNA, 13 nt, Human
caaagcaaauaau

SEQ ID NO: 2744019 - RNA, 17 nt, Human
caaagcacgaaauguua

SEQ ID NO: 2744020 - RNA, 23 nt, Human
caaagcaugggccuagcccacug

SEQ ID NO: 2744021 - RNA, 13 nt, Human
caaagcccagcuu

SEQ ID NO: 2744022 - RNA, 20 nt, Human
caaagccuucauugccuuaa

SEQ ID NO: 2744023 - RNA, 14 nt, Human
caaaggcacacagc

SEQ ID NO: 2744024 - RNA, 14 nt, Human
caaaguccugggau

SEQ ID NO: 2744025 - RNA, 18 nt, Human
caaagucucuggaauuug

SEQ ID NO: 2744026 - RNA, 21 nt, Human
caaagugcuggcauuacaggu

SEQ ID NO: 2744027 - RNA, 13 nt, Human
caaagugcuggga

SEQ ID NO: 2744028 - RNA, 21 nt, Human
caaagugguauagaaaugcug

SEQ ID NO: 2744029 - RNA, 19 nt, Human
caaagugucuugaauugua

SEQ ID NO: 2744030 - RNA, 13 nt, Human
caaaguuuaaugg

SEQ ID NO: 2744031 - RNA, 14 nt, Human
caaauaaaggaaac

SEQ ID NO: 2744032 - RNA, 19 nt, Human
caaauaaaggaaacccagc

SEQ ID NO: 2744033 - RNA, 20 nt, Human
caaauaaaggaaacccagcu

SEQ ID NO: 2744034 - RNA, 15 nt, Human
caaauaaguauuuau

SEQ ID NO: 2744035 - RNA, 17 nt, Human
caaauaagucaucugau

SEQ ID NO: 2744036 - RNA, 23 nt, Human
caaauaagucaucugaugagaac

SEQ ID NO: 2744037 - RNA, 23 nt, Human
caaauacgugggcauucaaaugu

SEQ ID NO: 2744038 - RNA, 17 nt, Human
caaauauaaauaaaaau

SEQ ID NO: 2744039 - RNA, 20 nt, Human
caaauauaaauaaaaauaau

SEQ ID NO: 2744040 - RNA, 15 nt, Human
caaauauuccagaga

SEQ ID NO: 2744041 - RNA, 18 nt, Human
caaauauuguugacaacu

SEQ ID NO: 2744042 - RNA, 21 nt, Human
caaaucaaaagacuuuuuccu

SEQ ID NO: 2744043 - RNA, 14 nt, Human
caaauccaaugaaa

SEQ ID NO: 2744044 - RNA, 15 nt, Human
caaauccaaugaaau

SEQ ID NO: 2744045 - RNA, 19 nt, Human
caaaucuuaacuugaagga

SEQ ID NO: 2744046 - RNA, 19 nt, Human
caaaugauuuucaaauuug

SEQ ID NO: 2744047 - RNA, 17 nt, Human
augggacauuuuugacu

SEQ ID NO: 2744048 - RNA, 21 nt, Human
augggagugcccccaacagca

SEQ ID NO: 2744049 - RNA, 18 nt, Human
augggggcagcaccuccu

SEQ ID NO: 2744050 - RNA, 18 nt, Human
auggggguaauaagagca

SEQ ID NO: 2744051 - RNA, 23 nt, Human
augguaccaccagucugacuguu

SEQ ID NO: 2744052 - RNA, 17 nt, Human
auggucaauuuuguuau

SEQ ID NO: 2744053 - RNA, 20 nt, Human
auggucagaggcgcaugaau

SEQ ID NO: 2744054 - RNA, 20 nt, Human
auggucccuauuccuccuuc

SEQ ID NO: 2744055 - RNA, 14 nt, Human
auggucuccaucuc

SEQ ID NO: 2744056 - RNA, 15 nt, Human
auggugaaaugcaga

SEQ ID NO: 2744057 - RNA, 18 nt, Human
auggugaaaugcagaguc

SEQ ID NO: 2744058 - RNA, 19 nt, Human
auggugcacuaauuucacu

SEQ ID NO: 2744059 - RNA, 19 nt, Human
auggugccuucauuuggga

SEQ ID NO: 2744060 - RNA, 18 nt, Human
augguguacauucuuccu

SEQ ID NO: 2744061 - RNA, 14 nt, Human
auggugugcuggcu

SEQ ID NO: 2744062 - RNA, 15 nt, Human
augguguggcaaagc

SEQ ID NO: 2744063 - RNA, 16 nt, Human
augguguggcaaagcc

SEQ ID NO: 2744064 - RNA, 17 nt, Human
augguucccuugaugaa

SEQ ID NO: 2744065 - RNA, 12 nt, Human
augguuguauua

SEQ ID NO: 2744066 - RNA, 20 nt, Human
augguuuagaaagcuugccc

SEQ ID NO: 2744067 - RNA, 23 nt, Human
auguaacuagaauuucuuuaacu

SEQ ID NO: 2744068 - RNA, 19 nt, Human
auguaacuucccugaaaaa

SEQ ID NO: 2744069 - RNA, 16 nt, Human
auguaagggaaacugc

SEQ ID NO: 2744070 - RNA, 19 nt, Human
auguaagggaaacugccag

SEQ ID NO: 2744071 - RNA, 16 nt, Human
auguaaucaauguuuc

SEQ ID NO: 2744072 - RNA, 17 nt, Human
auguacaauaaagcaau

SEQ ID NO: 2744073 - RNA, 21 nt, Human
auguacauagcuugauaaagg

SEQ ID NO: 2744074 - RNA, 17 nt, Human
auguacaugaagaagcu

SEQ ID NO: 2744075 - RNA, 21 nt, Human
auguacaugaagaagcuaaau

SEQ ID NO: 2744076 - RNA, 18 nt, Human
auguacugauuacugccu

SEQ ID NO: 2744077 - RNA, 23 nt, Human
auguacuggcaagaccugauuuc

SEQ ID NO: 2744078 - RNA, 22 nt, Human
auguagaaaaaaguaaauguga

SEQ ID NO: 2744079 - RNA, 13 nt, Human
auguagaauauau

SEQ ID NO: 2744080 - RNA, 14 nt, Human
auguagaauauauu

SEQ ID NO: 2744081 - RNA, 16 nt, Human
auguagaauauauuuc

SEQ ID NO: 2744082 - RNA, 19 nt, Human
auguagaauauauuuccuu

SEQ ID NO: 2744083 - RNA, 16 nt, Human
auguagauaaagcacu

SEQ ID NO: 2744084 - RNA, 19 nt, Human
auguagccccucuccugga

SEQ ID NO: 2744085 - RNA, 23 nt, Human
auguagccccucuccuggaagug

SEQ ID NO: 2744086 - RNA, 23 nt, Human
auguaggaaagaccauuuuuccu

SEQ ID NO: 2744087 - RNA, 15 nt, Human
auguauguaauacau

SEQ ID NO: 2744088 - RNA, 16 nt, Human
auguauguacuucaug

SEQ ID NO: 2744089 - RNA, 22 nt, Human
auguauuacaguggggaaugaa

SEQ ID NO: 2744090 - RNA, 17 nt, Human
auguauuuauaaauaua

SEQ ID NO: 2744091 - RNA, 20 nt, Human
auguauuugcagcugagaga

SEQ ID NO: 2744092 - RNA, 23 nt, Human
augucaauucuugccaaauauaa

SEQ ID NO: 2744093 - RNA, 17 nt, Human
augucauuucauuuccu

SEQ ID NO: 2744094 - RNA, 15 nt, Human
augucauuugcugga

SEQ ID NO: 2744095 - RNA, 19 nt, Human
auguccacugguucuucuu

SEQ ID NO: 2744096 - RNA, 20 nt, Human
augucccuacaccccucccc

SEQ ID NO: 2744097 - RNA, 22 nt, Human
auguccuuggugccuggagccu

SEQ ID NO: 2744098 - RNA, 12 nt, Human
augucgcccuac

SEQ ID NO: 2744099 - RNA, 15 nt, Human
augucuagagaacac

SEQ ID NO: 2744100 - RNA, 22 nt, Human
augucuagagaacacugugcuc

SEQ ID NO: 2744101 - RNA, 23 nt, Human
augucugcagcucaagggcuggc

SEQ ID NO: 2744102 - RNA, 14 nt, Human
augugaaacauguu

SEQ ID NO: 2744103 - RNA, 18 nt, Human
augugaaacauguuucuu

SEQ ID NO: 2744104 - RNA, 16 nt, Human
augugaacacaucagc

SEQ ID NO: 2744105 - RNA, 17 nt, Human
augugaacacaucagcu

SEQ ID NO: 2744106 - RNA, 23 nt, Human
augugaauuguuaguuucugagu

SEQ ID NO: 2744107 - RNA, 22 nt, Human
augugcaauaugugauguggca

SEQ ID NO: 2744108 - RNA, 19 nt, Human
augugcauauuuuauuaua

SEQ ID NO: 2744109 - RNA, 21 nt, Human
augugcauauuuuauuauagu

SEQ ID NO: 2744110 - RNA, 22 nt, Human
augugccagauuuaugcauauu

SEQ ID NO: 2744111 - RNA, 15 nt, Human
augugcuuuuaaaaa

SEQ ID NO: 2744112 - RNA, 23 nt, Human
auguggagggggcgcgugcaggc

SEQ ID NO: 2744113 - RNA, 18 nt, Human
auguguauuacaaauauu

SEQ ID NO: 2744114 - RNA, 20 nt, Human
auguguauuacaaauauuuu

SEQ ID NO: 2744115 - RNA, 18 nt, Human
auguguggcauuuucacu

SEQ ID NO: 2744116 - RNA, 12 nt, Human
augugugugugu

SEQ ID NO: 2744117 - RNA, 21 nt, Human
auguguguuuuaaaaugagaa

SEQ ID NO: 2744118 - RNA, 12 nt, Human
auguguucauuc

SEQ ID NO: 2744119 - RNA, 16 nt, Human
auguuaaaacugggac

SEQ ID NO: 2744120 - RNA, 23 nt, Human
auguuaaaacugggacaggggag

SEQ ID NO: 2744121 - RNA, 19 nt, Human
auguuacaacacggacgaa

SEQ ID NO: 2744122 - RNA, 15 nt, Human
auguuagagaauuuc

SEQ ID NO: 2744123 - RNA, 19 nt, Human
auguuagcaaagaguuaau

SEQ ID NO: 2744124 - RNA, 21 nt, Human
auguuauguauuauuauuccc

SEQ ID NO: 2744125 - RNA, 16 nt, Human
auguuauuuuuuaauu

SEQ ID NO: 2744126 - RNA, 20 nt, Human
auguuauuuuuuaauuauua

SEQ ID NO: 2744127 - RNA, 12 nt, Human
auguucaucaau

SEQ ID NO: 2744128 - RNA, 15 nt, Human
auguucaucauguau

SEQ ID NO: 2744129 - RNA, 16 nt, Human
auguuccgaaggugag

SEQ ID NO: 2744130 - RNA, 17 nt, Human
auguuccuuauauuuac

SEQ ID NO: 2744131 - RNA, 18 nt, Human
auguuccuuuuaaagaaa

SEQ ID NO: 2744132 - RNA, 19 nt, Human
auguuccuuuuaaagaaac

SEQ ID NO: 2744133 - RNA, 17 nt, Human
auguucuaagaagugaa

SEQ ID NO: 2744134 - RNA, 17 nt, Human
auguugacaugggacau

SEQ ID NO: 2744135 - RNA, 18 nt, Human
auguugacaugggacauu

SEQ ID NO: 2744136 - RNA, 17 nt, Human
auguugcccuguugcug

SEQ ID NO: 2744137 - RNA, 13 nt, Human
auguuggccaggc

SEQ ID NO: 2744138 - RNA, 15 nt, Human
auguuguuauuuaaa

SEQ ID NO: 2744139 - RNA, 18 nt, Human
auguuuaauucugaaagc

SEQ ID NO: 2744140 - RNA, 18 nt, Human
auguuuacagauccccaa

SEQ ID NO: 2744141 - RNA, 19 nt, Human
auguuuacagauccccaag

SEQ ID NO: 2744142 - RNA, 21 nt, Human
auguuuacagauccccaagcc

SEQ ID NO: 2744143 - RNA, 17 nt, Human
auguuucauaagaauuc

SEQ ID NO: 2744144 - RNA, 18 nt, Human
auguuucauaagaauucu

SEQ ID NO: 2744145 - RNA, 22 nt, Human
auguuugcucagcuucuccaac

SEQ ID NO: 2744146 - RNA, 10 nt, Human
auguuuucag

SEQ ID NO: 2744147 - RNA, 18 nt, Human
auguuuugacauuuuuag

SEQ ID NO: 2744148 - RNA, 20 nt, Human
auuaaaaaugcauauacuuu

SEQ ID NO: 2744149 - RNA, 11 nt, Human
auuaaaaccuc

SEQ ID NO: 2744150 - RNA, 19 nt, Human
auuaaaacucauuuuuguu

SEQ ID NO: 2744151 - RNA, 17 nt, Human
auuaaagaagagaacug

SEQ ID NO: 2744152 - RNA, 23 nt, Human
auuaaagcuaaaguaucuguauu

SEQ ID NO: 2744153 - RNA, 17 nt, Human
auuaaaguucuagugac

SEQ ID NO: 2744154 - RNA, 19 nt, Human
auuaaauauaaagcaagau

SEQ ID NO: 2744155 - RNA, 19 nt, Human
auuaacaugaauauuuagu

SEQ ID NO: 2744156 - RNA, 21 nt, Human
auuaacucagacacaaauaaa

SEQ ID NO: 2744157 - RNA, 23 nt, Human
auuaagacuuuauguaguuuuua

SEQ ID NO: 2744158 - RNA, 20 nt, Human
auuaaggcuucucuuaaaca

SEQ ID NO: 2744159 - RNA, 22 nt, Human
auuaaggcuucucuuaaacacu

SEQ ID NO: 2744160 - RNA, 16 nt, Human
auuaaguuuuuuuuua

SEQ ID NO: 2744161 - RNA, 18 nt, Human
auuaaguuuuuuuuuaaa

SEQ ID NO: 2744162 - RNA, 19 nt, Human
auuaaguuuuuuuuuaaaa

SEQ ID NO: 2744163 - RNA, 22 nt, Human
auuaauaaacauucuaucuauu

SEQ ID NO: 2744164 - RNA, 14 nt, Human
auuaauauauguau

SEQ ID NO: 2744165 - RNA, 20 nt, Human
auuaauauauguauuauuua

SEQ ID NO: 2744166 - RNA, 17 nt, Human
auuaauggaauauguaa

SEQ ID NO: 2744167 - RNA, 23 nt, Human
auuaauggaauauguaaauagaa

SEQ ID NO: 2744168 - RNA, 14 nt, Human
auuaauucaccuuc

SEQ ID NO: 2744169 - RNA, 16 nt, Human
auuaauucaccuucca

SEQ ID NO: 2744170 - RNA, 12 nt, Human
auuaauucuuua

SEQ ID NO: 2744171 - RNA, 22 nt, Human
auuacaggcgugagccaccaaa

SEQ ID NO: 2744172 - RNA, 19 nt, Human
auuacaguuagagauuuuu

SEQ ID NO: 2744173 - RNA, 23 nt, Human
auuacaguuagagauuuuuaaau

SEQ ID NO: 2744174 - RNA, 20 nt, Human
auuacauuuguauaaaauaa

SEQ ID NO: 2744175 - RNA, 22 nt, Human
auuacauuuguauaaaauaauu

SEQ ID NO: 2744176 - RNA, 16 nt, Human
auuaccaguuuuccua

SEQ ID NO: 2744177 - RNA, 20 nt, Human
auuacccccagcuuugagga

SEQ ID NO: 2744178 - RNA, 13 nt, Human
auuacccucuggg

SEQ ID NO: 2744179 - RNA, 22 nt, Human
auuaccuucuauuggucucccu

SEQ ID NO: 2744180 - RNA, 16 nt, Human
auuacugcaugcacuu

SEQ ID NO: 2744181 - RNA, 17 nt, Human
auuacugcaugcacuuc

SEQ ID NO: 2744182 - RNA, 16 nt, Human
auuacugccuauuuua

SEQ ID NO: 2744183 - RNA, 19 nt, Human
auuagaccaagcuugucca

SEQ ID NO: 2744184 - RNA, 17 nt, Human
auuagaguauuuuccac

SEQ ID NO: 2744185 - RNA, 19 nt, Human
auuagaguauuuuccacaa

SEQ ID NO: 2744186 - RNA, 13 nt, Human
auuagccgggcgu

SEQ ID NO: 2744187 - RNA, 17 nt, Human
auuagccugaguagaaa

SEQ ID NO: 2744188 - RNA, 20 nt, Human
auuagcuccuccuuuuuccu

SEQ ID NO: 2744189 - RNA, 23 nt, Human
auuagcuccuccuuuuuccuucc

SEQ ID NO: 2744190 - RNA, 16 nt, Human
auuagggagagaagau

SEQ ID NO: 2744191 - RNA, 23 nt, Human
auuaguacuccccuccuugaacu

SEQ ID NO: 2744192 - RNA, 17 nt, Human
auuauaacuggaaagaa

SEQ ID NO: 2744193 - RNA, 18 nt, Human
auuauaagcuguuuuuau

SEQ ID NO: 2744194 - RNA, 14 nt, Human
auuauaauauacua

SEQ ID NO: 2744195 - RNA, 16 nt, Human
auuauacccccugcaa

SEQ ID NO: 2744196 - RNA, 20 nt, Human
auuauaccgcuaucauucca

SEQ ID NO: 2744197 - RNA, 15 nt, Human
auuauagucacuagu

SEQ ID NO: 2744198 - RNA, 16 nt, Human
auuauagucacuaguu

SEQ ID NO: 2744199 - RNA, 14 nt, Human
auuauauaauauuu

SEQ ID NO: 2744200 - RNA, 14 nt, Human
auuauauauauuuu

SEQ ID NO: 2744201 - RNA, 21 nt, Human
auuauauggcuugaguuuaaa

SEQ ID NO: 2744202 - RNA, 15 nt, Human
auuaucaauaucuaa

SEQ ID NO: 2744203 - RNA, 14 nt, Human
auuauccccauuuc

SEQ ID NO: 2744204 - RNA, 19 nt, Human
auuaucuaucuaucuauuu

SEQ ID NO: 2744205 - RNA, 21 nt, Human
auuaucuaucuaucuauuuau

SEQ ID NO: 2744206 - RNA, 19 nt, Human
auuaucuuuucauacauuu

SEQ ID NO: 2744207 - RNA, 22 nt, Human
auuaugaagcuuuuaugugaaa

SEQ ID NO: 2744208 - RNA, 15 nt, Human
auuaugaauuacauu

SEQ ID NO: 2744209 - RNA, 19 nt, Human
auuaugaauuacauuugua

SEQ ID NO: 2744210 - RNA, 15 nt, Human
auuauggauaaagau

SEQ ID NO: 2744211 - RNA, 18 nt, Human
auuauggcugguaacaua

SEQ ID NO: 2744212 - RNA, 19 nt, Human
auuauggcugguaacauag

SEQ ID NO: 2744213 - RNA, 19 nt, Human
auuauguguguuuuaaaau

SEQ ID NO: 2744214 - RNA, 15 nt, Human
auuauguuaaaacug

SEQ ID NO: 2744215 - RNA, 18 nt, Human
auuauguuaaacuagcau

SEQ ID NO: 2744216 - RNA, 13 nt, Human
auuauuauuuaaa

SEQ ID NO: 2744217 - RNA, 15 nt, Human
auuauucccauucua

SEQ ID NO: 2744218 - RNA, 11 nt, Human
auuauucuuau

SEQ ID NO: 2744219 - RNA, 18 nt, Human
auuauuggacuuccauuu

SEQ ID NO: 2744220 - RNA, 16 nt, Human
auuauuguacauuuau

SEQ ID NO: 2744221 - RNA, 14 nt, Human
auuauuguuuuucu

SEQ ID NO: 2744222 - RNA, 16 nt, Human
auuauuguuuuucuuu

SEQ ID NO: 2744223 - RNA, 16 nt, Human
auuauuuaaacaucag

SEQ ID NO: 2744224 - RNA, 17 nt, Human
auuauuuauauauguau

SEQ ID NO: 2744225 - RNA, 15 nt, Human
auuauuuucuacaca

SEQ ID NO: 2744226 - RNA, 20 nt, Human
auuauuuugaauccagaaau

SEQ ID NO: 2744227 - RNA, 17 nt, Human
auuauuuuugagacaga

SEQ ID NO: 2744228 - RNA, 21 nt, Human
auuauuuuugagacagagucu

SEQ ID NO: 2744229 - RNA, 14 nt, Human
auuauuuuuuaaaa

SEQ ID NO: 2744230 - RNA, 15 nt, Human
auuauuuuuuaaaaa

SEQ ID NO: 2744231 - RNA, 21 nt, Human
auucaaaaauuauauuuugaa

SEQ ID NO: 2744232 - RNA, 17 nt, Human
auucaaaaguugaaauu

SEQ ID NO: 2744233 - RNA, 19 nt, Human
auucaaaaguugaaauuaa

SEQ ID NO: 2744234 - RNA, 18 nt, Human
auucaaacuaauagaauu

SEQ ID NO: 2744235 - RNA, 20 nt, Human
auucaaaggcauuucuuuuc

SEQ ID NO: 2744236 - RNA, 24 nt, Human
auucaaaggcauuucuuuucugca

SEQ ID NO: 2744237 - RNA, 14 nt, Human
auucaaaugucuau

SEQ ID NO: 2744238 - RNA, 16 nt, Human
auucaacaucuaguga

SEQ ID NO: 2744239 - RNA, 20 nt, Human
auucaaguccaggcuuuuuu

SEQ ID NO: 2744240 - RNA, 19 nt, Human
auucaauaaaguauuuaau

SEQ ID NO: 2744241 - RNA, 23 nt, Human
auucaauaucuuuuuuuuaauaa

SEQ ID NO: 2744242 - RNA, 20 nt, Human
auucaaugccccugaauuua

SEQ ID NO: 2744243 - RNA, 19 nt, Human
auucacaagacccaaaagg

SEQ ID NO: 2744244 - RNA, 22 nt, Human
auucacaucgcagauucucccu

SEQ ID NO: 2744245 - RNA, 18 nt, Human
auucacccugauuuuaca

SEQ ID NO: 2744246 - RNA, 18 nt, Human
auucacuccacuuggaca

SEQ ID NO: 2744247 - RNA, 19 nt, Human
auucagaauuucuaaaagu

SEQ ID NO: 2744248 - RNA, 15 nt, Human
auucagacuguuuuu

SEQ ID NO: 2744249 - RNA, 21 nt, Human
auucagauaugauucaaaugu

SEQ ID NO: 2744250 - RNA, 22 nt, Human
auucagauaugauucaaauguc

SEQ ID NO: 2744251 - RNA, 20 nt, Human
auucagccccgggaguggcg

SEQ ID NO: 2744252 - RNA, 21 nt, Human
auucagccccgggaguggcgc

SEQ ID NO: 2744253 - RNA, 20 nt, Human
auucagggcuauuuuuuccc

SEQ ID NO: 2744254 - RNA, 18 nt, Human
auucaggucuuucuuucc

SEQ ID NO: 2744255 - RNA, 13 nt, Human
auucauaagauuu

SEQ ID NO: 2744256 - RNA, 21 nt, Human
auucauagcagcuuauucaca

SEQ ID NO: 2744257 - RNA, 15 nt, Human
auucauauuuucuuu

SEQ ID NO: 2744258 - RNA, 21 nt, Human
auucauauuuucuuucaaaau

SEQ ID NO: 2744259 - RNA, 18 nt, Human
auucaugcugauuguuau

SEQ ID NO: 2744260 - RNA, 16 nt, Human
auucaugucaugugua

SEQ ID NO: 2744261 - RNA, 17 nt, Human
auucauuaaucugccuc

SEQ ID NO: 2744262 - RNA, 13 nt, Human
auucauucacuca

SEQ ID NO: 2744263 - RNA, 22 nt, Human
auuccaacuaucucauuuccaa

SEQ ID NO: 2744264 - RNA, 12 nt, Human
auuccacagcug

SEQ ID NO: 2744265 - RNA, 17 nt, Human
auuccacagcugcucaa

SEQ ID NO: 2744266 - RNA, 18 nt, Human
auuccacagcugcucaau

SEQ ID NO: 2744267 - RNA, 22 nt, Human
auuccaccaggauauccucccu

SEQ ID NO: 2744268 - RNA, 23 nt, Human
auuccaccaggauauccucccuc

SEQ ID NO: 2744269 - RNA, 14 nt, Human
auuccaccugcaau

SEQ ID NO: 2744270 - RNA, 24 nt, Human
auuccagaccugaagaaucacaau

SEQ ID NO: 2744271 - RNA, 19 nt, Human
auucccagccagcacagcc

SEQ ID NO: 2744272 - RNA, 20 nt, Human
auucccagccagcacagccu

SEQ ID NO: 2744273 - RNA, 15 nt, Human
auuccccuaaccuca

SEQ ID NO: 2744274 - RNA, 21 nt, Human
auucccguggaacguuuuucc

SEQ ID NO: 2744275 - RNA, 13 nt, Human
auucccucuccag

SEQ ID NO: 2744276 - RNA, 17 nt, Human
auucccuuuugcugccu

SEQ ID NO: 2744277 - RNA, 19 nt, Human
auuccuauauccugugacu

SEQ ID NO: 2744278 - RNA, 13 nt, Human
auuccucacuuug

SEQ ID NO: 2744279 - RNA, 19 nt, Human
auuccucacuuugaagagu

SEQ ID NO: 2744280 - RNA, 12 nt, Human
auuccuccuucc

SEQ ID NO: 2744281 - RNA, 17 nt, Human
auuccuccuucccuugc

SEQ ID NO: 2744282 - RNA, 18 nt, Human
auuccucugcccuuccug

SEQ ID NO: 2744283 - RNA, 22 nt, Human
auuccuguggauguaaagugau

SEQ ID NO: 2744284 - RNA, 23 nt, Human
auuccuguggauguaaagugaua

SEQ ID NO: 2744285 - RNA, 16 nt, Human
auuccuuaagauauua

SEQ ID NO: 2744286 - RNA, 12 nt, Human
auuccuuagcuu

SEQ ID NO: 2744287 - RNA, 23 nt, Human
auuccuuagcuuagaccucagcc

SEQ ID NO: 2744288 - RNA, 23 nt, Human
auuccuugauggagauauuuaca

SEQ ID NO: 2744289 - RNA, 21 nt, Human
auuccuuuuucucuccucucc

SEQ ID NO: 2744290 - RNA, 17 nt, Human
auucgcaauaaguacca

SEQ ID NO: 2744291 - RNA, 15 nt, Human
auucucccuugcucu

SEQ ID NO: 2744292 - RNA, 22 nt, Human
auucuccugccucagccucccg

SEQ ID NO: 2744293 - RNA, 23 nt, Human
auucucucuccuguacuuuuucc

SEQ ID NO: 2744294 - RNA, 22 nt, Human
auucucuugccucaaccuccca

SEQ ID NO: 2744295 - RNA, 15 nt, Human
auucugaaagcaacc

SEQ ID NO: 2744296 - RNA, 15 nt, Human
auucugaggccaggg

SEQ ID NO: 2744297 - RNA, 16 nt, Human
auucugaggccaggga

SEQ ID NO: 2744298 - RNA, 17 nt, Human
auucugagguaaccuca

SEQ ID NO: 2744299 - RNA, 22 nt, Human
auucugagguaaccucauuauc

SEQ ID NO: 2744300 - RNA, 14 nt, Human
auucugccugcccu

SEQ ID NO: 2744301 - RNA, 18 nt, Human
auucugccugcccugaaa

SEQ ID NO: 2744302 - RNA, 16 nt, Human
auucuggacuguuuuu

SEQ ID NO: 2744303 - RNA, 19 nt, Human
auucuggacuguuuuuaaa

SEQ ID NO: 2744304 - RNA, 21 nt, Human
auucuggacuguuuuuaaaaa

SEQ ID NO: 2744305 - RNA, 18 nt, Human
auucuuacauguuuucuu

SEQ ID NO: 2744306 - RNA, 16 nt, Human
auucuuauuauuuuug

SEQ ID NO: 2744307 - RNA, 13 nt, Human
auucuuauuucau

SEQ ID NO: 2744308 - RNA, 22 nt, Human
auucuugaaagcuguggccagc

SEQ ID NO: 2744309 - RNA, 18 nt, Human
auucuugccaaauauaaa

SEQ ID NO: 2744310 - RNA, 19 nt, Human
auucuugccaaauauaaau

SEQ ID NO: 2744311 - RNA, 19 nt, Human
auucuuuacccccugggag

SEQ ID NO: 2744312 - RNA, 18 nt, Human
auugaaaggcauucucug

SEQ ID NO: 2744313 - RNA, 19 nt, Human
auugaaaggcauucucuga

SEQ ID NO: 2744314 - RNA, 21 nt, Human
auugaaaggcauucucugaag

SEQ ID NO: 2744315 - RNA, 21 nt, Human
auugaaaugacuaaaaaacaa

SEQ ID NO: 2744316 - RNA, 22 nt, Human
auugacuauuauagaauggaac

SEQ ID NO: 2744317 - RNA, 17 nt, Human
auugagcaccugcaggc

SEQ ID NO: 2744318 - RNA, 20 nt, Human
auugagcaccugcaggcgug

SEQ ID NO: 2744319 - RNA, 19 nt, Human
auugaggacacugauaugg

SEQ ID NO: 2744320 - RNA, 13 nt, Human
auugaggcaggca

SEQ ID NO: 2744321 - RNA, 14 nt, Human
auugaggcaggcac

SEQ ID NO: 2744322 - RNA, 16 nt, Human
auugaggcaggcacug

SEQ ID NO: 2744323 - RNA, 17 nt, Human
auugaggcuuuaaaacu

SEQ ID NO: 2744324 - RNA, 18 nt, Human
auugauccagaaagaaaa

SEQ ID NO: 2744325 - RNA, 16 nt, Human
auugauuuaauguaau

SEQ ID NO: 2744326 - RNA, 23 nt, Human
auugcagaguacuggcugaugga

SEQ ID NO: 2744327 - RNA, 16 nt, Human
auugcuauguuuugac

SEQ ID NO: 2744328 - RNA, 15 nt, Human
auugcugaaugacua

SEQ ID NO: 2744329 - RNA, 16 nt, Human
auugcugaaugacuac

SEQ ID NO: 2744330 - RNA, 21 nt, Human
auugcuuguuagcaaaaugga

SEQ ID NO: 2744331 - RNA, 19 nt, Human
auugcuuuaccuuuuuucu

SEQ ID NO: 2744332 - RNA, 15 nt, Human
auuggaaaggcagcu

SEQ ID NO: 2744333 - RNA, 13 nt, Human
auuggacaguaaa

SEQ ID NO: 2744334 - RNA, 13 nt, Human
auuggagauguuu

SEQ ID NO: 2744335 - RNA, 18 nt, Human
auuggggaagacuguggc

SEQ ID NO: 2744336 - RNA, 20 nt, Human
auugguuuaccugugaaaua

SEQ ID NO: 2744337 - RNA, 21 nt, Human
auuguagaaaagcuauaaaau

SEQ ID NO: 2744338 - RNA, 17 nt, Human
auuguagauaauacagu

SEQ ID NO: 2744339 - RNA, 21 nt, Human
auuguaggauguugagcagca

SEQ ID NO: 2744340 - RNA, 19 nt, Human
auuguaggugacuauuaua

SEQ ID NO: 2744341 - RNA, 19 nt, Human
auuguaguccuguaaugga

SEQ ID NO: 2744342 - RNA, 19 nt, Human
auuguauuuuaguaagaga

SEQ ID NO: 2744343 - RNA, 16 nt, Human
auugucuagugaaacu

SEQ ID NO: 2744344 - RNA, 14 nt, Human
auugucuuuguucu

SEQ ID NO: 2744345 - RNA, 21 nt, Human
auugugaucagaccauaaugu

SEQ ID NO: 2744346 - RNA, 19 nt, Human
auugugaugugaguugcac

SEQ ID NO: 2744347 - RNA, 21 nt, Human
auugugcuggaaauggacaca

SEQ ID NO: 2744348 - RNA, 19 nt, Human
auugugggauacuauuuaa

SEQ ID NO: 2744349 - RNA, 14 nt, Human
auuguguguuauuu

SEQ ID NO: 2744350 - RNA, 16 nt, Human
auuguuacugguacca

SEQ ID NO: 2744351 - RNA, 17 nt, Human
auuguuauauaaucauu

SEQ ID NO: 2744352 - RNA, 19 nt, Human
auuguucucuaauauguaa

SEQ ID NO: 2744353 - RNA, 19 nt, Human
auuguugacaacugugacu

SEQ ID NO: 2744354 - RNA, 23 nt, Human
auuguuuuuccuuguauuuaaau

SEQ ID NO: 2744355 - RNA, 11 nt, Human
auuuaaaaauc

SEQ ID NO: 2744356 - RNA, 14 nt, Human
auuuaaauauaugc

SEQ ID NO: 2744357 - RNA, 17 nt, Human
auuuaaauuauuuuugu

SEQ ID NO: 2744358 - RNA, 18 nt, Human
auuuaacuauucauaaga

SEQ ID NO: 2744359 - RNA, 19 nt, Human
auuuaacugacuauucuug

SEQ ID NO: 2744360 - RNA, 19 nt, Human
auuuaagagaacaagcaaa

SEQ ID NO: 2744361 - RNA, 16 nt, Human
auuuaaggauucugag

SEQ ID NO: 2744362 - RNA, 19 nt, Human
auuuaaggauucugagauu

SEQ ID NO: 2744363 - RNA, 14 nt, Human
auuuaaggccaggc

SEQ ID NO: 2744364 - RNA, 15 nt, Human
auuuaauuauuucac

SEQ ID NO: 2744365 - RNA, 19 nt, Human
auuuaauuauuucacuuua

SEQ ID NO: 2744366 - RNA, 21 nt, Human
auuuacaaaugggaaacaaaa

SEQ ID NO: 2744367 - RNA, 17 nt, Human
auuuaccacuuguguuu

SEQ ID NO: 2744368 - RNA, 16 nt, Human
auuuacccuucuuuuc

SEQ ID NO: 2744369 - RNA, 17 nt, Human
auuuacccuucuuuucu

SEQ ID NO: 2744370 - RNA, 21 nt, Human
auuuacccuucuuuucugacu

SEQ ID NO: 2744371 - RNA, 23 nt, Human
auuuacgcucauuguagaaaagc

SEQ ID NO: 2744372 - RNA, 15 nt, Human
auuuacugagcuucu

SEQ ID NO: 2744373 - RNA, 16 nt, Human
auuuagauuugugugc

SEQ ID NO: 2744374 - RNA, 17 nt, Human
auuuaggccaugggaca

SEQ ID NO: 2744375 - RNA, 18 nt, Human
auuuaggccaugggacag

SEQ ID NO: 2744376 - RNA, 17 nt, Human
auuuagguuucugaguu

SEQ ID NO: 2744377 - RNA, 16 nt, Human
auuuagugaucaaauu

SEQ ID NO: 2744378 - RNA, 19 nt, Human
auuuaguguucauaaauaa

SEQ ID NO: 2744379 - RNA, 20 nt, Human
auuuaguguucauaaauaaa

SEQ ID NO: 2744380 - RNA, 17 nt, Human
auuuaguuauaaaaaua

SEQ ID NO: 2744381 - RNA, 13 nt, Human
auuuauaaaaaua

SEQ ID NO: 2744382 - RNA, 14 nt, Human
auuuauaaaaauaa

SEQ ID NO: 2744383 - RNA, 16 nt, Human
auuuauaaaaauaaaa

SEQ ID NO: 2744384 - RNA, 22 nt, Human
auuuauaaaaauaaaaaacacu

SEQ ID NO: 2744385 - RNA, 18 nt, Human
auuuauaaacuuuuuucu

SEQ ID NO: 2744386 - RNA, 19 nt, Human
auuuauaaauggacaaaug

SEQ ID NO: 2744387 - RNA, 12 nt, Human
auuuauauaugu

SEQ ID NO: 2744388 - RNA, 20 nt, Human
auuuauauauuuauaacuca

SEQ ID NO: 2744389 - RNA, 22 nt, Human
auuuauauggggaauauauuuu

SEQ ID NO: 2744390 - RNA, 12 nt, Human
auuuaucauuua

SEQ ID NO: 2744391 - RNA, 14 nt, Human
auuuaugaguuuuu

SEQ ID NO: 2744392 - RNA, 17 nt, Human
auuuaugccucuguauu

SEQ ID NO: 2744393 - RNA, 21 nt, Human
auuuaugccucuguauuuaaa

SEQ ID NO: 2744394 - RNA, 23 nt, Human
auuuauguuccuuuuaaagaaac

SEQ ID NO: 2744395 - RNA, 14 nt, Human
auuuauguuuaauu

SEQ ID NO: 2744396 - RNA, 17 nt, Human
auuuauguuuaauucug

SEQ ID NO: 2744397 - RNA, 18 nt, Human
auuuauguuuaauucuga

SEQ ID NO: 2744398 - RNA, 14 nt, Human
auuuauuaaguauu

SEQ ID NO: 2744399 - RNA, 15 nt, Human
auuuauuaaguauuu

SEQ ID NO: 2744400 - RNA, 14 nt, Human
auuuauuacuguaa

SEQ ID NO: 2744401 - RNA, 14 nt, Human
auuuauuauugugu

SEQ ID NO: 2744402 - RNA, 20 nt, Human
auuuauucaauaaaguauuu

SEQ ID NO: 2744403 - RNA, 15 nt, Human
auuuauucauauuuu

SEQ ID NO: 2744404 - RNA, 15 nt, Human
auuuauugaggcuuu

SEQ ID NO: 2744405 - RNA, 13 nt, Human
auuuauugcugaa

SEQ ID NO: 2744406 - RNA, 18 nt, Human
auuuauuuacugagcuuc

SEQ ID NO: 2744407 - RNA, 18 nt, Human
auuuauuuccauauuaaa

SEQ ID NO: 2744408 - RNA, 20 nt, Human
auuuauuuccauauuaaaau

SEQ ID NO: 2744409 - RNA, 21 nt, Human
auuuauuuccauauuaaaauc

SEQ ID NO: 2744410 - RNA, 13 nt, Human
auuuauuugagac

SEQ ID NO: 2744411 - RNA, 17 nt, Human
auuuauuuguuuaaaaa

SEQ ID NO: 2744412 - RNA, 16 nt, Human
auuucaaaaaaaaacc

SEQ ID NO: 2744413 - RNA, 13 nt, Human
auuucaacuguuu

SEQ ID NO: 2744414 - RNA, 19 nt, Human
auuucaauuaccuucuauu

SEQ ID NO: 2744415 - RNA, 15 nt, Human
auuucacuuuagaaa

SEQ ID NO: 2744416 - RNA, 20 nt, Human
auuucauaccuaucaucuua

SEQ ID NO: 2744417 - RNA, 16 nt, Human
auuucaugauuucauu

SEQ ID NO: 2744418 - RNA, 18 nt, Human
auuucaugauuucauuuc

SEQ ID NO: 2744419 - RNA, 15 nt, Human
auuucauuuccuauu

SEQ ID NO: 2744420 - RNA, 21 nt, Human
auuucauuuccuauuuuugga

SEQ ID NO: 2744421 - RNA, 15 nt, Human
auuucauuucuuuga

SEQ ID NO: 2744422 - RNA, 23 nt, Human
auuuccacagugacuccacucug

SEQ ID NO: 2744423 - RNA, 16 nt, Human
auuuccauauuaaaau

SEQ ID NO: 2744424 - RNA, 20 nt, Human
auuuccauuuacccuucuuu

SEQ ID NO: 2744425 - RNA, 13 nt, Human
auuuccccauuua

SEQ ID NO: 2744426 - RNA, 19 nt, Human
auuucccuguuucuuccac

SEQ ID NO: 2744427 - RNA, 21 nt, Human
auuuccuaguucuguagaaau

SEQ ID NO: 2744428 - RNA, 13 nt, Human
auuuccuaucugu

SEQ ID NO: 2744429 - RNA, 18 nt, Human
auuuccucaaaaagauuu

SEQ ID NO: 2744430 - RNA, 19 nt, Human
auuuccucaaaaagauuuc

SEQ ID NO: 2744431 - RNA, 20 nt, Human
auuuccuuauucagaauuuc

SEQ ID NO: 2744432 - RNA, 15 nt, Human
auuucuaaagccauu

SEQ ID NO: 2744433 - RNA, 18 nt, Human
auuucuaaagccauugua

SEQ ID NO: 2744434 - RNA, 17 nt, Human
auuucuaugaaauauua

SEQ ID NO: 2744435 - RNA, 18 nt, Human
auuucuaugaaauauuau

SEQ ID NO: 2744436 - RNA, 16 nt, Human
auuucuauuuauuuac

SEQ ID NO: 2744437 - RNA, 18 nt, Human
auuucucauaccuucccc

SEQ ID NO: 2744438 - RNA, 18 nt, Human
auuucucaucuuuuuacu

SEQ ID NO: 2744439 - RNA, 13 nt, Human
auuucuccuugga

SEQ ID NO: 2744440 - RNA, 18 nt, Human
auuucugagcauuuaaua

SEQ ID NO: 2744441 - RNA, 23 nt, Human
auuucugagcauuuaauauggau

SEQ ID NO: 2744442 - RNA, 22 nt, Human
auuucugugggagaauucuuac

SEQ ID NO: 2744443 - RNA, 14 nt, Human
auuucuucaaauaa

SEQ ID NO: 2744444 - RNA, 19 nt, Human
auuucuucaacucccugcc

SEQ ID NO: 2744445 - RNA, 17 nt, Human
auuucuuuuuguucccc

SEQ ID NO: 2744446 - RNA, 21 nt, Human
auuucuuuuuguuccccuuug

SEQ ID NO: 2744447 - RNA, 21 nt, Human
auuucuuuuuuaaaugaagaa

SEQ ID NO: 2744448 - RNA, 20 nt, Human
auuugaaacacuuugcauaa

SEQ ID NO: 2744449 - RNA, 13 nt, Human
auuugaaauauug

SEQ ID NO: 2744450 - RNA, 23 nt, Human
auuugaaauauugacuuuuuaug

SEQ ID NO: 2744451 - RNA, 13 nt, Human
auuugaaauugua

SEQ ID NO: 2744452 - RNA, 21 nt, Human
auuugaaauuguauuacaaau

SEQ ID NO: 2744453 - RNA, 15 nt, Human
auuugaguguuuuaa

SEQ ID NO: 2744454 - RNA, 21 nt, Human
auuugaguguuuuaagauaaa

SEQ ID NO: 2744455 - RNA, 14 nt, Human
auuugaugaaauca

SEQ ID NO: 2744456 - RNA, 15 nt, Human
auuugaugaaaucag

SEQ ID NO: 2744457 - RNA, 19 nt, Human
auuugaugaaaucagaguu

SEQ ID NO: 2744458 - RNA, 23 nt, Human
auuugaugaaaucagaguuuuca

SEQ ID NO: 2744459 - RNA, 16 nt, Human
auuugcaaaguuuaau

SEQ ID NO: 2744460 - RNA, 16 nt, Human
auuugcaaccccauca

SEQ ID NO: 2744461 - RNA, 19 nt, Human
auuugcaagacauagaaua

SEQ ID NO: 2744462 - RNA, 17 nt, Human
auuugcacuauuggaag

SEQ ID NO: 2744463 - RNA, 17 nt, Human
auuugcagcugugccau

SEQ ID NO: 2744464 - RNA, 20 nt, Human
auuugccaauuuacuuuguu

SEQ ID NO: 2744465 - RNA, 23 nt, Human
auuugggcacaacacaucaggaa

SEQ ID NO: 2744466 - RNA, 15 nt, Human
auuugggcucuugga

SEQ ID NO: 2744467 - RNA, 20 nt, Human
auuugggggacuuacaugau

SEQ ID NO: 2744468 - RNA, 15 nt, Human
auuugguaaggggaa

SEQ ID NO: 2744469 - RNA, 22 nt, Human
auuuggucaacacuaacaugau

SEQ ID NO: 2744470 - RNA, 23 nt, Human
auuuggugauuacauuuuaaaca

SEQ ID NO: 2744471 - RNA, 19 nt, Human
auuugguucuaggccgggc

SEQ ID NO: 2744472 - RNA, 22 nt, Human
auuuguacaccaauauucauag

SEQ ID NO: 2744473 - RNA, 19 nt, Human
auuuguagcauccucuuua

SEQ ID NO: 2744474 - RNA, 18 nt, Human
auuuguauaaaauaauuu

SEQ ID NO: 2744475 - RNA, 22 nt, Human
auuuguauaaaauaauuuuuau

SEQ ID NO: 2744476 - RNA, 15 nt, Human
auuuguuuguauuuu

SEQ ID NO: 2744477 - RNA, 22 nt, Human
auuuuaaaaaauggaacauaaa

SEQ ID NO: 2744478 - RNA, 13 nt, Human
auuuuaaaagaau

SEQ ID NO: 2744479 - RNA, 15 nt, Human
auuuuaaaagaauga

SEQ ID NO: 2744480 - RNA, 17 nt, Human
auuuuaaaagaaugauu

SEQ ID NO: 2744481 - RNA, 15 nt, Human
auuuuaaaaguuuuu

SEQ ID NO: 2744482 - RNA, 14 nt, Human
auuuuaaaauaaau

SEQ ID NO: 2744483 - RNA, 18 nt, Human
auuuuaaaauaaauuauu

SEQ ID NO: 2744484 - RNA, 17 nt, Human
auuuuaaaucuaaaucu

SEQ ID NO: 2744485 - RNA, 18 nt, Human
auuuuaacucuauaaugu

SEQ ID NO: 2744486 - RNA, 15 nt, Human
auuuuaacuuccuug

SEQ ID NO: 2744487 - RNA, 16 nt, Human
auuuuaaguaauuuca

SEQ ID NO: 2744488 - RNA, 20 nt, Human
auuuuaauaaacacucuuga

SEQ ID NO: 2744489 - RNA, 13 nt, Human
auuuuaauaaugu

SEQ ID NO: 2744490 - RNA, 15 nt, Human
auuuuaauaauguuu

SEQ ID NO: 2744491 - RNA, 16 nt, Human
augaaagcguaaagag

SEQ ID NO: 2744492 - RNA, 14 nt, Human
augaaauauuaugu

SEQ ID NO: 2744493 - RNA, 22 nt, Human
augaaccaccgcgcccagccuu

SEQ ID NO: 2744494 - RNA, 14 nt, Human
augaaccuuuacau

SEQ ID NO: 2744495 - RNA, 14 nt, Human
augaagaagcuaaa

SEQ ID NO: 2744496 - RNA, 21 nt, Human
augaagaaguugauaugccuu

SEQ ID NO: 2744497 - RNA, 16 nt, Human
augaagagauuuuuca

SEQ ID NO: 2744498 - RNA, 20 nt, Human
augaagauacugaaauaaac

SEQ ID NO: 2744499 - RNA, 22 nt, Human
augaaggugucauacagauuug

SEQ ID NO: 2744500 - RNA, 11 nt, Human
augaaguacuc

SEQ ID NO: 2744501 - RNA, 19 nt, Human
augaaguacucauacaugu

SEQ ID NO: 2744502 - RNA, 11 nt, Human
augaauacaau

SEQ ID NO: 2744503 - RNA, 16 nt, Human
augaauacuuuauaaa

SEQ ID NO: 2744504 - RNA, 17 nt, Human
augaauaucaguuauuu

SEQ ID NO: 2744505 - RNA, 23 nt, Human
augaauaucaguuauuuuuaaac

SEQ ID NO: 2744506 - RNA, 15 nt, Human
augaauuaaagaaga

SEQ ID NO: 2744507 - RNA, 17 nt, Human
augaauuaaagaagaga

SEQ ID NO: 2744508 - RNA, 15 nt, Human
augaauuaaguuuuu

SEQ ID NO: 2744509 - RNA, 17 nt, Human
augaauuaaguuuuuuu

SEQ ID NO: 2744510 - RNA, 20 nt, Human
augaauuaaguuuuuuuuua

SEQ ID NO: 2744511 - RNA, 15 nt, Human
augaauuacauuugu

SEQ ID NO: 2744512 - RNA, 20 nt, Human
augaauuacauuuguauaaa

SEQ ID NO: 2744513 - RNA, 23 nt, Human
augaauuauguuugcauguucac

SEQ ID NO: 2744514 - RNA, 12 nt, Human
augacaggaugu

SEQ ID NO: 2744515 - RNA, 22 nt, Human
augacaugucccuacaccccuc

SEQ ID NO: 2744516 - RNA, 12 nt, Human
augaccaacauc

SEQ ID NO: 2744517 - RNA, 13 nt, Human
augacccccaucc

SEQ ID NO: 2744518 - RNA, 16 nt, Human
augacuaaaaaacaaa

SEQ ID NO: 2744519 - RNA, 17 nt, Human
augacuauggaaagagu

SEQ ID NO: 2744520 - RNA, 23 nt, Human
augacuuguacucugaaaguuuu

SEQ ID NO: 2744521 - RNA, 18 nt, Human
augagaaaucuaaaaaac

SEQ ID NO: 2744522 - RNA, 22 nt, Human
augagaacucugagcagugcuu

SEQ ID NO: 2744523 - RNA, 15 nt, Human
augagaagaaugacu

SEQ ID NO: 2744524 - RNA, 15 nt, Human
augagaccacuguua

SEQ ID NO: 2744525 - RNA, 18 nt, Human
augagaguacaccccaac

SEQ ID NO: 2744526 - RNA, 11 nt, Human
augagauauua

SEQ ID NO: 2744527 - RNA, 15 nt, Human
augagcaaaaccaaa

SEQ ID NO: 2744528 - RNA, 18 nt, Human
augagcacgcauggaaaa

SEQ ID NO: 2744529 - RNA, 23 nt, Human
augagcacgcauggaaaaguuuc

SEQ ID NO: 2744530 - RNA, 17 nt, Human
augagccggagccccuu

SEQ ID NO: 2744531 - RNA, 17 nt, Human
augaggaaagcauguau

SEQ ID NO: 2744532 - RNA, 14 nt, Human
augaggccgccaug

SEQ ID NO: 2744533 - RNA, 14 nt, Human
augaggcuacagaa

SEQ ID NO: 2744534 - RNA, 12 nt, Human
augagggcugga

SEQ ID NO: 2744535 - RNA, 13 nt, Human
augaguaacugau

SEQ ID NO: 2744536 - RNA, 13 nt, Human
augauaaaagcac

SEQ ID NO: 2744537 - RNA, 19 nt, Human
augauacuugaaaauuaac

SEQ ID NO: 2744538 - RNA, 17 nt, Human
augaucaguaugaaaau

SEQ ID NO: 2744539 - RNA, 16 nt, Human
augaucuuuaaaauac

SEQ ID NO: 2744540 - RNA, 17 nt, Human
augaucuuuaaaauaca

SEQ ID NO: 2744541 - RNA, 19 nt, Human
augaugauuucagcaggga

SEQ ID NO: 2744542 - RNA, 18 nt, Human
augaugcaacauccuugu

SEQ ID NO: 2744543 - RNA, 18 nt, Human
augaugcuuugagaacau

SEQ ID NO: 2744544 - RNA, 21 nt, Human
augaugcuuugagaacauacu

SEQ ID NO: 2744545 - RNA, 19 nt, Human
augauggguguuuuuagca

SEQ ID NO: 2744546 - RNA, 16 nt, Human
augauguacauguacu

SEQ ID NO: 2744547 - RNA, 14 nt, Human
augauguuuagaaa

SEQ ID NO: 2744548 - RNA, 20 nt, Human
augauguuuagaaacacaac

SEQ ID NO: 2744549 - RNA, 18 nt, Human
augauguuucauaagaau

SEQ ID NO: 2744550 - RNA, 17 nt, Human
augauuaaguaaugaua

SEQ ID NO: 2744551 - RNA, 11 nt, Human
augauuccacc

SEQ ID NO: 2744552 - RNA, 21 nt, Human
augauuccagccaucaccuua

SEQ ID NO: 2744553 - RNA, 19 nt, Human
augauuccuugauggagau

SEQ ID NO: 2744554 - RNA, 16 nt, Human
augauuucagcaggga

SEQ ID NO: 2744555 - RNA, 16 nt, Human
augauuuucaaauuug

SEQ ID NO: 2744556 - RNA, 23 nt, Human
augauuuugaaaccaugaagaga

SEQ ID NO: 2744557 - RNA, 15 nt, Human
augauuuugaaauca

SEQ ID NO: 2744558 - RNA, 22 nt, Human
augcaaacuuuauuuuguguuu

SEQ ID NO: 2744559 - RNA, 17 nt, Human
augcacacagugcuuuc

SEQ ID NO: 2744560 - RNA, 12 nt, Human
augcacaugagc

SEQ ID NO: 2744561 - RNA, 14 nt, Human
augcacuaaucaau

SEQ ID NO: 2744562 - RNA, 19 nt, Human
augcacugauguuguguuu

SEQ ID NO: 2744563 - RNA, 16 nt, Human
augcacuuccuugcuu

SEQ ID NO: 2744564 - RNA, 22 nt, Human
augcacuuggcugcauaaaugu

SEQ ID NO: 2744565 - RNA, 17 nt, Human
augcagagguccacaac

SEQ ID NO: 2744566 - RNA, 19 nt, Human
augcagagguccacaacac

SEQ ID NO: 2744567 - RNA, 17 nt, Human
augcagugccuuucuuc

SEQ ID NO: 2744568 - RNA, 15 nt, Human
augcauacacucuca

SEQ ID NO: 2744569 - RNA, 18 nt, Human
augcauacacucucaaag

SEQ ID NO: 2744570 - RNA, 20 nt, Human
augcauauacuuuaauaaau

SEQ ID NO: 2744571 - RNA, 18 nt, Human
augcauauuauuuuaugu

SEQ ID NO: 2744572 - RNA, 21 nt, Human
augcaucuuacugaagguaaa

SEQ ID NO: 2744573 - RNA, 14 nt, Human
augcauuacugcau

SEQ ID NO: 2744574 - RNA, 17 nt, Human
augcauuauaaauaaau

SEQ ID NO: 2744575 - RNA, 21 nt, Human
augccacccaguugugacaau

SEQ ID NO: 2744576 - RNA, 22 nt, Human
augccacuagcccuccucuccc

SEQ ID NO: 2744577 - RNA, 19 nt, Human
augccaucucaaccucuuc

SEQ ID NO: 2744578 - RNA, 16 nt, Human
augccauuuaaagcuu

SEQ ID NO: 2744579 - RNA, 22 nt, Human
augccauuuaaagcuuauuaaa

SEQ ID NO: 2744580 - RNA, 18 nt, Human
augcccaagaaugagaag

SEQ ID NO: 2744581 - RNA, 18 nt, Human
augccccauucaacaucu

SEQ ID NO: 2744582 - RNA, 16 nt, Human
augccccgucccccuc

SEQ ID NO: 2744583 - RNA, 19 nt, Human
augcccggcuaauuuuugu

SEQ ID NO: 2744584 - RNA, 14 nt, Human
augccgcugucucu

SEQ ID NO: 2744585 - RNA, 20 nt, Human
augccugcaaucugagccag

SEQ ID NO: 2744586 - RNA, 20 nt, Human
augccugcccauuggagaga

SEQ ID NO: 2744587 - RNA, 22 nt, Human
augccuuguuucauauuuuuca

SEQ ID NO: 2744588 - RNA, 14 nt, Human
augccuuuucccaa

SEQ ID NO: 2744589 - RNA, 12 nt, Human
augccuuuucuc

SEQ ID NO: 2744590 - RNA, 19 nt, Human
augcgccaccauggccagc

SEQ ID NO: 2744591 - RNA, 16 nt, Human
augcuaagugaaauaa

SEQ ID NO: 2744592 - RNA, 21 nt, Human
augcuaauuauauaauauuuu

SEQ ID NO: 2744593 - RNA, 21 nt, Human
augcuacaggauuugaaauug

SEQ ID NO: 2744594 - RNA, 16 nt, Human
augcuagaacucccuu

SEQ ID NO: 2744595 - RNA, 14 nt, Human
augcuccuccaggg

SEQ ID NO: 2744596 - RNA, 14 nt, Human
augcucugauuuau

SEQ ID NO: 2744597 - RNA, 22 nt, Human
augcucuggacuugccuccaga

SEQ ID NO: 2744598 - RNA, 22 nt, Human
augcugagcccggaaacuccac

SEQ ID NO: 2744599 - RNA, 12 nt, Human
augcugcugggg

SEQ ID NO: 2744600 - RNA, 15 nt, Human
augcugcuggggaag

SEQ ID NO: 2744601 - RNA, 21 nt, Human
augcugcuggggaagacagug

SEQ ID NO: 2744602 - RNA, 23 nt, Human
augcugcuggggaagacaguggc

SEQ ID NO: 2744603 - RNA, 17 nt, Human
augcuggccaggcuggu

SEQ ID NO: 2744604 - RNA, 14 nt, Human
augcugguuuuuca

SEQ ID NO: 2744605 - RNA, 17 nt, Human
augcugguuuuucaguu

SEQ ID NO: 2744606 - RNA, 14 nt, Human
augcuguauucuuc

SEQ ID NO: 2744607 - RNA, 14 nt, Human
augcuguauuuuaa

SEQ ID NO: 2744608 - RNA, 16 nt, Human
augcuguauuuuaaaa

SEQ ID NO: 2744609 - RNA, 13 nt, Human
augcuguucauga

SEQ ID NO: 2744610 - RNA, 17 nt, Human
augcuguucaugaaaga

SEQ ID NO: 2744611 - RNA, 20 nt, Human
augcuucuguuuuauaauuu

SEQ ID NO: 2744612 - RNA, 21 nt, Human
auggaaauacacuguuaucuu

SEQ ID NO: 2744613 - RNA, 22 nt, Human
auggaaauguuuacagaucccc

SEQ ID NO: 2744614 - RNA, 17 nt, Human
auggaacucaaggaaau

SEQ ID NO: 2744615 - RNA, 13 nt, Human
auggaauuggagc

SEQ ID NO: 2744616 - RNA, 14 nt, Human
auggaauuggagcu

SEQ ID NO: 2744617 - RNA, 15 nt, Human
auggaauuggagcuc

SEQ ID NO: 2744618 - RNA, 16 nt, Human
auggaauuggagcucg

SEQ ID NO: 2744619 - RNA, 14 nt, Human
auggacaucaaaau

SEQ ID NO: 2744620 - RNA, 14 nt, Human
auggagacaccacc

SEQ ID NO: 2744621 - RNA, 17 nt, Human
auggagacaccaccacc

SEQ ID NO: 2744622 - RNA, 19 nt, Human
auggagccagcucugcauu

SEQ ID NO: 2744623 - RNA, 13 nt, Human
auggaggaaagug

SEQ ID NO: 2744624 - RNA, 14 nt, Human
auggaggaaaguga

SEQ ID NO: 2744625 - RNA, 15 nt, Human
auggaggccuguccu

SEQ ID NO: 2744626 - RNA, 15 nt, Human
auggagucuugcucu

SEQ ID NO: 2744627 - RNA, 11 nt, Human
auggauaaaga

SEQ ID NO: 2744628 - RNA, 21 nt, Human
auggcagcuuuccucaaaacu

SEQ ID NO: 2744629 - RNA, 14 nt, Human
auggcaggaggcau

SEQ ID NO: 2744630 - RNA, 12 nt, Human
auggcaguggga

SEQ ID NO: 2744631 - RNA, 18 nt, Human
auggccacaucugagccc

SEQ ID NO: 2744632 - RNA, 19 nt, Human
auggccagcuaauuuuugu

SEQ ID NO: 2744633 - RNA, 17 nt, Human
auggccuggcugcugcu

SEQ ID NO: 2744634 - RNA, 20 nt, Human
auggcuaagcaaaaugugau

SEQ ID NO: 2744635 - RNA, 14 nt, Human
auggcuaguaucaa

SEQ ID NO: 2744636 - RNA, 17 nt, Human
auggcuuccuggcaaua

SEQ ID NO: 2744637 - RNA, 18 nt, Human
auggcuugaguuuaaauu

SEQ ID NO: 2744638 - RNA, 21 nt, Human
augggaaagcauuguaaaugu

SEQ ID NO: 2744639 - RNA, 15 nt, Human
augggaacaaggaag

SEQ ID NO: 2744640 - RNA, 19 nt, Human
augggacagggaggacgcu

SEQ ID NO: 2744641 - RNA, 15 nt, Human
augggacauuuuuga

SEQ ID NO: 2744642 - RNA, 17 nt, Human
aucccgauucacccugu

SEQ ID NO: 2744643 - RNA, 15 nt, Human
aucccggccggcgcg

SEQ ID NO: 2744644 - RNA, 16 nt, Human
aucccggccggcgcgc

SEQ ID NO: 2744645 - RNA, 20 nt, Human
aucccggccggcgcgcucau

SEQ ID NO: 2744646 - RNA, 20 nt, Human
aucccuagaaagccaugugc

SEQ ID NO: 2744647 - RNA, 16 nt, Human
aucccucccuccaccu

SEQ ID NO: 2744648 - RNA, 17 nt, Human
aucccucccuccaccuc

SEQ ID NO: 2744649 - RNA, 19 nt, Human
aucccucccuccaccuccc

SEQ ID NO: 2744650 - RNA, 22 nt, Human
aucccucccuccaccucccugc

SEQ ID NO: 2744651 - RNA, 23 nt, Human
aucccucccuccaccucccugca

SEQ ID NO: 2744652 - RNA, 15 nt, Human
aucccucuaucucua

SEQ ID NO: 2744653 - RNA, 17 nt, Human
aucccuuaccugggaaa

SEQ ID NO: 2744654 - RNA, 15 nt, Human
auccuaauaaaaagg

SEQ ID NO: 2744655 - RNA, 15 nt, Human
auccuacaagacaca

SEQ ID NO: 2744656 - RNA, 16 nt, Human
auccuacaagacacag

SEQ ID NO: 2744657 - RNA, 19 nt, Human
auccuacaagacacaguga

SEQ ID NO: 2744658 - RNA, 13 nt, Human
auccuagucucua

SEQ ID NO: 2744659 - RNA, 21 nt, Human
auccuagucucuaucauuaaa

SEQ ID NO: 2744660 - RNA, 16 nt, Human
auccuaucucuccaac

SEQ ID NO: 2744661 - RNA, 16 nt, Human
auccuccacaauagca

SEQ ID NO: 2744662 - RNA, 16 nt, Human
auccuccaugaauauc

SEQ ID NO: 2744663 - RNA, 21 nt, Human
auccucugagugugaccaggc

SEQ ID NO: 2744664 - RNA, 12 nt, Human
auccugaggcuc

SEQ ID NO: 2744665 - RNA, 13 nt, Human
auccugaggcucc

SEQ ID NO: 2744666 - RNA, 14 nt, Human
auccugaggcucca

SEQ ID NO: 2744667 - RNA, 18 nt, Human
auccugaggcuccacuug

SEQ ID NO: 2744668 - RNA, 19 nt, Human
auccugaggcuccacuugg

SEQ ID NO: 2744669 - RNA, 20 nt, Human
auccugaggcuccacuuggu

SEQ ID NO: 2744670 - RNA, 23 nt, Human
auccugaggcuccacuuggucug

SEQ ID NO: 2744671 - RNA, 16 nt, Human
auccugccccugagcc

SEQ ID NO: 2744672 - RNA, 12 nt, Human
auccugugggac

SEQ ID NO: 2744673 - RNA, 17 nt, Human
auccugugggaccuggg

SEQ ID NO: 2744674 - RNA, 18 nt, Human
auccugugggaccugggc

SEQ ID NO: 2744675 - RNA, 21 nt, Human
auccugugggaccugggccau

SEQ ID NO: 2744676 - RNA, 15 nt, Human
auccuuccuuuugag

SEQ ID NO: 2744677 - RNA, 12 nt, Human
auccuugaagau

SEQ ID NO: 2744678 - RNA, 13 nt, Human
auccuugaagauu

SEQ ID NO: 2744679 - RNA, 18 nt, Human
auccuugaagauuuacca

SEQ ID NO: 2744680 - RNA, 16 nt, Human
auccuugucuuuuuau

SEQ ID NO: 2744681 - RNA, 21 nt, Human
aucgacuugccaaauuuagau

SEQ ID NO: 2744682 - RNA, 21 nt, Human
aucgcagacacaugugcuggc

SEQ ID NO: 2744683 - RNA, 19 nt, Human
aucggagcugcuagaguuc

SEQ ID NO: 2744684 - RNA, 21 nt, Human
aucggagcugcuagaguucug

SEQ ID NO: 2744685 - RNA, 13 nt, Human
aucguaaaauuaa

SEQ ID NO: 2744686 - RNA, 14 nt, Human
aucuaaaaaacgaa

SEQ ID NO: 2744687 - RNA, 22 nt, Human
aucuaauagggcaauuaauucc

SEQ ID NO: 2744688 - RNA, 14 nt, Human
aucuacacuccagu

SEQ ID NO: 2744689 - RNA, 19 nt, Human
aucuagaggcuuccuucau

SEQ ID NO: 2744690 - RNA, 22 nt, Human
aucuagaggcuuccuucauuuc

SEQ ID NO: 2744691 - RNA, 13 nt, Human
aucuauauuuuac

SEQ ID NO: 2744692 - RNA, 16 nt, Human
aucuauauuuuacaua

SEQ ID NO: 2744693 - RNA, 18 nt, Human
aucuaugcauuuucugga

SEQ ID NO: 2744694 - RNA, 23 nt, Human
aucuaugccacaagaacccccuu

SEQ ID NO: 2744695 - RNA, 14 nt, Human
aucuauguagaaua

SEQ ID NO: 2744696 - RNA, 19 nt, Human
aucuauguagaauauauuu

SEQ ID NO: 2744697 - RNA, 20 nt, Human
aucuauguagaauauauuuc

SEQ ID NO: 2744698 - RNA, 22 nt, Human
aucuauguagaauauauuuccu

SEQ ID NO: 2744699 - RNA, 17 nt, Human
aucuauuuaaauauuua

SEQ ID NO: 2744700 - RNA, 19 nt, Human
aucuauuuauuaauauuua

SEQ ID NO: 2744701 - RNA, 13 nt, Human
aucuauuuuguaa

SEQ ID NO: 2744702 - RNA, 14 nt, Human
aucuauuuuguaac

SEQ ID NO: 2744703 - RNA, 21 nt, Human
aucucaaacuucuauuuuuau

SEQ ID NO: 2744704 - RNA, 16 nt, Human
aucucaaccucuuccc

SEQ ID NO: 2744705 - RNA, 13 nt, Human
aucucaauauuuc

SEQ ID NO: 2744706 - RNA, 14 nt, Human
aucucaauauuuca

SEQ ID NO: 2744707 - RNA, 15 nt, Human
aucucacaagcacuu

SEQ ID NO: 2744708 - RNA, 19 nt, Human
aucucacauuuucccuucc

SEQ ID NO: 2744709 - RNA, 16 nt, Human
aucucagcucacugca

SEQ ID NO: 2744710 - RNA, 24 nt, Human
aucucaggagauuucaugccuggu

SEQ ID NO: 2744711 - RNA, 14 nt, Human
aucucaucucuucu

SEQ ID NO: 2744712 - RNA, 15 nt, Human
aucucaucucuucuu

SEQ ID NO: 2744713 - RNA, 13 nt, Human
aucucauuuccaa

SEQ ID NO: 2744714 - RNA, 15 nt, Human
aucucccucuucccu

SEQ ID NO: 2744715 - RNA, 22 nt, Human
aucuccgucaacucauauuuuc

SEQ ID NO: 2744716 - RNA, 15 nt, Human
aucucucuucuuuuc

SEQ ID NO: 2744717 - RNA, 19 nt, Human
aucucugauacuuuuuuca

SEQ ID NO: 2744718 - RNA, 20 nt, Human
aucucugauacuuuuuucau

SEQ ID NO: 2744719 - RNA, 11 nt, Human
aucucuucugg

SEQ ID NO: 2744720 - RNA, 11 nt, Human
aucugaaaauu

SEQ ID NO: 2744721 - RNA, 15 nt, Human
aucugagagaugaca

SEQ ID NO: 2744722 - RNA, 22 nt, Human
aucugagagaugacagggaaaa

SEQ ID NO: 2744723 - RNA, 15 nt, Human
aucugagccagugcu

SEQ ID NO: 2744724 - RNA, 21 nt, Human
aucugagucaacuccuuucuc

SEQ ID NO: 2744725 - RNA, 18 nt, Human
aucugccuuuauuguguu

SEQ ID NO: 2744726 - RNA, 15 nt, Human
aucugcuaugcuauu

SEQ ID NO: 2744727 - RNA, 19 nt, Human
aucugcuauucuccauacu

SEQ ID NO: 2744728 - RNA, 12 nt, Human
aucuggcucugg

SEQ ID NO: 2744729 - RNA, 13 nt, Human
aucuggcucugga

SEQ ID NO: 2744730 - RNA, 18 nt, Human
aucuggcucuggacaggc

SEQ ID NO: 2744731 - RNA, 22 nt, Human
aucuggcucuggacaggcacua

SEQ ID NO: 2744732 - RNA, 20 nt, Human
aucugguccaacaugaaaac

SEQ ID NO: 2744733 - RNA, 24 nt, Human
aucugguccuaagucccugcugcc

SEQ ID NO: 2744734 - RNA, 19 nt, Human
aucuguaaaauggagacac

SEQ ID NO: 2744735 - RNA, 20 nt, Human
aucuguaaaauggagacacc

SEQ ID NO: 2744736 - RNA, 21 nt, Human
aucuguaaugccuuuucucac

SEQ ID NO: 2744737 - RNA, 14 nt, Human
aucuguaugucugc

SEQ ID NO: 2744738 - RNA, 17 nt, Human
aucuguaugucugccua

SEQ ID NO: 2744739 - RNA, 17 nt, Human
aucuuaaaugccaggcc

SEQ ID NO: 2744740 - RNA, 15 nt, Human
aucuuaauuauugua

SEQ ID NO: 2744741 - RNA, 18 nt, Human
aucuuacaaugaaaagga

SEQ ID NO: 2744742 - RNA, 13 nt, Human
aucuuauaauuua

SEQ ID NO: 2744743 - RNA, 15 nt, Human
aucuuauaauuuaaa

SEQ ID NO: 2744744 - RNA, 18 nt, Human
aucuuauaauuuaaaaua

SEQ ID NO: 2744745 - RNA, 20 nt, Human
aucuuauaauuuaaaauaug

SEQ ID NO: 2744746 - RNA, 16 nt, Human
aucuuaucauauuuca

SEQ ID NO: 2744747 - RNA, 12 nt, Human
aucuuauuucug

SEQ ID NO: 2744748 - RNA, 12 nt, Human
aucuucagaaaa

SEQ ID NO: 2744749 - RNA, 13 nt, Human
aucuucagaaaac

SEQ ID NO: 2744750 - RNA, 18 nt, Human
aucuucagaccuagaaua

SEQ ID NO: 2744751 - RNA, 23 nt, Human
aucuuccuauaauuuuagacauu

SEQ ID NO: 2744752 - RNA, 13 nt, Human
aucuucuuuugug

SEQ ID NO: 2744753 - RNA, 13 nt, Human
aucuuguaaaggu

SEQ ID NO: 2744754 - RNA, 14 nt, Human
aucuuguuuuucca

SEQ ID NO: 2744755 - RNA, 15 nt, Human
aucuuuaacccacua

SEQ ID NO: 2744756 - RNA, 14 nt, Human
aucuuuaauuuuac

SEQ ID NO: 2744757 - RNA, 16 nt, Human
aucuuucacaggggac

SEQ ID NO: 2744758 - RNA, 20 nt, Human
aucuuucuuucuuagaaauu

SEQ ID NO: 2744759 - RNA, 14 nt, Human
aucuuuuauuuugc

SEQ ID NO: 2744760 - RNA, 20 nt, Human
aucuuuucauacauuuucua

SEQ ID NO: 2744761 - RNA, 17 nt, Human
aucuuuuuacuaaacuc

SEQ ID NO: 2744762 - RNA, 22 nt, Human
aucuuuuuacuaaacucagagg

SEQ ID NO: 2744763 - RNA, 23 nt, Human
augaaaaggcuaagcuucacugu

SEQ ID NO: 2744764 - RNA, 23 nt, Human
augaaacuaagauuuguaauauu

SEQ ID NO: 2744765 - RNA, 22 nt, Human
augaaacucccuaguuccuuca

SEQ ID NO: 2744766 - RNA, 23 nt, Human
augaaacuuuuggaagguauuua

SEQ ID NO: 2744767 - RNA, 18 nt, Human
augaaagaggacaggcua

SEQ ID NO: 2744768 - RNA, 19 nt, Human
augaaagcagggacuugaa

SEQ ID NO: 2744769 - RNA, 20 nt, Human
auauguaccauguacaugaa

SEQ ID NO: 2744770 - RNA, 16 nt, Human
auauguaccuaacgaa

SEQ ID NO: 2744771 - RNA, 16 nt, Human
auauguccuuuuuaau

SEQ ID NO: 2744772 - RNA, 20 nt, Human
auauguuagagaauuuccuu

SEQ ID NO: 2744773 - RNA, 16 nt, Human
auauguucugacauaa

SEQ ID NO: 2744774 - RNA, 16 nt, Human
auauuaccaguuuucc

SEQ ID NO: 2744775 - RNA, 17 nt, Human
auauuaccaguuuuccu

SEQ ID NO: 2744776 - RNA, 12 nt, Human
auauuauaauuu

SEQ ID NO: 2744777 - RNA, 18 nt, Human
auauuauaauuuuuuuca

SEQ ID NO: 2744778 - RNA, 14 nt, Human
auauuaucaugcaa

SEQ ID NO: 2744779 - RNA, 16 nt, Human
auauuauguuaaaacu

SEQ ID NO: 2744780 - RNA, 22 nt, Human
auauuauguuaaaacugggaca

SEQ ID NO: 2744781 - RNA, 14 nt, Human
auauuauuuugaau

SEQ ID NO: 2744782 - RNA, 19 nt, Human
auauuauuuugaauccaga

SEQ ID NO: 2744783 - RNA, 19 nt, Human
auauuccucaguucaucca

SEQ ID NO: 2744784 - RNA, 23 nt, Human
auauucucacagcuccaagaauu

SEQ ID NO: 2744785 - RNA, 17 nt, Human
auauugauuuauuaaua

SEQ ID NO: 2744786 - RNA, 19 nt, Human
auauugcaaggcaaagacu

SEQ ID NO: 2744787 - RNA, 14 nt, Human
auauuggacaguaa

SEQ ID NO: 2744788 - RNA, 19 nt, Human
auauuggacaguaaaaucc

SEQ ID NO: 2744789 - RNA, 16 nt, Human
auauuguacaguuuuu

SEQ ID NO: 2744790 - RNA, 18 nt, Human
auauuguacaguuuuuau

SEQ ID NO: 2744791 - RNA, 19 nt, Human
auauuguuugcuaagcauu

SEQ ID NO: 2744792 - RNA, 21 nt, Human
auauuguuugcuaagcauucc

SEQ ID NO: 2744793 - RNA, 14 nt, Human
auauuuaacauuau

SEQ ID NO: 2744794 - RNA, 14 nt, Human
auauuuaagauaau

SEQ ID NO: 2744795 - RNA, 22 nt, Human
auauuuacaaaugggaaacaaa

SEQ ID NO: 2744796 - RNA, 21 nt, Human
auauuuauaacucaucauaaa

SEQ ID NO: 2744797 - RNA, 14 nt, Human
auauuuauuaccuc

SEQ ID NO: 2744798 - RNA, 15 nt, Human
auauuuauuaccucu

SEQ ID NO: 2744799 - RNA, 22 nt, Human
auauuuauuacuguaagaaaau

SEQ ID NO: 2744800 - RNA, 14 nt, Human
auauuuauuauuuu

SEQ ID NO: 2744801 - RNA, 18 nt, Human
auauuuauuuaacuauuc

SEQ ID NO: 2744802 - RNA, 13 nt, Human
auauuuauuuuaa

SEQ ID NO: 2744803 - RNA, 21 nt, Human
auauuucagauaaucacaaua

SEQ ID NO: 2744804 - RNA, 17 nt, Human
auauuuccaagaaauau

SEQ ID NO: 2744805 - RNA, 17 nt, Human
auauuuccuuauucaga

SEQ ID NO: 2744806 - RNA, 23 nt, Human
auauuuccuuauucagaauuucu

SEQ ID NO: 2744807 - RNA, 15 nt, Human
auauuugaaauauug

SEQ ID NO: 2744808 - RNA, 17 nt, Human
auauuugaaauauugac

SEQ ID NO: 2744809 - RNA, 19 nt, Human
auauuugcaagacauagaa

SEQ ID NO: 2744810 - RNA, 12 nt, Human
auauuuuaaugu

SEQ ID NO: 2744811 - RNA, 15 nt, Human
auauuuuauaucaau

SEQ ID NO: 2744812 - RNA, 20 nt, Human
auauuuuauaucaauuuaaa

SEQ ID NO: 2744813 - RNA, 13 nt, Human
auauuuuauuaua

SEQ ID NO: 2744814 - RNA, 19 nt, Human
auauuuucuuucaaaauua

SEQ ID NO: 2744815 - RNA, 12 nt, Human
auauuuugaaca

SEQ ID NO: 2744816 - RNA, 11 nt, Human
auauuuugcua

SEQ ID NO: 2744817 - RNA, 13 nt, Human
auauuuugcuaac

SEQ ID NO: 2744818 - RNA, 18 nt, Human
auauuuugcuaguuuuug

SEQ ID NO: 2744819 - RNA, 12 nt, Human
auauuuuucuua

SEQ ID NO: 2744820 - RNA, 15 nt, Human
auauuuuuuguuaaa

SEQ ID NO: 2744821 - RNA, 10 nt, Human
auauuuuuuu

SEQ ID NO: 2744822 - RNA, 18 nt, Human
auauuuuuuucugaaauu

SEQ ID NO: 2744823 - RNA, 18 nt, Human
auauuuuuuuuuuuaaaa

SEQ ID NO: 2744824 - RNA, 15 nt, Human
aucaaaagaaagaaa

SEQ ID NO: 2744825 - RNA, 16 nt, Human
aucaaaagaaagaaaa

SEQ ID NO: 2744826 - RNA, 19 nt, Human
aucaaaagacuuuuuccuu

SEQ ID NO: 2744827 - RNA, 16 nt, Human
aucaaacugaagccag

SEQ ID NO: 2744828 - RNA, 17 nt, Human
aucaaacugaagccaga

SEQ ID NO: 2744829 - RNA, 15 nt, Human
aucaaaggacaccau

SEQ ID NO: 2744830 - RNA, 16 nt, Human
aucaaauaaguauuua

SEQ ID NO: 2744831 - RNA, 20 nt, Human
aucaaauuccagaaugauuu

SEQ ID NO: 2744832 - RNA, 20 nt, Human
aucaaccugccagcuggccu

SEQ ID NO: 2744833 - RNA, 17 nt, Human
aucaagaaacuuaaggu

SEQ ID NO: 2744834 - RNA, 21 nt, Human
aucaagccaucggagcugcua

SEQ ID NO: 2744835 - RNA, 17 nt, Human
aucaagcccuuuacuug

SEQ ID NO: 2744836 - RNA, 15 nt, Human
aucaagccuaaaauu

SEQ ID NO: 2744837 - RNA, 13 nt, Human
aucaagccugccu

SEQ ID NO: 2744838 - RNA, 20 nt, Human
aucaaguccuacaagcuaaa

SEQ ID NO: 2744839 - RNA, 15 nt, Human
aucaauccaagaacu

SEQ ID NO: 2744840 - RNA, 13 nt, Human
aucaaugaaugaa

SEQ ID NO: 2744841 - RNA, 16 nt, Human
aucaauuuaaaaaaaa

SEQ ID NO: 2744842 - RNA, 20 nt, Human
aucaauuuuucuuauuucau

SEQ ID NO: 2744843 - RNA, 18 nt, Human
aucacaaaaguauauuca

SEQ ID NO: 2744844 - RNA, 23 nt, Human
aucacaaacucauccauuaaugu

SEQ ID NO: 2744845 - RNA, 13 nt, Human
aucacaaaucuua

SEQ ID NO: 2744846 - RNA, 23 nt, Human
aucacagcuacuugggaggcuga

SEQ ID NO: 2744847 - RNA, 17 nt, Human
aucacaugaacuuguaa

SEQ ID NO: 2744848 - RNA, 12 nt, Human
aucaccaaggag

SEQ ID NO: 2744849 - RNA, 14 nt, Human
aucaccaaggagcc

SEQ ID NO: 2744850 - RNA, 23 nt, Human
aucaccaaggcugauuaaaccaa

SEQ ID NO: 2744851 - RNA, 20 nt, Human
aucacguaaagcuagaaaug

SEQ ID NO: 2744852 - RNA, 14 nt, Human
aucacucauuuauu

SEQ ID NO: 2744853 - RNA, 21 nt, Human
aucacucuguucauuccucca

SEQ ID NO: 2744854 - RNA, 23 nt, Human
aucacugaugacuuuuuauacuu

SEQ ID NO: 2744855 - RNA, 18 nt, Human
aucacugcucacacugcu

SEQ ID NO: 2744856 - RNA, 14 nt, Human
aucacuugaacccg

SEQ ID NO: 2744857 - RNA, 19 nt, Human
aucagacagauggaaaagg

SEQ ID NO: 2744858 - RNA, 18 nt, Human
aucagcaucccuagaaag

SEQ ID NO: 2744859 - RNA, 18 nt, Human
aucagcccugggauagug

SEQ ID NO: 2744860 - RNA, 14 nt, Human
aucaggaaagagag

SEQ ID NO: 2744861 - RNA, 16 nt, Human
aucaggaaagagagca

SEQ ID NO: 2744862 - RNA, 19 nt, Human
aucaggccuagaggccuga

SEQ ID NO: 2744863 - RNA, 13 nt, Human
aucaggcuggcca

SEQ ID NO: 2744864 - RNA, 14 nt, Human
aucaggcuggccaa

SEQ ID NO: 2744865 - RNA, 18 nt, Human
aucaggguuaguauuguc

SEQ ID NO: 2744866 - RNA, 21 nt, Human
aucaguagccagcaucugccu

SEQ ID NO: 2744867 - RNA, 14 nt, Human
aucagucauaacua

SEQ ID NO: 2744868 - RNA, 16 nt, Human
aucaguuacucugaag

SEQ ID NO: 2744869 - RNA, 21 nt, Human
aucaguuacucugaagggcau

SEQ ID NO: 2744870 - RNA, 16 nt, Human
aucaguuauuuuuaaa

SEQ ID NO: 2744871 - RNA, 18 nt, Human
aucaguuauuuuuaaacu

SEQ ID NO: 2744872 - RNA, 22 nt, Human
aucauaaaauaaaguauauaua

SEQ ID NO: 2744873 - RNA, 12 nt, Human
aucauaauauaa

SEQ ID NO: 2744874 - RNA, 15 nt, Human
aucauaauauaaaac

SEQ ID NO: 2744875 - RNA, 18 nt, Human
aucauaauauaaaacagg

SEQ ID NO: 2744876 - RNA, 14 nt, Human
aucauauaauaaau

SEQ ID NO: 2744877 - RNA, 16 nt, Human
aucauauauauacaua

SEQ ID NO: 2744878 - RNA, 21 nt, Human
aucauauuucaaaugauuuuc

SEQ ID NO: 2744879 - RNA, 16 nt, Human
aucaucacauucaggg

SEQ ID NO: 2744880 - RNA, 13 nt, Human
aucauccucaggc

SEQ ID NO: 2744881 - RNA, 11 nt, Human
aucaugugaaa

SEQ ID NO: 2744882 - RNA, 14 nt, Human
aucaugugaaauca

SEQ ID NO: 2744883 - RNA, 20 nt, Human
aucaugugucuucugcccua

SEQ ID NO: 2744884 - RNA, 19 nt, Human
aucauuauuugcagagaca

SEQ ID NO: 2744885 - RNA, 15 nt, Human
aucauugugaaauua

SEQ ID NO: 2744886 - RNA, 12 nt, Human
aucauuuacuuu

SEQ ID NO: 2744887 - RNA, 17 nt, Human
aucauuuacuuuuaaac

SEQ ID NO: 2744888 - RNA, 17 nt, Human
aucauuuaguuauaaaa

SEQ ID NO: 2744889 - RNA, 16 nt, Human
auacaauuauuuuuac

SEQ ID NO: 2744890 - RNA, 15 nt, Human
auacacacucaaauc

SEQ ID NO: 2744891 - RNA, 15 nt, Human
auacacuguuaucuu

SEQ ID NO: 2744892 - RNA, 14 nt, Human
auacacuuuuuaaa

SEQ ID NO: 2744893 - RNA, 16 nt, Human
auacacuuuuuaaaau

SEQ ID NO: 2744894 - RNA, 14 nt, Human
auacaguaauuuua

SEQ ID NO: 2744895 - RNA, 21 nt, Human
auacaguggagacaucuggaa

SEQ ID NO: 2744896 - RNA, 12 nt, Human
auacagugucuu

SEQ ID NO: 2744897 - RNA, 16 nt, Human
auacaguuaaguuuug

SEQ ID NO: 2744898 - RNA, 14 nt, Human
auacauaaaguaug

SEQ ID NO: 2744899 - RNA, 21 nt, Human
auacauacaugcauacacucu

SEQ ID NO: 2744900 - RNA, 22 nt, Human
auacaugcauacacucucaaag

SEQ ID NO: 2744901 - RNA, 12 nt, Human
auacauguaaaa

SEQ ID NO: 2744902 - RNA, 15 nt, Human
auacauguaaaauau

SEQ ID NO: 2744903 - RNA, 17 nt, Human
auacauguaaaauaugu

SEQ ID NO: 2744904 - RNA, 22 nt, Human
auacauuauuggacuuccauuu

SEQ ID NO: 2744905 - RNA, 20 nt, Human
auacauuuucuaagaaacau

SEQ ID NO: 2744906 - RNA, 14 nt, Human
auaccacaggaacc

SEQ ID NO: 2744907 - RNA, 13 nt, Human
auaccauauacag

SEQ ID NO: 2744908 - RNA, 9 nt, Human
auacccaaa

SEQ ID NO: 2744909 - RNA, 18 nt, Human
auacccaugucuacacag

SEQ ID NO: 2744910 - RNA, 18 nt, Human
auaccccuggccaaggaa

SEQ ID NO: 2744911 - RNA, 23 nt, Human
auaccuuccccacaucugagaga

SEQ ID NO: 2744912 - RNA, 16 nt, Human
auacgcaucagacaga

SEQ ID NO: 2744913 - RNA, 18 nt, Human
auacgugggcauucaaau

SEQ ID NO: 2744914 - RNA, 23 nt, Human
auacguuaggaggacaaaaggaa

SEQ ID NO: 2744915 - RNA, 12 nt, Human
auacuaauaaaa

SEQ ID NO: 2744916 - RNA, 12 nt, Human
auacuauauuua

SEQ ID NO: 2744917 - RNA, 14 nt, Human
auacuauauuuuag

SEQ ID NO: 2744918 - RNA, 13 nt, Human
auacuauuuaauu

SEQ ID NO: 2744919 - RNA, 16 nt, Human
auacuauuuaauuauu

SEQ ID NO: 2744920 - RNA, 20 nt, Human
auacuauuuaauuauuucac

SEQ ID NO: 2744921 - RNA, 22 nt, Human
auacucagguuaaugcugaaaa

SEQ ID NO: 2744922 - RNA, 11 nt, Human
auacugaaaua

SEQ ID NO: 2744923 - RNA, 22 nt, Human
auacugaauguaaacaaaggaa

SEQ ID NO: 2744924 - RNA, 18 nt, Human
auacuguauuuuuaccuu

SEQ ID NO: 2744925 - RNA, 16 nt, Human
auacugugugcuaaaa

SEQ ID NO: 2744926 - RNA, 20 nt, Human
auacugugugcuaaaacaag

SEQ ID NO: 2744927 - RNA, 23 nt, Human
auacuuaucuaauguugaguuau

SEQ ID NO: 2744928 - RNA, 23 nt, Human
auacuucauuuaaaauauuuuua

SEQ ID NO: 2744929 - RNA, 20 nt, Human
auacuugguucucuccacca

SEQ ID NO: 2744930 - RNA, 22 nt, Human
auacuuuggccauuacccccag

SEQ ID NO: 2744931 - RNA, 17 nt, Human
auacuuuguaaagacaa

SEQ ID NO: 2744932 - RNA, 18 nt, Human
auagaaacguguauauuu

SEQ ID NO: 2744933 - RNA, 19 nt, Human
auagaacucaguuuuaacu

SEQ ID NO: 2744934 - RNA, 14 nt, Human
auagaacucaugac

SEQ ID NO: 2744935 - RNA, 13 nt, Human
auagaaggguacc

SEQ ID NO: 2744936 - RNA, 15 nt, Human
auagaaguaaaaaca

SEQ ID NO: 2744937 - RNA, 22 nt, Human
auagaauauuuauuaccucuga

SEQ ID NO: 2744938 - RNA, 16 nt, Human
auagacuccugaaaga

SEQ ID NO: 2744939 - RNA, 14 nt, Human
auagagacuuggga

SEQ ID NO: 2744940 - RNA, 14 nt, Human
auagagugggacag

SEQ ID NO: 2744941 - RNA, 21 nt, Human
auagauaaucucuccauuccc

SEQ ID NO: 2744942 - RNA, 18 nt, Human
auagaugcugauggagcc

SEQ ID NO: 2744943 - RNA, 19 nt, Human
auagauucccugagcagga

SEQ ID NO: 2744944 - RNA, 12 nt, Human
auagcaaauaag

SEQ ID NO: 2744945 - RNA, 18 nt, Human
auagcaagugaauuuuuc

SEQ ID NO: 2744946 - RNA, 13 nt, Human
auagcauauguuu

SEQ ID NO: 2744947 - RNA, 22 nt, Human
auagccagguaccuucucaccu

SEQ ID NO: 2744948 - RNA, 18 nt, Human
auagcuacuaauuuuaaa

SEQ ID NO: 2744949 - RNA, 19 nt, Human
auagcuacuaauuuuaaaa

SEQ ID NO: 2744950 - RNA, 14 nt, Human
auagcuuuucccuu

SEQ ID NO: 2744951 - RNA, 14 nt, Human
auaggaaauauuuu

SEQ ID NO: 2744952 - RNA, 18 nt, Human
auaggaauugacccacaa

SEQ ID NO: 2744953 - RNA, 16 nt, Human
auaggcguaacuaauu

SEQ ID NO: 2744954 - RNA, 18 nt, Human
auagggcaauuaauuccu

SEQ ID NO: 2744955 - RNA, 21 nt, Human
auagguuuaauaauuuuuaau

SEQ ID NO: 2744956 - RNA, 14 nt, Human
auagguuuggacaa

SEQ ID NO: 2744957 - RNA, 21 nt, Human
auaguaccaaucauuuuaauu

SEQ ID NO: 2744958 - RNA, 16 nt, Human
auaguaccucugcuau

SEQ ID NO: 2744959 - RNA, 19 nt, Human
auagucauucugccugccc

SEQ ID NO: 2744960 - RNA, 19 nt, Human
auagugaggagcuuugaaa

SEQ ID NO: 2744961 - RNA, 17 nt, Human
auagugaggcaucgcaa

SEQ ID NO: 2744962 - RNA, 19 nt, Human
auagugaggcaucgcaaug

SEQ ID NO: 2744963 - RNA, 10 nt, Human
auagugucuu

SEQ ID NO: 2744964 - RNA, 21 nt, Human
auaguuacccaaauuaagaga

SEQ ID NO: 2744965 - RNA, 14 nt, Human
auaguucuacucca

SEQ ID NO: 2744966 - RNA, 21 nt, Human
auaguucuacuccauuaaaua

SEQ ID NO: 2744967 - RNA, 22 nt, Human
auaguuggaaucauauugugug

SEQ ID NO: 2744968 - RNA, 17 nt, Human
auaguuuuauuaauaaa

SEQ ID NO: 2744969 - RNA, 15 nt, Human
auauaaauaaaaaua

SEQ ID NO: 2744970 - RNA, 22 nt, Human
auauaaauaaaaauaauccuca

SEQ ID NO: 2744971 - RNA, 14 nt, Human
auauaaauggaauu

SEQ ID NO: 2744972 - RNA, 23 nt, Human
auauaacaaugcuguauuuuaaa

SEQ ID NO: 2744973 - RNA, 16 nt, Human
auauaaguguguguuu

SEQ ID NO: 2744974 - RNA, 15 nt, Human
auauaaucagagaua

SEQ ID NO: 2744975 - RNA, 15 nt, Human
auauaaucauuauua

SEQ ID NO: 2744976 - RNA, 18 nt, Human
auauaauguuguuauuua

SEQ ID NO: 2744977 - RNA, 20 nt, Human
auauaauguuguuauuuaaa

SEQ ID NO: 2744978 - RNA, 14 nt, Human
auauaauucuuaug

SEQ ID NO: 2744979 - RNA, 15 nt, Human
auauacauacaugca

SEQ ID NO: 2744980 - RNA, 15 nt, Human
auauacuauauuuau

SEQ ID NO: 2744981 - RNA, 18 nt, Human
auauacuccuaguaauuu

SEQ ID NO: 2744982 - RNA, 20 nt, Human
auauacuugguucucuccac

SEQ ID NO: 2744983 - RNA, 22 nt, Human
auauacuugguucucuccacca

SEQ ID NO: 2744984 - RNA, 14 nt, Human
auauacuuuaauaa

SEQ ID NO: 2744985 - RNA, 19 nt, Human
auauaguuacccaaauuaa

SEQ ID NO: 2744986 - RNA, 14 nt, Human
auauauaacaaugc

SEQ ID NO: 2744987 - RNA, 14 nt, Human
auauauauacauac

SEQ ID NO: 2744988 - RNA, 13 nt, Human
auauauauuuuuu

SEQ ID NO: 2744989 - RNA, 21 nt, Human
auauaugcuaagucuuauaua

SEQ ID NO: 2744990 - RNA, 17 nt, Human
auauauguauuauuuau

SEQ ID NO: 2744991 - RNA, 15 nt, Human
auauauguauuuaua

SEQ ID NO: 2744992 - RNA, 17 nt, Human
auauauguauuuauaaa

SEQ ID NO: 2744993 - RNA, 15 nt, Human
auauaugugaaauaa

SEQ ID NO: 2744994 - RNA, 13 nt, Human
auauauuccacca

SEQ ID NO: 2744995 - RNA, 18 nt, Human
auauauuuauaacucauc

SEQ ID NO: 2744996 - RNA, 18 nt, Human
auauauuuuaaauauuuu

SEQ ID NO: 2744997 - RNA, 13 nt, Human
auaucaaacugaa

SEQ ID NO: 2744998 - RNA, 18 nt, Human
auaucaaacugaaacaaa

SEQ ID NO: 2744999 - RNA, 17 nt, Human
auaucaauuuaaaaaaa

SEQ ID NO: 2745000 - RNA, 15 nt, Human
auaucaauuuccuca

SEQ ID NO: 2745001 - RNA, 15 nt, Human
acuguccauucuucc

SEQ ID NO: 2745002 - RNA, 17 nt, Human
acuguccauucuuccuc

SEQ ID NO: 2745003 - RNA, 22 nt, Human
acugucucuaccaaaaaaagga

SEQ ID NO: 2745004 - RNA, 23 nt, Human
acugucuuguuggacgagaaaac

SEQ ID NO: 2745005 - RNA, 16 nt, Human
acugugcaaauauauc

SEQ ID NO: 2745006 - RNA, 21 nt, Human
acugugcaaauauaucugcua

SEQ ID NO: 2745007 - RNA, 19 nt, Human
acuguguauuuaacugccu

SEQ ID NO: 2745008 - RNA, 18 nt, Human
acugugugcuaaaacaag

SEQ ID NO: 2745009 - RNA, 14 nt, Human
acugugugcucagg

SEQ ID NO: 2745010 - RNA, 18 nt, Human
acugugugcucaggagcc

SEQ ID NO: 2745011 - RNA, 17 nt, Human
acuguuaucuucacuuu

SEQ ID NO: 2745012 - RNA, 18 nt, Human
acuguuaucuucacuuuu

SEQ ID NO: 2745013 - RNA, 17 nt, Human
acuguugcauauaccag

SEQ ID NO: 2745014 - RNA, 13 nt, Human
acuguuugccuuc

SEQ ID NO: 2745015 - RNA, 19 nt, Human
acuuaaaacuguaaauuua

SEQ ID NO: 2745016 - RNA, 19 nt, Human
acuuaagguuaccuuuguu

SEQ ID NO: 2745017 - RNA, 22 nt, Human
acuuaagguuaccuuuguuccc

SEQ ID NO: 2745018 - RNA, 22 nt, Human
acuuaaguagauaaggaaauaa

SEQ ID NO: 2745019 - RNA, 22 nt, Human
acuuaaugccacuaaauugaca

SEQ ID NO: 2745020 - RNA, 14 nt, Human
acuuacauucuuaa

SEQ ID NO: 2745021 - RNA, 21 nt, Human
acuuaccuugcaucucacagg

SEQ ID NO: 2745022 - RNA, 17 nt, Human
acuuaugaaccuuuaca

SEQ ID NO: 2745023 - RNA, 14 nt, Human
acuuauugacuauu

SEQ ID NO: 2745024 - RNA, 22 nt, Human
acuuauuguagcauccuggaau

SEQ ID NO: 2745025 - RNA, 23 nt, Human
acuuauuuauuguuguuggaggc

SEQ ID NO: 2745026 - RNA, 13 nt, Human
acuucaaauccuu

SEQ ID NO: 2745027 - RNA, 15 nt, Human
acuucaaauccuuga

SEQ ID NO: 2745028 - RNA, 18 nt, Human
acuucaauacuucauuua

SEQ ID NO: 2745029 - RNA, 12 nt, Human
acuucacuuuuu

SEQ ID NO: 2745030 - RNA, 16 nt, Human
acuucacuuuuuuucu

SEQ ID NO: 2745031 - RNA, 22 nt, Human
acuucacuuuuuuucuuuucuc

SEQ ID NO: 2745032 - RNA, 12 nt, Human
acuucagacaua

SEQ ID NO: 2745033 - RNA, 14 nt, Human
acuucagccuccca

SEQ ID NO: 2745034 - RNA, 19 nt, Human
acuucagcgguuuauauaa

SEQ ID NO: 2745035 - RNA, 15 nt, Human
acuucauuuaaaaua

SEQ ID NO: 2745036 - RNA, 17 nt, Human
acuucauuuaaaauauu

SEQ ID NO: 2745037 - RNA, 14 nt, Human
acuuccaagagccu

SEQ ID NO: 2745038 - RNA, 17 nt, Human
acuuccagauccuggaa

SEQ ID NO: 2745039 - RNA, 10 nt, Human
acuuccuccc

SEQ ID NO: 2745040 - RNA, 14 nt, Human
acuuccucccggcc

SEQ ID NO: 2745041 - RNA, 22 nt, Human
acuuccucccggccgcgcugcg

SEQ ID NO: 2745042 - RNA, 19 nt, Human
acuuccuuggacucauuuu

SEQ ID NO: 2745043 - RNA, 23 nt, Human
acuuccuuggacucauuuuaaaa

SEQ ID NO: 2745044 - RNA, 14 nt, Human
acuucuauuuuuau

SEQ ID NO: 2745045 - RNA, 22 nt, Human
acuucuccccugguagaaagaa

SEQ ID NO: 2745046 - RNA, 14 nt, Human
acuucuuaggguua

SEQ ID NO: 2745047 - RNA, 20 nt, Human
acuucuuaggguuaugauua

SEQ ID NO: 2745048 - RNA, 16 nt, Human
acuucuugaaaucaau

SEQ ID NO: 2745049 - RNA, 18 nt, Human
acuucuugaaaucaauca

SEQ ID NO: 2745050 - RNA, 17 nt, Human
acuugaacccauauuug

SEQ ID NO: 2745051 - RNA, 21 nt, Human
acuugaacccgggaggcagag

SEQ ID NO: 2745052 - RNA, 17 nt, Human
acuugaaugugucaggu

SEQ ID NO: 2745053 - RNA, 20 nt, Human
acuugaaugugucaggugac

SEQ ID NO: 2745054 - RNA, 16 nt, Human
acuugccauaaaacuu

SEQ ID NO: 2745055 - RNA, 13 nt, Human
acuugccucugca

SEQ ID NO: 2745056 - RNA, 17 nt, Human
acuugcugcaguaugaa

SEQ ID NO: 2745057 - RNA, 18 nt, Human
acuugcugcaguaugaaa

SEQ ID NO: 2745058 - RNA, 16 nt, Human
acuugcugcugagugc

SEQ ID NO: 2745059 - RNA, 14 nt, Human
acuugggaggcuga

SEQ ID NO: 2745060 - RNA, 15 nt, Human
acuugggaggcugag

SEQ ID NO: 2745061 - RNA, 21 nt, Human
acuugggcgggacacaggcuc

SEQ ID NO: 2745062 - RNA, 22 nt, Human
acuuggguaucuucuuuuguga

SEQ ID NO: 2745063 - RNA, 20 nt, Human
acuuggucugugagaugcua

SEQ ID NO: 2745064 - RNA, 18 nt, Human
acuugucauuguuauaua

SEQ ID NO: 2745065 - RNA, 20 nt, Human
acuugucauuguuauauaau

SEQ ID NO: 2745066 - RNA, 23 nt, Human
acuuguggggcuaaggcaggagg

SEQ ID NO: 2745067 - RNA, 12 nt, Human
acuuguugagau

SEQ ID NO: 2745068 - RNA, 14 nt, Human
acuuguuucagagu

SEQ ID NO: 2745069 - RNA, 15 nt, Human
acuuguuuuggaugc

SEQ ID NO: 2745070 - RNA, 16 nt, Human
acuuguuuuggaugcc

SEQ ID NO: 2745071 - RNA, 20 nt, Human
acuuuaacacagugucuggc

SEQ ID NO: 2745072 - RNA, 15 nt, Human
acuuuaauaaaugua

SEQ ID NO: 2745073 - RNA, 22 nt, Human
acuuuauaaaggauuaauguca

SEQ ID NO: 2745074 - RNA, 16 nt, Human
acuuuaucuugaauaa

SEQ ID NO: 2745075 - RNA, 18 nt, Human
acuuuauguaguuuuuau

SEQ ID NO: 2745076 - RNA, 22 nt, Human
acuuuaugugcaucuuauuucu

SEQ ID NO: 2745077 - RNA, 17 nt, Human
acuuuauguuacuacau

SEQ ID NO: 2745078 - RNA, 18 nt, Human
acuuuauguuacuacaug

SEQ ID NO: 2745079 - RNA, 17 nt, Human
acuuuauuuucuauaau

SEQ ID NO: 2745080 - RNA, 21 nt, Human
acuuuauuuuguguuuaggaa

SEQ ID NO: 2745081 - RNA, 14 nt, Human
acuuuccaauaaag

SEQ ID NO: 2745082 - RNA, 20 nt, Human
acuuuccacauucagagcuu

SEQ ID NO: 2745083 - RNA, 15 nt, Human
acuuuccagagacca

SEQ ID NO: 2745084 - RNA, 16 nt, Human
acuuuccagagaccag

SEQ ID NO: 2745085 - RNA, 17 nt, Human
acuuuccccuugguucu

SEQ ID NO: 2745086 - RNA, 20 nt, Human
acuuucuagauuaagauaug

SEQ ID NO: 2745087 - RNA, 21 nt, Human
acuuucuggcaaacguuucuc

SEQ ID NO: 2745088 - RNA, 11 nt, Human
acuuugaagag

SEQ ID NO: 2745089 - RNA, 14 nt, Human
acuuugauuuuaua

SEQ ID NO: 2745090 - RNA, 15 nt, Human
acuuugggaggcuga

SEQ ID NO: 2745091 - RNA, 20 nt, Human
acuuugugaaaaaaaauuuu

SEQ ID NO: 2745092 - RNA, 17 nt, Human
acuuuuaaguugcugau

SEQ ID NO: 2745093 - RNA, 15 nt, Human
acuuuuauaagaaau

SEQ ID NO: 2745094 - RNA, 15 nt, Human
acuuuuccaaugaca

SEQ ID NO: 2745095 - RNA, 21 nt, Human
acuuuuccaaugacauuuugu

SEQ ID NO: 2745096 - RNA, 23 nt, Human
acuuuuccuuugaauccucucuc

SEQ ID NO: 2745097 - RNA, 13 nt, Human
acuuuuuaaaauc

SEQ ID NO: 2745098 - RNA, 19 nt, Human
acuuuuuauugauuuuugg

SEQ ID NO: 2745099 - RNA, 13 nt, Human
acuuuuuccuugg

SEQ ID NO: 2745100 - RNA, 21 nt, Human
acuuuuuuucuuuucucugcc

SEQ ID NO: 2745101 - RNA, 13 nt, Human
acuuuuuuuuaag

SEQ ID NO: 2745102 - RNA, 19 nt, Human
acuuuuuuuuuuuaagagu

SEQ ID NO: 2745103 - RNA, 19 nt, Human
agucaaugaacuuuccaca

SEQ ID NO: 2745104 - RNA, 13 nt, Human
agucaauguuuuc

SEQ ID NO: 2745105 - RNA, 13 nt, Human
agucacagcuaca

SEQ ID NO: 2745106 - RNA, 15 nt, Human
agucaccucauggaa

SEQ ID NO: 2745107 - RNA, 21 nt, Human
agucacuaguuguaauuuuuu

SEQ ID NO: 2745108 - RNA, 21 nt, Human
agucaggaaagagaacuucca

SEQ ID NO: 2745109 - RNA, 16 nt, Human
agucagucugaugaga

SEQ ID NO: 2745110 - RNA, 18 nt, Human
agucagucugaugagaac

SEQ ID NO: 2745111 - RNA, 23 nt, Human
agucauaaccuuaccagauuuuu

SEQ ID NO: 2745112 - RNA, 13 nt, Human
agucauucagaua

SEQ ID NO: 2745113 - RNA, 22 nt, Human
agucauucagauaugauucaaa

SEQ ID NO: 2745114 - RNA, 18 nt, Human
agucauucugccugcccu

SEQ ID NO: 2745115 - RNA, 14 nt, Human
agucauuggcuuua

SEQ ID NO: 2745116 - RNA, 18 nt, Human
agucauuggcuuuauccu

SEQ ID NO: 2745117 - RNA, 22 nt, Human
aguccaggcuuuuuuaucaugu

SEQ ID NO: 2745118 - RNA, 21 nt, Human
agucccagaucaagccugccu

SEQ ID NO: 2745119 - RNA, 23 nt, Human
agucccagaucaagccugccuca

SEQ ID NO: 2745120 - RNA, 11 nt, Human
agucccaggcu

SEQ ID NO: 2745121 - RNA, 17 nt, Human
agucccaggcugagccu

SEQ ID NO: 2745122 - RNA, 13 nt, Human
aguccccagccug

SEQ ID NO: 2745123 - RNA, 17 nt, Human
agucccuccacauuucc

SEQ ID NO: 2745124 - RNA, 19 nt, Human
agucccuccccaaaugcuu

SEQ ID NO: 2745125 - RNA, 15 nt, Human
agucccugcugcccu

SEQ ID NO: 2745126 - RNA, 16 nt, Human
agucccugcugcccuu

SEQ ID NO: 2745127 - RNA, 22 nt, Human
agucccugcugcccuuccccuu

SEQ ID NO: 2745128 - RNA, 23 nt, Human
agucccugcugcccuuccccuuc

SEQ ID NO: 2745129 - RNA, 17 nt, Human
aguccugcaagcagagg

SEQ ID NO: 2745130 - RNA, 18 nt, Human
aguccugcaagcagaggu

SEQ ID NO: 2745131 - RNA, 12 nt, Human
aguccugggauu

SEQ ID NO: 2745132 - RNA, 21 nt, Human
aguccuguaauggaagcaucu

SEQ ID NO: 2745133 - RNA, 14 nt, Human
aguccuucccuuuc

SEQ ID NO: 2745134 - RNA, 19 nt, Human
aguccuucccuuucauuuu

SEQ ID NO: 2745135 - RNA, 22 nt, Human
aguccuugcaucaauuuuucuu

SEQ ID NO: 2745136 - RNA, 18 nt, Human
agucgguuaguggaagca

SEQ ID NO: 2745137 - RNA, 16 nt, Human
agucucaggaaaucaa

SEQ ID NO: 2745138 - RNA, 17 nt, Human
agucucaggaaaucaaa

SEQ ID NO: 2745139 - RNA, 22 nt, Human
agucuccaacggcaagggaaca

SEQ ID NO: 2745140 - RNA, 18 nt, Human
agucucccucccuugggg

SEQ ID NO: 2745141 - RNA, 15 nt, Human
agucucuacccagua

SEQ ID NO: 2745142 - RNA, 23 nt, Human
agucucuacccaguagaugccac

SEQ ID NO: 2745143 - RNA, 15 nt, Human
agucucuaucauuaa

SEQ ID NO: 2745144 - RNA, 16 nt, Human
agucucuaucauuaaa

SEQ ID NO: 2745145 - RNA, 18 nt, Human
agucucuaucauuaaagu

SEQ ID NO: 2745146 - RNA, 17 nt, Human
agucugacuguuuccau

SEQ ID NO: 2745147 - RNA, 17 nt, Human
agucuguuccccauggc

SEQ ID NO: 2745148 - RNA, 21 nt, Human
agucuguuuucccuccuugga

SEQ ID NO: 2745149 - RNA, 13 nt, Human
agucuuauuuccu

SEQ ID NO: 2745150 - RNA, 17 nt, Human
agucuucagcagagaag

SEQ ID NO: 2745151 - RNA, 18 nt, Human
agucuucagcagagaagu

SEQ ID NO: 2745152 - RNA, 13 nt, Human
agucuuccucccu

SEQ ID NO: 2745153 - RNA, 15 nt, Human
agucuuucacauuua

SEQ ID NO: 2745154 - RNA, 22 nt, Human
agucuuucacauuuaaauaaag

SEQ ID NO: 2745155 - RNA, 20 nt, Human
agugaaaaacuauuaacaac

SEQ ID NO: 2745156 - RNA, 21 nt, Human
agugaaaaucuacacuccagu

SEQ ID NO: 2745157 - RNA, 16 nt, Human
agugaaagaaaauaac

SEQ ID NO: 2745158 - RNA, 16 nt, Human
agugaaauauuauuuu

SEQ ID NO: 2745159 - RNA, 15 nt, Human
agugaauaaagucau

SEQ ID NO: 2745160 - RNA, 15 nt, Human
agugacaagcucaca

SEQ ID NO: 2745161 - RNA, 16 nt, Human
agugagacucugucuc

SEQ ID NO: 2745162 - RNA, 22 nt, Human
agugagcuccuaagccauggga

SEQ ID NO: 2745163 - RNA, 19 nt, Human
agugaggagcuuugaaacg

SEQ ID NO: 2745164 - RNA, 19 nt, Human
agugauaagagauguugac

SEQ ID NO: 2745165 - RNA, 23 nt, Human
agugauaucccccagccucaagu

SEQ ID NO: 2745166 - RNA, 22 nt, Human
agugaugucacuagggcaggga

SEQ ID NO: 2745167 - RNA, 15 nt, Human
agugauuuccacagu

SEQ ID NO: 2745168 - RNA, 10 nt, Human
agugauuuua

SEQ ID NO: 2745169 - RNA, 18 nt, Human
agugcacauauccaggca

SEQ ID NO: 2745170 - RNA, 12 nt, Human
agugcagccccg

SEQ ID NO: 2745171 - RNA, 23 nt, Human
agugcaguggcaucaucucagcu

SEQ ID NO: 2745172 - RNA, 23 nt, Human
agugcaguggcgugaucucagcu

SEQ ID NO: 2745173 - RNA, 17 nt, Human
agugcccccaacagcac

SEQ ID NO: 2745174 - RNA, 19 nt, Human
agugcuaguggauuuuaca

SEQ ID NO: 2745175 - RNA, 17 nt, Human
agugcucgcuguugcug

SEQ ID NO: 2745176 - RNA, 15 nt, Human
agugcuggcauuaca

SEQ ID NO: 2745177 - RNA, 18 nt, Human
agugcuucuccagccuca

SEQ ID NO: 2745178 - RNA, 18 nt, Human
agugcuuggcccaggagu

SEQ ID NO: 2745179 - RNA, 19 nt, Human
aguggaacgagacaagcag

SEQ ID NO: 2745180 - RNA, 20 nt, Human
aguggauuuuacauguggcc

SEQ ID NO: 2745181 - RNA, 21 nt, Human
aguggauuuuacauguggccc

SEQ ID NO: 2745182 - RNA, 22 nt, Human
aguggcgcgaucucagcucacu

SEQ ID NO: 2745183 - RNA, 15 nt, Human
aguggcuuuaaugaa

SEQ ID NO: 2745184 - RNA, 17 nt, Human
aguggcuuuaaugaaua

SEQ ID NO: 2745185 - RNA, 16 nt, Human
agugggacaguuccug

SEQ ID NO: 2745186 - RNA, 16 nt, Human
agugggacccugucuc

SEQ ID NO: 2745187 - RNA, 19 nt, Human
agugggagccagggcuguc

SEQ ID NO: 2745188 - RNA, 14 nt, Human
aguggggaagaggg

SEQ ID NO: 2745189 - RNA, 16 nt, Human
agugggggccagccac

SEQ ID NO: 2745190 - RNA, 19 nt, Human
agugggugccccccuugcc

SEQ ID NO: 2745191 - RNA, 13 nt, Human
aguggugacugug

SEQ ID NO: 2745192 - RNA, 19 nt, Human
aguggugacugugggcucc

SEQ ID NO: 2745193 - RNA, 17 nt, Human
aguguacagucuuguau

SEQ ID NO: 2745194 - RNA, 18 nt, Human
agugucaaugcagccccc

SEQ ID NO: 2745195 - RNA, 13 nt, Human
agugucuggcacu

SEQ ID NO: 2745196 - RNA, 15 nt, Human
agugucuuaauuaaa

SEQ ID NO: 2745197 - RNA, 17 nt, Human
agugucuuaauuaaaag

SEQ ID NO: 2745198 - RNA, 18 nt, Human
agugucuuaauuaaaaga

SEQ ID NO: 2745199 - RNA, 14 nt, Human
agugugaccaggca

SEQ ID NO: 2745200 - RNA, 15 nt, Human
agugugaggaaaacc

SEQ ID NO: 2745201 - RNA, 19 nt, Human
aguguguguuuuucauaaa

SEQ ID NO: 2745202 - RNA, 14 nt, Human
aguguuaagcguug

SEQ ID NO: 2745203 - RNA, 19 nt, Human
aguguuaucagucauaacu

SEQ ID NO: 2745204 - RNA, 17 nt, Human
aguguucauaaauaaag

SEQ ID NO: 2745205 - RNA, 13 nt, Human
aguguucccuggg

SEQ ID NO: 2745206 - RNA, 19 nt, Human
aguguuuuaagauaaauua

SEQ ID NO: 2745207 - RNA, 20 nt, Human
aguguuuuaggagcaugagu

SEQ ID NO: 2745208 - RNA, 16 nt, Human
aguuacacauuuuuca

SEQ ID NO: 2745209 - RNA, 20 nt, Human
aguuagaaaguugauuuuaa

SEQ ID NO: 2745210 - RNA, 21 nt, Human
aguuagcuuucuuccuggauu

SEQ ID NO: 2745211 - RNA, 12 nt, Human
aguuauaaaaau

SEQ ID NO: 2745212 - RNA, 16 nt, Human
aguuauguagaaaaaa

SEQ ID NO: 2745213 - RNA, 20 nt, Human
aguuauugcaagaguuuaau

SEQ ID NO: 2745214 - RNA, 14 nt, Human
aguuauuuuuaaac

SEQ ID NO: 2745215 - RNA, 23 nt, Human
aguuauuuuuaauuugguuuuca

SEQ ID NO: 2745216 - RNA, 19 nt, Human
aguucaauauaagcuuuuc

SEQ ID NO: 2745217 - RNA, 21 nt, Human
aguucaauauaagcuuuucuu

SEQ ID NO: 2745218 - RNA, 16 nt, Human
aguucagagcugcccu

SEQ ID NO: 2745219 - RNA, 17 nt, Human
aguucagagcugcccuc

SEQ ID NO: 2745220 - RNA, 19 nt, Human
aguucagagcugcccucuc

SEQ ID NO: 2745221 - RNA, 20 nt, Human
aguucagagcugcccucucc

SEQ ID NO: 2745222 - RNA, 17 nt, Human
aguuccccuauguggaa

SEQ ID NO: 2745223 - RNA, 18 nt, Human
aguucccucuugcucagu

SEQ ID NO: 2745224 - RNA, 20 nt, Human
aguuccugagaccagccaac

SEQ ID NO: 2745225 - RNA, 22 nt, Human
aguuccuucauguaacuucccu

SEQ ID NO: 2745226 - RNA, 13 nt, Human
aguucucagaauc

SEQ ID NO: 2745227 - RNA, 18 nt, Human
aguucuccacuagcuaug

SEQ ID NO: 2745228 - RNA, 16 nt, Human
aguucucuugauuuuc

SEQ ID NO: 2745229 - RNA, 14 nt, Human
aguucuguagaaau

SEQ ID NO: 2745230 - RNA, 15 nt, Human
aguucuucaaagaua

SEQ ID NO: 2745231 - RNA, 18 nt, Human
aguucuucaaagauaggg

SEQ ID NO: 2745232 - RNA, 15 nt, Human
aguucuuuggcugaa

SEQ ID NO: 2745233 - RNA, 22 nt, Human
aguucuuuggcugaaaggaagc

SEQ ID NO: 2745234 - RNA, 13 nt, Human
aguugaaaaucuu

SEQ ID NO: 2745235 - RNA, 15 nt, Human
aguugagacaagaaa

SEQ ID NO: 2745236 - RNA, 16 nt, Human
aguugagacaagaaaa

SEQ ID NO: 2745237 - RNA, 20 nt, Human
aguugagacaagaaaauaag

SEQ ID NO: 2745238 - RNA, 20 nt, Human
aguugauaugccuuuuccca

SEQ ID NO: 2745239 - RNA, 20 nt, Human
aguugauuaagaaaggaagu

SEQ ID NO: 2745240 - RNA, 19 nt, Human
aguugauuuaaggccaggc

SEQ ID NO: 2745241 - RNA, 12 nt, Human
aguugcaacuuu

SEQ ID NO: 2745242 - RNA, 13 nt, Human
aguugcaacuuug

SEQ ID NO: 2745243 - RNA, 16 nt, Human
aguugcagugagcuga

SEQ ID NO: 2745244 - RNA, 17 nt, Human
aguuggggacacaugua

SEQ ID NO: 2745245 - RNA, 22 nt, Human
aguugguaucaaccaaauggag

SEQ ID NO: 2745246 - RNA, 13 nt, Human
aguuguaauuuuu

SEQ ID NO: 2745247 - RNA, 19 nt, Human
guguguuuuaaacugguag

SEQ ID NO: 2745248 - RNA, 13 nt, Human
guguuaacuugcu

SEQ ID NO: 2745249 - RNA, 20 nt, Human
guguugcagugucugcugga

SEQ ID NO: 2745250 - RNA, 13 nt, Human
guguuggccagga

SEQ ID NO: 2745251 - RNA, 14 nt, Human
guguuuuaaaauga

SEQ ID NO: 2745252 - RNA, 20 nt, Human
guuaaacuuacuuaguguua

SEQ ID NO: 2745253 - RNA, 21 nt, Human
guuaaagggccaaaaguaucc

SEQ ID NO: 2745254 - RNA, 11 nt, Human
guuaaaugauu

SEQ ID NO: 2745255 - RNA, 14 nt, Human
guuaagcaacaucu

SEQ ID NO: 2745256 - RNA, 12 nt, Human
guuaauaaaagu

SEQ ID NO: 2745257 - RNA, 13 nt, Human
guuaauauggugu

SEQ ID NO: 2745258 - RNA, 15 nt, Human
guuaaugcucuggac

SEQ ID NO: 2745259 - RNA, 14 nt, Human
guuacauuauuauc

SEQ ID NO: 2745260 - RNA, 16 nt, Human
guuaccucugccucag

SEQ ID NO: 2745261 - RNA, 21 nt, Human
guuagaaaaguuauguagaaa

SEQ ID NO: 2745262 - RNA, 16 nt, Human
guuagagaauuuccuu

SEQ ID NO: 2745263 - RNA, 17 nt, Human
guuagagaauuuccuua

SEQ ID NO: 2745264 - RNA, 17 nt, Human
guuagccaauauuuuuc

SEQ ID NO: 2745265 - RNA, 15 nt, Human
guuagccaggcuggu

SEQ ID NO: 2745266 - RNA, 23 nt, Human
guuaggaggguuucauugucugu

SEQ ID NO: 2745267 - RNA, 18 nt, Human
guuaggguuggagcaggg

SEQ ID NO: 2745268 - RNA, 14 nt, Human
guuauaauaaaugu

SEQ ID NO: 2745269 - RNA, 17 nt, Human
guuauaaucauuuauca

SEQ ID NO: 2745270 - RNA, 14 nt, Human
guuauauaaucauu

SEQ ID NO: 2745271 - RNA, 17 nt, Human
guuaucuaauagggcaa

SEQ ID NO: 2745272 - RNA, 15 nt, Human
guuaucuucacuuuu

SEQ ID NO: 2745273 - RNA, 16 nt, Human
guuaucuucacuuuua

SEQ ID NO: 2745274 - RNA, 17 nt, Human
guuaucuucacuuuuau

SEQ ID NO: 2745275 - RNA, 16 nt, Human
guuaugauuaaguaau

SEQ ID NO: 2745276 - RNA, 20 nt, Human
guuaugauuaaguaaugaua

SEQ ID NO: 2745277 - RNA, 16 nt, Human
guuauuauauuuacaa

SEQ ID NO: 2745278 - RNA, 13 nt, Human
guuauuauuaaau

SEQ ID NO: 2745279 - RNA, 20 nt, Human
guuauuuagggaacugcuug

SEQ ID NO: 2745280 - RNA, 21 nt, Human
guuauuuuuaaacuguaaagc

SEQ ID NO: 2745281 - RNA, 13 nt, Human
guucaaaacuuau

SEQ ID NO: 2745282 - RNA, 18 nt, Human
guucaaagccaaguuuau

SEQ ID NO: 2745283 - RNA, 11 nt, Human
guucaagauug

SEQ ID NO: 2745284 - RNA, 19 nt, Human
guucaagcaauccucccac

SEQ ID NO: 2745285 - RNA, 20 nt, Human
guucaagcaauccucccacu

SEQ ID NO: 2745286 - RNA, 22 nt, Human
guucaagcgauucuccugccuc

SEQ ID NO: 2745287 - RNA, 15 nt, Human
guucaaguccugccu

SEQ ID NO: 2745288 - RNA, 18 nt, Human
guucaaguccugccucuu

SEQ ID NO: 2745289 - RNA, 12 nt, Human
guucaagugcuu

SEQ ID NO: 2745290 - RNA, 20 nt, Human
guucacagccagacuggcac

SEQ ID NO: 2745291 - RNA, 14 nt, Human
guucagagcugccc

SEQ ID NO: 2745292 - RNA, 16 nt, Human
guucagagcugcccuc

SEQ ID NO: 2745293 - RNA, 12 nt, Human
guucaucaauga

SEQ ID NO: 2745294 - RNA, 16 nt, Human
guucaugcaaacuuua

SEQ ID NO: 2745295 - RNA, 17 nt, Human
guucauuccuccaggua

SEQ ID NO: 2745296 - RNA, 16 nt, Human
guuccaguggcggcac

SEQ ID NO: 2745297 - RNA, 14 nt, Human
guucccaccaggcu

SEQ ID NO: 2745298 - RNA, 18 nt, Human
guucccggguagccacug

SEQ ID NO: 2745299 - RNA, 18 nt, Human
guuccuaaccagccuggu

SEQ ID NO: 2745300 - RNA, 22 nt, Human
guuccugagaccagccaaccug

SEQ ID NO: 2745301 - RNA, 20 nt, Human
guuccuuccucugagccuug

SEQ ID NO: 2745302 - RNA, 14 nt, Human
guuccuucugcucc

SEQ ID NO: 2745303 - RNA, 17 nt, Human
guuccuuucucugggcu

SEQ ID NO: 2745304 - RNA, 17 nt, Human
guuccuuuuaaagaaac

SEQ ID NO: 2745305 - RNA, 15 nt, Human
guucuaagaagugaa

SEQ ID NO: 2745306 - RNA, 13 nt, Human
guucuauaacaac

SEQ ID NO: 2745307 - RNA, 23 nt, Human
guucuaugagggcuaauaucuua

SEQ ID NO: 2745308 - RNA, 17 nt, Human
guucucccaccaccuca

SEQ ID NO: 2745309 - RNA, 22 nt, Human
guucucuaucauuuaauaauau

SEQ ID NO: 2745310 - RNA, 16 nt, Human
guucucuucuuuaaag

SEQ ID NO: 2745311 - RNA, 13 nt, Human
guucugauauugg

SEQ ID NO: 2745312 - RNA, 16 nt, Human
guucugcacacagcac

SEQ ID NO: 2745313 - RNA, 20 nt, Human
guucugcagauaaacaguag

SEQ ID NO: 2745314 - RNA, 16 nt, Human
guucuugugaacccaa

SEQ ID NO: 2745315 - RNA, 21 nt, Human
guucuuucuuuaaagcaggau

SEQ ID NO: 2745316 - RNA, 19 nt, Human
guugaacacuuuuuuauau

SEQ ID NO: 2745317 - RNA, 15 nt, Human
guugaagagguuuua

SEQ ID NO: 2745318 - RNA, 16 nt, Human
guugaagagguuuuaa

SEQ ID NO: 2745319 - RNA, 14 nt, Human
guugaauuuuacau

SEQ ID NO: 2745320 - RNA, 21 nt, Human
guugagacaagaaaauaagag

SEQ ID NO: 2745321 - RNA, 13 nt, Human
guugagccaccaa

SEQ ID NO: 2745322 - RNA, 16 nt, Human
guugagguaccuccaa

SEQ ID NO: 2745323 - RNA, 20 nt, Human
guugagguaccuccaaggac

SEQ ID NO: 2745324 - RNA, 12 nt, Human
guugauggaaau

SEQ ID NO: 2745325 - RNA, 16 nt, Human
guugauggaaauacac

SEQ ID NO: 2745326 - RNA, 17 nt, Human
guugcaacuuuguauaa

SEQ ID NO: 2745327 - RNA, 15 nt, Human
guugcagugagcuga

SEQ ID NO: 2745328 - RNA, 19 nt, Human
guugcauagaauaaaauuu

SEQ ID NO: 2745329 - RNA, 15 nt, Human
guugccaaggcugga

SEQ ID NO: 2745330 - RNA, 18 nt, Human
guugccuaauuuguuuuc

SEQ ID NO: 2745331 - RNA, 17 nt, Human
guugcugccugcccuau

SEQ ID NO: 2745332 - RNA, 16 nt, Human
guuggaaaaugugcaa

SEQ ID NO: 2745333 - RNA, 18 nt, Human
guuggaaaaugugcaaua

SEQ ID NO: 2745334 - RNA, 22 nt, Human
guuggagcaggggugcugggac

SEQ ID NO: 2745335 - RNA, 13 nt, Human
guuggaggcugca

SEQ ID NO: 2745336 - RNA, 14 nt, Human
guuggauuuuuguc

SEQ ID NO: 2745337 - RNA, 12 nt, Human
guuggccaggcu

SEQ ID NO: 2745338 - RNA, 23 nt, Human
guuguaauuuuuuugugggaaau

SEQ ID NO: 2745339 - RNA, 13 nt, Human
guuguaccgcaau

SEQ ID NO: 2745340 - RNA, 23 nt, Human
guuguagguaauauugcaaggca

SEQ ID NO: 2745341 - RNA, 22 nt, Human
guuguauuagauguucucuauc

SEQ ID NO: 2745342 - RNA, 19 nt, Human
guuguauuauuuuuuaaaa

SEQ ID NO: 2745343 - RNA, 15 nt, Human
guugucuuuuccuuc

SEQ ID NO: 2745344 - RNA, 13 nt, Human
guuguguuuuuaa

SEQ ID NO: 2745345 - RNA, 22 nt, Human
guuuaacguuuucauuaaaauu

SEQ ID NO: 2745346 - RNA, 13 nt, Human
guuuaaguucuau

SEQ ID NO: 2745347 - RNA, 17 nt, Human
guuuaauaauuuuuaau

SEQ ID NO: 2745348 - RNA, 14 nt, Human
guuuaauuaaaauc

SEQ ID NO: 2745349 - RNA, 14 nt, Human
guuuaauucugaaa

SEQ ID NO: 2745350 - RNA, 14 nt, Human
guuuaccagaaagc

SEQ ID NO: 2745351 - RNA, 17 nt, Human
guuuaccagaaagcagu

SEQ ID NO: 2745352 - RNA, 20 nt, Human
guuuagaaagcuugcccugg

SEQ ID NO: 2745353 - RNA, 19 nt, Human
guuuauauagaaauguauu

SEQ ID NO: 2745354 - RNA, 15 nt, Human
guuuauuucuuaaau

SEQ ID NO: 2745355 - RNA, 19 nt, Human
guuuauuuguuuuuccagu

SEQ ID NO: 2745356 - RNA, 18 nt, Human
guuucaaacauauauaac

SEQ ID NO: 2745357 - RNA, 23 nt, Human
guuucacaagugaaaaacaucca

SEQ ID NO: 2745358 - RNA, 16 nt, Human
guuucacaccuuaucu

SEQ ID NO: 2745359 - RNA, 22 nt, Human
guuucaccauguuggccaggcu

SEQ ID NO: 2745360 - RNA, 22 nt, Human
guuucauaagaauucuguugau

SEQ ID NO: 2745361 - RNA, 21 nt, Human
guuucauccgcaaauuuucuu

SEQ ID NO: 2745362 - RNA, 17 nt, Human
guuuccauagggugaca

SEQ ID NO: 2745363 - RNA, 15 nt, Human
guuuccuagcgcagc

SEQ ID NO: 2745364 - RNA, 16 nt, Human
guuucugaguuccugc

SEQ ID NO: 2745365 - RNA, 17 nt, Human
guuucugaguuccugca

SEQ ID NO: 2745366 - RNA, 20 nt, Human
guuucugaguuccugcaugc

SEQ ID NO: 2745367 - RNA, 15 nt, Human
guuucugaguuuuac

SEQ ID NO: 2745368 - RNA, 14 nt, Human
guuucuuccacagu

SEQ ID NO: 2745369 - RNA, 22 nt, Human
guuucuucuuuaggcauuaaau

SEQ ID NO: 2745370 - RNA, 16 nt, Human
guuucuuuaguuuuug

SEQ ID NO: 2745371 - RNA, 17 nt, Human
guuucuuuaguuuuugu

SEQ ID NO: 2745372 - RNA, 15 nt, Human
guuucuuucuuucuu

SEQ ID NO: 2745373 - RNA, 17 nt, Human
guuugcaucugaaaauu

SEQ ID NO: 2745374 - RNA, 15 nt, Human
guuugcauguucacu

SEQ ID NO: 2745375 - RNA, 20 nt, Human
guuuggaggcucucuugugc

SEQ ID NO: 2745376 - RNA, 23 nt, Human
guuuguacacaacaauccuucua

SEQ ID NO: 2745377 - RNA, 12 nt, Human
guuuuaauaauu

SEQ ID NO: 2745378 - RNA, 14 nt, Human
guuuuacaaagggg

SEQ ID NO: 2745379 - RNA, 17 nt, Human
guuuuaggaauacauaa

SEQ ID NO: 2745380 - RNA, 13 nt, Human
guuuuauaugcuu

SEQ ID NO: 2745381 - RNA, 18 nt, Human
guuuuauaugcuucuguu

SEQ ID NO: 2745382 - RNA, 22 nt, Human
guuuuauaugcuucuguuuuau

SEQ ID NO: 2745383 - RNA, 19 nt, Human
guuuuauuguuuaaaauca

SEQ ID NO: 2745384 - RNA, 22 nt, Human
guuuucaggaguggguugauuu

SEQ ID NO: 2745385 - RNA, 12 nt, Human
guuuucuuucua

SEQ ID NO: 2745386 - RNA, 16 nt, Human
guuuuguuucuuccuu

SEQ ID NO: 2745387 - RNA, 21 nt, Human
guuuuuauauaugugaaauaa

SEQ ID NO: 2745388 - RNA, 23 nt, Human
guuuuuuuuuuuuuugagacaga

SEQ ID NO: 2745389 - RNA, 14 nt, Human
uaaaaaaaaauacu

SEQ ID NO: 2745390 - RNA, 18 nt, Human
uaaaaaaggaauccucug

SEQ ID NO: 2745391 - RNA, 19 nt, Human
uaaaaaaggaauccucugu

SEQ ID NO: 2745392 - RNA, 21 nt, Human
uaaaaaauggaacauaaaaua

SEQ ID NO: 2745393 - RNA, 17 nt, Human
uaaaaacaaagaaauua

SEQ ID NO: 2745394 - RNA, 18 nt, Human
uaaaaacaaagaaauuau

SEQ ID NO: 2745395 - RNA, 21 nt, Human
uaaaaaggcauguaauugcuu

SEQ ID NO: 2745396 - RNA, 15 nt, Human
uaaaaauaaaaaaca

SEQ ID NO: 2745397 - RNA, 19 nt, Human
uaaaaauaaaaauaaauuu

SEQ ID NO: 2745398 - RNA, 11 nt, Human
uaaaaauaaau

SEQ ID NO: 2745399 - RNA, 13 nt, Human
uaaaaauaaauuu

SEQ ID NO: 2745400 - RNA, 16 nt, Human
uaaaaaugcauauacu

SEQ ID NO: 2745401 - RNA, 20 nt, Human
uaaaacaagcacuaaacaaa

SEQ ID NO: 2745402 - RNA, 20 nt, Human
uaaaacagggccacauagau

SEQ ID NO: 2745403 - RNA, 18 nt, Human
uaaaacugggacagggga

SEQ ID NO: 2745404 - RNA, 17 nt, Human
uaaaacuguaaauuuau

SEQ ID NO: 2745405 - RNA, 18 nt, Human
uaaaacuguaaauuuauu

SEQ ID NO: 2745406 - RNA, 15 nt, Human
uaaaacuuuuccaau

SEQ ID NO: 2745407 - RNA, 15 nt, Human
uaaaagacaaggaaa

SEQ ID NO: 2745408 - RNA, 17 nt, Human
uaaaagacaaggaaaaa

SEQ ID NO: 2745409 - RNA, 20 nt, Human
uaaaagacaaggaaaaaaua

SEQ ID NO: 2745410 - RNA, 16 nt, Human
uaaaagacagugaaag

SEQ ID NO: 2745411 - RNA, 17 nt, Human
uaaaagacagugaaaga

SEQ ID NO: 2745412 - RNA, 19 nt, Human
uaaaagacagugaaagaaa

SEQ ID NO: 2745413 - RNA, 20 nt, Human
uaaaagacagugaaagaaaa

SEQ ID NO: 2745414 - RNA, 15 nt, Human
uaaaagaugaaaaua

SEQ ID NO: 2745415 - RNA, 18 nt, Human
uaaaagauggggucugua

SEQ ID NO: 2745416 - RNA, 21 nt, Human
uaaaagauggggucuguaaaa

SEQ ID NO: 2745417 - RNA, 14 nt, Human
uaaaagcacuuacu

SEQ ID NO: 2745418 - RNA, 16 nt, Human
uaaaaggaaagaaaau

SEQ ID NO: 2745419 - RNA, 18 nt, Human
uaaaagggacugagaaau

SEQ ID NO: 2745420 - RNA, 19 nt, Human
uaaaagggacugagaaauu

SEQ ID NO: 2745421 - RNA, 22 nt, Human
uaaaagggacugagaaauuuau

SEQ ID NO: 2745422 - RNA, 17 nt, Human
uaaaaguacauguuaaa

SEQ ID NO: 2745423 - RNA, 19 nt, Human
uaaaaguacauguuaaacu

SEQ ID NO: 2745424 - RNA, 20 nt, Human
uaaaaguacauguuaaacuu

SEQ ID NO: 2745425 - RNA, 13 nt, Human
uaaaaguuuaagu

SEQ ID NO: 2745426 - RNA, 21 nt, Human
uaaaaguuuuuuauuaugcau

SEQ ID NO: 2745427 - RNA, 16 nt, Human
uaaaauaaaaugaagu

SEQ ID NO: 2745428 - RNA, 17 nt, Human
uaaaauaaaguauauau

SEQ ID NO: 2745429 - RNA, 14 nt, Human
uaaaauaaauuauu

SEQ ID NO: 2745430 - RNA, 22 nt, Human
uaaaauacacacucaaaucaag

SEQ ID NO: 2745431 - RNA, 15 nt, Human
uaaaauaugcucuaa

SEQ ID NO: 2745432 - RNA, 17 nt, Human
uaaaauaugcucuaaac

SEQ ID NO: 2745433 - RNA, 23 nt, Human
uaaaaucagccaauuauguuaaa

SEQ ID NO: 2745434 - RNA, 19 nt, Human
uaaaaucauuucugcauca

SEQ ID NO: 2745435 - RNA, 22 nt, Human
uaaaaucauuucugcaucagcu

SEQ ID NO: 2745436 - RNA, 14 nt, Human
uaaaauccauacau

SEQ ID NO: 2745437 - RNA, 16 nt, Human
uaaaauccauacauuu

SEQ ID NO: 2745438 - RNA, 18 nt, Human
uaaaauccauacauuugu

SEQ ID NO: 2745439 - RNA, 16 nt, Human
uaaaaucuaauucaaa

SEQ ID NO: 2745440 - RNA, 21 nt, Human
uaaaaucuuucuuucuuagaa

SEQ ID NO: 2745441 - RNA, 14 nt, Human
uaaaaugaauacaa

SEQ ID NO: 2745442 - RNA, 10 nt, Human
uaaaauggug

SEQ ID NO: 2745443 - RNA, 22 nt, Human
uaaaauggugugaccacugcag

SEQ ID NO: 2745444 - RNA, 23 nt, Human
uaaaauggugugaccacugcaga

SEQ ID NO: 2745445 - RNA, 20 nt, Human
uaaaaugucuauuuuuaaug

SEQ ID NO: 2745446 - RNA, 17 nt, Human
uaaaauguuagaaaaaa

SEQ ID NO: 2745447 - RNA, 20 nt, Human
uaaaauucauuccauuugcu

SEQ ID NO: 2745448 - RNA, 12 nt, Human
uaaaauugaaag

SEQ ID NO: 2745449 - RNA, 16 nt, Human
uaaaauuuuuaaucuu

SEQ ID NO: 2745450 - RNA, 17 nt, Human
uaaaauuuuuuuagaaa

SEQ ID NO: 2745451 - RNA, 19 nt, Human
uaaaauuuuuuuagaaagc

SEQ ID NO: 2745452 - RNA, 17 nt, Human
uaaacaaaaaaagcauu

SEQ ID NO: 2745453 - RNA, 14 nt, Human
uaaacaaaggaauu

SEQ ID NO: 2745454 - RNA, 17 nt, Human
uaaacacauuaggaaaa

SEQ ID NO: 2745455 - RNA, 18 nt, Human
uaaacacucuugaaaaau

SEQ ID NO: 2745456 - RNA, 21 nt, Human
uaaacacucuugaaaaaugca

SEQ ID NO: 2745457 - RNA, 15 nt, Human
uaaacaguagugaua

SEQ ID NO: 2745458 - RNA, 18 nt, Human
uaaacaucagcaaaaaag

SEQ ID NO: 2745459 - RNA, 14 nt, Human
uaaacauuaauauu

SEQ ID NO: 2745460 - RNA, 20 nt, Human
uaaaccuuuuuggacacaca

SEQ ID NO: 2745461 - RNA, 16 nt, Human
uaaacgucuuaaauau

SEQ ID NO: 2745462 - RNA, 22 nt, Human
uaaacuaaggcccucuugaauc

SEQ ID NO: 2745463 - RNA, 12 nt, Human
uaaacucagagg

SEQ ID NO: 2745464 - RNA, 19 nt, Human
uaaacuggaaauaaaagau

SEQ ID NO: 2745465 - RNA, 22 nt, Human
uaaacuguaaagcuuugugcag

SEQ ID NO: 2745466 - RNA, 21 nt, Human
uaaacuuaccugggcauucuu

SEQ ID NO: 2745467 - RNA, 16 nt, Human
uaaacuuugauuuuau

SEQ ID NO: 2745468 - RNA, 16 nt, Human
uaaagaaaaucucugu

SEQ ID NO: 2745469 - RNA, 13 nt, Human
uaaagaaacaaaa

SEQ ID NO: 2745470 - RNA, 19 nt, Human
uaaagaacacccuauauuu

SEQ ID NO: 2745471 - RNA, 24 nt, Human
uaaagaaggugugggccagacaag

SEQ ID NO: 2745472 - RNA, 16 nt, Human
uaaagaauuauuuugu

SEQ ID NO: 2745473 - RNA, 14 nt, Human
uaaagaauuuuaaa

SEQ ID NO: 2745474 - RNA, 23 nt, Human
uaaagacaauuguuggagagccc

SEQ ID NO: 2745475 - RNA, 15 nt, Human
uaaagcaauguggua

SEQ ID NO: 2745476 - RNA, 20 nt, Human
uaaagcaguggacaccagga

SEQ ID NO: 2745477 - RNA, 20 nt, Human
uaaagcuguguggcagucug

SEQ ID NO: 2745478 - RNA, 16 nt, Human
uaaagcuguuauuuaa

SEQ ID NO: 2745479 - RNA, 15 nt, Human
uaaagcuuauuaaaa

SEQ ID NO: 2745480 - RNA, 20 nt, Human
uaaagcuuauuaaaacucau

SEQ ID NO: 2745481 - RNA, 14 nt, Human
uaaagcuuccauug

SEQ ID NO: 2745482 - RNA, 14 nt, Human
uaaaggaaacccag

SEQ ID NO: 2745483 - RNA, 16 nt, Human
uaaaggcuaugauugu

SEQ ID NO: 2745484 - RNA, 22 nt, Human
uaaagguucaugcaaacuuuau

SEQ ID NO: 2745485 - RNA, 15 nt, Human
uaaaguaaaggcaaa

SEQ ID NO: 2745486 - RNA, 23 nt, Human
uaaaguaucaggauacuauauuu

SEQ ID NO: 2745487 - RNA, 14 nt, Human
uaaaguaugugcau

SEQ ID NO: 2745488 - RNA, 14 nt, Human
uaaaguauuuaauu

SEQ ID NO: 2745489 - RNA, 19 nt, Human
uaaagucaagauuuccaua

SEQ ID NO: 2745490 - RNA, 13 nt, Human
uaaagucuugccu

SEQ ID NO: 2745491 - RNA, 17 nt, Human
uaaaguugguaaaccuu

SEQ ID NO: 2745492 - RNA, 19 nt, Human
uaaauaaaaagcauuauua

SEQ ID NO: 2745493 - RNA, 14 nt, Human
uaaauaaaaauaau

SEQ ID NO: 2745494 - RNA, 16 nt, Human
uaaauaaaaauaaucc

SEQ ID NO: 2745495 - RNA, 13 nt, Human
uaaauaaagaauu

SEQ ID NO: 2745496 - RNA, 13 nt, Human
uaaauaaauaaau

SEQ ID NO: 2745497 - RNA, 15 nt, Human
uaaauaaauguaucu

SEQ ID NO: 2745498 - RNA, 14 nt, Human
uaaauaaauuguau

SEQ ID NO: 2745499 - RNA, 21 nt, Human
uaaauaacuuuuuuuuaaguu

SEQ ID NO: 2745500 - RNA, 20 nt, Human
uaaauagagaaauaugauuu

SEQ ID NO: 2745501 - RNA, 13 nt, Human
uaaauagcuuuuu

SEQ ID NO: 2745502 - RNA, 14 nt, Human
uaaauaguuuauga

SEQ ID NO: 2745503 - RNA, 18 nt, Human
uaaauauaaagcaagaua

SEQ ID NO: 2745504 - RNA, 22 nt, Human
uaaauauaaagcaagauaauaa

SEQ ID NO: 2745505 - RNA, 23 nt, Human
uaaauauaauaugcacacagugc

SEQ ID NO: 2745506 - RNA, 19 nt, Human
uaaauauauuuaagauaau

SEQ ID NO: 2745507 - RNA, 21 nt, Human
uaaauauuuauuuaacuauuc

SEQ ID NO: 2745508 - RNA, 15 nt, Human
uaaauauuuuuucuu

SEQ ID NO: 2745509 - RNA, 15 nt, Human
uaaaucacucaaauu

SEQ ID NO: 2745510 - RNA, 15 nt, Human
uaaaucccuccccgu

SEQ ID NO: 2745511 - RNA, 17 nt, Human
uaaauccuuuacuguua

SEQ ID NO: 2745512 - RNA, 18 nt, Human
uaaaucuauuuauuaaua

SEQ ID NO: 2745513 - RNA, 19 nt, Human
uaaaucuauuuauuaauau

SEQ ID NO: 2745514 - RNA, 12 nt, Human
uaaaugcucaau

SEQ ID NO: 2745515 - RNA, 17 nt, Human
uaaauggaaguaaaugu

SEQ ID NO: 2745516 - RNA, 16 nt, Human
uaaauggacaaaugcu

SEQ ID NO: 2745517 - RNA, 16 nt, Human
uaaauguacauuaauu

SEQ ID NO: 2745518 - RNA, 19 nt, Human
uaaauguaucuuauucaca

SEQ ID NO: 2745519 - RNA, 11 nt, Human
uaaaugugauu

SEQ ID NO: 2745520 - RNA, 18 nt, Human
uaaaugugcuuuuaaaaa

SEQ ID NO: 2745521 - RNA, 19 nt, Human
uaaaugugcuuuuaaaaaa

SEQ ID NO: 2745522 - RNA, 18 nt, Human
uaaauguuguuuuaggaa

SEQ ID NO: 2745523 - RNA, 14 nt, Human
uaaauuauaucaau

SEQ ID NO: 2745524 - RNA, 22 nt, Human
uaaauuauuguuuuucuuuuuu

SEQ ID NO: 2745525 - RNA, 21 nt, Human
uaaauuauuuuuguucauaua

SEQ ID NO: 2745526 - RNA, 22 nt, Human
uaaauucaaguccaggcuuuuu

SEQ ID NO: 2745527 - RNA, 15 nt, Human
uaaauuuaucauuua

SEQ ID NO: 2745528 - RNA, 17 nt, Human
uaaauuuaucauuuagu

SEQ ID NO: 2745529 - RNA, 13 nt, Human
uaaauuugguucu

SEQ ID NO: 2745530 - RNA, 13 nt, Human
uaaauuuuagcaa

SEQ ID NO: 2745531 - RNA, 21 nt, Human
uaacaaauauggggaaaaaac

SEQ ID NO: 2745532 - RNA, 13 nt, Human
uaacaaauuccaa

SEQ ID NO: 2745533 - RNA, 22 nt, Human
uaacaaccaaagacuacauauu

SEQ ID NO: 2745534 - RNA, 14 nt, Human
uaacaauaaaagac

SEQ ID NO: 2745535 - RNA, 16 nt, Human
uaacaauaaaagacaa

SEQ ID NO: 2745536 - RNA, 20 nt, Human
uaacaaugcuguauuuuaaa

SEQ ID NO: 2745537 - RNA, 18 nt, Human
uaacaauguaauaaaaag

SEQ ID NO: 2745538 - RNA, 14 nt, Human
uaacaauuuuagga

SEQ ID NO: 2745539 - RNA, 22 nt, Human
uaacacccagucuguuccccau

SEQ ID NO: 2745540 - RNA, 18 nt, Human
uaacaggcaaaaggaagc

SEQ ID NO: 2745541 - RNA, 17 nt, Human
uaacaguugcauugacu

SEQ ID NO: 2745542 - RNA, 12 nt, Human
uaacaucugaga

SEQ ID NO: 2745543 - RNA, 16 nt, Human
uaacaucugagaaaag

SEQ ID NO: 2745544 - RNA, 23 nt, Human
uaacauuccucaugaauguaaau

SEQ ID NO: 2745545 - RNA, 15 nt, Human
uaaccaacacccuga

SEQ ID NO: 2745546 - RNA, 19 nt, Human
uaaccagaucauugugaaa

SEQ ID NO: 2745547 - RNA, 20 nt, Human
uaaccagaucauugugaaau

SEQ ID NO: 2745548 - RNA, 16 nt, Human
guaacauagguuuuua

SEQ ID NO: 2745549 - RNA, 21 nt, Human
guaaccccagauucaugcacu

SEQ ID NO: 2745550 - RNA, 13 nt, Human
guaacuaauuuua

SEQ ID NO: 2745551 - RNA, 14 nt, Human
guaacuaauuuuaa

SEQ ID NO: 2745552 - RNA, 19 nt, Human
guaagauuuccuucuuuuu

SEQ ID NO: 2745553 - RNA, 17 nt, Human
guaagggaaacugccag

SEQ ID NO: 2745554 - RNA, 13 nt, Human
guaagucuuuaau

SEQ ID NO: 2745555 - RNA, 22 nt, Human
guaaguuuaugcauacaguaau

SEQ ID NO: 2745556 - RNA, 12 nt, Human
guaauaaaaugu

SEQ ID NO: 2745557 - RNA, 14 nt, Human
guaauauuucuuca

SEQ ID NO: 2745558 - RNA, 16 nt, Human
guaaucauauaauaaa

SEQ ID NO: 2745559 - RNA, 17 nt, Human
guaauccaagcaaaugu

SEQ ID NO: 2745560 - RNA, 16 nt, Human
guaaugaauuaaagaa

SEQ ID NO: 2745561 - RNA, 17 nt, Human
guaaugauaacuggaaa

SEQ ID NO: 2745562 - RNA, 22 nt, Human
guaaugauaacuggaaacuuca

SEQ ID NO: 2745563 - RNA, 14 nt, Human
guaauugauuuauu

SEQ ID NO: 2745564 - RNA, 22 nt, Human
guaauuuaagauuuuguuuuua

SEQ ID NO: 2745565 - RNA, 19 nt, Human
guacaagagcuuaacagug

SEQ ID NO: 2745566 - RNA, 17 nt, Human
guacaagcauucugucu

SEQ ID NO: 2745567 - RNA, 19 nt, Human
guacacugcacgaauggaa

SEQ ID NO: 2745568 - RNA, 22 nt, Human
guacacugccuucucaacucca

SEQ ID NO: 2745569 - RNA, 20 nt, Human
guacauguuaaacuuacuua

SEQ ID NO: 2745570 - RNA, 22 nt, Human
guacauuaauuaccuugagcca

SEQ ID NO: 2745571 - RNA, 22 nt, Human
guacauuuuuuuuuucaauaaa

SEQ ID NO: 2745572 - RNA, 16 nt, Human
guacccaaauggaaag

SEQ ID NO: 2745573 - RNA, 16 nt, Human
guaccuaguccccagc

SEQ ID NO: 2745574 - RNA, 20 nt, Human
guaccucucuuauagaauau

SEQ ID NO: 2745575 - RNA, 19 nt, Human
guacgcgagcgcgcgcgcc

SEQ ID NO: 2745576 - RNA, 20 nt, Human
guacuagagcaagcaggaau

SEQ ID NO: 2745577 - RNA, 19 nt, Human
guacuauuauccccauuuc

SEQ ID NO: 2745578 - RNA, 18 nt, Human
guacuccagccagggcaa

SEQ ID NO: 2745579 - RNA, 23 nt, Human
guacuccccuccuugaacuagga

SEQ ID NO: 2745580 - RNA, 16 nt, Human
guacucugaaaguuuu

SEQ ID NO: 2745581 - RNA, 16 nt, Human
guacugcaguaaagaa

SEQ ID NO: 2745582 - RNA, 12 nt, Human
guacuuaaaacu

SEQ ID NO: 2745583 - RNA, 20 nt, Human
guacuuaaaacuguaaauuu

SEQ ID NO: 2745584 - RNA, 14 nt, Human
guacuugcucuuga

SEQ ID NO: 2745585 - RNA, 14 nt, Human
guacuuuagggaag

SEQ ID NO: 2745586 - RNA, 19 nt, Human
guagaaugggggcagcacc

SEQ ID NO: 2745587 - RNA, 17 nt, Human
guagaauugugcaacca

SEQ ID NO: 2745588 - RNA, 19 nt, Human
guagaggagaaacuggaac

SEQ ID NO: 2745589 - RNA, 20 nt, Human
guagauaaggaaauaagaac

SEQ ID NO: 2745590 - RNA, 15 nt, Human
guagauaggccaugg

SEQ ID NO: 2745591 - RNA, 20 nt, Human
guagauauuaccaguuuucc

SEQ ID NO: 2745592 - RNA, 23 nt, Human
guagaugccacuagcccuccucu

SEQ ID NO: 2745593 - RNA, 22 nt, Human
guagccagcaucugccuccccu

SEQ ID NO: 2745594 - RNA, 14 nt, Human
guagcuaaauauau

SEQ ID NO: 2745595 - RNA, 15 nt, Human
guagcuacaggacau

SEQ ID NO: 2745596 - RNA, 18 nt, Human
guagggaguuguggguag

SEQ ID NO: 2745597 - RNA, 20 nt, Human
guauaauauuaauaauaccu

SEQ ID NO: 2745598 - RNA, 17 nt, Human
guauaauucacauugua

SEQ ID NO: 2745599 - RNA, 22 nt, Human
guauagguugauggugguaugu

SEQ ID NO: 2745600 - RNA, 12 nt, Human
guauauauagaa

SEQ ID NO: 2745601 - RNA, 12 nt, Human
guauauucaaaa

SEQ ID NO: 2745602 - RNA, 12 nt, Human
guauauuuuaua

SEQ ID NO: 2745603 - RNA, 16 nt, Human
guauccuucagccuga

SEQ ID NO: 2745604 - RNA, 21 nt, Human
guaucuagccuggaaccaagg

SEQ ID NO: 2745605 - RNA, 17 nt, Human
guaucugaggcacaugu

SEQ ID NO: 2745606 - RNA, 17 nt, Human
guaucuuguuuuuccac

SEQ ID NO: 2745607 - RNA, 22 nt, Human
guaucuuguuuuuccacuacug

SEQ ID NO: 2745608 - RNA, 14 nt, Human
guaucuuuuuauuc

SEQ ID NO: 2745609 - RNA, 19 nt, Human
guaugaaaaugucauuguu

SEQ ID NO: 2745610 - RNA, 22 nt, Human
guaugauggguguuuuuagcag

SEQ ID NO: 2745611 - RNA, 13 nt, Human
guauggcaaacug

SEQ ID NO: 2745612 - RNA, 13 nt, Human
guauggcagcuuu

SEQ ID NO: 2745613 - RNA, 14 nt, Human
guauggcuccucca

SEQ ID NO: 2745614 - RNA, 15 nt, Human
guauggcuccuccau

SEQ ID NO: 2745615 - RNA, 16 nt, Human
guauguacuucaugcu

SEQ ID NO: 2745616 - RNA, 17 nt, Human
guauguguaucucacac

SEQ ID NO: 2745617 - RNA, 12 nt, Human
guauuauuuaua

SEQ ID NO: 2745618 - RNA, 14 nt, Human
guauuauuuauaau

SEQ ID NO: 2745619 - RNA, 20 nt, Human
guauuauuuuuuaaaaaaau

SEQ ID NO: 2745620 - RNA, 23 nt, Human
guauucagcuuuaguagauauua

SEQ ID NO: 2745621 - RNA, 22 nt, Human
guauucauauuuauagccaggu

SEQ ID NO: 2745622 - RNA, 20 nt, Human
guauuccagaccugaagaau

SEQ ID NO: 2745623 - RNA, 13 nt, Human
guauucguuaucu

SEQ ID NO: 2745624 - RNA, 14 nt, Human
guauucuucuuugg

SEQ ID NO: 2745625 - RNA, 12 nt, Human
guauuguauuua

SEQ ID NO: 2745626 - RNA, 19 nt, Human
guauuuaagguauauaaau

SEQ ID NO: 2745627 - RNA, 16 nt, Human
guauuuauaaauauau

SEQ ID NO: 2745628 - RNA, 13 nt, Human
guauuuauauauu

SEQ ID NO: 2745629 - RNA, 17 nt, Human
guauuucuaugaaauau

SEQ ID NO: 2745630 - RNA, 23 nt, Human
guauuugaguguuuuaagauaaa

SEQ ID NO: 2745631 - RNA, 14 nt, Human
guauuuuaaucacc

SEQ ID NO: 2745632 - RNA, 16 nt, Human
guauuuuuaguagaga

SEQ ID NO: 2745633 - RNA, 17 nt, Human
gucaaagcugaaaugga

SEQ ID NO: 2745634 - RNA, 16 nt, Human
gucaaauugugugaaa

SEQ ID NO: 2745635 - RNA, 14 nt, Human
gucaacuccuuucu

SEQ ID NO: 2745636 - RNA, 22 nt, Human
gucaagaagcaucgugucuggc

SEQ ID NO: 2745637 - RNA, 22 nt, Human
gucaagaucagccugggcaaca

SEQ ID NO: 2745638 - RNA, 20 nt, Human
gucaagaugaugaugaucuu

SEQ ID NO: 2745639 - RNA, 14 nt, Human
gucaaggguucaag

SEQ ID NO: 2745640 - RNA, 19 nt, Human
gucaaucagccuaguugau

SEQ ID NO: 2745641 - RNA, 22 nt, Human
gucaaucuuaucauauuucaaa

SEQ ID NO: 2745642 - RNA, 15 nt, Human
gucaaugcagccccc

SEQ ID NO: 2745643 - RNA, 17 nt, Human
gucacagccacuuggga

SEQ ID NO: 2745644 - RNA, 16 nt, Human
gucacagcuacacaga

SEQ ID NO: 2745645 - RNA, 12 nt, Human
gucaccucagag

SEQ ID NO: 2745646 - RNA, 15 nt, Human
gucaccucauggaau

SEQ ID NO: 2745647 - RNA, 16 nt, Human
gucacuacgccuggcu

SEQ ID NO: 2745648 - RNA, 16 nt, Human
gucacuagggcaggga

SEQ ID NO: 2745649 - RNA, 18 nt, Human
gucacucacauccauucu

SEQ ID NO: 2745650 - RNA, 20 nt, Human
gucacucguggugaggcuga

SEQ ID NO: 2745651 - RNA, 21 nt, Human
gucagcuccccucggagaaga

SEQ ID NO: 2745652 - RNA, 19 nt, Human
gucagcucuucuccauccu

SEQ ID NO: 2745653 - RNA, 21 nt, Human
gucaucaucacauucagggcu

SEQ ID NO: 2745654 - RNA, 21 nt, Human
gucauguuuaagaaauuuuug

SEQ ID NO: 2745655 - RNA, 20 nt, Human
gucauucagauaugauucaa

SEQ ID NO: 2745656 - RNA, 14 nt, Human
gucauucugccugc

SEQ ID NO: 2745657 - RNA, 12 nt, Human
gucauuguucuu

SEQ ID NO: 2745658 - RNA, 17 nt, Human
guccaaagggcaugggu

SEQ ID NO: 2745659 - RNA, 16 nt, Human
guccaacccgaggccc

SEQ ID NO: 2745660 - RNA, 14 nt, Human
guccacaaguaaaa

SEQ ID NO: 2745661 - RNA, 16 nt, Human
guccacugguucuucu

SEQ ID NO: 2745662 - RNA, 19 nt, Human
guccaggucuaccaaaaau

SEQ ID NO: 2745663 - RNA, 22 nt, Human
guccaggucuaccaaaaaucuc

SEQ ID NO: 2745664 - RNA, 22 nt, Human
guccaucucuuguuuaaauuca

SEQ ID NO: 2745665 - RNA, 23 nt, Human
guccauucuuccucccauucagg

SEQ ID NO: 2745666 - RNA, 14 nt, Human
guccauugggcagg

SEQ ID NO: 2745667 - RNA, 13 nt, Human
gucccagaaaaag

SEQ ID NO: 2745668 - RNA, 16 nt, Human
gucccagaucaagccu

SEQ ID NO: 2745669 - RNA, 16 nt, Human
gucccagccagcaguu

SEQ ID NO: 2745670 - RNA, 19 nt, Human
gucccagccagcaguucag

SEQ ID NO: 2745671 - RNA, 12 nt, Human
gucccaggcuga

SEQ ID NO: 2745672 - RNA, 14 nt, Human
gucccaggcugagc

SEQ ID NO: 2745673 - RNA, 22 nt, Human
gucccaucuagggaaggcugga

SEQ ID NO: 2745674 - RNA, 15 nt, Human
gucccauucccccag

SEQ ID NO: 2745675 - RNA, 12 nt, Human
guccccagagcu

SEQ ID NO: 2745676 - RNA, 15 nt, Human
guccccagccugcuc

SEQ ID NO: 2745677 - RNA, 16 nt, Human
guccccagccugcucc

SEQ ID NO: 2745678 - RNA, 17 nt, Human
guccccagccugcuccc

SEQ ID NO: 2745679 - RNA, 22 nt, Human
guccccagccugcucccuagcc

SEQ ID NO: 2745680 - RNA, 21 nt, Human
guccccuauccuacuuccccu

SEQ ID NO: 2745681 - RNA, 15 nt, Human
gucccuacaccccuc

SEQ ID NO: 2745682 - RNA, 22 nt, Human
gucccugcagcucucuuuccuc

SEQ ID NO: 2745683 - RNA, 17 nt, Human
guccgggauugggaauc

SEQ ID NO: 2745684 - RNA, 17 nt, Human
guccgggucgcaggacc

SEQ ID NO: 2745685 - RNA, 20 nt, Human
guccuaagucccugcugccc

SEQ ID NO: 2745686 - RNA, 12 nt, Human
guccucuuucaa

SEQ ID NO: 2745687 - RNA, 15 nt, Human
guccugaccugucuc

SEQ ID NO: 2745688 - RNA, 22 nt, Human
guccugaccugucucaccaugu

SEQ ID NO: 2745689 - RNA, 16 nt, Human
guccugcaagcagagg

SEQ ID NO: 2745690 - RNA, 18 nt, Human
guccugcaagcagaggug

SEQ ID NO: 2745691 - RNA, 14 nt, Human
guccuggggccucg

SEQ ID NO: 2745692 - RNA, 22 nt, Human
guccugucgaaggggaggcaca

SEQ ID NO: 2745693 - RNA, 20 nt, Human
guccugucuguuuccucugu

SEQ ID NO: 2745694 - RNA, 22 nt, Human
gucgcaggaccaucccggccgg

SEQ ID NO: 2745695 - RNA, 24 nt, Human
gucgcaggaccaucccggccggcg

SEQ ID NO: 2745696 - RNA, 19 nt, Human
gucgucaaagcugaaaugg

SEQ ID NO: 2745697 - RNA, 22 nt, Human
gucuaaaaaaggaauccucugu

SEQ ID NO: 2745698 - RNA, 18 nt, Human
gucuaggacacaguuccu

SEQ ID NO: 2745699 - RNA, 14 nt, Human
gucucaauaaauaa

SEQ ID NO: 2745700 - RNA, 16 nt, Human
gucucaauaaauaaau

SEQ ID NO: 2745701 - RNA, 23 nt, Human
gucucacaugauuccagccauca

SEQ ID NO: 2745702 - RNA, 17 nt, Human
gucucagcuucacccug

SEQ ID NO: 2745703 - RNA, 13 nt, Human
gucucaguguccu

SEQ ID NO: 2745704 - RNA, 16 nt, Human
gucucccaaagugcug

SEQ ID NO: 2745705 - RNA, 23 nt, Human
gucucccucccuuggggccuaug

SEQ ID NO: 2745706 - RNA, 21 nt, Human
gucucccucuguugccaaggc

SEQ ID NO: 2745707 - RNA, 17 nt, Human
gucuccuaagcuggagu

SEQ ID NO: 2745708 - RNA, 15 nt, Human
gucucuacauaaaau

SEQ ID NO: 2745709 - RNA, 16 nt, Human
gucucucacuuguuuu

SEQ ID NO: 2745710 - RNA, 19 nt, Human
gucucugcaaacugccuuc

SEQ ID NO: 2745711 - RNA, 15 nt, Human
gucucuugaggcaca

SEQ ID NO: 2745712 - RNA, 12 nt, Human
gucugagacaga

SEQ ID NO: 2745713 - RNA, 22 nt, Human
gucugagacagaaucucagucu

SEQ ID NO: 2745714 - RNA, 17 nt, Human
gucugccagccagcagc

SEQ ID NO: 2745715 - RNA, 18 nt, Human
gucugccagccagcagcc

SEQ ID NO: 2745716 - RNA, 20 nt, Human
gucugccuaauuaaaaaaau

SEQ ID NO: 2745717 - RNA, 18 nt, Human
gucuggaaauagcccugu

SEQ ID NO: 2745718 - RNA, 23 nt, Human
gucuggagggaagccuuggggcu

SEQ ID NO: 2745719 - RNA, 18 nt, Human
gucuguaaaaucuuucuu

SEQ ID NO: 2745720 - RNA, 18 nt, Human
gucugugaagugagaccu

SEQ ID NO: 2745721 - RNA, 22 nt, Human
gucugugagaugcuagaacucc

SEQ ID NO: 2745722 - RNA, 16 nt, Human
gucuguuuucccuccu

SEQ ID NO: 2745723 - RNA, 16 nt, Human
gucuuaauuaaaagaa

SEQ ID NO: 2745724 - RNA, 14 nt, Human
gucuucacaacaga

SEQ ID NO: 2745725 - RNA, 22 nt, Human
gucuucagccuagccgaccuca

SEQ ID NO: 2745726 - RNA, 18 nt, Human
gucuucuagcagugagcc

SEQ ID NO: 2745727 - RNA, 11 nt, Human
gucuucugccc

SEQ ID NO: 2745728 - RNA, 20 nt, Human
gucuucuuugcccacaaugc

SEQ ID NO: 2745729 - RNA, 19 nt, Human
gucuuucacauuuaaauaa

SEQ ID NO: 2745730 - RNA, 15 nt, Human
gucuuuuaggacccu

SEQ ID NO: 2745731 - RNA, 18 nt, Human
gucuuuuaggacccuucc

SEQ ID NO: 2745732 - RNA, 11 nt, Human
gugaaaaaaaa

SEQ ID NO: 2745733 - RNA, 16 nt, Human
gugaaaccuggucucu

SEQ ID NO: 2745734 - RNA, 12 nt, Human
gugaaagaaaau

SEQ ID NO: 2745735 - RNA, 16 nt, Human
gugaaagaaaauaaca

SEQ ID NO: 2745736 - RNA, 18 nt, Human
gugaaagaaaauaacaau

SEQ ID NO: 2745737 - RNA, 17 nt, Human
gugaaagaaaauaacga

SEQ ID NO: 2745738 - RNA, 21 nt, Human
gugaaauaguucaaagccaag

SEQ ID NO: 2745739 - RNA, 23 nt, Human
gugaaaucauucauuuucugggu

SEQ ID NO: 2745740 - RNA, 16 nt, Human
gugaaaugcagaguca

SEQ ID NO: 2745741 - RNA, 19 nt, Human
gugaacuugguuuuaauua

SEQ ID NO: 2745742 - RNA, 17 nt, Human
gugaagaaacauuuauc

SEQ ID NO: 2745743 - RNA, 23 nt, Human
gugaagggaagagacagcccagg

SEQ ID NO: 2745744 - RNA, 16 nt, Human
gugaagguggaaauaa

SEQ ID NO: 2745745 - RNA, 17 nt, Human
gugaagguggaaauaaa

SEQ ID NO: 2745746 - RNA, 18 nt, Human
gugaaguaugcacuaauc

SEQ ID NO: 2745747 - RNA, 21 nt, Human
gugaaguucaucuugcagcau

SEQ ID NO: 2745748 - RNA, 20 nt, Human
gugacaaccaaaagucuuca

SEQ ID NO: 2745749 - RNA, 21 nt, Human
gugacaaccaaaagucuucau

SEQ ID NO: 2745750 - RNA, 16 nt, Human
gugacaagcucacaga

SEQ ID NO: 2745751 - RNA, 19 nt, Human
gugacacagcugucccaag

SEQ ID NO: 2745752 - RNA, 21 nt, Human
gugacauguuuacaaaccuca

SEQ ID NO: 2745753 - RNA, 23 nt, Human
gugacauuuucugccacccaaac

SEQ ID NO: 2745754 - RNA, 20 nt, Human
gugaccaaccuuuucccaac

SEQ ID NO: 2745755 - RNA, 17 nt, Human
gugacuauuauauuucc

SEQ ID NO: 2745756 - RNA, 16 nt, Human
gugacuggccugcugg

SEQ ID NO: 2745757 - RNA, 19 nt, Human
gugacuuaaugccacuaaa

SEQ ID NO: 2745758 - RNA, 18 nt, Human
gugacuuuccuaaaucaa

SEQ ID NO: 2745759 - RNA, 14 nt, Human
gugagaaccggaga

SEQ ID NO: 2745760 - RNA, 15 nt, Human
gugagacagcucugc

SEQ ID NO: 2745761 - RNA, 16 nt, Human
gugagacagcucugca

SEQ ID NO: 2745762 - RNA, 18 nt, Human
gugagaccaaauugagcu

SEQ ID NO: 2745763 - RNA, 17 nt, Human
gugagacucugucucag

SEQ ID NO: 2745764 - RNA, 12 nt, Human
gugagaugcuag

SEQ ID NO: 2745765 - RNA, 13 nt, Human
gugagaugcuaga

SEQ ID NO: 2745766 - RNA, 23 nt, Human
gugagcagucaggaaagagaacu

SEQ ID NO: 2745767 - RNA, 12 nt, Human
gugagccaccaa

SEQ ID NO: 2745768 - RNA, 14 nt, Human
gugagccaccaaac

SEQ ID NO: 2745769 - RNA, 20 nt, Human
gugagccaccaaacccggcc

SEQ ID NO: 2745770 - RNA, 16 nt, Human
gugagcuccuaagcca

SEQ ID NO: 2745771 - RNA, 15 nt, Human
gugaggagcuggaaa

SEQ ID NO: 2745772 - RNA, 21 nt, Human
gugagggggggguauuucaau

SEQ ID NO: 2745773 - RNA, 19 nt, Human
gugagggugcugacuggcu

SEQ ID NO: 2745774 - RNA, 19 nt, Human
gugauaguuguaccgcaau

SEQ ID NO: 2745775 - RNA, 23 nt, Human
gugauccacccgccucagccucc

SEQ ID NO: 2745776 - RNA, 24 nt, Human
gugauccacccgccucagccuccc

SEQ ID NO: 2745777 - RNA, 19 nt, Human
gugaugugaguugcacagc

SEQ ID NO: 2745778 - RNA, 13 nt, Human
gugauuccgcagu

SEQ ID NO: 2745779 - RNA, 22 nt, Human
gugauugaaaccuacacgagau

SEQ ID NO: 2745780 - RNA, 20 nt, Human
gugauugauuauaugucacu

SEQ ID NO: 2745781 - RNA, 17 nt, Human
gugauuuugugauugau

SEQ ID NO: 2745782 - RNA, 15 nt, Human
gugcagauucuuuac

SEQ ID NO: 2745783 - RNA, 18 nt, Human
gugcaucaggcuuucuuu

SEQ ID NO: 2745784 - RNA, 17 nt, Human
gugcccccaacagcacc

SEQ ID NO: 2745785 - RNA, 22 nt, Human
gugccccugcacuccagccuga

SEQ ID NO: 2745786 - RNA, 12 nt, Human
gugccgcucucu

SEQ ID NO: 2745787 - RNA, 17 nt, Human
gugccgcucucucugag

SEQ ID NO: 2745788 - RNA, 14 nt, Human
gugccgcuuucucu

SEQ ID NO: 2745789 - RNA, 17 nt, Human
gugccgcuuucucugag

SEQ ID NO: 2745790 - RNA, 21 nt, Human
gugccguccccagagcuacag

SEQ ID NO: 2745791 - RNA, 15 nt, Human
gugccuguaaucaca

SEQ ID NO: 2745792 - RNA, 15 nt, Human
gugccuuucuucucu

SEQ ID NO: 2745793 - RNA, 21 nt, Human
gugcgagugcgugaauauugg

SEQ ID NO: 2745794 - RNA, 17 nt, Human
gugcguucuccugaugu

SEQ ID NO: 2745795 - RNA, 18 nt, Human
gugcuaauuuugaaaaac

SEQ ID NO: 2745796 - RNA, 17 nt, Human
gugcuacaaaaacacag

SEQ ID NO: 2745797 - RNA, 19 nt, Human
gugcucaguagucagacug

SEQ ID NO: 2745798 - RNA, 14 nt, Human
gugcucucucugag

SEQ ID NO: 2745799 - RNA, 16 nt, Human
gugcugaguucuauaa

SEQ ID NO: 2745800 - RNA, 20 nt, Human
gugcugggaauuacaggcgu

SEQ ID NO: 2745801 - RNA, 21 nt, Human
gugcugggaauuacaggcgug

SEQ ID NO: 2745802 - RNA, 23 nt, Human
gugcugggccccugccucucugc

SEQ ID NO: 2745803 - RNA, 15 nt, Human
gugcuucuccagccu

SEQ ID NO: 2745804 - RNA, 21 nt, Human
gugcuucuccagccucagccu

SEQ ID NO: 2745805 - RNA, 14 nt, Human
gugcuucuuucuuu

SEQ ID NO: 2745806 - RNA, 22 nt, Human
gugcuugagccaggaggccugc

SEQ ID NO: 2745807 - RNA, 14 nt, Human
gugcuugagucucc

SEQ ID NO: 2745808 - RNA, 12 nt, Human
gugcuuggccca

SEQ ID NO: 2745809 - RNA, 15 nt, Human
gugcuuggcccagga

SEQ ID NO: 2745810 - RNA, 23 nt, Human
gugcuuuaauggcaugucagaca

SEQ ID NO: 2745811 - RNA, 16 nt, Human
gugcuuugaaaaugcu

SEQ ID NO: 2745812 - RNA, 17 nt, Human
guggaaaccuccuucca

SEQ ID NO: 2745813 - RNA, 15 nt, Human
guggaaaugauguuu

SEQ ID NO: 2745814 - RNA, 16 nt, Human
guggaacaguuaccuc

SEQ ID NO: 2745815 - RNA, 19 nt, Human
guggacguggguugcacug

SEQ ID NO: 2745816 - RNA, 15 nt, Human
guggagacaucugga

SEQ ID NO: 2745817 - RNA, 13 nt, Human
guggagggggcgc

SEQ ID NO: 2745818 - RNA, 15 nt, Human
guggaugauccccac

SEQ ID NO: 2745819 - RNA, 19 nt, Human
guggcaggaaaauggacau

SEQ ID NO: 2745820 - RNA, 21 nt, Human
guggccagcuuguuauuuaua

SEQ ID NO: 2745821 - RNA, 23 nt, Human
guggcuuucagagccuccuuucu

SEQ ID NO: 2745822 - RNA, 14 nt, Human
gugggacaguuccu

SEQ ID NO: 2745823 - RNA, 12 nt, Human
gugggaccuggg

SEQ ID NO: 2745824 - RNA, 15 nt, Human
gugggccugagacca

SEQ ID NO: 2745825 - RNA, 13 nt, Human
guggggauaguga

SEQ ID NO: 2745826 - RNA, 20 nt, Human
guggggcgggcuucauagag

SEQ ID NO: 2745827 - RNA, 15 nt, Human
gugggggugccgcuc

SEQ ID NO: 2745828 - RNA, 15 nt, Human
guggguauaaaagau

SEQ ID NO: 2745829 - RNA, 15 nt, Human
gugguaagcaccagg

SEQ ID NO: 2745830 - RNA, 17 nt, Human
guggugcgagugcguga

SEQ ID NO: 2745831 - RNA, 23 nt, Human
guggugggacagggacccacuuc

SEQ ID NO: 2745832 - RNA, 16 nt, Human
guguaaguagauaggc

SEQ ID NO: 2745833 - RNA, 22 nt, Human
guguaaguagauaggccauggg

SEQ ID NO: 2745834 - RNA, 17 nt, Human
guguaaugaaaaugaau

SEQ ID NO: 2745835 - RNA, 15 nt, Human
guguacaugaaagcg

SEQ ID NO: 2745836 - RNA, 14 nt, Human
guguacauucuucc

SEQ ID NO: 2745837 - RNA, 12 nt, Human
guguauauuuuu

SEQ ID NO: 2745838 - RNA, 17 nt, Human
guguauuuucagcagag

SEQ ID NO: 2745839 - RNA, 16 nt, Human
gugucaaugcagcccc

SEQ ID NO: 2745840 - RNA, 19 nt, Human
gugucaggugacccugaug

SEQ ID NO: 2745841 - RNA, 22 nt, Human
guguccccuauccuacuucccc

SEQ ID NO: 2745842 - RNA, 22 nt, Human
guguccgacucuucugagcacc

SEQ ID NO: 2745843 - RNA, 22 nt, Human
gugucuggcguuguggggauga

SEQ ID NO: 2745844 - RNA, 16 nt, Human
gugucuuaauuaaaag

SEQ ID NO: 2745845 - RNA, 22 nt, Human
gugugaccacugcagaagacag

SEQ ID NO: 2745846 - RNA, 20 nt, Human
gugugcuggcuuaaaaugua

SEQ ID NO: 2745847 - RNA, 18 nt, Human
gggcaggcagauguuccu

SEQ ID NO: 2745848 - RNA, 17 nt, Human
gggcaguguucccuggg

SEQ ID NO: 2745849 - RNA, 15 nt, Human
gggccaggcuggguc

SEQ ID NO: 2745850 - RNA, 16 nt, Human
gggccgacggagccgg

SEQ ID NO: 2745851 - RNA, 15 nt, Human
gggccuaugcagagg

SEQ ID NO: 2745852 - RNA, 23 nt, Human
gggccuaugcagagguccacaac

SEQ ID NO: 2745853 - RNA, 19 nt, Human
gggccuguaaucccagcau

SEQ ID NO: 2745854 - RNA, 12 nt, Human
gggcgcgguggc

SEQ ID NO: 2745855 - RNA, 15 nt, Human
gggcgcgugcaggca

SEQ ID NO: 2745856 - RNA, 17 nt, Human
gggcuaaggcaggagga

SEQ ID NO: 2745857 - RNA, 13 nt, Human
gggcuacgcgcgc

SEQ ID NO: 2745858 - RNA, 13 nt, Human
gggcuauuuuuuc

SEQ ID NO: 2745859 - RNA, 21 nt, Human
gggcucagccuggugggccuc

SEQ ID NO: 2745860 - RNA, 15 nt, Human
gggcucuggaaacca

SEQ ID NO: 2745861 - RNA, 13 nt, Human
gggcugaagcugu

SEQ ID NO: 2745862 - RNA, 13 nt, Human
gggcugaugcagu

SEQ ID NO: 2745863 - RNA, 16 nt, Human
gggcuuuagggaccug

SEQ ID NO: 2745864 - RNA, 14 nt, Human
ggggaacaugagcc

SEQ ID NO: 2745865 - RNA, 16 nt, Human
ggggaagacaguggcc

SEQ ID NO: 2745866 - RNA, 21 nt, Human
ggggagccaacagaagcuucc

SEQ ID NO: 2745867 - RNA, 23 nt, Human
ggggagccaacagaagcuuccau

SEQ ID NO: 2745868 - RNA, 11 nt, Human
ggggaggggcg

SEQ ID NO: 2745869 - RNA, 16 nt, Human
ggggcagcaccuccua

SEQ ID NO: 2745870 - RNA, 13 nt, Human
ggggccaggcugg

SEQ ID NO: 2745871 - RNA, 14 nt, Human
ggggccaggcuggg

SEQ ID NO: 2745872 - RNA, 18 nt, Human
ggggcccggacgcccagg

SEQ ID NO: 2745873 - RNA, 12 nt, Human
ggggcgcgugca

SEQ ID NO: 2745874 - RNA, 14 nt, Human
ggggcgcucgcuuc

SEQ ID NO: 2745875 - RNA, 14 nt, Human
ggggcggggagcga

SEQ ID NO: 2745876 - RNA, 12 nt, Human
ggggcucuggga

SEQ ID NO: 2745877 - RNA, 15 nt, Human
ggggcuucugggcag

SEQ ID NO: 2745878 - RNA, 16 nt, Human
ggggcuucugggcaga

SEQ ID NO: 2745879 - RNA, 11 nt, Human
gggggagggga

SEQ ID NO: 2745880 - RNA, 12 nt, Human
gggggucagcca

SEQ ID NO: 2745881 - RNA, 18 nt, Human
gggggucagccagcccuc

SEQ ID NO: 2745882 - RNA, 22 nt, Human
gggguaccuaguccccagccug

SEQ ID NO: 2745883 - RNA, 23 nt, Human
gggguaccuaguccccagccugc

SEQ ID NO: 2745884 - RNA, 23 nt, Human
gggguauuucaauuaccuucuau

SEQ ID NO: 2745885 - RNA, 18 nt, Human
ggggucagccagcccucu

SEQ ID NO: 2745886 - RNA, 20 nt, Human
ggggugcucucucugagggg

SEQ ID NO: 2745887 - RNA, 22 nt, Human
ggggugggaaagauuacuuuuu

SEQ ID NO: 2745888 - RNA, 12 nt, Human
ggggugggggug

SEQ ID NO: 2745889 - RNA, 13 nt, Human
ggggugggggugc

SEQ ID NO: 2745890 - RNA, 17 nt, Human
gggguggguggggcagu

SEQ ID NO: 2745891 - RNA, 22 nt, Human
ggggugguuuucccaucucagg

SEQ ID NO: 2745892 - RNA, 17 nt, Human
gggguucucacaguggg

SEQ ID NO: 2745893 - RNA, 19 nt, Human
ggguaccuaguccccagcc

SEQ ID NO: 2745894 - RNA, 23 nt, Human
ggguaccuaguccccagccugcu

SEQ ID NO: 2745895 - RNA, 15 nt, Human
gggucagccagcccu

SEQ ID NO: 2745896 - RNA, 16 nt, Human
ggguccuggggccucg

SEQ ID NO: 2745897 - RNA, 23 nt, Human
gggucucccucuguugccaaggc

SEQ ID NO: 2745898 - RNA, 21 nt, Human
gggugccgcucucucugaggg

SEQ ID NO: 2745899 - RNA, 18 nt, Human
gggugcugcgcagcaucc

SEQ ID NO: 2745900 - RNA, 14 nt, Human
ggguggggcagugc

SEQ ID NO: 2745901 - RNA, 18 nt, Human
ggguucaagcgauucucu

SEQ ID NO: 2745902 - RNA, 22 nt, Human
ggguucagagacucagggcccc

SEQ ID NO: 2745903 - RNA, 14 nt, Human
ggguugguuucccu

SEQ ID NO: 2745904 - RNA, 12 nt, Human
ggguuucacaag

SEQ ID NO: 2745905 - RNA, 11 nt, Human
ggguuucucca

SEQ ID NO: 2745906 - RNA, 16 nt, Human
gguaaccucuuacuua

SEQ ID NO: 2745907 - RNA, 23 nt, Human
gguacaagcauucugucuugaag

SEQ ID NO: 2745908 - RNA, 17 nt, Human
gguaccuaguccccagc

SEQ ID NO: 2745909 - RNA, 21 nt, Human
gguagcuaaauauauauuuua

SEQ ID NO: 2745910 - RNA, 18 nt, Human
gguauaauucacauugua

SEQ ID NO: 2745911 - RNA, 22 nt, Human
gguauaauucacauuguauuca

SEQ ID NO: 2745912 - RNA, 23 nt, Human
gguauguuuucaggcuagaugua

SEQ ID NO: 2745913 - RNA, 19 nt, Human
gguauuuauugagcaccug

SEQ ID NO: 2745914 - RNA, 12 nt, Human
gguauuuuaauc

SEQ ID NO: 2745915 - RNA, 15 nt, Human
gguauuuuaaucacc

SEQ ID NO: 2745916 - RNA, 17 nt, Human
ggucaaagcaacuggau

SEQ ID NO: 2745917 - RNA, 20 nt, Human
ggucaacauagugagacacu

SEQ ID NO: 2745918 - RNA, 21 nt, Human
ggucaagaagcaucgugucug

SEQ ID NO: 2745919 - RNA, 14 nt, Human
gguccaccaggagu

SEQ ID NO: 2745920 - RNA, 18 nt, Human
ggucccuauuccuccuuc

SEQ ID NO: 2745921 - RNA, 17 nt, Human
gguccgaagucuuccau

SEQ ID NO: 2745922 - RNA, 16 nt, Human
gguccuaagucccugc

SEQ ID NO: 2745923 - RNA, 19 nt, Human
gguccuaagucccugcugc

SEQ ID NO: 2745924 - RNA, 18 nt, Human
gguccugcugaaacugcc

SEQ ID NO: 2745925 - RNA, 18 nt, Human
ggucgcaggaccaucccg

SEQ ID NO: 2745926 - RNA, 23 nt, Human
ggucgcaggaccaucccggccgg

SEQ ID NO: 2745927 - RNA, 23 nt, Human
ggucggguuuuauuguuuaaaau

SEQ ID NO: 2745928 - RNA, 17 nt, Human
ggucgucgucuugacuu

SEQ ID NO: 2745929 - RNA, 18 nt, Human
ggucuaccacucagagaa

SEQ ID NO: 2745930 - RNA, 23 nt, Human
ggucuaucuuugagcgcccacua

SEQ ID NO: 2745931 - RNA, 23 nt, Human
ggucucagugucaaugcagcccc

SEQ ID NO: 2745932 - RNA, 19 nt, Human
ggucucaguguccucaucu

SEQ ID NO: 2745933 - RNA, 23 nt, Human
ggucucccuucucuacacucuug

SEQ ID NO: 2745934 - RNA, 16 nt, Human
ggucucuacauaaaau

SEQ ID NO: 2745935 - RNA, 21 nt, Human
ggucucuacauaaaauacaaa

SEQ ID NO: 2745936 - RNA, 23 nt, Human
ggucugaggucauuaaaauuaca

SEQ ID NO: 2745937 - RNA, 16 nt, Human
ggugaaacccugucuc

SEQ ID NO: 2745938 - RNA, 14 nt, Human
ggugaaagauggaa

SEQ ID NO: 2745939 - RNA, 17 nt, Human
ggugaaagauggaacuu

SEQ ID NO: 2745940 - RNA, 17 nt, Human
ggugaacugcagcgagu

SEQ ID NO: 2745941 - RNA, 15 nt, Human
ggugacacagcuguc

SEQ ID NO: 2745942 - RNA, 18 nt, Human
ggugacuauuauauuucc

SEQ ID NO: 2745943 - RNA, 18 nt, Human
ggugauuccgcagugaga

SEQ ID NO: 2745944 - RNA, 20 nt, Human
ggugccccccuugccagaca

SEQ ID NO: 2745945 - RNA, 13 nt, Human
ggugccgcucucu

SEQ ID NO: 2745946 - RNA, 16 nt, Human
ggugccgcucucucug

SEQ ID NO: 2745947 - RNA, 21 nt, Human
ggugccgcucucucugagggg

SEQ ID NO: 2745948 - RNA, 21 nt, Human
ggugccgcugucucugagggg

SEQ ID NO: 2745949 - RNA, 21 nt, Human
ggugccgcuuucucugagggg

SEQ ID NO: 2745950 - RNA, 13 nt, Human
ggugcucucucug

SEQ ID NO: 2745951 - RNA, 16 nt, Human
ggugcucucucugagg

SEQ ID NO: 2745952 - RNA, 12 nt, Human
ggugcugcagcc

SEQ ID NO: 2745953 - RNA, 14 nt, Human
ggugcugcagcccc

SEQ ID NO: 2745954 - RNA, 15 nt, Human
ggugcugcagccccu

SEQ ID NO: 2745955 - RNA, 15 nt, Human
ggugcugggaccugg

SEQ ID NO: 2745956 - RNA, 14 nt, Human
ggugcuugagucuc

SEQ ID NO: 2745957 - RNA, 23 nt, Human
gguggcgcuggcugcgcucggcc

SEQ ID NO: 2745958 - RNA, 12 nt, Human
ggugggcagaga

SEQ ID NO: 2745959 - RNA, 20 nt, Human
ggugggccuccucuguccag

SEQ ID NO: 2745960 - RNA, 14 nt, Human
gguggggcagugcu

SEQ ID NO: 2745961 - RNA, 15 nt, Human
gguggggcagugcuu

SEQ ID NO: 2745962 - RNA, 13 nt, Human
gguggggugaggg

SEQ ID NO: 2745963 - RNA, 13 nt, Human
gguggguggggca

SEQ ID NO: 2745964 - RNA, 18 nt, Human
ggugugaccacugcagaa

SEQ ID NO: 2745965 - RNA, 13 nt, Human
ggugugugcagca

SEQ ID NO: 2745966 - RNA, 14 nt, Human
ggugugugcagcau

SEQ ID NO: 2745967 - RNA, 18 nt, Human
gguuaagcacuuuaacac

SEQ ID NO: 2745968 - RNA, 12 nt, Human
gguuagaaaagu

SEQ ID NO: 2745969 - RNA, 15 nt, Human
gguuaguggaagcau

SEQ ID NO: 2745970 - RNA, 19 nt, Human
gguucaagcaauccuccca

SEQ ID NO: 2745971 - RNA, 20 nt, Human
gguucaagcaauccucccac

SEQ ID NO: 2745972 - RNA, 22 nt, Human
gguucuaggccgggcgcggugg

SEQ ID NO: 2745973 - RNA, 19 nt, Human
gguucuucuuggucucagu

SEQ ID NO: 2745974 - RNA, 21 nt, Human
gguucuucuuggucucagugu

SEQ ID NO: 2745975 - RNA, 21 nt, Human
gguucuuucuuuaaagcagga

SEQ ID NO: 2745976 - RNA, 13 nt, Human
gguugcagugagc

SEQ ID NO: 2745977 - RNA, 12 nt, Human
gguuuauauaag

SEQ ID NO: 2745978 - RNA, 21 nt, Human
gguuucacaagugaaaaacau

SEQ ID NO: 2745979 - RNA, 23 nt, Human
gguuucaccauguuggccaggcu

SEQ ID NO: 2745980 - RNA, 23 nt, Human
gguuucccuucuuuuuguucuuc

SEQ ID NO: 2745981 - RNA, 14 nt, Human
gguuuggacaaaau

SEQ ID NO: 2745982 - RNA, 20 nt, Human
gguuuuaauuagugaacugc

SEQ ID NO: 2745983 - RNA, 11 nt, Human
gguuuuauuau

SEQ ID NO: 2745984 - RNA, 21 nt, Human
gguuuucacauuggaaacaag

SEQ ID NO: 2745985 - RNA, 21 nt, Human
guaaaauacuucuugaagccg

SEQ ID NO: 2745986 - RNA, 16 nt, Human
guaaaauagugaauaa

SEQ ID NO: 2745987 - RNA, 19 nt, Human
guaaaauuaagaaaggaua

SEQ ID NO: 2745988 - RNA, 22 nt, Human
guaaaauuaagaaaggauaaag

SEQ ID NO: 2745989 - RNA, 15 nt, Human
guaaagaacaucccu

SEQ ID NO: 2745990 - RNA, 22 nt, Human
guaaagaacaucccuccuggga

SEQ ID NO: 2745991 - RNA, 16 nt, Human
guaaagaauuauuuug

SEQ ID NO: 2745992 - RNA, 12 nt, Human
guaaaggcaaac

SEQ ID NO: 2745993 - RNA, 20 nt, Human
guaaaggggcagcagugcca

SEQ ID NO: 2745994 - RNA, 22 nt, Human
guaaaggggcagcagugccaaa

SEQ ID NO: 2745995 - RNA, 17 nt, Human
guaaaugugcuuuuaaa

SEQ ID NO: 2745996 - RNA, 22 nt, Human
guaacaggcuugaaucaaagaa

SEQ ID NO: 2745997 - RNA, 17 nt, Human
ggaacccaaguccaagc

SEQ ID NO: 2745998 - RNA, 23 nt, Human
ggaacccuacaccccaacccugg

SEQ ID NO: 2745999 - RNA, 18 nt, Human
ggaacuggugucuucagg

SEQ ID NO: 2746000 - RNA, 20 nt, Human
ggaagaauuuuuauauccac

SEQ ID NO: 2746001 - RNA, 21 nt, Human
ggaagacaagaaggaaagauu

SEQ ID NO: 2746002 - RNA, 17 nt, Human
ggaaggcugaggcagga

SEQ ID NO: 2746003 - RNA, 18 nt, Human
ggaaggcugaggcaggag

SEQ ID NO: 2746004 - RNA, 21 nt, Human
ggaaggcuuacacccacagug

SEQ ID NO: 2746005 - RNA, 12 nt, Human
ggaaggcuucca

SEQ ID NO: 2746006 - RNA, 13 nt, Human
ggaaggcuuccac

SEQ ID NO: 2746007 - RNA, 14 nt, Human
ggaaguagaggagg

SEQ ID NO: 2746008 - RNA, 18 nt, Human
ggaaguauaggccaggca

SEQ ID NO: 2746009 - RNA, 22 nt, Human
ggaagugacgguuuaaugggca

SEQ ID NO: 2746010 - RNA, 17 nt, Human
ggaauauguaaauagaa

SEQ ID NO: 2746011 - RNA, 13 nt, Human
ggaauauuugaau

SEQ ID NO: 2746012 - RNA, 18 nt, Human
ggaauccccaacaugcac

SEQ ID NO: 2746013 - RNA, 14 nt, Human
ggaaucuuguaaag

SEQ ID NO: 2746014 - RNA, 19 nt, Human
ggaaugaagauacugaaau

SEQ ID NO: 2746015 - RNA, 18 nt, Human
ggaauugaggacacugau

SEQ ID NO: 2746016 - RNA, 13 nt, Human
ggaauuggagcuc

SEQ ID NO: 2746017 - RNA, 14 nt, Human
ggaauuuaaaaauc

SEQ ID NO: 2746018 - RNA, 19 nt, Human
ggaauuuaaaucacucaaa

SEQ ID NO: 2746019 - RNA, 13 nt, Human
ggaauuucuucaa

SEQ ID NO: 2746020 - RNA, 12 nt, Human
ggaauuuuauuu

SEQ ID NO: 2746021 - RNA, 19 nt, Human
ggaauuuuauuuuuuucug

SEQ ID NO: 2746022 - RNA, 15 nt, Human
ggacaaaaggaaugu

SEQ ID NO: 2746023 - RNA, 12 nt, Human
ggacacacaaau

SEQ ID NO: 2746024 - RNA, 17 nt, Human
ggacacaggcuccaaac

SEQ ID NO: 2746025 - RNA, 18 nt, Human
ggacacaggcuccaaacu

SEQ ID NO: 2746026 - RNA, 21 nt, Human
ggacacagucuaacaaauucc

SEQ ID NO: 2746027 - RNA, 22 nt, Human
ggacagcccuucuuuccacaga

SEQ ID NO: 2746028 - RNA, 14 nt, Human
ggacagggacccac

SEQ ID NO: 2746029 - RNA, 22 nt, Human
ggacaguaaaauccacagacca

SEQ ID NO: 2746030 - RNA, 18 nt, Human
ggacaguuccugagacca

SEQ ID NO: 2746031 - RNA, 16 nt, Human
ggacaugggccccaga

SEQ ID NO: 2746032 - RNA, 18 nt, Human
ggacauuugcucauggaa

SEQ ID NO: 2746033 - RNA, 18 nt, Human
ggaccaggcacccccaga

SEQ ID NO: 2746034 - RNA, 18 nt, Human
ggaccaguaugcuuggac

SEQ ID NO: 2746035 - RNA, 17 nt, Human
ggaccaucccggccggc

SEQ ID NO: 2746036 - RNA, 23 nt, Human
ggaccaucccggccggcgcgcuc

SEQ ID NO: 2746037 - RNA, 13 nt, Human
ggacccaggaggu

SEQ ID NO: 2746038 - RNA, 22 nt, Human
ggacccagggaugacauguccc

SEQ ID NO: 2746039 - RNA, 21 nt, Human
ggaccggccuuugcaccucca

SEQ ID NO: 2746040 - RNA, 17 nt, Human
ggaccuggggcacugug

SEQ ID NO: 2746041 - RNA, 14 nt, Human
ggacgaaccuugaa

SEQ ID NO: 2746042 - RNA, 15 nt, Human
ggacgcucucuggcc

SEQ ID NO: 2746043 - RNA, 16 nt, Human
ggacgcucucuggccu

SEQ ID NO: 2746044 - RNA, 17 nt, Human
ggacgcucucuggccuu

SEQ ID NO: 2746045 - RNA, 19 nt, Human
ggacgcucucuggccuucg

SEQ ID NO: 2746046 - RNA, 20 nt, Human
ggacgcucucuggccuucgg

SEQ ID NO: 2746047 - RNA, 13 nt, Human
ggacggcuccgga

SEQ ID NO: 2746048 - RNA, 13 nt, Human
ggacuacaggcgu

SEQ ID NO: 2746049 - RNA, 14 nt, Human
ggacucaccucccc

SEQ ID NO: 2746050 - RNA, 15 nt, Human
ggacucaccuccccc

SEQ ID NO: 2746051 - RNA, 19 nt, Human
ggacugaggggaggggagc

SEQ ID NO: 2746052 - RNA, 14 nt, Human
ggacugugugcuca

SEQ ID NO: 2746053 - RNA, 19 nt, Human
ggacugugugcucaggagc

SEQ ID NO: 2746054 - RNA, 12 nt, Human
ggacuuacauga

SEQ ID NO: 2746055 - RNA, 22 nt, Human
ggacuucugucuucacaacaga

SEQ ID NO: 2746056 - RNA, 14 nt, Human
ggagaaaugaaaaa

SEQ ID NO: 2746057 - RNA, 18 nt, Human
ggagaaaugaaaaaauau

SEQ ID NO: 2746058 - RNA, 15 nt, Human
ggagaagaacugaaa

SEQ ID NO: 2746059 - RNA, 22 nt, Human
ggagacaaaacuagagacucaa

SEQ ID NO: 2746060 - RNA, 17 nt, Human
ggagacaaaaucuuaaa

SEQ ID NO: 2746061 - RNA, 13 nt, Human
ggagacaccacca

SEQ ID NO: 2746062 - RNA, 19 nt, Human
ggagacauugaggcaggca

SEQ ID NO: 2746063 - RNA, 21 nt, Human
ggagacauugaggcaggcacu

SEQ ID NO: 2746064 - RNA, 20 nt, Human
ggagaccuacccuccacagg

SEQ ID NO: 2746065 - RNA, 23 nt, Human
ggagaccuacccuccacaggcac

SEQ ID NO: 2746066 - RNA, 16 nt, Human
ggagaggcaaagaaag

SEQ ID NO: 2746067 - RNA, 20 nt, Human
ggagaggcaaagaaaggaga

SEQ ID NO: 2746068 - RNA, 23 nt, Human
ggagauauuuacaugaauugcau

SEQ ID NO: 2746069 - RNA, 20 nt, Human
ggagauggaaguugcaguga

SEQ ID NO: 2746070 - RNA, 14 nt, Human
ggagcaucuccuca

SEQ ID NO: 2746071 - RNA, 23 nt, Human
ggagcaucuccucaacucugagu

SEQ ID NO: 2746072 - RNA, 16 nt, Human
ggagccagggcugucu

SEQ ID NO: 2746073 - RNA, 14 nt, Human
ggagccuccagcug

SEQ ID NO: 2746074 - RNA, 15 nt, Human
ggagccuccagcugc

SEQ ID NO: 2746075 - RNA, 19 nt, Human
ggagccuccagcugccccg

SEQ ID NO: 2746076 - RNA, 17 nt, Human
ggagccuccucucucaa

SEQ ID NO: 2746077 - RNA, 17 nt, Human
ggagcucgugggacagu

SEQ ID NO: 2746078 - RNA, 19 nt, Human
ggagcucugcccauccugc

SEQ ID NO: 2746079 - RNA, 11 nt, Human
ggagcugccuc

SEQ ID NO: 2746080 - RNA, 18 nt, Human
ggaggacgcucucuggcc

SEQ ID NO: 2746081 - RNA, 23 nt, Human
ggaggacgcucucuggccuucgg

SEQ ID NO: 2746082 - RNA, 23 nt, Human
ggaggcagagguugcagugagcc

SEQ ID NO: 2746083 - RNA, 20 nt, Human
ggaggcauccaaaggcuccu

SEQ ID NO: 2746084 - RNA, 13 nt, Human
ggaggccuguccu

SEQ ID NO: 2746085 - RNA, 14 nt, Human
ggaggccuuucccu

SEQ ID NO: 2746086 - RNA, 19 nt, Human
ggaggcuaaagcccagaga

SEQ ID NO: 2746087 - RNA, 16 nt, Human
ggaggcucuggagccc

SEQ ID NO: 2746088 - RNA, 12 nt, Human
ggaggcugagau

SEQ ID NO: 2746089 - RNA, 16 nt, Human
ggaggcugaggcgggu

SEQ ID NO: 2746090 - RNA, 16 nt, Human
ggaggggcgcucgcuu

SEQ ID NO: 2746091 - RNA, 12 nt, Human
ggaggggcuucu

SEQ ID NO: 2746092 - RNA, 18 nt, Human
ggagguccuuaggccucu

SEQ ID NO: 2746093 - RNA, 13 nt, Human
ggaguacacccca

SEQ ID NO: 2746094 - RNA, 22 nt, Human
ggagucucagcuucacccugag

SEQ ID NO: 2746095 - RNA, 12 nt, Human
ggagugcagugg

SEQ ID NO: 2746096 - RNA, 23 nt, Human
ggagugcccccaacagcacccuc

SEQ ID NO: 2746097 - RNA, 19 nt, Human
ggagugugaagcaaggagc

SEQ ID NO: 2746098 - RNA, 20 nt, Human
ggaguucucccaccaccuca

SEQ ID NO: 2746099 - RNA, 16 nt, Human
ggaguuucucuagaag

SEQ ID NO: 2746100 - RNA, 14 nt, Human
ggaguuuggccaga

SEQ ID NO: 2746101 - RNA, 23 nt, Human
ggauaaugaauacuuuauaaagg

SEQ ID NO: 2746102 - RNA, 21 nt, Human
ggauacagccaggcccagagc

SEQ ID NO: 2746103 - RNA, 15 nt, Human
ggauagagugggaca

SEQ ID NO: 2746104 - RNA, 21 nt, Human
ggauccuguguggagagggaa

SEQ ID NO: 2746105 - RNA, 20 nt, Human
ggaucguuuuuucccagggc

SEQ ID NO: 2746106 - RNA, 19 nt, Human
ggaucuggggcucugggau

SEQ ID NO: 2746107 - RNA, 23 nt, Human
ggaugaauuaaguuuuuuuuuaa

SEQ ID NO: 2746108 - RNA, 12 nt, Human
ggaugacauguc

SEQ ID NO: 2746109 - RNA, 13 nt, Human
ggaugauccccac

SEQ ID NO: 2746110 - RNA, 15 nt, Human
ggauggggcuguggg

SEQ ID NO: 2746111 - RNA, 23 nt, Human
ggaugguucccuugaugaagaag

SEQ ID NO: 2746112 - RNA, 19 nt, Human
ggauuaugggucacaggaa

SEQ ID NO: 2746113 - RNA, 15 nt, Human
ggauuccccuaaccu

SEQ ID NO: 2746114 - RNA, 15 nt, Human
ggauuccucacuuug

SEQ ID NO: 2746115 - RNA, 16 nt, Human
ggauucuuccaucuga

SEQ ID NO: 2746116 - RNA, 16 nt, Human
ggauuuuugucuugug

SEQ ID NO: 2746117 - RNA, 13 nt, Human
ggcaaauaucuug

SEQ ID NO: 2746118 - RNA, 21 nt, Human
ggcaaaucucuauuaggaaau

SEQ ID NO: 2746119 - RNA, 17 nt, Human
ggcaacugaggcagaca

SEQ ID NO: 2746120 - RNA, 19 nt, Human
ggcaagaccugauuucuga

SEQ ID NO: 2746121 - RNA, 15 nt, Human
ggcaagcagaagaga

SEQ ID NO: 2746122 - RNA, 15 nt, Human
ggcaagcucuaucac

SEQ ID NO: 2746123 - RNA, 19 nt, Human
ggcaaggguucaccugggc

SEQ ID NO: 2746124 - RNA, 20 nt, Human
ggcaagugggugaaagaugg

SEQ ID NO: 2746125 - RNA, 15 nt, Human
ggcaauagucaaauu

SEQ ID NO: 2746126 - RNA, 22 nt, Human
ggcaauuaauuccuucagcacu

SEQ ID NO: 2746127 - RNA, 22 nt, Human
ggcacaacacaucaggaaagag

SEQ ID NO: 2746128 - RNA, 14 nt, Human
ggcacacaccacca

SEQ ID NO: 2746129 - RNA, 22 nt, Human
ggcacacagcaagucaggguug

SEQ ID NO: 2746130 - RNA, 16 nt, Human
ggcacagaaacuccug

SEQ ID NO: 2746131 - RNA, 18 nt, Human
ggcacagaaacuccuguu

SEQ ID NO: 2746132 - RNA, 21 nt, Human
ggcaccaggacuagggcugga

SEQ ID NO: 2746133 - RNA, 13 nt, Human
ggcacccccagaa

SEQ ID NO: 2746134 - RNA, 23 nt, Human
ggcacuguggguagacacacaug

SEQ ID NO: 2746135 - RNA, 13 nt, Human
ggcacuugggaca

SEQ ID NO: 2746136 - RNA, 19 nt, Human
ggcacuugggacaaaaaca

SEQ ID NO: 2746137 - RNA, 20 nt, Human
ggcacuugggacaaaaacaa

SEQ ID NO: 2746138 - RNA, 13 nt, Human
ggcagaagcaacc

SEQ ID NO: 2746139 - RNA, 19 nt, Human
ggcagaguucuauaaugua

SEQ ID NO: 2746140 - RNA, 12 nt, Human
ggcagcaccucc

SEQ ID NO: 2746141 - RNA, 22 nt, Human
ggcagcaggauagagugggaca

SEQ ID NO: 2746142 - RNA, 20 nt, Human
ggcagcugccuccccuccuc

SEQ ID NO: 2746143 - RNA, 22 nt, Human
ggcagcuuuccucaaaacuuca

SEQ ID NO: 2746144 - RNA, 15 nt, Human
ggcagcuuuuucucu

SEQ ID NO: 2746145 - RNA, 16 nt, Human
ggcagcuuuuucucuc

SEQ ID NO: 2746146 - RNA, 20 nt, Human
ggcaggaggaucacuugagc

SEQ ID NO: 2746147 - RNA, 17 nt, Human
ggcaggucacacaaccu

SEQ ID NO: 2746148 - RNA, 17 nt, Human
ggcaggucugaagcuca

SEQ ID NO: 2746149 - RNA, 23 nt, Human
ggcagguuugcaauccaagcagg

SEQ ID NO: 2746150 - RNA, 17 nt, Human
ggcagugcuuggcccag

SEQ ID NO: 2746151 - RNA, 20 nt, Human
ggcagugggaaaaauguagg

SEQ ID NO: 2746152 - RNA, 15 nt, Human
ggcaucaucucagcu

SEQ ID NO: 2746153 - RNA, 20 nt, Human
ggcauuuaggccaugggaca

SEQ ID NO: 2746154 - RNA, 22 nt, Human
ggcauuuaggccaugggacagg

SEQ ID NO: 2746155 - RNA, 14 nt, Human
ggccaacuaggcag

SEQ ID NO: 2746156 - RNA, 20 nt, Human
ggccacaccaaccuucugag

SEQ ID NO: 2746157 - RNA, 23 nt, Human
ggccacacguggcuggcggccuc

SEQ ID NO: 2746158 - RNA, 14 nt, Human
ggccacaucugagc

SEQ ID NO: 2746159 - RNA, 23 nt, Human
ggccacccaaggaugucugccac

SEQ ID NO: 2746160 - RNA, 14 nt, Human
ggccaccugcugag

SEQ ID NO: 2746161 - RNA, 14 nt, Human
ggccagaagucaag

SEQ ID NO: 2746162 - RNA, 23 nt, Human
ggccagccacggggacucagccc

SEQ ID NO: 2746163 - RNA, 20 nt, Human
ggccagcuuguuauuuauaa

SEQ ID NO: 2746164 - RNA, 16 nt, Human
ggccaggcaugguggu

SEQ ID NO: 2746165 - RNA, 12 nt, Human
ggccaggcuggg

SEQ ID NO: 2746166 - RNA, 17 nt, Human
ggccaugggacagggag

SEQ ID NO: 2746167 - RNA, 13 nt, Human
ggccaugggaggc

SEQ ID NO: 2746168 - RNA, 22 nt, Human
ggccaugggaggccuuucccua

SEQ ID NO: 2746169 - RNA, 22 nt, Human
ggccauuacccccagcuuugag

SEQ ID NO: 2746170 - RNA, 18 nt, Human
ggccccaagcccacuggg

SEQ ID NO: 2746171 - RNA, 16 nt, Human
ggcccccgggccgacg

SEQ ID NO: 2746172 - RNA, 19 nt, Human
ggccccugccucucugcag

SEQ ID NO: 2746173 - RNA, 21 nt, Human
ggccccugccucucugcaggu

SEQ ID NO: 2746174 - RNA, 19 nt, Human
ggccccuuugcugacccuc

SEQ ID NO: 2746175 - RNA, 23 nt, Human
ggccccuuugcugacccucccca

SEQ ID NO: 2746176 - RNA, 23 nt, Human
ggcccgcaugcggcccaggaugg

SEQ ID NO: 2746177 - RNA, 13 nt, Human
ggcccugaaagcg

SEQ ID NO: 2746178 - RNA, 21 nt, Human
ggcccugagcucgguggaccc

SEQ ID NO: 2746179 - RNA, 23 nt, Human
ggcccugcucuuccucagcugug

SEQ ID NO: 2746180 - RNA, 17 nt, Human
ggcccugugcggccugg

SEQ ID NO: 2746181 - RNA, 18 nt, Human
ggcccugugcggccuggu

SEQ ID NO: 2746182 - RNA, 14 nt, Human
ggccgacggagccg

SEQ ID NO: 2746183 - RNA, 14 nt, Human
ggccgcagugaggc

SEQ ID NO: 2746184 - RNA, 15 nt, Human
ggccgcgcugcgcgc

SEQ ID NO: 2746185 - RNA, 16 nt, Human
ggccuagacucugucu

SEQ ID NO: 2746186 - RNA, 16 nt, Human
ggccuccauccugagg

SEQ ID NO: 2746187 - RNA, 23 nt, Human
ggccuccauccugaggcuccacu

SEQ ID NO: 2746188 - RNA, 21 nt, Human
ggccucccuggucccuuggag

SEQ ID NO: 2746189 - RNA, 15 nt, Human
ggccucggagccuca

SEQ ID NO: 2746190 - RNA, 23 nt, Human
ggccugagaccaaggcccccggg

SEQ ID NO: 2746191 - RNA, 15 nt, Human
ggccugcucgcccac

SEQ ID NO: 2746192 - RNA, 21 nt, Human
ggccugcucgcccacuuccuc

SEQ ID NO: 2746193 - RNA, 23 nt, Human
ggccugcucgcccacuuccuccc

SEQ ID NO: 2746194 - RNA, 12 nt, Human
ggccuggcuggg

SEQ ID NO: 2746195 - RNA, 17 nt, Human
ggccuggggagauggag

SEQ ID NO: 2746196 - RNA, 20 nt, Human
ggccuggggcuucugaggcu

SEQ ID NO: 2746197 - RNA, 15 nt, Human
ggccuucggccucca

SEQ ID NO: 2746198 - RNA, 16 nt, Human
ggccuuggcugacaug

SEQ ID NO: 2746199 - RNA, 15 nt, Human
ggcgcgaucucagcu

SEQ ID NO: 2746200 - RNA, 21 nt, Human
ggcgcgcaccuguaaucccag

SEQ ID NO: 2746201 - RNA, 17 nt, Human
ggcgcgcgccaccacgc

SEQ ID NO: 2746202 - RNA, 21 nt, Human
ggcgcgcgccaccacgcccag

SEQ ID NO: 2746203 - RNA, 22 nt, Human
ggcgcggggcggggagcgagcc

SEQ ID NO: 2746204 - RNA, 17 nt, Human
ggcgcgugcaggcagca

SEQ ID NO: 2746205 - RNA, 18 nt, Human
ggcgcuggcugcgcucgg

SEQ ID NO: 2746206 - RNA, 20 nt, Human
ggcgcuggcugcgcucggcc

SEQ ID NO: 2746207 - RNA, 23 nt, Human
ggcgcuggcugcgcucggccugc

SEQ ID NO: 2746208 - RNA, 14 nt, Human
ggcgggacacaggc

SEQ ID NO: 2746209 - RNA, 16 nt, Human
ggcgggagggcgcggg

SEQ ID NO: 2746210 - RNA, 19 nt, Human
ggcgugaccugacagccca

SEQ ID NO: 2746211 - RNA, 21 nt, Human
ggcgugaccugacagcccaag

SEQ ID NO: 2746212 - RNA, 17 nt, Human
ggcgugaccugccaggc

SEQ ID NO: 2746213 - RNA, 13 nt, Human
ggcgugaucucag

SEQ ID NO: 2746214 - RNA, 12 nt, Human
ggcgugcagcau

SEQ ID NO: 2746215 - RNA, 18 nt, Human
ggcuaagcaaaaugugau

SEQ ID NO: 2746216 - RNA, 16 nt, Human
ggcuaagcacgggcca

SEQ ID NO: 2746217 - RNA, 15 nt, Human
ggcuaaggcaggagg

SEQ ID NO: 2746218 - RNA, 16 nt, Human
ggcuaauaucuuaucu

SEQ ID NO: 2746219 - RNA, 14 nt, Human
ggcuacagugagcc

SEQ ID NO: 2746220 - RNA, 19 nt, Human
ggcuaccccuuuacaaaua

SEQ ID NO: 2746221 - RNA, 20 nt, Human
ggcuacgcgcgcuccgcgca

SEQ ID NO: 2746222 - RNA, 16 nt, Human
ggcuagacuagucuca

SEQ ID NO: 2746223 - RNA, 11 nt, Human
ggcuaucugug

SEQ ID NO: 2746224 - RNA, 13 nt, Human
ggcuaugauuguc

SEQ ID NO: 2746225 - RNA, 13 nt, Human
ggcuauucacaac

SEQ ID NO: 2746226 - RNA, 16 nt, Human
ggcuauuuaaagacaa

SEQ ID NO: 2746227 - RNA, 17 nt, Human
ggcucacugcaaccucc

SEQ ID NO: 2746228 - RNA, 14 nt, Human
ggcucagauuauaa

SEQ ID NO: 2746229 - RNA, 14 nt, Human
ggcuccagcuggcc

SEQ ID NO: 2746230 - RNA, 16 nt, Human
ggcuccagcuggccgg

SEQ ID NO: 2746231 - RNA, 18 nt, Human
ggcuccggacgcugcugc

SEQ ID NO: 2746232 - RNA, 20 nt, Human
ggcuccggacgcugcugccg

SEQ ID NO: 2746233 - RNA, 23 nt, Human
ggcuccuccauaucucccucuuc

SEQ ID NO: 2746234 - RNA, 19 nt, Human
ggcucuaauguacaauaaa

SEQ ID NO: 2746235 - RNA, 17 nt, Human
ggcucuggacaggcacu

SEQ ID NO: 2746236 - RNA, 21 nt, Human
ggcucuuuccuccacaccauu

SEQ ID NO: 2746237 - RNA, 15 nt, Human
ggcugagaugggaga

SEQ ID NO: 2746238 - RNA, 18 nt, Human
ggcugagccucagucucc

SEQ ID NO: 2746239 - RNA, 15 nt, Human
ggcugaggcgggugg

SEQ ID NO: 2746240 - RNA, 12 nt, Human
ggcugaugcagu

SEQ ID NO: 2746241 - RNA, 16 nt, Human
ggcugccuucuggccu

SEQ ID NO: 2746242 - RNA, 14 nt, Human
ggcugcuagcacuu

SEQ ID NO: 2746243 - RNA, 16 nt, Human
ggcugcugcugugcag

SEQ ID NO: 2746244 - RNA, 14 nt, Human
ggcugcugguggcg

SEQ ID NO: 2746245 - RNA, 22 nt, Human
ggcugcugguggcgcuggcugc

SEQ ID NO: 2746246 - RNA, 15 nt, Human
ggcuggacuaggccu

SEQ ID NO: 2746247 - RNA, 14 nt, Human
ggcuggagucugca

SEQ ID NO: 2746248 - RNA, 15 nt, Human
ggcuggagugcagug

SEQ ID NO: 2746249 - RNA, 20 nt, Human
ggcuggagugcaguggcgca

SEQ ID NO: 2746250 - RNA, 16 nt, Human
ggcuggcaccgcugua

SEQ ID NO: 2746251 - RNA, 15 nt, Human
ggcuggcgugcagca

SEQ ID NO: 2746252 - RNA, 22 nt, Human
ggcuggggcauggaaggcaaga

SEQ ID NO: 2746253 - RNA, 16 nt, Human
ggcugggucgcccugg

SEQ ID NO: 2746254 - RNA, 17 nt, Human
ggcugggucgcccugga

SEQ ID NO: 2746255 - RNA, 21 nt, Human
ggcuggucucgaacugcugga

SEQ ID NO: 2746256 - RNA, 21 nt, Human
ggcuguggauuuaauguggaa

SEQ ID NO: 2746257 - RNA, 20 nt, Human
ggcuguucccaccaggcugc

SEQ ID NO: 2746258 - RNA, 15 nt, Human
ggcuuagacccucau

SEQ ID NO: 2746259 - RNA, 21 nt, Human
ggcuuagacccucaugcugcc

SEQ ID NO: 2746260 - RNA, 17 nt, Human
ggcuugaggacuugggc

SEQ ID NO: 2746261 - RNA, 11 nt, Human
ggcuuguaaag

SEQ ID NO: 2746262 - RNA, 21 nt, Human
ggcuuguaaaguacagacuuu

SEQ ID NO: 2746263 - RNA, 21 nt, Human
ggcuuuaacuccugcuagaac

SEQ ID NO: 2746264 - RNA, 19 nt, Human
gggaaaagaaaaagauuga

SEQ ID NO: 2746265 - RNA, 22 nt, Human
gggaaacaaaaggauaaugaau

SEQ ID NO: 2746266 - RNA, 11 nt, Human
gggaaagaaga

SEQ ID NO: 2746267 - RNA, 13 nt, Human
gggaaagaagagc

SEQ ID NO: 2746268 - RNA, 18 nt, Human
gggaacaaggaaggaaag

SEQ ID NO: 2746269 - RNA, 12 nt, Human
gggaagacagug

SEQ ID NO: 2746270 - RNA, 17 nt, Human
gggaagccuuggggcug

SEQ ID NO: 2746271 - RNA, 16 nt, Human
gggaaggagacaaaac

SEQ ID NO: 2746272 - RNA, 20 nt, Human
gggaaugaagauacugaaau

SEQ ID NO: 2746273 - RNA, 22 nt, Human
gggaauuucuucaacucccugc

SEQ ID NO: 2746274 - RNA, 15 nt, Human
gggacagggacccac

SEQ ID NO: 2746275 - RNA, 19 nt, Human
gggacagggaggacgcucu

SEQ ID NO: 2746276 - RNA, 15 nt, Human
gggacaguuccugag

SEQ ID NO: 2746277 - RNA, 22 nt, Human
gggaccccugagcuugcagaga

SEQ ID NO: 2746278 - RNA, 19 nt, Human
gggaccugcuguuuccuag

SEQ ID NO: 2746279 - RNA, 11 nt, Human
gggaccugggc

SEQ ID NO: 2746280 - RNA, 20 nt, Human
gggacucaucuuucccuccu

SEQ ID NO: 2746281 - RNA, 17 nt, Human
gggagccugaucaccug

SEQ ID NO: 2746282 - RNA, 21 nt, Human
gggagccugaucaccugcccu

SEQ ID NO: 2746283 - RNA, 23 nt, Human
gggagccugaucaccugcccugc

SEQ ID NO: 2746284 - RNA, 17 nt, Human
gggagcgagccccaggc

SEQ ID NO: 2746285 - RNA, 20 nt, Human
gggaggcagagguugcagug

SEQ ID NO: 2746286 - RNA, 20 nt, Human
gggagugcccccaacagcac

SEQ ID NO: 2746287 - RNA, 13 nt, Human
gggaguggcgcgc

SEQ ID NO: 2746288 - RNA, 14 nt, Human
gggaguggcgcgcg

SEQ ID NO: 2746289 - RNA, 17 nt, Human
gggagugggcuaagcac

SEQ ID NO: 2746290 - RNA, 21 nt, Human
gggaucacugaugacuuuuua

SEQ ID NO: 2746291 - RNA, 16 nt, Human
gggauuguaaaauggu

SEQ ID NO: 2746292 - RNA, 14 nt, Human
gggcaagagagcga

SEQ ID NO: 2746293 - RNA, 20 nt, Human
gggcaauuaauuccuucagc

SEQ ID NO: 2746294 - RNA, 22 nt, Human
gggcagccagaccagcaggcug

SEQ ID NO: 2746295 - RNA, 23 nt, Human
gggcagcugccuccccuccucug

SEQ ID NO: 2746296 - RNA, 18 nt, Human
gcccugugcggccugguc

SEQ ID NO: 2746297 - RNA, 19 nt, Human
gcccugugcggccuggucu

SEQ ID NO: 2746298 - RNA, 13 nt, Human
gcccuguuaaaag

SEQ ID NO: 2746299 - RNA, 13 nt, Human
gcccuuagcccuu

SEQ ID NO: 2746300 - RNA, 17 nt, Human
gcccuuccccucugcag

SEQ ID NO: 2746301 - RNA, 13 nt, Human
gcccuuccugcag

SEQ ID NO: 2746302 - RNA, 14 nt, Human
gccgacggagccgg

SEQ ID NO: 2746303 - RNA, 15 nt, Human
gccgacggagccggg

SEQ ID NO: 2746304 - RNA, 14 nt, Human
gccgagccucaaga

SEQ ID NO: 2746305 - RNA, 19 nt, Human
gccgcgcuccucggacggc

SEQ ID NO: 2746306 - RNA, 13 nt, Human
gccgcgcugcgcg

SEQ ID NO: 2746307 - RNA, 15 nt, Human
gccgcgcugcgcgcc

SEQ ID NO: 2746308 - RNA, 16 nt, Human
gccgcgcugcgcgccg

SEQ ID NO: 2746309 - RNA, 19 nt, Human
gccgcgcugcgcgccgcgc

SEQ ID NO: 2746310 - RNA, 20 nt, Human
gccgcgcugcgcgccgcgcu

SEQ ID NO: 2746311 - RNA, 12 nt, Human
gccgcucucucu

SEQ ID NO: 2746312 - RNA, 16 nt, Human
gccgcucucucugagg

SEQ ID NO: 2746313 - RNA, 12 nt, Human
gccgcugucucu

SEQ ID NO: 2746314 - RNA, 15 nt, Human
gccgcugucucugag

SEQ ID NO: 2746315 - RNA, 15 nt, Human
gccgcuuaagcuuuc

SEQ ID NO: 2746316 - RNA, 15 nt, Human
gccgcuuucucugag

SEQ ID NO: 2746317 - RNA, 13 nt, Human
gccggagccucca

SEQ ID NO: 2746318 - RNA, 15 nt, Human
gccggagccuccagc

SEQ ID NO: 2746319 - RNA, 18 nt, Human
gccggagccuccagcugc

SEQ ID NO: 2746320 - RNA, 22 nt, Human
gccggagccuccagcugccccg

SEQ ID NO: 2746321 - RNA, 12 nt, Human
gccggcgcgcuc

SEQ ID NO: 2746322 - RNA, 21 nt, Human
gccggcgcgcucaucccaccc

SEQ ID NO: 2746323 - RNA, 23 nt, Human
gccggcgcgcucaucccacccgc

SEQ ID NO: 2746324 - RNA, 19 nt, Human
gccgggaaagaagagccgg

SEQ ID NO: 2746325 - RNA, 20 nt, Human
gccgggaaagaagagccgga

SEQ ID NO: 2746326 - RNA, 21 nt, Human
gccgggaaagaagagccggag

SEQ ID NO: 2746327 - RNA, 22 nt, Human
gccgggagccugaucaccugcc

SEQ ID NO: 2746328 - RNA, 14 nt, Human
gccgggcauggugg

SEQ ID NO: 2746329 - RNA, 15 nt, Human
gccgggcgcgguggc

SEQ ID NO: 2746330 - RNA, 18 nt, Human
gccgggcgcgguggcuca

SEQ ID NO: 2746331 - RNA, 17 nt, Human
gccgguccuugcugcac

SEQ ID NO: 2746332 - RNA, 13 nt, Human
gccguccccagag

SEQ ID NO: 2746333 - RNA, 15 nt, Human
gccguccccagagcu

SEQ ID NO: 2746334 - RNA, 18 nt, Human
gccguccccagagcuaca

SEQ ID NO: 2746335 - RNA, 20 nt, Human
gccguccccagagcuacagg

SEQ ID NO: 2746336 - RNA, 23 nt, Human
gccgugggccugagaccaaggcc

SEQ ID NO: 2746337 - RNA, 18 nt, Human
gccuaagggauccugccu

SEQ ID NO: 2746338 - RNA, 16 nt, Human
gccuaagugcagcccc

SEQ ID NO: 2746339 - RNA, 17 nt, Human
gccuaagugcagccccg

SEQ ID NO: 2746340 - RNA, 20 nt, Human
gccuaauuuguuuucccuuc

SEQ ID NO: 2746341 - RNA, 16 nt, Human
gccuacuaaaugcuca

SEQ ID NO: 2746342 - RNA, 18 nt, Human
gccuagccgaccucagcc

SEQ ID NO: 2746343 - RNA, 17 nt, Human
gccuaggcauagcccug

SEQ ID NO: 2746344 - RNA, 16 nt, Human
gccuaguugaucagcu

SEQ ID NO: 2746345 - RNA, 21 nt, Human
gccuauagucccacuacuugu

SEQ ID NO: 2746346 - RNA, 12 nt, Human
gccuauauuuuu

SEQ ID NO: 2746347 - RNA, 16 nt, Human
gccuaucagcauuuua

SEQ ID NO: 2746348 - RNA, 17 nt, Human
gccuaugcagaggucca

SEQ ID NO: 2746349 - RNA, 15 nt, Human
gccuauuuuaauaaa

SEQ ID NO: 2746350 - RNA, 12 nt, Human
gccucaaccucc

SEQ ID NO: 2746351 - RNA, 20 nt, Human
gccucaaccucccaagcagu

SEQ ID NO: 2746352 - RNA, 14 nt, Human
gccucaccagcccu

SEQ ID NO: 2746353 - RNA, 13 nt, Human
gccucagccuccc

SEQ ID NO: 2746354 - RNA, 15 nt, Human
gccucagucucccuc

SEQ ID NO: 2746355 - RNA, 13 nt, Human
gccucaguuuccu

SEQ ID NO: 2746356 - RNA, 18 nt, Human
gccuccagcugccccggg

SEQ ID NO: 2746357 - RNA, 20 nt, Human
gccuccagcugccccgggga

SEQ ID NO: 2746358 - RNA, 21 nt, Human
gccuccauccugaggcuccac

SEQ ID NO: 2746359 - RNA, 22 nt, Human
gccuccauccugaggcuccacu

SEQ ID NO: 2746360 - RNA, 16 nt, Human
gccucccaaagugcug

SEQ ID NO: 2746361 - RNA, 16 nt, Human
gccucccaaguagcug

SEQ ID NO: 2746362 - RNA, 15 nt, Human
gccuccccuccucug

SEQ ID NO: 2746363 - RNA, 17 nt, Human
gccuccccuccucugcu

SEQ ID NO: 2746364 - RNA, 22 nt, Human
gccuccccuccucugcuugcca

SEQ ID NO: 2746365 - RNA, 20 nt, Human
gccuccgcuacuuccagggc

SEQ ID NO: 2746366 - RNA, 13 nt, Human
gccuccucucuca

SEQ ID NO: 2746367 - RNA, 18 nt, Human
gccuccucuguccagggc

SEQ ID NO: 2746368 - RNA, 17 nt, Human
gccuccuuuuaaaguaa

SEQ ID NO: 2746369 - RNA, 15 nt, Human
gccucggagccucau

SEQ ID NO: 2746370 - RNA, 16 nt, Human
gccucuaaaaggccug

SEQ ID NO: 2746371 - RNA, 20 nt, Human
gccucuaaaaggccuguccc

SEQ ID NO: 2746372 - RNA, 13 nt, Human
gccucugagaagc

SEQ ID NO: 2746373 - RNA, 16 nt, Human
gccucugagaagcucu

SEQ ID NO: 2746374 - RNA, 18 nt, Human
gccucuuagaugcaguuc

SEQ ID NO: 2746375 - RNA, 18 nt, Human
gccugaaacucauagaca

SEQ ID NO: 2746376 - RNA, 16 nt, Human
gccugacugccaagcc

SEQ ID NO: 2746377 - RNA, 16 nt, Human
gccugagaccaaggcc

SEQ ID NO: 2746378 - RNA, 21 nt, Human
gccugagaccaaggcccccgg

SEQ ID NO: 2746379 - RNA, 18 nt, Human
gccugagcgacagugaga

SEQ ID NO: 2746380 - RNA, 23 nt, Human
gccugagcggaccuucccagcua

SEQ ID NO: 2746381 - RNA, 19 nt, Human
gccugaucaccugcccugc

SEQ ID NO: 2746382 - RNA, 14 nt, Human
gccugcaauauuug

SEQ ID NO: 2746383 - RNA, 22 nt, Human
gccugcagacucacugugggaa

SEQ ID NO: 2746384 - RNA, 17 nt, Human
gccugccccuacccugg

SEQ ID NO: 2746385 - RNA, 22 nt, Human
gccugccuccccugccucacca

SEQ ID NO: 2746386 - RNA, 15 nt, Human
gccugccuuucuccc

SEQ ID NO: 2746387 - RNA, 17 nt, Human
gccugccuuucuccccc

SEQ ID NO: 2746388 - RNA, 16 nt, Human
gccugcucccuagcca

SEQ ID NO: 2746389 - RNA, 17 nt, Human
gccugcucccuagccag

SEQ ID NO: 2746390 - RNA, 19 nt, Human
gccugcucccuagccagag

SEQ ID NO: 2746391 - RNA, 13 nt, Human
gccugcucgccca

SEQ ID NO: 2746392 - RNA, 21 nt, Human
gccugcucgcccacuuccucc

SEQ ID NO: 2746393 - RNA, 22 nt, Human
gccugcuggauguggagggggc

SEQ ID NO: 2746394 - RNA, 17 nt, Human
gccuggcgggguggggu

SEQ ID NO: 2746395 - RNA, 19 nt, Human
gccuggcgggguggggugg

SEQ ID NO: 2746396 - RNA, 18 nt, Human
gccuggcucucccagcca

SEQ ID NO: 2746397 - RNA, 18 nt, Human
gccuggcugggaguggca

SEQ ID NO: 2746398 - RNA, 15 nt, Human
gccuggcuucaaauu

SEQ ID NO: 2746399 - RNA, 13 nt, Human
gccugggugacag

SEQ ID NO: 2746400 - RNA, 18 nt, Human
gccuggucaacaugguga

SEQ ID NO: 2746401 - RNA, 13 nt, Human
gccuguaaucaca

SEQ ID NO: 2746402 - RNA, 15 nt, Human
gccuguaaucccagc

SEQ ID NO: 2746403 - RNA, 14 nt, Human
gccuguacccagua

SEQ ID NO: 2746404 - RNA, 18 nt, Human
gccuuccccuugcccagg

SEQ ID NO: 2746405 - RNA, 21 nt, Human
gccuuccccuugcccagggcu

SEQ ID NO: 2746406 - RNA, 13 nt, Human
gccuucggccucc

SEQ ID NO: 2746407 - RNA, 18 nt, Human
gccuucggccuccauccu

SEQ ID NO: 2746408 - RNA, 16 nt, Human
gccuucucuguucauu

SEQ ID NO: 2746409 - RNA, 21 nt, Human
gccuucucuguucauuuccuc

SEQ ID NO: 2746410 - RNA, 18 nt, Human
gccuucuggccuuguaag

SEQ ID NO: 2746411 - RNA, 18 nt, Human
gccuuggauacuccaugg

SEQ ID NO: 2746412 - RNA, 15 nt, Human
gccuuggcuucccaa

SEQ ID NO: 2746413 - RNA, 14 nt, Human
gccuugggaccccu

SEQ ID NO: 2746414 - RNA, 18 nt, Human
gccuuggggcugaugcag

SEQ ID NO: 2746415 - RNA, 16 nt, Human
gccuugguauagcaua

SEQ ID NO: 2746416 - RNA, 14 nt, Human
gccuuguuucaaca

SEQ ID NO: 2746417 - RNA, 12 nt, Human
gcgacagugaga

SEQ ID NO: 2746418 - RNA, 13 nt, Human
gcgacagugagac

SEQ ID NO: 2746419 - RNA, 21 nt, Human
gcgagacccugucucaauaaa

SEQ ID NO: 2746420 - RNA, 12 nt, Human
gcgagcgcgcgc

SEQ ID NO: 2746421 - RNA, 14 nt, Human
gcgagcgcgcgcgc

SEQ ID NO: 2746422 - RNA, 15 nt, Human
gcgagcgcgcgcgcc

SEQ ID NO: 2746423 - RNA, 16 nt, Human
gcgauucuccugccuc

SEQ ID NO: 2746424 - RNA, 12 nt, Human
gcgcagccaugu

SEQ ID NO: 2746425 - RNA, 16 nt, Human
gcgcagcucaggcugg

SEQ ID NO: 2746426 - RNA, 17 nt, Human
gcgccaccacgcccagc

SEQ ID NO: 2746427 - RNA, 18 nt, Human
gcgcccacuagacccacu

SEQ ID NO: 2746428 - RNA, 16 nt, Human
gcgcccucuggcugcu

SEQ ID NO: 2746429 - RNA, 19 nt, Human
gcgcccucuggcugcuggu

SEQ ID NO: 2746430 - RNA, 13 nt, Human
gcgccgcgcuccu

SEQ ID NO: 2746431 - RNA, 21 nt, Human
gcgccgcgcuccucggacggc

SEQ ID NO: 2746432 - RNA, 19 nt, Human
gcgccuccgcuacuuccag

SEQ ID NO: 2746433 - RNA, 12 nt, Human
gcgcgaucucag

SEQ ID NO: 2746434 - RNA, 15 nt, Human
gcgcgcaccuguaau

SEQ ID NO: 2746435 - RNA, 16 nt, Human
gcgcgccaccacgccc

SEQ ID NO: 2746436 - RNA, 18 nt, Human
gcgcgcccucuggcugcu

SEQ ID NO: 2746437 - RNA, 13 nt, Human
gcgcgccuccgcu

SEQ ID NO: 2746438 - RNA, 15 nt, Human
gcgcgccuccgcuac

SEQ ID NO: 2746439 - RNA, 12 nt, Human
gcgcgcgccacc

SEQ ID NO: 2746440 - RNA, 13 nt, Human
gcgcgcgccacca

SEQ ID NO: 2746441 - RNA, 14 nt, Human
gcgcgcgccaccac

SEQ ID NO: 2746442 - RNA, 20 nt, Human
gcgcgcucaucccacccgcc

SEQ ID NO: 2746443 - RNA, 14 nt, Human
gcgcgcuccgcgca

SEQ ID NO: 2746444 - RNA, 23 nt, Human
gcgcggcgggagggcgcggggcg

SEQ ID NO: 2746445 - RNA, 20 nt, Human
gcgcggggcggggagcgagc

SEQ ID NO: 2746446 - RNA, 16 nt, Human
gcgcucaucccacccg

SEQ ID NO: 2746447 - RNA, 12 nt, Human
gcgcuccgcgca

SEQ ID NO: 2746448 - RNA, 18 nt, Human
gcgcucgcuuccgcaucc

SEQ ID NO: 2746449 - RNA, 13 nt, Human
gcgcucggccugc

SEQ ID NO: 2746450 - RNA, 21 nt, Human
gcgcucggccugcucgcccac

SEQ ID NO: 2746451 - RNA, 14 nt, Human
gcgcugcgcgccgc

SEQ ID NO: 2746452 - RNA, 17 nt, Human
gcgcugcgcgccgcgcu

SEQ ID NO: 2746453 - RNA, 20 nt, Human
gcgcugcgcgccgcgcuccu

SEQ ID NO: 2746454 - RNA, 11 nt, Human
gcgcuggcugc

SEQ ID NO: 2746455 - RNA, 23 nt, Human
gcgcuggcugcgcucggccugcu

SEQ ID NO: 2746456 - RNA, 19 nt, Human
gcgcuucaguucagcuuua

SEQ ID NO: 2746457 - RNA, 15 nt, Human
gcggaccuucccagc

SEQ ID NO: 2746458 - RNA, 18 nt, Human
gcggaccuucccagcuag

SEQ ID NO: 2746459 - RNA, 21 nt, Human
gcggccagcuccgcgccagga

SEQ ID NO: 2746460 - RNA, 13 nt, Human
gcggccuggucua

SEQ ID NO: 2746461 - RNA, 22 nt, Human
gcggggagcgagccccaggcgg

SEQ ID NO: 2746462 - RNA, 16 nt, Human
gcgggguggggugggg

SEQ ID NO: 2746463 - RNA, 13 nt, Human
gcgugagccacca

SEQ ID NO: 2746464 - RNA, 15 nt, Human
gcgugagccaccaaa

SEQ ID NO: 2746465 - RNA, 15 nt, Human
gcgugagccaccaug

SEQ ID NO: 2746466 - RNA, 14 nt, Human
gcguugagccacca

SEQ ID NO: 2746467 - RNA, 23 nt, Human
gcguugagccaccaagcuggugg

SEQ ID NO: 2746468 - RNA, 11 nt, Human
gcuaaaacaag

SEQ ID NO: 2746469 - RNA, 23 nt, Human
gcuaaaacaagcacuaaacaaag

SEQ ID NO: 2746470 - RNA, 17 nt, Human
gcuaacugguuaaacau

SEQ ID NO: 2746471 - RNA, 17 nt, Human
gcuaauuagcauggcca

SEQ ID NO: 2746472 - RNA, 13 nt, Human
gcuacaaaaacac

SEQ ID NO: 2746473 - RNA, 20 nt, Human
gcuacaaaugcauuucuaaa

SEQ ID NO: 2746474 - RNA, 21 nt, Human
gcuacaaaugcauuucuaaag

SEQ ID NO: 2746475 - RNA, 16 nt, Human
gcuacaggauuugaaa

SEQ ID NO: 2746476 - RNA, 17 nt, Human
gcuacccucauuucuca

SEQ ID NO: 2746477 - RNA, 19 nt, Human
gcuaccugcucagcccugc

SEQ ID NO: 2746478 - RNA, 20 nt, Human
gcuaccugcucagcccugca

SEQ ID NO: 2746479 - RNA, 21 nt, Human
gcuaccugcucagcccugcac

SEQ ID NO: 2746480 - RNA, 23 nt, Human
gcuaccugcucagcccugcacca

SEQ ID NO: 2746481 - RNA, 17 nt, Human
gcuaccuguaacuugaa

SEQ ID NO: 2746482 - RNA, 19 nt, Human
gcuaccuuuugcuguggca

SEQ ID NO: 2746483 - RNA, 22 nt, Human
gcuaccuuuugcuguggcaaau

SEQ ID NO: 2746484 - RNA, 13 nt, Human
gcuacgcgcgcuc

SEQ ID NO: 2746485 - RNA, 21 nt, Human
gcuacgcgcgcuccgcgcagc

SEQ ID NO: 2746486 - RNA, 22 nt, Human
gcuacuaauuuuaaaaugucuu

SEQ ID NO: 2746487 - RNA, 15 nt, Human
gcuacuugggaggcu

SEQ ID NO: 2746488 - RNA, 15 nt, Human
gcuagaaccaccugc

SEQ ID NO: 2746489 - RNA, 13 nt, Human
gcuagaacucccu

SEQ ID NO: 2746490 - RNA, 13 nt, Human
gcuaguuuauaua

SEQ ID NO: 2746491 - RNA, 18 nt, Human
gcuauaggauguggggaa

SEQ ID NO: 2746492 - RNA, 13 nt, Human
gcuaucaauccaa

SEQ ID NO: 2746493 - RNA, 14 nt, Human
gcuaucgcaccacu

SEQ ID NO: 2746494 - RNA, 11 nt, Human
gcuaugcuauu

SEQ ID NO: 2746495 - RNA, 23 nt, Human
gcuaugcuauugaaguuuuggca

SEQ ID NO: 2746496 - RNA, 12 nt, Human
gcuauucacaac

SEQ ID NO: 2746497 - RNA, 17 nt, Human
gcuauucuccauacucu

SEQ ID NO: 2746498 - RNA, 16 nt, Human
gcuauuugcuguuauu

SEQ ID NO: 2746499 - RNA, 23 nt, Human
gcucaacaagagacuggaaggac

SEQ ID NO: 2746500 - RNA, 14 nt, Human
gcucaacauaacau

SEQ ID NO: 2746501 - RNA, 17 nt, Human
gcucacaggagcuuaaa

SEQ ID NO: 2746502 - RNA, 15 nt, Human
gcucacgccuguaau

SEQ ID NO: 2746503 - RNA, 23 nt, Human
gcucacuacaaccuccgccuccc

SEQ ID NO: 2746504 - RNA, 14 nt, Human
gcucacugcaaccu

SEQ ID NO: 2746505 - RNA, 22 nt, Human
gcucacugcaaccucugccucc

SEQ ID NO: 2746506 - RNA, 23 nt, Human
gcucagaaaugucauguggcuac

SEQ ID NO: 2746507 - RNA, 22 nt, Human
gcucagcccugcaccaugcugc

SEQ ID NO: 2746508 - RNA, 24 nt, Human
gcucagcccugcaccaugcugcug

SEQ ID NO: 2746509 - RNA, 15 nt, Human
gcucagcccuggugg

SEQ ID NO: 2746510 - RNA, 22 nt, Human
gcucagccuggugggccuccuc

SEQ ID NO: 2746511 - RNA, 16 nt, Human
gcucagcuucuccaac

SEQ ID NO: 2746512 - RNA, 14 nt, Human
gcucaggagcccug

SEQ ID NO: 2746513 - RNA, 11 nt, Human
gcucaggcaca

SEQ ID NO: 2746514 - RNA, 14 nt, Human
gcucaggcacacuu

SEQ ID NO: 2746515 - RNA, 17 nt, Human
gcucagggcucuuuccu

SEQ ID NO: 2746516 - RNA, 15 nt, Human
gcucagguggugagu

SEQ ID NO: 2746517 - RNA, 22 nt, Human
gcucagguggugaguccuccug

SEQ ID NO: 2746518 - RNA, 24 nt, Human
gcucagugggggcagagccaccug

SEQ ID NO: 2746519 - RNA, 20 nt, Human
gcucaucccacccgcccacc

SEQ ID NO: 2746520 - RNA, 21 nt, Human
gcucaucccacccgcccaccg

SEQ ID NO: 2746521 - RNA, 23 nt, Human
gcucaucccacccgcccaccgca

SEQ ID NO: 2746522 - RNA, 18 nt, Human
gcucauggaauuggagcu

SEQ ID NO: 2746523 - RNA, 22 nt, Human
gcucauggaauuggagcucgug

SEQ ID NO: 2746524 - RNA, 17 nt, Human
gcuccaaacuggagcuu

SEQ ID NO: 2746525 - RNA, 16 nt, Human
gcuccaagaauuucua

SEQ ID NO: 2746526 - RNA, 13 nt, Human
gcuccacccucuu

SEQ ID NO: 2746527 - RNA, 15 nt, Human
gcuccacuuggucug

SEQ ID NO: 2746528 - RNA, 14 nt, Human
gcuccagcugcucu

SEQ ID NO: 2746529 - RNA, 20 nt, Human
gcuccagcugcucugucuuc

SEQ ID NO: 2746530 - RNA, 13 nt, Human
gcuccagcuggcc

SEQ ID NO: 2746531 - RNA, 17 nt, Human
gcuccauucaaagugag

SEQ ID NO: 2746532 - RNA, 21 nt, Human
gcucccaggaggggcuucugg

SEQ ID NO: 2746533 - RNA, 20 nt, Human
gcucccuagccagaggcucu

SEQ ID NO: 2746534 - RNA, 21 nt, Human
gcucccuuuggagauuuuuua

SEQ ID NO: 2746535 - RNA, 14 nt, Human
gcuccgcgcagcuc

SEQ ID NO: 2746536 - RNA, 22 nt, Human
gcuccgcgcagcucaggcuggc

SEQ ID NO: 2746537 - RNA, 20 nt, Human
gcuccgcgccaggauggcgc

SEQ ID NO: 2746538 - RNA, 15 nt, Human
gcuccggacgcugcu

SEQ ID NO: 2746539 - RNA, 21 nt, Human
gcuccggacgcugcugccgug

SEQ ID NO: 2746540 - RNA, 22 nt, Human
gcuccuccagggagucucagcu

SEQ ID NO: 2746541 - RNA, 14 nt, Human
gcucgcccacuucc

SEQ ID NO: 2746542 - RNA, 21 nt, Human
gcucgcccacuuccucccggc

SEQ ID NO: 2746543 - RNA, 22 nt, Human
gcucgcccacuuccucccggcc

SEQ ID NO: 2746544 - RNA, 15 nt, Human
gcucgcuuccgcauc

SEQ ID NO: 2746545 - RNA, 17 nt, Human
gcucggccugcucgccc

SEQ ID NO: 2746546 - RNA, 12 nt, Human
gcucggugcucc

SEQ ID NO: 2746547 - RNA, 16 nt, Human
gcucgguggacccagg

SEQ ID NO: 2746548 - RNA, 18 nt, Human
gcucuaaacauguuuauc

SEQ ID NO: 2746549 - RNA, 17 nt, Human
gcucuaauguacaauaa

SEQ ID NO: 2746550 - RNA, 18 nt, Human
gcucuaauguacaauaaa

SEQ ID NO: 2746551 - RNA, 17 nt, Human
gcucuaucaccaaggag

SEQ ID NO: 2746552 - RNA, 11 nt, Human
gcucucagcca

SEQ ID NO: 2746553 - RNA, 14 nt, Human
gcucucggugcuuc

SEQ ID NO: 2746554 - RNA, 13 nt, Human
gcucucucugagg

SEQ ID NO: 2746555 - RNA, 14 nt, Human
gcucucuggccuuc

SEQ ID NO: 2746556 - RNA, 15 nt, Human
gcucucuggccuucg

SEQ ID NO: 2746557 - RNA, 17 nt, Human
gcucucuggccuucggc

SEQ ID NO: 2746558 - RNA, 21 nt, Human
gcucucuggccuucggccucc

SEQ ID NO: 2746559 - RNA, 15 nt, Human
gcucucuuuccucug

SEQ ID NO: 2746560 - RNA, 14 nt, Human
gcucugauuuaucu

SEQ ID NO: 2746561 - RNA, 13 nt, Human
gcucuggaaacca

SEQ ID NO: 2746562 - RNA, 16 nt, Human
gcucuggacaggcacu

SEQ ID NO: 2746563 - RNA, 20 nt, Human
gcucuggacaggcacuaucu

SEQ ID NO: 2746564 - RNA, 21 nt, Human
gcucuggacuugccuccagag

SEQ ID NO: 2746565 - RNA, 17 nt, Human
gcucugggucgccggca

SEQ ID NO: 2746566 - RNA, 17 nt, Human
gcucuugaugccuggcg

SEQ ID NO: 2746567 - RNA, 19 nt, Human
gcugaaacaacaaauagga

SEQ ID NO: 2746568 - RNA, 20 nt, Human
gcugaaacaacaaauaggaa

SEQ ID NO: 2746569 - RNA, 14 nt, Human
gcugacccucccca

SEQ ID NO: 2746570 - RNA, 16 nt, Human
gcugacccuccccaaa

SEQ ID NO: 2746571 - RNA, 18 nt, Human
gcugagcccggaaacucc

SEQ ID NO: 2746572 - RNA, 13 nt, Human
gcugaggcgggug

SEQ ID NO: 2746573 - RNA, 23 nt, Human
gcugaguguuucacaccuuaucu

SEQ ID NO: 2746574 - RNA, 20 nt, Human
gcugauaaacugauuuaucu

SEQ ID NO: 2746575 - RNA, 20 nt, Human
gcugauauauguguuuuuca

SEQ ID NO: 2746576 - RNA, 13 nt, Human
gcugaugcaguug

SEQ ID NO: 2746577 - RNA, 19 nt, Human
gcugaugggcaaaaaacca

SEQ ID NO: 2746578 - RNA, 16 nt, Human
gcugcagccccuggga

SEQ ID NO: 2746579 - RNA, 22 nt, Human
gcugcagccccugggaccaggc

SEQ ID NO: 2746580 - RNA, 14 nt, Human
gcugcccccagagc

SEQ ID NO: 2746581 - RNA, 17 nt, Human
gcugcccccagagccac

SEQ ID NO: 2746582 - RNA, 20 nt, Human
gcugcccccagagccacagu

SEQ ID NO: 2746583 - RNA, 20 nt, Human
gcugccccggggaggggcgc

SEQ ID NO: 2746584 - RNA, 23 nt, Human
gcugccccggggaggggcgcucg

SEQ ID NO: 2746585 - RNA, 24 nt, Human
gcugccccggggaggggcgcucgc

SEQ ID NO: 2746586 - RNA, 21 nt, Human
gcugcccucccccuccucucc

SEQ ID NO: 2746587 - RNA, 13 nt, Human
gcugcccucuccu

SEQ ID NO: 2746588 - RNA, 18 nt, Human
gcugcccucuccugggca

SEQ ID NO: 2746589 - RNA, 19 nt, Human
gcugcccucuccugggcag

SEQ ID NO: 2746590 - RNA, 20 nt, Human
gcugcccucuccugggcagc

SEQ ID NO: 2746591 - RNA, 21 nt, Human
gcugcccucuccugggcagcu

SEQ ID NO: 2746592 - RNA, 22 nt, Human
gcugcccucuccugggcagcug

SEQ ID NO: 2746593 - RNA, 17 nt, Human
gcugcccuuccccuucc

SEQ ID NO: 2746594 - RNA, 19 nt, Human
gcugcccuuccccuuccca

SEQ ID NO: 2746595 - RNA, 17 nt, Human
gcugccuccccagcucu

SEQ ID NO: 2746596 - RNA, 16 nt, Human
gcugccuccccuccuc

SEQ ID NO: 2746597 - RNA, 20 nt, Human
gcugccuccccuccucugcu

SEQ ID NO: 2746598 - RNA, 21 nt, Human
gcugccuccccuccucugcuu

SEQ ID NO: 2746599 - RNA, 22 nt, Human
gcugccucucucauccacuuuc

SEQ ID NO: 2746600 - RNA, 18 nt, Human
gcugcgcgccgcgcuccu

SEQ ID NO: 2746601 - RNA, 16 nt, Human
gcugcgcucggccugc

SEQ ID NO: 2746602 - RNA, 14 nt, Human
gcugcuagagugac

SEQ ID NO: 2746603 - RNA, 17 nt, Human
gcugcuagagugacuca

SEQ ID NO: 2746604 - RNA, 14 nt, Human
gcugcucagggcug

SEQ ID NO: 2746605 - RNA, 19 nt, Human
gcugcucagggcuggucuu

SEQ ID NO: 2746606 - RNA, 12 nt, Human
gcugcucucucc

SEQ ID NO: 2746607 - RNA, 18 nt, Human
gcugcugccgugggccug

SEQ ID NO: 2746608 - RNA, 20 nt, Human
gcugcuggggaagacagugg

SEQ ID NO: 2746609 - RNA, 16 nt, Human
gcugcugguggcgcug

SEQ ID NO: 2746610 - RNA, 19 nt, Human
gcugcugguggcgcuggcu

SEQ ID NO: 2746611 - RNA, 16 nt, Human
gcuggaaaaguauguu

SEQ ID NO: 2746612 - RNA, 13 nt, Human
gcuggaaauggac

SEQ ID NO: 2746613 - RNA, 20 nt, Human
gcuggaauugaauucccugc

SEQ ID NO: 2746614 - RNA, 20 nt, Human
gcuggagacauugaggcagg

SEQ ID NO: 2746615 - RNA, 13 nt, Human
gcuggagcucugc

SEQ ID NO: 2746616 - RNA, 14 nt, Human
gcuggagcucugcc

SEQ ID NO: 2746617 - RNA, 22 nt, Human
gcuggagcucugcccauccugc

SEQ ID NO: 2746618 - RNA, 12 nt, Human
gcuggagugcag

SEQ ID NO: 2746619 - RNA, 13 nt, Human
gcuggagugcagu

SEQ ID NO: 2746620 - RNA, 14 nt, Human
gcuggagugcagug

SEQ ID NO: 2746621 - RNA, 15 nt, Human
gcuggagugcagugg

SEQ ID NO: 2746622 - RNA, 22 nt, Human
gcuggagugcaguggcgcgauc

SEQ ID NO: 2746623 - RNA, 12 nt, Human
gcuggauucaag

SEQ ID NO: 2746624 - RNA, 19 nt, Human
gcuggauucaagugauccg

SEQ ID NO: 2746625 - RNA, 14 nt, Human
gcuggcaccgcugu

SEQ ID NO: 2746626 - RNA, 12 nt, Human
gcuggccaggcu

SEQ ID NO: 2746627 - RNA, 19 nt, Human
gcuggccuauguggucuaa

SEQ ID NO: 2746628 - RNA, 23 nt, Human
gcuggccuugugaggagcuggaa

SEQ ID NO: 2746629 - RNA, 14 nt, Human
gcuggcgugcagca

SEQ ID NO: 2746630 - RNA, 16 nt, Human
gcuggcgugcagcauc

SEQ ID NO: 2746631 - RNA, 23 nt, Human
gcuggcgugcagcaucagcaucc

SEQ ID NO: 2746632 - RNA, 11 nt, Human
gcuggcucugu

SEQ ID NO: 2746633 - RNA, 13 nt, Human
gcuggcucuuucc

SEQ ID NO: 2746634 - RNA, 12 nt, Human
gcuggcugcgcu

SEQ ID NO: 2746635 - RNA, 15 nt, Human
gcuggcugcgcucgg

SEQ ID NO: 2746636 - RNA, 18 nt, Human
gcuggcugcgcucggccu

SEQ ID NO: 2746637 - RNA, 22 nt, Human
gcugggcagaaggccaagaggc

SEQ ID NO: 2746638 - RNA, 16 nt, Human
gcugggucgcccugga

SEQ ID NO: 2746639 - RNA, 21 nt, Human
gcuggucucgaacugcuggau

SEQ ID NO: 2746640 - RNA, 12 nt, Human
gcugguggcgcu

SEQ ID NO: 2746641 - RNA, 22 nt, Human
gcugguggcgcuggcugcgcuc

SEQ ID NO: 2746642 - RNA, 14 nt, Human
gcugguggcucugu

SEQ ID NO: 2746643 - RNA, 21 nt, Human
gcuguaauguuaauauugauu

SEQ ID NO: 2746644 - RNA, 17 nt, Human
gcuguacgcgagcgcgc

SEQ ID NO: 2746645 - RNA, 19 nt, Human
gcuguacgcgagcgcgcgc

SEQ ID NO: 2746646 - RNA, 21 nt, Human
gcuguauacugugugcuaaaa

SEQ ID NO: 2746647 - RNA, 19 nt, Human
gcuguaugauucccagcca

SEQ ID NO: 2746648 - RNA, 13 nt, Human
gcuguauucuucu

SEQ ID NO: 2746649 - RNA, 21 nt, Human
gcugucccaagggccccucug

SEQ ID NO: 2746650 - RNA, 14 nt, Human
gcuguccuggaggg

SEQ ID NO: 2746651 - RNA, 17 nt, Human
gcugucucugaggggug

SEQ ID NO: 2746652 - RNA, 18 nt, Human
gcugucuucguauuccca

SEQ ID NO: 2746653 - RNA, 23 nt, Human
gcuguggauuuaauguggaaaug

SEQ ID NO: 2746654 - RNA, 16 nt, Human
gcuguguggcagucug

SEQ ID NO: 2746655 - RNA, 20 nt, Human
gcuguuauuuaauuagccag

SEQ ID NO: 2746656 - RNA, 12 nt, Human
gcuguuauuuua

SEQ ID NO: 2746657 - RNA, 17 nt, Human
gcuguucccaccaggcu

SEQ ID NO: 2746658 - RNA, 18 nt, Human
gcuguuccucgccacgcu

SEQ ID NO: 2746659 - RNA, 19 nt, Human
gcuguuccucgccacgcuc

SEQ ID NO: 2746660 - RNA, 15 nt, Human
gcuguugagcuguuu

SEQ ID NO: 2746661 - RNA, 13 nt, Human
gcuguugcugaau

SEQ ID NO: 2746662 - RNA, 20 nt, Human
gcuguugucuuuuccuucug

SEQ ID NO: 2746663 - RNA, 11 nt, Human
gcuguuuccau

SEQ ID NO: 2746664 - RNA, 16 nt, Human
gcuguuuuuauauaug

SEQ ID NO: 2746665 - RNA, 22 nt, Human
gcuuaacccuggaaaaugaauc

SEQ ID NO: 2746666 - RNA, 20 nt, Human
gcuuagacccucaugcugcc

SEQ ID NO: 2746667 - RNA, 16 nt, Human
gcuuagaccucagccu

SEQ ID NO: 2746668 - RNA, 22 nt, Human
gcuuagaccucagccugugcug

SEQ ID NO: 2746669 - RNA, 11 nt, Human
gcuuaguucaa

SEQ ID NO: 2746670 - RNA, 13 nt, Human
gcuuaguucaagu

SEQ ID NO: 2746671 - RNA, 15 nt, Human
gcuuauuaaaacuca

SEQ ID NO: 2746672 - RNA, 21 nt, Human
gcuuauucacaagacccaaaa

SEQ ID NO: 2746673 - RNA, 20 nt, Human
gcuucaaauuguaagcaugc

SEQ ID NO: 2746674 - RNA, 17 nt, Human
gcuucaccuguccccga

SEQ ID NO: 2746675 - RNA, 15 nt, Human
gcuucagccaggagc

SEQ ID NO: 2746676 - RNA, 14 nt, Human
gcuucaguucagcu

SEQ ID NO: 2746677 - RNA, 20 nt, Human
gcuuccacuaggguccacca

SEQ ID NO: 2746678 - RNA, 21 nt, Human
gcuuccacuaggguccaccag

SEQ ID NO: 2746679 - RNA, 20 nt, Human
gcuuccaggcuggcgugcag

SEQ ID NO: 2746680 - RNA, 11 nt, Human
gcuuccgcauc

SEQ ID NO: 2746681 - RNA, 17 nt, Human
gcuucucauccugcagg

SEQ ID NO: 2746682 - RNA, 16 nt, Human
gcuucuguuccgugcu

SEQ ID NO: 2746683 - RNA, 19 nt, Human
gcuucuguuuuauaauuuu

SEQ ID NO: 2746684 - RNA, 14 nt, Human
gcuugagcaggauu

SEQ ID NO: 2746685 - RNA, 15 nt, Human
gcuugagccaggagg

SEQ ID NO: 2746686 - RNA, 18 nt, Human
gcuugaggacuugggcgg

SEQ ID NO: 2746687 - RNA, 22 nt, Human
gcuugaggacuugggcgggaca

SEQ ID NO: 2746688 - RNA, 14 nt, Human
gcuugagucuccaa

SEQ ID NO: 2746689 - RNA, 15 nt, Human
gcuugaucaaaggca

SEQ ID NO: 2746690 - RNA, 23 nt, Human
gcuugaucaaaggcacacagcaa

SEQ ID NO: 2746691 - RNA, 13 nt, Human
gcuugccaucccu

SEQ ID NO: 2746692 - RNA, 17 nt, Human
gcuugcccuguuaaaag

SEQ ID NO: 2746693 - RNA, 13 nt, Human
gcuugccugcagg

SEQ ID NO: 2746694 - RNA, 16 nt, Human
gcuugccugcaggcau

SEQ ID NO: 2746695 - RNA, 22 nt, Human
gcuuggacugaagggguucuca

SEQ ID NO: 2746696 - RNA, 19 nt, Human
gcuuguauuccuuuuucuc

SEQ ID NO: 2746697 - RNA, 13 nt, Human
gcuuuaaguguaa

SEQ ID NO: 2746698 - RNA, 14 nt, Human
gcuuuaccuuuuuu

SEQ ID NO: 2746699 - RNA, 17 nt, Human
gcuuuaccuuuuuucuu

SEQ ID NO: 2746700 - RNA, 16 nt, Human
gcuuuagggaccugcu

SEQ ID NO: 2746701 - RNA, 17 nt, Human
gcuuuauuuuuuaagua

SEQ ID NO: 2746702 - RNA, 21 nt, Human
gcuuucagagccuccuuucug

SEQ ID NO: 2746703 - RNA, 18 nt, Human
gcuuucuaucuaauuuuu

SEQ ID NO: 2746704 - RNA, 15 nt, Human
gcuuucucaauaagc

SEQ ID NO: 2746705 - RNA, 16 nt, Human
gcuuucucugaggggg

SEQ ID NO: 2746706 - RNA, 12 nt, Human
gcuuucuucucc

SEQ ID NO: 2746707 - RNA, 14 nt, Human
gcuuucuucuccca

SEQ ID NO: 2746708 - RNA, 16 nt, Human
gcuuucuucucccaau

SEQ ID NO: 2746709 - RNA, 13 nt, Human
gcuuugaaacgag

SEQ ID NO: 2746710 - RNA, 23 nt, Human
gcuuugaaacgaggauugggaaa

SEQ ID NO: 2746711 - RNA, 17 nt, Human
gcuuuggaaaacccaga

SEQ ID NO: 2746712 - RNA, 12 nt, Human
gcuuuuaaaaaa

SEQ ID NO: 2746713 - RNA, 19 nt, Human
gcuuuuaugugaaacaugu

SEQ ID NO: 2746714 - RNA, 13 nt, Human
gcuuuucuuuucu

SEQ ID NO: 2746715 - RNA, 19 nt, Human
gcuuuugcuaggucacaga

SEQ ID NO: 2746716 - RNA, 20 nt, Human
gcuuuuuuuuuuucccuucc

SEQ ID NO: 2746717 - RNA, 23 nt, Human
gcuuuuuuuuuuuuucuuaaaga

SEQ ID NO: 2746718 - RNA, 17 nt, Human
ggaaaaaaaggaagaaa

SEQ ID NO: 2746719 - RNA, 15 nt, Human
ggaaaaaauaacaau

SEQ ID NO: 2746720 - RNA, 16 nt, Human
ggaaaaaauaacaaug

SEQ ID NO: 2746721 - RNA, 18 nt, Human
ggaaaaaauaacaaugaa

SEQ ID NO: 2746722 - RNA, 19 nt, Human
ggaaaaaauaacaaugaaa

SEQ ID NO: 2746723 - RNA, 17 nt, Human
ggaaaacccagauaaag

SEQ ID NO: 2746724 - RNA, 17 nt, Human
ggaaaauggacaucaaa

SEQ ID NO: 2746725 - RNA, 13 nt, Human
ggaaaauguguau

SEQ ID NO: 2746726 - RNA, 20 nt, Human
ggaaacaaaacuagguaaaa

SEQ ID NO: 2746727 - RNA, 18 nt, Human
ggaaacaagucagucauu

SEQ ID NO: 2746728 - RNA, 15 nt, Human
ggaaacguauucaaa

SEQ ID NO: 2746729 - RNA, 14 nt, Human
ggaaacuccacauc

SEQ ID NO: 2746730 - RNA, 12 nt, Human
ggaaagaaaaua

SEQ ID NO: 2746731 - RNA, 18 nt, Human
ggaaagacagcuucucau

SEQ ID NO: 2746732 - RNA, 17 nt, Human
ggaaagagaacuuccag

SEQ ID NO: 2746733 - RNA, 21 nt, Human
ggaaagcuucagugcugccga

SEQ ID NO: 2746734 - RNA, 19 nt, Human
ggaaaggagaaguuaagca

SEQ ID NO: 2746735 - RNA, 21 nt, Human
ggaaaggaguagaaaaagcag

SEQ ID NO: 2746736 - RNA, 22 nt, Human
ggaaagggauuuucagcccuca

SEQ ID NO: 2746737 - RNA, 13 nt, Human
ggaaagggucucc

SEQ ID NO: 2746738 - RNA, 16 nt, Human
ggaaagggucucccuc

SEQ ID NO: 2746739 - RNA, 17 nt, Human
ggaaauauuuauuuuaa

SEQ ID NO: 2746740 - RNA, 15 nt, Human
ggaaauauuuuaaug

SEQ ID NO: 2746741 - RNA, 15 nt, Human
ggaaaugauguuuca

SEQ ID NO: 2746742 - RNA, 12 nt, Human
ggaaaugcuccu

SEQ ID NO: 2746743 - RNA, 14 nt, Human
ggaacaaggaagga

SEQ ID NO: 2746744 - RNA, 19 nt, Human
ggaacaaguacuucuugau

SEQ ID NO: 2746745 - RNA, 23 nt, Human
ggaacaguuaccucugccucaga

SEQ ID NO: 2746746 - RNA, 22 nt, Human
ggaacauccuaagacagaggaa

SEQ ID NO: 2746747 - RNA, 17 nt, Human
ggaacauuuauguuccu

SEQ ID NO: 2746748 - RNA, 17 nt, Human
gacgcucucuggccuuc

SEQ ID NO: 2746749 - RNA, 22 nt, Human
gacgcucucuggccuucggccu

SEQ ID NO: 2746750 - RNA, 14 nt, Human
gacgcugcugccgu

SEQ ID NO: 2746751 - RNA, 13 nt, Human
gacggagccggga

SEQ ID NO: 2746752 - RNA, 14 nt, Human
gacggagccgggaa

SEQ ID NO: 2746753 - RNA, 14 nt, Human
gacggcuccggacg

SEQ ID NO: 2746754 - RNA, 20 nt, Human
gacggcuccggacgcugcug

SEQ ID NO: 2746755 - RNA, 23 nt, Human
gacguaacaaauauggggaaaaa

SEQ ID NO: 2746756 - RNA, 18 nt, Human
gacuaaguguaccagaga

SEQ ID NO: 2746757 - RNA, 12 nt, Human
gacuacaggcgu

SEQ ID NO: 2746758 - RNA, 14 nt, Human
gacuacaggcguga

SEQ ID NO: 2746759 - RNA, 14 nt, Human
gacuacuagggaaa

SEQ ID NO: 2746760 - RNA, 21 nt, Human
gacuacuagggaaaugccuuu

SEQ ID NO: 2746761 - RNA, 12 nt, Human
gacuagggcugg

SEQ ID NO: 2746762 - RNA, 17 nt, Human
gacuauuauagaaugga

SEQ ID NO: 2746763 - RNA, 16 nt, Human
gacuauuauauuucca

SEQ ID NO: 2746764 - RNA, 20 nt, Human
gacuauucccuucuaaccug

SEQ ID NO: 2746765 - RNA, 21 nt, Human
gacucaagcaagauuucagau

SEQ ID NO: 2746766 - RNA, 15 nt, Human
gacucaccuccccca

SEQ ID NO: 2746767 - RNA, 22 nt, Human
gacucaccucccccaucucuuc

SEQ ID NO: 2746768 - RNA, 10 nt, Human
gacucagccc

SEQ ID NO: 2746769 - RNA, 13 nt, Human
gacucagggcccc

SEQ ID NO: 2746770 - RNA, 16 nt, Human
gacucagggccccagc

SEQ ID NO: 2746771 - RNA, 18 nt, Human
gacucagggccccagcac

SEQ ID NO: 2746772 - RNA, 16 nt, Human
gacucaucauuuccau

SEQ ID NO: 2746773 - RNA, 19 nt, Human
gacucauuuuaaaaaaugg

SEQ ID NO: 2746774 - RNA, 20 nt, Human
gacucauuuuaaaaaaugga

SEQ ID NO: 2746775 - RNA, 14 nt, Human
gacuccacucugag

SEQ ID NO: 2746776 - RNA, 17 nt, Human
gacucucuuaaggaggc

SEQ ID NO: 2746777 - RNA, 18 nt, Human
gacucuggucaagaagca

SEQ ID NO: 2746778 - RNA, 21 nt, Human
gacugcuaguuuauauagaaa

SEQ ID NO: 2746779 - RNA, 15 nt, Human
gacugcuccagaguu

SEQ ID NO: 2746780 - RNA, 14 nt, Human
gacuggccugcugg

SEQ ID NO: 2746781 - RNA, 16 nt, Human
gacuggccugcuggau

SEQ ID NO: 2746782 - RNA, 21 nt, Human
gacugguucaaauguuguucu

SEQ ID NO: 2746783 - RNA, 12 nt, Human
gacuguggcugc

SEQ ID NO: 2746784 - RNA, 23 nt, Human
gacugugugcucaggagcccugg

SEQ ID NO: 2746785 - RNA, 14 nt, Human
gacuuaaugccacu

SEQ ID NO: 2746786 - RNA, 17 nt, Human
gacuuauuuauauaaau

SEQ ID NO: 2746787 - RNA, 17 nt, Human
gacuuccauuuggaauc

SEQ ID NO: 2746788 - RNA, 13 nt, Human
gacuugccucugc

SEQ ID NO: 2746789 - RNA, 15 nt, Human
gacuuuauagaucag

SEQ ID NO: 2746790 - RNA, 18 nt, Human
gacuuuaucaugugucuu

SEQ ID NO: 2746791 - RNA, 20 nt, Human
gacuuuauguaguuuuuaua

SEQ ID NO: 2746792 - RNA, 17 nt, Human
gacuuuccuaaaucaau

SEQ ID NO: 2746793 - RNA, 18 nt, Human
gacuuugugaaaaaaaau

SEQ ID NO: 2746794 - RNA, 16 nt, Human
gacuuuuuuuuauacg

SEQ ID NO: 2746795 - RNA, 23 nt, Human
gacuuuuuuuuuuuuuuaaacaa

SEQ ID NO: 2746796 - RNA, 16 nt, Human
gagaaaauaaaagcac

SEQ ID NO: 2746797 - RNA, 16 nt, Human
gagaaacuggaacucu

SEQ ID NO: 2746798 - RNA, 15 nt, Human
gagaaaugaaaaaau

SEQ ID NO: 2746799 - RNA, 23 nt, Human
gagaaaugagcacgcauggaaaa

SEQ ID NO: 2746800 - RNA, 12 nt, Human
gagaaauuugcc

SEQ ID NO: 2746801 - RNA, 16 nt, Human
gagaagaacugaaauc

SEQ ID NO: 2746802 - RNA, 21 nt, Human
gagaaggagcucccaggaggg

SEQ ID NO: 2746803 - RNA, 15 nt, Human
gagaaucacuugaac

SEQ ID NO: 2746804 - RNA, 15 nt, Human
gagaaucagaucauu

SEQ ID NO: 2746805 - RNA, 17 nt, Human
gagacaccaccacccuu

SEQ ID NO: 2746806 - RNA, 14 nt, Human
gagacacugaugua

SEQ ID NO: 2746807 - RNA, 10 nt, Human
gagacagagu

SEQ ID NO: 2746808 - RNA, 14 nt, Human
gagacagcaggucu

SEQ ID NO: 2746809 - RNA, 18 nt, Human
gagaccagccaaccuggg

SEQ ID NO: 2746810 - RNA, 13 nt, Human
gagaccuacccuc

SEQ ID NO: 2746811 - RNA, 16 nt, Human
gagaccuguaaucaua

SEQ ID NO: 2746812 - RNA, 16 nt, Human
gagacgagguuucacu

SEQ ID NO: 2746813 - RNA, 19 nt, Human
gagacgggguuugccaugc

SEQ ID NO: 2746814 - RNA, 22 nt, Human
gagacgggguuugccaugcugg

SEQ ID NO: 2746815 - RNA, 14 nt, Human
gagacucagggccc

SEQ ID NO: 2746816 - RNA, 21 nt, Human
gagacuugggaaugagcugaa

SEQ ID NO: 2746817 - RNA, 19 nt, Human
gagacuuugugaaaaaaaa

SEQ ID NO: 2746818 - RNA, 12 nt, Human
gagagaagauag

SEQ ID NO: 2746819 - RNA, 18 nt, Human
gagagacacacugaagaa

SEQ ID NO: 2746820 - RNA, 19 nt, Human
gagagacacacugaagaag

SEQ ID NO: 2746821 - RNA, 14 nt, Human
gagagagcuggagg

SEQ ID NO: 2746822 - RNA, 18 nt, Human
gagagagcuggaggcacc

SEQ ID NO: 2746823 - RNA, 22 nt, Human
gagagaugacagggaaaacugc

SEQ ID NO: 2746824 - RNA, 13 nt, Human
gagaggaguguga

SEQ ID NO: 2746825 - RNA, 14 nt, Human
gagaggcaaagaaa

SEQ ID NO: 2746826 - RNA, 14 nt, Human
gagaggggccucaa

SEQ ID NO: 2746827 - RNA, 14 nt, Human
gagaguacacccca

SEQ ID NO: 2746828 - RNA, 14 nt, Human
gagagugaacaaau

SEQ ID NO: 2746829 - RNA, 14 nt, Human
gagaguuuccuaug

SEQ ID NO: 2746830 - RNA, 20 nt, Human
gagauaucccaggaaaauua

SEQ ID NO: 2746831 - RNA, 20 nt, Human
gagaugacagggaaaacugc

SEQ ID NO: 2746832 - RNA, 15 nt, Human
gagaugagugucugg

SEQ ID NO: 2746833 - RNA, 16 nt, Human
gagauugugccccugc

SEQ ID NO: 2746834 - RNA, 21 nt, Human
gagauuuugcuugagcaggau

SEQ ID NO: 2746835 - RNA, 15 nt, Human
gagauuuuucaugau

SEQ ID NO: 2746836 - RNA, 23 nt, Human
gagcaaaaccaaauauuccagag

SEQ ID NO: 2746837 - RNA, 15 nt, Human
gagcaaguccuuccc

SEQ ID NO: 2746838 - RNA, 16 nt, Human
gagcaccuacuuacau

SEQ ID NO: 2746839 - RNA, 13 nt, Human
gagcaccugcagg

SEQ ID NO: 2746840 - RNA, 16 nt, Human
gagcaccugcaggcgu

SEQ ID NO: 2746841 - RNA, 19 nt, Human
gagcaccugcaggcgugac

SEQ ID NO: 2746842 - RNA, 20 nt, Human
gagcacgcauggaaaaguuu

SEQ ID NO: 2746843 - RNA, 17 nt, Human
gagcaggggugcuggga

SEQ ID NO: 2746844 - RNA, 15 nt, Human
gagcaguagcagcag

SEQ ID NO: 2746845 - RNA, 17 nt, Human
gagcaguagcagcagca

SEQ ID NO: 2746846 - RNA, 14 nt, Human
gagcagucagaaga

SEQ ID NO: 2746847 - RNA, 20 nt, Human
gagcaucaucuucuggguua

SEQ ID NO: 2746848 - RNA, 21 nt, Human
gagcaucuccucaacucugag

SEQ ID NO: 2746849 - RNA, 17 nt, Human
gagcaugggaagugacg

SEQ ID NO: 2746850 - RNA, 19 nt, Human
gagccaaggguucagagac

SEQ ID NO: 2746851 - RNA, 22 nt, Human
gagccaaggguucagagacuca

SEQ ID NO: 2746852 - RNA, 21 nt, Human
gagccaaucaguagccagcau

SEQ ID NO: 2746853 - RNA, 14 nt, Human
gagccaccaaaccc

SEQ ID NO: 2746854 - RNA, 16 nt, Human
gagccaccaaacccgg

SEQ ID NO: 2746855 - RNA, 19 nt, Human
gagccaccaagcugguggc

SEQ ID NO: 2746856 - RNA, 11 nt, Human
gagccagcucu

SEQ ID NO: 2746857 - RNA, 12 nt, Human
gagccagcucug

SEQ ID NO: 2746858 - RNA, 17 nt, Human
gagccaggaggccugcu

SEQ ID NO: 2746859 - RNA, 18 nt, Human
gagccaggaggccugcua

SEQ ID NO: 2746860 - RNA, 14 nt, Human
gagccagugucagg

SEQ ID NO: 2746861 - RNA, 18 nt, Human
gagcccacuguacuugcu

SEQ ID NO: 2746862 - RNA, 12 nt, Human
gagccccaaaag

SEQ ID NO: 2746863 - RNA, 13 nt, Human
gagccccaaaagg

SEQ ID NO: 2746864 - RNA, 23 nt, Human
gagccccaaaagguauuuuaauc

SEQ ID NO: 2746865 - RNA, 18 nt, Human
gagccccaucagcuccag

SEQ ID NO: 2746866 - RNA, 14 nt, Human
gagccccgaaucug

SEQ ID NO: 2746867 - RNA, 18 nt, Human
gagcccuucaugcauuug

SEQ ID NO: 2746868 - RNA, 15 nt, Human
gagccggagccucca

SEQ ID NO: 2746869 - RNA, 21 nt, Human
gagccggagccuccagcugcc

SEQ ID NO: 2746870 - RNA, 21 nt, Human
gagccgggaaagaagagccgg

SEQ ID NO: 2746871 - RNA, 18 nt, Human
gagccucagucucccucc

SEQ ID NO: 2746872 - RNA, 19 nt, Human
gagccucagucucccuccc

SEQ ID NO: 2746873 - RNA, 13 nt, Human
gagccuccagcug

SEQ ID NO: 2746874 - RNA, 15 nt, Human
gagccuccagcugcc

SEQ ID NO: 2746875 - RNA, 16 nt, Human
gagccuccagcugccc

SEQ ID NO: 2746876 - RNA, 20 nt, Human
gagccugaucaccugcccug

SEQ ID NO: 2746877 - RNA, 21 nt, Human
gagccugaucaccugcccugc

SEQ ID NO: 2746878 - RNA, 20 nt, Human
gagccuuuuuuugaaaaaaa

SEQ ID NO: 2746879 - RNA, 15 nt, Human
gagcgacagugagac

SEQ ID NO: 2746880 - RNA, 18 nt, Human
gagcgacagugagacucu

SEQ ID NO: 2746881 - RNA, 16 nt, Human
gagcgagccccaggcg

SEQ ID NO: 2746882 - RNA, 13 nt, Human
gagcgcgcgcgcc

SEQ ID NO: 2746883 - RNA, 13 nt, Human
gagcuaggggggu

SEQ ID NO: 2746884 - RNA, 22 nt, Human
gagcuaggggggucagccagcc

SEQ ID NO: 2746885 - RNA, 14 nt, Human
gagcucagcccugg

SEQ ID NO: 2746886 - RNA, 22 nt, Human
gagcucccaggaggggcuucug

SEQ ID NO: 2746887 - RNA, 14 nt, Human
gagcuccuaagcca

SEQ ID NO: 2746888 - RNA, 17 nt, Human
gagcucgguggacccag

SEQ ID NO: 2746889 - RNA, 21 nt, Human
gagcucgguggacccagggau

SEQ ID NO: 2746890 - RNA, 20 nt, Human
gagcucguggaacaguuacc

SEQ ID NO: 2746891 - RNA, 16 nt, Human
gagcucgugggacagu

SEQ ID NO: 2746892 - RNA, 19 nt, Human
gagcucgugggacagucac

SEQ ID NO: 2746893 - RNA, 12 nt, Human
gagcugcccucu

SEQ ID NO: 2746894 - RNA, 20 nt, Human
gagcugcccucuccugggca

SEQ ID NO: 2746895 - RNA, 22 nt, Human
gagcugcccucuccugggcagc

SEQ ID NO: 2746896 - RNA, 19 nt, Human
gagcuguuuucccugaccu

SEQ ID NO: 2746897 - RNA, 20 nt, Human
gagcuuaacccuggaaaaug

SEQ ID NO: 2746898 - RNA, 20 nt, Human
gagcuugaaauagugucuga

SEQ ID NO: 2746899 - RNA, 13 nt, Human
gagcuugcagaga

SEQ ID NO: 2746900 - RNA, 14 nt, Human
gagcuuuuguagaa

SEQ ID NO: 2746901 - RNA, 15 nt, Human
gaggaaagugauauc

SEQ ID NO: 2746902 - RNA, 18 nt, Human
gaggaauauuugcaagac

SEQ ID NO: 2746903 - RNA, 15 nt, Human
gaggacacugauaug

SEQ ID NO: 2746904 - RNA, 20 nt, Human
gaggacgcucucuggccuuc

SEQ ID NO: 2746905 - RNA, 12 nt, Human
gaggacuccuua

SEQ ID NO: 2746906 - RNA, 16 nt, Human
gaggacuugggcggga

SEQ ID NO: 2746907 - RNA, 17 nt, Human
gaggacuugggcgggac

SEQ ID NO: 2746908 - RNA, 19 nt, Human
gaggacuugggcgggacac

SEQ ID NO: 2746909 - RNA, 19 nt, Human
gaggagaaacuggaacucu

SEQ ID NO: 2746910 - RNA, 14 nt, Human
gaggagguaaugaa

SEQ ID NO: 2746911 - RNA, 19 nt, Human
gaggaucacuuuaggccug

SEQ ID NO: 2746912 - RNA, 14 nt, Human
gaggcacagaaacu

SEQ ID NO: 2746913 - RNA, 22 nt, Human
gaggcacccaugccaucucaac

SEQ ID NO: 2746914 - RNA, 22 nt, Human
gaggcaccugucccagaaaaag

SEQ ID NO: 2746915 - RNA, 16 nt, Human
gaggcagacagcagcu

SEQ ID NO: 2746916 - RNA, 22 nt, Human
gaggcagacagcagcucaggca

SEQ ID NO: 2746917 - RNA, 18 nt, Human
gaggcagagguugcagug

SEQ ID NO: 2746918 - RNA, 19 nt, Human
gaggcagagguugcaguga

SEQ ID NO: 2746919 - RNA, 13 nt, Human
gaggcaggcacug

SEQ ID NO: 2746920 - RNA, 14 nt, Human
gaggcagggucagg

SEQ ID NO: 2746921 - RNA, 17 nt, Human
gaggcauccuuccucac

SEQ ID NO: 2746922 - RNA, 19 nt, Human
gaggcauuuaggccauggg

SEQ ID NO: 2746923 - RNA, 20 nt, Human
gaggccccugucucagggug

SEQ ID NO: 2746924 - RNA, 21 nt, Human
gaggccugacugccaagccau

SEQ ID NO: 2746925 - RNA, 21 nt, Human
gaggccuuucccuaagccagc

SEQ ID NO: 2746926 - RNA, 18 nt, Human
gaggcggauugagaagga

SEQ ID NO: 2746927 - RNA, 16 nt, Human
gaggcuccacuugguc

SEQ ID NO: 2746928 - RNA, 18 nt, Human
gaggcuccacuuggucug

SEQ ID NO: 2746929 - RNA, 21 nt, Human
gaggcucuaauguacaauaaa

SEQ ID NO: 2746930 - RNA, 23 nt, Human
gaggcucuaauguacaauaaagc

SEQ ID NO: 2746931 - RNA, 12 nt, Human
gaggcugagaug

SEQ ID NO: 2746932 - RNA, 19 nt, Human
gaggcugaggcaagagaau

SEQ ID NO: 2746933 - RNA, 18 nt, Human
gaggcuguucccaccagg

SEQ ID NO: 2746934 - RNA, 16 nt, Human
gaggcuuugcauagau

SEQ ID NO: 2746935 - RNA, 16 nt, Human
gagggaaaagaaaaag

SEQ ID NO: 2746936 - RNA, 19 nt, Human
gagggaauugcagaguacu

SEQ ID NO: 2746937 - RNA, 22 nt, Human
gagggacucaucauuuccauuu

SEQ ID NO: 2746938 - RNA, 18 nt, Human
gagggcuugaggacuugg

SEQ ID NO: 2746939 - RNA, 17 nt, Human
gaggggcuucugggcag

SEQ ID NO: 2746940 - RNA, 14 nt, Human
gagggggugggggu

SEQ ID NO: 2746941 - RNA, 13 nt, Human
gaggggugggggu

SEQ ID NO: 2746942 - RNA, 13 nt, Human
gagggugggggug

SEQ ID NO: 2746943 - RNA, 21 nt, Human
gaggguuucauugucugugaa

SEQ ID NO: 2746944 - RNA, 11 nt, Human
gagguaaaagc

SEQ ID NO: 2746945 - RNA, 14 nt, Human
gagguaccagccuu

SEQ ID NO: 2746946 - RNA, 19 nt, Human
gagguacugagagugaaca

SEQ ID NO: 2746947 - RNA, 15 nt, Human
gaggucaggaguucc

SEQ ID NO: 2746948 - RNA, 19 nt, Human
gagguccuuaggccucuga

SEQ ID NO: 2746949 - RNA, 13 nt, Human
gagguggcugggu

SEQ ID NO: 2746950 - RNA, 22 nt, Human
gaguaaagaauuauuuugugau

SEQ ID NO: 2746951 - RNA, 20 nt, Human
gaguaagcaccuuuagaaua

SEQ ID NO: 2746952 - RNA, 22 nt, Human
gaguaauccaagcaaaugugaa

SEQ ID NO: 2746953 - RNA, 14 nt, Human
gaguacaccccaac

SEQ ID NO: 2746954 - RNA, 15 nt, Human
gaguacaccccaaca

SEQ ID NO: 2746955 - RNA, 18 nt, Human
gaguacaccccaacagca

SEQ ID NO: 2746956 - RNA, 19 nt, Human
gaguacaccccaacagcac

SEQ ID NO: 2746957 - RNA, 23 nt, Human
gaguacaccccaacagcacccuc

SEQ ID NO: 2746958 - RNA, 23 nt, Human
gaguauauugauccagaaagaaa

SEQ ID NO: 2746959 - RNA, 23 nt, Human
gaguauccucuugccaaaucaaa

SEQ ID NO: 2746960 - RNA, 18 nt, Human
gagucaacuccuuucuca

SEQ ID NO: 2746961 - RNA, 21 nt, Human
gagucaacuccuuucucaucu

SEQ ID NO: 2746962 - RNA, 21 nt, Human
gagucaagggugugugcagca

SEQ ID NO: 2746963 - RNA, 22 nt, Human
gagucaagggugugugcagcau

SEQ ID NO: 2746964 - RNA, 23 nt, Human
gagucaagggugugugcagcauu

SEQ ID NO: 2746965 - RNA, 15 nt, Human
gagucagucugauga

SEQ ID NO: 2746966 - RNA, 20 nt, Human
gagucagucugaugagaacu

SEQ ID NO: 2746967 - RNA, 18 nt, Human
cuugagguaaaagcauca

SEQ ID NO: 2746968 - RNA, 16 nt, Human
cuugagugcucaguag

SEQ ID NO: 2746969 - RNA, 14 nt, Human
cuugaguuuaaauu

SEQ ID NO: 2746970 - RNA, 22 nt, Human
cuugauaaauggcuuccuggca

SEQ ID NO: 2746971 - RNA, 23 nt, Human
cuugauaaauggcuuccuggcaa

SEQ ID NO: 2746972 - RNA, 19 nt, Human
cuugaugaagaaguugaua

SEQ ID NO: 2746973 - RNA, 18 nt, Human
cuugauugguguugccag

SEQ ID NO: 2746974 - RNA, 17 nt, Human
cuugcagcucuccccuu

SEQ ID NO: 2746975 - RNA, 19 nt, Human
cuugcagcucuccccuucu

SEQ ID NO: 2746976 - RNA, 19 nt, Human
cuugccaaauauaaauaaa

SEQ ID NO: 2746977 - RNA, 16 nt, Human
cuugccauaaaacuua

SEQ ID NO: 2746978 - RNA, 21 nt, Human
cuugccaucccucccuccacc

SEQ ID NO: 2746979 - RNA, 23 nt, Human
cuugccaucccucccuccaccuc

SEQ ID NO: 2746980 - RNA, 15 nt, Human
cuugcccagggcuca

SEQ ID NO: 2746981 - RNA, 19 nt, Human
cuugcccagggcucagccu

SEQ ID NO: 2746982 - RNA, 16 nt, Human
cuugcccgcucaggcu

SEQ ID NO: 2746983 - RNA, 22 nt, Human
cuugcccgcucaggcugaccac

SEQ ID NO: 2746984 - RNA, 20 nt, Human
cuugccuaggcauagcccug

SEQ ID NO: 2746985 - RNA, 21 nt, Human
cuugccuaggcauagcccugc

SEQ ID NO: 2746986 - RNA, 16 nt, Human
cuugccuccagagacu

SEQ ID NO: 2746987 - RNA, 13 nt, Human
cuugccugcaggc

SEQ ID NO: 2746988 - RNA, 15 nt, Human
cuugcggcuccucag

SEQ ID NO: 2746989 - RNA, 19 nt, Human
cuugcucagugggggcaga

SEQ ID NO: 2746990 - RNA, 20 nt, Human
cuugcucuugaugccuggcg

SEQ ID NO: 2746991 - RNA, 16 nt, Human
cuugcuuuuaaaaucc

SEQ ID NO: 2746992 - RNA, 19 nt, Human
cuuggacaugggccccaga

SEQ ID NO: 2746993 - RNA, 15 nt, Human
cuuggacucaagcaa

SEQ ID NO: 2746994 - RNA, 18 nt, Human
cuuggacucauuuuaaaa

SEQ ID NO: 2746995 - RNA, 18 nt, Human
cuuggagcccacacaugg

SEQ ID NO: 2746996 - RNA, 19 nt, Human
cuuggccaugggaggccuu

SEQ ID NO: 2746997 - RNA, 22 nt, Human
cuuggccaugggaggccuuucc

SEQ ID NO: 2746998 - RNA, 20 nt, Human
cuuggcccaggaguuuggcc

SEQ ID NO: 2746999 - RNA, 23 nt, Human
cuuggcccaggaguuuggccaga

SEQ ID NO: 2747000 - RNA, 17 nt, Human
cuugggaccccugagcu

SEQ ID NO: 2747001 - RNA, 21 nt, Human
cuugggcuuuagccuuaaaga

SEQ ID NO: 2747002 - RNA, 17 nt, Human
cuuggggcugaugcagu

SEQ ID NO: 2747003 - RNA, 18 nt, Human
cuuggucugugagaugcu

SEQ ID NO: 2747004 - RNA, 12 nt, Human
cuugguucagua

SEQ ID NO: 2747005 - RNA, 14 nt, Human
cuugguucucucca

SEQ ID NO: 2747006 - RNA, 22 nt, Human
cuuguaaaggaauuuaaaaauc

SEQ ID NO: 2747007 - RNA, 16 nt, Human
cuuguaauucuaaaug

SEQ ID NO: 2747008 - RNA, 14 nt, Human
cuuguacucugaaa

SEQ ID NO: 2747009 - RNA, 20 nt, Human
cuuguacucugaaaguuuug

SEQ ID NO: 2747010 - RNA, 15 nt, Human
cuuguacuuuauuuu

SEQ ID NO: 2747011 - RNA, 22 nt, Human
cuuguauuaaguuguuaauaaa

SEQ ID NO: 2747012 - RNA, 11 nt, Human
cuuguauuaug

SEQ ID NO: 2747013 - RNA, 22 nt, Human
cuuguauuauguguguuuuaaa

SEQ ID NO: 2747014 - RNA, 14 nt, Human
cuuguauuuuacuu

SEQ ID NO: 2747015 - RNA, 21 nt, Human
cuuguccccaacaccccacag

SEQ ID NO: 2747016 - RNA, 22 nt, Human
cuugucuauuaccuguuaguau

SEQ ID NO: 2747017 - RNA, 15 nt, Human
cuugucuuuuuacug

SEQ ID NO: 2747018 - RNA, 17 nt, Human
cuuguuagcaaaaugga

SEQ ID NO: 2747019 - RNA, 17 nt, Human
cuuguuauuuauaacaa

SEQ ID NO: 2747020 - RNA, 22 nt, Human
cuuguuggacgagaaaacaaua

SEQ ID NO: 2747021 - RNA, 22 nt, Human
cuuguuggauuuuugucuugug

SEQ ID NO: 2747022 - RNA, 12 nt, Human
cuuguuuccuua

SEQ ID NO: 2747023 - RNA, 23 nt, Human
cuuuaaaaaaaaaaaaaaagcca

SEQ ID NO: 2747024 - RNA, 20 nt, Human
cuuuaaaaauaguugcuguc

SEQ ID NO: 2747025 - RNA, 17 nt, Human
cuuuaaaacuuauccuc

SEQ ID NO: 2747026 - RNA, 22 nt, Human
cuuuaacuuaauugcuauguuu

SEQ ID NO: 2747027 - RNA, 14 nt, Human
cuuuaauaaaugua

SEQ ID NO: 2747028 - RNA, 22 nt, Human
cuuuaauaaauguauauuguau

SEQ ID NO: 2747029 - RNA, 19 nt, Human
cuuuaaugaauaaacauuu

SEQ ID NO: 2747030 - RNA, 22 nt, Human
cuuuaaugccgauaucuucaga

SEQ ID NO: 2747031 - RNA, 20 nt, Human
cuuuaauuuuacauuuccua

SEQ ID NO: 2747032 - RNA, 14 nt, Human
cuuuacagaaagau

SEQ ID NO: 2747033 - RNA, 16 nt, Human
cuuuaccuuuuuucuu

SEQ ID NO: 2747034 - RNA, 18 nt, Human
cuuuacuguuagucauuu

SEQ ID NO: 2747035 - RNA, 15 nt, Human
cuuuacuugaccucc

SEQ ID NO: 2747036 - RNA, 15 nt, Human
cuuuacuuuccccuu

SEQ ID NO: 2747037 - RNA, 13 nt, Human
cuuuaguuuuugu

SEQ ID NO: 2747038 - RNA, 16 nt, Human
cuuuauaguucuacuc

SEQ ID NO: 2747039 - RNA, 23 nt, Human
cuuuaucaugugucuucugcccu

SEQ ID NO: 2747040 - RNA, 12 nt, Human
cuuuaucuuuuu

SEQ ID NO: 2747041 - RNA, 16 nt, Human
cuuuaugcuaagugaa

SEQ ID NO: 2747042 - RNA, 22 nt, Human
cuuucacauuggcuauuuaaag

SEQ ID NO: 2747043 - RNA, 17 nt, Human
cuuucacauuuaaauaa

SEQ ID NO: 2747044 - RNA, 18 nt, Human
cuuucacauuuaaauaaa

SEQ ID NO: 2747045 - RNA, 20 nt, Human
cuuucagagccuccuuucug

SEQ ID NO: 2747046 - RNA, 18 nt, Human
cuuucauaaagucuugcc

SEQ ID NO: 2747047 - RNA, 21 nt, Human
cuuucauaaagucuugccuug

SEQ ID NO: 2747048 - RNA, 21 nt, Human
cuuucaugaaggggcggcggc

SEQ ID NO: 2747049 - RNA, 18 nt, Human
cuuuccacagaagcucca

SEQ ID NO: 2747050 - RNA, 14 nt, Human
cuuuccagagacca

SEQ ID NO: 2747051 - RNA, 18 nt, Human
cuuuccaugaguugcagu

SEQ ID NO: 2747052 - RNA, 19 nt, Human
cuuuccccuugguucucau

SEQ ID NO: 2747053 - RNA, 21 nt, Human
cuuucccuaagccagcugccc

SEQ ID NO: 2747054 - RNA, 16 nt, Human
cuuuccucaaaacuuc

SEQ ID NO: 2747055 - RNA, 21 nt, Human
cuuuccucuggggcauuaucc

SEQ ID NO: 2747056 - RNA, 19 nt, Human
cuuucuaucuaauuuuuau

SEQ ID NO: 2747057 - RNA, 16 nt, Human
cuuucucaauaagccu

SEQ ID NO: 2747058 - RNA, 21 nt, Human
cuuucucaauaagccucagcu

SEQ ID NO: 2747059 - RNA, 12 nt, Human
cuuucucccccc

SEQ ID NO: 2747060 - RNA, 15 nt, Human
cuuucuuuauuuuga

SEQ ID NO: 2747061 - RNA, 17 nt, Human
cuuucuuuuuuuucuuu

SEQ ID NO: 2747062 - RNA, 22 nt, Human
gaacaagcaaauauaaacagca

SEQ ID NO: 2747063 - RNA, 20 nt, Human
gaacacugggggaggggaca

SEQ ID NO: 2747064 - RNA, 18 nt, Human
gaacagauuucaaaaaaa

SEQ ID NO: 2747065 - RNA, 19 nt, Human
gaacagucucuugaggcac

SEQ ID NO: 2747066 - RNA, 21 nt, Human
gaacagucucuugaggcacag

SEQ ID NO: 2747067 - RNA, 13 nt, Human
gaacauaaaauac

SEQ ID NO: 2747068 - RNA, 17 nt, Human
gaacaucccuccuggga

SEQ ID NO: 2747069 - RNA, 22 nt, Human
gaacauuuauguuccuuuuaaa

SEQ ID NO: 2747070 - RNA, 18 nt, Human
gaaccacaagacugcaca

SEQ ID NO: 2747071 - RNA, 14 nt, Human
gaacccuugcacua

SEQ ID NO: 2747072 - RNA, 23 nt, Human
gaaccggagaaccccaggacgcc

SEQ ID NO: 2747073 - RNA, 18 nt, Human
gaaccucaagcugcaucu

SEQ ID NO: 2747074 - RNA, 19 nt, Human
gaaccuuuacauccagaua

SEQ ID NO: 2747075 - RNA, 18 nt, Human
gaacgauuuagaaagaag

SEQ ID NO: 2747076 - RNA, 15 nt, Human
gaacuaaaaauuaaa

SEQ ID NO: 2747077 - RNA, 20 nt, Human
gaacuagccaaaccaggacc

SEQ ID NO: 2747078 - RNA, 15 nt, Human
gaacucccucucugc

SEQ ID NO: 2747079 - RNA, 22 nt, Human
gaacuccugaccccaaguuauc

SEQ ID NO: 2747080 - RNA, 16 nt, Human
gaacuccuugauuuua

SEQ ID NO: 2747081 - RNA, 15 nt, Human
gaacuucaagcucuc

SEQ ID NO: 2747082 - RNA, 20 nt, Human
gaacuuccagauccuggaaa

SEQ ID NO: 2747083 - RNA, 14 nt, Human
gaacuucuccccug

SEQ ID NO: 2747084 - RNA, 22 nt, Human
gaacuuuccacauucagagcuu

SEQ ID NO: 2747085 - RNA, 14 nt, Human
gaagaaagugaagu

SEQ ID NO: 2747086 - RNA, 21 nt, Human
gaagaaauuccaggaaaaucu

SEQ ID NO: 2747087 - RNA, 14 nt, Human
gaagaaauucugca

SEQ ID NO: 2747088 - RNA, 19 nt, Human
gaagaacucucuggaagcc

SEQ ID NO: 2747089 - RNA, 13 nt, Human
gaagaacugaaau

SEQ ID NO: 2747090 - RNA, 18 nt, Human
gaagaagcaccaaucaug

SEQ ID NO: 2747091 - RNA, 12 nt, Human
gaagaaggaaaa

SEQ ID NO: 2747092 - RNA, 16 nt, Human
gaagaaggugggagga

SEQ ID NO: 2747093 - RNA, 12 nt, Human
gaagaccucauu

SEQ ID NO: 2747094 - RNA, 19 nt, Human
gaagagacagcccaggaua

SEQ ID NO: 2747095 - RNA, 13 nt, Human
gaagagccggagc

SEQ ID NO: 2747096 - RNA, 20 nt, Human
gaagagccggagccuccagc

SEQ ID NO: 2747097 - RNA, 22 nt, Human
gaagaguggguuucacaaguga

SEQ ID NO: 2747098 - RNA, 17 nt, Human
gaagauacugaaauaaa

SEQ ID NO: 2747099 - RNA, 13 nt, Human
gaagauauuuuuc

SEQ ID NO: 2747100 - RNA, 12 nt, Human
gaagaucuagug

SEQ ID NO: 2747101 - RNA, 15 nt, Human
gaagauguagaggag

SEQ ID NO: 2747102 - RNA, 16 nt, Human
gaagauguagaggaga

SEQ ID NO: 2747103 - RNA, 18 nt, Human
gaagcaaaauuuuuucuc

SEQ ID NO: 2747104 - RNA, 17 nt, Human
gaagcaccaaucaugaa

SEQ ID NO: 2747105 - RNA, 13 nt, Human
gaagcaugauugg

SEQ ID NO: 2747106 - RNA, 21 nt, Human
gaagcaugauuggugcccagu

SEQ ID NO: 2747107 - RNA, 18 nt, Human
gaagccacagaccuagga

SEQ ID NO: 2747108 - RNA, 16 nt, Human
gaagccagaucuaugc

SEQ ID NO: 2747109 - RNA, 23 nt, Human
gaagccgagccucaagaugaagg

SEQ ID NO: 2747110 - RNA, 22 nt, Human
gaagcuaaaaggaaagaaaaua

SEQ ID NO: 2747111 - RNA, 15 nt, Human
gaagcucugaagaac

SEQ ID NO: 2747112 - RNA, 20 nt, Human
gaagcuuuuaugugaaacau

SEQ ID NO: 2747113 - RNA, 16 nt, Human
gaaggcaccucucugg

SEQ ID NO: 2747114 - RNA, 19 nt, Human
gaaggcaccucucuggguu

SEQ ID NO: 2747115 - RNA, 16 nt, Human
gaaggcuuacacccac

SEQ ID NO: 2747116 - RNA, 22 nt, Human
gaagggcaucaugcaucuuacu

SEQ ID NO: 2747117 - RNA, 15 nt, Human
gaaggggcggcggcc

SEQ ID NO: 2747118 - RNA, 16 nt, Human
gaagggguucucacag

SEQ ID NO: 2747119 - RNA, 14 nt, Human
gaaggugaucuggc

SEQ ID NO: 2747120 - RNA, 18 nt, Human
gaaggugaucuggcucug

SEQ ID NO: 2747121 - RNA, 16 nt, Human
gaagguggaaauaaac

SEQ ID NO: 2747122 - RNA, 12 nt, Human
gaaggugggagg

SEQ ID NO: 2747123 - RNA, 16 nt, Human
cuggccugcuggaugu

SEQ ID NO: 2747124 - RNA, 13 nt, Human
cuggccuucggcc

SEQ ID NO: 2747125 - RNA, 16 nt, Human
cuggccuucggccucc

SEQ ID NO: 2747126 - RNA, 20 nt, Human
cuggccuucggccuccaucc

SEQ ID NO: 2747127 - RNA, 21 nt, Human
cuggccuucggccuccauccu

SEQ ID NO: 2747128 - RNA, 23 nt, Human
cuggccuucggccuccauccuga

SEQ ID NO: 2747129 - RNA, 17 nt, Human
cuggcgugcagcaucag

SEQ ID NO: 2747130 - RNA, 22 nt, Human
cuggcuaauuagcauggccaca

SEQ ID NO: 2747131 - RNA, 24 nt, Human
cuggcuaauuagcauggccacauc

SEQ ID NO: 2747132 - RNA, 15 nt, Human
cuggcuacuccaugu

SEQ ID NO: 2747133 - RNA, 12 nt, Human
cuggcuccagcu

SEQ ID NO: 2747134 - RNA, 16 nt, Human
cuggcugcgcucggcc

SEQ ID NO: 2747135 - RNA, 17 nt, Human
cuggcugcgcucggccu

SEQ ID NO: 2747136 - RNA, 18 nt, Human
cuggcugcgcucggccug

SEQ ID NO: 2747137 - RNA, 19 nt, Human
cuggcugcgcucggccugc

SEQ ID NO: 2747138 - RNA, 21 nt, Human
cuggcugcgcucggccugcuc

SEQ ID NO: 2747139 - RNA, 17 nt, Human
cuggcugcugguggcgc

SEQ ID NO: 2747140 - RNA, 16 nt, Human
cuggcugggaguggca

SEQ ID NO: 2747141 - RNA, 13 nt, Human
cuggcuucagcaa

SEQ ID NO: 2747142 - RNA, 15 nt, Human
cugggaccaggcacc

SEQ ID NO: 2747143 - RNA, 21 nt, Human
cugggaccaggcacccccaga

SEQ ID NO: 2747144 - RNA, 15 nt, Human
cugggaccuggggca

SEQ ID NO: 2747145 - RNA, 17 nt, Human
cugggagaaaugaaaaa

SEQ ID NO: 2747146 - RNA, 21 nt, Human
cugggauagcugacccagccc

SEQ ID NO: 2747147 - RNA, 16 nt, Human
cugggaucacugauga

SEQ ID NO: 2747148 - RNA, 17 nt, Human
cugggaucacugaugac

SEQ ID NO: 2747149 - RNA, 15 nt, Human
cugggcagaaggcca

SEQ ID NO: 2747150 - RNA, 18 nt, Human
cugggcagaaggccaaga

SEQ ID NO: 2747151 - RNA, 14 nt, Human
cugggcagcugccu

SEQ ID NO: 2747152 - RNA, 23 nt, Human
cugggccauagucauucugccug

SEQ ID NO: 2747153 - RNA, 14 nt, Human
cugggccccugccu

SEQ ID NO: 2747154 - RNA, 15 nt, Human
cugggccccugccuc

SEQ ID NO: 2747155 - RNA, 14 nt, Human
cugggcugugggca

SEQ ID NO: 2747156 - RNA, 16 nt, Human
cugggcugugggcaag

SEQ ID NO: 2747157 - RNA, 17 nt, Human
cuggggaagacaguggc

SEQ ID NO: 2747158 - RNA, 19 nt, Human
cuggggaagacaguggccc

SEQ ID NO: 2747159 - RNA, 16 nt, Human
cuggggccaggcuggg

SEQ ID NO: 2747160 - RNA, 22 nt, Human
cuggggcucugggauagcugac

SEQ ID NO: 2747161 - RNA, 15 nt, Human
cuggggcuucagucu

SEQ ID NO: 2747162 - RNA, 23 nt, Human
cuggggcuuuaacuccugcuaga

SEQ ID NO: 2747163 - RNA, 19 nt, Human
cugggguggguggggcagu

SEQ ID NO: 2747164 - RNA, 23 nt, Human
cugggguggguggggcagugcuu

SEQ ID NO: 2747165 - RNA, 18 nt, Human
cugggguguguggcagag

SEQ ID NO: 2747166 - RNA, 15 nt, Human
cugggucgccggcau

SEQ ID NO: 2747167 - RNA, 20 nt, Human
cugggucuaccacucagaga

SEQ ID NO: 2747168 - RNA, 16 nt, Human
cugggucucagugucc

SEQ ID NO: 2747169 - RNA, 16 nt, Human
cuggguguaaaaccug

SEQ ID NO: 2747170 - RNA, 18 nt, Human
cuggguuaggccuugccu

SEQ ID NO: 2747171 - RNA, 15 nt, Human
cuggguuccuuccuc

SEQ ID NO: 2747172 - RNA, 16 nt, Human
cuggguugaagggcag

SEQ ID NO: 2747173 - RNA, 14 nt, Human
cuggucagcccccu

SEQ ID NO: 2747174 - RNA, 21 nt, Human
cuggucccagccagcaguuca

SEQ ID NO: 2747175 - RNA, 19 nt, Human
cugguccuaagucccugcu

SEQ ID NO: 2747176 - RNA, 21 nt, Human
cuggucuaccuguucgcgcgc

SEQ ID NO: 2747177 - RNA, 15 nt, Human
cuggucucgaacugc

SEQ ID NO: 2747178 - RNA, 19 nt, Human
cuggucucgaacugcugga

SEQ ID NO: 2747179 - RNA, 14 nt, Human
cuggucucuccuug

SEQ ID NO: 2747180 - RNA, 16 nt, Human
cuggucucuccuuguu

SEQ ID NO: 2747181 - RNA, 16 nt, Human
cuggucugguugggca

SEQ ID NO: 2747182 - RNA, 14 nt, Human
cuggugcuauuuug

SEQ ID NO: 2747183 - RNA, 13 nt, Human
cugguggcgcugg

SEQ ID NO: 2747184 - RNA, 17 nt, Human
cugguggcgcuggcugc

SEQ ID NO: 2747185 - RNA, 20 nt, Human
cugguggcgcuggcugcgcu

SEQ ID NO: 2747186 - RNA, 14 nt, Human
cugguggcucugug

SEQ ID NO: 2747187 - RNA, 22 nt, Human
cugguguuugguuucuucauuc

SEQ ID NO: 2747188 - RNA, 15 nt, Human
cuguaaaauaauaac

SEQ ID NO: 2747189 - RNA, 16 nt, Human
cuguaaaaucuuucuu

SEQ ID NO: 2747190 - RNA, 14 nt, Human
cuguaauaaacuca

SEQ ID NO: 2747191 - RNA, 12 nt, Human
cuguaaucacag

SEQ ID NO: 2747192 - RNA, 14 nt, Human
cuguaaucacagcu

SEQ ID NO: 2747193 - RNA, 17 nt, Human
cuguaaucacagcuacu

SEQ ID NO: 2747194 - RNA, 16 nt, Human
cuguaaucccagcacu

SEQ ID NO: 2747195 - RNA, 15 nt, Human
cuguaaucccagcau

SEQ ID NO: 2747196 - RNA, 21 nt, Human
cuguaaucccagcaugcugag

SEQ ID NO: 2747197 - RNA, 15 nt, Human
cuguaauccuugcau

SEQ ID NO: 2747198 - RNA, 16 nt, Human
cuguaauggaagcauc

SEQ ID NO: 2747199 - RNA, 20 nt, Human
cuguaauguuaauauugauu

SEQ ID NO: 2747200 - RNA, 19 nt, Human
cuguacgcgagcgcgcgcg

SEQ ID NO: 2747201 - RNA, 20 nt, Human
cuguagaaaugguuguauua

SEQ ID NO: 2747202 - RNA, 16 nt, Human
cuguagcaaccugaaa

SEQ ID NO: 2747203 - RNA, 23 nt, Human
cuguaucuagccuggaaccaagg

SEQ ID NO: 2747204 - RNA, 18 nt, Human
cuguaucuuguuuuucca

SEQ ID NO: 2747205 - RNA, 18 nt, Human
cuguauguccuuggugcc

SEQ ID NO: 2747206 - RNA, 15 nt, Human
cuguaugucugccua

SEQ ID NO: 2747207 - RNA, 17 nt, Human
cuguauugcauuaaaua

SEQ ID NO: 2747208 - RNA, 12 nt, Human
cuguauuucccc

SEQ ID NO: 2747209 - RNA, 19 nt, Human
cuguauuuuuaccuuuuuc

SEQ ID NO: 2747210 - RNA, 21 nt, Human
cuguauuuuuaccuuuuuccu

SEQ ID NO: 2747211 - RNA, 17 nt, Human
cugucaacuuguauuuu

SEQ ID NO: 2747212 - RNA, 14 nt, Human
cugucacccagguu

SEQ ID NO: 2747213 - RNA, 18 nt, Human
cugucauaugcucugauu

SEQ ID NO: 2747214 - RNA, 15 nt, Human
cugucauuucaaaga

SEQ ID NO: 2747215 - RNA, 14 nt, Human
cugucccaaacaug

SEQ ID NO: 2747216 - RNA, 22 nt, Human
cuguccccgaaacuaccagccc

SEQ ID NO: 2747217 - RNA, 19 nt, Human
cugucccugcagacaugag

SEQ ID NO: 2747218 - RNA, 15 nt, Human
cuguccuggaggggc

SEQ ID NO: 2747219 - RNA, 16 nt, Human
cugucgaaggggaggc

SEQ ID NO: 2747220 - RNA, 18 nt, Human
cugucgaaggggaggcac

SEQ ID NO: 2747221 - RNA, 13 nt, Human
cugucggagcccu

SEQ ID NO: 2747222 - RNA, 17 nt, Human
cugucuacacuaagaga

SEQ ID NO: 2747223 - RNA, 22 nt, Human
cugucucacuuaauccuuuguu

SEQ ID NO: 2747224 - RNA, 12 nt, Human
cugucucagggu

SEQ ID NO: 2747225 - RNA, 18 nt, Human
cugucucuacaaaaaaaa

SEQ ID NO: 2747226 - RNA, 16 nt, Human
cugucucuaccaaaaa

SEQ ID NO: 2747227 - RNA, 17 nt, Human
cugucugccagccagca

SEQ ID NO: 2747228 - RNA, 16 nt, Human
cugucuguuuccucug

SEQ ID NO: 2747229 - RNA, 18 nt, Human
cugucuucuuugcccaca

SEQ ID NO: 2747230 - RNA, 14 nt, Human
cugucuuuuuucua

SEQ ID NO: 2747231 - RNA, 15 nt, Human
cugugaaauaguuca

SEQ ID NO: 2747232 - RNA, 22 nt, Human
cugugaagugagaccuuccuuu

SEQ ID NO: 2747233 - RNA, 13 nt, Human
cugugaccucucc

SEQ ID NO: 2747234 - RNA, 15 nt, Human
cugugaccucucccc

SEQ ID NO: 2747235 - RNA, 12 nt, Human
cugugagggugc

SEQ ID NO: 2747236 - RNA, 16 nt, Human
cugugccguccccaga

SEQ ID NO: 2747237 - RNA, 22 nt, Human
cugugccguccccagagcuaca

SEQ ID NO: 2747238 - RNA, 21 nt, Human
cugugcugcccgucuucagcc

SEQ ID NO: 2747239 - RNA, 16 nt, Human
cuguggauuuaaugug

SEQ ID NO: 2747240 - RNA, 20 nt, Human
cugugguccgaagucuucca

SEQ ID NO: 2747241 - RNA, 22 nt, Human
cugugguuaguguaauaaaaca

SEQ ID NO: 2747242 - RNA, 13 nt, Human
cuguguauuuaac

SEQ ID NO: 2747243 - RNA, 13 nt, Human
cugugucuucaaa

SEQ ID NO: 2747244 - RNA, 19 nt, Human
cugugugcucaggagcccu

SEQ ID NO: 2747245 - RNA, 15 nt, Human
cuguguuggccagga

SEQ ID NO: 2747246 - RNA, 15 nt, Human
cuguuaaaagaugaa

SEQ ID NO: 2747247 - RNA, 17 nt, Human
cuguuauaauaaaugua

SEQ ID NO: 2747248 - RNA, 20 nt, Human
cuguuauaauaaauguaccu

SEQ ID NO: 2747249 - RNA, 13 nt, Human
cuguuauaaucuu

SEQ ID NO: 2747250 - RNA, 12 nt, Human
cuguuaucuuca

SEQ ID NO: 2747251 - RNA, 17 nt, Human
cuguuaucuucacuuuu

SEQ ID NO: 2747252 - RNA, 21 nt, Human
cuguuaucuucacuuuuauaa

SEQ ID NO: 2747253 - RNA, 19 nt, Human
cuguuauuuaauuagccag

SEQ ID NO: 2747254 - RNA, 19 nt, Human
cuguuauuuuaucugcuau

SEQ ID NO: 2747255 - RNA, 22 nt, Human
cuguucacagccagacuggcac

SEQ ID NO: 2747256 - RNA, 21 nt, Human
cuguucauuccuccagguauu

SEQ ID NO: 2747257 - RNA, 19 nt, Human
cuguucugcgcuguguaca

SEQ ID NO: 2747258 - RNA, 15 nt, Human
cuguucuuccaucac

SEQ ID NO: 2747259 - RNA, 12 nt, Human
cuguugauggaa

SEQ ID NO: 2747260 - RNA, 14 nt, Human
cuguuuaagagaca

SEQ ID NO: 2747261 - RNA, 15 nt, Human
cuguuuauaaacauu

SEQ ID NO: 2747262 - RNA, 21 nt, Human
cuguuuguuauggcuuaauga

SEQ ID NO: 2747263 - RNA, 11 nt, Human
cuguuuuauaa

SEQ ID NO: 2747264 - RNA, 15 nt, Human
cuuaaaaaugguuua

SEQ ID NO: 2747265 - RNA, 14 nt, Human
cuuaaaauguaauu

SEQ ID NO: 2747266 - RNA, 15 nt, Human
cuuaaaauguaauua

SEQ ID NO: 2747267 - RNA, 20 nt, Human
cuuaaagaauuuucaaaauc

SEQ ID NO: 2747268 - RNA, 13 nt, Human
cuuaaauaaaccu

SEQ ID NO: 2747269 - RNA, 15 nt, Human
cuuaaccagaucauu

SEQ ID NO: 2747270 - RNA, 20 nt, Human
cuuaacccuggaaaaugaau

SEQ ID NO: 2747271 - RNA, 20 nt, Human
cuuaacucauugcaaccucc

SEQ ID NO: 2747272 - RNA, 18 nt, Human
cuuaacuggagccccauc

SEQ ID NO: 2747273 - RNA, 15 nt, Human
cuuaagaagacugca

SEQ ID NO: 2747274 - RNA, 19 nt, Human
cuuaagacgugauuuugcu

SEQ ID NO: 2747275 - RNA, 21 nt, Human
cuuaagguaugguacaagcaa

SEQ ID NO: 2747276 - RNA, 14 nt, Human
cuuaauuaaaagaa

SEQ ID NO: 2747277 - RNA, 15 nt, Human
cuuaauuaaaagaau

SEQ ID NO: 2747278 - RNA, 19 nt, Human
cuuaauuaaaagaauauuu

SEQ ID NO: 2747279 - RNA, 14 nt, Human
cuuacaaagggaaa

SEQ ID NO: 2747280 - RNA, 17 nt, Human
cuuacaauaauucuaug

SEQ ID NO: 2747281 - RNA, 13 nt, Human
cuuacagagaaaa

SEQ ID NO: 2747282 - RNA, 17 nt, Human
cuuacaugauucauuuu

SEQ ID NO: 2747283 - RNA, 22 nt, Human
cuuaccugggcauucuuguuuc

SEQ ID NO: 2747284 - RNA, 19 nt, Human
cuuaccuugcaucucacag

SEQ ID NO: 2747285 - RNA, 18 nt, Human
cuuacuaguuucccuugc

SEQ ID NO: 2747286 - RNA, 20 nt, Human
cuuacuaguuucccuugcau

SEQ ID NO: 2747287 - RNA, 19 nt, Human
cuuacucuugauuguggga

SEQ ID NO: 2747288 - RNA, 13 nt, Human
cuuacugauuuuu

SEQ ID NO: 2747289 - RNA, 20 nt, Human
cuuacugauuuuuaaguuau

SEQ ID NO: 2747290 - RNA, 21 nt, Human
cuuacugauuuuuaaguuauu

SEQ ID NO: 2747291 - RNA, 19 nt, Human
cuuacuggugcuauuuugu

SEQ ID NO: 2747292 - RNA, 13 nt, Human
cuuacugucuuuu

SEQ ID NO: 2747293 - RNA, 15 nt, Human
cuuacuucuucucau

SEQ ID NO: 2747294 - RNA, 16 nt, Human
cuuagacccucaugcu

SEQ ID NO: 2747295 - RNA, 17 nt, Human
cuuagaccucagccugu

SEQ ID NO: 2747296 - RNA, 18 nt, Human
cuuagaugggcauggugg

SEQ ID NO: 2747297 - RNA, 13 nt, Human
cuuagcccuuccc

SEQ ID NO: 2747298 - RNA, 14 nt, Human
cuuaggaagagaaa

SEQ ID NO: 2747299 - RNA, 13 nt, Human
cuuaggccucuga

SEQ ID NO: 2747300 - RNA, 18 nt, Human
cuuaguguacaugaaagc

SEQ ID NO: 2747301 - RNA, 21 nt, Human
cuuaguugcuguaugucucgu

SEQ ID NO: 2747302 - RNA, 13 nt, Human
cuuauauauugua

SEQ ID NO: 2747303 - RNA, 12 nt, Human
cuuauauuuacu

SEQ ID NO: 2747304 - RNA, 20 nt, Human
cuuauauuucugcuuucaaa

SEQ ID NO: 2747305 - RNA, 22 nt, Human
cuuaucuauguagaauauauuu

SEQ ID NO: 2747306 - RNA, 12 nt, Human
cuuaucuuccua

SEQ ID NO: 2747307 - RNA, 14 nt, Human
cuuaugaaccuuua

SEQ ID NO: 2747308 - RNA, 19 nt, Human
cuuauguuuaauuaaaauc

SEQ ID NO: 2747309 - RNA, 14 nt, Human
cuuauuaauuugac

SEQ ID NO: 2747310 - RNA, 20 nt, Human
cuuauucacaagacccaaaa

SEQ ID NO: 2747311 - RNA, 17 nt, Human
cuuauugcuguccugga

SEQ ID NO: 2747312 - RNA, 23 nt, Human
cuuauuguagcauccuggaauau

SEQ ID NO: 2747313 - RNA, 14 nt, Human
cuuauuuauauaaa

SEQ ID NO: 2747314 - RNA, 14 nt, Human
cuuauuuauuauug

SEQ ID NO: 2747315 - RNA, 21 nt, Human
cuuauuuauucauauuuucuu

SEQ ID NO: 2747316 - RNA, 17 nt, Human
cuuauuuguacauuuuu

SEQ ID NO: 2747317 - RNA, 23 nt, Human
cuucaaacugagauccuuccuuu

SEQ ID NO: 2747318 - RNA, 15 nt, Human
cuucaaagcaaagcu

SEQ ID NO: 2747319 - RNA, 12 nt, Human
cuucaaauccuu

SEQ ID NO: 2747320 - RNA, 19 nt, Human
cuucaaauccuugaagauu

SEQ ID NO: 2747321 - RNA, 12 nt, Human
cuucaacucccu

SEQ ID NO: 2747322 - RNA, 15 nt, Human
cuucaacucccugcc

SEQ ID NO: 2747323 - RNA, 20 nt, Human
cuucaacucccugcccccca

SEQ ID NO: 2747324 - RNA, 23 nt, Human
cuucaacucccugccccccagcc

SEQ ID NO: 2747325 - RNA, 16 nt, Human
cuucaagcucuccaaa

SEQ ID NO: 2747326 - RNA, 13 nt, Human
cuucacaaaccca

SEQ ID NO: 2747327 - RNA, 14 nt, Human
cuucacccugaggu

SEQ ID NO: 2747328 - RNA, 19 nt, Human
cuucacccugaggugagca

SEQ ID NO: 2747329 - RNA, 16 nt, Human
cuucacuguaaaauaa

SEQ ID NO: 2747330 - RNA, 22 nt, Human
cuucacuguaaaauaauaacug

SEQ ID NO: 2747331 - RNA, 22 nt, Human
cuucacuugucauuguuauaua

SEQ ID NO: 2747332 - RNA, 22 nt, Human
cuucagaaaaccuaagcaaacu

SEQ ID NO: 2747333 - RNA, 23 nt, Human
cuucagcacuuuagaauaugccu

SEQ ID NO: 2747334 - RNA, 19 nt, Human
cuucagcagagaaguuuuc

SEQ ID NO: 2747335 - RNA, 23 nt, Human
cuucagccuagccgaccucagcc

SEQ ID NO: 2747336 - RNA, 15 nt, Human
cuucagccugaaaga

SEQ ID NO: 2747337 - RNA, 22 nt, Human
cuucagccugaaagaggaauga

SEQ ID NO: 2747338 - RNA, 14 nt, Human
cuucagucuuuucc

SEQ ID NO: 2747339 - RNA, 11 nt, Human
cuucagugcug

SEQ ID NO: 2747340 - RNA, 13 nt, Human
cuucaucuaagcc

SEQ ID NO: 2747341 - RNA, 21 nt, Human
cuucauguaacuucccugaaa

SEQ ID NO: 2747342 - RNA, 17 nt, Human
cuucauucaagucagcu

SEQ ID NO: 2747343 - RNA, 19 nt, Human
cuucauuuaaaauauuuuu

SEQ ID NO: 2747344 - RNA, 18 nt, Human
cuuccaacguggcccaga

SEQ ID NO: 2747345 - RNA, 23 nt, Human
cuuccaagagccuuuuuuugaaa

SEQ ID NO: 2747346 - RNA, 14 nt, Human
cuuccaauuuuugg

SEQ ID NO: 2747347 - RNA, 14 nt, Human
cuuccacagugccu

SEQ ID NO: 2747348 - RNA, 22 nt, Human
cuuccacuaggguccaccagga

SEQ ID NO: 2747349 - RNA, 23 nt, Human
cuuccacuaggguccaccaggag

SEQ ID NO: 2747350 - RNA, 19 nt, Human
cuuccagauccuggaaauc

SEQ ID NO: 2747351 - RNA, 20 nt, Human
cuuccaggcuggcgugcagc

SEQ ID NO: 2747352 - RNA, 23 nt, Human
cuuccagggcuacgcgcgcuccg

SEQ ID NO: 2747353 - RNA, 15 nt, Human
cuuccaucaccuccc

SEQ ID NO: 2747354 - RNA, 16 nt, Human
cuuccaucaccucccc

SEQ ID NO: 2747355 - RNA, 17 nt, Human
cuuccaucaccuccccc

SEQ ID NO: 2747356 - RNA, 12 nt, Human
cuuccaucugau

SEQ ID NO: 2747357 - RNA, 17 nt, Human
cuuccauuuggaaucau

SEQ ID NO: 2747358 - RNA, 15 nt, Human
cuucccaaaguccug

SEQ ID NO: 2747359 - RNA, 14 nt, Human
cuucccacacuguc

SEQ ID NO: 2747360 - RNA, 17 nt, Human
cuucccaggaguacacc

SEQ ID NO: 2747361 - RNA, 18 nt, Human
cuucccaggaguacaccc

SEQ ID NO: 2747362 - RNA, 22 nt, Human
cuuccccucugcagcuuccagg

SEQ ID NO: 2747363 - RNA, 19 nt, Human
cuucccgcuguuccucgcc

SEQ ID NO: 2747364 - RNA, 16 nt, Human
cuucccuaggagagga

SEQ ID NO: 2747365 - RNA, 14 nt, Human
cuucccuugagccc

SEQ ID NO: 2747366 - RNA, 13 nt, Human
cuucccuuucauu

SEQ ID NO: 2747367 - RNA, 19 nt, Human
cuuccuaauuccacagcug

SEQ ID NO: 2747368 - RNA, 21 nt, Human
cuuccuaauuccacagcugcu

SEQ ID NO: 2747369 - RNA, 12 nt, Human
cuuccucacacc

SEQ ID NO: 2747370 - RNA, 13 nt, Human
cuuccucccauuc

SEQ ID NO: 2747371 - RNA, 15 nt, Human
cuuccucccauucag

SEQ ID NO: 2747372 - RNA, 22 nt, Human
cuuccucccggccgcgcugcgc

SEQ ID NO: 2747373 - RNA, 16 nt, Human
cuuccucccuggaauc

SEQ ID NO: 2747374 - RNA, 12 nt, Human
cuuccucugagc

SEQ ID NO: 2747375 - RNA, 17 nt, Human
cuuccucugagccuugg

SEQ ID NO: 2747376 - RNA, 18 nt, Human
cuuccucugagccuuggg

SEQ ID NO: 2747377 - RNA, 14 nt, Human
cuuccucugucucc

SEQ ID NO: 2747378 - RNA, 12 nt, Human
cuuccugauuau

SEQ ID NO: 2747379 - RNA, 21 nt, Human
cuuccuggauuccucacuuug

SEQ ID NO: 2747380 - RNA, 17 nt, Human
cuuccuggcaauaguca

SEQ ID NO: 2747381 - RNA, 13 nt, Human
cuuccuucauuuc

SEQ ID NO: 2747382 - RNA, 15 nt, Human
cuuccuucauuuccu

SEQ ID NO: 2747383 - RNA, 13 nt, Human
cuucggccuccau

SEQ ID NO: 2747384 - RNA, 17 nt, Human
cuucggccuccauccug

SEQ ID NO: 2747385 - RNA, 21 nt, Human
cuucuaaccugaacugauggg

SEQ ID NO: 2747386 - RNA, 17 nt, Human
cuucuagcagugagcca

SEQ ID NO: 2747387 - RNA, 14 nt, Human
cuucuauucuagcc

SEQ ID NO: 2747388 - RNA, 15 nt, Human
cuucuauugccucug

SEQ ID NO: 2747389 - RNA, 12 nt, Human
cuucuauuuuua

SEQ ID NO: 2747390 - RNA, 21 nt, Human
cuucucacauuuauauuuuug

SEQ ID NO: 2747391 - RNA, 17 nt, Human
cuucuccaacaauaaga

SEQ ID NO: 2747392 - RNA, 13 nt, Human
cuucuccagccuc

SEQ ID NO: 2747393 - RNA, 17 nt, Human
cuucuccagccucagcc

SEQ ID NO: 2747394 - RNA, 22 nt, Human
cuucuccagccucagccuccca

SEQ ID NO: 2747395 - RNA, 20 nt, Human
cuucucccaauucauccuca

SEQ ID NO: 2747396 - RNA, 21 nt, Human
cuucuccuacuguagcaaccu

SEQ ID NO: 2747397 - RNA, 16 nt, Human
cuucucuaaacauuuc

SEQ ID NO: 2747398 - RNA, 16 nt, Human
cuucucuguucauuuc

SEQ ID NO: 2747399 - RNA, 14 nt, Human
cuucucuucacagu

SEQ ID NO: 2747400 - RNA, 15 nt, Human
cuucucuucacaguc

SEQ ID NO: 2747401 - RNA, 14 nt, Human
cuucugacacuaaa

SEQ ID NO: 2747402 - RNA, 17 nt, Human
cuucugaggagcuguug

SEQ ID NO: 2747403 - RNA, 13 nt, Human
cuucuggccuugu

SEQ ID NO: 2747404 - RNA, 19 nt, Human
cuucuggguucaagcgauu

SEQ ID NO: 2747405 - RNA, 19 nt, Human
cuucuggguuccuuccucu

SEQ ID NO: 2747406 - RNA, 20 nt, Human
cuucugucuucacaacagau

SEQ ID NO: 2747407 - RNA, 11 nt, Human
cuucuguuccg

SEQ ID NO: 2747408 - RNA, 12 nt, Human
cuucuuaaaaua

SEQ ID NO: 2747409 - RNA, 16 nt, Human
cuucuuacaauaauuc

SEQ ID NO: 2747410 - RNA, 22 nt, Human
cuucuuacuggugcuauuuugu

SEQ ID NO: 2747411 - RNA, 21 nt, Human
cuucuuccaacguggcccaga

SEQ ID NO: 2747412 - RNA, 17 nt, Human
cuucuuucaugaagggg

SEQ ID NO: 2747413 - RNA, 21 nt, Human
cuucuuuccacagaagcucca

SEQ ID NO: 2747414 - RNA, 20 nt, Human
cuucuuuguguuauuucccu

SEQ ID NO: 2747415 - RNA, 13 nt, Human
cuucuuuuuuucu

SEQ ID NO: 2747416 - RNA, 12 nt, Human
cuugaaaacuuu

SEQ ID NO: 2747417 - RNA, 15 nt, Human
cuugaaaacuuuaug

SEQ ID NO: 2747418 - RNA, 13 nt, Human
cuugaaagcugug

SEQ ID NO: 2747419 - RNA, 24 nt, Human
cuugaacacugggggaggggacau

SEQ ID NO: 2747420 - RNA, 12 nt, Human
cuugaacuagga

SEQ ID NO: 2747421 - RNA, 20 nt, Human
cuugagaaaccuuauuguac

SEQ ID NO: 2747422 - RNA, 14 nt, Human
cuugagaagagaau

SEQ ID NO: 2747423 - RNA, 19 nt, Human
cuugagccaggaggccugc

SEQ ID NO: 2747424 - RNA, 21 nt, Human
cuugaggcacagaaacuccug

SEQ ID NO: 2747425 - RNA, 23 nt, Human
cucugcacacccuccagagacaa

SEQ ID NO: 2747426 - RNA, 13 nt, Human
cucugcagcuucc

SEQ ID NO: 2747427 - RNA, 21 nt, Human
cucugcaggcagccugccuuu

SEQ ID NO: 2747428 - RNA, 17 nt, Human
cucugcccuuccugcag

SEQ ID NO: 2747429 - RNA, 14 nt, Human
cucugccucagaaa

SEQ ID NO: 2747430 - RNA, 17 nt, Human
cucugcucaacuagcag

SEQ ID NO: 2747431 - RNA, 21 nt, Human
cucugcuugccaucccucccu

SEQ ID NO: 2747432 - RNA, 22 nt, Human
cucugcuugccaucccucccuc

SEQ ID NO: 2747433 - RNA, 23 nt, Human
cucugcuugccaucccucccucc

SEQ ID NO: 2747434 - RNA, 16 nt, Human
cucuggacaggcacua

SEQ ID NO: 2747435 - RNA, 12 nt, Human
cucuggagccca

SEQ ID NO: 2747436 - RNA, 14 nt, Human
cucuggccuucggc

SEQ ID NO: 2747437 - RNA, 15 nt, Human
cucuggccuucggcc

SEQ ID NO: 2747438 - RNA, 16 nt, Human
cucuggccuucggccu

SEQ ID NO: 2747439 - RNA, 18 nt, Human
cucuggccuucggccucc

SEQ ID NO: 2747440 - RNA, 16 nt, Human
cucuggcuccagcugg

SEQ ID NO: 2747441 - RNA, 15 nt, Human
cucugggaucccccc

SEQ ID NO: 2747442 - RNA, 16 nt, Human
cucugggcuuggggcu

SEQ ID NO: 2747443 - RNA, 14 nt, Human
cucuggggagcuca

SEQ ID NO: 2747444 - RNA, 20 nt, Human
cucuggggcauuauccaucu

SEQ ID NO: 2747445 - RNA, 17 nt, Human
cucuggucaagaagcau

SEQ ID NO: 2747446 - RNA, 22 nt, Human
cucuggucaagaagcaucgugu

SEQ ID NO: 2747447 - RNA, 21 nt, Human
cucuguauacaaaacccuuuc

SEQ ID NO: 2747448 - RNA, 18 nt, Human
cucuguaucuagccugga

SEQ ID NO: 2747449 - RNA, 21 nt, Human
cucuguauuccuagaaacuga

SEQ ID NO: 2747450 - RNA, 20 nt, Human
cucugucucaaaaaauaaaa

SEQ ID NO: 2747451 - RNA, 15 nt, Human
cucuguguuacccag

SEQ ID NO: 2747452 - RNA, 18 nt, Human
cucuguucauuccuccag

SEQ ID NO: 2747453 - RNA, 13 nt, Human
cucuguucauuuc

SEQ ID NO: 2747454 - RNA, 22 nt, Human
cucuguugagccuuccuuucug

SEQ ID NO: 2747455 - RNA, 15 nt, Human
cucuuagaugcaguu

SEQ ID NO: 2747456 - RNA, 20 nt, Human
cucuuagcuaaaucccuccc

SEQ ID NO: 2747457 - RNA, 16 nt, Human
cucuuauugccucacu

SEQ ID NO: 2747458 - RNA, 17 nt, Human
cucuucccuaggagagg

SEQ ID NO: 2747459 - RNA, 14 nt, Human
cucuuccucagcug

SEQ ID NO: 2747460 - RNA, 19 nt, Human
cucuuccucagcugugugg

SEQ ID NO: 2747461 - RNA, 20 nt, Human
cucuucuccauccuaccaca

SEQ ID NO: 2747462 - RNA, 20 nt, Human
cucuucugacacuaaaacac

SEQ ID NO: 2747463 - RNA, 15 nt, Human
cucuucugagcaccu

SEQ ID NO: 2747464 - RNA, 23 nt, Human
cucuucugagcaccuacuuacau

SEQ ID NO: 2747465 - RNA, 14 nt, Human
cucuucuuuaaagg

SEQ ID NO: 2747466 - RNA, 12 nt, Human
cucuucuuuuca

SEQ ID NO: 2747467 - RNA, 19 nt, Human
cucuugaggcacagaaacu

SEQ ID NO: 2747468 - RNA, 23 nt, Human
cucuugaggcacagaaacuccug

SEQ ID NO: 2747469 - RNA, 23 nt, Human
cucuugccaaaucaaaagacuuu

SEQ ID NO: 2747470 - RNA, 14 nt, Human
cucuugcucagugg

SEQ ID NO: 2747471 - RNA, 17 nt, Human
cucuuggcacagcaugg

SEQ ID NO: 2747472 - RNA, 16 nt, Human
cucuuuuuagagaaau

SEQ ID NO: 2747473 - RNA, 22 nt, Human
cucuuuuuauuuagauuggcag

SEQ ID NO: 2747474 - RNA, 14 nt, Human
cugaaacaaaauua

SEQ ID NO: 2747475 - RNA, 22 nt, Human
cugaaacaaaauuagaaaugua

SEQ ID NO: 2747476 - RNA, 21 nt, Human
cugaaauaaacgucuuaaaua

SEQ ID NO: 2747477 - RNA, 23 nt, Human
cugaaaucauacuucuuaggguu

SEQ ID NO: 2747478 - RNA, 13 nt, Human
cugaaauuuccug

SEQ ID NO: 2747479 - RNA, 17 nt, Human
cugaacaggauauucuc

SEQ ID NO: 2747480 - RNA, 14 nt, Human
cugaacccagggaa

SEQ ID NO: 2747481 - RNA, 15 nt, Human
cugaacucccucucu

SEQ ID NO: 2747482 - RNA, 21 nt, Human
cugaagaagaugguaccacca

SEQ ID NO: 2747483 - RNA, 16 nt, Human
cugaagaaucacaaua

SEQ ID NO: 2747484 - RNA, 15 nt, Human
cugaagacccccaac

SEQ ID NO: 2747485 - RNA, 15 nt, Human
cugaagaguggguuu

SEQ ID NO: 2747486 - RNA, 20 nt, Human
cugaagaguggguuucacaa

SEQ ID NO: 2747487 - RNA, 18 nt, Human
cugaaggguaauuauaua

SEQ ID NO: 2747488 - RNA, 13 nt, Human
cugaauuuaaaua

SEQ ID NO: 2747489 - RNA, 17 nt, Human
cugaauuuaaauagcuu

SEQ ID NO: 2747490 - RNA, 20 nt, Human
cugaauuugagauacaaaca

SEQ ID NO: 2747491 - RNA, 11 nt, Human
cugacaaagac

SEQ ID NO: 2747492 - RNA, 15 nt, Human
cugacacuaaaacac

SEQ ID NO: 2747493 - RNA, 20 nt, Human
cugacacuaaaacaccucag

SEQ ID NO: 2747494 - RNA, 19 nt, Human
cugacagcccaaggguggg

SEQ ID NO: 2747495 - RNA, 14 nt, Human
cugacccagccccu

SEQ ID NO: 2747496 - RNA, 15 nt, Human
cugacccagccccuu

SEQ ID NO: 2747497 - RNA, 12 nt, Human
cugacccucccc

SEQ ID NO: 2747498 - RNA, 13 nt, Human
cugacccucccca

SEQ ID NO: 2747499 - RNA, 18 nt, Human
cugaccucccucuaauuu

SEQ ID NO: 2747500 - RNA, 16 nt, Human
cugacgaacuccuuga

SEQ ID NO: 2747501 - RNA, 17 nt, Human
cugacgacuugagugcu

SEQ ID NO: 2747502 - RNA, 23 nt, Human
cugacuaauuaggcaaggcuaug

SEQ ID NO: 2747503 - RNA, 13 nt, Human
cugacucucuuaa

SEQ ID NO: 2747504 - RNA, 15 nt, Human
cugacucuuaagaag

SEQ ID NO: 2747505 - RNA, 16 nt, Human
cugacugccaagccau

SEQ ID NO: 2747506 - RNA, 19 nt, Human
cugacugcuaguuuauaua

SEQ ID NO: 2747507 - RNA, 18 nt, Human
cugagaaauuuauaaacu

SEQ ID NO: 2747508 - RNA, 23 nt, Human
cugagaaggcuguggauuuaaug

SEQ ID NO: 2747509 - RNA, 17 nt, Human
cugagacaaauggaggc

SEQ ID NO: 2747510 - RNA, 21 nt, Human
cugagacaaauggaggccugu

SEQ ID NO: 2747511 - RNA, 18 nt, Human
cugagaccaaggcccccg

SEQ ID NO: 2747512 - RNA, 23 nt, Human
cugagaccaaggcccccgggccg

SEQ ID NO: 2747513 - RNA, 13 nt, Human
cugagaccagcca

SEQ ID NO: 2747514 - RNA, 14 nt, Human
cugagagaaaauaa

SEQ ID NO: 2747515 - RNA, 18 nt, Human
cugagagagcuggaggca

SEQ ID NO: 2747516 - RNA, 14 nt, Human
cugagagaugacag

SEQ ID NO: 2747517 - RNA, 13 nt, Human
cugagagugaaca

SEQ ID NO: 2747518 - RNA, 16 nt, Human
cugagagugaacaaau

SEQ ID NO: 2747519 - RNA, 17 nt, Human
cugagaugggagaauca

SEQ ID NO: 2747520 - RNA, 19 nt, Human
cugagcaggauuuuaaucu

SEQ ID NO: 2747521 - RNA, 17 nt, Human
cugagcagugcuugaau

SEQ ID NO: 2747522 - RNA, 14 nt, Human
cugagcauguacug

SEQ ID NO: 2747523 - RNA, 15 nt, Human
cugagcauguacuga

SEQ ID NO: 2747524 - RNA, 19 nt, Human
cugagcccggaaacuccac

SEQ ID NO: 2747525 - RNA, 21 nt, Human
cugagcccggaaacuccacau

SEQ ID NO: 2747526 - RNA, 19 nt, Human
cugagccucagucucccuc

SEQ ID NO: 2747527 - RNA, 13 nt, Human
cugagccugccuu

SEQ ID NO: 2747528 - RNA, 13 nt, Human
cugagccuuggga

SEQ ID NO: 2747529 - RNA, 17 nt, Human
cugagcgacagugagac

SEQ ID NO: 2747530 - RNA, 22 nt, Human
cugagcgcucagcuucaagaaa

SEQ ID NO: 2747531 - RNA, 17 nt, Human
cugagcuaaauaaagau

SEQ ID NO: 2747532 - RNA, 12 nt, Human
cugaggagcugu

SEQ ID NO: 2747533 - RNA, 13 nt, Human
cugaggcagacag

SEQ ID NO: 2747534 - RNA, 20 nt, Human
cugaggcagacagcagcuca

SEQ ID NO: 2747535 - RNA, 21 nt, Human
cugaggcagacagcagcucag

SEQ ID NO: 2747536 - RNA, 18 nt, Human
cugaggccuagacucugu

SEQ ID NO: 2747537 - RNA, 17 nt, Human
cugaggcuccacuuggu

SEQ ID NO: 2747538 - RNA, 14 nt, Human
cugaggcuucuggg

SEQ ID NO: 2747539 - RNA, 14 nt, Human
cugagggggugggg

SEQ ID NO: 2747540 - RNA, 19 nt, Human
cugagggggugggggugcc

SEQ ID NO: 2747541 - RNA, 13 nt, Human
cugaggggugggg

SEQ ID NO: 2747542 - RNA, 18 nt, Human
cugaggggugggggugcc

SEQ ID NO: 2747543 - RNA, 15 nt, Human
cugaggugagcauca

SEQ ID NO: 2747544 - RNA, 14 nt, Human
cugaguaaugcauu

SEQ ID NO: 2747545 - RNA, 17 nt, Human
cugagucaacuccuuuc

SEQ ID NO: 2747546 - RNA, 19 nt, Human
cugagucaacuccuuucuc

SEQ ID NO: 2747547 - RNA, 14 nt, Human
cugaguuuuaccaa

SEQ ID NO: 2747548 - RNA, 18 nt, Human
cugauaaugaaaauuaug

SEQ ID NO: 2747549 - RNA, 16 nt, Human
cugauacuuuuuucau

SEQ ID NO: 2747550 - RNA, 23 nt, Human
cugauauauguguuuuucacauu

SEQ ID NO: 2747551 - RNA, 19 nt, Human
cugauauauuccaccagga

SEQ ID NO: 2747552 - RNA, 23 nt, Human
cugauaucaugccccuguacucc

SEQ ID NO: 2747553 - RNA, 11 nt, Human
cuggaaacuuc

SEQ ID NO: 2747554 - RNA, 18 nt, Human
cuggaaacuucagcgguu

SEQ ID NO: 2747555 - RNA, 20 nt, Human
cuggaauaauccuaaacaua

SEQ ID NO: 2747556 - RNA, 21 nt, Human
cuggaauaauccuaaacauau

SEQ ID NO: 2747557 - RNA, 15 nt, Human
cuggaauguaaucaa

SEQ ID NO: 2747558 - RNA, 19 nt, Human
cuggacucaccucccccau

SEQ ID NO: 2747559 - RNA, 16 nt, Human
cuggacuugccuccag

SEQ ID NO: 2747560 - RNA, 16 nt, Human
cuggacuuuccagaga

SEQ ID NO: 2747561 - RNA, 22 nt, Human
cuggacuuuccagagaccagua

SEQ ID NO: 2747562 - RNA, 21 nt, Human
cuggagacauugaggcaggca

SEQ ID NO: 2747563 - RNA, 17 nt, Human
cuggagcgcuucaguuc

SEQ ID NO: 2747564 - RNA, 19 nt, Human
cuggagcgcuucaguucag

SEQ ID NO: 2747565 - RNA, 14 nt, Human
cuggagcucugccc

SEQ ID NO: 2747566 - RNA, 21 nt, Human
cuggagcuugaaauagugucu

SEQ ID NO: 2747567 - RNA, 22 nt, Human
cuggagcuugaaauagugucug

SEQ ID NO: 2747568 - RNA, 17 nt, Human
cuggagggaagccuugg

SEQ ID NO: 2747569 - RNA, 12 nt, Human
cuggaggggcug

SEQ ID NO: 2747570 - RNA, 14 nt, Human
cuggagugcagugg

SEQ ID NO: 2747571 - RNA, 19 nt, Human
cuggagugcaguggcgcaa

SEQ ID NO: 2747572 - RNA, 16 nt, Human
cuggaugcucucguug

SEQ ID NO: 2747573 - RNA, 20 nt, Human
cuggauguggagggggcgcg

SEQ ID NO: 2747574 - RNA, 16 nt, Human
cuggauuugcaacccc

SEQ ID NO: 2747575 - RNA, 21 nt, Human
cuggcacagagguagucucac

SEQ ID NO: 2747576 - RNA, 16 nt, Human
cuggcaguuuuccauu

SEQ ID NO: 2747577 - RNA, 20 nt, Human
cuggccaccugcugagcccc

SEQ ID NO: 2747578 - RNA, 12 nt, Human
cuggccaggcug

SEQ ID NO: 2747579 - RNA, 13 nt, Human
cuggccaggcugg

SEQ ID NO: 2747580 - RNA, 13 nt, Human
cuauuuaaagaca

SEQ ID NO: 2747581 - RNA, 11 nt, Human
cuauuuaauua

SEQ ID NO: 2747582 - RNA, 15 nt, Human
cuauuuauugcugaa

SEQ ID NO: 2747583 - RNA, 17 nt, Human
cuauuugaacuuuuuau

SEQ ID NO: 2747584 - RNA, 14 nt, Human
cuauuuuuaauguu

SEQ ID NO: 2747585 - RNA, 17 nt, Human
cuauuuuuggaagagga

SEQ ID NO: 2747586 - RNA, 13 nt, Human
cucaaaaaauaaa

SEQ ID NO: 2747587 - RNA, 21 nt, Human
cucaaaacuucagacauagaa

SEQ ID NO: 2747588 - RNA, 18 nt, Human
cucaaaauaccaugccau

SEQ ID NO: 2747589 - RNA, 18 nt, Human
cucaaacccauucccucu

SEQ ID NO: 2747590 - RNA, 22 nt, Human
cucaaacuccugaccucaggca

SEQ ID NO: 2747591 - RNA, 22 nt, Human
cucaaacuggggccucccuggu

SEQ ID NO: 2747592 - RNA, 20 nt, Human
cucaaagagggagugcauuu

SEQ ID NO: 2747593 - RNA, 16 nt, Human
cucaaagcaaauaauu

SEQ ID NO: 2747594 - RNA, 14 nt, Human
cucaaagugcuggc

SEQ ID NO: 2747595 - RNA, 18 nt, Human
cucaaaucaagaaacuua

SEQ ID NO: 2747596 - RNA, 14 nt, Human
cucaaaugcaccau

SEQ ID NO: 2747597 - RNA, 15 nt, Human
cucaaauuguucucu

SEQ ID NO: 2747598 - RNA, 14 nt, Human
cucaacaaacauaa

SEQ ID NO: 2747599 - RNA, 15 nt, Human
cucaacaaacauaau

SEQ ID NO: 2747600 - RNA, 22 nt, Human
cucaagcccugcagucacagcu

SEQ ID NO: 2747601 - RNA, 19 nt, Human
cucaagcuaugugagcuca

SEQ ID NO: 2747602 - RNA, 13 nt, Human
cucaagcugcauc

SEQ ID NO: 2747603 - RNA, 17 nt, Human
cucaagucuuauuuccu

SEQ ID NO: 2747604 - RNA, 20 nt, Human
cucaauaaaguacaagagcu

SEQ ID NO: 2747605 - RNA, 15 nt, Human
cucaauaagccucag

SEQ ID NO: 2747606 - RNA, 18 nt, Human
cucaauaagccucagcuu

SEQ ID NO: 2747607 - RNA, 18 nt, Human
cucaaugguuaacuaauu

SEQ ID NO: 2747608 - RNA, 15 nt, Human
cucacaacagcugcc

SEQ ID NO: 2747609 - RNA, 15 nt, Human
cucacaagcacuuuc

SEQ ID NO: 2747610 - RNA, 23 nt, Human
cucacacauuacaacaguagaga

SEQ ID NO: 2747611 - RNA, 19 nt, Human
cucacagaagaaggaaauu

SEQ ID NO: 2747612 - RNA, 18 nt, Human
cucacagaccuuugaacu

SEQ ID NO: 2747613 - RNA, 17 nt, Human
cucacaggagcaucucc

SEQ ID NO: 2747614 - RNA, 17 nt, Human
cucacauacccucacuu

SEQ ID NO: 2747615 - RNA, 16 nt, Human
cucacauccauucuuc

SEQ ID NO: 2747616 - RNA, 19 nt, Human
cucacaugauuccagccau

SEQ ID NO: 2747617 - RNA, 19 nt, Human
cucacauuuauauuuuugu

SEQ ID NO: 2747618 - RNA, 21 nt, Human
cucaccaagcugcuguggcca

SEQ ID NO: 2747619 - RNA, 12 nt, Human
cucaccaguccc

SEQ ID NO: 2747620 - RNA, 13 nt, Human
cucaccaguuucc

SEQ ID NO: 2747621 - RNA, 14 nt, Human
cucaccccuugcca

SEQ ID NO: 2747622 - RNA, 13 nt, Human
cucaccuccccca

SEQ ID NO: 2747623 - RNA, 19 nt, Human
cucaccucccccaucucuu

SEQ ID NO: 2747624 - RNA, 19 nt, Human
cucaccugagcgcucagcu

SEQ ID NO: 2747625 - RNA, 21 nt, Human
cucacuaauucauuaaucugc

SEQ ID NO: 2747626 - RNA, 14 nt, Human
cucacugcaaccuc

SEQ ID NO: 2747627 - RNA, 17 nt, Human
cucacugcaaccuccac

SEQ ID NO: 2747628 - RNA, 19 nt, Human
cucacugcaaccuccaccu

SEQ ID NO: 2747629 - RNA, 20 nt, Human
cucacugcaaccuccaccuc

SEQ ID NO: 2747630 - RNA, 21 nt, Human
cucacugcaaccucugccucc

SEQ ID NO: 2747631 - RNA, 15 nt, Human
cucacugcaggcucc

SEQ ID NO: 2747632 - RNA, 15 nt, Human
cucacugugggaagg

SEQ ID NO: 2747633 - RNA, 13 nt, Human
cucagaaaacaag

SEQ ID NO: 2747634 - RNA, 17 nt, Human
cucagaaacaucaguua

SEQ ID NO: 2747635 - RNA, 23 nt, Human
cucagaaguuucuucuuuaggca

SEQ ID NO: 2747636 - RNA, 19 nt, Human
cucagaaucaugcugagag

SEQ ID NO: 2747637 - RNA, 16 nt, Human
cucagaggcagugaca

SEQ ID NO: 2747638 - RNA, 13 nt, Human
cucagauccuccu

SEQ ID NO: 2747639 - RNA, 16 nt, Human
cucagauccuccucau

SEQ ID NO: 2747640 - RNA, 22 nt, Human
cucagauuauaacuguugucau

SEQ ID NO: 2747641 - RNA, 20 nt, Human
cucagcccugcaccaugcug

SEQ ID NO: 2747642 - RNA, 22 nt, Human
cucagcccugcaccaugcugcu

SEQ ID NO: 2747643 - RNA, 16 nt, Human
cucagcccuggugggc

SEQ ID NO: 2747644 - RNA, 21 nt, Human
cucagcccuggugggcagaga

SEQ ID NO: 2747645 - RNA, 22 nt, Human
cucagcccuggugggcagagag

SEQ ID NO: 2747646 - RNA, 23 nt, Human
cucagcccuggugggcagagagg

SEQ ID NO: 2747647 - RNA, 19 nt, Human
cucagccucccaaagugcu

SEQ ID NO: 2747648 - RNA, 14 nt, Human
cucagccucccaag

SEQ ID NO: 2747649 - RNA, 22 nt, Human
cucagccuggugggccuccucu

SEQ ID NO: 2747650 - RNA, 19 nt, Human
cucagccuuccccuugccc

SEQ ID NO: 2747651 - RNA, 17 nt, Human
cucagcuguguggguca

SEQ ID NO: 2747652 - RNA, 16 nt, Human
cucagcuucacccuga

SEQ ID NO: 2747653 - RNA, 20 nt, Human
cucagcuucacccugaggug

SEQ ID NO: 2747654 - RNA, 22 nt, Human
cucagcuucacccugaggugag

SEQ ID NO: 2747655 - RNA, 16 nt, Human
cucagcuucuccaaca

SEQ ID NO: 2747656 - RNA, 16 nt, Human
cucaggaaggggugug

SEQ ID NO: 2747657 - RNA, 14 nt, Human
cucaggagcccugg

SEQ ID NO: 2747658 - RNA, 20 nt, Human
cucaggaugagggaaaagaa

SEQ ID NO: 2747659 - RNA, 14 nt, Human
cucaggcuggcacc

SEQ ID NO: 2747660 - RNA, 14 nt, Human
cucagggccccagc

SEQ ID NO: 2747661 - RNA, 16 nt, Human
cucagggcucuuuccu

SEQ ID NO: 2747662 - RNA, 15 nt, Human
cucagggcuggucuu

SEQ ID NO: 2747663 - RNA, 17 nt, Human
cucagggcuggucuuuu

SEQ ID NO: 2747664 - RNA, 23 nt, Human
cucaggggggugguuuucccauc

SEQ ID NO: 2747665 - RNA, 17 nt, Human
cucagucucccucccuu

SEQ ID NO: 2747666 - RNA, 23 nt, Human
cucagucucccucccuuggggcc

SEQ ID NO: 2747667 - RNA, 13 nt, Human
cucagugggggca

SEQ ID NO: 2747668 - RNA, 16 nt, Human
cucagugggggcagag

SEQ ID NO: 2747669 - RNA, 20 nt, Human
cucagugucaaugcagcccc

SEQ ID NO: 2747670 - RNA, 14 nt, Human
cucaguucccucuu

SEQ ID NO: 2747671 - RNA, 22 nt, Human
cucauaacucugugaucuugcu

SEQ ID NO: 2747672 - RNA, 16 nt, Human
cucauaccuuccccac

SEQ ID NO: 2747673 - RNA, 20 nt, Human
cucauaccuuccccacaucu

SEQ ID NO: 2747674 - RNA, 23 nt, Human
cucauacuauuuaagagaacaag

SEQ ID NO: 2747675 - RNA, 21 nt, Human
cucauauccaguauuguuccu

SEQ ID NO: 2747676 - RNA, 18 nt, Human
cucauccacguccugucu

SEQ ID NO: 2747677 - RNA, 15 nt, Human
cucauccacuuucca

SEQ ID NO: 2747678 - RNA, 13 nt, Human
cucauccugcagg

SEQ ID NO: 2747679 - RNA, 14 nt, Human
cucauccugcaggc

SEQ ID NO: 2747680 - RNA, 16 nt, Human
cucauccugcaggcag

SEQ ID NO: 2747681 - RNA, 18 nt, Human
cucauccugcaggcagcu

SEQ ID NO: 2747682 - RNA, 21 nt, Human
cucaucuauuucuuuuuaauu

SEQ ID NO: 2747683 - RNA, 14 nt, Human
cucaucucuucuuu

SEQ ID NO: 2747684 - RNA, 23 nt, Human
cucaucucuucuuuuaaaccauu

SEQ ID NO: 2747685 - RNA, 24 nt, Human
cucaucuguaaaauggagacacca

SEQ ID NO: 2747686 - RNA, 19 nt, Human
cucaucuuuuuacuaaacu

SEQ ID NO: 2747687 - RNA, 17 nt, Human
cucaugagggcuggaug

SEQ ID NO: 2747688 - RNA, 19 nt, Human
cucaugcauuguccucuuu

SEQ ID NO: 2747689 - RNA, 17 nt, Human
cucauggaauuggagcu

SEQ ID NO: 2747690 - RNA, 21 nt, Human
cucauggaauuggagcucgug

SEQ ID NO: 2747691 - RNA, 23 nt, Human
cucauggaauuggagcucguggg

SEQ ID NO: 2747692 - RNA, 19 nt, Human
cucauugcaaccuccaccu

SEQ ID NO: 2747693 - RNA, 18 nt, Human
cucauuguagaaaagcua

SEQ ID NO: 2747694 - RNA, 12 nt, Human
cucauuucuagc

SEQ ID NO: 2747695 - RNA, 14 nt, Human
cucauuucucaucu

SEQ ID NO: 2747696 - RNA, 15 nt, Human
cucauuucucaucuu

SEQ ID NO: 2747697 - RNA, 21 nt, Human
cucauuucucaucuuuuuacu

SEQ ID NO: 2747698 - RNA, 15 nt, Human
cucauuuuaaaaaau

SEQ ID NO: 2747699 - RNA, 21 nt, Human
cucauuuuuguuuucauuauc

SEQ ID NO: 2747700 - RNA, 17 nt, Human
cucauuuuuucuucucc

SEQ ID NO: 2747701 - RNA, 12 nt, Human
cuccaaggaccg

SEQ ID NO: 2747702 - RNA, 18 nt, Human
cuccaaguucaaaacuua

SEQ ID NO: 2747703 - RNA, 20 nt, Human
cuccacaauagcagacagug

SEQ ID NO: 2747704 - RNA, 13 nt, Human
cuccacauccugu

SEQ ID NO: 2747705 - RNA, 15 nt, Human
cuccacauccugugg

SEQ ID NO: 2747706 - RNA, 16 nt, Human
cuccacauccuguggg

SEQ ID NO: 2747707 - RNA, 23 nt, Human
cuccaccagguucuuucuuuaaa

SEQ ID NO: 2747708 - RNA, 11 nt, Human
cuccaccaucg

SEQ ID NO: 2747709 - RNA, 13 nt, Human
cuccaccucccug

SEQ ID NO: 2747710 - RNA, 14 nt, Human
cuccaccucccugc

SEQ ID NO: 2747711 - RNA, 16 nt, Human
cuccaccuuacuucuu

SEQ ID NO: 2747712 - RNA, 19 nt, Human
cuccaccuugcagcucucc

SEQ ID NO: 2747713 - RNA, 22 nt, Human
cuccacucugagucccagagcc

SEQ ID NO: 2747714 - RNA, 13 nt, Human
cuccacuggaaaa

SEQ ID NO: 2747715 - RNA, 15 nt, Human
cuccacuggaaaacu

SEQ ID NO: 2747716 - RNA, 16 nt, Human
cuccacuuggucugug

SEQ ID NO: 2747717 - RNA, 22 nt, Human
cuccagagggaauugcagagua

SEQ ID NO: 2747718 - RNA, 19 nt, Human
cuccagaugagaguacacc

SEQ ID NO: 2747719 - RNA, 20 nt, Human
cuccagaugagaguacaccc

SEQ ID NO: 2747720 - RNA, 21 nt, Human
cuccagaugagaguacacccc

SEQ ID NO: 2747721 - RNA, 22 nt, Human
cuccagaugagaguacacccca

SEQ ID NO: 2747722 - RNA, 15 nt, Human
cuccagaugcagccc

SEQ ID NO: 2747723 - RNA, 17 nt, Human
cuccagaugcagcccca

SEQ ID NO: 2747724 - RNA, 18 nt, Human
cuaauguugaauuuugau

SEQ ID NO: 2747725 - RNA, 18 nt, Human
cuaauuagcauggccaca

SEQ ID NO: 2747726 - RNA, 21 nt, Human
cuaauuauauaauauuuuuaa

SEQ ID NO: 2747727 - RNA, 22 nt, Human
cuaauuauauaauauuuuuaau

SEQ ID NO: 2747728 - RNA, 22 nt, Human
cuaauugaaucccuuaaacuca

SEQ ID NO: 2747729 - RNA, 17 nt, Human
cuaauuggcaugaaggu

SEQ ID NO: 2747730 - RNA, 19 nt, Human
cuaauuuguguauuuucag

SEQ ID NO: 2747731 - RNA, 19 nt, Human
cuaauuuuaacucuauaau

SEQ ID NO: 2747732 - RNA, 15 nt, Human
cuaauuuugaaaaac

SEQ ID NO: 2747733 - RNA, 17 nt, Human
cuaauuuugaaaaacug

SEQ ID NO: 2747734 - RNA, 18 nt, Human
cuaauuuugaaaaacugc

SEQ ID NO: 2747735 - RNA, 12 nt, Human
cuaauuuuuagg

SEQ ID NO: 2747736 - RNA, 13 nt, Human
cuaauuuuuauua

SEQ ID NO: 2747737 - RNA, 19 nt, Human
cuaauuuuuguauuuuuag

SEQ ID NO: 2747738 - RNA, 12 nt, Human
cuacaaaaaaaa

SEQ ID NO: 2747739 - RNA, 15 nt, Human
cuacaaaaacacagc

SEQ ID NO: 2747740 - RNA, 14 nt, Human
cuacaaagaugacu

SEQ ID NO: 2747741 - RNA, 23 nt, Human
cuacaaaugcauuucuaaagcca

SEQ ID NO: 2747742 - RNA, 15 nt, Human
cuacaaccuccgccu

SEQ ID NO: 2747743 - RNA, 14 nt, Human
cuacaagacacagu

SEQ ID NO: 2747744 - RNA, 15 nt, Human
cuacaagcuaaaauu

SEQ ID NO: 2747745 - RNA, 17 nt, Human
cuacaagcuaaaauuag

SEQ ID NO: 2747746 - RNA, 17 nt, Human
cuacacagaucacagcu

SEQ ID NO: 2747747 - RNA, 21 nt, Human
cuacacagaucacagcuucag

SEQ ID NO: 2747748 - RNA, 21 nt, Human
cuacacauacauguaaaauau

SEQ ID NO: 2747749 - RNA, 14 nt, Human
cuacaccccucccc

SEQ ID NO: 2747750 - RNA, 16 nt, Human
cuacacuccagugaga

SEQ ID NO: 2747751 - RNA, 14 nt, Human
cuacagaacuaaaa

SEQ ID NO: 2747752 - RNA, 17 nt, Human
cuacagaacuaaaaauu

SEQ ID NO: 2747753 - RNA, 14 nt, Human
cuacaggacauuuu

SEQ ID NO: 2747754 - RNA, 17 nt, Human
cuacaggccccaucugg

SEQ ID NO: 2747755 - RNA, 16 nt, Human
cuacaggcgugagcca

SEQ ID NO: 2747756 - RNA, 22 nt, Human
cuacaggcgugagccaccaugc

SEQ ID NO: 2747757 - RNA, 12 nt, Human
cuacagugagcc

SEQ ID NO: 2747758 - RNA, 13 nt, Human
cuacagugagcca

SEQ ID NO: 2747759 - RNA, 13 nt, Human
cuacaguguacag

SEQ ID NO: 2747760 - RNA, 19 nt, Human
cuacaguguacagucuugu

SEQ ID NO: 2747761 - RNA, 12 nt, Human
cuacauaaaaua

SEQ ID NO: 2747762 - RNA, 13 nt, Human
cuacauaaaauac

SEQ ID NO: 2747763 - RNA, 22 nt, Human
cuacauaaaauacaaaaacuua

SEQ ID NO: 2747764 - RNA, 16 nt, Human
cuaccaaaaaucucaa

SEQ ID NO: 2747765 - RNA, 21 nt, Human
cuaccaaaaaucucaauauuu

SEQ ID NO: 2747766 - RNA, 19 nt, Human
cuaccacaaugcagugccu

SEQ ID NO: 2747767 - RNA, 21 nt, Human
cuacccaguagaugccacuag

SEQ ID NO: 2747768 - RNA, 18 nt, Human
cuaccccuuuacaaauag

SEQ ID NO: 2747769 - RNA, 18 nt, Human
cuacccuggacuugccuc

SEQ ID NO: 2747770 - RNA, 20 nt, Human
cuaccugcucagcccugcac

SEQ ID NO: 2747771 - RNA, 18 nt, Human
cuaccuguucgcgcgccu

SEQ ID NO: 2747772 - RNA, 19 nt, Human
cuaccuguucgcgcgccuc

SEQ ID NO: 2747773 - RNA, 22 nt, Human
cuaccuguucgcgcgccuccgc

SEQ ID NO: 2747774 - RNA, 21 nt, Human
cuaccuuuugcuguggcaaau

SEQ ID NO: 2747775 - RNA, 14 nt, Human
cuacgccuggcuga

SEQ ID NO: 2747776 - RNA, 13 nt, Human
cuacgcgcgcucc

SEQ ID NO: 2747777 - RNA, 15 nt, Human
cuacuaauuuuaaaa

SEQ ID NO: 2747778 - RNA, 17 nt, Human
cuacuaauuuuaaaaug

SEQ ID NO: 2747779 - RNA, 13 nt, Human
cuacuagaaaauu

SEQ ID NO: 2747780 - RNA, 16 nt, Human
cuacucuguuccuuca

SEQ ID NO: 2747781 - RNA, 20 nt, Human
cuacuggcugccagaaucua

SEQ ID NO: 2747782 - RNA, 13 nt, Human
cuacuuccccuuc

SEQ ID NO: 2747783 - RNA, 19 nt, Human
cuacuugggaggcugaggc

SEQ ID NO: 2747784 - RNA, 15 nt, Human
cuacuuucugugucu

SEQ ID NO: 2747785 - RNA, 16 nt, Human
cuagaaccaccugccu

SEQ ID NO: 2747786 - RNA, 15 nt, Human
cuagaacucccuuuc

SEQ ID NO: 2747787 - RNA, 17 nt, Human
cuagaacucccuuucaa

SEQ ID NO: 2747788 - RNA, 18 nt, Human
cuagaacucccuuucaac

SEQ ID NO: 2747789 - RNA, 19 nt, Human
cuagaauacuaauaaaaua

SEQ ID NO: 2747790 - RNA, 15 nt, Human
cuagaauucacucca

SEQ ID NO: 2747791 - RNA, 13 nt, Human
cuagaauuuauuc

SEQ ID NO: 2747792 - RNA, 23 nt, Human
cuagaauuugauaugugaacagu

SEQ ID NO: 2747793 - RNA, 15 nt, Human
cuagacaguucuuug

SEQ ID NO: 2747794 - RNA, 13 nt, Human
cuagacccacugg

SEQ ID NO: 2747795 - RNA, 23 nt, Human
cuagacccacuggacucaccucc

SEQ ID NO: 2747796 - RNA, 22 nt, Human
cuagacuagucucaaacuccug

SEQ ID NO: 2747797 - RNA, 15 nt, Human
cuagagcaaagccau

SEQ ID NO: 2747798 - RNA, 20 nt, Human
cuagagcacacuguagcauu

SEQ ID NO: 2747799 - RNA, 20 nt, Human
cuagagccaguuacuuugug

SEQ ID NO: 2747800 - RNA, 21 nt, Human
cuagagugacucacuaauuca

SEQ ID NO: 2747801 - RNA, 13 nt, Human
cuagcagugagcc

SEQ ID NO: 2747802 - RNA, 18 nt, Human
cuagcauaucugccuuua

SEQ ID NO: 2747803 - RNA, 22 nt, Human
cuagcaugaagacagagcccca

SEQ ID NO: 2747804 - RNA, 22 nt, Human
cuagccagaggcucuaauguac

SEQ ID NO: 2747805 - RNA, 15 nt, Human
cuagcccuccucucc

SEQ ID NO: 2747806 - RNA, 17 nt, Human
cuagccgaccucagccu

SEQ ID NO: 2747807 - RNA, 15 nt, Human
cuagccugccucccc

SEQ ID NO: 2747808 - RNA, 16 nt, Human
cuagccuggaaccaag

SEQ ID NO: 2747809 - RNA, 17 nt, Human
cuagcuggcucugugag

SEQ ID NO: 2747810 - RNA, 13 nt, Human
cuaggaauugugu

SEQ ID NO: 2747811 - RNA, 14 nt, Human
cuaggaauuguguu

SEQ ID NO: 2747812 - RNA, 14 nt, Human
cuaggacugaauua

SEQ ID NO: 2747813 - RNA, 22 nt, Human
cuaggauuguagucccaaagag

SEQ ID NO: 2747814 - RNA, 13 nt, Human
cuaggcauagccc

SEQ ID NO: 2747815 - RNA, 12 nt, Human
cuaggccgggcg

SEQ ID NO: 2747816 - RNA, 20 nt, Human
cuaggggggucagccagccc

SEQ ID NO: 2747817 - RNA, 15 nt, Human
cuaggguccaccagg

SEQ ID NO: 2747818 - RNA, 15 nt, Human
cuaggugcugcagcc

SEQ ID NO: 2747819 - RNA, 15 nt, Human
cuaguaauuggaaag

SEQ ID NO: 2747820 - RNA, 23 nt, Human
cuaguaauuggaaaggcagcucu

SEQ ID NO: 2747821 - RNA, 14 nt, Human
cuaguccccagccu

SEQ ID NO: 2747822 - RNA, 22 nt, Human
cuaguccccagccugcucccua

SEQ ID NO: 2747823 - RNA, 16 nt, Human
cuagucucuacccagu

SEQ ID NO: 2747824 - RNA, 18 nt, Human
cuagucucuacccaguag

SEQ ID NO: 2747825 - RNA, 19 nt, Human
cuagucuguuuucccuccu

SEQ ID NO: 2747826 - RNA, 21 nt, Human
cuagucuguuuucccuccuug

SEQ ID NO: 2747827 - RNA, 16 nt, Human
cuaguguucugauauu

SEQ ID NO: 2747828 - RNA, 18 nt, Human
cuaguugaucagcuuauu

SEQ ID NO: 2747829 - RNA, 19 nt, Human
cuauaaaaugaauacaauu

SEQ ID NO: 2747830 - RNA, 18 nt, Human
cuauaaaccgaacugaug

SEQ ID NO: 2747831 - RNA, 14 nt, Human
cuauaauauaagcu

SEQ ID NO: 2747832 - RNA, 14 nt, Human
cuauagauucuuua

SEQ ID NO: 2747833 - RNA, 20 nt, Human
cuauagcuuuucccuuuuuu

SEQ ID NO: 2747834 - RNA, 18 nt, Human
cuauaggugcuacaaaaa

SEQ ID NO: 2747835 - RNA, 21 nt, Human
cuauaguccagcuuuguucuu

SEQ ID NO: 2747836 - RNA, 17 nt, Human
cuauauccugugacugu

SEQ ID NO: 2747837 - RNA, 13 nt, Human
cuauauuaucaug

SEQ ID NO: 2747838 - RNA, 15 nt, Human
cuauauuaucaugca

SEQ ID NO: 2747839 - RNA, 17 nt, Human
cuauauuuuacauaaau

SEQ ID NO: 2747840 - RNA, 22 nt, Human
cuauauuuuuuguuaaaugauu

SEQ ID NO: 2747841 - RNA, 14 nt, Human
cuaucaauccaaga

SEQ ID NO: 2747842 - RNA, 22 nt, Human
cuaucaauccaagaacuuauuu

SEQ ID NO: 2747843 - RNA, 17 nt, Human
cuaucagcauuuuacua

SEQ ID NO: 2747844 - RNA, 18 nt, Human
cuaucccaaccucuccca

SEQ ID NO: 2747845 - RNA, 14 nt, Human
cuaucgcaccacug

SEQ ID NO: 2747846 - RNA, 20 nt, Human
cuaucgcaccacuguguauu

SEQ ID NO: 2747847 - RNA, 23 nt, Human
cuaucgcaccacuguguauuuaa

SEQ ID NO: 2747848 - RNA, 14 nt, Human
cuaucgccaucaca

SEQ ID NO: 2747849 - RNA, 18 nt, Human
cuaucuaauuuuuauuaa

SEQ ID NO: 2747850 - RNA, 11 nt, Human
cuaucucucca

SEQ ID NO: 2747851 - RNA, 19 nt, Human
cuaucucuccaaccagauu

SEQ ID NO: 2747852 - RNA, 12 nt, Human
cuaucuuugagc

SEQ ID NO: 2747853 - RNA, 18 nt, Human
cuaucuuugagcgcccac

SEQ ID NO: 2747854 - RNA, 20 nt, Human
cuaugaaguuuuuuuuauac

SEQ ID NO: 2747855 - RNA, 17 nt, Human
cuaugcagagguccaca

SEQ ID NO: 2747856 - RNA, 13 nt, Human
cuauggaaaaaaa

SEQ ID NO: 2747857 - RNA, 21 nt, Human
cuauguagaauauauuuccuu

SEQ ID NO: 2747858 - RNA, 17 nt, Human
cuaugucauuucauuuc

SEQ ID NO: 2747859 - RNA, 20 nt, Human
cuaugucauuucauuuccua

SEQ ID NO: 2747860 - RNA, 17 nt, Human
cuaugucauuugcugga

SEQ ID NO: 2747861 - RNA, 18 nt, Human
cuauguuuugacauuuuu

SEQ ID NO: 2747862 - RNA, 20 nt, Human
cuauguuuugacauuuuuag

SEQ ID NO: 2747863 - RNA, 21 nt, Human
cuauguuuugacauuuuuagu

SEQ ID NO: 2747864 - RNA, 18 nt, Human
cuauuacgugcaauacuu

SEQ ID NO: 2747865 - RNA, 12 nt, Human
cuauuauagaau

SEQ ID NO: 2747866 - RNA, 13 nt, Human
cuauuauauuucc

SEQ ID NO: 2747867 - RNA, 21 nt, Human
cuauucacaaccacucauuca

SEQ ID NO: 2747868 - RNA, 17 nt, Human
cuauuccuccuucccuu

SEQ ID NO: 2747869 - RNA, 18 nt, Human
cuauuccuccuucccuug

SEQ ID NO: 2747870 - RNA, 13 nt, Human
cuauucuagccug

SEQ ID NO: 2747871 - RNA, 23 nt, Human
cuauucuagucuauuuguugaug

SEQ ID NO: 2747872 - RNA, 16 nt, Human
cuauucuugauguaaa

SEQ ID NO: 2747873 - RNA, 19 nt, Human
cuauugccucugagagcau

SEQ ID NO: 2747874 - RNA, 20 nt, Human
cgcuguacgcgagcgcgcgc

SEQ ID NO: 2747875 - RNA, 15 nt, Human
cgcugucucugaggg

SEQ ID NO: 2747876 - RNA, 16 nt, Human
cgcugucucugagggg

SEQ ID NO: 2747877 - RNA, 13 nt, Human
cgcuguuccucgc

SEQ ID NO: 2747878 - RNA, 16 nt, Human
cgcuguuccucgccac

SEQ ID NO: 2747879 - RNA, 13 nt, Human
cgcuuccgcaucc

SEQ ID NO: 2747880 - RNA, 16 nt, Human
cgcuuccgcauccuag

SEQ ID NO: 2747881 - RNA, 22 nt, Human
cgcuuccgcauccuagucucua

SEQ ID NO: 2747882 - RNA, 23 nt, Human
cgcuuccgcauccuagucucuau

SEQ ID NO: 2747883 - RNA, 18 nt, Human
cggaauugcucucccagc

SEQ ID NO: 2747884 - RNA, 16 nt, Human
cggacgcugcugccgu

SEQ ID NO: 2747885 - RNA, 14 nt, Human
cggacggcuccgga

SEQ ID NO: 2747886 - RNA, 23 nt, Human
cggagauaucccaggaaaauuaa

SEQ ID NO: 2747887 - RNA, 19 nt, Human
cggagccccuugggcaggu

SEQ ID NO: 2747888 - RNA, 17 nt, Human
cggagcccugucuccuc

SEQ ID NO: 2747889 - RNA, 21 nt, Human
cggagccucauccgaggcagg

SEQ ID NO: 2747890 - RNA, 14 nt, Human
cgaaccuugaaaac

SEQ ID NO: 2747891 - RNA, 10 nt, Human
cgaacuccug

SEQ ID NO: 2747892 - RNA, 15 nt, Human
cgaagcaccaucauu

SEQ ID NO: 2747893 - RNA, 23 nt, Human
cgaaggaaaagggcuuucucaau

SEQ ID NO: 2747894 - RNA, 16 nt, Human
cgaaggggaggcacac

SEQ ID NO: 2747895 - RNA, 20 nt, Human
cgaaguauccuucagccuga

SEQ ID NO: 2747896 - RNA, 21 nt, Human
cgaaguauccuucagccugaa

SEQ ID NO: 2747897 - RNA, 14 nt, Human
cgaauggaagaggc

SEQ ID NO: 2747898 - RNA, 18 nt, Human
cgaccucagccuuccccu

SEQ ID NO: 2747899 - RNA, 13 nt, Human
cgagaaaacaaua

SEQ ID NO: 2747900 - RNA, 14 nt, Human
cgagaaaacaauaa

SEQ ID NO: 2747901 - RNA, 17 nt, Human
cgagaaaacaauaacga

SEQ ID NO: 2747902 - RNA, 18 nt, Human
cgagaaaacaauaacgau

SEQ ID NO: 2747903 - RNA, 19 nt, Human
cgagaaaacaauaacgaua

SEQ ID NO: 2747904 - RNA, 21 nt, Human
cgagaaaacaauaacgauaaa

SEQ ID NO: 2747905 - RNA, 15 nt, Human
cgagacccugucuca

SEQ ID NO: 2747906 - RNA, 22 nt, Human
cgagacccugucucaauaaaua

SEQ ID NO: 2747907 - RNA, 13 nt, Human
cgagauacagaau

SEQ ID NO: 2747908 - RNA, 21 nt, Human
cgagauugugccccugcacuc

SEQ ID NO: 2747909 - RNA, 21 nt, Human
cgagccccaggcggguccggg

SEQ ID NO: 2747910 - RNA, 22 nt, Human
cgagccccaggcggguccgggu

SEQ ID NO: 2747911 - RNA, 23 nt, Human
cgagccccaggcggguccggguc

SEQ ID NO: 2747912 - RNA, 15 nt, Human
cgagcgcgcgcgccc

SEQ ID NO: 2747913 - RNA, 14 nt, Human
cgagcguugcuggg

SEQ ID NO: 2747914 - RNA, 17 nt, Human
cgaggagguaaugaauu

SEQ ID NO: 2747915 - RNA, 20 nt, Human
cgaggagguaaugaauuaaa

SEQ ID NO: 2747916 - RNA, 15 nt, Human
cgaggauugggaaaa

SEQ ID NO: 2747917 - RNA, 13 nt, Human
cgaggcaggguca

SEQ ID NO: 2747918 - RNA, 21 nt, Human
cgaggccccugucucagggug

SEQ ID NO: 2747919 - RNA, 22 nt, Human
cgaggcccgcaugcggcccagg

SEQ ID NO: 2747920 - RNA, 22 nt, Human
cgaggugggcagaucacuugag

SEQ ID NO: 2747921 - RNA, 13 nt, Human
cgaguacuucccg

SEQ ID NO: 2747922 - RNA, 12 nt, Human
cgauaaaagaca

SEQ ID NO: 2747923 - RNA, 17 nt, Human
cgauaaaagacagugaa

SEQ ID NO: 2747924 - RNA, 21 nt, Human
cgauaaaagacagugaaagaa

SEQ ID NO: 2747925 - RNA, 21 nt, Human
cgauaaauaacuuuuuuuuaa

SEQ ID NO: 2747926 - RNA, 14 nt, Human
cgaucucagcucac

SEQ ID NO: 2747927 - RNA, 15 nt, Human
cgaucucagcucacu

SEQ ID NO: 2747928 - RNA, 15 nt, Human
cgaucucggcucacu

SEQ ID NO: 2747929 - RNA, 18 nt, Human
cgaugguacauauuucuu

SEQ ID NO: 2747930 - RNA, 21 nt, Human
cgauuauuauuuuagagcauc

SEQ ID NO: 2747931 - RNA, 23 nt, Human
cgauuauuauuuuagagcaucuc

SEQ ID NO: 2747932 - RNA, 14 nt, Human
cgauucuccugccu

SEQ ID NO: 2747933 - RNA, 15 nt, Human
cgauucuccugccuc

SEQ ID NO: 2747934 - RNA, 18 nt, Human
cgauucuccugccucagc

SEQ ID NO: 2747935 - RNA, 19 nt, Human
cgauuuagaaagaagccca

SEQ ID NO: 2747936 - RNA, 13 nt, Human
cgcaaauucgcaa

SEQ ID NO: 2747937 - RNA, 22 nt, Human
cgcaaugugacuuaaugccacu

SEQ ID NO: 2747938 - RNA, 18 nt, Human
cgcacagggagugcacau

SEQ ID NO: 2747939 - RNA, 22 nt, Human
cgcaccuguaaucccagcuacu

SEQ ID NO: 2747940 - RNA, 15 nt, Human
cgcagccaugugauu

SEQ ID NO: 2747941 - RNA, 14 nt, Human
cgcaggaacucaau

SEQ ID NO: 2747942 - RNA, 20 nt, Human
cgcaggaccaucccggccgg

SEQ ID NO: 2747943 - RNA, 20 nt, Human
cgcaggcacagcagcugcag

SEQ ID NO: 2747944 - RNA, 17 nt, Human
cgcaucagacagaugga

SEQ ID NO: 2747945 - RNA, 15 nt, Human
cgcauccuagucucu

SEQ ID NO: 2747946 - RNA, 17 nt, Human
cgcauccuagucucuau

SEQ ID NO: 2747947 - RNA, 17 nt, Human
cgcaugaauuugugaag

SEQ ID NO: 2747948 - RNA, 15 nt, Human
cgcaugcggcccagg

SEQ ID NO: 2747949 - RNA, 20 nt, Human
cgcaugcggcccaggauggc

SEQ ID NO: 2747950 - RNA, 17 nt, Human
cgccaccacgcccagcu

SEQ ID NO: 2747951 - RNA, 14 nt, Human
cgccacccucccac

SEQ ID NO: 2747952 - RNA, 21 nt, Human
cgccacgcucugggucgccgg

SEQ ID NO: 2747953 - RNA, 16 nt, Human
cgcccacuagacccac

SEQ ID NO: 2747954 - RNA, 19 nt, Human
cgcccacuagacccacugg

SEQ ID NO: 2747955 - RNA, 20 nt, Human
cgcccacuagacccacugga

SEQ ID NO: 2747956 - RNA, 15 nt, Human
cgcccacuuccuccc

SEQ ID NO: 2747957 - RNA, 18 nt, Human
cgcccacuuccucccggc

SEQ ID NO: 2747958 - RNA, 21 nt, Human
cgcccacuuccucccggccgc

SEQ ID NO: 2747959 - RNA, 22 nt, Human
cgcccacuuccucccggccgcg

SEQ ID NO: 2747960 - RNA, 14 nt, Human
cgcccaucuccguc

SEQ ID NO: 2747961 - RNA, 17 nt, Human
cgccucgaccucucuca

SEQ ID NO: 2747962 - RNA, 16 nt, Human
cgccuguaaucccagc

SEQ ID NO: 2747963 - RNA, 17 nt, Human
cgcgagcgcgcgcgccc

SEQ ID NO: 2747964 - RNA, 18 nt, Human
cgcgagcgcgcgcgcccu

SEQ ID NO: 2747965 - RNA, 14 nt, Human
cgcgcagcucaggc

SEQ ID NO: 2747966 - RNA, 22 nt, Human
cgcgcagcucaggcuggcaccg

SEQ ID NO: 2747967 - RNA, 12 nt, Human
cgcgcccagccu

SEQ ID NO: 2747968 - RNA, 13 nt, Human
cgcgcccucuggc

SEQ ID NO: 2747969 - RNA, 14 nt, Human
cgcgcccucuggcu

SEQ ID NO: 2747970 - RNA, 18 nt, Human
cgcgcccucuggcugcug

SEQ ID NO: 2747971 - RNA, 23 nt, Human
cgcgcccucuggcugcugguggc

SEQ ID NO: 2747972 - RNA, 15 nt, Human
cgcgccgcgcuccuc

SEQ ID NO: 2747973 - RNA, 18 nt, Human
cgcgccgcgcuccucgga

SEQ ID NO: 2747974 - RNA, 19 nt, Human
cgcgccgcgcuccucggac

SEQ ID NO: 2747975 - RNA, 12 nt, Human
cgcgccuccgcu

SEQ ID NO: 2747976 - RNA, 17 nt, Human
cgcgccuccgcuacuuc

SEQ ID NO: 2747977 - RNA, 13 nt, Human
cgcgcgccaccac

SEQ ID NO: 2747978 - RNA, 14 nt, Human
cgcgcgccaccacg

SEQ ID NO: 2747979 - RNA, 17 nt, Human
cgcgcgccuccgcuacu

SEQ ID NO: 2747980 - RNA, 22 nt, Human
cgcgcgccuccgcuacuuccag

SEQ ID NO: 2747981 - RNA, 15 nt, Human
cgcgcgcuccgcgca

SEQ ID NO: 2747982 - RNA, 15 nt, Human
cgcgcuccgcgcagc

SEQ ID NO: 2747983 - RNA, 22 nt, Human
cgcgcuccgcgcagcucaggcu

SEQ ID NO: 2747984 - RNA, 16 nt, Human
cgcgcuccucggacgg

SEQ ID NO: 2747985 - RNA, 13 nt, Human
cgcgcugcgcgcc

SEQ ID NO: 2747986 - RNA, 14 nt, Human
cgcgcugcgcgccg

SEQ ID NO: 2747987 - RNA, 17 nt, Human
cgcgcugcgcgccgcgc

SEQ ID NO: 2747988 - RNA, 19 nt, Human
cgcggcgggagggcgcggg

SEQ ID NO: 2747989 - RNA, 23 nt, Human
cgcggggcggggagcgagcccca

SEQ ID NO: 2747990 - RNA, 20 nt, Human
cgcuccaccuugcagcucuc

SEQ ID NO: 2747991 - RNA, 14 nt, Human
cgcuccgcgcagcu

SEQ ID NO: 2747992 - RNA, 21 nt, Human
cgcuccucuauggccccugcc

SEQ ID NO: 2747993 - RNA, 13 nt, Human
cgcucgcuuccgc

SEQ ID NO: 2747994 - RNA, 15 nt, Human
cgcucgcuuccgcau

SEQ ID NO: 2747995 - RNA, 16 nt, Human
cgcucgcuuccgcauc

SEQ ID NO: 2747996 - RNA, 17 nt, Human
cgcucgcuuccgcaucc

SEQ ID NO: 2747997 - RNA, 15 nt, Human
cgcucggccugcucg

SEQ ID NO: 2747998 - RNA, 18 nt, Human
cgcucggccugcucgccc

SEQ ID NO: 2747999 - RNA, 19 nt, Human
cgcucggccugcucgccca

SEQ ID NO: 2748000 - RNA, 11 nt, Human
cgcucucuggc

SEQ ID NO: 2748001 - RNA, 13 nt, Human
cgcucucuggccu

SEQ ID NO: 2748002 - RNA, 14 nt, Human
cgcucucuggccuu

SEQ ID NO: 2748003 - RNA, 15 nt, Human
cgcucucuggccuuc

SEQ ID NO: 2748004 - RNA, 19 nt, Human
cgcucucuggccuucggcc

SEQ ID NO: 2748005 - RNA, 14 nt, Human
cgcucugggucgcc

SEQ ID NO: 2748006 - RNA, 17 nt, Human
cgcucugggucgccggc

SEQ ID NO: 2748007 - RNA, 18 nt, Human
cgcucugggucgccggca

SEQ ID NO: 2748008 - RNA, 19 nt, Human
cgcucugggucgccggcau

SEQ ID NO: 2748009 - RNA, 12 nt, Human
cgcugcgcgccg

SEQ ID NO: 2748010 - RNA, 13 nt, Human
cgcugcgcgccgc

SEQ ID NO: 2748011 - RNA, 13 nt, Human
cgcuggcugcgcu

SEQ ID NO: 2748012 - RNA, 16 nt, Human
cgcuggcugcgcucgg

SEQ ID NO: 2748013 - RNA, 19 nt, Human
cgcuggcugcgcucggccu

SEQ ID NO: 2748014 - RNA, 21 nt, Human
cgcuggcugcgcucggccugc

SEQ ID NO: 2748015 - RNA, 18 nt, Human
cgcuguacgcgagcgcgc

SEQ ID NO: 2748016 - RNA, 20 nt, Human
ccuauacucacuuucccaaa

SEQ ID NO: 2748017 - RNA, 21 nt, Human
ccuauauacucacuuucuaga

SEQ ID NO: 2748018 - RNA, 16 nt, Human
ccuaugcagaggucca

SEQ ID NO: 2748019 - RNA, 17 nt, Human
ccuauuccuccuucccu

SEQ ID NO: 2748020 - RNA, 19 nt, Human
ccucaaaacuucagacaua

SEQ ID NO: 2748021 - RNA, 17 nt, Human
ccucaaaugcaccaugu

SEQ ID NO: 2748022 - RNA, 19 nt, Human
ccucaacguugcuccccau

SEQ ID NO: 2748023 - RNA, 11 nt, Human
ccucaagccag

SEQ ID NO: 2748024 - RNA, 15 nt, Human
ccucaagccagccuu

SEQ ID NO: 2748025 - RNA, 18 nt, Human
ccucaagcuaugugagcu

SEQ ID NO: 2748026 - RNA, 24 nt, Human
ccucaagcuaugugagcucaccag

SEQ ID NO: 2748027 - RNA, 16 nt, Human
ccucaagcugcaucua

SEQ ID NO: 2748028 - RNA, 17 nt, Human
ccucaagcugcaucuag

SEQ ID NO: 2748029 - RNA, 12 nt, Human
ccucaccagccc

SEQ ID NO: 2748030 - RNA, 14 nt, Human
ccucaccagcccug

SEQ ID NO: 2748031 - RNA, 17 nt, Human
ccucaccagcccuggca

SEQ ID NO: 2748032 - RNA, 21 nt, Human
ccucaccaguuuccagguggu

SEQ ID NO: 2748033 - RNA, 13 nt, Human
ccucaccccuugc

SEQ ID NO: 2748034 - RNA, 16 nt, Human
ccucaccccuugccau

SEQ ID NO: 2748035 - RNA, 16 nt, Human
ccucagaaaacaagga

SEQ ID NO: 2748036 - RNA, 22 nt, Human
ccucagaaaacaaggaugaauu

SEQ ID NO: 2748037 - RNA, 20 nt, Human
ccucagaugcacaugagcug

SEQ ID NO: 2748038 - RNA, 13 nt, Human
ccucagccuccca

SEQ ID NO: 2748039 - RNA, 22 nt, Human
ccucagccucccaaagugcugg

SEQ ID NO: 2748040 - RNA, 14 nt, Human
ccucagccuucccc

SEQ ID NO: 2748041 - RNA, 15 nt, Human
ccucagccuuccccu

SEQ ID NO: 2748042 - RNA, 19 nt, Human
ccucagcugccuccccagc

SEQ ID NO: 2748043 - RNA, 23 nt, Human
ccucagcugccuccccagcucua

SEQ ID NO: 2748044 - RNA, 14 nt, Human
ccucagucucccuc

SEQ ID NO: 2748045 - RNA, 16 nt, Human
ccucagucucccuccc

SEQ ID NO: 2748046 - RNA, 17 nt, Human
ccucagucucccucccu

SEQ ID NO: 2748047 - RNA, 21 nt, Human
ccucagucucccucccuuggg

SEQ ID NO: 2748048 - RNA, 22 nt, Human
ccucagucucccucccuugggg

SEQ ID NO: 2748049 - RNA, 15 nt, Human
ccucaguucccucuu

SEQ ID NO: 2748050 - RNA, 17 nt, Human
ccucaguuuuaucauuu

SEQ ID NO: 2748051 - RNA, 19 nt, Human
ccucaguuuuaucauuuuc

SEQ ID NO: 2748052 - RNA, 21 nt, Human
ccucaguuuuugugaaaagcu

SEQ ID NO: 2748053 - RNA, 14 nt, Human
ccucauccgaggca

SEQ ID NO: 2748054 - RNA, 22 nt, Human
ccucauccgaggcagggucagg

SEQ ID NO: 2748055 - RNA, 19 nt, Human
ccucauggaauuggagcuc

SEQ ID NO: 2748056 - RNA, 20 nt, Human
ccucauggaauuggagcucg

SEQ ID NO: 2748057 - RNA, 22 nt, Human
ccucauggaauuggagcucgug

SEQ ID NO: 2748058 - RNA, 21 nt, Human
ccuccacauuucccccuagcc

SEQ ID NO: 2748059 - RNA, 18 nt, Human
ccuccaccucccugcaau

SEQ ID NO: 2748060 - RNA, 18 nt, Human
ccuccagagaguaucuga

SEQ ID NO: 2748061 - RNA, 12 nt, Human
ccuccagcugcc

SEQ ID NO: 2748062 - RNA, 16 nt, Human
ccuccagcugccccgg

SEQ ID NO: 2748063 - RNA, 21 nt, Human
ccuccagcugccccggggagg

SEQ ID NO: 2748064 - RNA, 22 nt, Human
ccuccauaucucccucuucccu

SEQ ID NO: 2748065 - RNA, 14 nt, Human
ccuccauccugagg

SEQ ID NO: 2748066 - RNA, 19 nt, Human
ccuccauccugaggcucca

SEQ ID NO: 2748067 - RNA, 19 nt, Human
ccucccaagcaccugggau

SEQ ID NO: 2748068 - RNA, 13 nt, Human
ccucccccaucuc

SEQ ID NO: 2748069 - RNA, 20 nt, Human
ccucccccuccucuccacca

SEQ ID NO: 2748070 - RNA, 15 nt, Human
ccuccccuccucugc

SEQ ID NO: 2748071 - RNA, 22 nt, Human
ccucccggccgcgcugcgcgcc

SEQ ID NO: 2748072 - RNA, 17 nt, Human
ccucccgucaccccugu

SEQ ID NO: 2748073 - RNA, 18 nt, Human
ccucccuccaccucccug

SEQ ID NO: 2748074 - RNA, 12 nt, Human
ccucccuccaga

SEQ ID NO: 2748075 - RNA, 22 nt, Human
ccucccuuggggccuaugcaga

SEQ ID NO: 2748076 - RNA, 11 nt, Human
ccuccgccucc

SEQ ID NO: 2748077 - RNA, 13 nt, Human
ccuccgccuccca

SEQ ID NO: 2748078 - RNA, 15 nt, Human
ccuccucuccaccau

SEQ ID NO: 2748079 - RNA, 12 nt, Human
ccuccucuccca

SEQ ID NO: 2748080 - RNA, 14 nt, Human
ccuccucucccagu

SEQ ID NO: 2748081 - RNA, 13 nt, Human
ccuccucugucca

SEQ ID NO: 2748082 - RNA, 17 nt, Human
ccuccuguccagccugc

SEQ ID NO: 2748083 - RNA, 16 nt, Human
ccuccuuuuaaaguaa

SEQ ID NO: 2748084 - RNA, 14 nt, Human
ccuccuuuuuccuu

SEQ ID NO: 2748085 - RNA, 18 nt, Human
ccuccuuuuuccuuccag

SEQ ID NO: 2748086 - RNA, 12 nt, Human
ccucggcuuccu

SEQ ID NO: 2748087 - RNA, 22 nt, Human
ccucuaauuuaucuugucucug

SEQ ID NO: 2748088 - RNA, 16 nt, Human
ccucuaugguguggca

SEQ ID NO: 2748089 - RNA, 21 nt, Human
ccucuccaccaucgucuucuu

SEQ ID NO: 2748090 - RNA, 22 nt, Human
ccucuccaccaucgucuucuug

SEQ ID NO: 2748091 - RNA, 11 nt, Human
ccucuccagau

SEQ ID NO: 2748092 - RNA, 17 nt, Human
ccucuccagaugcagcc

SEQ ID NO: 2748093 - RNA, 17 nt, Human
ccucuccaggagaccua

SEQ ID NO: 2748094 - RNA, 14 nt, Human
ccucuccucucuuc

SEQ ID NO: 2748095 - RNA, 13 nt, Human
ccucuccugggca

SEQ ID NO: 2748096 - RNA, 22 nt, Human
ccucuccugggcagcugccucc

SEQ ID NO: 2748097 - RNA, 20 nt, Human
ccucucguaagauuuccuuc

SEQ ID NO: 2748098 - RNA, 22 nt, Human
ccucucugcaggcagccugccu

SEQ ID NO: 2748099 - RNA, 23 nt, Human
ccucucugcaggcagccugccuu

SEQ ID NO: 2748100 - RNA, 15 nt, Human
ccucucuuccucccu

SEQ ID NO: 2748101 - RNA, 19 nt, Human
ccucucuuccucccuggaa

SEQ ID NO: 2748102 - RNA, 20 nt, Human
ccucugagaagcucugaaga

SEQ ID NO: 2748103 - RNA, 17 nt, Human
ccucugcacacccucca

SEQ ID NO: 2748104 - RNA, 14 nt, Human
ccucugcagcuucc

SEQ ID NO: 2748105 - RNA, 23 nt, Human
ccucugcagcuuccaggcuggcg

SEQ ID NO: 2748106 - RNA, 12 nt, Human
ccucugcccuuc

SEQ ID NO: 2748107 - RNA, 15 nt, Human
ccucugcccuuccug

SEQ ID NO: 2748108 - RNA, 14 nt, Human
ccucugccucccag

SEQ ID NO: 2748109 - RNA, 17 nt, Human
ccucugccucccagguu

SEQ ID NO: 2748110 - RNA, 13 nt, Human
ccucugcuugcca

SEQ ID NO: 2748111 - RNA, 13 nt, Human
ccucuggcuccag

SEQ ID NO: 2748112 - RNA, 22 nt, Human
ccucuggggagcucaggaaggg

SEQ ID NO: 2748113 - RNA, 19 nt, Human
ccucugguaaccucuuacu

SEQ ID NO: 2748114 - RNA, 20 nt, Human
ccucuguauacaaaacccuu

SEQ ID NO: 2748115 - RNA, 23 nt, Human
ccucuguauuugaaucagccuac

SEQ ID NO: 2748116 - RNA, 21 nt, Human
ccucuguccagggcccugagc

SEQ ID NO: 2748117 - RNA, 22 nt, Human
ccucuguccagggcccugagcu

SEQ ID NO: 2748118 - RNA, 23 nt, Human
ccucuguccagggcccugagcuc

SEQ ID NO: 2748119 - RNA, 15 nt, Human
ccucugucuccuaag

SEQ ID NO: 2748120 - RNA, 17 nt, Human
ccucugucuccuaagcu

SEQ ID NO: 2748121 - RNA, 21 nt, Human
ccucuguucugcacacagcac

SEQ ID NO: 2748122 - RNA, 15 nt, Human
ccucuuagaugcagu

SEQ ID NO: 2748123 - RNA, 20 nt, Human
ccucuucccuaggagaggag

SEQ ID NO: 2748124 - RNA, 14 nt, Human
ccucuucugacacu

SEQ ID NO: 2748125 - RNA, 12 nt, Human
ccucuuucaaag

SEQ ID NO: 2748126 - RNA, 18 nt, Human
ccugaaagaggaaugaag

SEQ ID NO: 2748127 - RNA, 20 nt, Human
ccaucugguccuaagucccu

SEQ ID NO: 2748128 - RNA, 20 nt, Human
ccaugaagauguagaggaga

SEQ ID NO: 2748129 - RNA, 12 nt, Human
ccaugaaucacc

SEQ ID NO: 2748130 - RNA, 14 nt, Human
ccaugaccaacauc

SEQ ID NO: 2748131 - RNA, 17 nt, Human
ccaugaugcugagcccg

SEQ ID NO: 2748132 - RNA, 20 nt, Human
ccaugauguuuagaaacaca

SEQ ID NO: 2748133 - RNA, 12 nt, Human
ccaugcugcugg

SEQ ID NO: 2748134 - RNA, 16 nt, Human
ccaugcuggccaggcu

SEQ ID NO: 2748135 - RNA, 22 nt, Human
ccauggaaacgaagcaccauca

SEQ ID NO: 2748136 - RNA, 15 nt, Human
ccauggagguuaagc

SEQ ID NO: 2748137 - RNA, 15 nt, Human
ccaugggacagggag

SEQ ID NO: 2748138 - RNA, 17 nt, Human
ccaugggacagggagga

SEQ ID NO: 2748139 - RNA, 18 nt, Human
ccauguacauagcuugau

SEQ ID NO: 2748140 - RNA, 13 nt, Human
ccaugucaagggu

SEQ ID NO: 2748141 - RNA, 19 nt, Human
ccaugugauuccaucuugc

SEQ ID NO: 2748142 - RNA, 16 nt, Human
ccaugugcagccacca

SEQ ID NO: 2748143 - RNA, 13 nt, Human
ccauguuggccag

SEQ ID NO: 2748144 - RNA, 15 nt, Human
ccauguuggccaggc

SEQ ID NO: 2748145 - RNA, 19 nt, Human
ccauguuggcuagccucug

SEQ ID NO: 2748146 - RNA, 15 nt, Human
ccauuaaauauaaag

SEQ ID NO: 2748147 - RNA, 19 nt, Human
ccauuacggagaguuuccu

SEQ ID NO: 2748148 - RNA, 13 nt, Human
ccauuagaccaag

SEQ ID NO: 2748149 - RNA, 19 nt, Human
ccauuauggauaaagauga

SEQ ID NO: 2748150 - RNA, 20 nt, Human
ccauucaaagugagcuccua

SEQ ID NO: 2748151 - RNA, 12 nt, Human
ccauucaggaug

SEQ ID NO: 2748152 - RNA, 17 nt, Human
ccauucaggaugcccac

SEQ ID NO: 2748153 - RNA, 14 nt, Human
ccauucuucccuug

SEQ ID NO: 2748154 - RNA, 15 nt, Human
ccauugucucagagc

SEQ ID NO: 2748155 - RNA, 16 nt, Human
ccauuuagguuucuga

SEQ ID NO: 2748156 - RNA, 16 nt, Human
ccauuuuuagugaaau

SEQ ID NO: 2748157 - RNA, 20 nt, Human
cccaaaggcuuugcccugcu

SEQ ID NO: 2748158 - RNA, 17 nt, Human
cccaaaguccugggauu

SEQ ID NO: 2748159 - RNA, 12 nt, Human
cccaaauguuca

SEQ ID NO: 2748160 - RNA, 16 nt, Human
cccaaauguucaucaa

SEQ ID NO: 2748161 - RNA, 14 nt, Human
cccaacaccccaca

SEQ ID NO: 2748162 - RNA, 13 nt, Human
cccaacagcaccc

SEQ ID NO: 2748163 - RNA, 15 nt, Human
cccaacagcacccuc

SEQ ID NO: 2748164 - RNA, 17 nt, Human
cccaacagcacccucuc

SEQ ID NO: 2748165 - RNA, 16 nt, Human
cccaaccacaucccac

SEQ ID NO: 2748166 - RNA, 15 nt, Human
cccaaccucucccaa

SEQ ID NO: 2748167 - RNA, 16 nt, Human
cccaaccucucccaac

SEQ ID NO: 2748168 - RNA, 17 nt, Human
cccaagcaccugggauu

SEQ ID NO: 2748169 - RNA, 18 nt, Human
cccaagccuggcaaggga

SEQ ID NO: 2748170 - RNA, 22 nt, Human
cccaagggcaggggccacucuu

SEQ ID NO: 2748171 - RNA, 14 nt, Human
cccacacuguccau

SEQ ID NO: 2748172 - RNA, 23 nt, Human
cccacagaagugcuuucuucucc

SEQ ID NO: 2748173 - RNA, 23 nt, Human
cccacagcuguaugauucccagc

SEQ ID NO: 2748174 - RNA, 20 nt, Human
cccacaguggaaagacagcu

SEQ ID NO: 2748175 - RNA, 14 nt, Human
cccaccaccucacc

SEQ ID NO: 2748176 - RNA, 13 nt, Human
cccaccaggcugc

SEQ ID NO: 2748177 - RNA, 17 nt, Human
cccacggcuggagcugc

SEQ ID NO: 2748178 - RNA, 20 nt, Human
cccacuacaagugauccuca

SEQ ID NO: 2748179 - RNA, 15 nt, Human
cccacucugcaagaa

SEQ ID NO: 2748180 - RNA, 17 nt, Human
cccacuggacucaccuc

SEQ ID NO: 2748181 - RNA, 19 nt, Human
cccacuggacucaccuccc

SEQ ID NO: 2748182 - RNA, 21 nt, Human
cccacuggacucaccuccccc

SEQ ID NO: 2748183 - RNA, 14 nt, Human
cccacuggcucccu

SEQ ID NO: 2748184 - RNA, 19 nt, Human
cccacugggguguguggca

SEQ ID NO: 2748185 - RNA, 22 nt, Human
cccacuuaccuugcaucucaca

SEQ ID NO: 2748186 - RNA, 17 nt, Human
cccacuucagccuccca

SEQ ID NO: 2748187 - RNA, 22 nt, Human
cccacuuccucccggccgcgcu

SEQ ID NO: 2748188 - RNA, 19 nt, Human
cccacuugccauaaaacuu

SEQ ID NO: 2748189 - RNA, 20 nt, Human
cccagaaugaccuggccgca

SEQ ID NO: 2748190 - RNA, 14 nt, Human
cccagagaagccaa

SEQ ID NO: 2748191 - RNA, 11 nt, Human
cccagagacag

SEQ ID NO: 2748192 - RNA, 13 nt, Human
cccagauaccaug

SEQ ID NO: 2748193 - RNA, 22 nt, Human
cccagcacuuugggaggcugag

SEQ ID NO: 2748194 - RNA, 15 nt, Human
cccagccagcaguuc

SEQ ID NO: 2748195 - RNA, 17 nt, Human
cccagccagcaguucag

SEQ ID NO: 2748196 - RNA, 23 nt, Human
cccagcccuccuuaucaaaggac

SEQ ID NO: 2748197 - RNA, 13 nt, Human
cccagccugcucc

SEQ ID NO: 2748198 - RNA, 15 nt, Human
cccagccugcucccu

SEQ ID NO: 2748199 - RNA, 18 nt, Human
cccagcggcaucaggcuu

SEQ ID NO: 2748200 - RNA, 19 nt, Human
cccagcuagaauucacucc

SEQ ID NO: 2748201 - RNA, 20 nt, Human
cccagcuugaaaccuucacu

SEQ ID NO: 2748202 - RNA, 19 nt, Human
cccaggaguacaccccaac

SEQ ID NO: 2748203 - RNA, 13 nt, Human
cccaggcgggucc

SEQ ID NO: 2748204 - RNA, 22 nt, Human
cccaggcggguccgggucgcag

SEQ ID NO: 2748205 - RNA, 14 nt, Human
cccaggcugagccu

SEQ ID NO: 2748206 - RNA, 18 nt, Human
cccaggcugagccucagu

SEQ ID NO: 2748207 - RNA, 19 nt, Human
cccagguuggagugcagug

SEQ ID NO: 2748208 - RNA, 12 nt, Human
cccauccugccc

SEQ ID NO: 2748209 - RNA, 20 nt, Human
cccauccugccccugagccc

SEQ ID NO: 2748210 - RNA, 12 nt, Human
cccaucuaggga

SEQ ID NO: 2748211 - RNA, 15 nt, Human
cccaucucaggugug

SEQ ID NO: 2748212 - RNA, 17 nt, Human
cccaucucagguguguu

SEQ ID NO: 2748213 - RNA, 16 nt, Human
cccaugaccaacaucg

SEQ ID NO: 2748214 - RNA, 23 nt, Human
cccaugguuuuaaucuguauuuc

SEQ ID NO: 2748215 - RNA, 13 nt, Human
cccauucaacauc

SEQ ID NO: 2748216 - RNA, 14 nt, Human
cccauucaggaugc

SEQ ID NO: 2748217 - RNA, 12 nt, Human
cccauuccccca

SEQ ID NO: 2748218 - RNA, 13 nt, Human
cccauucccccag

SEQ ID NO: 2748219 - RNA, 16 nt, Human
cccauucgcaauaagu

SEQ ID NO: 2748220 - RNA, 19 nt, Human
cccauuuagguuucugagu

SEQ ID NO: 2748221 - RNA, 15 nt, Human
ccccaaaaagaaugg

SEQ ID NO: 2748222 - RNA, 16 nt, Human
ccccaacagcacccuc

SEQ ID NO: 2748223 - RNA, 21 nt, Human
ccccaacagcacccucuccag

SEQ ID NO: 2748224 - RNA, 18 nt, Human
ccccaaccauuuccucag

SEQ ID NO: 2748225 - RNA, 16 nt, Human
ccccaagcccacuggg

SEQ ID NO: 2748226 - RNA, 13 nt, Human
ccccaagccuggc

SEQ ID NO: 2748227 - RNA, 14 nt, Human
ccccaagccuggca

SEQ ID NO: 2748228 - RNA, 21 nt, Human
ccccaaguuauccaccugccu

SEQ ID NO: 2748229 - RNA, 14 nt, Human
ccccacgccacagc

SEQ ID NO: 2748230 - RNA, 22 nt, Human
ccccacuacaagugauccucag

SEQ ID NO: 2748231 - RNA, 14 nt, Human
ccccagaaugaccu

SEQ ID NO: 2748232 - RNA, 15 nt, Human
ccccagaaugaccug

SEQ ID NO: 2748233 - RNA, 15 nt, Human
ccccagagccacagu

SEQ ID NO: 2748234 - RNA, 14 nt, Human
ccccagcccuccuu

SEQ ID NO: 2748235 - RNA, 11 nt, Human
ccccagccuca

SEQ ID NO: 2748236 - RNA, 16 nt, Human
ccccagccugcucccu

SEQ ID NO: 2748237 - RNA, 15 nt, Human
ccccaggacgcccuc

SEQ ID NO: 2748238 - RNA, 18 nt, Human
ccccaggacgcccucacu

SEQ ID NO: 2748239 - RNA, 16 nt, Human
ccccaucucuucuggg

SEQ ID NO: 2748240 - RNA, 11 nt, Human
cccccaacagc

SEQ ID NO: 2748241 - RNA, 18 nt, Human
cccccaacagcacccucu

SEQ ID NO: 2748242 - RNA, 15 nt, Human
cccccagagccacag

SEQ ID NO: 2748243 - RNA, 12 nt, Human
cccccagcccuc

SEQ ID NO: 2748244 - RNA, 11 nt, Human
cccccagccuc

SEQ ID NO: 2748245 - RNA, 20 nt, Human
cccccucaaacccauucccu

SEQ ID NO: 2748246 - RNA, 21 nt, Human
cccccucuccucucuuccucc

SEQ ID NO: 2748247 - RNA, 12 nt, Human
cccccucuggcu

SEQ ID NO: 2748248 - RNA, 19 nt, Human
cccccucuggcuccagcug

SEQ ID NO: 2748249 - RNA, 21 nt, Human
cccccucuggcuccagcuggc

SEQ ID NO: 2748250 - RNA, 22 nt, Human
cccccugcaaagcccagcuuga

SEQ ID NO: 2748251 - RNA, 20 nt, Human
ccccgggaguggcgcgcgcc

SEQ ID NO: 2748252 - RNA, 17 nt, Human
ccccgggccgacggagc

SEQ ID NO: 2748253 - RNA, 22 nt, Human
ccccuaaaagaaacccugcacc

SEQ ID NO: 2748254 - RNA, 15 nt, Human
ccccuaagcccccac

SEQ ID NO: 2748255 - RNA, 14 nt, Human
ccccuagccugccu

SEQ ID NO: 2748256 - RNA, 15 nt, Human
ccccuagccugccuc

SEQ ID NO: 2748257 - RNA, 19 nt, Human
ccccuagccugccuccccu

SEQ ID NO: 2748258 - RNA, 20 nt, Human
ccccuauccuacuuccccuu

SEQ ID NO: 2748259 - RNA, 12 nt, Human
ccccuccccugc

SEQ ID NO: 2748260 - RNA, 15 nt, Human
ccccuccccugcccu
